United States Patent 12,569,549 (FLAVIVIRUS VACCINE) - sequence listing, part 62

SEQ ID NO: 21648 - RNA, 9879 nt, synthetic construct
  misc_feature 1..9879: note = derived and/or modified CDS sequence (opt6) from DENV-1__FJ898383__SS-prME
  source 1..9879: mol_type = other RNA
tctgtaacaatgttactaatgttaatgccgactgcacttgcgttccaccttactacgcgaggaggagaacctcatatgatagtttccaaacaagaaaggggtaagagcttgctttttaaaacaagcgcaggagtaaatatgtgcacgttaattgctatggatttgggggaattgtgtgaagatacgatgacttacaaatgtccaagaattactgaaacagaaccagacgatgtcgactgttggtgtaacgccacggatacatgggtaacatatggaacatgcagtcaaacaggcgagcaccgacgagacaaaagatccgtcgctctggcccctcacgtcggactcggattagaaactaggacggaaacttggatgtcttcagagggagcttggaaacaaatacaaagagtagaaacgtgggccttaagacacccaggattcacagtaatagcactctttctagctcacgcaataggcacaagcattactcaaaaaggtattatctttattttactcatgctagttacaccgtcaatggcaatgagatgcgtaggtataggttcccgggactttgtcgaaggcttgtcaggggcaacatgggtagatgttgttctcgaacacggttcatgcgtaaccacaatggctaaagataaaccgactttggacattgaactacttaaaacggaagtaactaatccagctgtattaaggaaactctgtatagaggccaaaataagcaatacaacaactgacagccgctgtcccactcaaggtgaagctacgttagtcgaagaacaagacgcgaattttgtatgccgaagaacctttgtcgataggggctgggggaacggctgtggactcttcggcaaaggctcacttattacctgcgcaaaatttaaatgtgttactaaattagagggaaaaattgttcaatatgaaaacttgaaatatagcgtaattgtcacagtccacactggtgatcaacatcaagttggaaatgaatctacagaacacggaactactgcaacaataacacctcaagccccaacaactgaaatccaacttacagattatggggctttaacattggactgtagtccacgaacggggctagatttcaacgagatggtattgctaacaatgaaagaaaagagttggttagtacataaacagtggttcctagatctaccattaccctggacaagcggtgcaagtacctcgcaagagacatggaatagacaggacttgttggtaacctttaaaactgcacacgccaagaaacaagaagtagtggtacttggtagccaagaaggcgcaatgcacaccgcattgactggtgcgactgaaattcagacctccggtacgaccaccatctttgcagggcacttaaaatgtagactgaagatggacaaactaacactaaaaggaatgagttatgtaatgtgcacaggcagctttaaactagaaaaggaagtcgccgaaactcaacacggaacggttcttgtacaaataaaatatgagggcactgatgccccgtgcaaaatacctttttccacgcaggacgaaaaaggcgtcacgcaaaatggacgcctaataacagcaaacccaattgtcactgacaaagagaagcctataaatatagaagctgagccgcccttcggagaaagctacattgttataggtgcaggggaaaaagctctaaaacttagttggttcaagaaaggttccagtatcgggaaaatgttcgaggcaacagctcgaggagcgagacgaatggcgattctgggcgacacagcatgggattttggaagtatcggaggggtattcaccagcgttggcaaattagttcaccagatattcggtacagcgtatggggttcttttcagcggagttagctggacaatgaaaataggcataggtgtacttctaacctggttgggattaaactccagatctacatcattatcaatgacatgcattgccgtaggtcttgtaacactatatcttggggtcatggtacaagcagactcgggctgtgtaataaattggaaaggtagagaacttaagtgcgggtctggtatttttgtgacaaatgaagtacatacatggacagagcagtacaaatttcaggctgattctcccaaaagattaagcgcggcgatcggaaaggcatgggaagagggagtgtgtggcattcgtagtgcaaccaggctcgagaacatcatgtggaaacaaatatcaaacgaactaaatcatatcttactagaaaatgatatgaaatttacagttgtggtaggcgacgtagcagggattctagcccaaggaaagaaaatgattcgtccacaaccgatggaatacaaatattcttggaaaagctggggaaaagcaaaaataattggggccgacgtacaaaatactacctttattatagatggaccgaatacacccgaatgccctgatgatcaaagagcatggaacatatgggaggtagaagattatggattcggaatttttacaactaacatctggttaaaactccgagactcatatacacaggtgtgtgatcacagacttatgagtgcagctataaaagattccaaagctgtgcatgcggacatggggtactggatagagtcagagaaaaatgaaacttggaaattagcacgagcatcatttattgaagtcaaaacgtgtatatggcccaaaagtcacacactatggtcgaatggagtcctcgagagtgagatgatcattccaaaaatatacggtggacctatatcacagcacaattatcgcccgggttactttacacaggctgcaggaccttggcatctaggaaagttagagctagacttcgatttatgcgaaggcacaactgttgtggtagatgagcattgcggaaataggggacccagcttacgaaccacaactgttacaggtaagataatacatgagtggtgttgcagatcctgtacacttccgcccttaaggtttaggggcgaagatggatgttggtacggaatggaaatacgtcccgttaaagagaaagaagagaacctagtaaagtccatggtcagtgcgggttctggcgaagtagatagctttagcctaggcctactatgcatctctatcatgatagaagaagttatgagatcaagatggtcaaggcggatgttaatgacaggcacattagcagtcttctttctacttataatgggccaattaacttggaatgatctaataagactatgcattatggtaggcgcaaacgctagtgataggatgggcatgggcacgacatatttagcactgatggctacatttaaaatgcgacccatgtttgcagttggactcttattccggagactaacatcaagggaagttctacttttaaccataggtttaagcctagttgcgtctgtggaattaccaaactcccttgaagagttaggggatggattggcaatgggaattatgattctcaaactacttacagattttcagtctcaccaattatgggctacactactttcattgacattcataaaaacaacattttcccttcattatgcatggaaaacaatggcaatggtacttagtatagtcagcttatttccattatgcttatccactacttcgcagaaaaccacatggttgccagtattattaggctcactcggatgcaaaccactaactatgttcctcatcgccgagaataaaatatggggtagacgaagctggccactgaacgaggggataatggcagtcggcatagtctctattttattaagcagtctcctgaagaatgacgtaccgctagctggtccactgattgcaggcggaatgttgatagcgtgttacgtaatatcaggaagttctgctgatttgagcctagaaaaagcagcagaagtttcatgggaagaagaagccgaacattccggtgccagtcacaatattttggtcgaggttcaagacgatggaactatgaaaattaaagatgaagagagagatgatacgcttacaatcttactaaaggctacattattagcagtttccggcgtctatcccctatcgattcccgccactcttttcgtgtggtacttttggcagaagaagaaacaaagaagtggcgttctctgggacacaccctccccaccagaagtcgaaagagcggtcttagacgatggtatatacaggataatgcagcgcggtctgttaggccggagccaggtaggagtcggtgtttttcaggaaaatgtctttcacacaatgtggcacgtaacccgaggagccgtgctcatgtatcaaggaaaaagactggaaccgagctgggcatcagtaaagaaagacctaatctcatatggagggggatggagactccaaggatcatggaacacaggagaggaggtccaagtaatagcagtagagccaggcaaaaatccgaaaaacgtccaaactgcaccgggaacattcaaaacaccggaaggggaagtaggagcaattgccttagatttcaaacctggtacgtccggaagtccaatagtaaatagagaaggaaaaattgtaggcctatacggaaatggagttgtgacaacttccggaacctacgtgtcagcaatagcacaagctaaagctagtcaagaaggacccctacccgaaatagaggacgaagtattcagaaaaaggaatttaacaataatggatctgcaccccggaagcggtaaaactaggagatacctccctgcaatcgtccgcgaagccattaaaagaaaattacggactctaatcctagcccctactcgtgtagtcgccagcgagatggcagaggcactgaaaggaatgccaatacgctatcaaacaactgctgttaagagtgagcatactggaaaagaaatagtcgatttgatgtgtcacgcaacatttactatgagactcttatccccggtgagagtaccaaattataatatgataattatggatgaagctcattttactgatccgagcagcatagcagcacgaggctatatatcaactcgcgtaggaatgggagaagcggctgctatattcatgactgcaacaccaccaggttccgtagaggcctttccacaatccaacgccgtaatacaggatgaggagcgagatataccagagcgtagctggaactcaggttacgaatggataacagatttccctggaaagaccgtatggttcgtaccttctatcaagagcggaaacgatatagctaattgtctaaggaaaaatggtaaaagagtaatacagttgtctagaaaaacttttgacaccgaataccagaaaacgaaaaataacgactgggactatgtggtgactacagatatcagcgagatgggagcgaatttccgcgccgacagagtaatagacccgagacgctgtttaaaacccgttattcttaaggatggaccagaaagggtcatactcgcagggcccatgccagtgacagtagctagtgcagcgcaacgaagagggagaataggaaggaatcataataaagagggagaccaatatatatacatgggtcaacccttgaataatgatgaagatcatgcgcattggaccgaagcaaaaatgttattagataacataaacacaccggaggggattatccctgccctatttgaacctgagcgagagaaaagcgctgccattgatggagaatacaggctacgaggagaggcaaggaaaactttcgttgaattaatgagaagaggagacctgccagtatggctatcgtacaaggtagcatcagaagggtttcaatattctgacagaagatggtgctttgatggagaacgtaataaccaagttctagaggaaaatatggatgtagaaatctggacgaaagaaggggagagaaagaaactccgtcctcgatggctcgatgctagaacatattctgatcctttagcattaagggaatttaaagaatttgcggcgggtaggaggtctgtcagcggtgacctgatcttagaaataggaaaattaccacagcacctgacacaaagagcacagaatgccctcgataatttggtaatgttacataattcagaacaaggcggtcgagcgtacagacatgctatggaagaacttccagacactatagaaacactaatgttattggcgctcatagccgtcttgacaggtggtgtaacactcttctttctaagcggccggggcctgggaaaaacatctataggcttactttgcgttatggcgtcatcagtattactgtggatggcttcagtagaacctcattggattgcggctagtatcattttagaatttttcctaatggtcttattaatccctgaaccagataggcaaagaactccacaagataaccaacttgcgtatgttgttattggactattatttatgatcttaaccgttgctgcaaatgaaatgggtctattagaaaccactaagaaagatctcggcataggtcacgtagcggtagaaaaccatcaccacgcagccatgttggatgtagatcttcatccggcttccgcatggaccctatacgctgttgcaacgacaataatcacacctatgatgcgacacacaatagaaaatacaactgcgaacatctcactaactgcaatcgctaaccaagcagcaatattaatgggtttagataaaggatggcccatatcaaaaatggatataggagtgcctctattggccttgggatgctactcgcaagtaaatccattaactcttactgcagcggttctaatgctagtagcacactacgcgataataggtccaggcctacaagcgaaggcaacacgggaagcacaaaagagaacagctgctgggatcatgaaaaatcccacggtagatggtattgtggcaattgacctggaccctgtggtttacgatgcaaaattcgaaaaacaattaggtcagataatgctgctaatcttgtgtacatcacagattctattaatgaggaccacgtgggcactatgcgaaagcattacacttgccactggacccttaacgacactttgggaagggtcccctggcaagttctggaatacaacgatagcagtaagtatggcaaatatatttcgtggtagctatctagcgggcgcaggcttggcattttcattaatgaaatcactaggtgggggtagacgaggtaccggagcacaaggagagacgcttggcgagaagtggaaaaggcaactaaatcagctaagcaagagtgaatttaacacatataagcgtagtggaattatggaagtcgataggagtgaagctaaagaaggcctaaaacgcggagaaaccactaagcacgcagtgtctagaggaacggctaagttaagatggttcgtagagcgaaacttagttaaacctgagggaaaagtaatcgatctggggtgtggacggggaggttggagttactattgtgcaggactcaaaaaggttacagaagtgaaaggatatacgaaaggaggaccgggacacgaggaacccatacccatggccacctacggttggaatttagtaaagttacactcagggaaggatgttttcttcattccaccagaaaaatgcgacacactgctatgcgatatcggcgaaagcagccccaatccgacaatagaagaaggaagaactctaagggtacttaaaatggtcgaaccttggcttcggggaaatcaattttgtattaaaatattgaatccttacatgccctcagtagttgagaccttagaacaaatgcaaagaaaacacggaggaatgctagtgagaaatccactatcacgcaactcgacacatgaaatgtactgggtatcgtgtggtacaggaaatatagtttcagcagtaaacatgacatctcggatgttattaaatagattcactatggctcataggaaacctacatatgaacgggatgttgatttaggcgcgggaacaagacatgtcgcagtagaaccagaggtggcgaatttggatatcattggacaaaggatagaaaacataaaacacgaacataagagtacatggcactatgatgaagataacccctataagacatgggcataccatggctcatatgaggttaagccaagtggatcagccagctccatggtaaacggggttgtcaagttattaacaaagccgtgggatgtaataccgatggtgacacaaatagcaatgacagataccacgcctttcggacaacagcgggttttcaaggagaaagtagacacgcgaacaccaaaagcgaaaaggggaactgcacaaatcatggaagtaaccgcgaaatggttgtggggatttctatccaggaacaaaaagccaaggatatgtactagagaagaatttacccgtaaggtgaggtccaatgcagcaataggagcagtatttgtagacgaaaaccagtggaatagcgctaaagaagctgtagaagacgaacgtttttgggatctggtacacagagaacgggaattgcacaagcagggaaaatgtgctacatgtgtttacaatatgatgggtaagagagagaagaaattgggcgaatttgggaaagctaagggatcgagagcaatatggtacatgtggctcggcgccaggtttttagaatttgaggcgctgggatttatgaacgaggatcactggtttagcagagaaaattctttatccggtgtagaaggagaaggactccataagctagggtacatattacgagacatcagtaaaataccaggaggaaacatgtatgccgatgataccgcagggtgggacactagaatcactgaagatgatttacaaaatgaagcacgaattacggatataatggaaccggagcacgctctactagcgaagtcgatcttcaagctaacgtaccaaaataaggtggtaagagttcaacgccctgctaaaaatgggaccgtaatggatgtaataagtcgcagagaccaaagaggctccggacaggtgggcacgtatggcctcaacacatttacaaatatggaagcccaacttattcgacaaatggagtcagaaggtatattctcccctagcgagctagaaacgcccaatctagctgaacgggttttagactggttagaaaagtacggagtggagagactaaaaagaatggcaataagtggcgacgactgcgtcgttaagcctatagatgatcgatttgcaactgcgctcacagcgttgaatgatatgggaaaagtgaggaaggacataccacagtgggaaccgagtaaaggttggaacgattggcaacaagttcctttttgtagccatcatttccatcaacttattatgaaggacggcagagagatagtggtcccatgcagaaatcaggatgaactggtcggcagagcgagagtctctcaaggagccggttggtcacttcgagagacggcgtgcttagggaaatcatatgctcaaatgtggcagttaatgtatttccaccgtagagacttacgcttggcggcgaatgcaatctgtagtgcagtaccagttgactggataccaacatcaaggaccacttggtcaattcatgcacatcatcagtggatgacaaccgaagatatgctatcagtctggaatcgagtttggatagaggaaaatccttggatggaagacaaaacacatatatcttcgtggggtgatgtaccatatctagggaagagagaggaccagtggtgcggatcgttgattgggttaactgcacgtgctacatgggcgacaaacatacaggttgcgatcaatcaggtacgtagactcatcggtaacgagaactacttggattatatgacaagtatgaaaagatttaaaaatgagagtgatccggaaggggcactctggtaa

SEQ ID NO: 21649 - RNA, 9879 nt, synthetic construct
  misc_feature 1..9879: note = derived and/or modified CDS sequence (opt6) from DENV-1__FJ898384__SS-prME
  source 1..9879: mol_type = other RNA
agtgtgacaatgctactaatgctaatgccaacggcattagctttccatttaactacacgagggggagaacctcatatgatagtaagtaaacaagaacgagggaaatctctgctttttaaaacttcagccggtgtaaatatgtgcacactaattgcaatggatctaggagaattttgcgaagacactatgacatataaatgcccaagaattacagaagcggaaccagatgatgtagattgttggtgtaacgcaacagatacatgggttacctatggtacatgttcccaaacgggtgaacatagacgggataaaagatcggtggctttagctccccatgtaggattgggcctagaaactcgaaccgaaacatggatgtcttcagaaggcgcctggaaacaaattcagcgagtcgaaacatgggcattacgacacccaggatttacagtaatcgcaatattcttagcacatgcaattggtaccagtattacgcaaaagggaattatcttcattttactgatgctagtaactccatcaatggcaatgagatgtgtgggaataggttctagggattttgttgaaggtctatctggagcaacatgggtagacgtggtcctcgaacacggatcctgcgtaaccacgatggcaaaagataagccgacgttagacatagaattattgaagacggaagtaaccaatccagctgttctgagaaaactatgtatagaagcgaaaatctctaatacaactacagacagtcgatgtcctactcaaggagaagcaacgctggtagaagaacaagatgctaattttgtatgcagacgaacgtttgttgatagaggctggggaaatggatgtggtttgttcgggaaaggatctttgataacgtgtgcaaaattcaaatgcgtcactaagttagaaggcaaaatagtgcaatatgaaaatctaaaatatagtgtcattgttacagtacacacaggagatcaacatcaagttggcaatgaatccacagaacatggaacaacagcgactataacaccacaggccccatccacggaaatacaactcaccgattatggtgcattaacactagactgcagcccaagaacaggcttggatttcaatgagatggtattactcacgatgaaggagaaatcgtggttagtgcacaaacaatggtttctagacctaccactcccatggacttctggagcatcaacaagtcaagaaacctggaaccgccaagacctcctagtaacattcaagacggctcacgcaaagaaacaagaagttgtggtgctaggttcccaagaaggagcaatgcatacagccctaacaggggctacagagattcaaacgtcaggcactacgacgatttttgctggtcacttaaaatgtagactgaaaatggacaaacttacattaaaaggtatgagttatgtgatgtgtacaggatctttcaaacttgaaaaagaggtggcggaaacacaacatggcacggttctcgtacaaatcaagtatgaaggtactgatgccccctgtaaaataccattcagcacacaagacgagaagggagttacacagaacggaagactaataacagcaaacccaatcgtaaccgataaggaaaaacctgtaaatatcgaagcagaaccacccttcggcgagtcctacatagttattggggccggagagaaagctctaaaactatcctggtttaagaaagggtcttcgattggtaaaatgtttgaggcgacagctaggggagcaagaagaatggctatactaggggacacagcgtgggactttggcagtattggtggagtttttacatctgttggaaaattagttcatcagatattcgggacagcttacggcgtattattctctggcgtgagttggacaatgaaaataggtatcggagtgctacttacatggctagggttaaattctcggagcacaagtttatctatgacctgtatagctgtggggttggttactctatatctgggagtcatggtacaggcagacagcggatgcgtaatcaattggaagggacgtgaactaaagtgtggatcaggtatatttgtaactaacgaggtacacacatggaccgaacaatacaagtttcaagcggactcgccaaaaaggctatctgcagcaatcgggaaggcttgggaagagggcgtctgtggcattagatcagctacgagattggaaaacataatgtggaaacaaatctctaatgagttaaaccacatattattagagaacgatatgaaattaacagtagtagtaggagatgttgccggtatattggctcaggggaagaaaatgataagaccccagccaatggagtataaatactcatggaaaagttggggaaaagcaaagataataggtgccgatgtacagaacacaacgtttattattgacggccctaatacacctgaatgtccagatgaccaaagagcatggaacatttgggaggttgaagattacggatttggaattttcactaccaatatttggttaaaacttagagactcgtacactcaagtttgtgatcatagattaatgtcggctgcaataaaggacagtaaggcggttcatgcagatatggggtattggatagagagtgagaaaaatgaaacttggaagttagctagggcatccttcatagaagtcaaaacatgcatttggccaaaatctcatacgctttggtcgaacggagttttagaaagcgaaatgatcattccaaaaatttatggagggccaatcagccaacataactatagacccggttactttacacaaacagcaggcccatggcatttaggaaagttggaactggattttgatttgtgcgaaggaaccacagttgttgtagatgaacattgtggtaatcgaggaccttccttacgaactacgaccgttacaggaaagattatccatgaatggtgctgtagatcatgcaccttacctcccttacgttttaagggtgaagacggatgttggtatggcatggagatccgtcctgtgaaagagaaggaagaaaatctagtaaagagtatggtatcagcaggcagtggtgaagttgattcattctctttaggactgctatgcatatcaataatgatcgaggaagtgatgaggtccagatggagtcggaaaatgttgatgacaggcacattggcagtcttctttcttctgataatgggtcagttaacttggaatgatttaataagactatgcattatggtgggagctaatgcaagtgatcgaatgggtatgggcacaacctatcttgcgttgatggccacgttcaaaatgagaccaatgtttgcagtaggactgctatttaggcgcttgacttcaagagaagtgttgctgttaacaataggtctgtcactcgtagcttctgttgaattacctaattccttagaagaattaggcgatggtcttgcaatgggaatcatgattttaaaattgctaacggacttccaaagtcatcagctttgggccactttgcttagtttaacctttataaggacaacatttagtctccactatgcttggaaaaccatggcaatggtattatccattgtctccttatttcccctttgcctaagtacaactagccaaaagacgacatggctaccagttttactcggaagtctcgggtgcaaacctcttacgatgttcttaatcgccgaaaataaaatttggggcaggaaatcatggccactgaatgaaggtattatggcagtaggtatagtatcaatccttctaagttctttactcaaaaacgatgtaccccttgcaggaccactgatagcaggaggcatgttaatagcttgctacgttatttcagggagtagcgctgatcttagtctcgagaaagccgctgaggtgtcctgggaagaagaagccgaacattccggggcctcccacaatatattggtcgaagttcaagatgacggtacgatgaagatcaaagatgaggaacgagacgatactctaacgattttactaaaagcaacactacttgcagttagtggagtatatccattaagtataccggccacattgttcgtttggtatttctggcagaagaagaaacaaaggtctggtgtattatgggatactccatctccgcctgaagtagaacgagccgtcctcgatgacggaatatatagaatcatgcaaagggggttactaggtcgtagtcaggtaggtgttggtgtattccaagagaatgtatttcacaccatgtggcacgtaactcgtggtgcagtactaatgtatcaaggaaaacggcttgaaccaagttgggcctctgtcaagaaagacctaataagttacggcggtggatggaggcttcaaggttcctggaatactggcgaagaagtccaagtaatagccgtcgaacccggcaaaaaccccaaaaatgttcaaaccgcaccgggaacgtttaaaaccagcgaaggtgaggttggggcaatagctctggatttcaaaccaggtacatccggaagtccaattgtgaatagagagggaaaaattgtaggtctgtatgggaacggagtcgtgaccacaagtggaacatacgtgtctgcaatcgcacaggccaaagcaagtcaagaaggccccttaccggaaattgaagacgaggtctttaggaaacgcaatttgaccatcatggatctacacccaggtagtggcaaaacacggaggtatctcccggcaatcgtaagggaagcaataaaaagacgcttacggactctcatattagctcccacacgggtcgtagcatcagaaatggcagaggcactcaagggaatgcccatacgatatcaaactacggctgtcaaatccgagcacacaggaaaagaaattgtagacttaatgtgccacgcaacatttacaatgagactattgagtcccgttagagtgccgaattacaacatgataataatggatgaagcgcactttacagacccatcgagcattgcagccagaggatatatatcaacccgcgtgggaatgggtgaagcagcagcaattttcatgacagcgacacctcccggatcagtagaagcattccctcaatcaaatgccgtaattcaagacgaagaaagagacattccagagagatcttggaactctggctacgaatggatcactgactttccgggtaagaccgtatggttcgtaccgtccataaaaagtgggaatgatattgccaactgccttaggaaaaatggaaaacgcgtaatacaattaagtcgtaaaacatttgatacagaatatcagaaaacgaaaaataacgactgggactacgtagtaacaacagatattagcgagatgggagctaactttcgggcagacagggttatcgaccccagacgatgtctaaaacccgtgattttaaaggacggccccgaaagagttatactggccggaccaatgcccgtaacagtagcaagtgcagcccagcgaagaggaagaataggaagaaatcacaataaagaaggggatcaatacatttatatgggtcagccgctcaataatgacgaagaccatgcacattggaccgaggccaagatgttattggacaatataaatactccagagggtataattcctgccctatttgaacctgaaagagagaaaagcgcagcaatagatggagaatatagattaaggggcgaagcacgaaagactttcgtcgaacttatgaggagaggagacttgccagtatggcttagttacaaagtagcttcagaggggtttcagtacagcgatcgcagatggtgctttgacggggagagaaacaatcaagtgctagaagagaacatggatgttgaaatttggacaaaggagggtgagcgtaaaaagttacgaccgaggtggctagatgcacgaacatattccgacccactagccctgcgagaatttaaggaatttgcagctggacgacgaagtgtatccggagatttaatattagaaataggcaagttacctcaacaccttacacaaagagcacaaaatgccctggacaatttagtgatgctacacaattcagaacaaggtggcagagcatacaggcatgcgatggaagaattgcctgatacaattgaaaccctgatgttgttagcattaattgctgttctaaccggcggagtcacattattctttctaagtggtcgcggacttggaaaaacttccattgggttattgtgtgtaatggcatctagcgtattactttggatggcctcagtagaaccgcactggattgccgcgtccataatattggaatttttcttaatggtcttgttaatcccagaaccagatagacaaagaacccctcaggataaccaacttgcatatgttgtcatcggcttactctttatgatacttactgtagctgcaaatgaaatgggtttactagaaaccactaagaaagacttaggaattggacatgtggcggtcgagaaccaccaccatgcggctatgttagacgtagatttacatcctgctagcgcatggactctctacgctgtagccacaaccattattactccaatgatgcggcacactatagaaaatactactgcgaacatcagcctaactgcaatcgctaatcaagcagcaattctaatgggcctcgacaaaggctggccaataagcaaaatggacattggagtgccattgctggcattaggctgctactcacaagtaaacccattaacccttacggctgcggtgttaatgctagtagcccattatgcaatcataggtccaggccttcaagcaaaagctacacgggaggctcaaaaacggacagcagccgggattatgaaaaatccgacagttgacggaatagtagcaattgacctagatcctgttgtttatgatgcgaagtttgaaaaacaactaggccaaattatgctattaatactatgtacttctcaaattctattaatgcgtaccacttgggctctgtgtgaatcaataacacttgcgacaggaccactaaccacattatgggaggggtcgccaggaaaattttggaataccacaatagcagtatcaatggccaatatatttagaggctcatacctagctggagcagggctcgcttttagtctaatgaaatcgctcggaggaggtagaaggggcacgggcgcgcagggggaaacattgggagaaaagtggaagcgacaattgaatcagctttctaagagtgagtttaatacatataaacgttcaggtataatggaagtagatagatccgaggctaaagaaggattaaagagaggagaaacgactaaacacgctgtctctagggggactgctaaattgagatggtttgtggaacgcaatttagttaaaccagagggaaaagtgattgacttggggtgcggtcggggaggctggtcttattattgtgctggacttaagaaggtcacagaagtcaaaggctatacgaaaggagggccaggacatgaagaaccgatacccatggctacctacggttggaatctagtgaagttacattcaggaaaagatgtattctttataccacctgaaaaatgtgacacacttctttgcgacataggagagagcagtcctaatccaactatagaagaaggtaggacactgagagttttgaagatggttgaaccgtggctaagaggtaaccaattttgtattaaaatattaaatccttacatgccctccgtagttgagactttagagcagatgcaacgcaaacatggtggtatgttggtgcgtaacccactatccaggaacagtacacacgaaatgtactgggtatcttgtggaacgggtaacatagtatctgctgtaaatatgacaagtaggatgttgctaaataggttcacaatggcacaccgaaagcccacatatgaaagggatgtggatctcggagcaggtactagacatgtggcagttgaacccgaggtcgcaaatttagacattataggacaacgaatagaaaacatcaagcacgaacacaaaagtacatggcattacgacgaagataacccttataagacctgggcatatcacggaagttatgaagttaagcctagtggatccgcaagctcaatggttaatggggtagtaaagttattgaccaagccatgggacgtaataccaatggttacgcaaattgccatgacagacacaactcctttcggtcagcagagagtatttaaggaaaaagtagacacgagaacgcctaaggcaaagaggggtactgcacaaataatggaagtaacagcaaagtggctgtgggggtttctatcaagaaataagaagccaaggatatgcacaagagaggaatttacccgaaaagtacggtccaatgctgctatcggagctgtatttgtcgatgaaaatcagtggaactcagctaaagaggcagttgaagatgaacgattctgggatttagtacacagggaaagagaactccataagcaaggtaaatgtgcgacgtgcgtctataatatgatgggcaagagagagaagaaactcggtgaatttggtaaagcgaaaggttctcgtgcgatatggtatatgtggttaggagctcgatttctagagttcgaagcacttggattcatgaacgaagaccactggttttcacgcgaaaacagtctatcgggcgtcgagggtgaaggccttcataaacttggttacattttgcgtgacattagcaaaatccccggcggaaatatgtacgccgatgacacagctggctgggacactagaataacagaagatgatctccaaaatgaagcaaaaattacagatattatggaacccgagcatgcactattggcgaaatctatattcaaactcacatatcaaaacaaagtggttagggttcaaaggcccgcaaagaatggtactgtcatggatgtaatttcaagaagagatcaacgaggatcgggtcaagttggtacttacggtctgaatacattcacgaatatggaagctcaactcataagacaaatggaatcagagggtatattttccccatcagaattagaaacgccaaatctcgcgggtagagtattagactggctagaaaaacatggcgttgaacggctgaaaagaatggcaatatcaggggatgactgtgtagttaaacctatagatgaccgatttgcgacggcactcactgcattaaacgatatggggaaagtcagaaaggacataccccaatgggagccatcgaaaggatggaacgactggcaacaagttcctttttgctcccatcactttcatcagctaattatgaaagatggtcgagaaatcgtagtaccctgtcgcaaccaagacgagctagtgggtagagcaagagtgtcacaaggtgctgggtggtctcttagagaaacagcatgtttaggtaaatcatacgcgcaaatgtggcagttgatgtattttcatagacgagacctacgtcttgctgcaaatgcaatctgcagcgctgtgcctgttgactgggtacccacatccaggacaacatggtcaatacacgcccatcatcaatggatgacaaccgaggacatgctaagtgtatggaatcgagtatggatagaggaaaacccatggatggaggataagacacatgtaagcagctggggagacgttccctatttgggaaaaagagaagatcagtggtgcggcagcctcatagggctaacggcacgcgcaacctgggcaacaaatatacaagtagctataaaccaagttagaagattgcttgggaatgaaaactatttggattatatgaccagtatgaagaggtttaaaaatgaatcagatccagaaggagcactatggtag

SEQ ID NO: 21650 - RNA, 9879 nt, synthetic construct
  misc_feature 1..9879: note = derived and/or modified CDS sequence (opt6) from DENV-1__FJ898385__SS-prME
  source 1..9879: mol_type = other RNA
agcgtgacgatgctcttgatgctgatgccgactgcattagcgtttcatttaactacacggggaggagaaccccacatgatagtgacaaaacaagaacgtggaaaaagcctcctgtttaaaacttcggctggtgtaaatatgtgcaccctaattgcaatggatttaggtgaactatgcgaagatacgatgacttacaaatgtccccgaattactgaagcagaacccgatgacgtggattgttggtgtaatgcaacggacacatgggttacgtacggtacatgtagccaaacaggagaacataggcgggataaacgatcagtagcattggcacctcatgtgggtctgggattagaaacgcgtacagaaacatggatgtcaagcgagggcgcgtggaaacaaattcaacgggtagaaacttgggctcttagacatcccggttttacagtcatagcactatttctagcacatgctatagggacatcaatcacacaaaaaggcataatatttattctactaatgttggtcacaccatccatggcgatgaggtgtgtgggcatcggttcaagagattttgtagaaggattaagtggtgccacttgggtagatgtcgtccttgaacatggatcatgtgtaacaactatggcaaaagacaaacccacattagacatagaactacttaaaactgaagttactaacccagcggttttacgaaaattatgcattgaagcgaaaatttctaatacaacaactgattcacgatgtccgacacaaggagaagccacattaatggaagaacaagacgctaatttcgtatgcagacgcacatttgtagacagaggctggggtaacggatgtggacttttcgggaaaggatccctaataacgtgcgcgaaatttaaatgcgtaaccaaattagagggaaaaatagttcaatacgaaaatcttaaatattcggtaatagttactgtgcatacaggagatcaacatcaagtagggaatgaatcaacggaacacggcacaactgcaacgattacgcctcaagcccctacaagtgaaatccaattaactgattatggggctttaaccttagattgttcaccacggaccggtttagactttaacgaaatggtgttattaacaatgaaagagaaaagttggctggtgcacaaacaatggttcctagatttaccactcccctggacctctggggcatctacgtcacaagaaacttggaataggcaagatcttttagtaacgttcaaaaccgcccatgcgaagaaacaagaagtagtagttttggggagccaagagggagcaatgcacacggccctcactggggctacggagattcaaacaagcggtacaacaactatcttcgctggtcatttaaaatgcaggctcaaaatggacaaactaacattaaaagggatgagttatgtcatgtgcaccgggagctttaaactagaaaaagaagttgcagaaacgcaacatgggacagtgctagtacaaattaaatacgaagggactgatgctccttgtaaaattccattcagcactcaagacgaaaaaggggtaactcaaaacggaagactaataacggccaatccaatagtaacggacaaagaaaaacctgttaacatagaggccgagccaccatttggagagagttacattgtgataggggccggtgaaaaagcgctcaaactcagctggttcaagaaaggttcaagtataggaaaaatgttcgaagcaacagcaagaggagctagaagaatggcaattcttggggacacagcatgggattttggctcaataggtggtgtgtttacatcagttggtaaattggtgcatcaaattttcggtacggcttatggagtactatttagcggagtgtcatggacaatgaaaatcggcattggagttttactcacatggctaggtctaaattcaagaagtacaagtctatcaatgacttgcatagcagttggattagttaccttatatttaggagtcatggtccaagctgactcaggatgtgttataaattggaaaggaagagagttaaaatgtggaagtggtatattcgtcacaaacgaagttcatacttggacagaacagtacaagtttcaggcagactcccccaagagactgtccgcagcaattggtaaggcatgggaagaaggagtgtgtggaataagaagtgctacccgactagagaacataatgtggaaacaaatcagcaatgaactaaaccacattctgctagaaaacgacatgaaattcacagtagtagtaggtggagtggtaggcattctcgcacaggggaaaaagatgattaggccgcagccaatggaacacaaatattcatggaaaagctggggtaaagctaagataattggtgcggacgtacaaaacacaacttttattatagatggaccaaataccccagagtgcccggatgatcaaagagcatggaacatctgggaagttgaagattacggattcggtatatttactacgaacatatggttgaaacttcgtgactcctatacacaagtatgcgaccaccgattaatgtcagcagcaatcaaagactcgaaagcggtacatgcggatatgggttactggattgagtccgagaaaaatgagacatggaaacttgccagagctagtttcattgaagttaaaacgtgcatctggccaaaatcacatactctatggtccaatggagtactcgaaagcgaaatgattatccctaaaatttatggcggaccgataagtcaacacaactataggcctggctattttacacaaactgcagggccttggcacttaggcaaactagagctagatttcgatttatgcgaagggacaactgtagttgtcgatgaacattgcggaaacagagggccgtccctccgaacaacgacagtaactggcaaaatcatacacgaatggtgttgtaggtcatgtacgttacccccattaagatttaaaggtgaagacggttgttggtacggtatggaaatcagaccggtaaaagagaaggaagaaaaccttgtaaaaagtatggtatctgcaggcagtggagaagttgattcattttcattgggcttgctttgcatatcgattatgattgaagaagtaatgagaagtaggtggtcgaggaaaatgctaatgactggaacgttagccgtatttctcctattaataatgggacaactaacgtggaacgacctaattcgattatgtataatggtaggagcgaatgcctcagaccgtatggggatgggcactacatatttagcacttatggcaacatttaaaatgcgaccgatgtttgctgtaggtttactgtttcgacgattaactagccgtgaagtcttgctcctaactattggccttagtttggtagcatccgtagaattgccgaatagtctggaggagcttggagacggtctagcaatgggcataatgatattgaaattattaactgactttcaaagccatcaattatgggcaacattactgagcttaacttttattaaaaccactttatcgctacattatgcttggaagacgatggccatgattctaagtatagtttccctatttcctctatgcctatcgacaacaagtcagaaaacgacatggttaccagtgttattaggcagcctaggatgtaaaccactaacaatgtttttaatcgcagaaaataagatatggggtagaaaaagctggcctttaaatgaaggcattatggcggttggtgtagtaagtattttgctctcaagtttattaaagaacgatgtaccgttggccggaccactaattgcgggaggtatgctaattgcctgttatgtgatttctggatcgtcggcggacttatctttagaaaaagccgcagaggttagctgggaagaagaggctgagcattcaggagctagtcataacatcttagtcgaagtacaggatgacggtacaatgaaaatcaaggacgaggaaagagatgatactctgacaatattattgaaagctacattactcgccgtgtcaggggtttatcctctatctatacccgcaacactatttgtttggtacttttggcagaaaaagaaacaaagaagcggtgtactctgggatactccatctccaccagaggtcgaaagagccgtactagacgatggaatttatagaataatgcaaagaggactactagggagatcacaagttggcgtgggcgtctttcaggaaaatgtatttcatacaatgtggcacgtcacaagaggtgcggttttaatgtatcaagggaaaagattagaaccctcttgggctagcgtcaagaaagatctaataagttatggcggaggctggagactccaaggatcttggaatatgggagaagaagtacaggtgatagccgtggagccggggaaaaatcctaaaaatgtacaaacagctccaggtacatttaaaacaccagaaggggaagtaggagctattgcattggacttcaaaccgggtacatcaggcagtcctatagtaaaccgcgagggcaagatagtcggactttatggaaacggagttgtaacaacaagcggaacgtacgtttccgcaattgcacaagcgaaagcatcacaggaaggcccgttaccggaaatagaggacgaagtttttagaaaaagaaatttgacaattatggatctacacccaggatcaggcaaaacacgaaggtacctcccagccattgttcgcgaggcaattaagcgtaagttaagaacgttaatattagcccctacaagggtcgtggcgtccgaaatggcagaggcattaaaaggtatgcctataaggtatcaaactactgccgtaaagtcagaacataccggaaaagaaatagtcgatttaatgtgccacgcgacatttacaatgaggctcctctcaccggtaagggttccaaattataacatgatcatcatggacgaagcgcattttacagacccatcgtctattgcggcgaggggatatatatcaactcgtgtgggaatgggagaagcggcagcgatcttcatgacggcaacaccacccggtagtgtagaggcttttccacaaagtaacgctgtgatacaagatgaagaaagagacatcccagaacgcagctggaactcaggatacgaatggataacggacttcccggggaaaactgtatggtttgtgccctctataaagtcaggaaatgacatagcaaattgtctccgcaagaatgggaaacgtgtcatacaattaagtcgtaaaactttcgatacggagtatcagaaaactaaaaataatgactgggactatgtggtgactactgacatcagcgagatgggtgctaatttcagggcagatagagtaatagacccgagaaggtgcctgaaaccggtgatactaaaggatgggcctgaaagagttatattagcaggtccaatgcctgttactgtagcttccgcggcacagagacgtgggcgaataggacgcaaccacaacaaagaaggagatcagtacatatatatgggacaaccattaaacaacgacgaggaccatgcacattggacggaagcaaaaatgttacttgacaatattaatacgccggaaggtataataccagcactcttcgagccagaaagggagaaaagcgcagcaattgacggcgagtataggttgcgcggcgaagccaggaaaacatttgtagaacttatgagaagaggagacttgcctgtctggttaagttataaagtggcctctgaaggattccaatattcagatcgccgatggtgtttcgatggagaacgcaataaccaagttctggaagaaaatatggatgttgagatttggacgaaagaaggagagagaaagaaactgaggcctagatggttggacgcaagaacgtattccgatccattagctttacgtgagttcaaagagttcgctgccggccgcaggtcagtttccggagacttaatattagaaatagggaagctaccacagcatttgacacaacgtgcccaaaacgccttagacaacctagtaatgctacataatagcgagcaaggaggacgagcatatcgacatgcaatggaagaattgccagatacgatagagactctcatgcttctggcactaatagctgtcttgaccggaggcgtcacgcttttcttcctgtccggtcgagggcttgggaaaacatcaattggtttactatgcgtcatggcctcaagtgtacttttatggatggcaagcgttgagcctcactggattgctgccagcataattctagaatttttccttatggtattactaatacctgaacctgacagacaaagaacacctcaagataatcaactcgcgtatgtagtcataggcttattatttatgatcttaactgtagcagcgaacgaaatgggtctactcgaaacaactaagaaagatctaggaataggacatgtagcagtcgaaaaccaccaccatgcaacgatgttggatgtagatttgcacccggcttccgcatggacactttacgcggtagcgaccacaataataacgcccatgatgaggcataccatcgagaataccacagccaatatcagtttgaccgctattgctaaccaagctgcgatattaatgggcctagataaaggatggcctatttccaaaatggatataggggtaccacttttagcattaggatgttattcacaagtgaatccgctaacacttacagccgcagtattaatgctcgtagcgcattatgctattatagggcccgggctacaagcgaaggccacaagagaggcacagaaaaggacagcagctgggattatgaaaaaccccactgtagatggaatagttgcaattgatttagacccagttgtgtacgacgcgaaatttgaaaaacaacttggacaaataatgttactaatattatgtacatcacagattcttctaatgcgtactacatgggctttgtgcgagtcgattaccttagcaaccggaccacttacaacgctctgggaaggatcaccaggaaagttttggaatactacaattgctgtatccatggccaatatcttcagaggctcatacttagccggtgcaggtctggctttctcattaatgaaatcattaggtgggggcagacgcggtacgggtgcccaaggtgagactcttggagaaaagtggaaaagacaattaaatcagcttagtaagagtgaatttaacatatataagagaagtggtatcatggaagtggacagaagtgaagccaaggaagggctaaagagaggcgaaacgactaggcatgcagtgtctcggggcacagcgaaattgagatggtttgtagaaagaaacctagtcaaacctgaaggaaaagtcatcgacctagggtgtggtagaggaggatggtcatattactgcgcagggctaaagaaagtgacagaagtcaaaggatatacaaagggcgggccgggacacgaagaaccaataccgatggccacttatggatggaatctcgttaaactccattcaggtaaagatgtgttctttacacccccagaaaaatgtgacacacttttatgcgatatcggcgaatcgagtcctaatccgacgattgaggaaggaagaacactcagagtacttaaaatggtggaaccgtggttaagaggtaaccagttttgtatcaaaatacttaatccatacatgccgtcggtcgtagaaacactggaacagatgcaacgaaaacatggagggatgctggtacgcaacccactttcaagaaattcaacacacgaaatgtattgggtaagctgtggaacggggaacatcgtatcagcagtgaatatgactagcaggatgttactaaacaggttcactatggcgcatagaaaacctacttatgaacgtgacgttgacttaggagccggaacaagacatgtggccgttgaaccagaagtagctaacctggatattatcgggcaacgcatagagaacatcaaacacgaacataaatcaacatggcactacgacgaggataacccctataaaacatgggcataccatggatcatacgaggtgaaaccatctggatcagctagtagtatggttaatggggttgtcaaacttctaaccaagccatgggacgtaatacccatggtgacgcaaatcgctatgaccgacacaacacctttcggtcagcagagagtttttaaggagaaagtagacactaggacaccaaaggcaaagagaggtactgcacagatcatggaagtaacagctaggtggctatggggctttctaagcagaaataagaaacctagaatatgtaccagagaagaatttacacgtaaagtccgatccaatgcagcaattggagcagtcttcgttgacgaaaaccaatggaacagtgcaaaggaagcggtagaagatgaaaggttttgggatctcgttcaaaaagagcgagaattacataaacaaggaaaatgtgctacttgcgtgtataacatgatgggcaagcgagaaaagaagttaggcgagttcggaaaggcaaagggatctcgcgcgatatggtacatgtggctaggagccaggtttctagaatttgaagcgctaggttttatgaatgaagatcattggttctctagagagaacagcctttccggcgtcgaaggggaagggttacataaactaggttatattttgcgtgacatctcaaaaataccaggaggaaacatgtacgcggacgatacggcaggctgggacaccagaataacagaagatgatctgcaaaacgaagctaagataaccgacatcatggaacccgagcatgcattgttagcaacaagcatttttaaacttacttaccaaaacaaggtagttcgcgtccaacgccctgctaaaaatggtacggtcatggatgtcatttccaggagagatcaaagggggtcgggacaggttggcacctacggacttaacacattcacaaacatggaagcacaattgataaggcaaatggaaagtgagggaatattttcacccagtgaactagaaatacctaatctagcggaaagagtgctggactggttggaaaaatacggagtagagcgcctcaaacggatggcaatatcgggggatgattgtgtggttaagccaatagacgaccgatttgccacagcgttgacggcactaaatgatatgggaaaggtgcgtaaagacgtccctcaatgggaaccgagtaaaggttggaatgattggcaacaggtgcccttttgttcccatcatttccaccaactcatcatgaaagatggaagagaaatagttgttccatgtagaaatcaagatgagttagtgggcagagcaagggtgagtcagggggcagggtggagtctacgagagactgcatgtttgggaaaaagttatgcacagatgtggcaacttatgtacttccacagaagagatctcagactcgcagcgaatgctatttgttcggctgtcccggtagattgggtgcccacatcgagaacaacatggtcaatacatgcacaccatcaatggatgaccacggaggatatgttatccgtttggaacagggtttggatagaagaaaacccttggatggaagacaaaacgcacgtttctagttggggagatgtaccatacctaggaaaaagagaagatcagtggtgtggctcattaattggtctaacagccagagcaacatgggcatcgaacatacaagtagcaataaatcaagttcggcgtttaatcggaaatgaaaattaccttgactacatgactagcatgaaacgattcaaaaatgaaggagacccagagggagccttatggtaa

SEQ ID NO: 21651 - RNA, 9879 nt, synthetic construct
  misc_feature 1..9879: note = derived and/or modified CDS sequence (opt6) from DENV-1__GQ868608__SS-prME
  source 1..9879: mol_type = other RNA
tctgtcactatgctattgatgttaatgcctacagcactggcgtttcatttaacgacacgaggaggagaaccacatatgatcgtcagcaaacaagaacggggaaaatcactactttttaaaacaagtgctggtgtgaatatgtgtacactaatagccatggatttaggagaattttgcgaagacactatgacatataaatgtccaaggatcaccgaagctgaaccagacgatgtcgattgttggtgtaatgcaacagatacttgggttacctatgggacttgttcccaaactggtgaacatagacgcgataaacgatccgttgccctagcaccacatgttggactcggattggagacaaggacagaaacatggatgtcatcggaaggagcatggaaacaaatacaaagagttgaaacatgggccttacgccatcctggattcacagtaatagctttatttttagcccatgctatcgggacttcaattactcagaaaggaatcatattcatattgttaatgctggtaaccccgagtatggcaatgagatgtgtaggaatcggatcgagagattttgtggaaggtttatccggagctacatgggttgatgtagttttagaacacggctcatgtgtaactaccatggctaaggacaagccgacgttagatattgaattactaaagacagaagtcactaatccagccgttttgcgtaaattgtgcatagaagcaaagatctccaatacaaccacggacagtcgctgtccgacacaaggtgaagcaacattagtagaagaacaagatgccaatttcgtgtgccgcagaacttttgtagatagaggatggggaaatggatgtggattatttggcaaaggtagtttaatcacatgtgcaaaatttaagtgcgtaaccaaactagaaggaaaaactgttcagtatgagaacttaaaatactcagttattgtaacagttcatacaggtgatcaacatcaagtaggtaacgaaagtactgaacatggcaccactgcgacgatcacaccgcaagcacctagtacagagattcaactgacagactacggcgcattaacgttagattgctccccaaggactggattggacttcaatgaaatggttcttctaacaatgaaagaaaaagcatggctggtccacaaacaatggtttttagacctgcccctaccgtggacgtctggagcatcaacgtctcaagaaacttggaatagaaaagacctattagttacctttaaaacggcacatgcaaagaagcaagaagtagtcgtactaggaagtcaagaaggcgcaatgcacaccgcgctaaccggcgcaacagagatacaaaccagtggtaccaccacaattttcgccgggcacctgaagtgtaggctcaagatggataaacttaccctcaagggaatgtcgtacgtaatgtgtacggggtctttcaaactagaaaaagaagtagcagagacacagcatggcaccgttttagtccagatcaaatacgagggaactgacgcaccctgcaagatcccattctcgactcaagatgaaaaaggtgtaactcaaaacggaaggctaattaccgcaaatccaattgtcactgataaggagaagcccgtaaacatcgaagctgaacccccatttggagaatcttatatagtaataggagcaggagagaaggcattaaaactcagttggtttaagaaaggaagttccatagggaagatgtttgaagctaccgccagaggggcacgacgcatggcgattttaggggatacggcttgggattttggatcaatcgggggagtgttcactagcgtaggtaaactggtccatcaaatattcggaaccgcttatggagttctatttagcggagtgagctggacgatgaaaattgggataggtgtcttacttacatggttaggattaaacagcagatcaacatctttgtcaatgacctgtattgcggttggcttagttacgttgtacctaggagtgatggttcaggccgattcaggatgtgtaataaattggaaggggcgcgaattaaaatgtggatcgggcatttttgttacaaatgaagtacacacatggactgaacaatacaaatttcaagcagattctcccaaaagattatcagcagcgatcgggaaggcatggaaggaaggagtttgtgggataaggtcggcgaccagactggaaaatataatgtggaagcaaatcagcaatgaactgaaccatatattgctggaaaatgacatgaaatttaccgtcgtggtaggcgatgtcgctgggatcctagctcaaggtaagaaaatgataaggccccaaccaatggagtacaaatactcatggaagtcatggggcaaggctaagataattggtgctgacgttcaaaatgcaactttcataatagatggtccaaatacaccggaatgcccggatgaccagcgcgcatggaatatctgggaagttgaagattacggcttcggaatttttacaacgaatatatggctcaaactgagggactcttatacgcaagtatgcgaccatcgtctaatgagcgctgcaattaaagatagtaaggcggtacatgccgatatgggttattggatagaatctgagaaaaatgaaacatggaaattggcgagagcatcatttatagaagtaaaaacatgcatatggccaaaatctcatacactatggtctaatggggtgctagagagcgaaatgattataccaaaaatttatggaggacccattagtcagcacaactataggccgggatattttacgcagacagcgggaccatggcatctcggaaagctagaattagatttcgatctctgcgaaggaacaacagtagttgtcgatgagcattgtggcaacagaggtccatctctgcgaaccacgacggtgaccgggaagatcattcacgagtggtgctgcagaagctgtacattacctccactcaggttcaagggcgaagatgggtgttggtatggtatggaaatccgacctgttaaagaaaaggaagaaaatctagtaaaatctatggtatctgcgggatccggagaagttgattctttctcgctggggttgctttgtatttcgataatgattgaagaagtaatgaggagtagatggagcagaaaaatgcttatgacaggcacattggctgtattctttctattaattatgggacaactaacttggaatgacttaatcagactttgcattatggttggagccaatgcttcagaccgtatgggtatgggtactacttatttagccttaatggctacattcaagatgcgaccaatgttcgcggtcggattattattcagacggctcacatctcgagaggttctgttactaaccatagggttatctctagtggcatcagttgaattacccaatagtttagaggaattaggggatggcttagcaatgggaataatgatactaaaacttctaactgacttccaaagtcatcaattatgggccacgctgctcagcttgacgtttataaaaacaactttttcactacactacgcatggaagactatggcaatggttctttcaatagtgagtcttttccccttatgtctaagcacgacttcgcagaaaacaacatggcttcccgtactcctaggtagtttaggatgcaagcctcttaccatgttcttaatagcagaaaataaaatctgggggagaaaatcttggccgctcaacgaaggcataatggcagtcggcatagtctcgatactcttatccagcttacttaaaaatgacgtacctcttgcgggccccctaattgctggaggaatgttgattgcttgctacgtgataagtggctcatccgcggacttaagcctcgaaaaagctgcggaagtaagttgggaggaagaggctgaacatagtggagcatcacataatatattagtagaagtgcaagacgatgggacgatgaaaataaaagatgaggaaagagacgacatgttgaccatactgttaaaggcaaccctcttagcagtttccggggtatacccactatcaataccagcgacactttttgtatggtatttctggcagaagaagaaacaacgatccggtgtcctttgggatacaccaagtcctcctgaagtagagcgagccgttttagacgacgggatctatagaataatgcagaggggtctacttggtcgctcacaggttggggttggagtattccaagaaaatgtatttcacacaatgtggcatgtcactagaggcgcagtattgatgtaccagggtaaaagattagaaccttcttgggcgagcgtcaagaaagacctgataagttacggtggtggatggaggttacaaggaagctggaatacaggagaagaagtacaagtcattgctgttgaaccaggcaaaaaccccaaaaatgtacaaactgcgcccggaacttttaaaacgagtgagggagaagtgggggctatagcgttagactttaaaccagggactagcggatcgcctattgtaaatagggagggcaaaattgtcggattgtatggcaatggagtggtcacgacatcagggacctacgtatcggccatagcgcaagcaaaagcatctcaagagggaccattacccgaaatcgaagacgaagttttcagaaaacggaatctcaccattatggaccttcacccagggtccggaaaaacgagaagatatctaccggctatagtaagagaggcgatcaaaagaaaactaagaacacttatattagctccaactagggtagtcgcgagtgagatggctgaagccttaaagggtatgccaatcaggtaccaaacaactgcagtaaagtcagagcatactgggaaagaaatagtagacctaatgtgtcatgctacattcaccatgagattattaagtccagtaagagtgccaaactataatatgattattatggatgaggctcatttcacagatccttcttctatagcagccagaggatacatttccactagagtagggatgggtgaagctgcagccatctttatgaccgcaacgcccccaggcagtgttgaggctttcccgcaaagtaacgccgtaatacaagatgaggaacgggatatacccgaaaggagttggaatagcggttatgaatggatcacagacttcccaggaaagacagtatggtttgtaccatctattaaaagtggtaacgatatagcgaactgtctgaggaaaaatggcaaaagagtaatacagctcagccgaaaaacatttgatactgaatatcagaaaaccaaaaataatgactgggactatgtcgtgaccacagacatatcagaaatgggcgcaaatttccgagctgacagggttattgatcctcgtcgatgtctgaagcctgtgatattgaaggatggtccagaaagagtgatattagcaggtcctatgccagtaacggtagcatcagccgcgcaacgacggggtagaataggtaggaaccacaacaaggaaggtgatcaatacatatacatgggacaacccctaaacaatgacgaggatcacgcccattggactgaagctaaaatgttattggacaatatcaacacacctgaagggattatacctgcgctttttgaaccagaacgggagaaaagcgcagccatcgacggtgagtatagactgcgtggagaagcgagaaaaacttttgttgaactcatgcgtagaggagacctccctgtttggctaagctacaaggtagcatcagaggggtttcaatacagtgacagacgatggtgctttgatggggaacgaaataaccaagtactagaagaaaatatggatgtagaaatctggacaaaagaaggcgaaagaaagaaattacgacctagatggctcgacgcaaggacatattctgatccgctagctctgagagaatttaaagagttcgcagcaggacgacggtccgtatcaggagacctcatactcgaaataggaaaactgccacaacatcttacgcagcgtgctcaaaatgcgttagacaacctagtaatgttacataatagcgaacaagggggtcgcgcttatagacatgccatggaggagttaccagatacaatagaaacattaatgttactagcgcttatagcagtattaactggtggagtaactctatttttcttgtctggcagaggattgggaaaaacaagtattggcttattatgtgtcatggcaagtagtgtattattatggatggccagtgtggaaccacattggatagcagcttctataattctcgagttcttcctaatggttttactaattcccgaaccagatagacaacgaaccccgcaggataatcagctagcttatgttgtgataggattactttttatgatcttaacagtagcagcaaacgagatgggattgttggaaacaacaaagaaagatctaggtatagggcacgttgcagtcgaaaaccatcatcatgctgcaatgctagatgtagatttacatccagcatcggcatggacactctatgcagtagctacaacgatcataacgccgatgatgaggcataccatcgaaaacactacggctaacatatctctcactgccattgcaaaccaggccgctattttaatgggattagataaagggtggcctatttctaaaatggatataggtgtaccactactagcactaggatgctattctcaagttaatccactgacgcttacagctgccgtacttatgctagtcgcacattatgcaataataggcccaggacttcaagctaaagcgacaagggaagcccagaaacgtacggcggccggaataatgaagaacccaacagtcgatggtatagtagcaatagatctagaccctgttgtctatgacactaaatttgagaaacaactaggccaaattatgttgcttatactttgtacctctcagattcttttaatgaggacaacatgggcattatgtgagtccattacccttgccactggaccattaactactttatgggaagggtcaccaggcaagttttggaacactactattgcggtgagtatggcgaatatcttcagaggtagttatctagcaggagcgggacttgcattctctctgatgaagagtttgggtgggggacgtagaggaacaggtgcccaaggtgaaacattgggtgaaaaatggaagagacaacttaatcaactgagtaaaagcgagtttaatacttataaaagatctggaattatggaagtagatagatcagaggcaaaggaaggtttaaaaaggggtgaaacaaccaaacatgctgtaagtaggggaacagctaagttgcgatggtttgtagaacgaaacttagtaaaacccgaaggaaaggttattgaccttggttgtggaaggggaggatggtcatattactgcgcaggattaaagaaagtcactgaggttaaaggatatactaaagggggtccgggacatgaagaacccatacctatggctacgtacggttggaacctagtaaaattacactctgggaaagatgttttcttcatacccccagaaaagtgtgatacactactatgtgacataggagaaagcagtcctaatcccactattgaggaaggcagaacactgcgtgtgctaaaaatggtagagccatggctacgcggtaaccagttttgtataaaaattttaaatccatacatgccgtcagtagttgagactttagaacaaatgcagaggaaacatggaggcatgttagtacgaaatcctttatcgagaaattcgacacacgagatgtactgggtcagttgtggaactggtaatattgtctcagccgtaaatatgacgagccggatgttactcaacagatttaccatggcacatagaaaacctacatatgaacgcgacgtcgatctgggtgcaggtacacgacatgtggcagtcgaacctgaagttgccaatctcgacatcataggacaaagaattgaaaatataaaacatgaacacaagagtacatggcattatgatgaagataacccttataagacatgggcctatcatggttcgtacgaagttaaaccctccgggtcagcgagtagtatggtgaatggagtagtcaagttgcttactaaaccatgggacgtcattccaatggttacccagattgccatgactgatacaacgccgtttgggcaacagcgagtttttaaagagaaagttgatacaagaactccgaaggcaaaaagaggaactgcacaaataatggaggtcacagcgaaatggctgtggggttttctttcacgtaataagaaacctcgaatctgtactagggaagagttcactcgaaaagtaagatcaaatgctgctataggtgctgtgtttgtggacgaaaatcagtggaactccgctaaagaggctgtcgaggacgaacgtttttgggatctcgtacatagagagcgagaattgcacaaacaggggaaatgcgccacatgtgtttataatatgatgggaaagcgagagaagaaactaggggaatttgggaaagctaaaggcagtagagctatttggtacatgtggttgggcgcaaggttcctagagtttgaggctttaggcttcatgaatgaggatcattggttctcacgcgaaaatagtctttccggcgtagagggggaaggacttcataaactcggttacatactacgagatatcagcaaaataccaggcggaaatatgtacgcagatgacacggcaggatgggacacaagaatcacagaagacgatctacaaaatgaagctaaaataacggatataatggaaccagaacacgctctactagctaaatctatattcaagctcacttatcaaaacaaggtggtcagagtccaacgaccagctaaaaatggtactgtgatggatgtaatctcccggagagatcaaagaggttcaggacaagtaggcacttatgggcttaatacatttacaaatatggaagctcagttaattcgacaaatggaatcggaaggcatattcagcccatccgagctggaaacaccaaatctggctggtagagttctagactggttagaaaaacatggagtcgaaagactaaaaaggatggcaatatctggggacgactgtgtcgtcaaaccaattgatgatcgctttgcaaccgcattgacagcattaaatgatatgggtaaagtaagaaaagacataccccaatgggagccatccaagggctggaatgattggcaacaggtcccattctgctcacaccattttcatcaacttataatgaaggatggccgtgagattgttgtaccatgcaggaatcaggacgaacttgttggcagagcccgtgtatcgcaaggcgcaggttggtcgctgagggaaaccgcttgtcttgggaaaagctacgcacagatgtggcaactcatgtacttccatcgtagagatttgcggctagcggctaacgccatctgcagtgcagttccagtagattgggtaccaacatcacgaacaacttggtctatccatgctcaccaccaatggatgacgactgaggatatgctttcagtatggaacagagtctggattgaagaaaacccatggatggaagataaaacacacataagcagttggggtgatgtaccttacttaggtaaaagggaagaccaatggtgcggcagtctcataggtctcacagcaagagcaacctgggcaacgaacattcaagtggcgattaaccaagtaagaagattaatcggaaatgaaaactacttggattatatgacaagtatgaaaagatttaaaaatgagatcgaccctgaaggtgctttatggtag

SEQ ID NO: 21652 - RNA, 9879 nt, synthetic construct
  misc_feature 1..9879: note = derived and/or modified CDS sequence (opt6) from DENV-1__GQ199774__SS-prME
  source 1..9879: mol_type = other RNA
tcagttacaatgttgcttatgcttatgccaacagcattggcttttcatttgactactcgcggtggggaaccgcacatgattgtatccaaacaagaaagaggaaaatccttactctttaaaacaagcgcaggcgtaaacatgtgtacgctcatagcgatggatttaggcgaactctgcgaagatacgatgacatataaatgcccaagaatcactgaagttgaaccagatgatgtagactgttggtgcaacacaacagatacttgggtgacatacggaacttgcagtcaaacaggggaacaccgtagagataaaagatcagttgcccttgcgccacatgttgggcttgggcttgaaactagggcagaaacctggatgagtagtgaaggagcatggaaacaaatacaaaaagtagaaacctgggctctaagacacccggggtttacagtaatcgcactttttctagctcacgcaatcgggacatctataacacaaaaaggcataatattcatattgctgatgttggttactccaagcatggccatgcgatgtgttggtatcgggtcacgtgactttgttgagggcttatcgggtgcgacgtgggtagatgtagtactcgaacatgggtcatgtgttaccacgatggccaaagataaaccgacgttagatatagagttgttaaaaacggaagtaacaaacccagcagtccttcgtaaactatgtatagaagccaaaatatcgaatactacaaccgactctcgatgccctacacaaggagaagcgacattagttgaagaacaagacgcaaacttcgtttgtagacgaacttttgttgatagaggatggggtaacggctgtggattgttcgggaaaggtagcttaataacatgcgcaaaattcaaatgcgtaacgaaactagaaggcaaaatagtccagtatgagaatctaaaatactccgtgatcgttacagttcacacaggagatcaacaccaagtcggaaatgagagtactgagcatggaacaatcgcaactataacccctcaagcacctacatcggaaatccaattaaccgactatggagctcttaccctagactgctcccctagaacaggacttgattttaatgaaatggtgttattaaccatgaaagaaaaatcttggttagttcataaacaatggtttctagacctaccactcccgtggacatcaggtgcttcgaccagtcaggaaacttggaatcgacaggatttgttagtaacattcaaaacagcacacgctaagaaacaagaagtagtggtcttaggctcacaggagggggccatgcacacagcattgactggagcaacagaaatccagaccacaggaactacgacgatatttgccggtcacttgaaatgcaggttaaaaatggacaaattaacactaaagggcatgtcatatgtaatgtgtacaggttctttcaaattagagaaagaggtagcagaaacgcagcatggtacggtattagttcaaataaaatatgaaggaaccgacgctccgtgtaagataccatttagcactcaggatgagaaaggagtgacacaaaacggtagattaataacggcaaaccctattgtcactgacaaagaaaaaccagtaaacattgaagcagagcctccatttggagagtcgtatatagtaataggtgcaggggaaaaagcattaaaactatcatggtttaagaaaggatctagcatcggcaaaatgtttgaagcaacggctaggggagcaaggagaatggccattttgggcgacacagcctgggatttcgggtcaatcggaggagtctttacttctgtaggcaagctagtacatcagatattcggaactgcttatggagttttattttccggcgtgagttggacaatgaaaattggtataggagtgttactcacctggttgggtctgaatagtaggagcacgagcttgtccatgacatgtatcgctgtaggtttgattactctgtatctgggggtcatggtacaggcagacagcgggtgtgtcatcaactggaaaggtagggaattaaaatgtggctcaggaatatttgtgaccaatgaggtacatacgtggacagaacaatataaatttcaagcagactccccaaaaaggttatctgctgcgataggaaaagcctgggaagaaggggtatgtgggataagatcagcgacaagactcgaaaatattatgtggagacaaatttcaaatgaattgaaccacattctactagagaatgatatgaaattcacagtggtggtgggagatgttgtgggaatattggcccaaggcaagaaaatggtaaggccccagccgatggaacataagtattcgtggaagagttggggaaaggcaaaaataattggagcggatgtacaaaacactacattcattatagacggaccaaacacacccgagtgtccagacgatcaaagagcatggaatatatgggaagttgaagattatggttttgggatatttacaaccaatatatggctaaaacttagggactcatatacacaagtctgcgaccacagattgatgtccgcagcgatcaaagacagcaaagcagtgcacgcagatatgggatattggattgaaagtgagaaaaatgaaacatggaaactcgcccgagcttcttttatcgaggtgaagacttgcatctggccaaaatcccatacattgtggtcaaatggcgtgcttgagtcagaaatgatcattccaaaaatctatggaggaccaatttcacaacataactacagaccgggttactttacacaaaccgctggaccgtggcatttaggaaaacttgaactagatttcgacctctgtgaagggactacggtagttgtcgatgaacattgtggtaataggggaccgtctctccggacgacgacggtcacaggaaaaatcatacacgagtggtgttgccgaagctgtacgctaccaccattacgcttcaaaggagaggatggatgctggtatggaatggaaatcagacctgtacgagagaaagaagaaaacctcgttaaatctatggtttcggctggatcgggcgaagtagattctttttcactgggtttgctctgtatctcaataatgattgaagaggtaatgagaagtaggtggtcgaggaagatgctaatgacgggaacactggctgtattctttttactaattatgggtcaactaacgtggaacgatttaataagaagttgtataatggtaggtgctaacgcttcagatagaatgggaatgggaactacgtatctcgcactgatggcgacattcaaaatgagacctatgttcgcggtgggtttacttttcagacgattgaccagtagagaagtgttattactcaccatcggtttgagcctagtcgcaagtgttgaattaccgaatagcctagaagaattaggagatggactggcaatgggaattatgatactaaaattattgactgattttcaaagctaccaactctgggccactttattgtcattgactttcataaagacaacattttcactacactatgcttggaaaacaatggccatggttttgtctattgtatcacttctgcccctctgcttgtctacaacatcccagaaaactacttggcttccagttttactgggcagtcttggttgtaaaccactaacaatgtttttaatcgcagaaaataaaatttggggtcgaaaatcgtggcctttgaatgaaggaattatggcagtagggatagtctctattcttttatccagtttactgaaaaatgatgtacctttagcaggtccactcattgccggtgggatgttaatagcgtgttatgtcatatctggcagttcggctgacttatctttagaaaaagccgcggaggtctcctgggaggaagaagccgagcattccggagcgtcgcataatatcttggtagaggtgcaagatgatgggacgatgaaaattaaagacgaggaacgggatgacacactaactatcttattgaaggctacattactcgctgttagtggagtgtaccccctatctattcctgcgactctatttgtttggtatttctggcaaaagaaaaagcaaagaagtggtgtcctttgggacacacccagcccgcctgaagtcgaacgggcagtcttagacgacggcatttatcggataatgcagagaggattactagggagaagccaagtgggtgtgggagtgtttcaagaaaacgtgtttcatacaatgtggcacgtaacgagaggagcagttttaatgtaccaggggaagcgactagaaccatcatgggcttctgtcaagaaagatctcattagctatggcggcgggtggagactccaagggtcctggaatacaggtgaagaggtacaggttattgcagttgaacctgggaagaatcccaaaaatgtgcaaacagcgcccgggactttcaagactcccgaaggagaggtaggagcaatagcactagattttaaaccgggtacctctggatcgcctatcgtcaacagagaaggtaaaatagtaggcctatatggcaacggagtggtaactacctccggaacgtacgtatcagcaatagcgcaggcgaaagcatcacaagaaggacctctacctgaaatagaagatgaggtttttagaaaaaggaatttaaccattatggatctgcaccccggatcgggcaagactcgtagatatttgcccgctattgtgagagaagcaataaagcggaaactaaggacacttatcctagcaccaacacgtgtagtagcgtcagaaatggcagaagctctaaaaggtatgcctattcgctatcagacaacggccgtaaaatcagagcacactggacgagagatagttgacttaatgtgtcacgcaacgtttaccatgcgtctcctaagtcctgtgagggtacctaattataacatgattataatggatgaagcacacttcaccgacccaagttccattgcggcacggggatacataagtacccgagtaggcatgggcgaagctgccgcaattttcatgacggctacgccaccagggtctgtagaagcctttccacaatcgaacgcggttattcaagatgaagaaagggacattcctgagcgcagctggaatagcggttatgaatggataactgattttcctggtaagacagtctggttcgtaccttctatcaaatccggcaatgatatagcaaattgcttaagaaagaatggaaaaagggtaatacagctctcaagaaaaacattcgatacggaatatcaaaagaccaaaaataatgactgggactacgtagtcacaacagatatttcggaaatgggagccaattttagagccgatagggtaattgatccccgtagatgtttgaaaccggtaatattaaaagacggacccgaaagagtaatattagcgggccctatgccagtaacagtggcctccgcagcacagagacgtggaagaataggtcggaatcataacaaggaaggggatcaatatatatacatgggacagcctctgaacaatgacgaagatcatgcccattggacagaagcaaaaatgttgttagataatatcaacacccctgaaggaataataccagcattattcgaaccagaacgggaaaaatcggcagcaattgacggggaatacaggctacggggagaagcaaggaaaacctttgtcgaactcatgagaagaggcgacttaccagtctggctatcatacaaagtagccagcgaaggattccaatactcagatcgacgatggtgttttgatggtgaacgaaataaccaagtactagaagagaacatggacgtggaaatttggacgaaagaaggcgaaaggaagaaattaagaccacgatggttagatgctaggacgtatagtgacccactggcactgagggaatttaaggagtttgcagccggcagacgcagcgtatcaggagacctcatactcgaaattggtaaattaccccaacacttgacacaacgagcccaaaatgcattagacaacctagtaatgcttcacaactcagaacagggcggacgtgcgtacagacacgctatggaagaacttccagacacgatagagactctaatgttactggccttaatagcagttctgaccgggggagtcacactattcttcttatcagggcgtggactcgggaagacatccatagggttgttatgtgtaatggcaagtagtgcgttgctatggatggcttctgtcgaaccgcactggattgccgcaagtataatactcgagttctttcttatggttttattaatccctgaaccagaccgtcagagaactccacaagataaccagcttgcttatgtagtaattggtcttttatttatgatattaacagtagcagcgaatgaaatgggactattagaaacgaccaagaaagatctagggattggccatgtggcagtagaaaatcatcatcatgcaacgatgctcgacgtagacttacatcccgcgtctgcttggacattatatgctgtagcaacaacgatcattacacccatgatgcgtcacaccatcgagaataccacggcaaatatctccctaacagcgatagctaatcaggctgctatcttaatgggacttgataaaggttggcctatatccaaaatggatatcggagttccgctacttgcactaggctgttactcacaagtaaacccccttacactaactgcagcagtgctaatgttagtcgctcattacgccatcataggtcctggcctgcaagcaaaggcaactagagaagcacaaaaacgcactgcggctggcattatgaaaaaccccacggttgacggtatagtggcgatagatttggatccagtagtatacgatgctaaatttgaaaagcagctaggacaaattatgctcttaatattatgcacgagccaaattttgttgatgaggaccacatgggctctatgtgagagcattactttagcaacaggaccactaaccactttatgggaaggcagcccggggaaattctggaacacgacaatagctgtttcaatggcaaacatctttcgtggttcttatttggcgggagcagggcttgcattttctctaatgaaatcactaggaggtggtcgaagaggtacaggcgctcaaggtgaaacactcggagaaaaatggaagagacaattaaatcagttgagtaaatcggagttcaatacgtataaaagatccggtatcatggaagttgaccgtagtgaggcgaaagaaggcttacggaggggcgagaccactaaacatgcagtttctcgaggcacagcgaaattaagatggtttgttgaacggaacctagtaaaaccagagggaaaggttattgacctgggatgtggcagaggaggttggtcctattattgtgccggcttaaagaaagtaacggaagtcaagggatatacgaaaggagggccaggtcacgaagaacccatacctatggcgacgtacggatggaatttggttaaattacattccggaaaagatgtgttctttataccgccagagaaatgtgacactctactatgcgatataggagaatcaagtcccaatccaactatagaagaaggtagaacactgagagtcctaaaaatggtagaaccatggctaagaggaaaccagttctgcattaaaatcctcaacccatacatgccatcagttgttgagacattggaacacatgcaaagaaaacatgggggtatgttagttcgtaatccattgagccggaactctactcacgagatgtattgggtttcatgtggaacaggaaatatagttagtgccgtcaatatgacttcgaggatgcttttaaatagatttaccatggctcatcgaaaaccaacatatgagagagacgtagacctaggtgctggcacaaggcatgtggcggttgaacctgaagtggcaaatcttgacatcatcggacaaaggatagagaatatcaaacacgaacacaaatcaacctggcactatgatgaagacaatccctacaaaacttgggcatatcatgggtcttacgaagtaaaaccaagtggctcagcgtcttctatggtaaatggagttgtcaaacttttaaccaaaccatgggacgtaatccccatggtaacacaaatcgccatgacagatactactcctttcggacaacagagagtctttaaagagaaagtggacacaaggacacccaaagcaaaacgaggtacagcacaaataatggaagtcactgcccgttggctctggggcttcctatcacgaaataagaaaccgagaatttgtacgagagaagaatttaccaggaaagtaagaagtaacgccgcgattggtgcggtctttgtcgatgaaaatcaatggaactcagctaaagaagctgttgaagatgaacgcttttgggacctcgtacacagggagcgtgaactacataagcaaggtaaatgcgccacgtgcgtttacaacatgatgggaaaacgcgagaagaaactcggtgaatttggaaaagccaaaggaagccgtgcaatatggtatatgtggttaggggccagatttttagaatttgaagccttaggattcatgaatgaagaccattggtttagcagagaaaattctttatcaggagtagagggtgaaggattgcataaactaggatatatattgcgcgatatatcgaagatcccagggggaaatatgtacgccgatgatactgctggttgggatactcggattactgaagacgatcttcaaaatgaagctaaaatcactgacattatggaaccagaacatgcattgcttgcaacatctatatttaagctgacctatcaaaataaagtcgttagggtccaaagacctgccaaaaatggaacggtgatggatgttatttcaagacgagatcaacggggatcaggacaggttgggacgtatggtcttaacacgtttaccaacatggaagcccaactaataaggcagatggagagtgaagggatctttagtccaagcgaattagaaacacctaacctagcggagagggttctagattggctcgaaaaatatggagttgaaagacttaaaagaatggcaatttccggtgatgactgtgttgtcaaaccaatagatgacaggtttgcaactgccctaaccgctttgaacgatatgggaaaagtcaggaaagacattccacaatgggaaccttccaaaggatggaacgattggcaacaagttcccttttgcagccaccatttccatcaattaataatgaaggatggacgagagattgtcgtaccatgtcgtaatcaagacgagttagtaggtagagcaagagtttcgcaaggagcgggctggtctctgcgtgaaacagcatgcttggggaaaagttatgcgcaaatgtggcaactcatgtattttcatcgccgcgacctacgtttggcggccaatgcaatatgcagcgcagttccagttgactgggtacccacatcgagaacaacctggtctattcacgcacaccatcaatggatgacaactgaagacatgctgtccgtgtggaatcgcgtatggattgaagaaaacccatggatggaagataaaactcatatttcgtcctggggtgatgttccatacctgggtaaaagagaggatcaatggtgtggtagcctaataggactaacagcacgtgctacatgggcaaccaatatccaggtagcaataaatcaagtacggagattgattggaaacgaaaattacctggattatatgacctcaatgaaacgattcaaaaatgagtcagatcctgagggcgctttatggtag

SEQ ID NO: 21653 - RNA, 9879 nt, synthetic construct
  misc_feature 1..9879: note = derived and/or modified CDS sequence (opt6) from DENV-1__GQ199775__SS-prME
  source 1..9879: mol_type = other RNA
agtgtaactatgctcttaatgctgatgccaactgcgctagcttttcatctaactacacgcggtggagaaccgcatatgattgtatcaaaacaagaacgcgggaaaagcctgctatttaaaacatcggcaggagtaaatatgtgtactcttatagcaatggacttaggagaattatgtgaagataccatgacgtacaaatgtccaaggataaccgaagtcgaaccagacgacgtagactgttggtgcaatacaacagatacctgggtaacctatggtacatgtagtcaaacaggggaacatcgacgagataaaaggtcagttgcacttgctccccatgtcggattaggtcttgaaacgagggctgagacatggatgagttcggaaggagcatggaaacaaattcaaaaagtagaaacttgggcactgaggcatcctggcttcaccgtaatcgcgctatttttagctcacgcaataggaactagcattactcaaaaaggaatcatttttatattattgatgttagtcacaccgagtatggcaatgcgatgcgtaggaattggttctagagatttcgtcgaagggctaagtggcgcaacatgggtcgatgtcgtattagaacatggcagctgtgttactacgatggcaaaagataaaccgacgctggatatagagctattaaaaacggaagtaacgaaccccgctgttctccgaaaactctgcatcgaagcaaaaatttcgaatacaaccaccgactcacgatgcccaacacaaggagaagcgaccttagtagaggaacaagatgcaaattttgtgtgtagaagaacatttgtagatagaggatggggcaatggatgtggtttgtttggaaaaggaagtctaataacttgcgcaaaattcaaatgcgtaacgaaattagaagggaaaattgttcaatacgaaaatttaaaatattctgtgattgtaactgtacacacgggcgatcaacaccaggtaggaaatgaatcaactgagcacggaacaatagctacgataacccctcaagcacccacgtcagaaatacagctcacagattacggagcactaacattagactgctctccaagaacagggttagatttcaacgaaatggtattattgactatgaaagagaaaagttggctagtacataaacaatggtttctcgacctgccgctaccatggacttctggagccagcacatctcaagaaacttggaatcgacaggacctattagtcaccttcaaaaccgcacatgctaagaaacaagaggtagtcgtgttagggtcgcaagaaggagcaatgcatactgctctaacaggtgccaccgaaatacaaacgactggtactacaacaatattcgcaggtcatctaaaatgcagattgaaaatggataaactaaccctgaaaggtatgtcgtatgtcatgtgtacaggctcgtttaaactggaaaaagaagtagccgaaacacaacatggaacagtcctcgttcagataaaatacgaaggtacagatgctccgtgtaaaattccattttcaacgcaagacgaaaagggagtcacacagaatggacgacttataacagcaaacccgattgtaacagacaaggagaaacccgtcaatatcgaggcagaacctccgttcggggaatcttacatagtaataggagctggtgagaaggccctaaaactgtcctggtttaagaaaggatcaagtataggcaagatgtttgaagctacggcacgaggagctcgacgcatggcaatattaggcgatacggcatgggacttcggttcaataggtggagtttttacaagtgtaggaaagctagtccatcaaatcttcggaacggcatacggtgtcctcttcagcggagtgagctggacgatgaaaataggtataggtgtattattaacctggttaggacttaactctcggagcacgagcctatcaatgacgtgcatcgcggtaggtctcataacactttatttgggagtgatggttcaggctgattccggatgcgtcattaattggaaggggcgtgagcttaaatgtggtagtggaatttttgtgacaaacgaagtacatacttggacggaacaatataaatttcaagccgactcacccaaaaggttgtcagccgcaattggcaaggcttgggaagaaggggtttgcgggataagaagcgccacgcgacttgagaatataatgtggcgacaaattagtaacgaacttaatcacattttattggagaacgacatgaaatttacagtagttgtcggagatgttgtgggcatactagctcaaggcaagaaaatggttagacctcaacccatggaacacaaatacagttggaaatcatggggaaaagctaagataataggggccgacgttcaaaatacaacattcattatagacggcccaaatactccggagtgcccggatgatcagcgtgcctggaatatctgggaagtagaagactatggtttcggcatctttactactaatatttggttaaagttacgagattcatatactcaagtatgcgatcacagattaatgagtgcagctataaaagattctaaggcagtgcatgctgacatggggtattggattgaaagtgaaaagaacgagacatggaagttagcacgtgcttcttttatcgaagtaaagacttgcatttggcctaagtcccacacattatggagcaacggggttctggagagcgaaatgattataccgaaaatttatggaggacctatttcgcaacacaactatcgaccgggatattttactcaaacagctggtccctggcacttaggaaaattggaactagattttgacctatgcgagggaactacagtcgttgttgacgagcattgtggaaacagaggtccatcattacgaactacaactgttacgggaaaaattattcacgaatggtgctgtcgttcttgtacactacccccactgcgttttaaaggcgaagacggctgctggtatggcatggagatacgacccgtacgagaaaaagaagaaaaccttgtcaagtcgatggtatcagcaggctcaggagaggtagatagtttcagcttaggattactttgtataagtatcatgatagaagaagtaatgagatcgagatggtcgcggaaaatgttgatgacaggcacattagcagtattctttttattgataatgggacaacttacatggaatgatttaataaggagttgcatcatggtaggtgcgaacgcatctgatcgaatgggtatggggacaacatacttagccttgatggcaacttttaagatgagacctatgttcgcagtcggtcttctgtttcgaagactaacatcgagggaggttttgctcctaacgataggcctctctttagtagcatccgtagaattacccaacagtttagaagaattaggcgacggtcttgcaatggggataatgatactcaagttgcttacggactttcaatcttaccaactatgggcaacacttttaagtctcaccttcataaaaactacgttcagcctacattatgcctggaagactatggctatggttctgtcaattgtgtctttacttcctttatgcctttcaacgacaagtcagaaaactacctggctgccagtattgttggggtctttaggctgcaaacccctcactatgtttttaatagcagagaataagatttggggccgtaagagttggcccttaaatgaaggaattatggcagtcggaattgtcagcatcttactctcgagtctacttaaaaatgacgtacctttggcaggtccactcatcgctggaggaatgctcatagcctgttatgtcatttctggatccagcgcagacttatctctcgaaaaagctgcagaagtaagttgggaagaagaggcagagcatagcggggcaagtcataatatattagtcgaggtacaggatgatgggactatgaaaattaaagatgaggaacgggacgataccttgactattttattaaaagctacattattggcagtatcaggcgtttaccccctcagcattccagcaacgttattcgtctggtacttctggcagaagaagaaacaaagaagtggagtgttatgggataccccatccccgccagaagtagaaagagctgttttagatgacggaatatatagaattatgcaacgaggcttactaggtcgaagccaagttggtgttggagtgtttcaagaaaacgtgtttcacacgatgtggcatgtcacacgcggcgcagtgttaatgtatcaaggtaaacggttagagcctagttgggcatcagttaagaaagatttaattagctacgggggtggctggagattacaaggctcttggaacacaggagaagaagtacaagtaatagctgttgaacccggcaaaaatcctaagaatgtccaaactgcccctggaacctttaagacaccagaaggtgaagtaggtgccatcgccttggacttcaaacctggtacttcgggatcaccaatagtgaatagagaaggaaaaattgttggattgtatggtaacggagttgtaacgacaagtggcacttacgtgagtgcaatagcccaggcaaaggcttcacaagaaggaccactaccagagattgaggatgaggtatttagaaaaaggaatttgaccataatggacttgcaccccggttcaggaaaaactaggaggtatttacctgcgatagtcagggaggctataaaacgtaaactaagaacattaatactagcaccaacacgagtagtcgcatctgaaatggccgaagccttaaaggggatgcccataaggtatcaaaccactgccgtgaaaagtgaacatactgggagagaaattgtcgatctaatgtgtcacgcaacattcactatgcgcctactaagtccagtgcgtgttccaaattacaatatgataattatggacgaagctcatttcacagatccatcgtcaatcgcagccaggggatacatatcgaccagagttggaatgggcgaagccgccgcgatatttatgacggcaactccacccggtagtgtagaagcatttccacaatccaacgccgttattcaagatgaagaacgagacatacctgaaagatcgtggaactcaggttatgaatggataacagactttcctggtaaaactgtatggttcgtaccgagcataaaaagtggaaacgacatcgcgaattgcctgcggaaaaatggcaaaagagttattcaactttcaagaaaaacgtttgatactgaatatcagaagaccaagaacaatgattgggactatgttgttacgacagacatatcagaaatgggcgcaaatttcagggcagacagagttatcgacccaagacgttgcttgaagcctgtcatattgaaggatgggccagaaagagtgattctagctggacctatgccggtaacagtagcctccgccgcccagagacgagggagaataggtagaaatcacaataaggagggagatcaatatatctatatgggacaacccctaaataacgatgaagatcatgcccactggactgaagcgaaaatgttgctagataacattaatacccctgagggtataataccagcattatttgaacccgaacgagagaaatcggccgcgattgacggagaatatcgattacgcggagaagcgagaaagacttttgttgagttgatgcgacgcggagatcttcctgtatggctgagctacaaagtagcgtcagaaggatttcaatattcggatagacgttggtgttttgacggtgaaaggaacaatcaggtcttagaagaaaacatggatgtggaaatatggacaaaagaaggtgagagaaagaaactcagaccaagatggttagacgcacgaacatattcagatcctttagcattacgagagttcaaagaatttgcggccgggcgtcgatcagtatctggagatctaatattagaaatcggtaaactgcctcaacacttaacacagagagctcaaaacgctttagataatcttgtaatgttgcacaattcagagcaaggaggacgagcatatcggcacgcaatggaggagctaccggacacaatcgaaaccttgatgttgttggccttgatagccgtcctaacaggaggtgtaacgctgttctttttaagcggaagaggactaggaaagacatccataggtttactctgtgttatggcaagtagtgcgttgttatggatggcatctgtagaaccacactggattgccgccagtataatactcgagttctttcttatggtattgctaattccagaacccgatcgtcaacggacaccccaagataatcaattggcgtatgtggtcataggattgttatttatgattttaactgtagctgctaacgaaatgggactgttagaaacgactaagaaagatcttggaataggccatgtcgcagtagaaaatcatcaccacgctactatgttagatgtagatctccatcctgcaagcgcttggaccttgtacgcagtagcaactaccattatcactccaatgatgcgccatacgatagaaaacaccacagcaaatatatctctaactgcaatagctaatcaagcagcaatcctaatgggacttgacaaagggtggccgatatccaaaatggatattggagtaccattactagccctggggtgttacagccaggtaaatccgttaactctgactgcagctgtattaatgctcgtagcacactacgccataatagggccaggcttacaagcaaaagcaacaagggaggcacaaaagaggactgccgcaggcataatgaagaatccaacggtggatgggattgtagctattgacctcgaccccgtagtatatgacgcaaagttcgaaaaacaattaggacaaatcatgcttctaatactatgcacttcacaaatcttactcatgagaacaacttgggcattatgtgagagcatcacgttagctactggaccgctcacaaccttatgggaaggatctccgggaaaattctggaacacaaccatcgctgtaagtatggcaaatatttttagaggaagttatctagctggtgcaggtctggcatttagcctaatgaaaagcctagggggcggtcgtagaggaactggggctcagggggagactctgggagaaaaatggaaaagacagctaaatcaactctcgaaatcagaatttaacacgtataaaagatcagggattatggaagttgatcgtagtgaagccaaagaaggacttcgtagaggagaaacaacaaagcacgccgtaagccgaggaactgctaaattacgatggtttgttgaaaggaatctagttaaaccagagggaaaagtcatcgatttaggatgcggaaggggaggttggtcatactattgtgctgggctaaagaaagttacagaagtcaaaggatatacaaagggaggaccaggacacgaggagccaattcctatggcaacatatggatggaacctagtgaaactacatagcgggaaagatgtgtttttcatcccgcctgagaaatgtgatacacttctctgtgatatcggcgagtccagtccaaatccaacaatcgaagaagggagaacacttagagttcttaagatggtagaaccatggttaaggggaaatcaattttgcataaaaatattaaatccctacatgccatctgtagtggaaacactggaacacatgcaacgaaaacatggaggaatgttagtaaggaaccccctaagcagaaattctacgcatgaaatgtattgggttagttgcggtacgggcaacatagtttctgcagttaatatgacgtcaagaatgttactgaataggtttaccatggcccataggaaaccaacttatgagagggatgtagacttaggagctgggacaagacacgtagctgttgaacctgaagtagcaaacctagatatcatcgggcaaagaatagaaaatatcaaacatgaacacaaatcgacatggcactacgacgaggataatccgtacaagacatgggcctatcatggttcgtacgaagtcaaaccatcgggatccgcttcgtccatggtaaatggtgttgttaaactcttaactaaaccgtgggatgtaatacctatggtgacacaaatagctatgaccgataccacgcctttcgggcaacaaagagttttcaaggaaaaagtggacacaagaacgcccaaagcaaagagaggaactgctcaaatcatggaggtaaccgcgagatggctatggggctttcttagtcgaaataaaaagccccgcatttggacgagagaagaggtaactcgcaaagtccgatcaaacgccggcatcggcgcgggtgtgggtgatgaaaatcaatggaatagcgccaagaaaggcgttgaagatgaacgattctgggatctagtacaccgtgaaagagaacttcataaacaagggaagtgcgcaacttgtgtatataatatgatgggtaagagagagaagaaactaggagaatttggtaaggctaagggcagtcgtgcgatatggtatatgtggctcggcgctcgatttctcgagttcgaagccttgggttttatgaatgaagatcattggttctctagggaaaattctttatctggtgttgaaggcgaagggctacataaattaggttacatactaagagatataagtaaaatccctggtggaaatatgtatgctgacgataccgctgggtgggatacccgaataacggaggacgatctacagaatgaagcaaaaattactgatataatggagccagaacatgccttattagcaacctcaatattcaaactgacttatcaaaataaggtggtaagggtacaacgcccggcgaagaatggaactgtaatggacgttatatcaagacgtgaccaaagaggatcgggtcaggtcggcacatatgggttaaatacatttactaatatggaggcacagttaatacgtcagatggaatcagagggcatattttcgccttcagaattggaaacaccaaatttagcagagcgggtactagactggttggaaaagtatggcgttgagagactaaaacggatggcaatctctggtgatgactgtgtagtgaaacctatagatgataggtttgccactgctcttactgcacttaacgatatgggaaaggtaagaaaagatattcctcaatgggagccatcaaaggggtggaacgactggcaacaagttcccttttgttctcaccattttcaccaattgattatgaaggacggaagagaaatagtcgttccatgtaggaatcaagatgaattggtaggtagagcaagagtctctcaaggcgctgggtggagcttaagagaaacagcctgtctaggaaaaagttatgcccaaatgtggcaattaatgtattttcatagacgtgatctcagacttgccgcgaacgctatatgttctgctgtcccagttgattgggtcccgacctcaaggaccacatggagtatacatgcgcaccatcaatggatgacaacagaagacatgctaagcgtttggaaccgtgtttggattgaagagaatccttggatggaagataagacacacattagcagttggggagatgtaccctatctaggtaagcgggaagatcagtggtgtggatcacttataggattaacagcgcgagcaacttgggccacaaatatccaagtagcaataaatcaagtgcgaagattaattggaaatgaaaactacctagattacatgacctcaatgaaacgatttaagaacgaaagcgatccagaaggagcgctttggtag

SEQ ID NO: 21654 - RNA, 9876 nt, synthetic construct
  misc_feature 1..9876: note = derived and/or modified CDS sequence (opt6) from DENV-1__FJ882546__SS-prME
  source 1..9876: mol_type = other RNA
agcgtgacaatgttactgatgttaatgcctacagctctagcatttcacctcacaacacgaggaggtgaaccccacatgatcgtaagtaaacaggagagaggaaaatctttgcttttcaaaacaagcgcaggcgttaacatgtgtactttgatcgctatggaccttggagaactatgtgaagatacaatgacatacaaatgtccccgcataaccgaagcagaaccagatgacgtggattgttggtgcaacgccacggacacatgggtaacctatggtacatgcagtcaaacaggggaacatcgtagagataaaagaagtgtggcgctggccccacatgtgggattaggtctagaaacgaggactgaaacctggatgagtagtgaaggagcgtggaaacaaatccaacgagtagaaacatgggcattaagacatcccggatttaccgtcatagcattatttttagcgcatgctataggaacaagcataactcaaaaaggaattatatttattctcttgatgcttgtgacaccaagcatggcaatgagatgtgtcgggatcggcagcagagattttgtagaaggattaagtggtgctacatgggttgatgttgtactggagcacggatcttgcgttactacaatggccaaagataaacctacattggatatcgaactactaaagacagaagtaacgaatcctgctgtactacgcaaactgtgtatcgaagcaaaaataagtaatacgactacagattccaggtgtccaacacagggtgaagccactttggtagaagaacaagatgctaattttgtttgtagaaggacctttgtagatcgtggctggggaaatggttgcggcctttttggtaaaggaagcctcattacttgtgcgaaatttaagtgtgtcacaaagttagaaggaaaaattgttcagtacgaaaacctgaagtattctgtaattgtaacggtgcacaccggtgatcaacatcaggtgggaaatgaaagtacggaacacggcacaacagcaacaataactccacaggcacctacaactgaaatacaactaacagactatggtgccctgactcttgattgctctcccagaacaggacttgattttaatgaaatggttctattgacaatgaaggaaaaaagttggctagtacacaagcaatggtttttagatttacctttaccgtggactagcggcgcgtcgacctcccaagagacgtggaatcgtcaagaccttctggtcacatttaaaactgcgcacgcaaagaaacaagaagttgtagtgctaggatcacaggaaggagcaatgcacacggcattaactggggctacggaaattcagacctcaggtacaacaactatatttgccggacatttgaaatgtagattaaaaatggataagcttaccttaaagggtatgagttacgtaatgtgtacaggaagtttcaaattggaaaaagaagtggcagaaacccaacatggtaccgtactagtacaaataaaatacgaaggtacagacgcaccatgcaaaatacccttctcaacccaagatgagaaaggggtcactcaaaacgggcgactaataacagccaatccaatagtgacggacaaggaaaaacctgtcaacattgaagctgaacccccgtttggcgagagctacatagttattggcgcaggggaaaaagcgttaaaactgtcatggttcaagaaaggctcgagtataggaaaaatgttcgaagccacagccaggggagcacgcaggatggcaatcttaggagatacagcatgggattttgggtcaattggcggtgtctttaccagtgtaggtaaacttgttcatcaaatattcggaacagcatatggtgtgctattttcaggagtcagttggacaatgaaaattggtattggcgtccttctaacttggttagggctaaactcaagatcaacatcattatcaatgacctgtatcgctgttgggcttgtcactttatatcttggtgtaatggttcaagcagactctggttgcgttatcaattggaaaggaagagagttaaagtgtggatccggtatttttgtaacaaacgaggttcacacatggacagaacaatataaatttcaagcggactccccgaaaagactttctgccgccatcggcaaagcatgggaagagggtgtctgtggaatcagatcagccactaggttagaaaacataatgtggaaacagatttctaatgagttaaaccatatattactcgaaaacgacatgaagctaacggtagtcgtaggagacgttgctggaattcttggacagggaaagaaaatgattagaccacaaccgatggaatataaatactcgtggaaaagctgggggaaggcaaagattattggtgctgatgctcaaaacactacgtttatcatagatggacccaacactcctgaatgtccagatgaccaacgtgcatggaacatatgggaggtagaagactacggattcgggatatttaccacaaatatctggcttaaacttagagattcgtacacacaggtatgtgaccatagactcatgagcgcagcaatcaaagatagtaaagccgtgcatgcagacatgggatattggattgaaagtgaaaaaaatgaaacttggaaactagctcgggcgtcttttatagaagttaaaacgtgtatatggcccaaaagccatactctctggtccaacggcgtcttagagtcagaaatgataatacccaagatttacgggggcccgatatcacaacacaactatagacctggatacttcacacagacggcgggaccgtggcacttaggaaaactcgaattggatttcgacctttgtgaaggaacaacagtggtagttgatgaacattgtggaaacagaggccccagcctccgaacaactactgtaaccggaaaaataatccatgaatggtgttgtcgatcctgcaccttacctcctcttaggttcagaggagaagatggatgttggtacggaatggaaatacgtccagtaaaagagaaagaagaaaatttagtaaaatcaatggtgagtgcaggttccggagaagtggattcttttagcctgggcttactttgcataagcataatgatcgaggaagttatgcgatctagatggagccgtaaaatgttaatgactgggacactagcagtattctttttactgataatggggcaactaacatggaatgacctaataaggctatgcattatggtcggggctaatgcaagtgatcgcatgggcatgggtacgacatacttagcgttaatggcaacatttaaaatgagaccaatgttcgctgtaggattattatttcgtcgactaacctcaagagaagtactactcctaaccattggtctcagcttggtagcaagtgtagaactcccgaacagtttagaagaactaggagatggactagccatgggtatcatgattctaaagcttctgacggattttcaaagtcatcaactttgggccacattgttatctcttacgttcattaaaacaacatttagtctacattacgcttggaaaactatggccatggtattatctatcgtgagtttatttcccctctgcctttcaacaacatctcagaaaactacttggttgcctgtattattagggtctttgggatgcaaaccactaacgatgttcttaatcgctgaaaataagatatggggaagaaaaagctggccacttaacgaaggtattatggctgtaggcatagtgagtatactactgtcaagtctactcaaaaatgatgtgccattagctggacctctcatagccggtggaatgttgatagcatgctatgtgatcagtggatcttcggcagatctgagtttagaaaaagcggccgaagtatcttgggaagaagaagctgagcatagtggagcatcacacaacatattagttgaggtacaagatgatggtacaatgaagattaaagatgaagaaagagatgacactctaacaattttactaaaagctactctattagcagttagtggcgtctaccctctttcaatacctgcgacgctgtttgtatggtatttctggcaaaaaaaaaaacaaaggagcggtgtattatgggacacaccatccccccccgaagttgaaagagcggtgctcgatgatggaatataccgaattatgcaacgaggcctgttaggcagatcacaggtaggagtaggagtattccaagagaatgtttttcacacaatgtggcatgtaacaaggggagctgtgctaatgtatcaaggaaagcgactagaaccatcatgggcgtctgtcaaaaaagacctaatttcatacgggggaggatggagattgagaggttcttggaacacgggggaggaagtacaagttatcgcagtggagcccgggaagaatcctaagaatgtacaaacggcaccgggtacattcaaaacaccggaaggagaagtaggggcgatcgctctcgatttcaaaccgggaacaagtggatcccctattgtgaatagagaaggaaaaatagtcggactttacgggaatggagtagtaacaacctcaggcacatacgtttcagcaatagcacaagccaaagcgagtcaagaaggtccattaccagagatcgaagatgaggtgttcaggaagagaaatctaacaataatggaccttcacccaggtagcggaaaaactcgaaggtacctacctgctatagtaagagaagctatcaagaggaagcttcgaactctaatccttgcaccaacaagagtggtagcttcagagatggcggaggctttgaaagggatgcctataagatatcaaacaaccgcggtaaagtctgagcatacagggaaagaaattgtagatctaatgtgtcacgcaacgttcacgatgagattactgagcccagtcagagtaccaaattataatatgattattatggatgaggctcattttaccgatccctcatcgatcgcagctcgcggctatataagtacgcgggtcggaatgggtgaggccgctgcgatctttatgacagccacacctccagggtccgtagaagcgtttccacaatcaaacgccgtgatacaagacgaggaaagagacattcctgaaagaagctggaattcgggatatgaatggataacggactttccagggaagacagtatggtttgtccctagcattaaaagcgggaacgacatagcgaattgtcttagaaaaaacggaaaaagagtaatacaattatcaagaaagaccttcgatacagagtatcagaaaacaaaaaataatgattgggattatgtagtaacgactgacattagtgaaatgggagcaaatttccgagcagaccgtgtgattgacccgagacgttgcttaaagcccgtcattctaaaggacggtccggaaagagtaatactcgccggaccaatgccagtgaccgtagcgtccgcagcacaacgaagggggagaataggcaggaaccataataaagagggagaccaatacatatatatgggacagccattaaataatgatgaggatcatgcacattggactgaagcaaaaatgttgctggacaatatcaatactccagaaggaattattccagcactattcgaacctgaaagggagaaatcggcggctgtggatggagagtataggctcagaggtgaggcaagaaaaactttcgtagaactcatgagaaggggagaccttccggtatggctttcatataaggtagcttcagagggattccaatatagcgatagacgatggtgcttcgatggtgagagaaacaatcaagtactggaagagaatatggatgtagaaatttggacgaaagaaggtgaaagaaagaaattgcgaccccgatggctagatgcacgaacatactcagacccgttagctttgcgagaatttaaggagttcgcagcgggcagaaaatcggtatcaggtgatctcatactcgaaattggaaaattaccgcaacacctaactcaacgcgcacagaacgccctcgacaatcttgtaatgctacataattcggaacaaggaggacgagcgtatcgccatgcgatggaagaattaccagacactatagaaactctaatgttattagcgcttatcgcagtgttaacaggaggagttacactgttctttcttagcggcagagggttaggtaaaacctctataggattactatgcgtcatggccagtagcgttttgttatggatggcttcagtagaaccacattggatagccgcctcaatcattttagaattcttccttatggtactattaattcccgaacctgatagacaaagaactcctcaagataatcaattagcgtatgtagtcatcggattgctctttatgatactaacggtggcggcaaatgaaatggggctccttgaaaccactaaaaaagatcttggcataggacacgttgctgtggagaatcatcaccacgcagcgatgttggatgttgatctgcatcccgccagtgcttggacactgtatgcggtagcaacaacgatcatcacgcccatgatgagacatacaatagaaaatacaacagctaatattagtctgacagcgatagcgaatcaagcagcgatattaatggggttggacaaaggatggccaatttctaagatggacatcggagtaccgttactagccttaggatgttacagccaagtgaacccacttactctaaccgcagctgtactaatgctagtagctcattatgctattatcggtcccggccttcaagctaaggctactcgagaagcacaaaagcgtacagctgccggcattatgaaaaacccaactgtggacggaatagtcgcaattgacctggaccccgtcgtatatgacgcaaaattcgaaaaacagctaggacagatcatgttactgattctatgcacttctcaaatattactaatgcgtactacgtgggcattatgtgaaagtatcacgctagcaactggcccgctaacaactttatgggaaggcagtccaggcaaattttggaatacaaccatcgctgtatcaatggctaatatattcagaggatcctatcttgctggtgcgggcctagcatttagtttgatgaaatccttgggaggaggcaggagaggaacaggggctcaaggtgaaaccttaggggagaaatggaaacgccaattaaaccagctttctaaatctgaatttaatacatacaaaaggtcaggcattatggaagtagatagaagcgaagcaaaagaaggtctcaaaagaggcgaaaccactaaacatgcagtgtctcgtgggactgcaaaacttagatggtttgtagagaggaaccttgtgaaaccagaaggaaaggtaatagaccttggatgcgggcgtggcggttggagttattattgcgcgggactaaagaaggttaccgaagtgaagggatacacaaagggtgggccaggccatgaggaacctataccaatggcaacgtatggatggaatctcgtgaaactacactctggaaaagacgtatttttcatcccacctgaaaaatgcgacacattactatgtgacattggtgagtcaagccctaacccgacaatcgaggaaggtaggactttgcgtgtacttaagatggtcgaaccctggcttcgaggtaatcaattttgcatcaaaatattgaacccatatatgcccagtgttgtagaaacgctagaacaaatgcaacgtaaacatggaggtatgctagttagaaacccactttctcgaaacagcactcatgaaatgtattgggtttcgtgcgggacgggtaatatcgtatcagcggtaaacatgacaagccgaatgttactaaacaggtttacaatggctcaccgaaaaccaacatatgaacgggacgtagatctcgggacagggacgcggcacgttgctgtagagcctgaagtagcgaacctggatataataggtcaaaggatcgaaaatataaaacacgagcacaaaagtacgtggcattacgacgaagacaacccatataaaacttgggcttatcacggtagttacgaggtcaaaccaagtggaagtgcatcgtcaatggtaaacggtgtcgtaaaactgttgactaaaccatgggatgtaattcccatggtcacccaaatagcaatgaccgaactacacctaggacaacagagagtcttcaaggaaaaagtagatacaaggacgcctcgtgctaaaagagggaccgctcaaattatggaaatgacagcccgatggctctggggatttttgagtagaaacaaaatcccaagaatatgtactagggaggagtttacacgtaaagttagatcaaatgccgccataggggcagtctttgttgatgagaatcaatggaatagtgcaaaggaagccgttgaagacgaacggttttgggaccttgtgcaccgggaaagagagttacataaacaaggcaagtgcgcaacctgtgtctataatatgatgggaaaaagagagaaaaaattaggtgagtttggaaaagcaaaaggaagtagagcaatatggtacatgtggttgggcgcaagatttctagaatttgaggcattgggtttcatgaatgaagatcattggtttagcagagaaaattccttaagtggcgtggaaggggaaggtctccataaattgggatacattttacgcgatatatcaaaaattccaggcggaaacatgtatgcggacgatactgcaggatgggacacaaggattactgaagatgatttgcaaaatgaggccaaaattactgatattatggagcccgagcatgccctactagcaaaagctatcttcaagcttacgtatcaaaacaaggtagtaagagtacaaagaccagctaaaaatggcacagtcatggacgttatatcacgaagagatcagagaggatcaggccaagtgggaacctacgggctcaatacctttacaaatatggaagcacaattgattagacagatggaatcagaagagattttctctccgtccgaactggaaacaccaaatttggctgaacgagctttggactggcttgaaaaatacggcgtagaacgtcttaagaggatggccataagcggtgacgactgtgttgtgaagccgatagatgatagatttgctacagccctcaccgccttaaatgatatgggaaaagtaagaaaggatatacctcaatgggaaccgagtaaaggatggaatgattggcaacaggtaccattctgcagccatcatttccaccaattaataatgaaagacggcagagaaattgttgtgccatgtcggaatcaagatgaattggtagggcgagctcgagtctcccaaggcgcaggttggtctctacgggaaacagcttgcctaggtaaatcgtacgcccaaatgtggcaactaatgtacttccacagacgggatcttcgtctcgcagcaaatgcgatctgctcagccgtcccagttgattgggtgcctacttcccggacaacctggagcatccacgcccaccatcagtggatgactactgaagacatgctgagcgtttggaacagggtttggattgaagagaatccatggatggaagataaaacccatataagttcctgggaagacgttccttatttaggaaaaagagaagatcaatggtgcggcagcctcataggtttaacagcccgcgctacttgggctactaacattcaagttgccataaatcaggttcggcgattaattggcaacgaaaattatcttgactacatgacctcaatgaaaaggtttaaaaatgagtcagaccccgagggagccttatggtga

SEQ ID NO: 21655 - RNA, 9879 nt, synthetic construct
  misc_feature 1..9879: note = derived and/or modified CDS sequence (opt6) from DENV-1__KF921935__SS-prME
  source 1..9879: mol_type = other RNA
agcgtgacgatgttgctaatgcttatgcctactgctctcgcatttcatcttaccaccagaggtggagaaccacatatgatagtatcaaaacaagaacgaggaaaatcactcttatttaaaacctcagctggggtcaatatgtgcacgttaatagctatggatctgggagaactttgcgaagacactatgacgtataaatgtcccagaataactgaaactgagcctgacgatgtcgactgttggtgcaacgctacggacacttgggtaacgtatgggacatgttcccaaacgggagaacaccgacgagacaaaagatctgttgctttagcgcctcatgtcggactgggtcttgaaacaagaacggaaacctggatgagttctgaaggggcgtggaaacaaatacaaagagttgagacttgggcactgcgccacccaggatttacagtgattgcactatttctagcacacgcaatagggaccagcataacacaaaaaggaataatatttattcttttgatgctggtaacgccctctatggcaatgcgctgtgtaggtataggttctagagattttgtagaagggttaagtggagcaacgtgggtagatgtcgttctcgagcatggctcatgtgttaccacaatggctaaagacaaaccaactctagacatagagttactcaagaccgaggtaactaatcctgcagtactaagaaaactttgtatagaagctaaaataagtaatacaaccactgattctcgatgtccaacacaaggagaagctacgctcgtcgaagaacaggatgctaattttgtatgtcgaagaacatttgtagatagaggctggggcaatggttgtggtttgttcggtaaagggagtctaataacatgcgccaagttcaaatgtgttactaaattagaagggaaaattgtgcaatatgaaaatctaaaatatagtgtaattgtaactgtacatacgggagatcaacatcaagtcgggaatgagagtacggaacacggtacaacagcaactatcacaccccaagcccccacaacggagatacaattaacagattatggagcattaacacttgattgcagtcccagaacagggttagatttcaacgaaatggtactattaacaatgaaagaaaaatcatggctcgtgcacaagcagtggttccttgacctacctttgccttggacatctggggcctcaacgtctcaggaaacatggaatcgacaggacttactcgtaactttcaagacggcacacgccaagaaacaagaagtggttgtactaggatcacaggaaggggcgatgcatacggcattaacaggtgccacagagatccaaacgtcgggcactactaccatctttgccggacacttgaagtgcagattaaaaatggacaaactaacattaaaaggaatgagttacgtgatgtgtacagggtcgttcaagctagagaaagaagttgctgaaacacaacacggaacagtcttagtacagataaaatatgaaggcaccgacgccccttgtaaaatcccctttttgacacaagacgagaaaggagttacacaaaacggacgacttataactgctaatccgatagtaacagacaaggaaaaacctgtaaatatagaagcggaaccaccttttggggaatcttacataataataggtgcgggagaaaaggcattaaaactcagttggtttaaaaaggggagtagcatcggtaagatgtttgaggctacagcccgaggcgcaagaagaatggcaatattaggggacaccgcatgggattttggcagcattggcggagtatttacttctgtaggtaaattagtacatcaaatctttggaacagcatatggcgtactgttttctggagtcagttggactatgaaaattggaataggagtcctgcttacatggttgggattgaacagtagaagcacaagtctgagcatgacatgcatagcagtgggactcgttacattgtatctgggagtcatggtacaagccgattcgggatgcgtaattaattggaagggtcgtgaattaaaatgtggcagtggaatattcgttactaacgaggtccatacatggacagaacaatataaattccaagcggatagcccgaagagactaagcgcagctataggaaaggcttgggaagaaggtgtatgtggcattagatcagctactaggttagaaaacataatgtggaaacaaatctctaacgaattaaatcacattttattagaaaatgacatgaaatttacagtagtcgttggagacgtcgcaggcattctagcacaaggcaaagaaatgatacgaccccagcccatggaatataaatactcatggaaaagttggggaaaagcaaagataataggcgcagatgtacagaacactacgtttatcatagatggaccaaacacccctgaatgccctgatgatcaaagagcgtggaatatctgggaagtagaagattatggttttggcattttcacgaccaatatttggcttaagctaagggatagtcacacacaggtatgcgaccataggcttatgtctgctgctataaaagattcaaaagcagttcacgcagacatgggctattggatcgagagcgaaaagaacgaaacctggaaactcgcaagagcaagttttatcgaagtaaaaacatgcatatggccaaagtcacataccttgtggtctaatggagtattagaatcagaaatgataataccgaaaatctacggtggtcctatttcacaacataattatagaccaggctattttacgcaaactgcgggtccatggcatcttgggaagttagaactcgattttgatctatgcgaaggtacaaccgtggtcgtagatgaacattgtggtaacagagggccatcacttagaactacgactgtgacggggaaaatcattcatgaatggtgttgcagatcatgtacattgccacccctaagatttcggggagaagatggatgctggtatgggatggaaatcagaccagttaaagagaaagaagagaacctcgtcaaatcaatggtatctgctggatccggtgaggtggacagcttcagtctaggactcttatgcatttctataatgatagaagaagttatgaggtcgcgatggtcacgaaagatgttaatgaccggcactctcgccgtatttttcttacttattatgggacaacttacatggaatgatcttataagactatgcataatggtgggtgcaaatgcatccgacagaatgggaatgggtacaacatacttagcactcatggcaacattcaagatgagaccgatgtttgcagtaggcctattgttccgtcggctcactagccgtgaggtgctactcttaacaattggtctatctttggtagcctcagtcgaattaccgaatagtcttgaggaactaggggacggattagcgatgggaatcatgattttaaagttattgacagatttccaaagtcatcaactatgggccacgctattgtcactcacttttattaaaacaacgttctcattgcattacgcgtggaaaactatggcaatggtcctttctatagtatcattatttcctttgtgtttatcgacgacatcccaaaagactacatggctccctgtactactaggcagcctaggatgcaaaccattaacaatgtttctgatagccgagaacaaaatatggggaaggcggagctggccgctgaatgaaggtataatggcagtaggaatagtgtccattttactaagtagcctactgaaaaacgacgtccccttggccggtccgttgatagccggtggtatgttaattgcttgttatgtaatatcgggatcgtcggctgacttatcactagaaaaagcggctgaagttagctgggaggaggaagcagaacatagtggcgcatcgcataacatacttgttgaggtacaagacgatggaacgatgaaaataaaagacgaagaaagagatgatactcttactatcctattaaaagcaactttacttgcagtgagtggagtatacccactatcaattccagcgactttatttgtatggtacttttggcagaaaaagaaacaacgaagtggggtcctctgggatactcccagccctcccgaagtagaacgtgctgtcctagacgatggaatataccgaataatgcaaagaggtctactgggaagaagccaagtgggagtcggagtctttcaggagaatgtctttcacacaatgtggcacgtcacacgaggggcagttttaatgtaccagggaaaacgactagaacctagctgggcaagtgttaaaaaggatctgatatcatatggcggtgggtggcgtttacaaggttcttggaacaccggcgaagaagttcaagtcatagctgtagagccgggtaaaaatcctaagaatgtacaaacagctccgggtacctttaaaactccagagggagaagtaggagcaattgccctggactttaaacctggcacctctgggtcacctattgtaaatagagagggcaagatagtaggactatacggcaatggagtggttacgacatctggaacgtatgtctcagctatagcccaagctaaggcgagccaggagggccctctgcccgaaatagaggacgaggtgttcagaaaaagaaatttaaccataatggatttgcatccagggtcaggaaaaacacgtcgatatctgccagcaatagtgagagaagcaataaaaagaaaacttagaacgcttattttagcaccaacaagagtggttgcaagcgaaatggcagaagctctcaaaggcatgccaattcgataccagacaacagcggtaaaatctgaacatactgggaaagagatagttgatctaatgtgtcatgcaacattcactatgcgactattatctcccgtcagagtaccaaattataatatgatcataatggacgaggcgcattttacagatcccagttccatagcagcacgagggtatatatcaacacgagtggggatgggagaggcggctgcaatttttatgacagcaacccctccaggttcggtagaggcgttcccacaatcaaacgctgtgatacaagatgaggaaagagatataccagaacgttcttggaactccggctatgaatggataacggacttcccaggaaaaacagtctggttcgtaccttcaataaaatccggtaatgatatagcaaactgtctcaggaaaaatggcaaacgagtcatacagttaagccgaaaaacatttgatactgagtatcagaaaacgaaaaacaacgattgggattatgttgtaaccactgatatatctgaaatgggagcaaatttccgggccgatagggttatagacccccgcagatgtttaaaaccagttattttaaaggatggcccggaacgagtaatattagctggaccaatgccagtaaccgtcgcatctgctgctcaaagacgaggccgtataggaaggaatcataataaagaaggtgatcagtatatatatatgggacaaccactaaacaacgacgaagatcatgcgcactggacggaggcgaaaatgctattggataacataaatacacccgaggggattatcccagcattgtttgaacccgagagggaaaaatcagcagcaatagatggagaatataggttgaggggagaagcacggaagacattcgttgaattaatgagaagaggagatctaccagtctggctttcatacaaagtagcaagtgagggttttcagtactccgatcgtaggtggtgtttcgatggagaacggaacaatcaagtgctagaagaaaatatggacgttgaaatatggacaaaagaaggtgagaggaagaaattacgaccacgatggttagacgctagaacatactcggaccctctggcattacgtgaatttaaagaatttgctgctgggaggagatctgtctccggagatttaatactggaaataggtaaactaccacaacacctaacccaaagagctcaaaatgctttggacaatttagtgatgttgcataatagtgaacaaggtggtagggcttaccggcacgctatggaggaattaccagatacgatagaaaccttaatgttactcgcgttgatagctgtattaacgggaggagtaacattattctttctatccggccgaggtctagggaaaacaagtatcggactgctatgcgttatggcatcgtcagtcctattgtggatggcgtctgttgagccgcactggatagccgcaagcataatcttggagttctttttgatggtacttttgatacctgaacctgacagacaaagaaccccacaagataaccaactagcatacgttgtaatcggcctattgtttatgattttaaccgtggcggctaatgaaatgggtctcctcgaaacaacaaagaaggacttgggtattggtcatgtagcagtcgagaatcatcatcatgcagcaatgctagatgtggatcttcatccggcaagtgcatggactttgtatgctgttgcaaccactatcataactcccatgatgaggcatacaattgaaaatactacagctaacatttcactgacagcaatagcaaaccaagccgcaattctaatgggactagacaaaggatggcctattagcaagatggacatcggggttccactcttagctttgggatgttatagccaagtaaatccccttactctaacggcagcagtattaatgctagtcgctcattacgctataattggaccgggcttacaggcgaaggcaacccgagaagcgcagaaaagaactgcagcaggtataatgaaaaatccaacagtagacggcatcgtggccatagacctagaccctgttgtatatgacgctaaatttgaaaaacaattaggccaaataatgctcttgatcctctgtacatcccaaattttgttaatgcgtacaacatgggctttatgtgagtcaattacattagccactggtcctttaactacgttgtgggaggggtctccaggcaaattttggaatactaccatagctgtttcaatggctaatatattcagaggatcatatctagctggggcaggactggctttcagcctcatgaaatcactcggcggagggcgaagagggacaggagctcaaggagaaacgttaggggaaaaatggaaacgacagctgaatcaactaagcaaatctgagttcaacacatataaaagatcaggaataatggaagttgataggtcagaagcaaaagagggacttaaaagaggagaaacaacaaaacacgcagtatcacgaggaaccgcaaaactccggtggttcgtggaaagaaatttggtaaagcccgagggtaaagttatagatctgggctgcggcagaggcggttggagttattattgtgctggcttgaagaaggtaacggaggtgaagggatacacgaagggaggtccgggacacgaagaacccatacccatggcgacatatggctggaatttggtaaaacttcattctgggaaagatgtatttttcataccaccggaaaagtgtgacacactactctgcgacatcggagaatcgtcacctaatccaactatagaggaaggaagaactctccgagtgctgaaaatggtagaaccatggttaaggggcaatcagttttgcataaaaatattgaatccttacatgccttctgtagtagaaacactcgaacagatgcagagaaaacatggaggtatgctagtgcgtaatcctctctcacgtaattcgacgcatgaaatgtactgggtcagctgtggaacaggcaatattgtctcagcggtaaatatgacaagcaggatgttactcaatcgtttcacaatggcacatagaaaaccaacctatgaacgagacgtcgatttaggggcaggaacaagacatgtggcggtagaaccagaaatagcaaacttagacatcataggccaaagaatagaaaacataaagcatgaacacaaatctacatggcattatgatgaggataatccttacaaaacttgggcataccatggatcgtatgaagtgaaaccgagtggaagtgccagctcaatggtaaatggagtagttaaactattgacaaaaccatgggacgtaatccctatggtaacgcaaatagcaatgactgataccactccttttggccaacaaagagtattcaaagaaaaagtagatacccggacgccaaaagctaaaaggggaactgcccaaataatggaagttaccgctaaatggttatggggatttctttcccgaaacaagaaacccagaatctgtacgcgggaagaatttacccgtaaagtgcgttcgaatgcagcaataggggcagtttttgttgatgaaaatcagtggaactcagccaaggaagcagtagaagatgagaggttttgggatctggtacaccgagaacgagaattgcataaacaaggaaagtgcgcaacctgtgtctacaacatgatgggtaaaagagagaagaaattaggagagttcggaaaagctaaaggcagcagagcaatatggtatatgtggctaggcgccagatttctagaatttgaagccctcggatttatgaacgaagatcactggttttcacgcgaaaactctttgtctggcgtagaaggagaaggtctccacaaactaggatacattcttagagatatctcaaaaatccccggtgggaacatgtatgccgatgatactgctggttgggatacacgaatcaccgaagacgacttgcaaaacgaagctagaatcactgacatcatggaaccagaacacgctttgctcgcaaaatctattttcaaactaacttatcaaaacaaagtggtacgtgtacaacgtcctgccaaaaatgggacggttatggatgtaattagcaggagagaccaaaggggatcgggccaagtcggtacttatggcttaaacacattcaccaacatggaggcccagctaataagacaaatggaaagtgagggaatattcagtcctagtgagctagaaacacccaaccttgccgaacgagtgttagactggctcgaaaaatatggagtggagcgccttaagagaatggcaataagtggcgacgactgtgtagtaaaaccaattgacgatagatttgccacagcactaacagctttgaatgacatgggtaaagtgcgaaaagatataccccagtgggaaccatcaaaggggtggaatgactggcaacaagtaccgttttgttcacatcatttccaccagctaataatgaaagacggtagagaaattgtggttccatgtcgcaatcaagacgagctcgtaggtagagcacgagtgagtcagggtgcagggtggtcattaagagaaacagcgtgtctaggaaagtcatacgcccaaatgtggcaattaatgtactttcatagacgtgacctaaggcttgcggctaacgctatatgttcggcagtaccagtagactggataccgacgtcgcgaactacctggagtatacatgcacatcatcagtggatgacgacagaagacatgctatctgtctggaatcgtgtttggatcgaagagaatccgtggatggaggataaaacgcacataagttcctggggtgatgtcccctatttaggaaagcgagaagatcaatggtgtggaagtcttattggccttacagccagagcaacttgggctactaacatacaggtagccataaatcaagttcggcgactaatagggaatgaaaattatctagattacatgacaagcatgaaaagattcaaaaacgaaggtgacccagaaggtgcgttatggtaa

SEQ ID NO: 21656 - RNA, 9879 nt, synthetic construct
  misc_feature 1..9879: note = derived and/or modified CDS sequence (opt6) from DENV-1__GQ199776__SS-prME
  source 1..9879: mol_type = other RNA
tcagtaacaatgttacttatgttaatgccaacagcattagcattccacttaacgacaaggggtggagaaccacatatgatagtttctaaacaagaaaggggtaaatcccttctctttaaaacatccgcaggagtgaatatgtgtaccttaatagcaatggatttgggagaactttgtgaagatactatgacgtataaatgtcctagaatcacagaaactgaacctgatgatgtagattgttggtgcaatgcaacagatacttgggtaacgtatggaacatgttcccagacgggagaacacagaagagataaacggagcgtagctttagcaccacacgtaggtttaggactcgaaaccagaactgaaacgtggatgagttctgagggagcatggaaacagatacagagagtagagacgtgggctctacgccaccctgggtttactgtaatagcactatttctagcacatgcaataggaacaagtataacacaaaaaggtataatttttatcttattaatgctcgtgacaccgagtatggccatgcgatgcgtaggaataggatctagggacttcgttgaaggtttatcgggcgcgacctgggttgatgtggtactcgaacacggatcatgcgtaaccactatggccaaagataaacctaccctagacatagaactccttaaaacagaagtaactaatccagccgtacttagaaaactctgtatagaggcgaaaatctcaaacaccacaaccgactccagatgtccgacgcagggtgaagccactcttgtagaagaacaggacgctaattttgtatgtagacgcacctttgtagacagaggatggggtaatggatgtggtttatttgggaaagggtcactgataacatgtgcaaaattcaaatgtgtaaccaaactagaaggaaaaatagttcaatatgaaaatttaaaatactcagtaatcgttacagtccatactggggaccaacaccaggtaggaaacgaatctacggagcatgggacaacggccacaataactccacaagcacccacaacggaaatacaactgacagattatggtgccttaaccttggattgtagcccacgaacaggattagatttcaatgagatggtattacttactatgaaagaaaaatcgtggctagtacataaacaatggtttctagatttgccactaccttggacttccggagccagcacctcccaggaaacatggaatagacaagatttacttgttacgtttaaaaccgcccacgccaagaaacaagaggtagtggtattaggatcacaagaaggtgccatgcatacagcccttactggtgcaacagagattcaaacaagtggcacaacaacaattttcgctgggcatctcaaatgccgtctaaaaatggacaaactcaccctcaaaggaatgtcatacgttatgtgcacaggttcgtttaaactggaaaaagaggttgcagaaacacagcacggcactgttctagtgcagataaaatacgaaggaactgatgcaccctgcaaaataccgttctcaacccaagacgagaaaggtgtgacccaaaatggcagattaataactgcaaaccccattgtaaccgacaaagaaaaacccgtgaatatagaagctgaaccaccctttggagagtcatatatagtgataggagccggtgaaaaagcactgaaattaagttggttcaagaaaggatcatcaatagggaaaatgtttgaagcgacagcccgaggagcgagaagaatggctatactgggagatacagcttgggattttggttcaataggcggggtctttacaagtgttggaaaattggttcatcaaatattcggaactgcttacggggtgctctttagcggcgtctcatggactatgaaaattggcataggagttctgttaacctggttaggtctaaattcaagaagtacatctctttcaatgacatgtatagccgtcggacttgtaactctatacttgggggttatggtacaagcagatagtgggtgcgttataaactggaaaggaagagaattaaaatgtggctcgggaatttttgtaacgaacgaggttcacacctggacagagcaatataaattccaagccgattcgcccaaaaggttatcagcagcaattggaaaagcctgggaagagggagtctgtggtatacgatcagctacacgacttgaaaacataatgtggaaacaaatatctaatgaattaaatcacattctcttagaaaatgatatgaaatttactgttgtagtaggagatgtggcaggaatattggcgcaaggcaaaaagatgataagaccccaacccatggaatataaatattcatggaaaagctggggtaaagcaaagataataggagcagatgtgcaaaatacaacatttatcattgacggtcctaatacaccggaatgtccggatgatcaaagagcatggaatatttgggaagtagaagactatggattcggcatttttacaactaacatttggcttaagttgcgagattcatatactcaagtgtgtgatcacagactaatgagcgctgctattaaagatagcaaagcagtacatgcggacatgggctattggattgaatccgagaaaaatgagacgtggaagttagcgagagcgagttttatcgaagttaaaacgtgtatatggccaaagtcacacactttatggagtaacggcgtattggaaagtgaaatgataatacctaagatctatggaggaccaatttcacaacataattacagacctggatattttacccaagcagcagggccatggcatttaggaaagttggaactagactttgatctttgtgaagggacaactgtcgtcgttgatgaacactgtggtaatcgaggtccatcgttacgcactactactgttacaggtaaaatcatacatgaatggtgctgtcgcagttgcactctccctccacttagatttcgtggagaagatggttgttggtacggaatggaaatccgtccggtaaaggagaaagaagaaaacctagttaaatcaatggtgagtgcagggagtggggaggtagattcattcagtctgggattgctatgcattagcatcatgatcgaggaagtaatgaggtctcgatggagcaggaggatgttaatgaccggcacactggccgtattctttttattaataatgggacaacttacatggaatgacctgattcgactatgtattatggtcggggcgaacgcttcagatagaatgggtatggggacaacgtacctcgcactcatggctacttttaaaatgagaccaatgttcgcagtaggactactattccgtcgattgacgtcgagagaagtgctcctcctgacaattgggctttctctggtagcatcggtagaattacctaactctcttgaagaactgggtgacggtttggcgatgggaattatgatattgaaactactaacagatttccaatctcatcaattatgggcaacattattaagtttaaccttcatcaagactacgctatcattgcattatgcttggaaaaccatggccatggtactatctatagtctccctatttccactatgcttgtctaccacatctcagaaaacaacatggctgccagtgcttctgggatctctgggatgcaaacccttaactatgtttctaatagctgaaaataaaatatggggaagacggagctggcccttaaacgagggaataatggccgtaggcatagttagtatcttgttatcaagtcttctcaaaaatgatgttccattagcaggacctctgatagctggtggtatgcttatagcctgctatgttatatcaggatcatccgcagacttaagtcttgagaaagctgcggaagtaagttgggaggaggaagcggagcattcgggagctagtcacaatatactcgtcgaggtacaagacgatgggacaatgaagataaaggatgaggaaagagatgatacgctaactatcctactaaaagcaacactgttagctgtttcaggcgtttatccgttatcaatccccgctacattatttgtgtggtacttctggcagaagaagaaacaaagatcaggcgtactctgggacaccccaagcccaccagaagtggaacgagcagtactggatgatggcatttatagaattatgcagcgaggtttattgggacggagccaagttggggtaggtgtatttcaagaaaatgtattccacacaatgtggcatgtaacacggggcgccgtacttatgtaccaaggaaagcgtttagagcctagctgggcctccgtcaagaaagatctaattagctacggaggaggatggagactgcaagggtcgtggaatacaggggaagaagttcaagtgattgccgtagaaccaggcaaaaatcccaaaaatgtccaaactgcacctggaacctttaaaacaccagaaggtgaagttggggccatagctctggatttcaaacccgggacgtccggatctccgatagtcaacagagaagggaaaattgtagggctatacggaaacggcgttgtaactacttctggaacatatgtaagtgctatagctcaagcaaaagccagccaagaaggcccactgcctgaaatcgaagatgaagtatttcgcaagcgaaacttaacgattatggacctacatccgggcagtggaaaaacacgccgttatttgccggcaatcgttagagaagctatcaaacgtaagttaagaaccttaattttagcgccaacacgggttgtagcgtcagagatggccgaagcattaaaaggcatgcccatcagatatcaaacaacagctgtgaaaagtgaacacactgggaaagaaatagttgatctaatgtgccacgctacttttacaatgagattactatctcccgtacgagttcctaactacaacatgattataatggacgaggctcattttactgacccaagctcaattgcagcaagaggttacatctcaacgcgagtagggatgggggaggctgcagcaatatttatgacagccactccgccgggatcagtcgaagcattcccacaatcgaatgctgtaatacaagacgaggaaagagatattcctgaacgaagctggaactcgggatatgagtggattactgacttcccaggaaagactgtttggttcgtgccatctataaaatccggtaatgacatagcaaactgccttaggaaaaatgggaagagagttattcaactaagccgcaaaacgttcgatacggagtatcagaaaaccaaaaacaacgattgggactatgtagtcacaacagatatttcagaaatgggagctaattttcgggcagatagggtgatagacccgcgtagatgcctaaagcccgttatcctgaaagacggacctgagagggtaattctagccggaccaatgccggtaacggtagcctccgccgcacaaagaagaggaagaatagggaggaatcataataaagaaggggaccaatacatttatatggggcagcccttaaataacgatgaagatcatgcccactggaccgaggcaaaaatgctccttgacaatatcaatacacccgaaggaattatacctgcattatttgagcctgaacgcgagaaatctgctgccatcgatggggaatatcgattaagaggggaagcacggaaaacatttgtagagctgatgcgaaggggtgatttgcccgtgtggcttagctataaagttgcaagtgaaggatttcagtactcagatagacgatggtgctttgatggcgaacgaaataaccaagtactagaggaaaacatggacgtcgaaatttggacaaaggaaggggaacgtaagaaattaagacctaggtggctggacgcaaggacatattcagatcctttagcgctgagagagttcaaagaatttgcagccgggagacggtcagttagtggagatctaatactagagataggcaaattaccacaacatttaactcaacgagctcaaaatgcgttagataacttagtcatgttacataattcagaacaaggagggagggcctacaggcacgcaatggaagaattgccggacactatcgaaacattaatgctgctagccttgattgcagtactgactggaggcgtgacacttttcttcttatcgggcagaggtctaggcaaaacatctataggtttactatgcgtcatggctagttcagtactactctggatggccagcgtggaaccacactggatagcagctagtataatacttgagttctttttaatggtgttgctcataccagaacccgaccgacaaaggacaccgcaagataaccaactagcctacgtggtaataggtctattattcatgattctaacagtcgcggccaacgaaatgggattgcttgagacaacaaagaaagacttagggatagggcatgtggcagtggagaatcaccaccacgccgctatgttagatgttgatctccacccagcatctgcatggaccttatatgctgtggccaccacaataattacaccgatgatgaggcacacgatagaaaacacaaccgcaaacatctcgttaacggctatagcaaatcaagccgctatcttgatgggcctcgacaaaggatggcctataagtaaaatggacataggggtgccacttctcgccttgggttgttactcacaagtaaatcccttaactttaacagctgctgtgttaatgcttgtcgcacattatgccattataggccctggattacaagcgaaagccactcgagaggctcagaaacgaacggccgcgggaattatgaaaaatcccacagtcgacggaatcgtagcaatcgacttagatccagttgtctacgacgcgaaatttgagaaacaattgggacaaatcatgctccttatactttgcacaagtcaaattctgctaatgagaacaacctgggcactatgtgaatcaatcacgttagccacaggcccgttgacaacattatgggaaggtagtccaggcaaattctggaatactacaattgcagtaagtatggcgaacatattcagaggatcttatttggcaggggctggactagcattttccctgatgaaaagtttagggggagggcggcgtggtacaggagcacagggagaaaccctgggcgaaaagtggaaaagacagctaaatcaactaagcaaatcagaatttaatacgtataaaagaagtggcataatggaagtagatagatccgaagcaaaggaaggtctaaaaagaggtgagactaccaaacacgcagtatcaagaggtacagcaaagctaaggtggttcgtagaaagaaatctagtaaaaccggaaggtaaagtaatagatctgggctgcggaaggggtggctggagctactactgtgcgggtctaaagaaagtcactgaagtgaaaggttatacaaaaggcgggcccggtcatgaggaaccaatcccgatggctacatacggttggaatctcgtaaaactacatagcggaaaagatgtattctttataccgcctgaaaaatgtgacacactactatgcgacatcggagaatcctccccaaatcccacaattgaggaagggcgaacacttcgcgtcctgaaaatggtggagccctggctgcgaggaaatcaattttgcattaaaatattaaatccatacatgccaagtgttgtggaaacacttgaacaaatgcaaagaaaacacggtgggatgttagtcaggaacccactcagtagaaactcaacacatgaaatgtactgggtctcatgtgggactggaaatatagtttctgctgtaaatatgacatcccggatgctactcaacaggtttactatggcccaccgcaagcctacgtatgaacgagacgtagacttgggcgctggtacacgacatgtcgtagtagagccagaagtagcaaacttagacataataggccaacgaatagagaatataaaacatgaacacaaatctacatggcactatgacgaagataatccgtataaaacatgggcttaccacgggagttatgaggtgaaaccttcgggatctgcttcaagcatggtaaatggagttgtgaaattgttaacgaaaccatgggatgttatacccatggttacgcaaatcgccatgacagataccacacctttcgggcaacagagagtattcaaagaaaaagtcgatacaagaacaccaaaggcgaaaagggggactgcacaaattatggaagtaacagcgaaatggctatggggcttcttatcgcgcaataagaaaccgcgaatatgtacacgtgaagaatttacgagaaaagtacgatcgaatgccgcaataggtgccgtttttgtagacgagaaccaatggaactcagctaaagaagcagtagaagatgaaagattctgggatctagtccatagagagcgagaactacataagcaaggtaagtgcgcaacttgcgtgtacaacatgatgggtaaacgagagaagaaactcggcgaatttggtaaggcaaaaggatccagagccatttggtatatgtggttgggtgcccgatttctcgaatttgaagcacttggctttatgaacgaagaccattggttttcacgcgaaaattctctaagtggagtcgagggcgagggattacataaattaggctacatattacgagacatctcaaaaataccaggagggaacatgtatgcagacgacacagcaggctgggatacccgaataactgaagacgatttacaaaacgaggcaaggataacagatataatggaaccagagcatgcattattagcaaagagtattttcaagctaacatatcaaaataaggtagtcagggtgcaacgaccagccaaaaacggaacagtaatggatgtaatatcaagacgtgaccaaagggggtcaggacaagttgggacttacggattaaacacattcacgaatatggaagcacaacttataagacaaatggagagtgaagggatttttagcccgtcagagcttgaaacacctaacctagcagagcgcgtattagattggttagaaaagtatggcgtggaacgcttaaaaaggatggctataagcggagacgactgcgtagtgaaaccaatcgacgatcgctttgcaacggcacttaccgctttgaatgatatggggaaagtacgtaaagacataccccaatgggaaccatctaaaggctggaatgactggcaacaagtacctttctgttcacaccattttcatcaattaatcatgaaagacggtagagaaatcgttgtgccttgtagaaaccaggacgaacttgtaggacgtgcacgagtatctcagggcgctggatggtcattaagggagaccgcatgtttaggcaaatcatatgcacaaatgtggcaattaatgtactttcaccgacgcgatttacgtttggcagcaaacgcaatatgtagcgcggttcctgtcgattggatacccacgtcacgaacaacttggagtatacatgctcaccatcaatggatgactaccgaagatatgcttagcgtttggaatcgtgtatggatagaggagaacccatggatggaagataaaacacacatttcttcatggggtgacgttccttacctaggtaagcgagaagaccaatggtgcggtagtcttatcgggctaacagccagggcaacgtgggccaccaatatccaagtagcaataaatcaagtcagaagattaatagggaacgagaattacctcgattatatgacatcaatgaaaaggtttaagaatgaatcagacccggaaggagctctctggtaa

SEQ ID NO: 21657 - RNA, 9879 nt, synthetic construct
  misc_feature 1..9879: note = derived and/or modified CDS sequence (opt6) from DENV-1__GQ199777__SS-prME
  source 1..9879: mol_type = other RNA
tcagttaccatgttattaatgttaatgcccactgccttagccttccatttaacaactcgaggaggcgaaccccatatgatcgtatctaaacaagaaagaggcaaatctttattattcaaaacttccgcgggtgtaaacatgtgcacgctgatagccatggatctcggagaactttgtgaagacacaatgacatataaatgtccgagaataacagaaacagaaccagatgatgttgattgttggtgcaatgctactgacacttgggtaacgtatggaacatgtagtcaaactggggaacatcgtcgtgataaaagaagcgtagccctagcacctcatgtaggattgggactagaaacaagaacagaaacgtggatgtccagcgaaggagcttggaaacaaatacaacgagtagaaacctgggccctacgtcatccaggctttacggtaatcgctttattcttagcacatgttattggtacctcaataacacaaaaaggtattatatttattctattaatgttagttacaccatcaatggcaatgcgctgcgtaggcattggaagccgagattttgttgaaggcctatcaggcgcaacatgggttgacgtagtgcttgaacacggatcttgtgtaaccactatggccaaagacaaacctacccttgatatcgaattactaaaaaccgaagtaacaaatccagctgtactaagaaaactatgtatcgaagcaaaaatatctaatactacaacagattctagatgcccaacgcaaggtgaagccactttggtagaagaacaagacgcgaacttcgtatgtcgaagaacgtttgtcgacagaggctggggcaatggctgtggtctgtttggaaaagggtctctgataacttgtgctaaatttaaatgtgtaacaaaattggaaggaaaaatagtacaatatgaaaatttaaaatacagcgtcatagttacagtacatacaggtgaccagcatcaagtaggaaacgaatcaactgaacacggcacaacagcaacgataacaccacaagcacctacaacagaaatacaactcacggactatggagccttaacactagattgttcaccaaggacaggtttagattttaatgaaatggtgttattaacaatgaaagagaaaagttggcttgtgcataaacaatggtttcttgacctccctttaccgtggacctcaggtgcaagtacctcacaggaaacatggaaccgtcaagatttattggtcacgtttaaaacggcacacgccaaaaagcaagaagttgtagttttaggttcacaagaaggtgccatgcataccgcactaactggtgcaacagaaatacaaacaagtggcacaaccacaatcttcgctggacacttaaaatgcagattaaaaatggataaattaacgctaaaaggtatgagttacgtaatgtgcacaggcttattcaaactggaaaaagaagttgctgaaactcaacatggtacagttttagtacagataaaatatgaaggaactgatgccccttgtaaaattccttttagcacacaagatgaaaagggtgtcacacaaaacggcagattaataactgcgaatcccatagttacagataaggaaaaacctgtaaacatcgaagcagagccaccttttggcgaaagttatataatcataggagctggggaaaaggccctaaaactttcgtggtttaagaaaggatcttcaatcggtaaaatgttcgaagcgacagcacgaggggcacgaaggatggcgatattgggggatacagcatgggatttcgggagtatagggggagtgtttactagcgtgggcaaattagtgcaccaaatattcggcacagcctatggagtactattttccggagtaagttggactatgaagattggtattggagtgttactcacgtggttagggctaaattcacgatccacttcgttgagtatgacatgcatcgccgtcggcctagtaacactatatttaggcgtaatggtacaagctgattcaggctgcgttataaactggaaagggagagaactaaagtgtggatcaggtatattcgtaaccaatgaagtacacacatggaccgaacagtacaaattccaagctgacagtccgaagcgactaagtgctgcaatcggaaaagcatgggaagaaggagtatgtggcattagatcagcgacccggcttgagaatataatgtggaagcaaatttcaaacgaactaaaccatatactgttggagaatgacatgaaatttacagtagtagtaggagatgtagcaggaatactcgcccagggaaagaaaatgatcaggccccaacctatggaatacaaatattcttggaaaagttggggaaaagcaaaaatcataggggcagatgttcagaatactacatttattattgacggccccaatactccagagtgtccggacgatcaaagagcatggaacatatgggaagtagaagattatggtttcggtatctttacgaccaacatctggctaaaactaagggattcatacacgcaagtatgcgatcatagattgatgtcagcagcgattaaagactctaaagccgttcacgcggatatgggatattggatagaaagcgagaaaaacgaaacatggaaattagctagagcgtccttcatagaagttaaaacctgtatatggcccaaatcacacaccttatggagtaacggggtgctagagtccgagatgattataccgaagatatatggcgggcccatcagccaacataactatcggccaggttactttacccagacagctggcccatggcatctgggaaagttggaactggatttcgatttatgcgaaggaacgactgttgtagtggacgaacattgcggcaatagagggccaagtttgcggaccacaaccgtaacaggaaaaataatacatgaatggtgttgcaggagttgcacgttaccacctttacgctttagaggggaagacggatgttggtatggcatggagatccggccagttaaagaaaaagaagaaaatctagtgaaatcaatggtcagtgctggcagtggagaagtcgactcattctctctcggattgctttgtatctcgattatgatagaggaagtcatgagaagtcgatggagtagaaaaatgctaatgaccggtacattggctgtattcttcctactcattatggggcaacttacctggaatgacttaattagattatgcataatggttggtgctaacgccagtgacagaatgggaatgggaactacatatttagcattgatggcgacattcaaaatgagacccatgtttgccgtaggattgctattccgtagattgactagcagagaagtattattactaacaatcggtctatccctcgtcgcttcagtagagctgccaaattcattagaagaactgggcgatgggttggcaatgggaataatgatattgaaactattggccgatttccagagtcaccaattgtgggctacattactcagcttaacattcataaaaactacatttagtctgcattatgcatggaaaactatggcgatggtactctctatagtttcactgtttccattatgtctatcgacaacaagtcaaaagactacatggctacccgtccttcttggatcgttaggttgtaaaccactaacgatgtttttgatagcagaaaataagatttggggacgtagatcatggccgttgaatgagggaatcatggctgtaggcatagtctcaatcctactatcgtccctattgaaaaacgacgtcccattggcaggtcccttgatagccggcggcatgttgattgcatgttatgtcatatcaggctctagtgcagatctcagtttggaaaaagcagccgaagtatcatgggaagaagaggcggaacatagcggagcatcgcataatatcttggtagaagtacaagacgacggaaccatgaaaattaaggatgaagaacgcgacgatacgttaaccattttattaaaagccactttattagcagtatcaggggtttacccgttatcgattcccgcaacgctattcgtctggtatttctggcaaaagaagaaacaaagaagtggagtcttgtgggacacacctagcccgccagaagttgaaagagccgtacttgatgatggaatatacagaataatgcaacggggccttctagggagatcacaagtaggggtcggagtatttcaagaaaatgttttccacacgatgtggcacgtaactcgtggggcagtacttatgtatcaagggaaaagactagaaccatcatgggcgtctgtgaagaaagatctaatatcatacggtggtggctggagactgcagggttcttggaacaccggagaagaagtgcaggtcattgctgtagaacctggcaaaaatccgaaaaacgttcaaactgctccgggcacctttaaaacgccagagggtgaggttggtgcaatagcactagacttcaaacccggaacgagtggatcgccaattgtgaatcgcgaaggaaaaatagtgggattgtatggaaatggcgttgtgacaacgtctggaacgtacgttagtgcgattgcacaagccaaggcgtctcaggaaggaccccttccagaaatcgaggacgaggtatttaggaaacgtaatttaacaataatggacctacacccaggtagcggcaaaacacgtcgctatctaccagctattgttcgtgaagcaattaaaagacgcctaagaacgttaatattggcgccgactagagtagtagcttcagaaatggccgaagctcttaaaggaatgccgataagatatcagacaactgcagtaaaatcggaacataccggaaaagaaatcgtagacttgatgtgtcatgctacattcactatgcgacttctatcacctgttagagttccaaactacaacatgataataatggacgaagctcactttacagatccgtccagcatcgctgcaagaggttacatatcaacaagagtcgggatgggtgaagcagcagcaatcttcatgacagctacgccacctggctcagtagaagccttcccacaaagcaatgccgtaattcaagatgaagaaagagatataccagaaagatcatggaacagcggttatgaatggataaccgactttccaggcaaaacagtctggtttgtaccatcgataaaatcaggcaatgacattgcaaattgcctgcgcaagaatggaaaaagagtaatacagttgagccgaaaaacctttgacactgaatatcagaaaacgaaaaataacgattgggattacgtcgttaccacagacataagcgagatgggagcaaacttccgagctgaccgagtgattgatccacgaaggtgtctcaaacctgttatcttaaaagatggcccagaacgagtaatcttggccggaccaatgccggtgacggttgcatcagctgcccagagacgcggccgcatcggcaggaaccataataaagagggggatcaatatatatacatgggacaaccactaaacaacgacgaggatcacgctcattggacagaagcaaaaatgttgttagacaatatcaacacaccggaaggaatcatacctgcactatttgaaccagaacgtgagaagtccgcagcaatcgatggggaatatcgtttgaggggagaagccaggaaaactttcgttgaacttatgagaaggggtgacttgcccgtttggctctcgtataaagttgcaagtgaagggttccagtatagtgatcgaagatggtgcttcgatggggaacgtaacaaccaggttttagaagagaatatggatgttgaaatttggactaaagaaggcgagaggaagaaattaaggccgagatggttagacgctagaacgtactcagacccgcttgccctgagggagtttaaggagttcgcagccggcaggcgaagcgtatcgggtgatctaatattagaaataggtaagctcccacaacatttaacgcaacgggcgcagaatgctttagataatctcgtcatgttgcataattctgaacaaggaggtagagcgtatagacatgcaatggaagaactgccagatactatagaaactttaatgttactcgcgttaatagcagtattaacaggaggagtaacgttatttttcttatcaggtagaggactcggtaagacatcaataggcctattatgcgtaatggcgtcatcggtcctgttatggatggcttctgtagaaccgcactggatagcagcatccataattttagagttcttcctaatggtcctgttaatacccgaacctgaccgccaacgtactccacaagataaccaactggcttacgttgtaatagggttactttttatgatcctgacggtcgctgcaaatgaaatgggtctccttgaaacaacgaagaaagacttaggcattggccatgttgcagttgaaaaccaccaccatgccgctatgcttgacgtagatttacaccctgcgtctgcatggactctttatgcagtagctacaaccatcattaccccaatgatgagacatacgatagaaaatacaacagccaacattagcttaacagctatagcaaaccaagctgcaattctaatgggactagacaaaggatggcctatatctaaaatggacatcggagttcccttattagccctaggatgctacagccaggtaaatccattgacgcttacagcagcagttctgatgctcgtggcgcactacgctattattggaccaggtctccaagccaaagccacacgtgaggctcaaaaacgaacagcggcgggtattatgaaaaatcctactgtagatggcattgtcgctatcgacttggacccagtagtttacgatgcaaagtttgagaagcaactgggtcaaatcatgctattaatcctttgtacttcccaaattttactgatgagaacaacttgggcactatgtgagtctattacactagccactggtccacttacaaccctatgggaaggcagtccagggaaattttggaacaccaccatagccgtaagtatggcaaacatcttccgaggtagctacctcgcgggtgcaggactcgcattcagtcttatgaaaagcctcgggggaggaagacgtgggactggagcgcaaggtgaaacattaggggaaaagtggaaacgtcaattgaatcagttgtcgaaaagtgagttcaacacatacaaacgatccgggattatggaggtggacagatcagaagcaaaagagggcttgaaaagaggagaaacaactaaacacgccgtgtcacgtgggacagcaaagctacgatggttcgtagaaagaaacttggttaaaccagaaggaaaagtcatagatttaggatgcggaagaggaggctggagctactattgcgcaggtttgaagaaagttacagaagtgaaaggatataccaaaggtggtccgggacatgaagaacctatcccaatggcgacctacggctggaacctagtcaaactacatagtgggaaagatgtattctttattccacccgaaaaatgtgacactctgttatgcgacataggcgaatcttctccaaatccaaccatcgaagaaggccgtacactgagagtgctaaaaatggtagagccctggttgaggggaaaccaattttgcatcaaaattctaaatccttacatgcccagtgtggtagaaactctagaacagatgcagcgaaaacacggtggaatgttggtacggaaccccttgtcaaggaacagtactcatgaaatgtattgggtatcatgcggaaccgggaacattgtatcagccgttaacatgacgagtagaatgcttcttaacaggtttacaatggctcaccgaaaaccaacctatgaaagagatgttgacttaggagctggtacacgacacgtagcagtggaacccgaagttgctaatcttgatataataggtcagcggatcgaaaatattaaacacgaacataagtcaacttggcattacgatgaagacaacccatataaaacttgggcctatcatggctcctacgaagttaaaccaagcggaagcgcctcgtcaatggttaatggggtagtaaagttgcttacaaaaccgtgggatgttattcccatggtaacccaaattgcgatgaccgatacaacaccatttggtcaacaacgtgtatttaaagaaaaggtagacaccagaacccccaaagctaaaagagggacagcgcaaataatggaagtaacggcaaaatggttatggggatttctatcacgaaataagaaaccccgcatatgtacaagggaagagttcacccgaaaggtgcgatctaatgctgctattggagctgtgttcgtagacgagaatcaatggaacagcgctaaggaagcagtagaagacgaacgcttttgggatctagttcacagagagcgagagttacataaacaagggaaatgtgcaacttgtgtctacaatatgatgggcaaaagagagaagaaactcggggagttcggaaaagcaaaaggcagtagggcgatctggtacatgtggttaggcgctagatttctagagttcgaggctttgggctttatgaatgaggaccattggtttagtcgagaaaactcactgagtggcgtagaaggagagggattacataaacttggttatatactgcgagacatctcgaagattccaggtggcaacatgtacgcagatgacaccgccggatgggatacaaggatcactgaagatgatttacagaatgaagcgagaataaccgatataatggaaccagagcatgcgttactagccaaatctatatttaagttaacgtatcagaacaaggtcgtacgtgtacagagacccgccaaaaacggaaccgtaatggacgtcataagcaggcgggaccaaagagggtcaggacaggtaggtacctatggtttaaatacctttacaaacatggaagcacagttaataagacaaatggagtcggaaggtatctttagtccttccgagttggaaacaccaaatttagctgaacgggttctagactggttggagaaatatggtgtagaacgcctcaaacgaatggcaatatccggagatgactgtgtagttaaacccatagacgacaggtttgcgacagctctgaccgctttgaatgatatggggaaagttagaaaggatataccacagtgggagccatctaagggatggaacgactggcagcaggtaccattctgctcccatcattttcaccaattaataatgaaagacggacgggaaatagtagtaccatgtcgcaaccaggatgaattagttggaagggcgagagtatcgcaaggcgccggttggagccttagagaaacagcatgcctcggaaaaagctatgcacaaatgtggcagctaatgtattttcatcgccgggaccttaggctcgccgcaaatgctatatgttccgcagtgcccgtagattggatacctacatcaagaacgacatggagcatacatgctcatcatcaatggatgacaactgaggacatgttatctgtatggaatcgagtatggatagaagaaaatccatggatggaggacaaaacccatataagttcatggggagatgttccctatctcggaaaaagggaggaccaatggtgcggatctttaatcggattaacagcaagagccacttgggctacaaacatccaggtcgctataaatcaagtaagacgactcattggaaatgaaaactatcttgattacatgacatcaatgaagagatttaagaatgaatcagatccagaaggggcactatggtaa

SEQ ID NO: 21658 - RNA, 9879 nt, synthetic construct
  misc_feature 1..9879: note = derived and/or modified CDS sequence (opt6) from DENV-1__GQ199778__SS-prME
  source 1..9879: mol_type = other RNA
tctgtaactatgctccttatgttaatgcctacagccctcgcctttcatttaacaactagagggggagaaccgcatatgatcgtatcaaaacaagaaagaggaaaatccctattatttaaaacctcggcgggtgtaaatatgtgtaccttgatagcaatggatttgggggaactatgcgaggacaccatgacttataaatgtccccgaataactgaaacagaacccgatgatgttgattgctggtgcaatgctaccgacacctgggtaacatatggaacgtgttcccaaactggtgaacatagaagagataaacgaagtgtagcactagcgcctcacgtaggtctcggacttgaaacaagaacagaaacgtggatgagttcagagggagcttggaaacaaatacaaagagtggaaacttgggcactaagacatccaggattcacagttatagccctattcttagcccatgcaatcgggacaagtataactcaaaaaggaataatattcattcttctaatgttagtaacaccaagtatggcaatgcgatgtgtcgggataggaagtagagactttgttgaaggattaagtggggcaacttgggtagacgttgtgttggagcacggaagctgcgtgactacgatggcaaaagacaaaccgacattagatatcgaactactaaaaactgaagttacaaatcccgcagtactacgcaaactgtgtatagaagccaaaatctcaaatacgacaacagacagcagatgtcctactcaaggagaagcaaccttagtagaagaacaggatgccaattttgtgtgcagacggacgtttgtggacaggggttggggtaatggttgtgggttatttggaaaaggcagcttaatcacatgtgccaaattcaaatgtgtaacaaaattggaaggtaaaattgttcaatatgaaaatctaaaatattccgtaattgtgacagtgcatacgggggatcaacaccaagttgggaacgagtcaaccgagcacggcacgaccgctacaataactcctcaagcaccaaccacagaaatacaactaacagattacggagctttaacacttgactgctccccacgtacaggattggacttcaatgagatggtgctcttaacaatgaaagagaaaagttggttagtccataaacaatggttcctcgatctacctttgccatggacttcaggcgcatctactagccaagaggcctggaataggcaagatttactggtgacttttaaaacagcccatgctaagaaacaggaagttgtcgttctaggatcacaagagggtgcaatgcataccgcactaaccggagcgacagaaatccaaacatctggaaccactacaatctttgcaggacacttaaaatgtagactaaaaatggataaattaactcttaaaggtatgtcctacgttatgtgcacgggaagttttaaattggaaaaagaagtagcagagacccaacatggcacagtcttagtacaaattaaatatgaaggaaccgacgcaccgtgtaaaattcctttctcaacacaagatgaaaagggagttacacaaaacggacggttaataactgcaaatcctatagtaacagataaagaaaaacctgtgaatatcgaggctgaaccaccatttggagaaagctatatagtgattggagcaggcgaaaaggctttaaaattgtcatggttcaagaagggaagttccataggtaaaatgtttgaggctactgccaggggagcgagaagaatggcaattctcggagataccgcatgggattttggatcaattggaggagtattcacatcggtagggaagctagtacatcagatctttgggacagcttacggagtactgttttctggcgtatcatggacgatgaagataggtattggtgtcttattaacctggttaggattgaatagcagatcaacctcgttgtctatgacatgtatagcagtaggtcttgttactctgtacttgggtgtaatggtgcaggcagattccggctgtgtgataaattggaaggggagagaacttaaatgtggaagcggaatatttgtgactaacgaagtgcacacatggacagaacaatacaaatttcaagccgacagtcctaaacggctatcagcagcgattggtaaggcatgggaagaaggtgtatgtggcattagatcagccaccagacttgagaacattatgtggaagcaaatatcaaatgaacttaatcacatactactggaaaacgatatgaagttcaccgtagtggttggggatgtagcaggcatactcgctcaaggtaagaaaatgatccgaccacaacccatggaatataagtattcctggaaaagttggggcaaagcgaaaattattggagcagatgtacagaacacaacctttataatagatggtccgaacacaccggaatgtccagatgaccaacgtgcatggaatatttgggaagttgaagattacggcttcggaatatttacaacaaatatttggcttaaactaagagattcctacactcaagtatgtgatcaccgattaatgtcggctgccattaaagattcaaaggcagtccacgcggacatgggttactggatcgaatccgaaaagaacgagacttggaaacttgctcgagcttcgttcatagaggttaagacctgcatatggccaaagtcacatactctttggtcaaatggggtactagagtcagaaatgataatacccaagatatatggaggaccaatatctcagcataattatcgtccgggatattttactcaggccgcagggccatggcacttgggaaaattagaacttgactttgatctatgcgaaggaactacggtagtagtagatgaacattgtggcaatcgaggcccgagcctaagaacgactacagtgacaggaaaaataatacacgaatggtgttgcagatcatgtactctaccacctttaagattcaggggtgaagatggatgttggtatggcatggagatccgaccaataaaagaaaaagaagaaaacctggtgaaaagcatggtaagcgctggctccggagaagttgactctttctcactcggtttactatgtatatcaatcatgatcgaagaggtaatgaggtctagatggagcaggaggatgttaatgaccggaacattagccgtattctttttattgataatggggcaacttacttggaacgatctaataagactgtgtattatggtaggtgccaatgcgtccgacagaatgggtatggggacgacgtatttagccttaatggcaacatttaaaatgaggccaatgtttgcggtgggcttactatttcgacgtctaacaagtagggaagtattgcttcttaccatcggactaagtctggtagcttctgtagaattacccaatagcttagaggaacttggcgatggcctcgccatgggtataatgatactaaaattacttacagattttcaatcccatcaattatgggcaacgctattaagtctgaccttcataaaaacaacgttttcactacattatgcgtggaagactatggcgatggtcctatccatagtatcattgtttccactttgtttgtccacaacaagtcaaaagacgacctggctacctgtactcttaggatcacttggctgtaaaccgttaacaatgttccttatagcagagaataaaatatggggccgtcgcagctggccactaaacgaaggaattatggcagtcggtatcgtttcgatcctattaagcagtctcctcaaaaacgacgtgccattagcggggcccttaattgcaggaggaatgctaattgcctgctatgtgatatctggttcctcagcagacttaagcctagaaaaggcggccgaggtaagctgggaagaagaagctgaacacagtggagcaagccataatatcctcgtagaagtacaagacgatggcactatgaaaatcaaagatgaagaacgggacgacacgctaacaattttgctaaaagcaactctgttagcagtttcaggtgtttatccactttccatcccagcaactttatttgtctggtatttctggcagaagaagaaacaaagatctggggtgttatgggacactccaagtcccccggaagttgaaagggcggtattagatgatgggatttaccgcataatgcagcgagggttattaggaaggtcccaagttggagttggagtctttcaagagaacgtatttcacaccatgtggcatgtcaccaggggtgcagtcttaatgtatcagggaaagaggttagagccctcgtgggcatctgttaagaaagatttaattagctacggtgggggatggcgactacagggaagctggaacacaggtgaggaagtccaagttatagctgtcgaaccagggaaaaatcctaaaaacgtccaaaccgcaccagggactttcaaaactcctgagggtgaggttggggctatagcattagactttaaacctggcacaagtggcagtccaatagtaaatagggagggaaaaatagtaggattgtatggaaatggagtagtaacaacttcaggaacatatgtatctgctatcgctcaagcgaaggcttcacaagaaggccccttacccgaaatcgaagatgaagtattccgtaagcgtaatctaacgattatggacctacatccaggttcaggaaaaacaagaaggtatctacccgctattgtgagagaagcaatcaaaaggaagctaagaacattaattttggctcctacccgagttgttgctagtgaaatggccgaagctctaaaaggcatgcccattagataccaaacaacggcagtgaaatcggaacatactggtaaagagatagtagacttaatgtgccatgcgacctttacaatgagattattatcaccagtgcgagtcccaaactataatatgattatcatggacgaagcacattttaccgatccatcttccatagcggctcgagggtacatatcaactagagtaggaatgggagaagcggcagcgattttcatgacggcgactccaccaggatcagtagaagcatttcctcaatcgaatgcagtaattcaagacgaagaacgtgatattccagaacgttcttggaactcaggctatgaatggataaccgactttccaggtaaaactgtatggtttgtcccgagcataaagagcggaaatgatattgcgaactgcctgaggaaaaatggaaaacgagtcatacagttaagcaggaaaacgttcgatacagagtaccagaaaactaaaaacaatgattgggattatgttgtgacaactgacatctcagagatgggagcgaactttagagcagacagggtcatagacccgagacggtgcctgaagcccgtaatattaaaagatgggccagagcgagtaattttggcaggacctatgcccgtcactgtggcgagtgcagcgcaacgtagggggcgaataggtcgaaatcacaataaagaaggtgatcaatatatatatatggggcagccccttaacaatgatgaagaccacgcacactggacagaagcaaaaatgctactcgataacatcaacacaccggaaggtatcataccggcattatttgagccagaaagggaaaaatccgcagcaatcgacggagaatatagattaagaggagaagctcgaaagacatttgtggagttaatgcgcagaggagacttgccagtatggttaagctataaagtagcctcagagggattccaatatagtgaccgacggtggtgctttgacggagagcgaaacaatcaagttctagaagaaaatatggatgtggaaatttggacaaaagaaggagagagaaagaaacttcggcccaggtggctagacgcaaggacgtatagtgacccgttagcgcttagagaatttaaggaatttgcggcaggcagacgatccgtttcaggcgacttaattttagaaatcggcaaactgcctcagcatcttactcaaagggcacaaaacgctttagataatttagttatgttacataattctgaacagggaggacgagcttatcgacacgcaatggaggaactgccagatacgatagaaactttaatgctccttgccctaatagcagtactcacaggcggagttacactgttcttcttatccggaagaggcctaggtaagacgagtatcgggcttctgtgtgttatggcctcaagtgtcctactatggatggccagtgtagaaccgcattggattgctgctagcataatacttgagttctttttaatggtgttactaataccagaaccagaccgtcagagaactcctcaggacaaccagctagcttatgtcgtaattgggctgctatttatgatcttaacagtcgcagcaaacgagatgggactattagaaaccactaagaaagacctcggtatcggccacgtggctgtagaaaatcatcatcatgctgcaatgttagacgtcgacttacacccggcttcagcgtggacactgtatgcagtcgcaaccacgatcatcactccgatgatgcgacacactatagaaaatacaacagcaaacataagtctaactgccattgcaaaccaggcagctatattaatgggattagacaagggctggcccatctctaaaatggatatcggagtgcctttgttagctttaggatgttactcacaagtgaatcccttaactctcacggccgctgtcttgatgctggtagcacattacgcaattataggacctggcttgcaagcgaaagcaaccagggaagcgcaaaaacgaacagcagctggtattatgaaaaatcccacagtagacggaatagtggctatagatttggatccagttgtctatgacgccaaatttgaaaaacaattgggacaaataatgctacttatcctatgtacctcccaaatcctactaatgagaacaacgtgggccttatgcgaaagcatcacccttgcgacaggaccactgacgactctttgggaaggttcacctggtaagttctggaatacaacaatagccgtaagtatggctaacatctttagggggtcctatctagccggtgcaggcttagctttttctttaatgaaatctttaggaggtggccgaagagggactggggcacaaggggagaccttgggagaaaaatggaaaaggcaactcaaccaattatctaagagcgaatttaacacgtacaaacgcagtggtatcatggaagtagatcgttcagaggccaaggaaggtttaaaacgtggagaaaccacaaaacatgcagtcagtaggggaacagcaaaattacggtggtttgtcgagcgaaacttggttaaaccagagggaaaagttatagaccttgggtgcggaagaggtgggtggtcatattactgtgctggactcaagaaagtgaccgaagtgaagggatacacaaaaggtggcccaggacatgaagaaccaatacctatggcaacttatggatggaacttggtgaaactacacagcggcaaggatgttttctttatacccccggaaaaatgtgatactttgctatgtgacattggcgagagttctccgaacccaactattgaagaaggccgaaccttaagagtgctaaaaatggtggaaccctggctcaggggtaatcagttttgcattaaaatccttaacccatatatgccgagcgtcgtagaaactttagaacagatgcagcgtaaacacggaggcatgcttgtaagaaatccactaagtagaaatagcacccatgagatgtactgggtttcgtgtggaacaggaaacattgtatcagccgtaaatatgacatcaagaatgctccttaacaggtttaccatggcacatcgaaaacccacatatgaacgggacgttgatctgggggccggaacacgacatgtggccgtcgaaccagaggttgcaaatttagacataataggccagcgcatcgaaaatataaagcatgaacacaaatcaacttggcactacgacgaagataatccatataagacatgggcataccatgggtcctatgaagtgaaaccctcggggtcagctagctcaatggtaaacggagtggttaagctcttaacaaaaccctgggatgtcattcctatggtaacacaaatagctatgacagatactaccccattcggccaacagagagtctttaaagaaaaggtggatacaagaactccaaaagcaaaaaggggaacggctcaaatcatggaggttactgctaaatggctatggggattcttatctagaaacaagaaacctcgtatatgtacccgcgaagagttcacccggaaagttcgctcgaacgctgcaattggagctgtattcgttgacgaaaatcaatggaactctgctaaggaagctgtcgaagatgagagattttgggacctcgtacatagagagagagagcttcataagcaaggaaaatgtgcaacatgtgtctataatatgatgggaaaaagagagaagaaattaggcgagtttgggaaagccaagggatctagagcaatatggtatatgtggcttggtgccagatttcttgagttcgaggcattaggattcatgaacgaagatcactggtttagtagagagaatagtttatctggagtagaaggagaaggcttacacaaactaggctatatattaagggacataagcaaaatacctggaggtaacatgtatgctgatgatacagcaggatgggacaccaggataacagaagatgatttacaaaatgaagcccgaataacagatataatggaacccgaacacgctttactagcaaaatctatattcaagttaacatatcaaaataaagtagtccgcgttcaacgaccggctaaaaatggcactgtaatggatgtaatttctagaagagaccaaagaggctcggggcaggttggaacctatggacttaatacattcacaaacatggaagcacaattaatacgacaaatggagtctgagggtatcttctcgccctccgagctagagaccccaaacctcgcagaacgagtactagattggctagaaaaatatggagttgaacgactgaaacgaatggctattagcggagatgactgcgtcgtcaaacctattgatgatagatttgcaaccgcactgacagcattaaatgatatggggaaagtgcggaaagacattccccaatgggaaccttctaagggttggaatgactggcaacaagtgcccttttgtagccatcattttcatcaattgataatgaaagatggaagagaaatagtcgtcccgtgcagaaaccaagatgaattagtcggccgggcacgggtctcgcaaggcgctggatggagtctcagagaaacagcctgcctagggaaatcatacgcccaaatgtggcaattaatgtactttcaccgtagagacttgcgattggcagctaatgcaatctgttctgcagtaccagtggattggataccaacaagtcgtactacatggtcaatacacgcgcaccatcaatggatgacaacagaagatatgctaagcgtttggaatcgtgtatggattgaagaaaacccatggatggaggataaaacccacataagtagttggggagacgtgccatacctgggcaaacgagaagaccaatggtgtggcagcttgataggtctaacggcacgagcgacctgggcgacaaacatccaagtggcaataaaccaagtccgccgcttaatcggaaacgaaaactacttagactatatgacctctatgaagagattcaaaaatgagtcggacccagagggtgcactgtggtaa

SEQ ID NO: 21659 - RNA, 9879 nt, synthetic construct
  misc_feature 1..9879: note = derived and/or modified CDS sequence (opt6) from DENV-1__GQ199780__SS-prME
  source 1..9879: mol_type = other RNA
tcagtgacaatgttattaatgttaatgcccaccgcactagcttttcacttaactacaagaggaggagaaccccatatgatcgtaagtaaacaagaaagggggaaatctttactttttaaaacaagtgcaggagtaaatatgtgtacgctcatcgccatggatttaggagaattttgcgaagacactatgacttataaatgtccaagaatcactgaagcagaacctgacgatgttgactgctggtgtaatgctacggatacgtgggtgacatatgggacatgctctcaaacgggagaacataggagagataaacgttctgttgcattagcaccacatgtgggcctaggtttagagacgaggacagaaacctggatgagtagtgaaggagcatggaaacaaatccaacgagttgagacctgggccttaagacatccgggattcacagtaatagcattgttcttggcacacgcaataggtacatcaattacgcaaaaaggaattatatttatccttctaatgctggtaacaccaagcatggcaatgagatgtgtaggaattggttcaagagatttcgtagaaggattatcaggagcgacttgggtcgacgtagttctggaacacgggtcctgtgtaactacaatggccaaagataaacctacgctcgacatcgagctattaaaaaccgaggtaacaaatcctgccgtattgcgaaaattatgtatcgaggccaaaatcagcaatacaactacggattcgagatgcccaacccaaggagaggcaacccttgtcgaagaacaagacgccaattttgtatgtaggcgcacgttcgtagatcgagggtggggaaatgggtgtggactatttgggaaaggatcattgataacatgtgccaaatttaaatgtgtgacgaaactggaaggcaaaatcgttcaatatgaaaacttaaaatacagcgttatagtaacggtacatacgggcgatcaacatcaagtgggaaatgaatcaacggaacatggaaccacagcaactattactccacaagcacctagtaccgaaattcaactgacagactatggcgcactgaccctggattgctccccacgaacaggattagattttaacgaaatggtattactaactatgaaagagaaatcgtggttagtacacaaacaatggttcctagatttgcccctcccttggacaagtggtgctagcacctcccaagaaacttggaatcgaaaagacctattagtcacattcaaaaccgctcatgcaaagaaacaagaagtggtagttttaggttctcaagaaggagcgatgcacactgcacttacaggcgcgacagagattcaaacttcaggcactactacgatttttgctggccacttaaaatgcagactaaaaatggacaaacttactcttaaaggaatgagttatgtgatgtgcacaggttcgttcaaattggaaaaagaagttgcagaaactcaacacgggacagtccttgtacaaataaaatacgaaggaacagacgctccttgtaagatacccttttcaacacaagatgaaaagggcgtaacacaaaatggtcgacttataactgctaatcccatagtaacagataaagagaagccagttaatatagaagctgagccaccctttggtgagtcttacatagtaatcggcgcgggtgaaaaggccttgaaattgagttggttcaagaaaggctccagcataggcaaaatgtttgaagcgaccgctcgcggagcaagaaggatggctattcttggagacacagcttgggattttggtagtatcggaggagtcttcacttcagtgggcaagctagtacaccaaatattcggaactgcttatggcgttctattcagcggcgtatcatggacaatgaaaatcggcataggggtcctgttaacgtggctaggattaaactctaggtcaacatctttatcaatgacgtgtatagcagtcggtctagtaacgttatacttaggagttatggttcaggccgattcaggatgtgtaattaattggaaaggcagagaactaaaatgcggttctggcatttttgtgacgaatgaggtacacacttggacagaacagtacaaatttcaggcagattccccaaaaaggctatcagctgctatagggaaggcttgggaggagggggtatgcggtatacgatcggcaacacgcctggaaaacataatgtggaaacaaatatcgaatgaattaaaccacattctattggaaaacgacatgaaatttacggtcgttgtaggtgatgtagcaggcatacttgcacaaggcaagaaaatgatccgtccacagccaatggaatacaagtacagttggaagtcttggggaaaagcaaaaatcataggtgctgatgttcaaaatacgacattcataatcgacggtccaaatactcccgaatgcccagatgaccaaagggcatggaacatttgggaagttgaagattatggtttcggaatattcacgacaaatatatggcttaaacttagagatagctatacacaagtatgtgatcacaggctaatgagtgctgcaataaaagatagtaaggcagtgcatgcagatatgggatattggatcgagtcggaaaagaatgaaacttggaagttggcgcgggcttcgttcattgaggtaaaaacttgtatatggccaaagagccatactctttggtccaatggtgttttggaatcagaaatgattatacctaagatatatggaggtccgatatcccagcataattatcgaccagggtattttactcagaccgccggtccatggcacttaggaaaactcgaactggactttgacttatgtgaaggaacaacagttgttgtggatgaacattgtgggaatagagggccatctctaagaacaacaacggtaaccgggaagataatccatgaatggtgttgcaggagctgtacattacctccattaagatttaaaggagaagacggatgctggtacggtatggaaatacgcccggtcaaagaaaaagaagaaaatctggtaaaatcaatggtcagtgcaggtagcggggaagtagattcgttttctttgggattattatgcataagtattatgatagaagaggtaatgagatctagatggtccagaaaaatgttaatgacaggcacactagctgtattctttcttctaattatgggtcagctgacatggaacgacctgataagactttgtataatggtcggtgccaatgcatctgatcgtatgggaatgggaactacttacttggccttaatggctaccttcaaaatgagacccatgtttgcagtaggcttgttattccgaaggctaacttcgcgagaggtattgctcttaacaataggtctaagtctggtagccagtgtggagctgccaaatagtcttgaagaactcggtgacggactagcgatggggataatgattttaaaactcttaacagattttcagtcacatcagctatgggccacactgctatcactaacttttataaaaacaacgtttagcttgcattatgcttggaagacaatggctatggtactttcgatagtttcgctatttcctttgtgtcttagtacaacttcacagaagacgacgtggttaccagtattactaggttcacttggttgtaaaccattaaccatgttccttattgcagaaaataagatatggggacgaaaatcctggccgctaaacgaaggtatcatggctgttggtatcgtttctatattactttcagccttgttgaaaaatgatgtgcccctagctggacccttgatagctggcggcatgcttatagcctgttacgttataagcggttctagtgccgatttatctttagaaaaagcggctgaagtctcgtgggaggaggaagctgaacacagcggggcatcgcacaatattctcgttgaagtccaagacgacggaacaatgaaaataaaggatgaagaaagagacgatactttaactatattgttaaaagccacactactggcggtgtcaggagtttatcctctaagtataccagcaactttgttcgtttggtatttctggcagaagaagaaacaacgttcaggagtactatgggacactccatccccgccagaagtcgaaagggctgtgcttgacgacggtatctatagaatcatgcaaaggggactattaggccgatcacaagttggagttggagtttttcaagagaatgttttccataccatgtggcatgtaacgaggggtgccgtccttatgtatcaggggaaaagattagaaccttcatgggcaagcgtcaagaaagacctaatatcttacggaggtggatggagactacaaggatcatggaacacaggcgaagaagttcaagttatagcagtggaacctggcaaaaatcctaaaaacgtacaaacagccccaggaacattcaaaacgagtgaaggagaggtgggcgccattgcacttgacttcaaaccaggcacttctggaagtcctatagtcaatcgagaagggaaaatagtcgggttgtacggaaatggggtggtcactacatcaggcacatacgttagcgcgatcgcccaagcaaaagcctcacaagaaggtcccttacctgaaatagaagatgaagtttttcgaaaaagaaatttaactataatggacctccatccgggttcgggcaagacaaggagatacttgcctgctatagtgcgggaggcaataaaacggaaacttagaacgctcatattagcacccacaagagtagtagcatcggaaatggcagaagctctaaaaggtatgccaatcaggtaccaaaccacagccgtaaaaagtgaacatacggggaaagaaattgttgaccttatgtgccatgctactttcacaatgagattactaagccctgtaagggtcccaaactacaatatgataattatggatgaagcacattttacagatccgtcatcgatagcagcaagagggtatatttccactagggttgggatgggagaggcggcagccatatttatgacggcaactccaccaggatcagtagaggcttttcctcaatcaaatgctgttatacaggatgaggaaagagacatcccggaaaggagctggaactcagggtatgaatggatcacagatttcccaggaaaaacagtctggtttgtacctagcataaaatccggtaatgatattgctaattgcttacggaaaaatggaaagagggtgatacaactcagccgtaaaactttcgacacagaatatcagaaaactaagaataatgattgggactatgtagttaccacggacattagtgagatgggggctaactttcgtgccgacagggtaatagatccgagaagatgccttaagccagtaattcttaaggatgggcctgagcgagtcatattagcagggccaatgccggtcacagtggcaagtgcggcacaaagacgaggacgaatcgggaggaatcacaataaagaaggtgatcagtacatttatatgggtcaacctctcaacaatgatgaggatcacgcacactggacagaggcaaagatgctacttgataatattaacacgcccgaaggaattatcccggctctttttgaacctgaaagagaaaagagcgcggctattgatggagagtatcgcctgagaggcgaagcaaggaaaacatttgtggaactaatgcggcgtggggatttgccagtctggctaagttacaaagtagcttcagaaggatttcaatattcagaccggcggtggtgcttcgacggagagcgtaacaatcaagttctcgaagaaaacatggacgttgaaatatggacaaaggaaggagaaaggaagaaattacgtccgagatggttagatgcccgaacctatagtgacccgcttgccctccgcgagtttaaggaatttgcagccggccgaagatctgtgtccggtgatttgatacttgagataggtaagctgccacaacatttaactcaaagagctcaaaacgccttagataatctcgtaatgttacataatagcgaacaaggcgggagagcatatcgtcatgcgatggaagaattacccgacacgattgagactctaatgttattagcgttgatcgccgttttaaccggtggagttactctattctttttatcgggtcgtgggttgggaaaaacttcaatagggttactctgtgtaatggcatctagtgtactactatggatggcaagtgtggagccgcattggatcgcagcgagtataattttagaatttttcttaatggtattattaatccctgaaccagacaggcagagaactccacaagacaatcagttggcttatgtggtaataggacttttatttatgatactaaccgtagcagcaaatgaaatgggattactggaaactactaagaaagacctaggaatcggacatgtagcagtcgaaaatcaccatcatgccgcaatgcttgacgttgacttgcatccagcatccgcatggacattatacgcggtcgcaaccacaataataacccctatgatgagacatacaatagaaaatacaacggctaatatatctctgactgcgatcgccaatcaagcagctatattaatgggactcgataaagggtggccaatatcgaaaatggatattggggtacctctattagcactgggatgttattcacaagttaatccgctaaccctaacagctgcagtacttatgctggtggcgcattatgctatcataggacccggactacaagcaaaagcaacgagggaggcacaaaaacgaacagcagcagggatcatgaaaaatccaacggtggacggaattgtcgctattgatcttgaccccgtagtctatgacgccaaattcgaaaaacaattgggtcaaatcatgttattaatcctgtgtaccagtcagatactgcttatgcgaaccacgtgggctctctgtgaatccattactttggcaactggacctctaacgacattgtgggaaggaagccccggaaagttctggaatacaactattgcagtgtcaatggccaacatctttcgtggcagttatctcgcgggcgctggtttggcatttagcttaatgaaatccctcggaggtggacggagaggaactggagcacaaggcgaaacactaggggaaaaatggaaaagacaacttaaccaactgtccaaatcagagttcaacacctacaaaagatccggcattatggaagtcgatcgttccgaggctaaagaaggattgaaaagaggagaaactacaaaacatgctgtgtcgcgtggaaccgcgaagctcagatggtttgtagaacggaatctagtaaaacctgaaggtaaagtaatagatttaggatgcggcagaggtggttggtcatactattgtgcggggttaaagaaagtaaccgaagtaaaagggtatacaaaaggtggcccgggacatgaagaaccaattccaatggcaacatatggttggaatctggtcaaattacattcaggtaaagatgtatttttcataccgcctgaaaaatgcgataccttactatgtgatatcggcgagagcagccctaatccaacaatagaagaaggccggacattacgggtcctaaaaatggtagagccatggttaagaggaaatcaattctgcattaaaattctaaacccttacatgccaagcgtcgtcgaaactctagagcagatgcaaagaaagcatggaggaatgttagtaagaaatccattatcaagaaacagtacacacgagatgtactgggtaagctgtggtaccggcaacatagtatctgctgtaaatatgacgagtcggatgctattaaatcgtttcactatggctcataggaagcctacgtatgagagagacgtagatctgggtgctggaacaagacacgtagccgtggaaccggaagtagccaatctagacattatcgggcaaagaattgaaaatataaaacacgaacataagagcacctggcattatgatgaggacaatccttataaaacatgggcttatcacggatcatacgaagtaaaaccgagcgggagcgcatcaagcatggtaaatggagtagtcaaactcctcactaaaccatgggatgttattcctatggttacacaaatagctatgactgatacaacacccttcggccaacaacgagtttttaaagagaaagttgacacaagaacaccaaaggctaaacgaggcacggctcagataatggaagtaacagcaaaatggctatggggtttcttatcgcgaaacaagaaaccaagaatttgcacacgagaagagttcacgagaaaggtgcggtcgaatgcagcaataggtgcagtttttgtagatgaaaatcaatggaactcagccaaggaagctgtcgaagatgaaaggttttgggatttagttcatcgagaaagggaattacataaacaaggtaaatgcgcaacatgcgtgtataatatgatgggtaagagagagaagaaacttggggaatttggcaaagcaaagggaagtagagctatatggtacatgtggctaggagctagatttctcgaatttgaggcgctagggtttatgaatgaagatcattggttcagtagggaaaattctttgtcgggagtggaaggcgaaggcctccataaacttggttacatccttagagatatatcgaaaatacctggcggtaacatgtatgcggacgacactgcggggtgggacaccaggatcacagaagatgacctgcaaaatgaggcaaaaataacagacataatggaacccgaacacgcgttgttagcaaaatcgatattcaaactgacctaccaaaataaagtagtgagagtccaacgccctgctaaaaacgggacagtaatggatgttatttccagacgagatcaacgaggttcgggacaggtcggaacatacggtttaaataccttcactaatatggaggcccaattaatacgacaaatggaatcagaagggatattctcaccatcagaacttgaaactcctaacttagctgggcgtgtgctagactggctcgaaaagcacggggtcgaacggttaaaacgaatggcaatttctggagatgattgtgtagtgaaaccgatagatgaccgatttgctacagcgttaactgcattaaacgatatgggtaaagttcgcaaggatgtacctcagtgggaaccatcgaaaggatggaacgactggcaacaagttccattctgttctcaccatttccatcaattgattatgaaagacggacgcgagattgttgtaccctgccgaaaccaggatgaactcgtgggtagagctcgagtatcacaaggagccgggtggagcctcagagagaccgcctgcctgggcaaaagttatgctcaaatgtggcagctaatgtattttcatagacgagatctgagactggccgcaaacgcaatatgttcggcagttcctgtagattgggtaccgacaagcagaacaacgtggtccatacatgcgcaccatcagtggatgactacagaagatatgttgagtgtttggaaccgagtatggatagaagaaaacccttggatggaggacaagactcatataagtagctggggtgatgttccatacctgggaaaaagagaagaccagtggtgtggttctctaataggtctaacagcaagagcaacgtgggccactaacatccaggttgcaattaaccaggtccggcgattaataggcaacgagaactatctagattacatgacgtcaatgaaaagatttaaaaatgaatcagatcccgaaggtgcattatggtga

SEQ ID NO: 21660 - RNA, 9879 nt, synthetic construct
  misc_feature 1..9879: note = derived and/or modified CDS sequence (opt6) from DENV-1__GQ199781__SS-prME
  source 1..9879: mol_type = other RNA
agtgtaaccatgcttttaatgctgatgccaaccgcactagcgtttcaccttacaacacgaggtggtgaaccacatatgatagtaaccaaacaagaacgcggcaaatctttattatttaaaaccagtgcaggggtaaacatgtgcactctaatcgcaatggacttgggagaattatgcgaagacactatgacgtataaatgtcccagaattacagaagcagaacccgatgatgtggactgctggtgcaacgcaaccgatacctgggtaacttacggaacctgctctcaaactggtgaacacagaagggacaaaagatcagttgccctagcaccacacgtaggcctagggcttgaaacgagaacagaaacatggatgtctagtgaaggtgcatggaaacaaattcaaagggtggaaacatgggctttacgacatcctggatttactgtaatagcactcttcctagcgcatgcaataggaacatctataacgcaaaaaggaatcatatttattttactaatgcttgtcacgccatccatggctatgcgatgcgtcgggataggatcccgagatttcgtagaaggactaagcggagcaacatgggtggatgtggtattagaacatggatcatgcgtaactaccatggccaaagacaaaccgacattggatatcgaattattaaaaacagaagtaacaaatccggctgtgctaaggaaactatgcatagaagcaaaaatatcaaatacgactacagattcgagatgccctactcaaggagaagcgactcttatggaggagcaagatgctaattttgtttgtagaaggacctttgttgatagaggttggggtaacggttgcggtcttttcggtaaagggtcactaattacgtgtgctaaatttaaatgtgtcacaaaactggaagggaaaattgtacaatatgaaaacttgaaatattcggtaatcgtaaccgttcatacaggagatcagcaccaagttggtaatgaaagcactgaacacggtaccacagctacaataactccccaagcacctaccagtgaaatacagttaaccgattatggggcgctcactttggattgttcaccaagaaccggactagatttcaacgaaatggtgttactcactatgaaagaaaaatcatggctagtacataagcagtggtttcttgacctacctctaccgtggacaagtggtgcctcaacatctcaagaaacttggaacaggcaagatctactggtaacatttaaaacggcacacgcgaagaaacaggaagtagttgttcttggcagccaagagggagcgatgcatacagctctcactggagcaacggagatccaaacgtcaggaactacgaccatcttcgctgggcatctaaaatgcaggctaaaaatggacaaactaacgctgaaaggtatgagttatgttatgtgtacaggatcttttaagttagaaaaagaagtcgctgaaacccaacacgggacagtattggttcaaataaaatatgaggggacggatgcgccgtgtaaaataccgttcagcacgcaggacgaaaagggcgtcatccaaaacggccggcttatcacggccaatccaatagtaactgataaggaaaaaccggtcaatattgaagcagaacccccttttggcgaaagctacatagtaataggggttggagaaaaagcattgaaactctcatggtttaagaaaggatccagtatagggaaaatgtttgaggcgactgcaagaggggctcgaagaatggcaatactcggagatacagcctgggattttggctcgattggcggcgtcttcacttcggtagggaaattagttcatcagattttcggtacagcgtacggagtcttgttttctggcgtaagttggactatgaagataggaattggcgtactgttaacatggttaggacttaactccaggtcaacatcactatcgatgacttgtatagctgtgggcttggtgactctgtatctaggggtaatggtccaagcagatagtggatgcgtcattaactggaaagggcgagaactaaaatgtggatccggaatatttgtaacgaacgaggtacacacatggacagaacaatataaattccaagcagactcgccaaagcgattgtcagccgcaatcggtaaggcttgggaggaaggcgtttgtggtattcgatccgcaacccgattagaaaacattatgtggaagcagataagcaacgaattgaaccacatactattagagaacgatatgaaatttacagtagttgtcggagacgtagtaggaatactagcccagggcaaaaagatgatacgtcctcagccaatggaacataaatattcttggaaatcatggggcaaagctaaaataatcggggcagacgcccaaaacacgacatttattatagatggacccaatacacccgaatgcccagatgaccaaagagcatggaacatatgggaagtagaagactatggatttggaattttcacaaccaatatctggctcaagttaagggactcatatacgcaggcttgtgaccatagactaatgagcgccgcaattaaggatagcaaggccgtacacgctgacatgggatattggatagaaagtgagaaaaatgaaacctggaaactagctcgtgcttcatttatcgaagtaaaaacttgcatatggcctaaatcacacacgctgtggtcaaacggcgttctagaaagtgagatggtaatacccaaaatctacggcggaccaatctcacagcacaattatagaccagggtacttcacacaaacagccggcccttggcacttgggaaaactagaattggattttgatttatgtgaagggaccacggtagtcgttgacgaacattgtgggaatcgaggaccctccctcagaacgactactgtcacagggaagatcattcacgagtggtgctgtagatcgtgtaccttacctcccttgaggtttaaaggtgaagacggctgttggtatggcatggaaatcagaccagtcaaagagaaagaagagaatctagtcaaatcaatggtatcggcaggttcaggggaagtcgatagtttctcccttggactattgtgtattagcataatgatcgaagaagttatgcgatccagatggtccagaaaaatgttaatgacgggaactctagcagtatttctgttgttaataatggggcaactaacgtggaatgacctaatacgactatgtattatggtaggagcaaatgcctctgacaggatgggaatggggacgacatacttggcattgatggcaacatttaaaatgcgtccgatgtttgctgtaggattattatttcgtcgactgacctcaagggaggttttgctacttacgataggactaagcctcgtagcaagtgttgaactacctaactcattagaagaactcggggatggtttggcaatgggtatcatgatcctgaaacttttaaccgactttcaatcccaccagctatgggctacgctgctttccttaacgtttataaagacaaccttatccctccactacgcatggaaaactatggcgatggtgcttagtattgtatccttattcccactatgtttatcgacaacatcacaaaagacaacttggctgcctgtcttacttggttcccttgggtgcaaacccctcacaatgtttttaatagcggaaaataaaatatggggaagaaaaagttggccacttaatgagggaatcatggcagtaggggtagtcagtatattattatcatctcttcttaagaacgacgtaccactagcaggaccgttgattgctggtggtatgctaatagcatgctatgttataagtggaagcagtgcagacctctctctagagaaggcagctgaggtgagttgggaagaagaagcagaacatagtggggcctctcacaatatcttagtggaagttcaggatgacggcacaatgaaaataaaagacgaggagcgggatgatacccttactatattgttgaaagctactctgttagctgtttcaggagtctaccctttaagcatacctgcgacactgttcgtatggtatttttggcagaaaaagaaacaacggagtggcgttttatgggacacaccatcaccacccgaagttgaacgagcagtcttagacgatggtatctatagaataatgcaaagagggttgcttggtagaagccaagtaggagttggagtctttcaggaaaacgtcttccacacaatgtggcacgttactagaggagctgtgctaatgtatcaaggaaaaagactagagccgtcatgggcttcagtcaagaaagacctaattagctacggcggaggatggaggctacaaggtagctggaacacaggtgaagaggtacaagtgatagcggtcgaaccgggcaaaaatccaaagaatgtacagacagcgcccggaacatttaaaaccccagaaggagaagtaggggcgatagctctagactttaaacctggaacctcaggatctccaatagttaatcgagaaggaaaaatagtgggtctatatgggaacggagttgtcacaacctccggtacatatgtaagcgccatagcacaaacgaaagccagtcaagaggggcctctacctgaaatcgaagacgaagtattcagaaaacggaatctgactataatggacctccatcctggatccggcaaaactcgacgatatttaccggccattattcgagaggcaataaaaagaaaactgcgcactcttattctagctccaacaagagtagtagctagcgagatggccgaggctttaaagggcatgccgataagatatcaaaccacagcagttaaaagcgaacataccgggaaggaaatagtcgacctaatgtgccatgcaacattcacgatgcgattactatctccagttagagtgcctaactataacatgataatcatggatgaagctcactttacggatccatcaagtatagctgcaagaggctacattagtacacgcgtaggaatgggagaggcagctgctatttttatgacagcaacaccaccgggatcagtggaggctttcccacaatctaatgcagtaatccaggatgaggaacgagatatccctgagagaagctggaactcaggatacgaatggatcactgatttcccaggcaagacagtatggttcgtaccaagtataaagtctgggaatgacatagcaaattgcctaaggaaaaacggaaaacgcgttatacaattaagccgcaaaacctttgatactgaatatcaaaagactaaaaataatgactgggattatgtagtaactaccgatatatctgaaatgggagcaaactttagagcggaccgagtgattgatcctagacggtgtttaaaaccagtaatattgaaagatggcccggaaagagtaatactcgcgggcccgatgccagtaactgtggcctcagctgcacagaggagaggacgaatcggaaggaatcacaataaggagggagatcaatatatttatatggggcaaccattaaataacgacgaagatcacgcacattggacagaagcaaaaatgttactagataatataaacactccggagggaatcattccggccctttttgaacctgaaagagaaaaatctgccgcgattgacggtgaatacagacttcgaggtgaagccagaaaaacatttgtggaacttatgagacgtggagatcttcccgtctggttaagttataaagtcgcaagtgaaggtttccaatatagtgatagacggtggtgttttgacggggaacgtaataatcaagtcttggaagaaaatatggatgtagaaatttggactaaagaaggtgaaaggaaaaagttaagaccgagatggttagatgccagaacgtactccgacccactagccttacgagagttcaaagagttcgcagcaggcagacggagcgtaagtggagatctaattctagaaattggtaaattgccgcagcatctgacccaacgagcgcaaaatgcccttgacaacctcgtaatgctacacaactcagaacaaggtggcagagcttatagacacgcgatggaggaactaccagacaccatagaaactcttatgcttctagcattgatagcagttttaacagggggagtaacactgttctttttgagtggacgtggcttgggaaagacttcgattggattgttgtgcgttatggctagctctgtgttattgtggatggcatctgtggaaccccactggatagcagctagtatcattctggagttcttcctaatggtacttttaataccggaaccagataggcaacgcacacctcaagataatcaactcgcttatgtagtgataggccttttatttatgattctaacagtagcagctaacgaaatgggtttattagaaacgacaaagaaggacctgggtataggtcacgtggccgtagaaaatcatcaccacgcaactatgctggacgtagaccttcatccagcgtcagcctggaccctttatgcagttgcgacgaccataatcactccaatgatgagacatacaatcgaaaatacaactgcaaatatatcgctaaccgcaatagcgaatcaagcggcaatccttatgggactggataaaggatggccaatttcgaagatggatataggagttccgctattagctttagggtgttatagtcaagtaaacccactaacattaactgcagcggtcctcatgcttgtcgcacactatgcaataatagggccgggcttacaggcgaaagctacaagggaagcccagaaaagaactgcggcaggaataatgaaaaaccccacagtagatggaatagtcgcaatagacttggaccctgtagtatatgatgccaaatttgagaaacaactgggtcaaataatgttactgattttatgcacaagtcaaatattgttgatgagaacgacgtgggctctctgcgaatctataacacttgctacgggaccattaactactttgtgggagggatctccaggaaaattttggaatacaaccattgcggtaagtatggcgaatatattcaggggatcttacttggccggagccggattagcattctcgttaatgaaatcattaggaggaggcagaagaggaacaggagcgcaaggagagacgttgggggaaaaatggaaaagacaactaaaccaactaagcaagtctgagttcaacatctacaaaagatcaggcataatggaagtagatcgaagcgaagcaaaggaaggactaaagagaggggaaacaacacgacatgcagtgtccagagggacggctaaattgcgttggtttgttgaaagaaacctcgttaaaccagaaggtaaggtcatcgatttgggttgtggccgaggtggatggtcctactactgtgctggtctcaagaaagtaacagaagttaaaggttacacaaaagggggaccaggacacgaagaacctattcctatggcgacgtacggatggaatttagtgaaattgcactcaggtaaagacgtgttctttgcgccaccagaaaaatgtgacacacttctatgcgatattggggaaagtagccctaatccgaccatcgaagagggccggacattacgtgttctaaaaatggtagaaccttggctaagagggaatcaattctgtataaaaattctaaatccttatatgccaagcgttgttgagacgttagagcagatgcagagaaaacacggaggaatgctcgtccgaaatccattgtcaagaaactcaacgcatgaaatgtactgggtgtcctgtggaactgggaacatagtcagcgcagtaaatatgacatcacgaatgctactaaacagattcacaatggcccacagaaagccaacatacgaaagggacgtagatcttggtgcgggtacaagacatgtagcggtagaaccagaggtggcgaatttagatattattggccaaagaatcgagaatataaagcacgaacataaatcaacttggcattacgacgaagataatccctataaaacatgggcatatcacggatcatatgaggttaaaccaagtggatcagcatcatcaatggtcaatggtgttgtaaagctactaacaaaaccttgggatgttattcccatggtaacgcagatagccatgacggatacaaccccttttggacagcagagagtatttaaggagaaggtagacaccagaacacccaaagcaagaagaggaacggctcaaattatggaggtaacagctaggtggttatggggatttctaagtagaaataagaaacctcgaatttgcactcgcgaagagttcactcgtaaggttaggtctaatgccgcaataggagcggtgttcgtggacgaaaaccagtggaactcagcaaaagaggcagttgaagatgaaaggttttgggatctagtacaaaaggaaagagaactgcataaacaaggcaaatgtgcgacttgcgtatataacatgatgggaaaaagagagaagaaactaggagaatttgggaaagcaaaaggttcacgcgcaatatggtacatgtggttaggtgcgaggtttctagaatttgaagcccttggctttatgaacgaagatcactggttcagtagagaaaactctttgagtggtgtcgaaggcgaaggactgcataaactaggttacatacttcgagacatcagtaagataccgggaggaaatatgtatgccgacgacacagccggatgggatactagaataaccgaggatgatttgcaaaacgaagctaagattacagacataatggaaccggagcacgccttacttgcgacttcgattttcaagctgacataccaaaataaagtggtcagagtacaacggcctgccaaaaatggaactgtgatggacgtaatttcaaggagggaccaacgtggaagcggccaagtaggtacgtacgggctcaatacatttacaaatatggaagcccaactaataagacagatggaatctgaaggaattttccttcctagcgagttagaaacgccaaacttagccgagagagttctcgactggctagaaaaacatggcgtagaaagactaaagcgtatggcaatctccggcgacgactgtgtagttaaacctattgatgatcgattcgctactgcattgacagctttaaatgacatgggaaaagtacgaaaagatataccacagtgggagccgagcaaaggctggaatgattggcaacaagtacccttctgttcacaccattttcaccagctaattatgaaagatgggcgagaaatcgttgtgccatgccgtaaccaagatgagttggttggcagagcacgagttagtcaaggcgcaggatggtccttacgggaaacagcttgtctggggaagtcgtacgcacaaatgtggcaactaatgtattttcacaggcgggacctcagattagccgcaaacgccatatgtagtgcagtgccagttgattgggtaccaacaagtaggacaacatggagcattcatgcacatcaccaatggatgacgacagaagatatgctatcggtgtggaacagagtgtggattgaagagaacccttggatggaggacaaaactcatgtaagctcatggggtgacgtaccatacctaggaaagagagaagaccaatggtgtggaagcctgattggactgactgctcgcgcaacatgggctagcaatatccaggtagccatcaatcaagtgcgccgcttaataggaaacgaaaactacttagattatatgacaagtatgaagcgcttcaaaaatgaaggagatcccgaaggggctttatggtaa

SEQ ID NO: 21661 - RNA, 9879 nt, synthetic construct
  misc_feature 1..9879: note = derived and/or modified CDS sequence (opt6) from DENV-1__GQ199782__SS-prME
  source 1..9879: mol_type = other RNA
agtgtgactatgttacttatgctgatgcctaccgcattagcttttcatcttacaacaagaggtggagaaccgcatatgatcgtaacaaaacaggaacgaggaaaaagtctgctattcaaaacaagcgctggtgtgaacatgtgcacactgatcgcaatggacctaggagaactatgtgaagataccatgacatacaaatgtccccgtattacagaagctgaaccagacgatgtagactgttggtgtaatgcaactgacacatgggtaacgtatgggacatgctcgcaaacaggagaacatcggcgggacaaaagaagtgttgcactggcaccacatgttgggctcggtttagaaactcggacagagacttggatgtcatcagaaggagcgtggaaacaaatacaaagagtggaaacatgggctttgcgacatcctgggtttaccgtaatagctctctttcttgcccatgcaattggtacctctattactcaaaaaggtattatatttatcctattgatgctagttacgcccagtatggccatgcgctgcgttgggataggatctagagattttgtggagggattatcaggagctacatgggtagacgttgtattagaacatggaagttgcgtaacaacaatggcaaaagacaaacctacacttgatatagaactcttaaaaacagaagtaacgaatcctgccgtacttagaaaattgtgcatagaagcgaaaatttctaataccacgacggacagtcgatgcccgactcagggtgaagcaacgcttatggaggaacaagatgctaactttgtttgtagaagaacattcgtcgacaggggatggggaaatggatgcggcttatttgggaaaggctcgttgataacctgcgctaaatttaaatgtgtaacaaaactcgaaggaaaaatcgtccagtacgaaaaccttaaatattcggtcattgttacagttcataccggggaccaacaccaagtaggaaatgaatcaacagaacacggaacaacagctacgataacaccacaagcacccacaagtgaaatacagctgacagactacggagcgctaacgttagattgtagcccaagaaccgggttggacttcaatgaaatggtactgttgacaatgaaagagaaaagctggctagtccacaaacaatggttcctagacttaccccttccatggacatctggggcgtcaacatctcaagaaacgtggaatagacaggatctattagtgacattcaaaacggcacatgcgaagaaacaggaagttgtcgtattaggtagccaagaaggtgccatgcatacagcccttaccggcgcaacagaaattcaaacaagtggaactaccacaatttttgcgggccatttgaaatgccgtcttaaaatggacaaactaacgttaaaaggaatgtcttatgttatgtgtacaggaagttttaaacttgaaaaagaagtagccgaaacacagcatggaaccgtcctagtgcaaatcaaatatgaaggcacagatgctccatgcaaaataccttttagtactcaggatgaaaaaggcgtaacacaaaatgggagacttattacagctaatccaatcgtaacggacaaggagaagccagtgaatatcgaggcggaaccacctttcggggagtcttacatcgtaataggagccggtgaaaaggcactgaaactatcttggttcaagaaaggttcgtcaattggtaaaatgtttgaggcaacagcacgaggagccagaagaatggctatattaggtgacactgcatgggactttggctctgtaggtggagttttcacgtccgtcggaaagttagttcatcaaatatttggtacagcgtacggtgttctattttcaggagtatcttggactatgaaaataggaataggtgtcttactaacctggttaggacttaactcacgctcaacaagtctttcaatgacatgtattgcagttgggttagtcactttgtacttaggcgttatggtacaagcggatagtggttgtgtgataaactggaaaggcagagagttgaaatgcggaagcggtatatttgtaaccaacgaggtacatacttggaccgaacaatataaatttcaagcagattcgcctaaaagactaagtgctgcaattgggaaagcatgggaagaaggagtatgtggcattcgaagcgcaactaggctagaaaatataatgtggaagcaaattagtaatgaattaaaccatatacttcttgagaacgatatgaagtttactgttgttgtaggagatgttgtcggtatattagcgcaaggcaagaaaatgattagaccccaaccaatggaacataaatatagttggaaatcgtggggtaaagctaaaataatcggagcagatatacagaataccacttttataatcgatggcccgaacacaccggaatgccctgatgatcaacgtgcctggaatatatgggaagttgaggactatggttttggcatatttacaaccaatatatggcttagacttagggattcatatacccaagtctgcgaccacagattaatgtccgccgcaattaaggattcaaaagctgtacatgcagacatggggtattggattgaaagcgagaaaaatgaaacatggaaactagcgagggcttcctttatcgaagttaagacgtgcatatggccaaaatcccatacattatggagcaacggagttcttgaaagtgaaatgataataccaaagatatatggaggtccaatttcacaacataactatcgacctggctatttcacgcaaacagctggaccttggcacctcggaaaattggaactagatttcgatctttgcgaaggtactacagtagtagtggatgagcattgtggaaataggggacccagtctgaggacaactacagtaacaggtaaaataatccacgaatggtgttgtagaagctgtactctaccacccttacgattcaaaggggaagacggttgttggtatggcatggaaatacgccccgtcaaggaaaaagaagaaaatcttgttaaaagcatggttagcgcaggaagtggagaagtagactcgttttcgcttggtttactatgtatatccattatggtagaagaggttatgaggtcgagatggagtcgtaaaatgttaatgacaggaacgttggctgttttcctactactcataatgggacaactcacttggaacgatcttatacgcctgtgtattatggtaggcgctaacgcaagcgatagaatggggatgggcactacataccttgcactaatggccacattcaaaatcagaccaatgtttgctgtaggcttattagtaagaagactcacaagtcgagaagtgctgttgttgacaattggtctttctttagtcgccagcgtggaattgccaaacagtttagaagaactgggtgacggcctagctatgggaataatgatacttaagttgcttactgattttcagtcccaccaattatgggccaccttattaagcctcacgttcataaagacaacgctctcattacattatgcatggaaaactatggccatggtcctgtcaatagtctcattgttcccattatgtttatcgaccacatcacagaaaactacgtggttgccagttctattggggtcactcggatgtaaacccctaacgatgtttctaatcaccgaaaataaaatctggggccgcaaaagttggcctcttaatgaagggatcatggcagtcggagtggtatcaatcttgttatcaagtctactcaaaaacgatgttccactggccggtccactaatcgcgggcggtatgttaatcgcttgttacgtaatttcgggttcctctgctgatttatcccttgagaaagcagccgaagtgtcatgggaagaggaggctgagcattccggtgccagccacaacatattagtagaggtacaagacgacggaacgatgaaaattaaagatgaagaaagagacgatactttaactattctcctcaaagcaactttgctagcagtatccggggtctaccccttgtctatcccagcaacactttttgtatggtatttttggcaaaagaagaaacagcgatccggtgtactctgggatactcctagtcccccagaggtcgaaagggcagtcctcgacgatggaatctataggataatgcaaagaggattactaggacgtagccaagtgggagtgggcgtgttccaagaaaatgtattccataccatgtggcatgtaacacgtggggccgttttgatgtatcaaggaaaaagactagaaccaagttgggcaagtgtcaagaaagatctaatctcatacggtgggggatggcgtctacaaggatcttggaataccggggaggaagttcaagttattgcggtagaacctggaaagaatccaaagaacgtacaaacagcgccggggacgtttaaaacccctgaaggcgaagtcggtgctatagcacttgactttaaacccgggacgagtggaagtccgatagtcaatcgcgagggcaaaatagttggcttgtatggaaatggggtggtcacgacatctggcacctatgttagcgcaattgcacaggccaaggcttcacaggaaggaccccttccagaaatcgaagacgaggtcttcagaaaaagaaatttaactataatggatctccatccaggctcaggaaaaactagaagatatttacccgcaatagtacgggaagcgattaaaagaaaattaagaacgctaatattagctccaacccgggtagtggcttctgaaatggcagaggctcttaaaggtatgccgattagatatcagactacagccgtaaaatcagaacacacaggaaaagaaattgttgatttaatgtgtcatgcaacatttactatgcgcttactatcaccagtacgggtgccaaattacaacatgattataatggacgaagcacatttcacagacccatcgagtattgcagcaagggggtacatcagtacacgagttggtatgggtgaggcagccgcaatattcatgacagctacaccaccagggtctgttgaagcatttccacaaagtaatgctgttatacaagatgaggaacgagacatacccgagcgctcatggaatagcggttatgagtggattacagattttcctgggaaaacggtttggtttgttccatcaattaaatcaggaaatgacatagcaaattgtttaaggaaaaatgggaagagagttattcagttaagtaggaagacattcgataccgaatatcaaaagacaaagaataatgattgggactatgtggtgacaactgacataagcgaaatgggggcgaatttcagagcagacagagtaatagatccaagacgttgcctgaaaccagtcatcttgaaggacgggcctgagagggtaatacttgctggacctatgcctgtgacggtagcttcggcagcacaacggagaggaagaataggaagaaaccataataaagaaggtgatcagtatatttacatgggacagccactaaacaacgatgaagatcacgcacactggacagaggctaaaatgttactagataatatcaatacaccggaaggcataattccagccctcttcgaaccggaacgggaaaaatcggcagctatagacggggaatacaggttacgaggagaagcaaggaagacatttgttgaactgatgcgacgaggcgacttgccagtttggctgtcttataaagttgcatcagaaggcttccaatattctgatagacggtggtgctttgacggggagcgtaataaccaagttctggaagaaaatatggacgtagaaatttggaccaaagagggagaaaggaagaaacttagacctcgatggttagacgcaaggacttactcggatccactagccctgagggagtttaaagaatttgcagcagggcgaaggtcagtgtcgggtgatctcatcctcgaaattgggaagctccctcaacacttaacacaaagggctcaaaatgcattagataacttagttatgctccacaattccgagcaaggcggacgcgcctatcgacatgccatggaagaactaccggacactatagagacactcatgcttttagcactcatagctgtccttaccggaggggttacgctatttttccttagtggacgtggattaggaaaaacatccatcggtctattgtgcgtgatggcctcaagtgtcctattgtggatggcttctgtagaaccacattggatagctgcatccattatccttgagttctttttgatggtacttcttataccggagcctgatagacaaagaacgcctcaagataaccaattagcatatgttgtaataggactcttattcatgatattaactgtagcagcaaacgaaatgggccttcttgaaacgactaagaaggatcttggcataggccacgtagccgtagaaaatcatcatcatgctacaatgttggacgtagatctccacccagcttcagcatggactctgtacgcagttgcaacgacaataatcactcccatgatgagacatacaatcgaaaataccacagcgaatatttcactaactgctattgcaaaccaagctgcgatactaatgggactggacaaaggatggccaatctctaaaatggatatcggtgttccactacttgcactgggttgttattcgcaagttaacccactaacactaaccgcagcagtattgatgttggttgctcattacgcaattatcggacctggattacaggcaaaagcaactagagaagcacagaaaagaaccgccgctggaatcatgaaaaatccgactgtcgacggaatagttgcaattgacctggatccggttgtatatgatgcgaaattcgaaaagcaattaggccaaataatgttactaatattatgcactagccaaatattactaatgcgtactacatgggcactttgcgagagtattaccctcgcaacaggtcctttaactacactatgggaaggcagtcctggaaagttttggaatacaacgatagcagtctcaatggccaatatcttcagagggagctatctggcgggtgcaggtctggctttcagtttgatgaaatccctaggaggcggaagaaggggaactggtgcgcaaggtgagacactaggagaaaagtggaaaagacaactaaatcaattatccaaatccgagttcaacatttataagagatcaggaatcatggaggttgacagaagcgaggctaaggaaggtctgaagagaggagagactacacgacatgccgtctcgagaggaactgcaaaactgaggtggttcgttgagcgcaacttagtgaaaccagaaggaaaggtaatcgatcttggttgtggccgaggtggatggagttactactgcgctggactaaagaaagttacggaagttaaaggttatacgaaagggggtccgggacacgaagaacctatccctatggctacttatggctggaacctggttaaattacacagtggtaaggacgtattctttacaccaccagagaagtgtgataccctcctttgcgatattggagaaagtagtccgaacccgacaatagaagaagggcgcactcttagagtattaaagatggtggaaccatggctgagagggaaccaattttgcattaaaatcttgaacccgtatatgccgagtgtagtagagaccctggaacagatgcagagaaaacatgggggaatgctagttcgaaatcctttaagtagaaactcgacacacgaaatgtactgggtatcatgcggcactggcaatatagtaagcgcagtcaatatgacgtcacggatgctcctaaatagatttactatggcccatagaaaaccaacctatgagcgagatgtagatttaggagcagggactagacatgtagctgtagagcctgaggtagctaacttagatattattggacaaagaatagaaaatatgaaacacgaacataaaagcacatggcattacgatgaagataatccctataagacatgggcatatcatggatcatatgaagtaaagccgtctgggtcggcctcaagtatggtaaatggagttgtcaaattattgaccaagccctgggacgtgatacctatggtaacgcagatcgcaatgacggataccacaccctttggacagcagagggttttcaaagaaaaggtcgatacccgtacgccgaaagcgaaacgcggcacagctcagataatggaagtaaccgccaggtggttgtgggggtttttgtcccgaaacaagaaaccacgcatatgcacaagagaggagttcacaagaaaagtccgatcgaacgctgcaataggcgcggtatttgttgatgagaatcaatggaactccgcaaaagaagccgtcgaagatgaacggttctgggatctcgtacaaaaagaacgcgaactacataagcagggtaaatgcgcaacgtgcgtttataatatgatgggaaagagagagaagaaattaggagagttcggtaaagctaaggggtcaagggctatatggtacatgtggttgggggcacgatttctggagttcgaagcactcggatttatgaacgaggatcattggttcagtagggaaaactcattatctggtgtagaaggggagggtttacacaagttaggatatatcttacgagatatctctaaaattcctggcggcaacatgtatgccgacgatacggcaggctgggatactagaataactgaagatgacttgcaaaatgaagccaaaatcacggatataatggaaccggagcacgcactcttggcaacatcaatctttaaattaacttatcagaataaagtggtccgcgtacaaagaccagctaagaacggaactgttatggatgttataagtaggcgagaccaacgaggaagtggacaggtagggacatacgggctaaatacattcaccaacatggaggcacagctaatccgacagatggaatcagaaggaatattcttaccgagtgaactagagacaccaaacttggcagaaagggtcctcgactggttggaaaaatatggagttgaacgattgaaacgtatggcaatatccggggatgattgtgtcgtcaagccaatagatgataggttcgccacagccctaacagcacttaacgacatggggaaagtaagaaaagacataccccaatgggaacctagtaaaggctggaacgattggcaacaagtaccattttgtagtcaccactttcaccaattaattatgaaagatggacgagaaatagtagtgccgtgtcgaaaccaagacgagctcgtaggcagagcacgagtcagtcagggagctggatggtcattaagggaaacagcttgcttaggcaagtcctatgcgcaaatgtggcagctaatgtattttcatcgacgcgatctaagattagctgctaatgctatttgctcagcagtacccgtcgactgggttccaacgtcaagaactacttggtcaattcatgctcatcatcagtggatgactactgaggacatgttgagtgtatggaatagagtgtggatagaggaaaatccttggatggaagacaaaactcatgtttcctcgtggggtgatgttccttacttgggaaaacgcgaagatcaatggtgtggatctttgataggcttaacggcgcgcgccacatgggcttccaacattcaagttgccataaaccaggtaagaagacttataggtaacgaaaattacttagattacatgacaagcatgaaacgattcaaaaatgagggcgatcctgaaggagcactatggtaa

SEQ ID NO: 21662 - RNA, 9879 nt, synthetic construct
  misc_feature 1..9879: note = derived and/or modified CDS sequence (opt6) from DENV-1__GQ199783__SS-prME
  source 1..9879: mol_type = other RNA
agtgttacgatgttattaatgctaatgccaacagcattggctttccatctgacaacccgtggcggagaaccccatatgatagtcactaaacaagaaagaggaaagagcttactatttaaaacatccgcgggcgtaaatatgtgtacactaatcgcaatggatctaggtgaactatgtgaagatacaatgacatataaatgcccaagaatcactgaagccgaaccagatgatgtagattgctggtgtaatgcaacagatacgtgggttacttatggcacatgttcacagaccggtgaacatagaagggacaaaagatctgtggcacttgcaccacacgttgggttaggcttagaaactcggaccgaaacttggatgtcaagtgaaggggcgtggaaacaaattcaacgtgttgaaacgtgggcgctaagacatccagggtttaccgtaattgcattgtttctagcacacgccattggcacatcgattacacaaaaaggaataatatttattctcttgatgcttgtaaccccttctatggcgatgcgttgtgtaggaataggatcacgtgactttgtagaaggaacgtctggagctacctgggtcgacgtagtacttgaacacggatcatgcgttactacaatggcgaaagataaaccaacacttgacattgaacttttaaaaaccgaagttactaatccagcagtgctcaggaaattgtgcatagaagcaaaaattagcaacacaactacagattctcggtgcccgactcaaggggaagcaacattaatggaagaacaagatgctaatttcgtatgtagaaggacatttgtagatagaggctggggaaatgggtgcggactttttggaaaaggtagcctaataacttgtgcaaaattcaaatgtgtgactaaactagaaggcaaaattgtacaatatgaaaatctgaaatacagcgtaatagtcacagtacacactggtgaccaacaccaggtagggaatgaaagtaccgagcacggtacgacggcgaccattacaccacaagcaccaacaagtgaaattcagctaactgattatggagctcttaccttagactgttccccacggactggattagatttcaatgaaatggttttacttactatgaaagagaaaagttggctagttcacaaacaatggttcttagaccttccgttaccttggacatcgggtgcatcaacctcccaagaaacatggaacagacaagatttattggtaacctttaaaacggcacacgctaagaaacaagaagtagtcgtgctaggaagccaagaaggagccatgcataccgcgctaactggggcaaccgagatacaaacaagtgggacaacgacaatatttgcaggccatttaaaatgtaggttaaaaatggataagttaacgttgaaaggaatgtcatatgtaatgtgtactgggtcatttaaacttgaaaaagaagtagctgaaacacaacatggaacagtgcttgttcaaataaaatacgaaggaaccgacgcgccatgtaaaatacccttttcaacccaagatgaaaagggagtaacgcagaacggacgccttattacggcaaatccgatagtgactgataaagaaaaaccagtcaatatcgaagcagaaccaccatttggtgagtcgtacatagtaattggtgcaggcgaaaaagccttaaaattaagttggtttaagaaaggatcctcaataggtaaaatgttcgaagctacggcacgtggcgcgcgaagaatggcaatactcggagataccgcatgggattttggttccgtcggtggggtttttacttcagttggaaagttggtgcatcaaatctttggaacagcatatggggtattattctcaggcgtatcatggacaatgaaaattggcataggtgtcctgttaacttggctaggcctaaattcaaggagtacgtccctttcaatgacatgtattgcggtcggcttagtaactttatatctcggggtaatggtccaagctgactcaggctgtgtaataaactggaagggacgcgaacttaaatgtggatcaggaatctttgtaaccaatgaagttcatacatggacagaacaatacaagttccaagccgatagccctaagcgtttaagcgccgccataggaaaagcatgggaagaaggtgtatgtggtatacgttcgagcacccgtcttgaaaacattatgtggaaacaaataagtaatgagttaaaccacatactcttagaaaacgatatgaagttcacagtagtcgtaggcgatgtagtaggaatcttggcgcaagggaagaaaatgatccgcccacagccgatggaacataaatactcatggaagagttgggggaaagcaaagataatcggtgctgatgtccaaaatacgacattcatcatagatggacctaatacgccggaatgtccagacgaccaaagggcatggaatatttgggaggtagaggactacggattcggcatatttactactaacatttggttgaagctacgggattcatatacgcaagtctgtgaccataggttgatgtctgcggcgataaaagattctaaggcagtacatgctgatatggggtattggattgaaagtgagaaaaatgaaacatggaagttggctcgtgccagctttattgaagtcaaaacctgcatttggcccaaatcgcatacgttatggagcaatggagtactggagagcgagatgataataccaaagatctatggaggaccaatttcccaacacaattaccgcccagggtactttactcagacagcgggaccctggcacttgggaaagttggaattagattttgatctatgtgaaggaacaacggtagtcgttgacgaacattgtggtaatcgtggcccctcactcaggacaacaacagtcactgggaaaataattcacgagtggtgttgtagatcctgtactttaccaccattaagattcaaaggagaagacgggtgctggtatggaatggagataaggccagtcaaggaaaaagaggaaaatctcgttaaaagcatggtaagtgcaggttccggtgaggttgatagcttttcactaggtttgttatgtatatcaataatgatcgaagaagtaatgagatcaagatggtctagaaagatgttaatgacagggacactcgcagtattcttactcttaataatggggcaactaacgtggaatgatcttattagattatgtatcatggtaggcgccaatgcatcagacaggatgggcatgggcacaacgtatttagcgctaatggcgacattcaaaattagaccgatgttcgcagtaggtttacttttccgtcgacttacatcaagagaagtcctccttcttacaatagggctatcgctcgtagcatctgtagaattaccaaacagccttgaagaattaggagacgggttagctatggggataatgatactcaagctactgacggacttccaatcacaccaactctgggcaacattgctttctctcacgttcattaagacaacactcagcttgcatcatgcatggaaaaccatggctatggtcttaagtatagtatcattatttccattgtgcctaagcacaacgtcacaaaagaccacatggttacctgtgctcttaggaagtttaggctgtaaaccactaactatgtttctaataacagaaaacaaaatatgggggagaaagagctggccattaaacgaaggaattatggcagttggtgttgtctccatattactaagcagcttattaaagaacgatgtacctttagcaggaccattaattgcgggtggaatgttaatagcatgttatgtaattagcggttctagcgctgatcttagccttgaaaaagcagctgaagtatcttgggaagaggaagcggagcattcaggagcttcacacaacatacttgtagaagtacaagatgatggtacgatgaaaatcaaagatgaagaaagagacgacacactaacgattctcctaaaagcaacattactagcggtctcgggagtgtaccctcttagcatcccagccacattgtttgtatggtatttttggcagaagaagaaacaaagatcaggagtgctttgggatacaccgtcgcctccagaagttgaacgcgccgttttagatgatggaatctacagaattatgcagcgaggattattaggtagaagtcaagtaggcgtcggggttttccaggaaaatgtattccacacaatgtggcatgtaacacgcggagcagtgcttatgtaccaaggcaagcggcttgagcccagctgggcatccgtcaagaaagacttgatctcgtatggaggtggttggcgcttacaaggttcatggaataccggggaggaggttcaagtaattgccgtagaaccgggtaaaaatcctaaaaacgttcaaactgctccaggcaccttcaaaactcccgaaggtgaggttggtgcaatagcactcgattttaagccaggtacaagtgggtcgccaatagttaatagagagggtaaaatagtgggactctatggtaatggtgtggttactacaagtggaacatatgtaagcgcaatcgcccaaactaaggcatcccaggaaggtccactacccgaaatagaggacgaagtattccgtaaaaggaatctaactataatggatttacatcctggttcgggtaaaacgcgccgctacctacctgctattgtcagagaagcgatcaaacggaaacttagaacacttatattagcacctacaagggtagttgctagtgaaatggccgaagcactaaaagggatgcccatacgttatcagactacagcagtaaaatctgaacatactggaaaagaaattgtcgatctaatgtgtcacgccacatttacaatgagactactgtctccagtccgagtacctaattataatatgatcataatggacgaagctcattttactgatccttcaagcattgcggcaaggggctacatttccacacgtgttggaatgggagaagcggcagctatattcatgacagctacacccccaggaagtgttgaggcctttccccaaagtaatgcagtaattcaagatgaggaacgagatataccagagaggtcatggaacagcggttacgaatggatcacagatttcccaggaaagactgtttggttcgtgccttcgataaaaagtgggaacgatatagccaattgtctgcgcaagaatggaaaaagagtaatacaactctctaggaaaaccttcgatacagagtatcagaaaactaaaaataacgactgggattatgtagttactacggatatatctgaaatgggagcgaactttagagctgatcgtgttattgacccccgaagatgcctcaaaccagttattttgaaagatggacctgaacgagtaatactggctggccccatgccagtgacggtcgcctcagccgcgcaaagacggggtcgtatagggagaaaccataataaagaaggagaccaatacatatacatgggtcaaccactaaataacgatgaagatcacgctcactggactgaagcaaagatgctacttgataatataaatacaccagaagggatcataccagccctttttgaacctgaaagagaaaagtctgctgcaatagatggcgaatatcgtctgagaggagaagcgagaaaaaccttcgttgaattgatgcgacgaggagacctaccagtttggctttcctacaaagtagcaagtgaaggttttcaatactcggaccggagatggtgctttgatggtgaacgcaataatcaagtacttgaagaaaacatggatgtagagatctggacaaaagagggtgaacggaagaaacttcgaccaagatggttagacgctcgtacttatagcgacccgttggcactacgggagtttaaagaatttgccgcaggaagacgatccgtaagtggagacttgatactggaaataggtaaacttcctcaacatctcactcaaagagcgcaaaatgcactagacaatctcgttatgttgcacaactctgagcaagggggacgagcgtacagacacgctatggaagaactcccagatacaatcgagacgctcatgctactggcattaatagcagttttaacgggaggcgttactctatttttcctctcgggacgtggcttgggaaaaacgtcgattgggttgctctgcgtcatggcttcatcagtcctattatggatggcttccgtggaaccgcattggatagcagcctcaattatcttagagttctttcttatggtattgctgatccccgaaccggataggcaacgtacaccacaggataaccaactagcttacgttgtaatcgggcttttattcatgattcttaccgtagccgcaaatgaaatgggcctactagaaacaactaagaaagacttgggaattgggcacgtagctgtagaaaaccatcaccatgcaacaatgctagacgttgacttacatccagcgtctgcctggactctatacgcagtagcaactaccattatcacaccgatgatgcgacacactatagaaaatacgacagctaatattagcttaactgcaattgcgaatcaagccgcaattctgatgggtcttgacaaaggctggcctattagtaagatggatattggagtgcccctcctagctctaggatgctattcccaagtgaatccactaacccttaccgcagctgtactgatgttagtagcccattatgctataattggacccggactgcaggcaaaagcaacaagggaggcgcaaaagagaacggctgccggtattatgaaaaaccctacagttgatggcatcgtggcgatagacttagatcctgttgtttacgacgccaaatttgagaaacaactagggcaaattatgctattaatcctttgtaccagtcaaatactcctaatgagaacgacttgggccttatgcgagagcattaccttggccacaggcccgttaactactctatgggaaggaagcccaggcaaattttggaatacaactattgcagtaagtatggccaatatctttcgaggatcataccttgcaggagctgggctagctttctccctcatgaaatccctcggaggtggtcggagaggaaccggagcacagggagagactttaggtgaaaaatggaaaagacagttaaatcaattgagcaagtcggagttcaatatttacaaaaggtccggtattatggaggttgatcgtagtgaagcaaaggaaggtttaaaaaggggagaaacgactagacacgctgtaagtagggggaccgctaaattacgctggttcgttgaaaggaatttagtaaagcccgaaggaaaagtaatagatcttggctgtggaagaggaggatggtcttattactgtgccggattaaagaaagtaacagaagtgaaaggatacacgaaaggagggccgggacatgaagaaccaatacctatggccacctatggctggaacttggtaaaacttcacagcggtaaagatgtattctttacacctcccgaaaaatgtgacaccctcctatgtgacataggtgaaagtagtccgaatccaactattgaagagggacgcactctcagagtgttgaaaatggttgagccttggcttagaggcaatcaattctgtataaaaatactaaatccatatatgccttctgtagtagaaacactagaacaaatgcaacgaaaacatggtgggatgctagtccgcaaccctttatcacgaaatagtacacatgagatgtattgggtaagttgtggaacaggtaatattgtctccgcggtaaacatgaccagtagaatgctactaaaccgctttactatggcccatagaaaaccaacttatgaacgcgacgtagacctaggggccggcactaggcacgtcgctgtagaacccgaagtggctaatttagatattatcggtcagcgtatagaaaatataaaacatgaacataaaagtacgtggcattatgatgaagataatccttataaaacgtgggcgtatcatggtagttatgaagttaagccatctggatcggcttcttcaatggttaacggggtagtgaagctcttaacgaaaccatgggacgtcattcctatggtcacccaaattgccatgacagatacgactccgtttggacaacagcgggttttcaaagagaaagtagatacaagaacaccaaaagcaaaacgtggcactgcccaaattatggaggtaacagcacggtggttatggggctttctatcacgtaacaagaaaccaagaatctgtacacgcgaggagttcacaaggaaagtgcgatccaatgcggcaataggtgccgtatttgtcgacgaaaaccaatggaactcggccaaagaagccgtggaagatgaacgtttttgggacttagtgcaaaaagaacgagagttacataagcaggggaagtgtgcaacctgcgtttacaatatgatgggaaagagggagaagaaattaggagagtttggaaaggcaaaaggttctagagctatatggtatatgtggcttggtgcacgattcctagaatttgaagctcttggctttatgaatgaggatcattggtttagtagagaaaattccttatcgggtgtagagggggaaggactgcacaaattgggatacatcttacgagatatatcaaagattccaggtggcaatatgtacgcagatgatacagctgggtgggatacgcgaattactgaagatgacttacaaaatgaagcaaaaataacggacataatggaaccggaacatgcgttattagcaacaagtatcttcaaactgacataccaaaacaaggtagtgagggttcagaggcctgctaagaatggtaccgttatggatgtaatatcgcgaagggatcaaagggggtcaggccaggtgggaacgtatggacttaatacattcaccaacatggaggcacaactgataaggcaaatggagtcagagggtatatttttgccctcagagttagaaacacccaacttggcagaaagagtactcgactggctcgaaaaatacggagttgaaagattaaaacgtatggcaatttccggtgacgattgcgtcgtcaaacccattgatgatcgattcgcgactgcactaacagcactcaacgatatgggaaaagtaagaaaggatataccacaatgggaaccgtcaaaaggatggaatgattggcaacaggtaccgttctgttcacatcatttccatcagcttataatgaaagacggcagagaaatcgttgtcccttgtaggaaccaagacgagctagtaggcagagcaagggtgtctcaaggagcaggatggagcctgcgcgaaactgcatgccttggtaaatcatatgcccaaatgtggcaactaatgtatttccaccggcgagatttacgattagcagcgaacgctatatgcagcgcggttcctgttgattgggtacccacgagtagaacaacttggtcaattcatgcacaccaccaatggatgactactgaggatatgctaagtgtatggaaccgagtgtggatagaagaaaacccatggatggaagacaaaactcacgtgtcaagctggggcgacgtgccatatttaggtaaaagagaagaccagtggtgcggaagtctaattggattaacagcgagggcaacatgggcctccaacatccaagtagcaataaatcaagttaggagattaataggcaatgagaactaccttgattatatgacaagtatgaaaagatttaaaaacgaaggggatcccgaaggtgcactctggtga

SEQ ID NO: 21663 - RNA, 9879 nt, synthetic construct
  misc_feature 1..9879: note = derived and/or modified CDS sequence (opt6) from DENV-1__GQ199784__SS-prME
  source 1..9879: mol_type = other RNA
tcagtaacaatgctgcttatgttaatgccgacagctctagcttttcacttaactacgagagggggtgaaccgcacatgatcgtaacaaaacaagagagaggcaaatcgttattattcaaaacgtccgctggagtaaatatgtgtacattaattgctatggatcttggtgaactatgtgaagatacaatgacatataaatgtccccggataaccgaagcggaaccagatgatgtagactgttggtgtaatgcaacggatacatgggttacatacggaacatgcagtcaaacgggagaacacagacgggataaacgatcggtagcacttgcaccacatgtagggttaggcctagagaccagaaccgagacttggatgtcgagtgaaggtgcttggaaacaaatacaaagagtagaaacttgggctctaagacaccctggatttacggtaattgcattattcctagcacatgtgataggtacctccataactcaaaaaggtattatctttatcttgctcatgttagtaacaccttctatggcgatgagatgcgtaggaataggaagtagagattttgtggaaggcttaagcggagcaacttgggttgacgttgtgctagagcatggatcctgtgttaccacgatggcaaaagataaaccaactcttgatattgaattattaaaaactgaagtaacgaacccagctgtattaaggaaattatgtattgaagcaaagatttcaaacacgactacggactctcggtgtcctacacaaggagaagctacgcttatggaagaacaagacgcaaattttgtttgtagaagaacatttgtggacaggggctggggaaacgggtgtggactatttggaaaagggtcccttattacttgtgcaaaatttaaatgtgtgaccaagttggaaggaaagatagtacaatatgaaaatcttaaatactccgttatcgtaacggtgcacactggagatcaacaccaagttggaaatgaaagcactgagcacggaactacagcaaccataacaccgcaggcaccaaccagtgaaattcaactaactgattatggagctctaacacttgattgttctcctagaactggtctagatttcaacgagatggtattactaaccatgaaggaaaagtcatggttagtacacaagcaatggtttctagatctgccattaccttggacatccggggcctctacatcgcaagaaacctggaaccgacaggatttattagttacttttaaaacagcgcatgccaagaaacaagaagttgtagtgctagggtcgcaagaaggcgccatgcatacggctttaacgggagcaactgagatacaaacttcgggcacaacgactatattcgcagggcacttaaaatgcaggttgaaaatggataaattaacattaaaaggtatgtcttatgtgatgtgtaccggcagtttcaaattagaaaaggaagttgctgagacacaacacggcacagtattagtacaaatcaaatacgaagggaccgacgcaccttgtaaaataccattttcgacgcaggatgaaaaaggagtgacccagaatggaagacttataaccgcgaatcccattgtaactgataaagagaaacccgtaaatatagaagcagagccaccatttggagaaagctatatagttattggtgctggagaaaaggccctaaaattatcatggtttaaaaagggaagcagtataggaaagatgtttgaggcgacagcgcggggtgctcgtagaatggctattctaggggacactgcttgggatttcggatcaatcggaggggtgtttacaagcgtggggaagctagtgcatcagatatttggaaccgcttatggtgtattgttttcaggcgtcagttggacaatgaaaatcggccttggtgttttgcttacatggcttggacttaattcaagatcaacctctctttcgatgacgtgtatagctgtgggcctggtaaccctttacctcggtgtaatggttcaggctgactccggctgcgtaattaactggaaaggacgagagttaaaatgcggtagtggcatatttgtaacgaatgaagtacacacctggaccgagcaatacaaatttcaagccgatagtccgaaacgattgtctgccgccatcggaaaagcctgggaggaaggcgtttgcgggattaggtctgcgactaggttagaaaacataatgtggaaacaaataagtaacgaattgaatcatattctgttagaaaacgatatgaagtttacagttgtcgtaggtgacgtagtcggcattttagcccaagggaagaaaatgattagaccacaacccatggaacacaaatactcatggaaatcgtggggaaaggccaaaattataggagcagatgtacagaacacgacattcattatagatggcccaaatactcctgaatgtcccgacgatcagagagcctggaacatatgggaagtagaagactatggattcggtattttcacaacaaacatttggctgaaacttagagatagccatacgcaagtatgtgatcatcgcttaatgagcgccgcgattaaagactcaaaagcggtccatgcagatatgggatattggatagaaagtgagaaaaacgaaacatggaaactagccagggctagctttatcgaggtcaagacctgtatctggccaaaaagccatacgttatggtctaacggcgtactagaaagcgaaatgataattccgaaaatatatggagggccgataagccaacataactatcgccccggttattttactcaaacggcgggaccctggcatcttggtaaattagaactcgattttgacttatgtgaagggacaactgttgtagttgacgaacactgcggtaatagaggtccaagtcttcggacaactaccgtaacgggcaaaattatacatgaatggtgctgtaggtcttgtacactaccacccctccggtttaaaggggaagatggctgctggtatgggatggagatacgacccgtaaaagaaaaagaggaaaatcttgtcaaatctatggtaagcgcgggttccggggaagtagattcattcagtctgggattgttatgcatatcaataatgatagaggaagtaatgcgcagcagatggtcgaggaaaatgttaatgaccgggactttggcggttttcctactactgatcatgggacaattaacttggaacgatctaataaggctatgtataatggtaggagcgaatgcaagcgaccgaatgggcatgggtaccacctatctcgcattgatggctacattcaaaatgagacctatgtttgcagtgggattactgtttcgacgattaacttcacgagaagtgctgttacttacaatagggctttcgcttgtagcatccgtagaactgccaaacagtttggaagaactcggagatggattagcgatgggcattatgattttaaaattgcttacagatttccaatcgcatcaactttgggctacactactaagcctcacattcattaaaacaactttgtcccttcattacgcttggaaaaccatggccatggtgctgtcaatcgtaagtttgtttccattatgtttatcaacaaccagccagaaaacaacctggctacctgtactactaggttctctaggatgcaaacctcttgcaatgtttctcattgcggaaaataaaatatggggtcgtaaatcctggcctttgaacgaaggaataatggccgttggagtagtaagcatcctgttaagtagtttattgaaaaacgatgtaccactagccggaccactaatcgcaggaggtatgcttatagcgtgttacgtaataagcggaagttcagcggatctatccttggaaaaggcagcagaagtttcctgggaagaagaagctgaacatagtggagctagtcacaatatattagtagaggtccaggacgatggaacaatgaaaattaaagacgaggaacgagacgacactctaactatccttttgaaagctacgctacttgccgtaagcggagtttatcctttaagtattccagcaaccctatttgtgtggtacttctggcagaaaaagaaacagcggtccggtgtattatgggacactccaagtccgccagaagtggaaagagctgtcctcgacgacggaatataccgaatcatgcaacgtggattactaggacgcagccaagtaggggtgggagtgtttcaggagaacgtgttccacacgatgtggcacgtaacgcgaggagctgttttaatgtaccaaggaaaacggttagaacccagttgggctagcgtcaagaaagatttaatttcttacgggggaggttggaggttgcaaggctcatggaatacaggagaggaagtacaggtgatcgcagtcgagcctggcaaaaatccgaagaatgtccagacagccccaggaacgtttaagacacctgaaggagaggttggtgctatagcattagattttaaaccaggaactagcggatcaccgattgtgaacagggaaggaaaaatagtaggactatacgggaatggggttgtaaccacttcaggaacgtacgtgagcgcaatcgcccaagcaaaggcttcccaggaaggaccactaccagaaatagaagacgaggtatttagaaagagaaatttaacaataatggatttacatccaggtagtggaaaaacccggcgctatctcccagcgatagtgcgtgaagcaataaaaagaaagctcagaacacttatacttgccccaacgcgagtggtcgcttcagagatggcagaggcattgaaaggaatgccaataaggtatcaaacaactgctgtaaagtctgaacatacgggtaaagagattgtagacttaatgtgccacgctacatttacaatgcgattgttgtcgccagtacgcgtcccaaattacaacatgatcattatggatgaggctcattttactgacccaagttcgattgccgctcgtggttatatttctacgcgagtagggatgggagaggctgcggcgatatttatgacagccaccccaccagggtcagttgaggcatttcctcaaagtaacgcagtaatacaagatgaagaaagagacattcccgaaaggtcctggaactcaggatatgaatggattactgatttcccaggtaagacagtatggtttgtaccttctataaagagtggaaatgatattgctaattgtttgaggaaaaatgggaaaagggttattcaactttctcgaaaaacatttgacactgaatatcaaaagaccaaaaataatgattgggattatgttgttacgactgacatatcggaaatgggggcaaattttagagcagacagagtaatcgacccacggcgttgtctaaaacccgtcatcctaaaagatggacctgagagagttatcttagccggtccaatgccggtaaccgttgctagtgccgcacaaaggaggggccgaattggtagaaaccataacaaggaaggggatcaatatatatatatgggacaacctctaaataatgacgaggatcatgctcactggactgaagctaaaatgttattagataacatcaatacaccggaaggaataattcccgcgttatttgaacctgaaagagagaaaagcgcagccattgacggggaatatagattaagaggcgaagctagaaaaactttcgtagaattaatgaggcgcggagacctcccagtctggttgagttacaaagttgcatcagaaggctttcaatactccgataggcgttggtgctttgatggtgaaagaaacaatcaagttctagaagaaaatatggatgtagaaatttggactaaagagggcgaacgtaagaaactacgtccgcggtggcttgacgcgagaacctacagcgacccactagcccttcgggaatttaaagaatttgctgctggtagaagatccgtttcaggcgatctaattttagagataggcaaactcccacagcatttaactcaaagagctcaaaatgccctcgataacctcgtaatgctacataactctgaacaaggtggtcgcgcatatcggcacgcgatggaggaattaccggacacaattgaaacattaatgctcctagctttgatagcagtgctgacgggaggagttacactcttctttttgagtgggagaggacttggaaaaacgagtatagggcttctatgcgtaatggctagcagtgtacttttgtggatggcaagtgtagagccgcattggatagccgcaagtataattttagagttcttcttaatggttctacttattcctgaaccggacaggcagaggacacctcaagacaatcagctagcatacgtagtcataggacttttatttatgattttaacagtagctgcgaacgaaatgggactcttggaaactacaaagaaagatttgggtataggacatgtcgctgtagaaaatcaccaccatgctacaatgctcgacgtagacttacatcccgcgtcagcttggacactttatgcagttgctactacaataattacccctatgatgaggcacacaattgaaaatacaacagcaaatatatccttaacggccatagcgaatcaggctgcaatattgatgggattggacaaaggttggccaatatctaaaatggatattggtgtacccttgttagcccttgggtgctattcacaagtcaatccgctgacacttacagcagccgtgctaatgttagttgctcattatgcaatcatagggccaggactccaggcaaaagcaacacgtgaggctcagaaaagaactgcggcaggcataatgaaaaatccaacagtcgacggcattgtagcaatagatctcgacccagtggtatacgatgctaaatttgaaaaacaattgggtcaaattatgcttttaatattgtgtacttctcaaatactacttatgcgcacaacatgggcgctgtgtgaaagtataactctagccaccggacctttaactactctctgggaaggatccccgggcaaattttggaacacaaccatcgcagtatccatggccaatatattcagagggtcatacttagctggggctggccttgcgttctcattaatgaaatcgcttggtggaggtcgacgaggtacaggagcacaaggtgaaacattaggcgaaaagtggaaaagacaattaaatcaactaagcaaaagcgaatttaacatttataaacgatccggaataatggaggttgatagatccgaagctaaagagggtctgaaaagaggagagactactcgacatgcagtctcacgcggcacggccaaactaaggtggtttgttgaaagaaatctagttaaaccggaaggaaaagtaattgacctgggatgtggaagaggcggctggagttattactgtgcaggactaaagaaagtaaccgaagtaaaagggtataccaaaggtggaccaggacacgaagaaccgatccctatggcaacatacggctggaacctagtcaaattacattctggtaaagatgttttctttacccctccagagaaatgcgacacattactttgcgatattggagaatcaagccctaacccgacaatagaggaaggtagaacactaagagtattaaaaatggtagaaccatggcttcgcggcaaccagttctgcataaagatactaaacccctatatgccctcggtagtagaaacccttgaacaaatgcagagaaaacacggaggaatgttggtacggaatcctcttagccgtaattctacacatgaaatgtattgggtatcgtgtgggactggaaatatagtgtctgctgttaatatgacatcccgcatgttgttaaatagattcactatggcgcatcgtaaacctacttatgaacgggatgtagacctgggagcagggacacgacatgtcgcagttgagccagaagtggcaaatctagatattatcggacaacgcattgaaaacataaaacatgaacacaaatcaacttggcactatgacgaagataatccgtataaaacatgggcttatcacgggtcttacgaagtgaaaccttccggtagtgcgtcgagcatggtcaacggcgtcgtgaagctattaactaaaccttgggacgtgatacctatggtaactcaaatagctatgactgacactacaccctttgggcaacaaagggttttcaaggagaaagtagatacgcgaactccgaaggccaaaagaggaacagcccaaataatggaggtaacagcacgctggttgtgggggtttctttctaggaataagaaacccagaatatgcaccagagaagaatttacacgcaaagtcagaagtaatgccgctataggtgcagtattcgtcgatgagaatcaatggaactccgctaaagaagcagtggaggacgaaaggttttgggatctagtacaaaaagaacgagaactccataagcaaggaaagtgtgcgacttgcgtctataacatgatgggcaagcgagagaagaaacttggagaatttggtaaagcaaaaggttctcgcgctatatggtatatgtggctaggtgctcggtttctcgagttcgaagcacttggatttatgaatgaagaccattggttcagtcgtgagaactcgctttcaggcgttgaaggcgagggtctccacaaattggggtacatattgcgagatatttcaaagatcccagggggaaatatgtacgcagatgatacagcaggatgggacactagaatcacagaggatgatttgcagaatgaagcacgtattacggatattatggaacccgagcatgccttactcgccacaagtatatttaagttaacttatcaaaataaagttgttagggttcaaagacctgcaaagaatgggactgtaatggatgtaatatcgaggcgagaccaaagaggctctggccaagtaggtacttacggattaaatacattcacgaacatggaagcccaactcattaggcaaatggaatcagaaggaattttcctgccgtccgagttagagactcaaaatttagctgaacgagttctagattggttagagaaatacggcgtggaaagattaaagcggatggcaataagtggagatgactgtgtagttaagcccatagatgaccgctttgcgactgcactgaccgcacttaacgatatgggtaaggtcaggaaagacataccccaatgggaaccctcgaaagggtggaatgactggcaacaggttcccttttgttcacatcattttcatcaactcataatgaaagatggacgtgaaattgtagtaccttgcaggaaccaagacgaattagtgggacgagctagagttagtcagggagcagggtggagtttaagagaaactgcttgtttgggaaagagttacgcgcaaatgtggcaattgatgtatttccatagacgagacctacgattagcagcaaatgcaatatgttcagcagttccggttgattgggtacctacatcgcgtacgacatggtcgatacatgcacatcatcaatggatgactactgaagacatgctgagtgtttggaatagagtttggattgaagaaaatccgtggatggaagataaaacacatgtatcgtcctggggagatgtgccgtatctaggaaaacgtgaagatcaatggtgcggatcactcataggactgacagcaagagccacatgggcatccaatatacaagtggcgataaatcaagttcgaaggcttattggtaatgaaaactatttggactatatgacctcaatgaaacggtttaaaaacgaaggtgatcccgaaggtgcgttatggtaa

SEQ ID NO: 21664 - RNA, 9879 nt, synthetic construct
  misc_feature 1..9879: note = derived and/or modified CDS sequence (opt6) from DENV-1__GQ199785__SS-prME
  source 1..9879: mol_type = other RNA
tccgtcacaatgctattaatgctaatgcccaccgcgcttgcatttcatttaacaactcgagggggtgaacctcacatgatagtttcgaaacaagaacgaggaaaatccttactgtttaaaaccagtgcaggagtaaatatgtgcacattgatagcaatggatttgggagaattatgtgaagataccatgacgtacaaatgcccccgtataactgaagtagaaccagatgatgttgattgctggtgcaatacaactgatacgtgggtgacatacggtacctgtagtcaaacaggggaacaccgccgagataaacgatctgtagcactagcgccacacgttggattagggctagaaacgagagcagaaacttggatgtcctcagaaggagcatggaaacaaatccaaaaagtagaaacatgggcattgagacatccaggatttacggttatagcactgttccttgcacatgcaattggtacctcgatcacacaaaaaggtataatttttatcttacttatgctcgttactccgagtatggcaatgagatgtgtaggaattgggtctagagactttgtagagggtctttcaggagcaacctgggtcgatgttgtcctggaacacggttcttgcgtaacaacaatggccaaagacaaacctacattggatattgaactactaaaaactgaagtaacaaatccagcggtcttacgtaaactttgtatagaagctaaaatttcgaatacaacaacagattctcgctgcccgacacaaggggaagccacgctggttgaagaacaagacgccaattttgtatgtagacgtacatttgtagatcgtggttgggggaatggttgcggcctatttggtaaaggtagccttataacttgtgctaaattcaaatgcgtaacaaaattagaaggcaaaatcgtacagtacgaaaatctgaaatattctgttattgttacagtacacacaggcgatcagcatcaagttggaaatgaatcaactgaacacggtacaacagcaactattacgccccaagctcccacgagtgagatacaattaacagactatggcgcattaactttggactgttcaccaagaactgggttagattttaatgaaatggtattactaactatgaaggaaaaatcttggttggttcacaaacaatggtttctcgacttaccgttaccttggaccagtggagcgagtactagccaagaaacttggaatcgacaggacttacttgtaacatttaagacagcacacgccaagaaacaagaggtggttgtactagggtcacaagaaggtgcgatgcatacagctctaacgggcgctacagaaatccaaacatcaggaacaaccacaatttttgcgggacacttgaaatgtagattaaaaatggataaattaaccctaaaaggaatgtcgtacgtcatgtgcacaggtagttttaagttggaaaaggaagtcgccgaaacgcaacatgggaccgtattagtgcaaatcaagtacgaaggcacagatgcaccatgcaagataccatttagtacacaggacgagaagggggtaacacaaaatggaagactgataacagcaaacccaatagtcactgataaagaaaaacctgtcaatatagaagctgagccgccatttggcgaatcatatatagtgataggagctggtgaaaaggcactaaaattatcgtggttcaagaagggatcgtctattggaaaaatgtttgaagccaccgcgcgtggagcaaggagaatggctattctcggagataccgcctgggattttggttcaatagggggcgtttttacatctgtaggaaagctagtacaccaaatctttggaactgcatacggagtattattcagtggagtctcatggacgatgaaaataggaataggtgtcctactgacatggctagggttgaactcacgctctacttcgttgtcaatgacttgcatagcagttggattggttactctatatctgggtgttatggttcaagcagactccggatgtgttataaactggaagggaagagagctaaagtgcggttcaggtatctttgtgaccaatgaagtacacacatggaccgagcagtacaaatttcaagctgactcaccaaagcgcctgtcagcagcaataggaaaagcatgggaagaaggtgtatgtggcattcgaagtgcaacacgattagagaatatcatgtggagacaaatctcaaacgaactaaaccatatactcttagagaacgatatgaaattcacggtagtcgtgggagacgtagtaggtatattggctcaaggaaagaaaatgataagaccgcaaccaatggaacataaatatagctggaaaagttgggggaaggctaaaatcatcggagcggatgtgcaaaatactaccttcattatcgacggaccaaacactccagaatgtccagatgatcaaagggcatggaacatctgggaagttgaagactatgggtttggtatattcactactaatatatggctgaaactgcgcgatagctacacacaagtgtgtgatcaccgtctaatgtcagccgcaataaaagatagcaaagcagtacacgcagacatgggatattggatagagtcggaaaagaatgaaacctggaaattagcacgagcctcatttatcgaagtaaaaacctgcatatggccaaaatcacacacattatggtctaatggtgtccttgaaagcgaaatgatcataccgaaaatatatgggggaccgatatcacagcataactatcgaccgggatacttcactcaaacagcaggcccatggcatttaggcaagctagaattggattttgatttgtgtgaaggtacgacagtagtagtagatgagcactgtggcaatcgcggaccatcgctaagaacaacaacggtcacgggcaaaattatccatgagtggtgctgtcgaagctgtactctcccacctctgaggttcaagggagaagacggttgctggtacggtatggaaataaggcccgtaaaagaaaaagaagaaaatttggtcaagtcgatggtgtctgcaggaagtggtgaagtagactcattctctctaggcttgctatgcataagtataatgatcgaagaagtcatgaggtcacggtggtctagaaaaatgctaatgacaggtaccctagcagtattctttttgttgatcatgggtcaactcacatggaatgatttaattagaagttgtataatggtcggagccaatgcttccgacagaatggggatggggacgacttacttagctctaatggcaacgtttaagatgaggcctatgttcgcagtcggattgctgttccgccggttaaccagcagggaagttttactactaacaattggattatcccttgttgcatctgtagagctacccaatagcttggaggaactaggagatgggttagctatgggcattatgatacttaaattgttgactgactttcaaagctatcaactatgggcaactcttctcagcttgacatttataaaaacaacgttctcactgcactacgcatggaaaaccatggcaatggttctctcgattgtaagtctcttaccattatgcctatctaccaccagccagaaaacaacttggctccccgtgctactaggaagtttaggatgcaaacctcttactatgttcttaattgcggaaaataaaatttggggaaggaaaagttggcccctaaatgaaggtattatggctgttggaatagtaagtatactattgtctagtcttctgaaaaatgatgtgccattagccggtccattaatcgctggtggaatgttaattgcatgctatgtcataagcggttcgtcagcagatctatcattagaaaaagcagctgaagtatcatgggaagaagaagcagaacattcaggagcatctcataatattttagtagaggtacaggatgacggtacgatgaaaataaaagatgaggaacgcgatgacaccctaacaattctgctcaaagccacattgttagctgtttccggtgtttacccgttaagtataccggccactctattcgtatggtatttttggcagaaaaagaaacaaagatcaggggttttgtgggatacacctagcccaccagaagtagaaagagccgtactagatgatgggatttacagaataatgcaaagaggacttcttggtcgatcacaagtgggagtcggagtatttcaagaaaatgtcttccatactatgtggcacgttaccagaggtgcagtattaatgtatcagggaaagagattagagccaagctgggcttcagtaaagaaagaccttatctcttacggaggcggatggaggttgcaaggtagttggaacacgggagaagaggtacaagtaattgcagtagagccaggcaagaatccgaaaaatgttcagacagcaccaggaacttttaaaaccccggaaggagaagtaggcgctattgcgttagattttaaacctggcacttctggctcacctatagttaatagggaaggaaaaatagtcggattatatggtaatggtgtcgtaacaaccagcgggacctacgtatctgcaattgcacaggctaaagcatctcaggaaggaccattgcctgaaatagaagatgaggtatttagaaaacgcaatttaacgataatggacctacaccccggaagcggaaaaactagaagatatctaccagctatagttagggaagcgataaaacgcaagctccgtacactaatactagcgcctaccagagtcgttgctagtgaaatggccgaagcactcaagggaatgcctataaggtatcaaacaacggctgttaaaagcgagcataccggcagggagatagttgacttgatgtgccatgcaacctttacaatgaggctcttatcacccgtccgtgttcccaattacaatatgataatcatggacgaagcgcatttcacggatccatcctcaatagcagcaagaggttatataagtacacgagtgggtatgggagaagctgcagcaatatttatgactgcaacaccccctggttcagttgaagcgttcccgcagagtaatgcagtcattcaagacgaagaaagggacatacccgaaagatcgtggaactctggctatgaatggataactgactttccaggtaaaaccgtgtggtttgtgccatctattaaatcagggaacgatattgcaaactgtttaagaaagaatggaaaacgagtaattcaactatcaagaaaaacttttgatacagaataccagaaaaccaaaaataatgattgggattacgttgtaactaccgatatatcagagatgggagccaactttagagctgaccgcgtaatcgatccacgacgatgtttgaaacccgtgattctaaaagacggtccagaaagagtaattttagcaggccccatgccggtaacggtagcgtcagcagcacaaaggcgaggcagaataggccgtaatcataataaagaaggtgatcaatatatttacatgggccaaccattgaataatgatgaagaccatgcccattggacagaggcgaaaatgttattagacaatatcaatacacctgaaggtataatcccagcattattcgaacccgagagagaaaaatcagccgccatcgatggagaatatagattaagaggagaagcgagaaaaacattcgtagaactaatgcgtcggggtgatttaccagtatggctgtcatataaagttgcttccgagggattccaatattcggataggagatggtgcttcgatggggaaaggaataaccaagttttggaggaaaatatggacgtggaaatttggacgaaagagggcgagagaaagaaactacggccaagatggttagatgcaaggacatattcagacccactagcgctcagagagtttaaagaatttgcagcagggagaagaagcgtttccggcgatcttattttagagataggtaaacttccacagcacttaacgcagagagcccaaaatgcattagacaatctcgtaatgttacacaacagcgaacaagggggccgtgcatatcgacacgctatggaggaactgcctgatacaatagaaacactaatgctactggccttgatcgcagtcctgacgggtggcgtgacactatttttcctatcaggcaagggattaggaaagacatcgattggccttctgtgcgtcatggcctcttctgccctgctttggatggcttccgtcgaaccacactggatagcagccagtataatactcgagttctttttaatggtgttgttaatacccgaacccgatagacagagaactccacaagataaccaattagcgtacgtcgtcattggccttttatttatgatcctcaccgtagcagcaaatgagatggggttgctagaaactaccaagaaagatctgggtataggacatgtggccgtggaaaatcatcatcacgctacaatgctggatgttgacctgcatcccgcctcagcttggactctatatgcagtagcgactaccatcataactccgatgatgagacacaccatagagaatacaacggcaaacattagccttacagctattgcaaatcaagcggcaatcttaatgggcttggacaaaggttggccgatttcaaaaatggacataggagttcctcttcttgctctggggtgttattctcaagttaaccctttaactttaacagcggcagttctcatgctggtggcacattatgcaattatagggccgggattacaggctaaagcgacacgggaagcacagaaaagaactgctgcaggaattatgaagaaccctacggtagacggcatcgtggcaatcgacttagatcctgtggtatacgacgctaaatttgaaaaacagttgggacaaataatgctcttaatcttatgtacctcgcaaatccttctcatgagaaccacttgggccttatgcgaatctattaccctagctactggacccttaacaacattatgggaaggttctccagggaaattctggaatactacaatagcggtaagcatggcaaatatcttcagaggatcctatctcgcgggcgcgggcttagccttttcacttatgaaatcactaggaggtggacgacgtggaactggggctcagggagagacactaggggagaaatggaaacgtcaactcaaccaactttctaaatccgagttcaatacgtacaaaagatcaggtataatggaagtagataggagtgaagctaaagagggacttagaagaggcgagacaacaaaacatgccgtatcaaggggtacagccaaacttagatggtttgtagaacggaatctggtaaaaccagaaggtaaggtaattgacctcggttgtggcagaggaggatggagttattactgtgcagggcttaagaaagtaacagaagtgaagggatacacaaaaggaggacccggtcacgaagaacccattcccatggcaacttatggctggaatctcgtcaagttacacagtggtaaagatgtcttctttattcctccagaaaaatgtgatacgttactatgtgatataggagaatcatctccaaatcctacaatagaggaaggaagaacactcagagtattaaagatggtcgagccttggcttcgtggaaaccaattttgtataaagattctgaatccctatatgccatcagtagtggaaacattagaacaaatgcaaagaaaacatggcggaatgttagtaaggaatccgctatctaggaacagtacacacgaaatgtattgggtaagctgcggaacaggaaatatagtcagtgccgtgaacatgacaagtagaatgttgctaaatagattcacaatggcccaccgaaaaccgacttacgaacgggatgtcgatcttggcgccgggacgcgacatgtggccgtagaacctgaggtagcaaatcttgatatcatcggccaacgcatagaaaacattaaacatgagcacaaatccacttggcactatgacgaagataatccttacaaaacttgggcctatcatggaagttatgaagttaaacctagtggtagcgcaagctcaatggtaaacggggtagtaaaactgttaaccaagccgtgggacgttatccctatggtaacgcaaatagccatgacggatactacaccttttggtcagcaacgggtatttaaagagaaagtggatacgagaacacctaaagctaaacgtgggacagcacagataatggaagtgaccgccaaatggttatggggttttctaagccgaaataagaaacccagaatttgcactcgagaagagttcacgcgtaaagtccgatcaaatgcggcaataggagctgtttttgttgacgaaaatcaatggaactccgccaaagaagcagtagaagacgagagattctgggatctggtacatcgtgagagggagctccataaacaaggtaagtgtgcaacctgcgtatataacatgatgggtaagagagaaaagaagctaggtgaatttggaaaagccaaaggatcaagagcaatctggtacatgtggctgggggccagattcttagaatttgaagccctgggctttatgaacgaagaccattggtttagcagagagaactcgttaagtggcgtcgaaggtgaggggctacacaaactaggttacatactaagagacatctccaagattccgggtggtaatatgtatgccgatgatacggcgggatgggacactagaattaccgaagatgatctacaaaacgaagccaaaatcaccgatataatgaaacccgagcacgcacttcttgcaacaagtatttttaagttaacttaccaaaacaaggtcgtaagggtacaaagaccggctagaaatgggacagttatggacgtaattagcaggagagaccaaagaggaagtggccaagttggtacttacggactaaatacctttactaacatggaagcccagctgatacggcaaatggaatctgaaggaatttttagtccctccgaattggagaccccaaacctcgctgagagagtgttagattggctagaaaaacatggggtagaaagattgaaacgaatggcaatatcgggtgatgattgtgtcgtgaagccaatcgatgatcgtttcgctactgctctaagcgctcttaatgatatgggtaaagtccgaaaagacatcccacaatgggagccctcaaaaggatggaatgattggcaacaggttcctttttgctcacatcacttccaccaactaataatgaaggacggaagagagattgtggtaccctgtagaaatcaagacgaactggttggtagggctagagtcagccaaggggctggctggtctttacgtgagaccgcctgtttgggtaagagctatgcccaaatgtggcagctaatgtattttcatagaagggatctaagactagccgcaaacgcaatatgttcagccgtgcctgttgattgggtcccaacaagcagaacaacttggtctatacatgctcatcaccaatggatgacaacagaggatatgctctctgtgtggaacagagtttggatcgaggagaatccttggatggaagacaaaacacacataagtagctggggagacgtaccatatttaggtaagagagaagaccaatggtgcggttcattgatcgggcttacagcaagagcaacatgggctaccaacatacaagtagccataaaccaagttcgaaggctgattggaaatgaaaactatttagattacatgacttctatgaaaagattcaaaaacgaatcagacccagaaggcgcattgtggtaa

SEQ ID NO: 21665 - RNA, 9879 nt, synthetic construct
  misc_feature 1..9879: note = derived and/or modified CDS sequence (opt6) from DENV-1__GQ199786__SS-prME
  source 1..9879: mol_type = other RNA
agtgtaacaatgctgttgatgctaatgcccacggcacttgcttttcacctgacgactcgtggaggtgaaccgcatatgatcgtatctaaacaagaacgggggaaaagtttgctatttaaaacatctgctggtgtgaatatgtgcactttaatcgctatggaccttggagaactttgtgaagatactatgacatacaaatgcccaagaattactgaaactgaaccggatgatgttgactgctggtgcaatgcaacggacacttgggtaacatatggaacatgtagtcaaacaggtgaacatcggagagacaaaagatcagtggcattggcacctcatgtcgggttgggacttgaaacaagaacagaaacatggatgtctagtgagggggcttggaaacaaatccaaagggtagaaacttgggccttaagacacccaggctttacagtgatagcccttttcttagctcatgcaataggcactagcattactcagaaaggtataatctttatccttttgatgctagtaacgccgtccatggctatgcggtgcgtaggaatcggctctcgcgacttcgtagaagggctctcaggagccacatgggtcgatgttgttctagaacacggtagttgtgtcacaacgatggcgaaagacaaaccgaccctggatatagagctgttaaaaacggaggtaactaatccagcggtattacgtaaactatgtatagaagcgaaaatatcaaataccacaaccgattcaaggtgtccaactcaaggtgaagcaaccttagtagaggagcaagatgcgaattttgtttgtcgaagaactttcgtcgacagaggatggggcaatggatgcggattatttgggaaaggtagtctaataacctgtgcgaaatttaaatgcgttactaaactcgagggtaaaatcgttcaatatgaaaatctgaaatatagcgttattgtgaccgtacatacaggagaccaacaccaggtcgggaacgaatccacagaacacggaacaaccgctactataacgccgcaggcgccaacgactgagatccaactaacggattacggagcattaaccttagattgtagcccacgaacaggtttggattttaacgaaatggttttacttactatgaaagaaaaatcgtggttagtacacaaacaatggtttctagacttgcccttaccgtggacatctggagcatcaacctcacaagaaacatggaatagacaagacctattagtaacatttaaaactgcacatgccaagaaacaggaagtcgttgtacttggctcacaagaaggtgcaatgcacaccgcactgaccggcgctactgaaattcaaacctcgggaacaactactatatttgcaggacacctcaaatgtagactaaaaatggataaactaacattaaaaggtatgtcttacgtaatgtgcacagggagctttaaactggagaaagaggtagctgaaactcaacatggaacggtgttagttcaaatcaaatacgagggcacagatgctccttgtaaaattccctttagtacgcaggacgaaaaaggagtaacacaaaatggtcgattaatcacggcaaatccaattgtaactgataaagagaaaccggtaaatattgaggctgaacctccattcggagaatcttatatagttattggagctggggagaaagcgttaaaattatcttggttcaagaaagggagttctataggaaaaatgtttgaagccacggctagaggagctagaagaatggccattcttggtgacacagcatgggactttggatctattggaggagtattcacaagtgttgggaagctagtacatcaaatcttcgggactgcatacggtgttctattttcaggtgtaagctggaccatgaaaataggaataggagttctccttacttggcttgggttaaattcgagatcaacatcccttagtatgacttgcattgcagtaggattagttacattatatcttggtgtgatggtgcaagctgattcgggatgtgtaataaattggaaagggcgcgaattaaaatgcggatccggtatattcgtaaccaacgaagtccatacctggactgaacaatataaattccaagcagatagccccaaaaggctgagtgcagcaattggtaaagcatgggaagaaggtgtttgcggcattcggtctgctacacgtctagaaaacattatgtggaaacagatatccaatgaacttaaccacatactcttagagaatgatatgaaatttacagtagtcgtgggagacgttgctggtatcttggctcaaggtaagaagatgataagaccacagccaatggaatataaatattcatggaagtcctggggaaaagcgaaaataataggcgcagatgttcaaaacaccacgtttataatagatggcccaaacacgcctgaatgcccagatgaccaacgagcatggaatatttgggaagttgaagattatggattcggtatattcactacgaacatatggctgaaattaagagatagctatactcaagtttgcgaccatcggttaatgtccgcggccataaaagactctaaagcggtacacgctgatatgggttattggattgaatcggagaaaaacgaaacgtggaagttagcgagggctagctttatagaagtgaaaacgtgcatctggcctaaaagtcatacactttggtctaacggagtcttagaaagtgaaatgattataccaaaaatatacggtggtccaatatctcaacacaactatcgacctggctatttcacacagacagcaggaccctggcatttaggtaaacttgaactagattttgacctatgtgaaggaacaacagtcgtggtagacgagcattgcggaaaccgaggtccaagtctaagaaccacaactgttaccggcaagataattcatgaatggtgctgccgatcgtgtacgttaccacccttgcgtttcagaggagaagacggatgttggtatggaatggaaatcaggcccgttaaagaaaaggaagaaaacttggtgaagagtatggttagcgcaggcagtggagaagtagacagcttttcattagggctactctgcatatctattatgatcgaagaagtaatgagatctagatggagcaggaaaatgctcatgacaggaactttagcagttttcttcttattaattatgggacagctgacctggaatgatctaattcggttatgtataatggtaggggcaaatgcctccgatagaatgggtatgggtacaacatacttggcactgatggcaacgttcaaaatgcgaccaatgttcgccgttgggctactttttcgtagattaacatcacgagaggtattgttgttaacgattggcctatcacttgtagcttccgttgaattgcctaactcacttgaggagttgggcgatggattagcgatgggtattatgatcctgaaactactaaccgactttcaaagtcaccaactatgggcaactcttctcagtctcacatttatcaaaacaacttttagcttacactacgcgtggaaaacaatggcaatggtacttagcatagtaagtttatttccactttgcttatccacgacctcgcagaagactacttggcttccggtactactaggctcattgggatgtaaaccccttacgatgtttctcatcgcagagaataaaatctggggaagaagatcttggccccttaatgaaggcataatggcagtaggcatagtatccattctactatcgtcattactaaagaacgatgtccctctagcaggtccactcatagccgggggtatgttaatagcgtgttatgttatatcagggagctcagcggatttatcattggagaaggctgcagaagtctcatgggaagaagaagcagaacacagtggcgcctcccataatatactcgtggaagttcaagatgacggaacaatgaaaatcaaagatgaagaacgcgatgacactttaacaatactattaaaggcaaccctactcgccgttagcggtgtatatcctttatctataccagcgacattatttgtatggtacttttggcaaaagaagaaacaacgttcaggcgtactgtgggatactccatccccacctgaagtggaacgagccgtattggatgatgggatatatagaataatgcagcgtggcctattaggaaggtctcaggtaggggtaggagtgttccaagaaaatgtttttcacactatgtggcatgtaacgaggggcgctgttctcatgtaccaaggcaaacgattggaaccctcatgggcgagtgtcaagaaagatctgataagttatggaggaggatggcgtttgcaaggatcgtggaacactggagaggaggtccaagtaatagcagtagagcctggtaaaaaccctaagaatgtacagaccgcacctggtacttttaaaaccccagaaggggaagtaggggctattgcactagattttaagccaggtacttccggaagcccgatagttaatcgcgaagggaaaatagtaggcctttatggaaacggggtcgtgactacctcaggaacttatgtatccgccatcgcgcaagcgaaagcatcgcaagagggtccgcttccggaaatcgaagacgaggttttccgaaagagaaatctaactatcatggatttacatcctggttcaggtaagacgcggagatatttaccagcaatagtaagggaggccataaaaaggaaattacgaacactaatattagctcctacgcgcgtagtagcttccgagatggccgaagccctcaaaggaatgcctataagatatcagacaacagcagtaaagagtgaacatacaggcaaagaaattgttgatctaatgtgccacgctactttcaccatgagactattgagcccagttcgcgtccctaattacaacatgataatcatggacgaagcacactttaccgatccgagctcaatagccgcgcgcggttatatcagtacgcgagtcggtatgggagaagcagcggccatatttatgaccgctacacctcctggttccgtagaagcatttcctcaatcaaatgcagtaatacaagatgaagagagagacataccggagcgctcatggaacagtggttacgaatggataactgactttcctggcaagacagtatggtttgtaccatctattaaatcaggaaacgacatagcaaattgcctaaggaaaaacggaaaacgtgtcattcagttaagccggaaaacattcgatactgaatatcagaaaaccaaaaataacgattgggattatgtcgtaacaacggatatttctgaaatgggggcaaactttagggcagatagagttatagacccacgacggtgcctaaaaccagtcattctgaaagacggaccagaacgggtcattttggcaggccccatgccggttactgttgcgagcgctgctcaaagacgcgggaggataggcagaaatcataataaagagggtgaccaatatatatatatgggacaaccattaaacaacgatgaggaccacgcacattggacagaagcaaaaatgttacttgataacatcaacactccagaaggtataattccggcattatttgaaccagaaagggagaaaagtgcagctatagacggagaatacagactcagaggtgaagcaagaaagacctttgttgagctaatgcggagaggggacttaccggtttggttatcgtataaggttgcttcggaaggcttccaatattcagaccggagatggtgcttcgacggggaacgtaataatcaagtgctggaagaaaacatggatgtggaaatatggaccaaagaaggtgagagaaagaaacttaggccaaggtggttagatgctcgaacctatagcgaccctctagcactccgagagtttaaagaatttgcagccggaaggcgatcggttagtggcgacttgatacttgaaataggaaaactgccacaacacctcacacaaagagctcaaaacgccttagataatctagtaatgttacataactcagaacagggtggcagagcctataggcatgcaatggaagaactacctgatacaatagaaaccctgatgctcctggccttaattgcggtattaacaggaggagtgatcttatttttccttagtggccgtgggttaggtaaaacaagtataggacttctttgtgttatggcctcgagcgtgctattgtggatggcatcagttgaacctcactggatagcagcatcaataattctcgagttctttctaatggtacttctaatacccgagccagatcgtcaaaggactccacaagacaatcagttagcatacgtcgttattggactcctcttcatgatattgacagttgcagcgaatgagatgggtcttctagagactacgaagaaagatctaggaataggccacgttgcagtagagaatcaccaccatgctgctatgttggacgtggaccttcacccagcttcagcatggactttatatgctgtcgccacgaccataataacaccgatgatgagacatacaatagaaaatacaactgccaacatatcactgacagctatcgccaaccaagcagcaatactcatgggtctagataaagggtggccaataagcaaaatggacattggcgtacctctgctcgccttgggatgctacagtcaagtgaacccccttacattaacagcagcagttctaatgttggtagcgcactacgcgattataggtcctggattacaggcgaaggcgactcgtgaagcacagaaacggactgcagccggaataatgaaaaatcccacagtcgatggaatcgtggccatcgacttagaccctgtggtatacgacgcgaaatttgaaaaacaattgggacaaataatgctacttattttatgtacgtcacaaattctgctgatgagaaccacctgggcactatgtgagtcaattacacttgccacaggccctttgacgacattgtgggaagggtctccggggaaattttggaacacaaccatagccgtatctatggcgaatatatttcgaggaagctacttagccggtgcaggactagccttcagcttaatgaagagtttgggtggaggtcgtcgcggtacaggggcccagggtgaaaccttaggggaaaaatggaaacgtcaactaaaccagttaagcaaatcagagttcaacacatataagagatccggaataatggaagtagatagatctgaggcaaaagagggtctcaagagaggggaaactactaaacatgccgttagtaggggtacagcaaaacttagatggtttgtcgaacggaacttagtgaaaccagaaggaaaggtcatagatctaggatgcggaagaggaggctggagctattattgcgctggcctaaagaaagtgactgaggttaaaggatatacaaaaggaggtccaggccacgaggaacctatcccaatggctacttatggatggaacctcgtcaaattacactccggcaaagacgtattcttcattccacctgaaaaatgtgacacgctgttatgcgatataggtgaaagctcacctaatccaaccattgaagaagggcgtacattgagagtccttaaaatggttgaaccgtggctaagaggcaaccaattctgcataaaaatccttaatccttacatgcctagtgtagtagagaccctcgagcaaatgcagaggaaacatggaggaatgttagttcgtaaccccctttctcgaaattctactcacgagatgtattgggttagctgtggcacaggaaatatagtcagcgctgtcaatatgacatcgcgaatgttgctaaatcgatttaccatggcgcatagaaaaccaacatatgagcgagacgtagatctaggagcggggacaagacatgtagcagttgaaccagaagtagctaacttagatataataggtcaaagaatagaaaacatcaaacatgagcacaaatcgacgtggcactacgatgaagacaacccttacaaaacctgggcctatcacggatcttacgaggtaaaaccctcaggatcagctagctcaatggttaacggagtggtgaagttgttaacaaaaccatgggatgtaataccgatggtaacccaaatagctatgaccgacactacacctttcgggcaacaaagggtgtttaaagagaaagtggatacgaggactcctaaagccaaacggggtaccgcccaaattatggaggtaactgcgaagtggttatggggctttttaagtaggaacaagaaaccgagaatttgtacccgcgaagagttcaccaggaaagtaagatctaatgccgcaattggcgcggtattcgtagacgagaatcaatggaacagcgctaaggaagcagttgaagatgaaagattttgggatctagtccatcgtgagcgagaactccataaacaagggaaatgtgctacatgcgtttacaatatgatgggcaaacgagagaagaaattaggcgagtttggcaaagcaaaaggtagtagggccatatggtacatgtggttaggagcaagatttctagagttcgaagccctaggttttatgaatgaggatcattggtttagtagagaaaattcgttatccggtgtagaaggagaagggttacataaacttggttatatcctcagggacataagtaaaatccctggaggaaatatgtatgccgatgatacagccgggtgggataccagaattaccgaagatgaccttcagaacgaggctaggattactgatattatggaaccggagcacgcattattagcacgatcaatatttaaactgacctaccagaataaagtagttcgcgtacaaagaccagctaaaaatggaacagtaatggatgtaataagcagaagagatcaacgcggatcagggcaggttggcacatatggattgaatacatttacaaacatggaagcacaattaatcagacaaatggaatcggaaggcatattttctcccagcgagttggaaactcccaatctagccgagcgtgtgttagactggttagaaaaatatggagtagaacgactaaaacgcatggccatatctggtgatgactgtgttgtaaagccgatcgacgataggttcgcgaccgctttaaccgctctaaatgatatgggaaaagtacgcaaggatataccgcaatgggaaccttcgaaaggctggaacgactggcaacaggttccattttgcagtcatcattttcaccaattaatcatgaaagacggcagagagatagtggtaccgtgtcgaaaccaagacgagttagtaggaagggcaagagtatctcagggcgcgggctggtcgttaagagaaaccgcatgcctcggaaaaagttacgcccaaatgtggcaactaatgtatttccacaggagagatcttagactcgcagcgaatgcaatctgttcagctgtaccagtcgactggatcccaacatcacgtactacatggagcattcacgctcatcatcaatggatgactactgaagatatgctcagcgtctggaacagggtctggatagaagaaaatccatggatggaagataaaacccacatttcaagctggggtgatgtaccctatttagggaaaagagaagatcaatggtgcggatctttaattggcctgaccgcgcgtgcaacttgggctacaaatatacaagtagcgattaaccaagtacgcagattaatagggaatgaaaattatctagactatatgacgtctatgaagcgattcaaaaatgaatcagatccagaaggagctctttggtaa

SEQ ID NO: 21666 - RNA, 9879 nt, synthetic construct
  misc_feature 1..9879: note = derived and/or modified CDS sequence (opt6) from DENV-1__GQ199787__SS-prME
  source 1..9879: mol_type = other RNA
tctgtaacaatgttattaatgttagtaccgactgcattagctttccatttaacaacacgaggaggggaacctcatatgattgtaactaaacaagaaagaggtaaaagtttattatttaaaacaagtgccggtgtaaatatgtgtacactgattgcaatggacctaggagaactctgtgaagacactatgacctataaatgcccacgcataactgaagctgaaccagatgacgtcgattgctggtgtaatgcgactgatacttgggtgacatacggcacctgtagccaaacaggagagcatcggcgagataaacgtagcgtagcactagcaccccatgtaggattgggactagaaacgaggactgagacatggatgtcttccgagggtgcatggaaacaaatacaacgggtagaaacttgggctctcaggcatcctggattcacagttattgcattatttctggctcatgcaattgggactagcattacccaaaaaggcattatttttatattgctcatgctagtaacgccaagcatggcaatgagatgtgtaggtataggttcgcgggacttcgtagaggggctttctggggcaacttgggtggacgtagtcttggagcatggcagctgtgtaactaccatggcaaaagacaaacctaccctagacatagagctactcaaaacagaagtaactaatcccgctgttctccgaaaactatgcatagaagctaaaatatcaaacactactactgattctagatgtcccacacaaggagaggcgacactcatggaggaacaagacgcaaattttgtgtgccggcgtacatttgtcgatagaggatggggaaatggatgtggattattcggaaaaggcagtctaataacttgcgcaaaatttaaatgcgtaacaaaactcgaaggaaaaattgtacaatatgaaaacttaaaatacagtgtaattgtaaccgtgcatactggtgaccaacaccaagttggaaacgaatcgacggaacatggaaccactgctacaatcacgcctcaagcccccacctccgaaattcaattaacggattatggtgcgctaacgttagactgcagtccgcgcacgggtttggatttcaatgaaatggtccttcttactatgaaagaaaaatcatggttggttcataaacaatggttcttggatttgcctttaccatggacaagcggggcctcgacctcgcaagaaacatggaacaggcaagatcttttagtaacgtttaaaacagcgcatgctaagaaacaggaagtagtagtactaggatcacaggaaggagctatgcatacagcactgaccggagcaacagagatccaaacaagtggtactacgacaatatttgccgggcatctcaaatgcagattaaaaatggacaaacttactttaaaaggaatgtcatacgttatgtgtacaggatcattcaaactagaaaaagaagtagctgaaactcaacatggtacagtgctggtacagattaaatacgaaggaacggatgctccatgtaaaatcccttttagcacgcaagatgaaaagggtgtaattcagaatgggagattaataacagcaaatcccatcgttacagataaagagaaaccagtgaatattgaagcagagcccccatttggagagtcctacattgtaattggagttggtgagaaggcccttaagctgtcatggtttaagaaaggaagtagtataggaaaaatgttcgaagcaactgctaggggcgccagacgcatggcaattctgggtgatactgcatgggatttcggaagtattggtggagtattcacctcggtcggaaagttagtgcaccagatttttggtacggcgtatggtgtattattttctggagtaagctggactatgaaaattggcataggtgtattgcttacatggctagggctgaatagtcgatcaacaagtctcagtatgacttgtatagcagtaggattggtaaccttatacctaggagtcatggtacaagcggactcaggctgcgtaatcaactggaaaggaagggaattaaaatgtggatctggaatcttcgtaacaaatgaagtacacacgtggactgaacagtacaaatttcaagctgattcaccgaaaagactatcggcggctataggtaaggcatgggaagaaggagtctgtggaattaggtcggcaacccgtttagaaaacataatgtggaaacaaatatcaaatgagctaaaccatatcctgctagaaaacgacatgaaatttactgtagtggttggggacgtggtcggaatattagctcaaggaaagaaaatgatcagaccccaaccaatggagcataaatattcctggaagtcgtgggggaaagctaaaataataggtgcggatgtacaaaatacaacgttcataattgatggaccaaacactccagagtgtccggatgatcaaagagcttggaacatttgggaagtcgaagattacggattcggaatattcactaccaatatatggcttaaactgcgggatagctatactcaagcatgcgaccaccgcctaatgtctgcagccataaaagacagcaaagcggtacacgcagatatgggatattggatagagtctgagaaaaatgaaacgtggaaactcgcaagagctagcttcatagaggtgaagacatgtatttggccaaaatcgcacactctttggagcaatggtgtactcgagagcgagatggtaataccaaaaatctacgggggaccaataagtcaacataattataggcctggatattttacacaaaccgcaggaccctggcacctaggcaaacttgagctcgactttgacttatgtgaaggaacaacagtggtcgttgatgagcactgtggaaaccgaggaccatctcttaggacaactaccgtaactggaaaaattatacacgaatggtgctgccgaagttgtacgcttcctccgttaagatttaaaggagaagacggctgctggtacggaatggagattcgacccgtaaaagaaaaagaggaaaaccttgtcaaaagcatggtctccgctggttcaggagaagttgattcctttagtttaggattattatgtatctcaatcatgatcgaggaggttatgcgatccaggtggtctcgtaaaatgctaatgacaggcaccttagcagtcttcttgttattaataatgggccaacttacctggaatgatctaataaggctttgcattatggtcggagcaaacgcatctgataggatgggaatggggacgacgtacttagcattgatggcaactttcaaaatgcgccccatgtttgccgtaggcttattatttagacgcctaacgtcacgtgaagtactgctgctgaccataggtctatcattagtggcatccgtagaactgccaaactccctagaagaactaggagatggacttgcaatgggcataatgatcttgaaattgttaacggactttcaatcacatcaattgtgggccacactacttagtctgacttttatcaaaaccactttgtcgctacactacgcgtggaaaacaatggcgatggttttatcaatagtaagtttatttccattgtgtctatcgacgacctctcagaaaacaacatggctaccagtactcttaggcagcttgggttgtaaacccttaacgatgtttctgatagcagagaataaaatttggggtagaaaaagctggcccctaaacgaaggtatcatggccgtaggagtagtatcgatcctattatcatcattactcaaaaatgatgttccgctagcaggaccattgatcgcaggcggtatgctaatagcatgttatgtcatatccggatcgagtgccgatcttagtttagaaaaagctgcagaagtatcttgggaggaagaagccgagcatagtggcgctagtcataatatcttagttgaagtgcaagacgatggcacaatgaagataaaagatgaagaaagagacgatactttgacaattttacttaaagcaacacttctagccgtgagtggagtttaccctttaagcatcccagcaactttatttctttggtatttctggcagaagaagaaacaaagaagtggtgtactttgggatactccatcgccacccgaggtagaaagagcggtacttgacgatggcatataccgaataatgcaaagaggtctcttaggtaggagtcaagtaggtgtaggtgtattccaagaaaatgttttccacacgatgtggcacgtaaccagaggggccgtactcatgtatcaaggtaaaaggctagagccgtcttgggcgtcggtcaagaaagacttaatctcttatgggggtggttggaggcttcaaggaagctggaacactggcgaggaagtacaggtcatcgcagtagaaccgggtaaaaatcctaaaaatgtacaaacagcacccggaactttcaaaactcccgaaggcgaagtcggagcaatagctttggattttaagcctggaacaagcgggtctcctattgtcaatagagaaggcaagatcgtaggtctttacggcaacggagttgttacaacctccgggacttacgtaagtgcgatagcccaagcaaaagcatctcaagaaggtccgctaccagaaattgaagatgaggtatttcggaaaagaaatctaacaataatggacttgcacccgggatccggtaaaacacgaagatatctaccggcaattgtacgagaggccattaagcgtaagctacgtactcttatactggcccctacccgtgtggtcgcatcggagatggcggaggccctaaaaggaatgccgattaggtaccaaacaacagccgtcaagtcagagcacacgggaaaggaaatagtggaccttatgtgtcatgctacatttactatgcgcctactatcacctgtacgtgttcccaattataatatgatcataatggatgaggcccactttaccgacccctcttcaatagcagccagaggttacatctcaaccagagtcggcatgggagaggcagccgctatatttatgacggctacgcccccgggatcggtagaagcattcccccagtcaaacgccgttattcaagacgaagaacgggacattccggaaagatcttggaatagcggttatgaatggataactgatttccccggaaagacggtttggtttgtgcctagcataaaatccgggaacgatattgcaaattgccttaggaaaaatggtaaaagagtcatacagctgtctagaaaaaccttcgatactgaatatcagaaaactaagaataacgactgggactacgttgtcaccaccgatatatccgaaatgggggccaattttcgggccgatcgtgttatagacccacgcagatgcctaaaaccagtaattcttaaagatggaccggaaagagttatattagctgggcccatgcccgtaaccgtcgctagcgcggcccaacgtcggggcagaataggacgcaatcataataaagaaggcgatcagtacatctatatgggacagccccttaacaatgatgaagatcatgcacactggaccgaagcaaaaatgctattagacaatattaatacgccagaaggaatcatacctgcattgttcgagcccgaacgagaaaagtcagccgcaattgatggagaataccgtcttagaggagaagctcgtaaaacatttgtcgagttaatgagacgaggtgatttaccagtgtggctatcttataaggtcgcatctgagggattccaatattctgaccgcagatggtgttttgatggggaaagaaataatcaagttttagaagagaacatggacgtagaaatctggaccaaagaaggggaaagaaagaaactaagaccaagatggttagacgcaagaacttacagcgacccactagctttacgtgaatttaaagaatttgctgcaggacgtagaagtgtatctggagatcttatattagaaataggaaaattgccacaacacctcacacaaagggcacagaatgcattagacaacttagtaatgttacataactccgaacaaggcggcagagcgtatagacatgctatggaagaattacccgataccatagaaacgctaatgttactagcattgattgcagtacttacaggtggagtaacactatttttcttaagtggaagaggtttaggaaaaactagcataggactattgtgtgtcatggcaagtagcgtactgttatggatggcttcagtagaacctcattggatcgcagcgagcataatacttgagttctttttaatggtacttctaattccagaaccagaccgccagcgtaccccacaggacaatcagctcgcctatgtggtaataggtttgctttttatgattttgactgttgcggctaatgaaatgggcttgcttgaaacaacaaagaaagatctagggattggccatgttgctgtcgaaaatcatcaccatgctactatgttggatgtggacctgcatcctgcgtccgcctggactttatatgccgttgctactacaataatcactcccatgatgagacataccattgaaaatactacagcgaatatatcattaacggcgatagccaatcaggcagccatattaatgggcctagataaaggatggcctatctcgaagatggatatcggcgtgcctctactcgcacttgggtgctatagccaagtaaatccgttaactctcacagccgctgtgctaatgttggttgctcactatgccatcatcggacccggattacaggcaaaagccacgagggaagctcagaaacgcactgccgccggtattatgaaaaatcccactgtagacggtatcgttgctattgatttagatcctgtagtatacgacgcaaaattcgaaaaacaacttggccaaataatgttgctgatactatgtacgtcacagatcctattaatgcgaacgacctgggccttatgtgaaagtataacacttgccacagggcctttaacaacactctgggaaggatcacctggtaaattctggaacaccacgattgcggtgagtatggccaacatattccgaggctcatacctagctggagcaggtctagctttctctttaatgaaatcgcttggtggagggagaagaggaactggtgcacaaggcgaaaccctgggggaaaagtggaaaagacagttaaaccaattatccaaatcggagttcaacatatacaaacgttccgggattatggaagtcgacagaagcgaagcaaaggaaggtttgaaaagaggagagaccacaagacacgctgtatcaaggggaacagccaaactaagatggtttgtcgagcgaaacctagtcaaacctgaaggtaaagtaatagatcttggatgtggcaggggaggatggtcatactactgcgcaggactaaagaaagttaccgaagttaaaggatatacgaaagggggaccaggacatgaagaacccataccaatggcgacttatggctggaacttagttaaactacattcaggtaaagatgtattcttcacgccaccagaaaagtgtgatacgctattgtgtgacataggagaatcttcgcccaatcctaccatagaagaaggaagaacgcttcgggtattgaaaatggtagaaccatggctacgagggaatcaattttgtattaagattctgaatccttacatgccatccgttgttgaaactctggaacaaatgcaacgaaagcacggaggcatgctagtaaggaacccactatcgagaaatagtacacacgagatgtattgggttagctgtggaacgggaaatatcgtttcagcagtcaacatgacttctcgcatgctactaaacagattcacaatggcgcatagaaaaccgacgtatgagagagatgtagatctaggtgccggcaccagacacgtagcagtagaaccggaggtggcaaatttagacatcattgggcaaagaattgaaaacataaaacatgaacacaagagcacctggcattacgatgaagataacccttataaaacatgggcgtatcacggaagttatgaagtaaagccttccggaagtgcttcatccatggtaaatggcgtcgttaaacttttgaccaaaccgtgggatgtcatccccatggttacacaaattgccatgacagacacaacaccctttggacaacagagggtctttaaggagaaggtcgacactcgaacacctaaagctaaaagaggtacggcacaaataatggaagtaacagctagatggctatggggattcttatcgcgtaataagaaacctaggatttgtacccgagaagagtttactcgtaaagttagatcaaacgccgcaataggagcagtattcgtagatgaaaatcagtggaactcagcaaaagaggctgttgaggatgagcggttttgggatttagtccaaaaagaaagagaattacacaagcaaggaaaatgtgcgacgtgtgtatataacatgatgggaaaacgtgagaagaaattaggagagttcggaaaggctaaaggtagccgggccatatggtacatgtggctgggcgctagattcctcgagttcgaagccttaggctttatgaatgaagatcactggttttcaagagaaaatagcttaagcggggttgaaggagaaggcctacacaaactaggatatatattacgcgacatatcaaaaatcccgggtggaaacatgtacgccgatgatacagccgggtgggacaccagaataacagaagacgatctacaaaacgaagctaaaattacagatattatggaaccggaacatgcattactagccacgtcaatcttcaaactaacttaccaaaataaagtcgtaagggttcaaagaccagccaaaaatggaacggtaatggacgtaatatcacgaagagaccagagaggatcaggccaagtaggaacgtatggattaaacacatttacaaacatggaagcgcaactgatcaggcaaatggaatcggaagggatttttcttccatctgaactcgaaacaccgaatctcgcagaacgagttctagattggcttgaaaagcatggagttgagagattgaagcgaatggccataagcggcgatgattgtgtagtcaaacctattgatgataggttcgcgactgcattaacggctctaaatgatatgggaaaagtaagaaaagatatacctcaatgggagccctcgaaaggttggaatgattggcaacaggtacccttctgtagtcaccactttcatcaactaataatgaaagatggaagagagattgtagttccctgtagaaacgaagatgagttggttggccgagcaagggtcagccaaggagcaggttggagccttcgagaaacggcatgcctgggaaaatcgtatgcgcagatgtggcagttgatgtattttcatagacgagacttgagattagcagcaaacgccatttgttcagccgtaccggtagactgggtacccacatctcgaacaacttggtccatacatgcacatcatcaatggatgaccacagaggacatgttgtctgtttggaatagagtgtggatagaggaaaatccttggatggaagacaagactcacgtaagcagttggggtgatgttccttatctcggaaaacgagaggatcaatggtgtggaagcctaattggtcttacggcacgcgccacttgggccagcaacatccaggtagctataaatcaggtcagaagattaatagggaacgaaaattatcttgattatatgacaagtatgaaaagatttaaaaacgaaggagatccagaaggcgccctgtggtag

SEQ ID NO: 21667 - RNA, 9879 nt, synthetic construct
  misc_feature 1..9879: note = derived and/or modified CDS sequence (opt6) from DENV-1__GQ199788__SS-prME
  source 1..9879: mol_type = other RNA
tcagtaactatgctactcatgctaatgcctaccgcattagccttccacttaaccacacgaggcggcgaaccgcatatgattgtatcaaaacaggaacgagggaaaagtctattatttaaaacgagcgcgggcgttaacatgtgcacactaatagcgatggacttgggagaattttgcgaagatacaatgacatataaatgcccacggataaccgaagcagaaccggacgatgttgattgttggtgtaatgcaactgacacttgggtgacatatggcacatgctcccaaacaggtgaacatcgcagggataaacgatctgtagcacttgcgccgcacgttggcctcgggctagaaacgcgaacagaaacctggatgagctcagaaggtgcctggaaacaaatacagagagttgaaacttgggctttaagacaccctggattcacggtcatagcgttgttccttgcacacgcaataggaacaagtataacacaaaaaggcattatatttatactactaatgctagtcactccaagtatggccatgaggtgtgttggaataggtagccgagatttcgtcgagggattatcaggagcgacatgggttgacgttgtattagaacatggctcctgcgtcacaaccatggccaaagacaaaccaacattagatattgagctactcaaaacagaagtcactaatcccgcagtacttagaaaactttgtattgaggcaaaaatttccaatactacaaccgattcgagatgcccaactcaaggagaagcaactctagttgaagaacaagatgctaacttcgtctgtagacgtactttcgtagatcgtggttggggcaatggttgcggactattcggtaaagggtctcttataacatgcgcaaaatttaaatgtgtaacgaaactcgagggaaaaacagtgcagtacgagaacttaaaatatagcgttatcgtgactgtacatactggcgaccagcatcaggtcggaaatgaatcaaccgaacacggtaccactgctacaatcacgccgcaagcaccctccacagaaatacaattaacggattacggagctctaaccctagactgtagtccacgaactggcttggactttaatgaaatggtcttactaaccatgaaagagaaaagctggttagtccacaaacaatggttcctagatttaccattgccgtggacctcaggagctagcacctcgcaggaaacctggaatagaaaagatctactcgtgacctttaaaactgcgcacgctaagaaacaggaagtcgttgtattaggaagccaggaaggagcgatgcatacggccttaacaggtgctaccgaaatacaaacaagtggcactactactatttttgccggacatctaaaatgcagacttaaaatggacaagttgacattaaaaggaatgtcctatgtaatgtgcacaggctcttttaaattagaaaaagaagtagctgaaacgcaacacggcacagttttagtgcagataaaatacgaaggaacagatgctccatgcaaaattccattttctacacaggacgaaaaaggagtaacacaaaatggaagacttatcacggcgaatccaatagtaacagacaaagaaaaacctgtgaatattgaagcggaaccaccatttggagaatcttatatagtcataggcgctggtgaaaaagcattaaaattatcttggttcaagaaaggatcatcaattggcaaaatgttcgaagctacggcacgtggagcacggagaatggctatattgggggacactgcatgggactttgggtccatcggaggagtattcacaagcgtcggaaaattagtgcaccagatcttcggaacagcatacggagtactattctccggggtgagttggacaatgaaaataggtatcggagtacttttgacatggctcggtcttaattcgagatcaacgtccttatctatgacatgtatagccgtaggacttgtcacactatatcttggtgtcatggtacaagcggacagcgggtgtgtaatcaactggaaaggaagggaattaaaatgtggaagtggtatcttcgtgacaaacgaggtgcacacgtggacagaacaatataagtttcaagctgatagtcccaaacgattaagtgctgcaataggaaaggcctgggaagaaggggtatgtggcatacgaagtgcgactagactagaaaatattatgtggaaacaaatttcaaatgaattaaatcatatcttgcttgaaaacgacatgaagttcaccgtagtagttggtgacgtggcgggaatcttagctcaaggaaagaaaatgatacgaccccaacccatggagtataaatacagttggaaaagctggggaaaggcaaaaatcattggtgctgatgttcaaaatacaaccttcataatcgatggcccaaatactccagaatgtccagacgaccagagagcctggaatatttgggaagtagaagactatggatttggcattttcacaacaaatatatggctaaaactcagagatagttatacgcaagtgtgcgatcatcggctaatgtctgcggctataaaagactctaaagcagttcatgccgatatgggctactggattgaatcggagaaaaatgaaacctggaaattagcaagggcatcatttatagaagtaaaaacatgcatctggccaaagtcacacacattatggtcgaacggagtactggaatcagaaatgatcatccctaagatatatggtggtccgatttcgcaacataattacaggcccggatactttactcaaacagcaggaccgtggcacttaggtaagttagaactagatttcgatctctgcgaaggaactacagttgtcgttgatgagcattgcggtaataggggtccttccctccgcacaacaactgttacgggaaaaataattcacgagtggtgctgtagatcctgcacattgcccccattacgttttaaaggagaagatggttgttggtatggaatggagatacgcccggttaaggagaaagaagaaaatttagtaaaatcaatggtatcggctggcagtggtgaagttgattccttctcattggggttactctgcatatcaataatgatagaggaagtaatgaggtcgaggtggagtagaaaaatgttaatgacagggacattagccgtattctttcttctaatcatgggccagttgacttggaacgacctaataaggctctgcataatggtaggcgcgaacgcatccgaccgtatgggcatgggaacaacctatctagctttaatggctactttcaagatgagaccaatgttcgctgtaggattactatttagacgactaacatcgagagaagtactattattgacaataggactcagtctagttgcaagcgtagaactaccgaactcactagaagaactgggagatggattggcgatggggataatgatcttgaaattactgactgattttcagtctcatcaattgtgggcaactttacttagtttaactttcataaagactacatttagtctccattatgcctggaaaactatggctatggttctatctatagttagcttatttccgttatgcttatctactacctcacagaaaactacttggttaccagtacttctaggatcattaggatgcaaaccgttgacaatgttcctaatagcagaaaacaagatatggggtaggaaatcttggccactaaatgaaggaataatggctgttggaatagtatctatactcctatcgtcactattaaagaacgacgtgcccctagcggggccacttattgcaggaggtatgcttatcgcatgctatgttatttcaggaagttcggcagatttaagtctggagaaagcagctgaagtatcttgggaagaagaggctgaacacagcggtgcttctcacaatattttagtagaggtgcaagatgacggtacgatgaaaataaaagatgaagaacgagacgataccctcacgattctgctaaaagctacgttactcgccgtaagtggagtctatccactaagtattcctgcaacattatttgtatggtacttttggcaaaagaagaaacaaagaagtggtgtattatgggatactcctagtcctccggaagtagaacgagcagttctcgacgatggaatctataggatcatgcaacggggtctgttaggcaggtctcaagtgggtgtgggagtgttccaggaaaatgtttttcatacgatgtggcacgtcacaaggggagccgtactaatgtatcagggtaaaagacttgagccatcgtgggcgtcagttaagaaagacctcattagttatggaggcggatggagactccaaggaagctggaatactggtgaggaagtgcaagttatagccgtagaaccagggaaaaatcccaaaaatgtacagaccgctcctggcacatttaaaacctctgagggagaagtaggtgcaatagcgcttgacttcaagccaggaacaagtggaagtcctattgtaaatagagagggcaaaattgtcggtttgtatggaaacggtgtggtcacaacgtccggaacttatgtatctgcgattgcacaagcaaaagcatcgcaagagggtcctttaccagaaatcgaagacgaagtttttcgtaagagaaatctaacaattatggaccttcacccaggatcagggaagactcgacgttacttgccagctattgtgcgcgaagcaatcaaacgtaaacttcgtaccctaattctagcgcccactcgtgtagtggcgtcagaaatggcggaggctttaaagggtatgcctataaggtatcaaactactgccgtgaaatcagaacatacgggaaaggaaattgtagacttaatgtgtcatgcgacattcactatgcgattactaagcccagttagagtaccaaactataatatgatcataatggacgaagcacacttcaccgatcctagttcaatagccgcaagaggttatatatctacaagggtagggatgggggaagcagccgccatttttatgactgcaacgccgccgggcagcgtcgaggcttttccacagtcaaatgctgtcattcaagacgaagagagggatataccggaacgatcttggaactcaggctacgaatggattacagactttcctggaaagaccgtttggtttgttccttctatcaagtcaggcaatgatattgccaattgcctcaggaagaatggcaaaagagtcattcaacttagtagaaagacatttgataccgaatatcagaaaacaaagaataacgattgggattacgtggtaacaactgatatttcagaaatgggagcaaatttccgtgcggatcgtgtcatagaccctagacggtgtttaaaaccagtgatactaaaggacggaccggagagggttatcttggcaggaccaatgccagtcacagtcgcttccgcagctcagagacgagggagaatcgggaggaaccacaataaagaaggggatcaatacatatacatgggacagccattaaataacgacgaggatcacgcacattggactgaagctaaaatgttgcttgataatattaatacgccagaaggcataatacccgcattatttgagcccgagcgagagaagtctgcggcaattgatggagagtacagattaagaggcgaagcaaggaagacttttgtggagctaatgcgtagaggagacctgccagtttggttaagttacaaagttgcttcagagggatttcaatattcagataggcgatggtgttttgatggagaaaggaataatcaggtactagaagaaaatatggacgtagagatctggacaaaggagggagaacgaaagaaattacgtccacgatggttagatgctcgcacatacagcgaccctttagcacttcgagaatttaaagagttcgctgcgggtcgtcggagtgtatcgggggatctaattttggaaataggaaaattgccgcagcatttaacccaaagagcacaaaatgctcttgataacttagtaatgctacataactccgaacaaggcggccgagcatatcgacatgcaatggaggagttaccagacaccatagaaacattaatgttattggctcttatagcagtactaacgggaggagtcacattatttttcctatctggccgaggacttggtaaaaccagcataggattactctgtgtcatggcttcaagcgtactcctatggatggccagcgtggaacctcattggatagccgcttcaatcattctagagttctttcttatggttttattgataccagaaccagatagacaacggactccacaagataaccagcttgcatatgtagtaatcggtcttctctttatgatactaacggtggctgcgaacgagatgggactgcttgaaacaacgaagaaagatctaggtatcggacatgtagccgttgagaatcatcaccatgcagcaatgttagacgttgacttacacccagcatcagcgtggacattatatgcagtagcaactacaatcattacacccatgatgagacatactattgaaaacacaacagccaatatctccctcacggcaatagcaaaccaagcagcaatacttatgggtcttgataaagggtggccgatatcaaaaatggatatcggggtaccactgttggcactaggttgctatagccaggttaatccactgacattaacagcagccgtcctgatgttagtcgcgcactacgcaataataggtccgggcttacaagcaaaagctactagagaagctcagaaacgtactgcggcaggcattatgaagaaccctacagttgacggaattgtagctattgatttggaccctgtagtttatgatgccaaattcgaaaaacaactgggacagataatgttattaattctatgtactagccagatactcctaatgcggacgacgtgggctttatgcgaatccataactctcgcgactggcccgcttacaacgttatgggaaggtagcccagggaaattctggaataccacgatagcagtatccatggcaaacatttttcgtggtagctacttggctggtgctggattggctttttcgttaatgaagtcactagggggaggcagacgtggtacgggagcacaaggtgaaacattaggagaaaagtggaaaaggcaactcaatcaactctcaaaatcagaatttaatacgtacaaaagaagcggaattatggaggtagataggagtgaagccaaggaaggcctcaaacggggtgagaccacgaaacacgctgtgagtagaggcactgcaaagttgcggtggtttgttgaaagaaatttggtcaagcctgagggaaaagttatcgatttagggtgtggaaggggtggatggtcctattattgtgcaggtttgaagaaagtgaccgaagttaaaggatacaccaaaggcggccctggtcacgaagaacctatacccatggccacttacggttggaatctagtgaaattacattcaggcaaagatgtgtttttcataccccctgaaaaatgtgacactcttctatgtgacattggggaatcgagtccaaatccaacaatagaagaaggcagaactctacgtgttctcaagatggtagaaccttggttacgaggcaatcaattttgtataaaaattcttaatccttatatgccatcagtcgtggaaacacttgagcagatgcagcgaaaacacggcgggatgttggtacgcaatccactatctagaaatagcacccatgagatgtactgggtatcatgtgggaccggaaacattgtctcagcagtcaatatgacctctcgtatgcttctaaacagatttactatggcacatcgcaaacccacgtatgaacgagatgtagaccttggggctggcacacggcatgtagccgtagagcccgaagtcgctaacctcgatatcatcggccaacgaatcgaaaacataaaacatgaacacaaatcaacatggcattacgacgaggataacccttataaaacgtgggcctatcatggtagctacgaagtaaaaccatcgggttcggcatcaagcatggtgaacggtgtcgtaaaactactaacgaagccgtgggatgtaataccgatggtaacgcaaattgcaatgacagatacaacaccgtttggtcaacaaagagtgttcaaagagaaagttgatactagaactccaaaggctaaacgtggcaccgcccaaataatggaggtgacagccaaatggttgtggggatttctaagcaggaataagaaacctaggatatgcacaagagaagagttcactcgcaaagtacgcagcaacgcagcaataggtgctgtattcgtagatgagaatcagtggaactcagcaaaagaggcggttgaggacgaaagattctgggacttagtacatagagagagggaattacacaaacaaggtaagtgcgctacttgcgtatacaatatgatgggaaagagagagaagaaattaggggagttcgggaaggcaaaaggttcccgggctatatggtacatgtggcttggtgctagatttcttgagttcgaggctctaggatttatgaatgaggaccattggttctcaagggaaaatagtctgagtggagtagagggcgagggacttcataaactaggttatattttacgtgacataagcaaaatcccagggggtaacatgtatgcagacgacactgccggctgggacacccgaataactgaggatgacctacaaaacgaagctaaaattacagacatcatggaaccggaacacgcactcctggctaaatcaatcttcaaattaacttaccaaaacaaagtcgtacgagttcagaggccagctaagaacggtaccgtaatggatgtaatatcgagaagagatcaaagagggtccggtcaagtaggaacatacggtctgaacacatttacgaatatggaagcccaattaattcggcaaatggaaagcgaaggtattttctcaccttctgaactagagaccccaaatctagcacggagggttttagactggctcgaaaagcacggagtagaaagactcaaacgaatggccatctcaggagacgattgcgtcgtaaagccgatagatgatagatttgctacggcattaaccgcactgaatgacatgggaaaagtaagaaaagacatacctcaatgggagcctagtaaagggtggaatgattggcaacaagttcccttttgtagccaccattttcatcaactcattatgaaagacgggcgtgaaattgttgtcccatgtcgaaatcaggatgagctagtggggagagcgagagtgtctcaaggagcgggttggagcttgagagaaacagcttgccttggtaaaagctacgcacagatgtggcaacttatgtacttccatcggcgagacctgagattagcagctaacgcaatttgttctgccgtacccgtagactgggtacccacaagtcgaacaacttggtcaatacatgcacaccatcagtggatgactacagaagatatgctttcggtatggaatagagtttggattgaagagaatccatggatggaagataagacgcatataagcagttggggagatgtaccataccttggaaagcgagaagatcagtggtgtggatcattaatcggacttacagcgagagcaacgtgggctacgaacatacaagttgcgataaatcaggttcgtagacttattggaaatgagaactatttggattatatgacatcaatgaaaagattcaagaatgaatccgaccccgaaggcgctttgtggtaa

SEQ ID NO: 21668 - RNA, 9879 nt, synthetic construct
  misc_feature 1..9879: note = derived and/or modified CDS sequence (opt6) from DENV-1__GQ199789__SS-prME
  source 1..9879: mol_type = other RNA
tctgtaactatgcttctgatgcttatgcccactgcgttagcgtttcatttaactactagaggcggggaacctcacatgatcgtttctaaacaagaaagagggaaatcacttctatttaaaacaagtgcaggggtgaacatgtgtactttaatcgcaatggatctaggggaattttgtgaagatactatgacttataaatgtccaaggataactgaagcagaacctgacgatgttgattgttggtgcaacgcaacagatacctgggttacatatggaacttgttcgcaaaccggtgaacacaggagagacaaacgatctgttgcgttggctccccatgtaggattaggtttagaaacaagaacagaaacatggatgagtagtgagggtgcgtggaaacaaattcaaaaggtggaaacatgggcacttagacacccgggatttactgtaatagccctgtttttggctcatgctatcggcacgtctataacccaaaaaggaataattttcattttattgatgttagtaacaccgagtatggcaatgagatgcgtcggaataggtagtcgtgacttcgtggaaggactttcaggagcgacatgggtagatgttgtattagaacatggatcctgcgttaccaccatggccaaagataaacccacattggacattgagttactaaaaacagaagtaaccaatccagccgttttgagaaagctatgcattgaagccaaaatcagtaacacaactacagatagtcggtgcccgactcaaggagaggctactttagtagaggaacaagacgctaatttcgtttgcagacgtaccttcgtagatcgtgggtggggtaatggatgtggtttgtttggaaaaggatccttaatcacgtgtgcaaaatttaaatgtgtcactaaactagagggcaaaacagtacaacacgaaaatctaaaatactcagttatagttaccgtgcacaccggcgaccaacatcaagtcggaaacgagtcaacggagcacggcacaacagctacaataacacctcaagcaccatcaacagagatacagctaacggactacggcgcacttactctcgattgctcacccagaactggcttagattttaacgaaatggtattgcttaccatgaaagagaaaagttggctggtacacaagcaatggtttctagatttacctttgccttggacttctggcgcatcaactagccaagaaacgtggaatagaaaagaccttttagtaacatttaaaactgcacatgcaaagaagcaggaagtagttgtgctaggatcacaagagggtgcgatgcacaccgcactaacaggagcgacagaaatacaaaccagtggcactacaacaatatttgctggacatttgaaatgtcgactgaaaatggacaaattgacattaaaaggcacctcatacgtgatgtgtactgggagctttaaactggaaaaagaagtcgctgagacacaacatggaactgttctcgtgcagataaaatacgaaggaaccgatgcgccgtgtaagatacccttctcaactcaggacgagaaaggggtaacgcaaaacggaaggctgatcactgctaatcctattgtcacagataaagagaaacccgtgaacattgaagcggaaccaccattcggcgaatcgtatattgtcataggagcaggggaaaaagctctaaagctgagttggttcaagaaaggatctagcattggaaaaatgttcgaggcaaccgcaagaggagcgagacgaatggcaatattgggtgacacagcatgggacttcggctcaataggcggcgtgttcacgagcgtaggaaagctggtgcatcaaatctttggaacggcatacggagttttgtttagcggagtttcatggacaatgaagattggtattggagtgttactaacctggttaggtctaaattcgaggagtaccagccttagcatgacctgtattgcagtagggctagtaacactatatctaggtgttatggttcaagcagatagcgggtgcgtaatcaattggaaaggtagagaactaaagtgcggaagtggaatattcgttactaatgaagttcatacttggacagaacaatataaatttcaagctgactcaccaaagagattatcagccgccatcgggaaagcctgggaagaaggcgtatgcggaatacgatctgctactcgcttagaaaatataatgtggaaacaaataagtaatgaactaaaccatatcctgcttgaaaacgacatgaaatttacagtagtcgttggtgatgttgcaggtatactagcacagggcaagaaaatgatcagaccgcaacctatggaatataaatactcttggaagagttggggaaaagcaaaaataataggagcagacgtgcagaacacaacattcataatagatggaccgaatactcctgaatgcccggacgatcaaagagcctggaatatttgggaggtggaagactatgggtttggtatattcactacaaacatctggctaaagctgagagactcatatactcaagtctgtgatcacagactcatgtctgcagctattaaagatagcaaggccgtccatgctgacatgggctattggatagaatccgagaaaaatgaaacctggaaactggctagagcttcatttattgaagtgaagacttgcatttggccgaaaagccataccttatggtcaaacggggtattagaatctgagatgataattcccaaaatttacggtgggcccacaagtcagcacaactataggccaggttacttcacccaaacagctggaccatggcacctgggaaagttagagttagacttcgatctatgtgaaggcacaacagtagtcgttgacgaacactgtgggaaccgagggccttcattaagaacgacaactgtaactggtaaaatcattcatgaatggtgttgtcgttcatgtacacttccacccttaagattcaaaggagaagatggctgttggtatggcatggaaataaggcctgtaaaagaaaaagaggagaatcttgtaaaaagcatggtatccgcaggttctggagaagttgatagtttcagtcttggtttgttgtgcatatcgataatgatcgaagaagttatgcgatctagatggtccaggaaaatgttaatgaccggaaccctagcagtattctttctgcttataatgggacaactaacctggaacgatttaattagattatgcattatggtaggagcaaatgcctccgatagaatgggaatgggaactacttatcttgcgcttatggctacatttaagatgcgaccaatgtttgcagttggtttactatttcgcagattaacaagtcgagaagttctattgctaacgataggactgtctcttgtagcgtccgtcgaactaccaaactcgttagaagagttaggggatggattggcaatgggaataatgatactcaagttattaacagattttcaatctcatcagctgtgggcaacgctattaagtttgacattcattaagactacttttagtcttcattatgcatggaaaaccatggcaatggtactatcaatcgtgagcttgtttcccttgtgcttgtcaacgactagccagaaaactacttggttacccgtattacttggttctctaggctgcaagccgctcactatgtttctaatagccgaaaataaaatatggggcagaaaatcgtggcctttgaatgaaggcattatggccgtgggaatagtatccattctattatcctcattgctcaaaaatgacgtacccctagcgggtccattaatcgctgggggtatgctaatagcctgctacgtaatcagcggttcatcagcagatttatcactggaaaaagcagcagaagttagctgggaagaagaagccgagcattcgggagccagccacaatattctcgtcgaagttcaagatgatggaacaatgaagattaaagacgaggaacgagatgacaccttgactattttacttaaagcaacactccttgctgtctctggagtctacccactatcaattcctgcaactctattcgtctggtatttctggcaaaagaaaaagcaacggtccggtgtcctctgggacacaccatctcccccagaagttgaacgtgccgtattggatgatggtatttatagaataatgcaaaggggtttactcggaaggtcccaagtaggagtcggtgtcttccaggagaatgtatttcatacaatgtggcacgtaaccaggggagccgtattaatgtatcaggggaagagactggaaccttcatgggcatctgtaaagaaagacttaatttcatatggaggcggatggagactgcaaggcagctggaatacgggggaggaagttcaagtaatcgcagtagaaccaggaaagaaccccaaaaatgtacagactgcgccagggacattcaaaaccagtgagggagaagttggcgccattgctttagattttaaaccaggcacaagtggatcgcccatagtcaatcgagaagggaaaatcgttgggctatacggtaatggagttgtcacaacaagtggcacctatgtatcagcaatcgcacaggcaaaagcatcgcaggaaggaccactcccagaaattgaagatgaagtttttagaaaaagaaatctgacaattatggacttacatccaggatcaggaaagactagaaggtatttgcctgcaatagtaagggaggcaataaaaaggaaactgagaaccttgatactagcccccacaagagtcgtggcgtcagaaatggccgaagcattaaaagggatgccaataagataccaaactacagcagtgaagggcgaacatacgggaaaggagatcgtggatttaatgtgtcatgctacctttactatgcgtctattatctcctgtacgcgtaccaaattataatatgataattatggatgaagcccactttaccgatccttcaagtatagcggcacgaggatatataagtacacgggttggaatgggagaggcggctgctatattcatgaccgctacacctccaggatcagttgaagcatttccacaaagtaatgcagttatccaagacgaagaaagagatatacctgaaagatcgtggaactcaggatatgaatggataacagactttccaggaaaaacggtgtggttcgtaccaagcattaaaagtggaaatgatattgcaaattgtcttaggaaaaatggaaagagagttatacaactctcgcgtaaaacatttgacactgagtaccagaaaactaaaaacaatgactgggattacgttgttactacagatataagtgaaatgggagccaattttagggccgatagagttatagatcctagacgatgtttaaaaccagtaatattaaaagacggacctgaacgagtcatcttagcgggacccatgcctgttacggtagcatcagccgcgcaaagacgtggcaggattggccgaaatcataataaagagggggatcaatacatctatatgggtcaacccttgaacaatgatgaagatcatgcccattggacggaggcaaaaatgttacttgataatattaacacccctgaagggataatccccgccttattcgaaccagagagggaaaaatcagctgcaatagacggcgaatacagattgagaggagaagctagaaaaacctttgtggagttaatgagacgaggggatctgccagtatggctttcctacaaagtagcctcggaaggatttcaatatagtgatcgcagatggtgtttcgatggagagcgtaataatcaagtacttgaagagaatatggacgtcgaaatatggacaaaagagggggaacggaagaaactgcgaccacgctggttggatgctagaacctactctgacccactggcgttacgagagtttaaagaatttgccgctggacgacgaagtgttagtggtgacttaatcttagaaataggtaagttgcctcaacatttgactcaaagggcacagaatgccctagataatctcgtgatgttacataactccgaacaaggagggagagcctatcgtcatgcgatggaagaactgccagatacaatagaaactcttatgctgctagctttgatcgctgttttaacaggaggcgtgacactattctttttaagcggtcggggtttaggaaaaacctctataggactattatgcgtcatggcctcgagcgctctcttatggatggcttctgtagagccacattggatagccgcgtctatcatactcgagttctttttgatggttcttttaatccccgaaccggacaggcaaagaacaccacaagataaccaattagcctatgtagtcattggtctactatttatgatacttacggtagctgctaacgaaatgggattactagaaaccaccaaaaaggatttaggaatcgggcatgtagcggttgaaaaccaccatcatgcggctatgttagatgtagatctacacccggcttccgcatggacgctgtatgcggtagccacgactataattactccgatgatgagacatacaatagaaaatactacggcaaatataagcctaactgctatcgctaatcaggctgcgatcttgatgggattagataagggatggcctattagtaagatggacataggagttccactactggcattggggtgctattcacaagtcaaccctctaaccctaactgctgcggtattgatgttagtagcccactacgcaattattggaccgggcctacaggcaaaagctaccagagaagctcagaaaaggacagcggctggaattatgaagaatccaactgtagatgggatagtagccatagacctagacccagtagtctacgatgcaaaattcgaaaaacaattggggcagatcatgttgttagttttgtgcacgtcacaaatccttttgatgaggacgacatgggcgctttgtgaatcaataacattagctacagggccactaacaacactttgggaaggaagccctggaaaattctggaatacaacgatagctgtgagcatggccaacattttccggggaagttatctagccggtgcaggtttagcattctctttaatgaaatcgcttggaggtggtcggagagggaccggtgcacaaggcgagacgttaggtgaaaaatggaaacggcaattgaatcaattatcaaagagcgaatttaatacatataaaagatccggaatcatggaagtagaccgatcagaggcaaaagaagggttaaaacgtggtgaaacaactaagcatgccgtatcacgaggtacagctaagctcagatggtttgtagaaagaaacttagtgaaaccagagggtaaagttattgatttaggatgtggcaggggaggttggtcctactattgtgctgggcttaagaaagtcacagaagtaaaagggtatactaaaggagggcccggacacgaagaaccaatcccgatggcaacgtacggatggaatttagttaaactgcattcaggcaaggatgtatttttcatacctcccgaaaaatgtgacacattattatgcgacataggcgagagttcacctaatccaaccatcgaagagggacgaaccctaagagttttaaagatggtggaaccatggctccgcggaaatcagttctgcataaaaattttaaatccttacatgccttcagtcgtggaaaccctagaacaaatgcagagaaagcatggtggtatgttagttagaaacccactttctagaaatagcacgcatgaaatgtactgggtttcctgtggcacaggtaatatagtgtcagccgtcaacatgacatcaagaatgctattaaacagatttacaatggctcatcgtaaacccacttacgaacgagatgttgacttaggagctggtacacgacatgtcgcagttgagcccgaagtcgccaacttggatattataggacaacgtattgaaaacattaaacatgaacataaatctacctggcattatgacgaggataatccttataaaacctgggcttatcacggtagttacgaagttaagccctctggtagtgcatcatcaatggtgaatggagtggtaaaattactgaccaaaccttgggacgttatacctatggtcacccaaatagcaatgacagacactacgccttttggtcaacaaagggtgtttaaagaaaaggtagacactagaacacctaaagcgaaacgtggcactgcccagataatggaggttacagcgaaatggctatgggggtttcttagtagaaacaagaaaccccgaatttgcacacgggaagaatttacaagaaaagtaaggtctaatgcagctattggagcagtgtttgtagatgagaaccagtggaatagcgctaaagaggctgtagaagatgagaggttttgggatttagttcacagagaaagagagttgcataaacaagggaaatgcgccacatgcgtttataacatgatgggcaaaagagagaagaaattaggcgaatttggtaaagccaaaggttctcgcgcaatatggtacatgtggctaggtgcacgctttctagaatttgaagctctgggatttatgaatgaagatcactggttttcacgagagaatagtttaagtggtgttgagggagaaggactacacaaactaggttacatattacgcgatatttcgaaaatacccggaggtaatatgtacgccgatgacacagcaggctgggacacaaggatcactgaagatgatctacaaaacgaggcaaaaataacagatataatggagccagagcatgcactactggcaaagtcaatattcaaacttacgtaccaaaataaagtcgttcgagtgcagagacccgccaaaaatggtaccgtcatggacgtaatttcacgccgtgatcaacgaggatcaggacaagtcggaacatatggattaaatacatttacaaatatagaagcacaactaataagacaaatggaaagtgaggaaattttcagtccgagtgaactggagacaccaaatctagcaggtagggttctggattggttggagaaacatggtgtggagaggctaaaaaggatggctatatctggagatgattgcgtagtcaaaccaatagatgatagatttgccaccgcactaacggcactgaatgacatgggaaaggtaaggaaagatataccgcagtgggaaccctctaaaggttggaatgattggcaacaggttccgttttgttcacaccacttccatcagttaataatgaaagatgggagagagatagtagtcccatgtcgaaatcaagatgagctagttggtagagcaagagtgagtcaaggagcaggctggtcacttagagaaacggcatgtttaggaaaaagctacgcgcaaatgtggcagttaatgtattttcacaggagagatcttcgactcgcagcaaacgcaatttgctccgcagtacctgtagattgggttccgacaagtagaactacttggagtattcatgcgcatcatcaatggatgacgaccgaagatatgctttcagtatggaacagggtttggattgaggagaatccatggatggaagacaagacgcatatttcaagctggggcgacgttccgtacctcggtaaacgtgaggaccaatggtgtggatctttgataggacttacagcacgagcgacgtgggcaacaaatatccaagttgcgataaatcaagtgagacgattaattggtaatgagaactatttagattatatgaccagtatgaaacggttcaaaaatgaatcagatcccgagggagctttatggtag

SEQ ID NO: 21669 - RNA, 9879 nt, synthetic construct
  misc_feature 1..9879: note = derived and/or modified CDS sequence (opt6) from DENV-1__GQ199790__SS-prME
  source 1..9879: mol_type = other RNA
tctgtaacaatgttattaatgttaatgccaacggctttagctttccacttaacgacgcggggaggagaacctcatatgatagtaacgaaacaagaaaggggtaagtcattattatttaaaacttctgctggagtgaatatgtgtactcttatcgctatggatctaggagaactctgtgaggatacgatgacatacaagtgtccgagaatcacggaggcagaacctgacgacgtagactgttggtgcaatgcaactgatacatgggtaacatatggtacctgctcacaaactggagaacatcgacgtgataaaagatctgtagcattggcgccccacgtcggactaggtctggagacaagaaccgagacatggatgagtagcgaaggtgcctggaaacaaattcagagggtagaaacttgggccttacggcatcctggatttactgtcatagcgttattcttggcacacgtaattgggactagcataacacaaaaaggaataatatttattctgctcatgttggttacacctagtatggcaatgcgatgtgtgggaattggatccagggattttgttgagggactcagcggagctacatgggttgatgtagttttggaacacgggtcttgtgtaaccacaatggccaaagacaagcctacactggacattgagttactcaaaacagaggtaacaaatcccgctgtcctacgaaaactttgtatagaagccaagattagtaatacaactacagattcacgctgcccgacccagggggaagctacattaatggaagaacaagatgctaattttgtttgtaggcgaacattcgtggatcgcggatggggtaacggatgtggactatttggcaagggaagtttaataacgtgcgccaaatttaaatgtgtaactaaactggagggtaaaatcgttcaatacgaaaacttgaaatacagtgtaatagtaaccgttcacaccggggaccaacaccaagtaggtaatgagtctacagaacatggtacaacggctacaattacaccgcaggctccgacttccgaaatacaattaacagactatggagcactcactttagattgtagcccaaggacaggtctagattttaatgaaatggtgctcttgaccatgaaagagaaaagctggctagttcacaaacagtggttcttagatttacctttgccatggacgtccggcgcctcaacttctcaagaaacttggaacagacaagatttactcgtaaccttcaaaacggctcatgcgaaaaagcaagaagtagtggttctaggttcacaagaaggtgcaatgcatacggctcttaccggagcaaccgagatacaaacatctgggactactacaatattcgcaggacacctgaaatgtcgcttgaagatggataagttgacgttaaaagggatgagctacgtcatgtgcacaggttctttcaaactagaaaaagaagtagccgaaacacagcacggcaccgtattagtacaaataaaatatgaaggtacagacgcgccatgtaaaataccattctccacgcaagacgaaaaaggtgtaactcaaaacggtagattgataactgctaacccaattgttactgacaaagaaaaacccgtcaacatagaggcggaacccccgtttggtgaaagttacatcgtaataggagcaggagaaaaagcactaaaactaagctggttcaagaagggtagtagtatcggaaaaatgttcgaagcaacggcaagaggagcacgaaggatggcaatactcggagatacagcatgggatttcggatctatcgggggtgtgttcacaagtgtaggcaagttggttcaccaaatttttggaactgcgtatggagttttgttctctggggtatcatggactatgaaaataggaattggagttctcctaacctggttaggacttaatagtaggagcacgtcactctccatgacatgtattgcagtcggattggtaacattatatctcggggtgatggtccaagcagattcaggatgcgtaattaattggaaaggaagagaacttaagtgcggaagcggaatattcgtcactaacgaggtacatacctggaccgaacaatataaattccaggcagactcaccgaaacgattatctgcggcaataggaaaggcatgggaagagggcgtctgcgggattcgctcggcgactcgtctcgagaacataatgtggaaacaaatctcaaacgaattaaaccatattctgctagaaaatgatatgaagtttactgttgtagtaggagatgttgtagggatactagcgcagggcaagaaaatgataagaccacaaccaatggaacacaaatattcttggaaatcatggggtaaagcaaaaataataggagcagatgtgcaaaatacaacattcattattgatgggcctaacacacctgagtgcccagatgatcaaagagcttggaatatatgggaggtagaagattacggttttggaatatttacaactaacatttggctaaaactgagggactcccacacgcaagtttgcgaccataggctaatgagcgccgcgatcaaagacagcaaagccgtccacgcagacatgggatactggattgaatcggagaaaaatgaaacgtggaaactagcaagggcgagctttatagaagtgaagacatgcatatggcctaaaagtcacacactttggagcaacggtgtccttgagtccgagatgatcataccgaaaatatacgggggtccaatctctcaacacaattatcgtcctggatattttacacaaacagcaggcccatggcacctaggtaagctcgaactcgacttcgacctgtgtgagggtaccactgttgtggtcgatgaacattgcggaaatagaggacctagtttaagaactacaacggtaacagggaagataattcacgaatggtgctgtagaagttgcaccttaccacccttacggtttaaaggagaagacggatgctggtatggtatggaaattagacccgttaaggagaaggaagaaaatttagttaaaagcatggtcagcgcaggaagtggggaagtagactcattttcgctaggtttactctgcatatcaataatgatagaagaagtgatgaggtcacggtggtcaaggaaaatgttaatgactggaacattggccgtgtttttattacttattatgggacagttaacttggaatgacttgatcagattgtgcataatggtaggcgcgaatgcatcagatcgtatgggcatggggacgacctatttggccctaatggccacttttaaaatgagaccaatgttcgcggtaggcctattatttcggcgattaacctcaagagaagtgttgttattgacaataggcttaagtttagtcgcgtccgttgaattgccaaatagtttggaggagttaggcgatgggctagcaatgggtataatgattttaaagttgcttactgattttcagtcgcatcaactgtgggcaacgctacttagtttaacgttcataaaaaccacactgtccctacactacgcctggaaaacgatggcgatggtattgagtatagtctccctgtttccattgtgccttagcacaacatcgcagaaaactacctggctacccgtactactgggaagcctaggctgtaaacccctcgcaatgttcttgatagccgaaaataaaatttggggccgaaaatcttggcctttgaatgaaggcattatggcggttggcgtcgtctccatattactcagctcgctgcttaaaaatgacgtccctctagcgggcccactcatagccggaggtatgctaattgcttgttatgtaattagcggttcgagtgcagacctctctctcgaaaaagccgcagaagtaagctgggaggaagaggcggagcactctggtgcgtcacacaacatccttgtggaagtccaagacgacggaaccatgaaaataaaagatgaagaacgggacgacactttaactattcttctaaaagctacattattagctgtatcaggagtatatcccttatccattccagccacattgttcgtatggtatttttggcaaaagaagaaacaaagatctggagtcctttgggacacaccgtcccctcctgaagtagaacgagctgttctagatgacggaatttatcgaattatgcaacggggactactcggtcgatctcaagtaggtgtaggtgtcttccaagaaaacgtgtttcacactatgtggcatgtgactaggggagcagtcttaatgtatcaaggaaaacgtctcgagcctagctgggcctccgtcaagaaagacttaataagttacggtggaggatggagactacaaggtagctggaataccggagaagaagttcaagtcatcgcagtagagccaggcaaaaatcccaaaaatgtacaaacggcgcctggtacgttcaaaacgccagaaggcgaagtaggcgcaatcgccctagactttaaaccagggacaagtggtagtcccatcgtgaatagagaaggtaaaatcgtcggtttgtacggaaatggggttgtgacaacgtccggcacttacgtctccgcaattgctcaagcaaaagcatcacaagaaggcccactaccagaaattgaagacgaagtattcagaaaaagaaacttgactataatggatttgcacccggggtctggaaaaacaaggaggtatttgccagcaatagtaagggaagctattaaacgaaaattaagaaccttaatcctcgcaccaactcgtgtggtcgcatctgagatggcagaagctctaaaaggaatgccaatcaggtaccaaacaacagcagtcaaatcagaacatactggaaaagaaatagtagatttgatgtgtcatgcaacatttacgatgagacttctaagcccagtaagagtaccaaattacaacatgattataatggatgaggcacacttcactgatccctccagtatcgcggctagaggatacatttctacgcgagttggtatgggtgaggcggcagcaatatttatgacggccacgccgccaggaagcgtagaagccttcccacagagtaatgctgttatacaagacgaggaacgggatataccagaaagatcatggaactcaggctatgaatggataacggactttccaggaaaaacggtatggttcgtaccaagtattaaatctggaaacgatatagcaaattgcttgaggaaaaacggaaagcgcgtcatacaactctcaagaaagacatttgacaccgagtatcagaagaccaaaaacaatgactgggactacgtagtaacaacagacatatcggaaatgggggcaaactttcgtgcggatcgcgtaatagacccacgtcgatgcctaaaaccagtaatattaaaagacggtcctgaacgagtaatattagcaggtccgatgccggttaccgtcgcctcagcagcacaaagaaggggacgtattggacgcaatcataacaaagagggagaccaatatatatacatgggccaacccttaaataatgacgaagatcacgcacattggaccgaagccaagatgttactggataacataaatactccggaaggaataattccggcactcttcgaacccgaaagagaaaaatccgctgcaatcgacggagagtaccgactcagaggggaagcccgaaaaacatttgttgaactaatgaggaggggagacttacctgtgtggttgtcatataaggtggcaagtgaaggcttccaatatagtgacagaaggtggtgtttcgatggcgagagaaataatcaggtgcttgaagaaaacatggacgttgagatctggaccaaagagggcgaacgtaagaagctccggccccgttggttagatgctaggacttatagtgaccctttagcacttcgtgaatttaaggagtttgccgcaggtcgcagatctgtttctggcgatctaatattagagataggtaaactacctcaacatctcacacagagagctcagaacgcgctagataatttagtcatgcttcacaattcagaacaaggcggtagagcttatcggcatgcaatggaagaattgcctgacacaattgaaacattgatgttgttagcattaatagctgtactaacagggggtgtaacactatttttcttaagtggcaggggactcgggaaaacatctattggccttctatgtgtcatggccagcagcgtcctattatggatggcctctgtagaacctcactggattgcagcttcaattattctagaatttttcctaatggtattgcttataccagaaccagacagacaacgaacaccacaagacaatcaactagcgtacgtcgtgatagggcttttatttatgattcttaccgtcgcagctaatgaaatgggtttactagaaacaactaagaaagatctggggataggtcatgtggcagtcgaaaatcaccatcatgcaaccatgttagacgtcgatctccacccagcgagcgcttggaccttatatgccgttgcaacaacgattataacgccaatgatgagacacacaattgaaaatacaacagccaatatttcactaacagctatagctaaccaagcagcaatattaatgggactagataaaggatggccgataagcaaaatggacataggggtgccgttgcttgcattaggatgttatagtcaagtaaatccgttgacgctgacagctgccgtactcatgttagtagcacattacgcaattatagggccagggctacaagcaaaagctacacgtgaagcgcagaagcgaaccgcagcgggtattatgaaaaatcccacagtggatggtatagtcgctatagacctagatccggtggtatatgacgctaaattcgaaaaacaattgggccagattatgttgctaatattgtgtacaagtcaaattcttctcatgagaaccacttgggcactttgcgagagtataaccttagccacaggtccgcttacaaccttatgggagggctcccccggtaaattttggaatacgactatagccgtatcaatggctaatatatttcgtggatcttacctagcaggagccggacttgctttcagtttaatgaaatcactagggggaggccggagaggaaccggtgcacaaggtgaaactctcggcgaaaaatggaaaagacaacttaatcaactgagcaagagtgaatttaatatatataaacgcagtggtattatggaggtcgataggagcgaagcaaaagaaggactaaaacgaggagaaacgacgcgacacgcggtcagccgaggaactgcaaaactacgatggtttgttgaaagaaatttagttaagcctgagggaaaagttattgacttaggatgcggacgtggtggttggtcttactactgcgcgggacttaagaaagtcactgaagtgaaagggtacacaaagggtggccctggacacgaagaacccataccgatggcaacctacggatggaacttagttaagttacactcaggcaaagacgtgttctttacgccaccagaaaaatgcgacactttactatgcgatatcggcgaatcatcaccaaatccgactatagaggagggtcgtacacttagagtgttgaaaatggtagagccttggttgcgaggcaatcaattttgtataaagattctcaacccatacatgccatccgttgtagaaacattagaacaaatgcaacgaaaacatggagggatgcttgttagaaaccccttgtcacgaaatagcacccacgagatgtactgggtgtcctgtgggacaggaaatattgttagtgcggtgaacatgacttcgcgtatgctgctgaacagatttacaatggctcacagaaaaccgacatatgaacgagatgtagacctaggcgctggaacacgtcatgtagcagtagaacctgaggtagctaacctagatataattggtcagcgcatagaaaatataaagcatgaacataaaagcacctggcattatgatgaagataatccttataaaacttgggcatatcatggttcgtatgaagttaagccaagcggaagtgcaagctcaatggtgaacggagtcgttaaactattaacaaaaccatgggatgtaatacctatggtgacacagatagcaatgacagatacaacgccatttggtcagcagcgagtatttaaggaaaaagtagacacccgaacgccgaaggctaaacgtgggacagcacaaattatggaagtgacagctaggtggttatggggatttctatcaaggaacaagaagccccgaatttgcactagagaggagttcactcggaaggtacgatcaaacgccgctataggagctgtatttgtagatgaaaatcaatggaactctgcaaaagaagctgttgaagacgagcgattttgggacttagtacagaaagaacgtgaattacataaacaaggaaaatgcgcgacatgtgtgtataatatgatgggcaaaagggagaagaaactaggtgagttcggtaaagcaaaaggcagccgagctatatggtacatgtggctgggtgcaagatttctagagtttgaagcgctaggatttatgaatgaggaccattggttcagcagggaaaattcactatcgggtgtagaaggagagggtttacataaacttggctacatcctaagagacataagtaaaatcccaggaggtaacatgtatgcagatgatacagcaggctgggatacgagaatcacagaagatgatttacaaaacgaagcacggatcacagacatcatggaacctgaacacgcactactggctacatccatttttaaactgacttaccagaacaaagtagtaagagtacagcgtccagccaaaaacgggacagtaatggatgtgatatccaggagagatcaacgtggttcaggacaagtcggcacttacggacttaatacatttaccaacatggaagcccaattaataaggcagatggaaagtgagggaatcttcttgccgagcgaactagaaacacagaatctagcggaaagagttttagactggctggagaaatatggggtagaaagacttaaacggatggctattagtggtgatgactgtgtagttaaacctatagacgacagattcgcgactgcactaacagcgttaaatgatatggggaaagtaaggaaagacataccacagtgggaacccagtaagggatggaatgactggcaacaagttccattttgttctcatcattttcaccaactgatcatgaaggatggccgtgagatcgtggtgccatgtagaaaccaggatgaattggttggtcgggcacgggtttcccagggagcagggtggagcctacgtgagacagcgtgtttaggaaaatcatatgcacaaatgtggcagctaatgtattttcatagaagagatcttagactagcagccaatgcaatctgttccgcagtgccggttgattgggtccccacatcaagaacaacttggtctattcacgcgcatcatcagtggatgacgacggaagacatgctctcggtatggaatcgcgtttggattgaggaaaatccttggatggaagataaaacccacgtttcgtcctggggcgatgtcccatatttggggaagcgagaagaccagtggtgcggcagcttaatagggcttacggcgcgagcgacttgggcaagcaatattcaggtagctataaaccaagttcgaagattaataggaaacgaaaattatttggactatatgacatctatgaagagattcaagaatgagggggaccctgaaggggcactatggtag

SEQ ID NO: 21670 - RNA, 9879 nt, synthetic construct
  misc_feature 1..9879: note = derived and/or modified CDS sequence (opt6) from DENV-1__GQ199791__SS-prME
  source 1..9879: mol_type = other RNA
agcgtaacaatgttattaatgctgatgcctaccgcattagcgttccatctcactactcgtggtggagaaccacacatgatagttacaaaacaagaacgtggtaaaagtttactattcaaaaccagtgctggagttaatatgtgtacattaatagcgatggaccttggtgaactatgtgaagatacaatgacatataaatgcccccgaataactgaagcagaacctgatgacgtagactgttggtgcaatgcaactgacacgtgggtaacctacggaacgtgtagccaaacaggagaacatcggagagacaaaagatcagttgcactcgctccgcacgttggattaggattagaaaccagaacagaaacatggatgtcgtcagaaggagcttggaaacaaattcaacgggtagaaacttgggcattgaggcatccagggttcacagttatagccttattcctagcacatgctatagggactagcataacccaaaaaggcatcatctttatattgttaatgctagtaactcctagtatggctatgagatgcgttggaattgggagcagagactttgtagaaggacttagcggagcgacctgggtcgatgtcgtgttggaacatggatcctgcgtgaccacaatggcgaaagataaacctactttagatattgaattactaaaaactgaagtaacaaatccagcagtattaagaaaactttgtatagaagcgaaaattagtaataccactacagattcaagatgtccaactcaaggcgaagcaacattaatggaagaacaagatgccaactttgtatgcaggagaacttttgtagacagaggatggggtaacggttgtgggttatttggtaaaggaagcctaattacttgtgcgaaattcaaatgcgtaactaaattagaaggaaaaattgtacaatacgaaaacttaaaatattcggttatagtaacagtacacacaggagatcaacaccaagtcgggaatgaatcaacagaacatggtacaacagccacaattacacctcaagccccaacatccgagatccaattaaccgactatggagcattgactctagactgctctccccgaacaggcttggatttcaatgagatggtactacttaccatgaaagagaaatcatggttagtacacaaacaatggtttctagacttgccgctgccgtggacgtcgggggcatcgacctcgcaggaaacatggaacagacaggacctattagtcacttttaagacagcacatgcaaagaagcaagaagttgtagtactcgggtctcaagagggggcaatgcatacagctttaacaggcgctactgaaatacagacatccggaacaactaccatatttgctgggcatctgaaatgcagattaaagatggataaactgacattaaaaggaatgtcatacgtgatgtgtactggttcctttaagttagaaaaagaagtggccgagacgcaacatggaacagtgctagttcaaataaaatatgagggaacggacgccccatgcaaaatcccattcctaacccaagacgaaaagggggtgacgcaaaatggtcggcttataacggcgaatccaattgtgacagacaaggaaaagcccgtcaatattgaagctgagccaccgtttggggaatcttacatcgtaataggggcgggtgagaaggctttaaaactctcctggttcaagaaaggtagctcaataggcaaaatgttcgaagccacagccaggggcgctaggcgaatggcaatattaggcgacacagcgtgggactttgggagtataggtggggtatttacaagtgtaggtaaattagtacatcaaatatttggtacagcatacggtgttttattctcaggagtaagttggacaatgaaaataggaataggagtgttgctgacctggctcggactcaactccagatcaacatcgttatcaatgacatgtatcgcagtaggcttagtcactctatatctcggagtgatggtgcaggcagactctggctgcgttattaattggaaaggacgtgaactaaaatgtggctcaggtatttttgtgacaaatgaagtgcacacttggacggaacaatataagttccaggccgattcgccaaaaagactaagtgccgcaataggaaaagcctgggaagagggggtatgtggcatacggtcggcgactagattagagaacataatgtggaagcaaataagcaatgagctaaaccatatactcttggaaaacgatatgaaatttacagtagtagttggtgacgttgttgggatattagctcaaggaaagaagatgattagaccccaacctatggaacacaagtactcatggaaaagctggggcaaagctaagataataggcgcagatgttcaaaacacaactttcataattgacggccctaatacgccagaatgtcctgatgatcaaagagcttggaatatatgggaagtagaagattatggcttcggtatcttcactactaatatctggcttaaactaagagatagttatacacaagtctgtgaccatagactaatgagtgcagctataaaagactcaaaggcagtccacgccgacatgggatattggattgaatcagagaaaaatgaaacttggaagttggctagagcatcattcatagaagttaaaacctgtatatggccaaagtcacacacattatggtcaaatggtgtactagaatcagagatgattatccctaaaatatacggtggaccgatctcccaacataattatcgtcccggttattttactcaaactgccggaccatggcacttaggtaagttagaattagatttcgatctttgtgaaggcacgacggttgtagtagatgaacactgtggtaatcggggacccagcttacgtacaacaactgttactggaaaaataattcatgaatggtgctgcagaagttgcacattgcctccactaagatttaaaggtgaagatggatgttggtatggtatggaaatccgaccggtaaaagaaaaggaagagaatcttgttaagagcatggtttccgcggggtcaggagaagtagactcctttagcctaggattattatgtatttcgataatgattgaggaggtaatgaggagtagatggagccgaaaaatgttgatgacaggcactttagctgtgtttttactccttataatgggtcagttgacttggaacgatctaattaggttgtgcatcatggttggagctaacgcgtccgatagaatgggaatgggtacaacatatttagccctaatggcaacgtttaaaatgaggcccatgttcgcggttggacttttattcaggaggctcaccagtcgagaagttctgttactgactatcgggttaagcctagtagcatcagttgaactgccaaatagtttggaagaattaggcgatggactcgcgatgggtataatgatattaaagctacttacagattttcagtcacatcaactatgggcgacattacttagcttaacttttataaaaacaacgttgtctctccattatgcatggaaaactatggcaatggttttaagcatagtatcactatttccactgtgtctttcaacaacctctcagaaaacaacatggcttccagttctcctgggatcattgggatgtaagcctctaaccatgtttctcatcgcagaaaataaaatatggggtcggaaatcctggccgttgaacgagggtataatggccgtcggcgtagtttctatattactaagttcactattgaagaacgacgtaccattggccggaccactcatcgccggtggaatgcttatagcttgttatgtcattagtggaagctctgctgatctaagcctagagaaagcagccgaagtgtcctgggaagaggaagctgagcactcgggagcgtcacacaacatcctagtagaggttcaagacgacgggacaatgaaaataaaagacgaagaacgggatgatacgctaacaattctacttaaagcgacactactcgcagtaagcggagtatacccactaagtatccctgctacattatttgtatggtatttttggcagaagaagaaacagaggagtggagtactgtgggacactccaagcccaccagaagtagaacgtgcagttctggatgacggcatttataggataatgcaaagagggctattagggaggagtcaagtgggggtcggggtcttccaagagaatgtgttccatactatgtggcatgtcactagaggagcagtattaatgtatcaaggtaagagattggagccctcatgggcgagtgtcaagaaagacctaatatcctacggcggtggctggcgactacagggtagttggaataccggagaagaagtacaggtaatcgcagtagaacctggcaaaaatccgaaaaacgtgcaaacagccccgggaacttttaaaacaccggagggtgaggttggcgccatcgcactagactttaaacctggtacgtcgggatcccccatagtaaacagggaaggaaaaattgtaggactatatggcaacggagtagtcacaacatcgggaacctatgtatcagcgatcgctcaagctaaggcgtcacaagagggcccattaccagaaatagaagacgaagtattccgcaaacgaaaccttactataatggatttacatccaggcagcggtaagacccgaagataccttcccgcaatagtccgcgaagccattaaacgcaagttacgcacgttaatattagccccaacacgagtagtggcatctgaaatggccgaggctttgaagggtatgccgatacgctaccaaactactgcagtaaaatcagaacatacaggaaaagaaatcgttgatttaatgtgtcacgccacctttactatgcggcttttgtccccagtaagagtaccaaattataacatgataattatggatgaggctcactttacagatccgtcatcgattgcagctaggggttatatatcaacacgagtgggaatgggcgaagcagcagccatcttcatgacggcaactccccctgggtcggtagaggcttttcctcaatcaaatgcagttatccaagatgaagaaagagacataccagaacgtagttggaatagcggttatgaatggataaccgactttccaggtaagactgtatggtttgtccctagtattaaatcaggaaacgacatagcaaattgtcttaggaagaatgggaaacgggttatccaattgtctcgaaaaacctttgatacagagtatcagaaaacgaaaaataatgattgggactacgtggtcacgactgatataagcgaaatgggtgccaatttcagagcggaccgagtgattgatccacgaaggtgtctaaaacctgttattctaaaagatgggcccgaacgggtcatactagcaggacccatgccagttaccgtagctagtgcggctcaaaggaggggtcgcattggaagaaaccacaataaagaaggcgaccaatatatatatatggggcaaccgttgaataatgacgaggatcatgctcattggacagaggccaagatgctattagataatattaacaccccagaaggtataatcccggccctctttgaacccgaacgggaaaaatcagctgcaatagatggggaataccgtctccgaggagaagctagaaaaacattcgttgaactaatgagacgaggggatctgcctgtctggcttagctacaaagtggcaagcgaaggttttcaatactcagacagacgatggtgcttcgacggtgaacgaaataatcaggtcttagaagaaaacatggatgtcgaaatttggacgaaagagggagaaagaaagaaattgaggcctcgctggttggacgcaaggacgtattcggatcctttagctcttagagagttcaaagaatttgccgcgggccgccgaagcgtatccggagacttaatacttgaaattggaaaactaccccaacatttgacacaaagagcgcaaaacgcccttgataacttagtcatgctccataatagcgaacaaggtggacgtgcatatagacacgcaatggaagaattgcccgatacaatagaaacactcatgctcttggctctcatagcggtgttgacaggcggagttactctattcttcttatccgggagaggactaggcaaaacttccatcggcgtgctttgcgtgatggcttcatcagtacttctttggatggcgagtgttgaaccgcactggattgcagcatcaattatcttagagttctttctaatggttcttttaattccagaacctgatcgacaaagaacccctcaagacaatcaattagcttacgtagtgatcgggctactttttatgatactcacagtagccgccaatgaaatgggcctcttggagaccacaaagaaagatttaggcataggacatgtagcagttgagaaccaccaccatgcaactatgttagacgtggatttacaccccgcaagcgcctggacactttatgccgttgctaccacaattattacgcctatgatgagacatacgattgaaaacacaacagctaatattagtttaacagctattgcaaatcaagcagcaatattaatgggactcgataaaggatggccgattagtaaaatggatataggagtacctctgttagcgctaggatgttacagccaagtcaatccactaacactgacagcggcggtattaatgttagtcgcgcactacgctataataggaccaggtctccaggcaaaggcaacgcgagaggcacagaaaagaactgctgctggcattatgaaaaatccaacggtagatggcatcgtcgcgattgatctagatccagtagtatacgacgcaaaattcgaaaaacaacttgggcaaatcatgttgttaattttatgtacttcgcaaattttattaatgaggactacatgggctctatgtgaatctatcacgctagctacagggcctcttacaaccctatgggaaggcagtccaggtaaattctggaatactaccattgccgtatcaatggcaaacatctttcgtggttcgtatttagcgggagccggtttggcattttctcttatgaagtcattgggtggaggtaggagaggaaccggggcgcaaggagagacgttgggagagaaatggaaacgtcaacttaaccagttgagtaaatccgagttcaatatttacaagagatccggaattatggaagtggataggtcagaagcaaaggaaggtctaaaaagaggggaaactactcgccatgcagtctcaagaggaacggctaaattaagatggtttgtagagagaaatcttgtaaaaccagaagggaaggtcatagaccttggctgtgggcgtggcggatggtcctactattgcgcaggtctaaagaaagttacagaggtaaaaggttatacaaagggaggtccaggacatgaagaaccgattcctatggcaacgtacgggtggaacctcgtgaaactacacagtggtaaagacgtattctttacaccaccggaaaaatgtgacactttattatgtgatataggagagagcagtcccaatcctacgatagaagaaggaagaacactccgtgtactcaaaatggtggaaccatggcttagggggaatcaattctgtattaaaatattaaatccttacatgccttccgtcgtggagaccttggaacaaatgcagcggaagcacggagggatgctagttagaaatcctctaagtagaaattccactcatgagatgtactgggtcagttgcggaactggaaacatagtaagcgcggttaatatgacttcccgaatgttgttaaatagatttacaatggcacatagaaaaccaacatacgaaagagacgtggacctaggtgcaggaactagacacgtggctgtagaaccagaagtagcgaacttggacatcatcggacaacgaattgagaatataaaacacgagcataaatcaacatggcattatgacgaagataatccgtataagacatgggcctatcacggatcctacgaagttaaaccttcaggttcagctagcagcatggtaaacggagtagtcaaactacttactaaaccttgggatgttatacctatggtaacacaaatagccatgacagacacgacaccctttggccaacaacgggtattcaaagaaaaagtagatactcgtacaccaaaagctaaacgcggtacagcccaaataatggaagttaccgccaggtggctttggggattcctgagccgaaataagaaacctcgtatttgtacacgtgaagagttcacaagaaaagttaggagcaatgccgcgatcggtgcggttttcgtagatgaaaaccagtggaactcagccaaagaggctgtcgaggacgaaagattttgggacctggttcaaaaggaacgagaactgcataaacaagggaaatgtgccacatgtgtgtataatatgatgggaaagagggagaagaaattgggcgaatttggtaaagcaaaaggatccagagcgatatggtatatgtggttaggggcaagattccttgagtttgaagctctcgggttcatgaatgaagatcactggttctcgagagaaaacagtctatctggagttgagggagaggggttacataaacttgggtatatcttgagagacatatctaaaattcccggaggtaatatgtatgccgacgatacagctggttgggacaccagaattaccgaggatgatctccaaaacgaagcaaaaataacagatataatggaacctgaacatgcccttttagcaacatcaatattcaagctaacgtatcaaaacaaagtggtgcgggtccagaggccagccaaaaacgggaccgttatggatgtaatctcgaggagggatcaacgaggttcaggacaagttggtacatatggtttaaacacatttacgaatatggaagctcaattgataagacagatggaatcagaaggaatctttctcccgtcagaattagaaacacccaacttggccgaaagggttttagattggttagagaaatatggtgttgagagactgaaaagaatggcaatatccggtgatgactgtgtagttaaaccgatagatgatcgctttgcaacagcactaacagcattaaatgatatgggtaaagtgcgtaaagatataccacaatgggaaccatcaaagggttggaatgattggcaacaagtgcctttctgctcgcaccatttccatcaattaatcatgaaagatggtagagaaatagttgtaccgtgcagaaatcaagatgaattggttgggagagcccgagtttcacaaggagcaggatggtcactaagggaaacagcatgcctaggaaaatcatatgcgcaaatgtggcaactaatgtattttcacaggcgggatctcagattagcagccaatgcgatttgttcagcagtgcctgtagattgggtaccaacgtctagaacaacttggagtatccatgctcatcaccagtggatgaccacagaagatatgctaagcgtttggaatagggtatggatagaggaaaatccttggatggaggataaaacccatgtaagttcttggggagatgtaccgtacctgggaaaaagagaagatcaatggtgtggttctctcatcggccttacggcgcgtgccacatgggcatcaaatatccaggttgcaattaatcaagtaagacgcctaataggcaatgaaaactacctcgactatatgaccagcatgaaacgttttaagaatgagggtgatcctgaaggagctttctggtag

SEQ ID NO: 21671 - RNA, 9879 nt, synthetic construct
  misc_feature 1..9879: note = derived and/or modified CDS sequence (opt6) from DENV-1__GQ199792__SS-prME
  source 1..9879: mol_type = other RNA
tcagtaaccatgttgttaatgttaatgccgacagctctcgcatttcacttaacaacaagagggggcgaaccccatatgattgtttcaaaacaagaacgtggaaaatccctattatttaaaacaagcgccggagtcaatatgtgtacgctcatagccatggaccttggtgaactatgtgaagacactatgacatataaatgtccacgaattacagaagctgagcctgacgacgttgattgttggtgtaatgctactgacgcctgggttacgtatggtacttgtagccaaactggggaacacagacgagataaacgatcagtagcactagcaccgcatgtggggctgggtctagaaactcgtacagagacatggatgtcgagcgaaggagcttggaaacagatacaaagagtagaaacatgggcactaagacacccaggattcacagttatagctctatttctagcccatgctataggtaccagtataactcagaaaggaataatttttattcttctaatgttggtgactcctagtatggcgatgcgatgtgttggaattgggtcacgagattttgttgaaggtctgagcggagccacgtgggtggatgtcgtcttagaacatgggtcatgtgtaactacaatggcaaaagacaaacccaccttagatatagagttacttaaaaccgaagtgacaaaccctgcagttttaaggaaactatgcatagaagcgaaaatatcgaacaccaccacagattcccgttgtcccacgcaaggagaagcaactctcgtcgaagaacaggacgcgaattttgtatgtagacgcacctttgtagatcgaggatggggaaatggatgcggtctatttggtaaaggctcattaataacctgcgctaaattcaaatgtgtcacaaaattagaaggtaaaatagtacaatacgaaaacctgaaatactccgtcatcgtgacagttcatacaggtgaccaacatcaagtagggaacgaaagtacggagcacggaactacagcaacaatcactcctcaagctccaacaacagaaatacaactaaccgattatggagcactaacactggactgtagtccccgaacaggtttagactttaatgaaatggtactattaacaatgaaagagaaaagttggctcgttcataaacaatggtttttggatctcccattaccctggactagcggtgcgagtacgtcgcaagagacttggaaccgacaagacttactggttacatttaagacagctcatgccaagaaacaagaggtggtggtcctcggtagccaagagggtgcaatgcatactgcgttgacaggagcaactgaaattcaaacttcgggaacaacaacaattttcgcagggcacttaaaatgccgacttaaaatggacaaactgactttaaaaggcatgagctatgtaatgtgtacaggatcttttaaactcgaaaaggaagtagcggagacacaacacggtacagtgctggtacaaattaaatatgaaggtacggatgcaccatgtaagattccgttttcgactcaggatgaaaaaggtgtaacacagaacggaagacttataacagcaaatccgattgtaaccgacaaagaaaaaccagtcaatatagaggccgaacctcctttcggtgaatcatatatcgttataggagcgggagaaaaagccctgaaactttcatggtttaagaaaggcagctcgattggaaaaatgttcgaagcaactgcaagaggagccaggaggatggcaatactaggagacaccgcatgggactttggttcaattggaggcgtctttacgtcagtcgggaagctggttcatcaaatatttgggactgcctacggggttctattctcaggtgtatcttggaccatgaagatcggtattggggttttactcacatggctgggactaaattctaggtcaacatccttatcaatgacttgtatagctgttggactcgtcaccttatatcttggagttatggttcaagcagattcgggatgtgtaataaattggaaaggtagggagttaaaatgcggttccggaatcttcgtgacaaacgaggtccacacatggacagaacaatataaattccaagccgactcaccaaaacgtttgtcagcagccattgggaaggcctgggaggagggagtttgtggaattaggtcagcaacgagattagaaaatattatgtggaaacaaatatctaacgaactaaaccacattctgttagaaaatgatatgaaacttacggtagttgtaggagacgttgcaggtatattaggtcaaggcaaaaagatgattaggcctcaaccgatggaatacaagtactcctggaaatcatggggaaaagcgaagattataggcgccgatgctcaaaatactacattcattatcgacggaccaaacacaccggaatgtccagatgatcaacgagcgtggaacatttgggaagtagaagactatggctttggaatattcacaacaaatatatggttaaaactcagagatagttatacacaagtatgtgatcatagacttatgtcggccgcaataaaggatagtaaagccgtgcatgccgatatgggatattggatagaatcagagaaaaacgaaacatggaagctcgcaagagctagcttcatagaagtaaaaacatgtatctggccaaaatcgcataccttgtggagcaatggggtactggagagcgagatgattataccgaaaatatatggtgggccaataagtcaacacaactatcggccgggatattttactcaaactgcaggcccatggcatttaggaaaactagaactagattttgatttgtgtgaaggtacaactgtagttgttgacgaacactgtggcaatcgaggaccaagtttgcggacgacaacagtcacaggaaagattatccacgaatggtgctgccgctcgtgtacattaccacctttgagatttcgtggagaagatggctgctggtacggaatggaaattagaccagtaaaagaaaaagaagagaatcttgtaaagagtatggtatcagctggttcaggggaagtcgatagtttctcgttgggtctcttatgcatcagtatcatgatagaggaagtcatgaggtcacgctggtcgagaaagatgctcatgacgggtaccttggctgtattctttttactgatcatgggccaattaacatggaacgatctaatacgtctatgtattatggtaggtgcgaacgcctccgacaggatgggaatgggcacaacttatttggcattgatggcaacatttaagatgcggcctatgtttgcagttggattactgtttagaagactaactagcagggaagtactactcttaacaataggattatcattagtcgcgagtgtcgaattgccaaacagtttagaagagttaggtgatggactggccatgggtattatgattcttaaactcctaacagatttccaatcgcaccaattatgggccactttgctgagtttaacatttataaaaactactttctcattacattacgcatggaaaacgatggccatggtactatcaattgtatcactattccccctatgtctaagcactacatcacagaaaactacctggcttcctgtacttttaggtagcttaggatgtaagcctcttacaatgttcctgatagcagagaataaaatatggggaagaaagagctggccattaaatgagggaataatggcagttggaatagttagtatcttattaagtagccttctcaaaaatgacgtaccactagccggaccgctaattgctggaggtatgttaatagcctgctatgttatttcaggatctagtgcagatttatcgctggaaaaggcggccgaagtcagctgggaagaggaagccgaacattctggggcgagtcataatatattagtggaagtacaagacgacgggacgatgaaaatcaaggacgaggaaagagatgatacattaacaatcctactaaaagccactcttctagctgtaagcggtgtataccctttatcaattcccgcgactctgtttgtttggtatttctggcagaaaaagaaacaaagaagcggagtgctttgggatactccatcaccaccggaagtcgaaagagcagttttagacgatggcatttatcgaattatgcaacgtgggcttttgggtcgatcacaggtgggagttggggtctttcaagagaatgtttttcatactatgtggcacgtaacaagaggggctgtattaatgtatcaagggaaaaggctcgagccaagttgggctagtgtgaagaaagatttgatatcatatggtggcggctggagattgagaggaagttggaatatgggagaagaggtccaagtgatagctgtagaacccggtaaaaatcccaaaaacgtccaaaccgctccaggaacttttaaaacaccggaaggggaagttggagcaatagccttagattttaaacctggaacttctgggagtcccattgtaaacagagaagggaagatcgtaggactgtatggaaatggggtggtcactacaagtggaacttatgtctcagccattgcgcaagctaaagcatctcaagaaggcccccttccggagatagaagacgaagtatttagaaaacgtaatctgactatcatggatttacacccaggtagtggtaaaacacggcgttaccttccggccattgtccgagaagctatcaaacgtaaattacgtactcttatattagctcccacaagagtagtggcatcagaaatggcagaagcactcaaaggaatgccgatacgttatcagacgacagctgtaaaatccgaacatacagggaaagaaatagtggacttaatgtgtcatgccacctttaccatgagattactaagtcctgtgagagtgcccaattacaacatgatcatcatggatgaagctcatttcacagatccatcctccatcgcggcaaggggatatattagtacacgagtaggtatgggagaggcagcagcaatattcatgacagcaaccccaccaggaagcgtagaagcatttccgcagtcaaatgccgtcatccaagatgaggaacgggacatcccagaaagatcctggaactccggctatgaatggatcactgactttcctggtaaaacagtgtggttcgtaccgagtataaaatcaggaaacgatatagcaaattgcctaaggaagaatggtaaacgtgtaattcaattgtcgagaaagacttttgacacggagtaccagaaaaccaaaaataacgattgggattatgtagtaactacggacatatctgaaatgggtgcaaattttagggccgacagggtcatagaccctcgaagatgtctcaagccagtaatcttaaaagatggtccagaacgagtaatattagcaggacctatgccagtgacggtggcttcagcggctcaacgtagagggagaataggtagaaatcataacaaagaaggagatcagtacatatatatgggccagccgttaaataacgacgaggatcatgcccactggaccgaagcaaaaatgctactagacaatatcaatacaccggaggggatcattccggcacttttcgaacctgaacgtgagaaaagtgcggcggttgacggagaatatcgactaagaggtgaggcccgaaaaacctttgtagaattaatgagacgtggcgatctacccgtatggttatcttacaaagtcgcgtcagaaggatttcaatatagcgacagacgttggtgctttgatggggagcggaacaaccaagtattagaggaaaacatggatgtcgaaatctggacgaaagagggtgaacgtaagaaactcaggccccgttggttagatgcacgtacatatagcgatccacttgctctaagagaatttaaggaatttgcagcaggtcgtagatcagtctcaggagatttaatcctagaaataggaaaactaccacaacatcttacacagagggcacagaacgcattagataatttagttatgttacataattctgaacaaggaggtagagcgtacagacacgcaatggaggaactacccgacaccatcgaaacattgatgctactagctcttattgcggtattaacaggcggcgtcaccctatttttcttgtcaggacggggattaggcaaaacgagtataggcttactatgtgtaatggcttcaagcgtcctactttggatggcgagcgtggaaccgcattggatagcagcatcaattatccttgagttcttcttaatggttctgcttataccagaaccagaccgacaaaggacaccccaagataatcagttagcctacgtagtcatcggtcttttgtttatgatactgactgtcgctgcaaacgaaatgggactcctagagacaactaagaaagatctcggaatcggacacgttgctgtagaaaatcatcatcatgctgctatgcttgacgtggatttacaccctgccagcgcttggacactatacgcagtggcaaccaccataataacgcctatgatgcggcatacaatagaaaatactacagcaaacatttcgttgaccgccatagcaaatcaagccgcaatattgatgggtttggataaaggatggccaattagtaaaatggatataggggtaccccttctagcgttaggatgttacagtcaggtaaatccgttaacactaaccgctgcagttttaatgcttgtagcccattacgcaattatcggtcctgggttacaagccaaagccacccgagaagctcaaaaacggacagctgccgggataatgaaaaatcctactgttgatggtatagtagccatagatttagacccagtagtatatgatgccaagtttgaaaaacaattaggtcaaataatgctattaatactttgtacttcgcaaatcctgttaatgagaacaacttgggcgctttgcgaatccatcactttagccacagggcctcttaccacattgtgggaaggcagtccaggtaaattttggaacactaccatagcggtcagtatggctaatatctttcgcgggtcgtacttagctggagcaggtctagcgttttctcttatgaaatcactaggaggtgggcggagaggcacaggcgcacaaggcgaaactctcggtgagaaatggaaaagacaactgaaccagttgtctaagagtgagtttaacacttacaagagatcaggcataatggaagtggatcgctcagaagcgaaagaaggattaaaacgaggtgaaacaactaaacacgctgtatccagaggtactgcaaagttgagatggttcgtggaaaggaacctagtaaagccagaaggcaaggtaatagacctgggatgtggcagaggcggctggtcctattattgtgcgggcctaaagaaagtaacagaagttaaaggatatacaaaaggtggaccaggccatgaagaaccaataccgatggctacgtatggatggaacctcgtcaaactgcatagcgggaaagacgtatttttcatccctcccgaaaaatgcgataccttattatgtgacatcggcgaatcatcacctaatccaacaatagaagaaggtaggacactacgagtactcaaaatggtagagccatggctaagggggaatcaattctgcataaaaatactaaacccttatatgccttcagtagttgaaactcttgaacaaatgcaaagaaaacacggtggaatgttggtgcgaaatcccttatctaggaacagtactcatgaaatgtactgggtctcctgtggtacaggcaatatagtatcagcagtaaatatgacaagtcggatgttattaaatagatttactatggcgcacagaaagccgacatatgaaagagatgtagatctaggcacagggactcggcacgtagctgtcgaacctgaggtggccaatctggacatcataggacagagaatagaaaacataaaacatgaacataaatcaacgtggcattatgacgaagataacccgtataaaacatgggcatatcacggtagttatgaagtaaaaccctccggaagcgctagtagcatggtaaacggcgtagttaaactactgaccaagccatgggatgtaataccaatggttacacaaatagcgatgacggatactacgccattcggacagcaaagagtctttaaagaaaaagtggatacacgaactccaaaagccaaaagaggaacagcgcaaataatggaagtgaccgcacggtggctttggggatttctttcgcgaaataagaaaccacgtatttgcacaagggaagagtttaccaggaaggtaaggagtaacgctgctattggtgctgtatttgtagacgaaaaccaatggaacagtgcaaaagaagcagtcgaagacgaaagattttgggatctagtccatagggaaagagaactgcataaacaaggaaaatgcgcaacatgtgtatataacatgatgggaaagagagaaaagaaacttggtgagttcggcaaagctaaagggtcgagagctatttggtacatgtggctgggtgcaagatttctagaatttgaagcactgggttttatgaatgaagatcactggttcagtcgagaaaacagtttaagcggagtcgaaggagaaggtttacataaactaggttacatcttacgagacatatcaaaaatacccggtggaaatatgtatgcagatgatactgccggctgggatactcgaataacggaggatgacttgcagaatgaggccaaaataacagatataatggaaccagaacatgcacttctcgcgaaagcaatttttaaactaacatatcaaaataaagtagtgagggtacagagacctgccaaaaatggtactgttatggatgtcataagtagacgagatcaacgtgggagtggacaagttggtacatatggtttaaacacgttcacgaacatggaagcccagttaattcgccaaatggaaagtgaagggattttcagtccgtcggaattggagactccaaacctcgcggagcgcgctctcgattggttggagaaatacggggtggaaagattaaagagaatggctataagcggcgatgattgcgtcgtaaagccgatcgatgaccgtttcgctacagcattaacagcgttgaacgatatgggaaaggtaaggaaagacataccccagtgggaaccatcaaaaggttggaatgactggcaacaagtcccgttttgttcacatcactttcatcaactcataatgaaggacggcagagaaatagtggtaccatgtcgtaaccaagacgaattggtcgggagagctcgagtaagccaaggagcaggatggagcctacgggaaacagcgtgtcttggtaaaagttacgcacaaatgtggcaattaatgtatttccatagaagggacttacgattagcagcgaacgcaatatgtagtgcggtacccggagattgggtacccaccagtcggacaacatggtcaattcacgctcaccaccaatggatgacaacggaagatatgctaagcgtttggaatcgtgtctggatagaagaaaacccctggatggaagacaagacacatataagcagctgggaagatgtcccgtacctcggaaaacgcgaagaccagtggtgtggcagtctcattggcctaaccgcacgagcaacttgggctacaaatatacaagtagcaataaatcaagtgcgaagactaatcggtaatgaaaattatttagactatatgaccagcatgaaacgttttaaaaacgaaagtgatccggaaggagcattatggtga

SEQ ID NO: 21672 - RNA, 9879 nt, synthetic construct
  misc_feature 1..9879: note = derived and/or modified CDS sequence (opt6) from DENV-1__GQ199793__SS-prME
  source 1..9879: mol_type = other RNA
tctgtaactatgttattaatgttgatgcctacagccttagcgttccatctgacaacccgaggaggtgaacctcacatgatcgtaactaaacaagaaagagggaaatcactcttatttaaaacatctgcaggagtaaatatgtgcaccttaattgctatggacttgggagaactatgtgaagacacgatgacatataaatgcccacggataactgaagctgaaccagatgatgttgattgttggtgtaatgcaactgatacgtgggttacttacggcacgtgttctcaaacaggcgaacataggagagataaacgttccgtagccctcgcaccgcacgtgggcctaggtctggaaacaagaacagagacgtggatgtcttcagaaggagcgtggaaacaaatccaaagggtggaaacatgggcattgagacatccgggctttacagttatagcgctattcctcgcacatgcaataggcacaagcataacacagaaagggattatattcatcttacttatgctagtgacaccgtcgatggccatgcgatgcgtaggaattggtagtcgggattttgtagagggcttaagcggcgccacctgggtagacgttgtattagaacatggctcatgcgtcacaactatggctaaagataaaccaaccttagatatagaactgctaaaaacggaagtcacaaatcctgcggtcttgcgaaaactgtgcattgaggcgaaaataagtaatacgacaaccgatagcagatgcccaacacaaggagaagccactctcatggaagaacaagatgcaaattttgtatgcagacgtacgttcgtagaccggggttggggtaatgggtgtggattatttggtaaagggtcattaattacttgcgctaaatttaaatgtgtaaccaaattagaaggcaaaatagtgcagtatgagaaccttaaatatagcgtaatcgtcaccgtccatacaggggatcaacaccaggttggaaatgaaagcacagaacatggtacaactgcgactataacgccccaagcaccgacgtcagagattcaattaactgattatggagcactcaccctggattgttcaccacgaactggactggatttcaatgaaatggtattgctcacaatgaaagagaaatcatggctagtacataaacagtggtttctcgaccttcccttaccatggacaagtggggcaaccacctcgcaagaaacctggaacaggcaagacttactcgtaacgttcaaaacggcccatgctaagaaacaagaggtagtggtcttaggttcccaagaaggtgctatgcatactgccctaacgggcgctacagaaattcaaacttcaggaacaacaacaatatttgctggacacctgaaatgtcgattaaaaatggataaactcacacttaaaggtatgtcatacgttatgtgtactgggtcgtttaaattagagaaagaagtagctgaaactcaacacggaactgttttagtccaaatcaaatatgaaggaacagatgcaccttgcaaaattcctttttctacgcaggatgaaaagggcgtgactcagaacggcagattgataacagccaacccaatagtcacagataaagaaaaacctgtaaacatagaagcagaaccgccatttggagaaagttacattgtaatcggcgcgggggaaaaggctttaaagctctcctggtttaagaaaggcagctcgataggaaaaatgttcgaagccactgcgcgtggtgcacgaagaatggctatactaggagatactgcgtgggatttcggaagcattggaggagtattcacgtccgtaggaaaactggtacatcaaatttttggtactgcatacggcgtcctattcagtggcgtatcttggacgatgaaaatcggaattggggtgcttctgacatggctgggactaaactcgcgttccacttcgctatcaatgacatgcatagcagtcggacttgtaacgctgtaccttggggttatggttcaagctgacagcggatgcgtgatcaattggaaagggagagaattaaagtgtggatccggtatattcgtaacgaatgaggttcatacgtggacagaacaatataagttccaagcagattctccgaaaagattaagtgctgcaattggcaaggcttgggaagagggtgtgtgtggaatacggtcagcaaccaggctcgagaatataatgtggaaacaaataagcaacgaactgaaccacattcttttagaaaatgacatgaaatttactgtggtagtaggagatgtagtaggtatcttagctcaaggaaagaaaatgataagaccacagcctatggagcataaatatagttggaaatcatggggcaaagcgaaaattataggtgcagatgtacagaatactacattcataatagatggaccaaacacccctgaatgtcccgacgatcagagagcttggaacatttgggaggtagaagactatggattcggcatatttacaacaaatatatggttgaaattaagggatagctatactcaaatgtgtgaccacaggctgatgtcagcggcaataaaggatagcaaggctgtccacgcagatatgggctactggatcgaatcagagaaaaatgagacatggaaattggccagagcttcttttatagaggtaaaaacttgcatatggccgaaatcccatacactatggagtaacggagtactcgaatcagaaatgataataccgaaaatttacggaggacctatttcgcaacataattatagaccaggttactttacacaaacagcaggcccctggcatctgggtaaactcgaacttgattttgacctatgtgaaggtactacagtagtagttgacgaacattgtggaaatcgcggtccatcgttacgaaccactacggtaacaggaaaaattatccatgagtggtgttgcaggtcgtgtaccctcccaccgctaagatttaaaggtgaagacggatgctggtatggaatggaaattcgaccggttaaagagaaagaagagaatttggtcaaatcaatggtctctgccggatcaggtgaagtagactctttttcattaggactgctatgcataagtataatgatagaggaagttatgagatcaagatggagccgtaaaatgctcatgacgggcactttagctgtattcctgttattaataatggggcaactcacctggaacgacttaataagactatgtataatggttggtgctaatgcaagcgaccgtatggggatgggaacgacgtaccttgcgcttatggccacttttaaaatgagaccgatgtttgcagtcggcctattattccgtagattaacatcaagagaagttctactcctaactatagggcttagtttagtagcaagtgtggaacttccaaattcattagaagaactaggagacggactcgcaatgggaattatgatcttaaaactgctgacagattttcaatcccatcagttgtgggcaacattattgagtctcacgtttatcaaaactacattgagcttgcattacgcatggaaaacaatggctatggtgctaagcatagtatcgctgtttccattgtgtctttcaacaacatcccagaaaacaacatggctaccagtactactaggctcgcttgggtgtaaaccattgactatgtttctaataactgaaaacaagatatggggtcgtaagtcatggcctcttaatgaaggaattatggcagtaggagtcgtatcgatcctactgtcatctttactaaagaatgacgtccccctagcaggtcccttaattgcaggaggaatgttgatagcttgttacgtcatatcgggaagcagtgcagatctatccctagaaaaagcagcagaggtatcctgggaagaagaggcagagcatagcggcgcaagtcacaatatactcgtagaggtacaagatgacggtactatgaaaataaaagatgaagagagggacgatacattaaccatattgctaaaagcaacattgctcgctgtaagcggtgtatatccactatcgatcccagcgaccctgtttgtatggtacttttggcagaagaagaaacaaaggtcaggggtcctatgggatacaccatcaccccctgaagttgaaagagcggtactagatgacggaatttatcgaattatgcaaaggggactactggggcgctctcaagtgggcgttggcgtttttcaagaaaatgtgttccacactatgtggcacgttacaagaggtgcggtcctaatgtatcaaggaaaaagactggaaccatcatgggcatctgtcaagaaagacctcatctcatatggaggaggatggagactgcaaggaagctggaatgcaggggaagaagtccaagtaattgcagtggaaccaggcaaaaaccctaaaaatgttcaaactgcacctggtacctttaaaactccggagggagaagtcggtgccatagcactggactttaaacccggtacgtccgggtcacccatagttaaccgagaaggaaaaatagtaggcctctatgggaacggagtcgtaacaacaagtggtacttacgtatcagctatagcgcaggctaaagccagtcaagagggtccactcccggagatagaagatgaagtttttagaaagcggaacttaacgataatggatctacacccaggatccgggaagactagacgatacctccctgcaatagtgagagaagcgatcaaaagaaaattgcgtaccttaattctggcaccgacaagggtagtagcttcggagatggcagaggcacttaaaggcatgccaatcaggtaccaaacgactgcggtcaaaagcgaacatacaggtaaagagattgtagatctaatgtgccatgcaacctttacaatgagattattgtctcccgtaagggttccaaactacaacatgatcataatggatgaggctcatttcacggaccctagttctatcgcagcgagaggctatatttctactagagtaggaatgggcgaagcagcagctatcttcatgacggcaacgcctccaggtagcgtcgaagcatttccgcaatcgaacgctgtgatacaggatgaagaaagagatattcctgaaaggagttggaatagtggtcacgaatggataacagattttccgggaaaaactgtgtggttcgtaccatcaataaaatctggaaatgatatagcaaattgtttaaggaaaaacggaaaaagagtaatacaactaagtcgaaagactttcgataccgaatatcagaaaacgaaaaataatgattgggactatgttgtaacaactgatatctctgagatgggtgccaattttcgagcagacagagttatagatccgcgtaggtgcttaaaaccggttatacttaaagatggccctgagagggtaatattagctggaccgatgccagttacagtagcaagtgcagcacagagaaggggtagaattggacgtaatcataataaggagggtgatcagtatatttatatgggacaacctctaaataatgatgaagaccacgcacactggacagaagcgaaaatgctactagataacattaatacaccggaaggaatcatacctgccctcttcgaaccagaaagggagaaaagtgcggctatagacggcgaatatagactaagaggcgaagctaggaagacgtttgttgaactaatgagaagaggagacttacctgtatggttatcatataaagtagcatctgaaggattccaatatagtgacaggagatggtgttttgatggcgaaaggaataaccaagtgctagaggaaaatatggacgtagaaatatggacaaaggaaggagaaagaaagaaactaagaccccgttggctcgatgcgaggacttattctgatccattagcattgcgtgaatttaaggaatttgcagcggggcgaaggtctgtaagcggagatctaattctagaaatcggtaagttaccacagcacttaactcaaagggcacagaatgccctcgataatttagttatgcttcataacagtgagcaagggggcagagcgtatcgacacgcaatggaggaattgccagatacaatagaaaccctaatgctgcttgcattaattgctgttttaaccggaggcgtaacgctgttctttctatcgggacgaggacttggaaagaccagtattggtctactttgcgtaatggctagctccgtactattatggatggcaagcgttgagccacattggattgctgcgtccataatcttagaatttttcctcatggttctgttgataccagagccggaccgccaaagaaccccgcaggataaccagctagcatatgttgtaataggactgctatttatgattctaaccgtagcagctaatgaaatggggctccttgaaaccactaaaaaggatctgggaataggacatgtggccgttgaaaaccaccatcatgcgaccatgttagatgtagatctacatcccgcgtctgcgtggacactatacgccgtagcaacaacaattattacaccaatgatgcgacacactattgagaacactaccgcgaacatcagtttaacagctatagctaaccaagcggcgatacttatgggattagacaaaggctggccaatttctaaaatggacataggagttccattacttgcattgggatgttatagtcaagtaaatcccttaacgttaactgcagctgttttaatgttagtagcgcactatgcgataatcggcccgggtttacaagcaaaggctacgagagaagcccagaaaagaacagcagcaggaataatgaagaatccgacagtggatggcattgtagccattgatctcgacccggtagtttatgacgccaaattcgagaaacaactgggacaaatcatgctattaatattgtgtacatctcaaatactattaatgagaacaacttgggcgctttgtgagagtataacattagcaactgggcctcttacaaccttatgggagggtagtccaggcaagttctggaacaccacaatagcagtgagtatggccaacatatttcggggtagttacttagccggagcaggtttagcgttttcattaatgaaaagcctcggcggtggacgtcggggaacaggagctcaaggcgaaacattaggcgaaaaatggaaaagacagctcaatcaactttcaaaatcagaatttaacatctacaagagaagtggaataatggaagtagatcgatcagaagcaaaggaaggcctcaagagaggagaaactactcgacacgcagtttcaagaggaactgcaaaactgaggtggttcgtagagagaaatttagtaaaaccagaagggaaagtgatagacttaggatgtggacgtggaggctggtcgtactactgcgcaggtcttaagaaagtcacagaagtaaagggctacacgaagggtggaccgggacacgaggaaccgataccaatggccacttatggatggaatctcgttaaactgcattctggaaaagatgtatttttcacacccccggaaaaatgtgacacactattatgtgacataggtgaatcgtcacccaatccgacgatagaggaaggccgcacactccgcgtactgaaaatggtcgaaccgtggcttagaggaaatcaattttgcataaaaatactcaatccttatatgccaagcgtcgtagaaacactcgagcagatgcaaagaaaatatggtggaatgttggtaagaaaccctctctcacgcaatagcactcatgaaatgtactgggtttcatgtggtacaggtaacatcgtatcagcagttaatatgacatcccgcatgctgttaaacagattcacgatggcacatcgaaaaccaacctacgaacgtgacgtcgatttgggggcaggtacgagacacgtggcagtagaacctgaggtggctaacttggatataatcggacaaaggatagagaacataaaacacgaacataaaagtacttggcattatgacgaagataatccatataaaacctgggcgtatcatgggtcttatgaagtcaaacccagtgggtccgcaagttccatggtcaacggtgttgtaaaactccttactaagccctgggacgttatacccatggtcacacaaatagcaatgacagacacaaccccctttggacaacaaagagtatttaaagagaaagtcgacacaaggacacctaaagctaaaagaggcacagctcagataatggaagtaacagctaggtggttatggggatttttgtcacgcaacaagaaaccgagaatatgcactcgggaagaatttactcgcaaggttagatccaatgcagcaataggcgcagtttttgtagacgagaatcaatggaactcagctaaagaagcggttgaagacgaaagattttgggatctggttcagaaagaacgtgaactacacaaacaaggtaagtgtgcaacttgtgtgtataacatgatgggaaaaagagagaagaaattgggagagtttgggaaagcaaaaggatcaagagcaatctggtatatgtggttaggcgctcgattcctagagtttgaggcacttggattcatgaatgaagatcactggttttctagggaaaactcactaagtggagtagaaggagaaggcttgcataaacttggctatatattaagagacataagtaaaatccctggagggaacatgtacgcagacgacactgcaggatgggacactagaataacagaggatgatcttcagaatgaagcgaaaataacagatataatggaaccggaacatgcccttttagctacttcaatttttaagttaacgtatcaaaataaggtggtacgagttcaacgacccgccaaaaacggaacagtgatggacgtgatatcacgaagagaccagagaggaagtggccaagtcgggacttatggactaaacaccttcacgaacatggaagcacaattaattcgacaaatggaaagcgagggtatatttttaccgagcgaactagaaacaccaaacctagctgaaagagttctagattggctagaaaaatacggagttgaaagattgaaaagaatggcaataagtggggatgattgcgtggtaaaacctatagatgacagattcgcaacagctttgactgccctaaatgacatgggtaaagttcggaaagatattcctcaatgggagccatctaaaggatggaatgattggcagcaggttccgttttgcagccatcatttccatcaattaattatgaaagatggtcgagagattgttgtgccatgcaggaatcaggatgaactggtaggcagagcaagagtatcacagggggctggatggtcactacgggaaactgcctgtttaggcaaatcttacgcccagatgtggcaattaatgtatttccaccgtagagatttaagactcgcagcaaacgcaatttgttcagcagttccagtagactgggttcccacttctcgcactacttggagtatacacgcacatcaccagtggatgacaacggaagatatgctctctgtctggaatagggtatggatcgaagaaaacccctggatggaagataaaacacacgtctcctcatggggagatgtaccgtatcttggtaaaagagaagaccaatggtgtggctctcttattggcctaactgctagggcaacatgggcatcgaacatacaggtggcgattaaccaagttagacgattaataggaaacgaaaactatttagactatatgacttcaatgaaaagatttaaaaatgagggggatcctgaaggagccctatggtaa

SEQ ID NO: 21673 - RNA, 9879 nt, synthetic construct
  misc_feature 1..9879: note = derived and/or modified CDS sequence (opt6) from DENV-1__GQ199795__SS-prME
  source 1..9879: mol_type = other RNA
agcgtaacaatgttactcatgttgatgccaacagcactagcatttcaccttacaacgagagggggcgaaccgcatatgatagtatcgaaacaagaacgcggtaaaagtctgttatttaaaacatccgccggagtaaatatgtgtacgctcatagcaatggacctaggtgaattatgtgaagacactatgacatataaatgtccgcgcataacggaaacagaaccagacgatgtagactgctggtgcaatgcaacagacacgtgggtgacttatggtacttgtagtcaaacaggcgagcaccgtagagataaacggagcgttgccttggccccacacgtaggtcttggcctagaaacaagaactgaaacatggatgagttccgaaggagcttggaaacaaattcaaagagtagaaacctgggcattaagacatccagggtttacagtgatcgccctattcttagctcatgccatagggacaagtataactcagaaaggaattattttcatcctgcttatgctcgttacaccttctatggcaatgcgatgtgtcggaattggatcccgtgatttcgtagagggacttagtggggctacatgggttgacgtggtactagaacacggatcgtgcgtaacaacaatggctaaagataaacccacccttgatatagaattactaaaaaccgaggttacaaatccagcagttttacgtaaactctgtatagaagccaaaataagtaatacaactacggattcacgttgccctacacaaggagaagccacacttgtagaggaacaagacgcaaattttgtgtgtagaagaacctttgtggaccgcgggtggggtaacggttgtggattgttcgggaaaggctcactaataacgtgtgcaaaattcaaatgtgttactaaacttgaaggaaaaatagtacagtacgaaaacctgaaatactcggtcattgtgactgtacatactggagaccaacaccaagtaggaaacgagagtacagagcacggaactacagctactattactccccaagccccgacaacagaaatccagctaactgattacggagcgttgaccctcgactgctcacctcgtacaggtcttgacttcaatgaaatggtacttctaacaatgaaagaaaaatcatggctagtacataaacaatggttcttagacttacctcttccctggacatccggtgcaagtacaagccaagagacttggaataggcaagatttgttagtgacttttaaaacagcgcatgccaagaaacaagaagttgtagttcttggaagccaagaaggcgcaatgcacaccgctcttacaggtgctacagaaattcagactagcgggacaaccacaatattcgccggccacctcaaatgtcggttgaaaatggataagctgacgttgaagggaatgtcatatgttatgtgcacgggatctttcaaactagaaaaagaggtggcagagacacaacacggaacagttctggtacagataaaatacgaaggcacagacgctccatgcaaaatccccttttcaacgcaagatgagaaaggagttacacaaaatgggcgacttattacggccaaccctatagtaactgataaagaaaaaccggttaacatagaggccgaacccccttttggagaatcatatattgttataggcgctggagaaaaagcgttaaaactaagttggtttaagaaaggttccagcattggtaaaatgttcgaggctacagcacgaggtgcaagaagaatggcaatcttgggagacaccgcatgggattttgggtctataggaggcgtattcaccagcgtaggaaagctggtacaccaaatatttggcacggcttacggggtactattttcaggtgtaagttggacaatgaaaattggcataggtgtattattgacgtggttaggtctaaacagtcgttcaactagcttgtcaatgacatgcatcgcggttggcttggtgacgctatacttaggggttatggtacaagccgatagtggttgcgttataaactggaaaggacgtgaattgaaatgtggatcaggtattttcgtaactaatgaagttcatacatggacagaacaatataagtttcaagctgatagcccgaaacgtctaagtgccgcaattggaaaggcttgggaagaaggggtgtgtggaatacgtagtgctacgcgcttagaaaatataatgtggaaacaaatcagcaacgagttaaatcacatattactagaaaatgatatgaagtttacagtagtagtgggtgatgtagcaggtatactggctcaaggcaagaaaatgatcagaccacagccgatggagtataagtattcgtggaagtcttggggtaaggcgaagataataggggcggatgtacaaaacacaacttttataatagacggtcccaatacccccgaatgccctgatgaccagcgagcgtggaatatttgggaagtagaagactatggatttggtatttttacaactaacatatggctcaaattacgcgatagctatacacaggtctgtgatcatagactaatgtcagcagctattaaggattctaaggcagtgcacgcagacatgggctattggatagagtcagagaaaaatgagacatggaaattagccagagcctcatttattgaggtaaaaacatgcatatggcctaaaagtcatactctatggtcaaacggagtcttggaaagcgaaatgataattcctaaaatatatgggggacccatctcccaacataactataggccaggatattttacgcaggcggcaggtccatggcatttaggtaagctagaactagacttcgatttgtgtgaaggtactacagttgtcgtcgacgagcattgtggtaataggggaccatcacttaggacaaccactgttacaggcaaaataattcatgaatggtgctgtagaagttgcacacttccacctttaagattcagaggtgaagatggctgttggtatgggatggaaattcgtccggtgaaggaaaaagaagaaaatctcgttaaatcaatggtatcagcagggagcggagaagtagatagtttctccctgggacttttatgcataagtataatgattgaagaggtgatgcggagcagatggtcacgacggatgctgatgacgggaactttagcggtctttttcttactgatcatgggtcaactaacttggaatgaccttataagactatgcataatggtaggcgcaaatgcttcggatcgcatgggaatggggaccacatatttggcccttatggccacgtttaaaatgagacctatgtttgctgtaggcctactatttagaagattaacgagtagagaagtacttttgttaacaataggactctctctggtggccagcgttgaacttccgaatagtctggaagaactcggagatggcttagcgatgggaataatgatacttaaattgttaacggactttcagtcgcatcagttatgggctacattactaagccttacatttataaagactacttttagcctacactacgcttggaaaactatggctatggtactctcaatcgtatcattatttccactttgtctgagtactacatcacaaaagactacctggctcccagtccttctgggatcactaggctgtaaacctttgactatgttcttgattgcagaaaataaaatctggggacgacgctcctggcctttaaatgaggggataatggccgttgggattgtttctatacttctatcgagtctgctgaaaaatgatgtgccattagcaggacctttgatagctggaggtatgctaattgcatgttacgtcattagtggaagttccgctgatcttagtttagaaaaagcagcggaagtaagttgggaagaagaagcagaacattctggagcgagtcataatatcttggtagaggtacaagacgatggcactatgaaaataaaagatgaggagagggacgatactcttacaattcttctgaaagcaacacttctagcagtatctggagtatacccactgagcataccggcaacattatttgtctggtatttttggcagaaaaagaaacaaaggtcaggtgtgctctgggacacaccttcacctccagaagtcgagcgtgcagtattagacgatggcatttatcggattatgcagagaggattgttaggtagatcgcaagttggagtaggagtatttcaggaaaacgtttttcataccatgtggcatgtaactagaggggccgttttaatgtatcagggaaaacgcttagaaccaagttgggcaagtgtcaagaaagatttaatctcatatgggggaggttggcggttacaggggtcatggaatacgggagaggaggtccaagttatagcagtagagcctggcaaaaacccgaaaaatgtacaaactgcaccaggcacattcaagaccccagagggtgaggtaggtgcaatcgcgttagattttaaacctggtacgagtggaagtccaatagtgaatagagagggaaaaatagtagggctatatggcaacggggtagttacgactagcggcacatatgtttccgcaatagcacaagcgaaggcctcacaagaagggccgttaccggagatagaggacgaggtatttcgaaaaaggaatctgacaataatggacttgcatcctggttctggaaaaacaagacgttatctgccagccatagtcagagaggctataaaaagaaaattacgcacattgatactagcaccaacacgagtggtggcgtccgaaatggctgaagccctaaaaggtatgcccattcgctaccaaacaacagcagtaaaatcagaacacactgggaaagaaatagttgatctgatgtgtcatgctacgttcactatgcgactgctcagccctgtacgagtgccaaattacaatatgataattatggatgaagcacattttacagatccatcttcaattgccgctagaggatatatttcaacgcgagttgggatgggtgaagcggctgccatttttatgacagcaaccccgcctggatccgtagaagcatttccacagagtaacgcagttatacaagacgaggaaagggatatcccagaaaggtcatggaatagtggatatgagtggattacagattttccagggaaaactgtgtggtttgtaccctcaattaaaagcggtaacgatattgccaactgtctaaggaaaaatggaaaacgagtaatacaattaagtagaaagacgttcgacacagaataccagaaaaccaaaaacaacgattgggattacgtcgttaccactgatatatcggagatgggtgctaacttccgcgcggacagagtaatagatccaagaagatgtctgaagccagttatattgaaagatggcccagaaagggttatactcgcaggaccaatgccagtaacggttgcttctgcggcccagagacgaggtagaataggtcgtaaccacaacaaagaaggagaccaatacatttacatgggacagccgctaaataacgacgaagaccatgcacactggacagaggctaaaatgctattagataatattaacactcccgaaggaattattcctgccttatttgaacccgagcgtgagaagtcagctgcaatagatggggaataccgtttgagaggagaagcacgaaaaacatttgttgaactcatgaggcgtggagatctacctgtatggctaagctataaagtagcttcagaaggcttccaatatagtgaccgccgatggtgttttgacggagaacgaaataatcaagtgctagaagaaaacatggatgttgaaatctggacgaaagaaggggaaaggaagaaactaagaccccgatggttggatgcacggacgtactccgacccgcttgcgttaagggagtttaaggaatttgcagcaggtagacggtcagtttcaggagaccttattctcgagatcggaaagttgccacaacacttaacacaaagagcacaaaacgcattagataatctagtgatgctacataacagtgagcaaggaggacgagcatatcgacatgctatggaagaattacctgatactatagaaacattaatgttactcgcactgatagcggttctaacagggggcgtgacactcttctttttatcagggcgaggtctaggcaaaaccagtatagggctgctttgtgttatggcaagtagtgtgctattatggatggcatcagttgaaccgcactggatagcggcatctatcatcttagaatttttcttgatggttttactaatacctgaaccagacagacaaagaaccccgcaagacaaccaactcgcgtatgtcgtaataggtctgttattcatgattctgacagtagctgctaacgaaatgggactcctagaaaccacgaagaaagatctaggcataggtcacgtagcagtagagaatcatcaccacgcagcaatgctggatgttgatcttcaccctgcgtcagcttggacactgtatgcggtagcaacaacgataatcacaccgatgatgcgacacactatagaaaatacaacagcaaatatatcactcactgccatagccaaccaagccgctatattaatgggattagataaaggttggcctatatcaaaaatggatatcggagtaccactattggcactaggctgttactctcaagtaaacccactaactttaacagccgctgtcttaatgctcgtagcacactatgctattatcggaccaggcctacaagcaaaagctacaagagaagctcagaaaagaacagctgctggcatcatgaagaacccgaccgtagacggcatagtggccatcgatttggatccggttgtatacgatgctaaatttgaaaaacagttagggcagatcatgttattaatcttatgtacctcccaaatcctgctaatgagaacaacatgggcgctgtgtgaatcgattacattagctaccggcccgttgactactttatgggaaggaagtccgggtaaattttggaacactacaattgcggtctccatggccaatattttcagaggttcctacttagccggagcagggttggcattttcgctaatgaaatccctagggggtggtcgtcgcggaactggggcgcaaggagaaacattgggggaaaaatggaagcggcaactaaatcaattatcaaaaagcgagtttaacacttacaaacgttctggtatcatggaggtcgaccgatcagaagcaaaagagggcctcaagcgtggagaaacaactaaacacgctgtttcccgagggacggctaaactaaggtggttcgtcgagaggaatctagtcaaaccagagggtaaagttatagacctcggatgcggccgcggcggttggtcgtattattgtgcaggacttaaaaaggtaacagaggttaaaggttatactaaaggtggtccaggtcacgaagacccaatacctatggcaacatatggatggaatctagtgaagttacattcaggaaaagatgtctttttcatacctccagaaaaatgtgatactttactttgtgacataggcgagtcatcgccaaaccccacaatcgaggaaggcagaacactacgagttctaaaaatggtagagccttggcttagaggaaatcaattctgtatcaagatattaaatccatacatgccttcagttgtagagacacttgaacaaatgcaacgtaaacatggtgggatgttagttcgaaatcctttatctagaaattccacacatgaaatgtactgggtatcatgcggaacaggaaatatcgtctctgcagtgaacatgactagccgaatgttattaaatcgattcacaatggcgcatcgcaagcccacgtacgaaagagacgttgacctaggagctggaacccgacatgtggccgttgaacctgaagtagccaatttagacataattggacagagaatagaaaatataaagcatgaacataagtccacatggcattacgatgaggataacccgtataaaacatgggcttatcatggctcttacgaagtcaaacccagcggatccgcctcgagcatggtgaatggcgtagtaaaattacttacgaagccttgggatgtaataccaatggttacgcaaatagctatgacggatacaacgccctttggccaacagagagtatttaaggaaaaagtagatactaggactccaaaagcaaaacgaggtactgctcaaattatggaagtcactgcaaaatggttgtggggatttttatcgcgcaataaaaagcccagaatatgtacacgcgaagaatttacgcgaaaagtgcgttcgaacgctgcgatcggcgcagtgtttgtggacgaaaatcaatggaactcggcaaaagaagcagtcgaagacgaaagattctgggatttagtacacagggagagagaattacataaacaaggaaagtgcgctacttgtgtatacaatatgatgggcaagcgcgagaagaaattaggcgagttcggtaaagccaaagggagcagagctatctggtatatgtggttgggagctagatttttagagtttgaagcgctcggctttatgaatgaagatcattggttcagtagggagaactcactatccggagtagaaggtgaagggctccacaagttgggctacatattgagagacatctcaaaaattcctggaggcaatatgtacgcagatgacacggcaggatgggacacacgaataacggaggatgatctgcaaaatgaagcaagaataacagatattatggaaccagaacatgcacttcttgcaaagagtatttttaagctaacatatcaaaataaggtagttcgtgttcagcgacctgctaaaaatggtacagtaatggatgtcataagtcgaagagatcaacgcggtagtggacaggtagggacttacggactaaatacttttacaaatatggaagcacagctcataaggcagatggaatcagaaggtatattctccccatccgaattagaaacacctaacttagcagaaagagttttagactggctggaaaaatacggagtcgagagacttaagaggatggcaatctctggtgacgattgtgtagtaaaacccattgatgaccgatttgcgactgctctcaccgcgctaaatgacatgggcaaggttcgaaaggatataccacaatgggaaccatcaaaaggctggaacgattggcaacaagttcccttttgttcacaccacttccaccaactaataatgaaagatggaagagagattgtagttccatgccgaaaccaagacgagctagtcggacgtgcaagagtctctcaaggggcaggatggagtctacgggagaccgcatgccttggtaaatcatatgcccaaatgtggcaattaatgtattttcatagacgggatttgcgactagcggctaacgcaatatgttcagcagtacctgttgactggattcccacgtctcgcactacatggagcatacatgcacatcatcagtggatgaccactgaagacatgttgtcagtttggaatagagtctggattgaagaaaacccatggatggaggataaaacgcatataagtagttggggagacgtaccgtacttgggtaaaagagaagaccagtggtgtggtagcttgattggattaacagctcgagcaacatgggcaaccaatattcaggtcgctataaatcaagtgaggcgacttataggcaacgaaaattatctagactacatgaccagcatgaagcgatttaaaaatgagtcagatccagagggggctctttggtga

SEQ ID NO: 21674 - RNA, 9873 nt, synthetic construct
  misc_feature 1..9873: note = derived and/or modified CDS sequence (opt6) from DENV-1__FJ882547__SS-prME
  source 1..9873: mol_type = other RNA
agtgttacgatgttgctaatgttgatgccaacagcgttagctttccatcttacgacacggggtggtgaacctcacatgattgtgtctaaacaagaaagaggaaaaagtctactgtttaaaacaagtgctggggttaatatgtgcacactaatagcaatggacctaggagaattgtgcgaagacactatgacctataaatgcccgagaataacggaagcggaacctgatgatgtggattgttggtgcaatgcaacagacacttgggtaacatatggtacttgcagccaaacaggggaacatcgaagagataaaagaagcgtagcattagcaccacacgtgggactaggtcttgaaactagaacagaaacatggatgagctccgaaggagcttggaaacaaatacaacgagtggaaacttgggcgctgagacaccctgggttcacagtaatcgcactcttcctagcacacgcgataggaacgtccataacacaaaaaggtataatattcatcctactcatgctcgtaactccatcaatggctatgcgatgtgttggtatcgggtcacgagactttgtagaagggttaagtggagcaacgtgggttgatgtagttctagaacatggatcgtgcgtaacaacaatggcaaaagacaaaccaacgttagatatagaactcttaaaaacagaagttactaatcccgctgtactaagaaaactgtgtattgaagcgaaaatttcgaatacaacgaccgattcccgctgtcccacacaaggtgaagcgactctagtagaagaacaagacgcaaactttgtttgtcgacgaacatttgttgacagaggatggggaaacgggtgcggtctattcggtaaagggagcctaattacttgtgcgaaatttaaatgtgttaccaaattagaaggcaaaatagtgcagtatgaaaatcttaaatatagtgtgatagtcacagttcatactggagatcaacatcaagtaggtaatgaaagtaccgaacatggaactacagctactattacgccgcaggctccaacaacagaaatccaattaacggactacggtgcacttacactagattgttcaccccgaactggactagattttaatgaaatggtcctcttgacaatgaaagaaaaatcctggttggttcacaaacaatggtttttagatctaccactgccatggacatcaggtgcgtccacaagccaagagacctggaatagacaagacttactcgtaaccttcaaaactgcacatgccaagaaacaagaagtagtagtgctcggaagccaagagggggcaatgcacaccgcgctaacaggcgctacagaaatccagacatcaggtacaacgacaattttcgcgggccatttaaaatgcaggttgaaaatggataaattaactcttaaaggtatgagttatgtaatgtgcaccgggagctttaaactagaaaaagaagtcgctgaaacgcagcatggaacagtcctagtgcaaatcaaatacgaaggcactgacgctccatgtaaaatacccttcagtactcaggacgaaaaaggtgtaacacaaaacgggagactcatcacagctaacccaattgtcacagacaaggaaaaaccagtaaatattgaggcggaacctccttttggagaaagttacatagtaattggagctggagaaaaagcgttgaaattatcttggtttaagaaaggaagtagcatcgggaaaatgtttgaagctactgcacgcggcgccaggcggatggcgattctaggggatactgcctgggactttggatcaatcgggggagttttcacgagtgttggtaagctggtacaccaaatatttggaaccgcttacggagttttgtttagtggagtcagctggacgatgaaaataggaataggtgtactcttaacttggttaggactaaattcgaggtccacttcacttagtatgacgtgtatcgctgtaggtctggtaactctatatttaggggtaatggtccaggccgattcgggatgcgtaataaattggaaaggtcgggaactaaaatgcgggtcaggtatatttgtgacgaatgaagttcatacttggacagaacaatataagttccaagccgactctccaaaaaggttgagtgcggcgattggtaaggcttgggaagagggcgtgtgtggtattcgatccgcaacgcgtctagaaaatattatgtggaaacaaatctctaacgaactaaatcacatattactagaaaacgacatgaaactaaccgtggtagtaggtgacgtagccggtatacttggtcaaggtaagaaaatgataagacctcagcctatggagtataaatactcttggaaatcgtggggcaaagcaaaaattataggcgcagatgcccaaaatacgactttcataatagacggtcctaacacgcctgaatgtccagatgatcaacgagcctggaatatttgggaagttgaggattacggttttggaattttcaccacaaatatatggttaaaattaagggattcctacacacaagtttgtgaccatcggttgatgtctgccgcaataaaggattccaaagcagtgcacgctgatatgggatattggattgaatcagagaaaaatgaaacatggaaactagctagagcatcgtttatcgaagtaaagacgtgcatttggccaaagagccatacactatggagtaatggtgtgttagaatcagaaatgataatcccgaagatatatgggggtcccatatctcaacataattatagacccggttactttacacaaacagcagggccatggcacttgggaaaactagagctcgattttgacttgtgtgaaggaaccacagttgttgtagacgaacactgcggtaacaggggaccatctcttaggacaactacagttacagggaaaattattcatgaatggtgctgccgatcatgtactctgccacctttacggtttcgcggtgaagatggttgctggtatggtatggagatccgaccagtaaaagagaaagaagaaaacctagtaaaaagcatggtatccgctggatcaggagaagtagacagttttagcttaggattactctgtataagcattatgatagaggaagttatgcgatccagatggagtaggaaaatgctaatgactggcacgctagctgtatttttcctactcataatgggacaactaacctggaatgatctcatccgcttatgcataatggtcggtgcgaatgcatccgatcgtatgggaattggaactacttatcttgcactaatggctacgtttaaaatgcgtcccatgtttgcagtaggtcttttattcagacgactgacctcaagagaagtattacttttgaccattgggctatcacttgtagcatctgttgaactaccaaactctctagaagaactcggtgacgggttagcaatgggtataatgatgctaaaattacttacagactttcagagccatcaactttgggctactttactatctctgactttcataaaaacgacatttagtctacattacgcgtggaaaacgatggctatggtattaagcatagtgagtctttttccattatgtctttcgactacatcgcaaaagacaacgtggttaccggtattactgggatcattaggatgcaagccattaacgatgttcttaatcgccgaaaacaaaatatggggccgaaagtcgtggccgttgaacgaaggaataatggcagtcggaatcgtatctattcttctgtcctcgttattgaaaaatgacgtaccgctagcaggtccactaatcgccggtggtatgttaattgcatgctatgtaatatctggatccagcgcagatctttcattagaaaaagcggcggaagtaagctgggaagaagaagcagagcattctggggcgtcccataacatactggtagaggtacaagacgatggtacgatgaaaatcaaggacgaggagagggacgatacgctaaccatcttactaaaagctaccttgctcgcagttagcggtgtgtatccactttcaatcccagctactctttttgtatggtacttctggcagaagaagaaacaaagaagtggtgtactatgggacactccgtcaccccctgaggttgaaagggccgtacttgatgatggaatttacagaataatgcagagaggtctactaggaagatcacaggtaggtgtaggtgtctttcaagaaaatgtatttcatactatgtggcatgtcacccgtggcgccgttcttatgtaccaagggaaacgactggagccatcgtgggcgtcagttaagaaagatttaataagttacggtggaggctggcgtctgcgaggttcgtggaacacaggtgaagaagtgcaggttatagcagttgagccaggcaaaaatccgaaaaatgtacaaacagcacctgggacattcaaaaccccagaaggagaagtaggtgccatcgcactagattttaaacctggaacttcaggtagtccaatcgtaaatcgagagggaaaaatagtaggtctttatggaaatggagttgttactacgagcggtacatatgtatcagcaatagcacaagctaaagcgtcccaggagggtcccctaccagagatcgaggatgaagtcttccgaaagcgtaacctaactattatggatttgcatccaggtagcggaaagacacgacgttatctacccgctatcgtgagagaagcaataaaacgtaaattaagaacgctaatactcgcaccaactagagtcgttgcttctgaaatggctgaggctttaaagggcatgcccatacgctaccagaccacagccgtaaaatcagaacacacagggaaggaaatagtcgaccttatgtgtcatgccacatttacaatgaggttattatcgccagtgagagtacctaattacaatatgattattatggacgaagcgcatttcacggacccaagtagtatagcagcccgaggttatatatctacaagagtgggtatgggtgaagcagcggctatattcatgacagcaacaccgccaggatcggttgaggcttttcctcaatccaatgcagtgatacaggacgaagaacgtgatattccggaaaggagctggaactcaggatacgaatggataacagatttccccggaaaaactgtatggttcgttccaagcattaagtcaggaaacgacatagccaattgtctacgcaaaaatggcaaacgtgtgatccaactaagtagaaaaacattcgacacggaataccagaaaaccaaaaacaacgactgggactatgtcgttacaaccgacatttctgagatgggtgctaattttcgggcggaccgagtcatagaccccaggagatgtttgaaacccgtgatattaaaagatggtccggaacgtgttatcttggccggaccaatgcctgtgactgttgccagtgctgcacagaggcgagggcgcattggacgaaatcacaataaggagggagatcaatacatttatatgggacaacctctaaacaatgatgaagaccatgcacactggaccgaggccaaaatgctcctcgataacattaatacaccagaagggattataccagctttattcgaacctgaaagagaaaagtcagcggcagtagacggagaatatagattgcgtggtgaggcccgtaagacgttcgtggaactgatgcggcggggagatcttcccgtatggttatcctacaaagttgccagcgaaggatttcagtatagcgatcgacgttggtgtttcgatggcgaacgtaataatcaagtgctagaagagaatatggacgtagagatctggacaaaagaaggtgaaggtaagaaactacgaccaaggtggttggatgcgcgcacatattctgatccattagcccttcgtgaatttaaagaatttgccgcaggtaggagatctgtcagcggagacctcatactcgaaataggcaagctaccgcaacatttgacgcaaagagcgcagaacgctctcgataatttagtaatgctacacaatagcgaacaaggtggacgagcatatagacacgcaatggaagaactacccgatacgatcgaaacattaatgctacttgcacttattgcagtgttgacaggcggagtcacgctgtttttcctgtcagggaggggattgggaaaaaccagcattgggttattgtgcgttatggcatcttccgtcctgctgtggatggcaagtgtagaaccgcactggattgcggcttccataattctcgagttctttctcatggtactgcttattcctgagcccgaccgacaacggacaccacaagataatcaattagcgtatgtagtaataggtttactcttcatgatacttactgtcgcagcgaatgaaatggggttgttagaaacaacgaagaaagatctcggaatagggcatgttgctgtggaaaaccaccatcatgcagccatgctggatgttgatcttcatccagcttcagcatggaccctatatgctgttgcaacgacaatcataactcctatgatgaggcatactatagagaacaccacagcaaacatttccctgaccgctatagctaatcaagcagcaattttaatgggacttgataaaggatggccaattagtaaaatggacatcggtgtccccttattagctctggggtgttattcgcaagtcaacccactaaccttgacggccgctgttttaatgctagtagcacattatgctatcatcggtcccggtttgcaagccaaagcgacaagggaagctcaaaaacgtaccgcagctggaataatgaaaaatccaactgtagatgggattgtcgcgatcgaccttgatcctgttgtatatgatgcaaagtttgaaaaacaattgggacagataatgctgttaattctatgtacttctcaaatattactaatgcgtactacctgggcactttgcgagagtataacacttgcaaccggacccttaactacattgtgggaaggaagcccaggcaaattttggaacactactatcgcagtttctatggctaatattttccgcggctcatacctagccggtgctggcttagctttttcactaatgaagtcattaggaggaggacgaagagggaccggcgctcaaggcgaaacattaggtgagaaatggaaacggcaactaaatcaactctcaaaatctgaatttaacacttataaacggtctgggataatggaagtcgaccggagcgaagcaaaagaagggttaaaaagaggagaaactacaaaacacgccgtctcaagaggcacagcgaaacttagatggtttgtcgaacgaaacttagtcaaacctgaaggaaaagtaatagatctaggttgtggacgaggcggatggagttactactgcgcaggtcttaaaaaggtaacagaagtcaaagggtatacaaaaggtggtcctgggcatgaagaacccatacctatggccacttatggctggaatctcgttaaattacattcgggaaaagacgtcttctttatccctccagagaaatgcgatactctattatgcgatatcggtgaatcttcacctaacccaacaatagaagagggcaggactttgagggtgttgaaaatggtggaaccttggctgcgtggtaaccaattctgtattaagatattaaatccttatatgccaagcgttgtagaaactctagaacaaatgcaaagaaaacacggtggtatgttggtgagaaatccattatctagaaattcaactcatgaaatgtactgggtctcttgtggtaccggtaatatagtaagcgcagtaaatatgacaagtagaatgcttttgaatcgatttactatggcacatagaaagccaacatacgaacgagatgtcgatttgggaacaggaacgcgacatgtagccgtagaacccgaagtggcaaatttggatataataggccagcggatagaaaatattaagcatgagcataaatccacatggcactatgatgaagataacccatataaaacctgggcctaccacggaagttacgaagtgaagccttccggtagcgccagtagcatggtaaacggcgttgtgaaattactgacaaaaccctgggatgtaattccaatgtctccaatcgcaatgacggacacgacacccttagcacaacgggtattcaaggagaaagtagatacccgaacgccgaaagcaaagaggggcaccgcccagatcatggaggtgactgctcggtggctctggggatttttatcaaggaataagaaaccgagaatttgtacaagagaagaatttactcgtaaagttcgatccaacgccgcaataggggcagtatttgtagacgaaaatcaatggaactcggctaaagaagcggttgaagatgaaaggttctgggacttggtacatagagaaagagaattgcataaacaaggaaaatgtgctacctgcgtttataatatgatgggaaaaagagagaagaaattgggcgaatttgggaaagcaaaaggaagtagagctatttggtatatgtggcttggagcaagatttttagaatttgaggcattagggtttatgaacgaagatcactggttctcgcgagaaaattctctatcaggtgtcgagggggagggtcttcataaattaggttatatactaagagatatttctaagatcccgggaggaaatatgtacgcagacgacacagcaggatgggataccagaataactgaggatgatttacagaacgaagcgaaaataaccgacataatggaacctgaacacgcccttctggcaaaagccatttttaaattgacatatcagaataaagttgtacgcgtacaaaggccagccaaaaatggaacggtaatggatgtcatttcaagaagggaccaaagagggtcaggtcaggttgggacgtatggcttaaacacatttacgaacatggaagcacagttaattagacagatggagagtgaagaaatattctcacccagcgaacttgagacaccaaacttagcagaacgtgccctagattggttagaaaaatacggagtggagagactaaaaagaatggcaatctccggagatgattgcgtcgtcaagcctatcgatgacaggtttgccaccgctttaacagctctgaacgatatgggcaaggtaagaaaggatattccacagtgggaaccatcaaaaggttggaatgattggcaacaggtcccattttgctcacatcatttccatcagctcatcatgaaggatggacgagaaatagttgtaccatgccgaaatcaggatgagctagtcggtagggctagggtatctcaaggagctggttggtctttaagagaaacagcctgtttaggaaaatcatacgcccaaatgtggcaattaatgtactttcatagaagagacttaagattggcagcgaacgcaatatgctccgcagtgccagtggattgggtacctacgtcaagaacaacatggtcgatacatgcacaccatcaatggatgactacagaagatatgttgtcagtctggaatagagtttggatcgaagaaaatccatggatggaggataaaacccatataagctcatgggaggatgttccgtatctaggcaagcgagaagatcaatggtgcgggtcactgatcggtctaacagcaagagcaacgtgggcaactaatatacaagtagcaatcaatcaggttagaagattaattgggaatgagaattatttggattacatgactagcatgaaaagattcaagaatgaatcggacccagaaggagcattatggtaa

SEQ ID NO: 21675 - RNA, 9879 nt, synthetic construct
  misc_feature 1..9879: note = derived and/or modified CDS sequence (opt6) from DENV-1__GQ199797__SS-prME
  source 1..9879: mol_type = other RNA
tctgtaactatgttactgatgctgatgccgacagcattggcgtttcatttaacaacgagagggggagagccccatatgatcgtatccaaacaagaacggggtaaatctttattatttaaaacatcagcaggagtaaacatgtgtacactgatagcaatggatctgggggaattttgtgaggatacgatgacatataaatgcccaaggattacagaggcagaaccagatgacgtggattgctggtgtaacgctacagacacatgggttacatatgggacgtgttcgcaaaccggggaacaccgccgtgataaacgaagcgtcgctcttgcgccccatgtcggtttggggttggaaactcgaaccgaaacatggatgtcaagtgaaggggcatggaaacaaattcaaagggtagaaacatgggctttgcgacacccaggattcacggtgattgctttatttctagcacatgcaataggaacaagtataacacaaaaaggcattatcttcatattgctaatgcttgtaactccttctatggcgatgcgatgtgtaggtataggatcacgcgattttgttgaaggattatctggagcgacttgggttgacgttgtacttgaacatggaagctgtgtcacgactatggcaaaagacaaaccaactctggatatcgaattattgaaaactgaagtgactaatcccgcggtcttaagaaaattatgcatagaagcgaaaataagcaataccacgacagacagtagatgcccgactcaaggagaggcgacacttgtggaagaacaagacgcaaacttcgtttgcagaagaacttttgtggatagaggatggggaaatggatgtggtttatttggcaaaggatccttaattacctgtgctaaatttaaatgcgtaactaaactagaaggaaaaacggtacaatacgagaatttgaaatatagtgttatagttacagtccacacaggtgatcaacaccaagtaggtaacgaatctaccgaacatgggactacggcaacaattacaccccaggcaccatccactgaaatacaactgacagattacggagcactcacattagattgctcaccaagaaccggactggattttaatgaaatggtattgctaacgatgaaagagaaaagttggttagttcataaacagtggtttttagacttaccactcccttggacaagtggagcgtctacttctcaggaaacatggaaccggaaagacttattagtcacgtttaaaaccgcacatgccaagaaacaggaagtagtagtattagggtctcaagaaggagccatgcatactgcattaactggggctactgaaatacagaccagcgggacaacaacaatatttgcaggacacttgaaatgtaggctaaaaatggacaaactaacgcttaaaggtatgtcttatgtaatgtgtaccggcagcttcaaattagagaaagaggtagccgagacccaacacggaacggtattagtgcaaataaaatacgaaggcacagacgccccttgcaaaataccgttctcaacccaagatgaaaaaggtgtaacgcaaaacggccgtttgataactgctaatcccatagtcaccgacaaagagaaaccagttaatattgaagcagaaccaccgtttggcgaatcttacatagtaatcggggccggtgaaaaggctttaaaactgtcatggtttaaaaagggaagtagcattggaaaaatgtttgaagccacagcacgtggagctcgtaggatggccattttaggggatacagcttgggattttgggtctatcggaggagttttcacttcagtagggaagctggttcatcaaatatttggaacggcctatggcgtattattttctggggtctcatggaccatgaaaataggtatcggggtattgcttacatggttaggtctaaattctcgatccacgtcgctctcaatgacgtgtatagcagtagggttggttacgctctacttaggtgtaatggttcaggcagactccggctgcgtcattaattggaaaggaagggagctaaaatgcggaagcgggatatttgttactaatgaggtgcacacgtggactgaacagtataaatttcaagctgactcacccaaaaggctatcggcggcaattgggaaagcatgggaagaaggagtatgtggaataagaagtgctacaaggttagaaaacataatgtggaaacaaataagcaatgaactaaatcatatactgctcgagaatgacatgaaatttacggttgtggtaggtgacgtggcaggaatattagcacagggtaagaaaatgataagacctcaaccaatggaatataaatattcctggaaatcatggggcaaagcaaaaattataggagcagacgtacaaaatacaactttcatcattgacgggcctaatacacctgaatgtccagatgatcaaagagcttggaatatttgggaagtggaagattatggatttggaatatttactacaaatatatggcttaaattaagagatagttatacgcaagtgtgtgatcacagacttatgtcagccgctataaaggactcaaaagcagtacacgcggatatgggctattggatcgaaagtgaaaagaacgaaacttggaaacttgcacgagcatcgttcatagaggtaaaaacctgcatttggccaaaatcccacacattatggtcaaatggcgtgctcgagtcggaaatgataattcccaaaatttacggtggcccaatttcacaacataactatagacctgggtatttcacccagactgcaggaccttggcacttaggcaaactggaattagacttcgatttgtgcgaaggaactactgtagttgtagacgagcattgcggtaatagagggccatcattacgcacaacaaccgtaaccggcaagataatacacgaatggtgctgtaggtcttgcacgctccctccactacgttttaagggtgaggacggatgttggtatggaatggagattcggccagtaaaagaaaaagaagaaaatttggtaaagtcaatggtgagtgcgggcagcggggaggtagatagtttttctttaggattgctttgtatctccatcatgattgaagaagtgatgcgctcaaggtggtcccgaaaaatgttaatgactggaacactcgcagttttctttttacttataatgggacaactcacgtggaatgacctaattcgcctatgcattatggtcggtgcaaatgcaagcgatagaatgggtatgggcactacctacttagctctcatggcgacatttaaaatgagaccgatgtttgccgtaggattattatttcgacgcctaacatccagagaagtattacttttgacaatagggttatctttagtggcatccgtagaactcccaaatagcttggaagagttaggagacggattagcgatgggaattatgatactcaaattgctcacagattttcaatctcaccaactatgggctacacttttgtcactaacctttataaaaacaacattttcgttacattacgcatggaaaactatggcaatggtccttagtattgtaagcctctttcctctttgcctcagtacgacatcacagaaaactacctggctgccagtactattaggatcactgggctgtaaacctttgactatgttcctaatcgcagagaataaaatttggggtcgaaaaagttggcccttgaacgaaggcattatggctgttggaatagtatcaattcttttatcttcactattaaagaacgacgtgcctctagcaggtccattgatagcagggggtatgctaatagcctgttatgtaatatctggatcgagcgctgacctaagccttgaaaaagccgcagaggtgagttgggaagaagaggccgaacactcaggagcgtcacataacatactggtagaagttcaagatgatgggacgatgaaaataaaggatgaagaaagggatgatacgctaactatcctgttgaaagcaacactactagcagtatcaggtgtatatccgctttcaatacccgccacactttttgtttggtacttttggcagaagaagaaacaacgaagcggcgtgctatgggacacgcctagcccaccagaagtagaaagagcagttttggacgacggcatatacagaataatgcaaagaggcttattgggtagatcccaggtaggcgttggagtctttcaagaaaatgtttttcatactatgtggcacgtgacacgaggagcagtcttaatgtatcaaggtaaaagactagaaccatcatgggcgagtgtcaaaaaggatctgatttcctatgggggcggatggagactccagggttcctggaacaccggagaagaagtacaagtaatagcagtcgaacccggcaaaaatcccaaaaatgttcaaactgcaccaggcaccttcaagacatctgaaggcgaagtcggagcaattgcattagatttcaagcctggaacaagtggcagtccaatcgttaatcgagaaggaaagattgtaggcttatatggaaatggtgtggttaccactagcggtacgtacgtatccgcaatagcccaggcaaaggcttcacaggaaggaccactccccgaaattgaagatgaagtgttcaggaagaggaatctcacaataatggacctacaccctggttccgggaagacgagacgatacttacctgcaatagttagggaagcaataaaacgtaaattacggactttgatactcgccccaactagagtagtagcaagtgaaatggcggaagcactaaaaggaatgcccatacgttaccaaacaacagccgtaaagtcagaacatacaggaaaggaaatagtagatctaatgtgtcatgcaacattcactatgcggctattaagcccggtacgagtgcctaattacaatatgataattatggacgaagctcatttcacagatccgagcagtatagcagcgcgagggtacattagcactcgagtgggaatgggcgaagcagccgcgatcttcatgacggcgacacccccaggcagtgtagaagcatttcctcaatcgaacgcggtcattcaggacgaagaaagagatattccggagcggagctggaactctggttatgaatggattaccgacttccccggtaaaacagtttggtttgtccctagtattaaatccggaaacgacattgccaattgtcttaggaaaaacgggaagcgagttatccagttatctagaaaaacatttgatacagaatatcagaaaaccaaaaataatgattgggactacgtagttactaccgacatatcagaaatgggagcgaactttcgtgcggatcgcgtcatagacccacgccgatgtttaaaaccagtaatattaaaggatggacccgagagggttattttagcaggacctatgcctgtgacagtagcaagtgccgcccaaaggcgcgggcgaataggacgcaatcacaataaggaaggagaccaatatatttatatgggacaaccactgaacaatgacgaggaccatgcacactggacagaagctaaaatgctactagacaatattaacactccagaaggaatcattccggcactgttcgaaccagaacgtgagaaatcagcagcaatcgatggtgaatacagattgcgaggtgaagcacgaaaaacttttgttgagttaatgcgcagaggagatctccccgtttggttatcatataaagtagcctccgagggttttcaatattctgatcgccgatggtgttttgacggagagcgcaacaatcaagtgttagaagaaaatatggatgttgaaatatggacaaaggagggagaaaggaagaaactacgcccaagatggttagatgcacggacatactcggaccctttagcactaagagagttcaaagaatttgcagcaggacgtaggtcagtatcaggggatctcattctcgaaataggaaagctcccacagcacctcacgcaacgcgcacaaaacgcactagataatttagtaatgttacataattcggagcagggaggcagagcgtacaggcatgcaatggaagaacttcctgatactatagaaaccatgatgctcctagcgttaatcgcagtcttaactgggggagtaaccttgtttttcctatctggcagaggacttggaaaaacatcgataggactgttatgcgttatggcttccagtgttctactgtggatggcttccgtagaaccacactggatagcggcgtcaattatcttagaatttttcttaatggtattgttaatccccgagccagataggcaaaggactccacaggataaccagttggcatacgtagtgattggactattatttatgatacttactgttgcggcgaatgaaatgggattacttgagaccacaaagaaagatctaggcatcggtcatgtggccgtcgagaaccaccatcatgcagcaatgctagacgttgaccttcatccagctagtgcatggactctttatgcggtagctactactataataactccaatgatgagacataccattgagaatacgacggctaatatctcccttacagccatagccaatcaagcagcaatacttatgggactggataaaggttggccgatttcaaaaatggacataggcgtcccactactcgcattaggatgctattcacaagtaaatccactgactttaactgccgctgttttaatgttagtagcacattacgcgataatcggaccgggattgcaggccaaagcaacacgagaagctcaaaagcgaactgcagcagggattatgaaaaaccctactgtcgacggaatagtagccattgacttagacccagtcgtctacgatgctaaatttgagaagcaactaggtcaaattatgctactgatattatgtaccagtcaaatattattaatgagaactacatgggcactttgtgagagcataacattggcgaccggtcccttaactaccttgtgggaaggatcacctggaaaattttggaataccacaatagcggtttctatggcaaacatttttcgtgggtcatacctagctggagcagggctagccttctcattaatgaagtctttaggagggggccgccgaggtacgggagcacaaggggaaacactcggagaaaagtggaaaagacagctgaaccaacttagtaaaagcgagttcaacacgtataaaagatcagggataatggaagtagatcgatctgaagcaaaagaagggttaaagcgaggagaaactaccaaacatgcagtatcgcgaggaactgccaaattgcgctggtttgtcgaaagaaacttggtaaaaccagaaggcaaagtcattgatttagggtgtgggcgaggcggatggagttattattgtgcagggttgaaaaaggtaacagaagtaaaaggatataccaaaggcggaccaggtcatgaagaaccaatacctatggcaacgtatgggtggaacctagttaaattacactcaggaaaggacgtattctttataccaccagaaaagtgcgacacactattatgtgatatcggagaaagttcaccaaatcccaccatcgaagaaggtcgtaccttacgagtgcttaagatggttgaaccatggctaagaggaaatcaattctgtatcaaaatcttaaatccgtacatgccttccgtagtggaaactttagaacagatgcaacgtaaacacggaggaatgttagttaggaaccctctcagtagaaacagtacgcatgaaatgtattgggtgtcttgtggtacgggcaacatagtcagtgcggtaaacatgacttccagaatgcttttaaatagattcacaatggcgcacagaaaaccaacttacgaacgggatgttgatctcggggcaggaacgcgacacgtggccgtagagccagaagtggcaaatttagatattataggacaaagaatagaaaatatcaaacatgaacataaaagtacctggcactacgacgaagataatccatacaaaacatgggcctatcatggatcctacgaagttaaaccttcaggtagcgcaagtagcatggttaatggggtggtcaaacttctgacaaaaccttgggacgtgataccaatggtaactcagatagcgatgacagacacgacaccttttgggcaacaaagagtcttcaaagaaaaagttgatacgcgcactcctaaagcaaaacgaggtacggctcagataatggaagttacagcaaaatggctgtggggtttcctttcaagaaataaaaagccaagaatttgcacccgagaagaatttacaagaaaagttaggtccaacgctgcaatcggagcggtctttgttgatgaaaaccaatggaacagcgcaaaagaagcagttgaagatgagcgattttgggacctcgtacacagggaacgtgaattgcataagcaaggtaaatgtgctacgtgcgtatataatatgatgggaaagagagaaaagaaactgggtgagttcggtaaggcgaaaggcagtcgggcgatttggtacatgtggttgggagctcgcttcctggaatttgaggcacttggattcatgaatgaagatcactggttctcgagagaaaactcattatcaggtgtggagggagagggattacacaaactgggctatatattgagagacatctcaaaaattccaggagggaatatgtatgcggacgataccgctggttgggacactcgaatcactgaagatgatctccaaaacgaagccaagatcacagatataatggaacccgaacatgctctactcgcaaagagtatattcaaattaacatatcagaataaggtagtgcgcgtccaaagaccagccaaaaacggaacagttatggacgttatctcgaggagagatcaacgagggagtggacaggttggtacatatggcttaaacacatttacaaatatggaagcccaactcatacggcagatggaatccgaaggtatttttagcccatccgaacttgaaacacccaatctcgctagaagagttctagattggctagaaaaacatggagttgaaagattaaaaaggatggcaatatcaggagacgactgcgtagtgaaacctattgatgacagattcgcaactgcactgaccgcattaaatgatatgggcaaagtacgaaaagatatcccccaatgggagccgtcgaaaggttggaatgattggcagcaagtccctttttgttcgcaccattttcatcaattaataatgaaggatggacgcgaaattgtagtaccatgcagaaatcaagacgaattggttgggagagcccgtgtttcgcaaggtgccgggtggagtcttagagaaactgcgtgtctagggaagtcttacgcgcaaatgtggcaacttatgtatttccacaggcgagatttaagactggcagctaacgctatttgttcggcggtacccgtcgattgggtaccaacttcacgaacaacttggtcgatacatgcccatcatcagtggatgaccacagaagatatgttgagcgtgtggaatagagtatggattgaagaaaatccgtggatggaagataagacacacatatcttcatggggagacgtaccgtatctaggcaagagagaagatcagtggtgcggtagtctaataggacttacagcaagagctacttgggcaacaaacatacaggtggcaattaatcaagtaagaaggctgataggaaatgaaaattacctggactacatgactagcatgaagagattcaaaaacgaatcagacccagaaggtgctttatggtga

SEQ ID NO: 21676 - RNA, 9879 nt, synthetic construct
  misc_feature 1..9879: note = derived and/or modified CDS sequence (opt6) from DENV-1__GQ199799__SS-prME
  source 1..9879: mol_type = other RNA
agcgtaaccatgttactgatgttaatgccaactgcattggcgttccatctcaccaccagaggtggagaaccacatatgattgtatcaaaacaagaacgagggaaatcgctattatttaaaacatcagcaggagtaaacatgtgcacgctgattgcgatggatctaggagaattttgtgaggatacaatgacgtacaaatgtcccagaatcacagaggcagaaccagatgacgttgattgttggtgcaatgcgactgatacatgggtaacctacggtacatgttctcaaacaggcgagcatagaagagacaaacgttccgtggcgctcgcaccgcacgttggactagggttagaaactagaactgaaacatggatgtcaagcgaaggagcttggaaacaaattcaaagagtggaaacgtgggcgcttcgacatcccggctttacagtcatagcattatttctagcacatgcaataggcaccagtataactcaaaaaggaattattttcatactgctaatgttagtcacacccagcatggctatgagatgcgtaggaattggaagtagagatttcgttgaagggctctcaggtgctacttgggtagatgttgtcttagaacatggttcttgcgtgacaacgatggcaaaagacaaaccaacattagacatagaactactgaaaacagaagttacgaatccggctgttttacgcaagctgtgcatagaagcaaaaataagcaatacaacaactgatagcagatgtccgacacaaggagaggcaactctagtagaggagcaagatgcaaattttgtatgcagacggacgtttgtagatcgaggttggggtaacggatgcggcctattcgggaaaggttcattaattacatgtgcaaaatttaaatgtgtaactaaattagaaggtaaaattgtacaatatgagaatttaaagtactccgtcatagtcaccgtacatacgggagaccaacatcaagttggaaatgaatcaactgaacacggtaccacagctacaatcacgcctcaagcgccgtcaacggagatacaactgacggactatggagccttaactttagattgcagcccaagaactggattagatttcaacgaaatggtattactcacgatgaaggagaaatcctggttagttcataaacaatggttcctcgacctcccgctcccgtggacttccggagctagtaccagtcaagaaacgtggaacagacaagatctattagttacgttcaagactgctcatgccaagaaacaagaagttgtcgttttgggctcgcaagagggtgccatgcacacagcactaacaggagcgacagaaattcaaacatcagggaccactacaatcttcgctgggcatcttaaatgtcggctcaaaatggataaactaacgttaaaaggaatgtcatacgtgatgtgcacaggttcatttaaattagagaaggaagttgctgaaactcaacacggaacagtgctcgtccaaataaagtatgaaggaactgatgcgccttgcaaaataccatttagtacacaggacgaaaagggagtcactcagaatggtagactaataactgcaaaccctatcgtgactgacaaagaaaagcccgtgaatatcgaagcagaaccacccttcggggaatcatatatagttataggggcaggagagaaagctctgaaattgtcctggtttaaaaagggaagtagtatcggaaaaatgtttgaagcgacggcaagaggtgcaagaaggatggcaattcttggagatactgcatgggacttcgggtctataggtggagtatttacatcggtcggcaaattggtccaccagatattcgggaccgcgtatggagtattgttttctggtgtgagctggaccatgaaaataggtataggggtactgctaacgtggctcggcctaaattctaggtctaccagtttgtcaatgacatgcatcgccgtaggactcgttactctatatttgggcgtaatggtacaggcggacagcggttgcgttataaattggaaaggtagagaattaaagtgtggcagtggaatatttgtaacaaatgaagtgcacacttggacggagcagtataaattccaagcagactctcccaaacggttaagcgccgcaatagggaaagcatgggaggagggggtctgcggtatacgaagtgcgactagattagaaaatattatgtggaaacaaatcagtaatgaattgaatcatattttacttgaaaatgatatgaagctaaccgtcgtagtaggagacgtcgccggtattttagctcaaggtaagaaaatgattagaccacaaccgatggaatacaaatacagttggaaatcgtggggaaaagccaaaatcataggggctgacgtacaaaacacaaccttcataatagatggacctaacacacccgagtgcccggacgaccaaagagcgtggaatatttgggaagttgaggattatggttttggcatctttaccacaaatatatggcttaagttgcgtgactcatatacacaagtatgtgatcatcgccttatgtcagcagcaataaaagacagtaaagcggtccacgctgatatggggtattggattgaaagcgagaaaaatgaaacctggaaactcgccagggcatcattcatcgaagttaaaacttgcatttggcccaaatcgcatacactatggtccaacggagttcttgagtcagaaatgataataccaaaaatatatggaggcccaataagccagcacaactatagacccgggtacttcacccaaacggcaggaccgtggcatttgggtaaactagaattggacttcgatctctgtgagggaactacggtagttgtggatgaacattgcggaaaccgaggacctagtttaagaacgacaacagtaacaggaaaaataatacacgagtggtgttgcagatcatgcacccttccgccactgcgattcaagggtgaagacggatgttggtacggaatggagatccgacctgtaaaagaaaaagaagaaaacttggtaaaatctatggtatccgcaggaagtggagaagtagacagtttcagcttaggtttactctgtatttcaatcatgatagaggaagtaatgagaagtaggtggtctcgtaaaatgcttatgaccggaaccctagctgtattctttcttttaataatgggtcaattaacatggaatgacttgatcagactgtgtataatggttggagcaaatgcaagtgatagaatgggtatgggaacaacgtatctagcgttaatggctacattcaaaatgagacccatgttcgcagttggtctgctctttagacggctcacgagtcgtgaagttctgctgctaacaattggcctgagcctagtcgcgtcggttgaactccctaactcattagaagaactgggtgatggactagcaatgggaataatgatactgaaactgcttacagattttcaaccgcaccaattatgggccaccctactaagtctcactttcatacggacaacattctcactacactatgcctggaaaaccatggccatggttctatctatagtatcattgttcccgctatgtctctcgacgacatcacagaaaacaacttggctaccagtattattgggtagccttgggtgtaagcctctaacaatgtttttaatagctgaaaataaaatatggggtcgaaaaagctggccccttaatgaaggcataatggcagtggggatagtaagtatcttattaagctcactattgaaaaacgatgtcccgctagcaggtccgctgatagccgggggcatgctgatagcgtgttatgtaattagcggctcatctgcagatttaagtttagaaaaggcagcagaagtatcatgggaagaggaggcggaacatagcggagcctctcataatatcctagttgaagtacaagatgatgggactatgaagataaaagacgaggagagagatgatacattaacgatattattaaaagctacccttcttgcggtgtctggtgtttatccactatctatacctgccaccctgttcgtttggtatttctggcagaagaagaaacaacgatcaggagttttgtgggatacgccgagtccacccgaagttgaacgtgcggtattagacgacgggatatatagaataatgcaaagaggcctgttaggtagaagtcaagttggagtaggagtgtttcaagaaaacgtgtttcacacaatgtggcatgtcacaagaggtgccgtactaatgtatcaagggaaaagattagaaccgagctgggcttcggtaaagaaggacttgataagttacggaggtggatggcgactgcagggcagctggaataccggcgaagaagtacaagtgatagcagtcgagcctggcaaaaatcccaaaaacgttcagacagctccaggaaccttcaagacatcagaaggagaagttggagcaatagcacttgacttcaaacctggcacatccggcagcccaattgttaacagagagggaaaaattgtaggactatatggtaatggtgtagtaactacttcaggtacttatgtatcggctatagctcaagcaaaggcatcacaggaaggacccttaccagaaatcgaagatgaagttttcagaaagcgcaatttaactataatggatttacaccccggaagcggaaagacgaggcgttatttaccagcaatcgtacgagaagctatcaaaagaagacttaggacgttaatattagctcctacaagagtagtagcaagtgagatggcagaagcactgaaaggtatgccgataagataccaaacaacagcagtaaagtcggagcatacaggcaaagagattgtagacttaatgtgccacgccacatttactatgcgcctattaagcccagtacgggttcctaattacaatatgattataatggatgaggctcattttactgatcctagttcaattgcagcgagaggatacatatcaaccagggtagggatgggagaagcagcggcaatttttatgacggcaactccacctggttccgtcgaggcatttccgcaaagtaacgcagtgattcaagacgaagaacgtgatattccagaacgctcgtggaatagcggatacgagtggatcacagactttccgggaaagacagtatggtttgtcccatcaataaaatcaggaaatgatatagctaactgtcttcggaaaaacgggaagagagtaattcagttgagcagaaaaacatttgatacagaatatcagaaaacgaagaataatgactgggattatgttgtcactacggacatatccgaaatgggagcaaatttccgagcggatcgcgtaatagatccaaggcgatgtctaaagcccgttattttaaaagatggaccagagagggttatcttggcgggacctatgccagtcactgtggccagtgctgcacagcgcagggggcgcattggtagaaatcataataaagaaggcgatcaatacatatacatgggtcaaccactgaataatgatgaggatcatgctcactggactgaagcaaaaatgctgctcgataatatcaacacaccagagggtataattcccgcgttattcgagccagagcgtgaaaaatccgcagctatcgatggagagtatagattacggggtgaagcgcggaaaacatttgtagagctaatgcggcgtggggacttaccggtgtggttaagttataaagtagcatctgaaggttttcagtacagcgataggcggtggtgtttcgatggtgaaagaaataaccaagtattagaagaaaatatggatgtggagatttggaccaaagaaggagaacgaaagaaattgcgaccacgatggctagacgcacggacatatagcgatccactagctttaagagagttcaaagaatttgctgccggccggagatccgtgagtggagatttgatactagagattggtaaactaccacaacacctaacacaaagagcacaaaacgccctagataacctagtgatgttacacaacagtgaacagggtggtagagcatacagacatgcgatggaagaactacccgatacgattgaaacactcatgttattagctttaatagcagtactaaccggaggggtaaccctcttcttcttatcgggccggggactaggaaaaacttcaataggcttactgtgcgttatggcgtcgtcagtattgctatggatggctagtgtagagcctcactggatcgcagctagtataatactagagttctttttaatggtattgttaataccagaacccgacagacaaaggactccacaggacaatcaattagcatatgtagtaataggattgttatttatgatcctgactgtagctgctaatgaaatgggattacttgaaacaacaaagaaagaccttgggataggacacgtagcagtggaaaaccatcaccacgctgcaatgttagatgttgatttgcaccccgcatcagcttggacgctatacgctgtggccactacgattataacaccaatgatgaggcatacaattgaaaacaccacagctaatatcagcttaaccgcaattgctaatcaggccgcgatattaatgggattggacaaaggttggccgatttcaaaaatggatattggtgtccctttgttagcattgggctgttacagtcaagtaaatcccttaaccttaactgccgcggtactaatgcttgtagcacattatgcgatcataggaccggggttacaagctaaagctacaagggaggctcagaaacgaactgctgccgggataatgaaaaaccccacagtcgacggaattgtggccatagatctcgatccggtagtatatgacgcgaaatttgaaaaacaattgggtcaaatcatgcttctaatactatgtacttctcaaatccttctaatgagaacaacgtgggctctgtgtgaatcgataacacttgcaacaggaccgctaacgacattgtgggaaggtagccctggaaaattttggaataccaccattgcagtttcaatggcaaacatattcagaggtagctatttggctggggcaggtttagcattttcattaatgaaatcgttaggaggcgggagacgtgggacgggggcacaaggtgaaacactaggtgaaaaatggaagagacaactaaaccagttgtcgaaaagtgaatttaatacctacaaacgttccgggataatggaggttgatcgatcagaggccaaggagggattgaaaaggggagagacaactaaacatgctgtcagtagagggactgcaaagctaagatggtttgtagagagaaacctagtaaaacctgaaggtaaagtcattgacttaggttgtggtcgtggaggatggtcatactactgcgctggcctaaagaaagtaacagaagttaagggatacacgaaaggaggacctggccatgaggaacccatacctatggcaacatatggttggaatttggtaaaacttcattccgggaaagacgtattctttataccaccggagaaatgcgacacattattgtgtgatataggtgagtcatccccaaacccgacaatagaagaaggtcgtacgttgagagttctaaaaatggtcgaaccatggcttaggggcaatcagttttgcataaagattcttaatccttacatgcccagtgtagtcgagacactagaacaaatgcaaagaaaacatggaggtatgttagtcagaaatccactatcaagaaattccacgcatgaaatgtactgggtatcatgtggaaccggaaacatcgtaagtgccgtcaatatgacatcacgaatgctcttgaacagatttacaatggctcacagaaaacccacatatgaaagggacgtagatctaggggctgggacgcgtcatgtagctgttgagcccgaagtggcaaacttggacataatagggcaaagaattgaaaatatcaaacacgagcataaaagcacatggcattatgatgaagacaatccatataaaacgtgggcgtatcacggtagttatgaagtaaaaccaagtggatccgccagtagcatggtaaatggtgtcgtcaagctattgacgaaaccatgggacgttattccaatggtaactcaaattgctatgaccgacacaaccccttttggacaacaaagagtattcaaagaaaaagtggatacacgtaccccgaaagctaaaagagggacagctcagatcatggaagttacggcgaagtggttatggggtttcctcagcagaaacaagaaaccacgaatctgcaccagagaagaatttacacgaaaggtccgaagtaatgcggcgatcggtgctgtctttgtagacgaaaatcagtggaactcagctaaagaggcggtcgaagacgaaagattttgggatttggtgcatcgagaaagagaacttcacaagcagggtaaatgtgcgacttgcgtctataatatgatgggaaaacgagagaagaaactcggagagttcggaaaagctaaaggttcgagagccatctggtacatgtggttaggtgccagatttctagagttcgaagccctaggattcatgaatgaagaccattggttttcacgcgagaactctttgagtggagtggaaggtgaaggcctacacaagttaggatatatattaagagatatctcaaaaattcctggagggaacatgtacgcggacgacaccgccggatgggatacgagaattactgaggatgatttacaaaatgaagctaaaattactgacatcatggaacctgagcacgcattacttgctaagtctatcttcaagctgacctatcagaacaaggtagtacgggtacaacggcccgccaaaaacggcacagtgatggatgtaatatcacgaagagatcagagaggttctggacaagtgggaacatacggacttaatacttttacaaatatggaggcacagctaattaggcaaatggagagcgaggggatattctcgccttcagaactagaaacccctaaccttgcaggtcgagtgctagattggctagaaaagcatggcgtggagaggttaaaaagaatggcgatttctggagatgattgcgtagtcaaaccaattgatgaccgtttcgccacggcactaaccgcccttaacgatatgggaaaagtacgtaaagatataccacaatgggaaccatcgaaaggttggaatgactggcaacaggtccctttctgtagtcatcactttcaccaactaataatgaaagatggaagagagatagttgtaccgtgtaggaaccaagatgaattagtagggcgagctagagtttcacaaggggcaggatggtcccttagagaaacggcatgtcttggaaaatcctacgcacagatgtggcaactaatgtattttcatcgaagagatttaagattagcagctaatgctatatgtagtgcagtacctgtagattgggtaccgacctcaagaacgacgtggtcgattcatgcacatcaccaatggatgaccacagaagacatgttgtcggtatggaatagggtttggatagaagaaaacccctggatggaagataagacacatgtttcgtcctggggtgacgtcccatatctgggaaaacgtgaagatcagtggtgcggaagtttgatcggactaaccgcccgagccacttgggcaacaaacattcaagttgcgattaatcaggttcgacgattattgggtaacgaaaactatcttgattacatgacatcaatgaaacgttttaagaacgaaagtgatccagaaggagcactttggtga

SEQ ID NO: 21677 - RNA, 9879 nt, synthetic construct
  misc_feature 1..9879: note = derived and/or modified CDS sequence (opt6) from DENV-1__GQ199800__SS-prME
  source 1..9879: mol_type = other RNA
tctgttactatgttattaatgctgatgccaactgcattagctttccacctaactactagagggggagaaccccatatgatagtgtcgaaacaagaaagaggaaaatcactactgtttaaaaccagcgctggagtaaacatgtgcacattgatcgcaatggacttaggagaattttgtgaagatactatgacatataaatgtcctagaataacagaagcggaacccgatgatgtagattgttggtgcaacgcaaccgatacgtgggtcacatacggtacttgttcccaaacaggtgaacatagacgagataaaagatctgtagctctagcgccgcatgtagggctcggattagaaactcgaactgaaacatggatgtcatcagaaggtgcctggaaacaaattcaacgagtggaaacatgggctttaagacacccaggatttacggtaatcgcattgtttctagctcatgctatcggaacaagcattacacaaaaaggaataatctttatcttgctcatgctcgtgacaccgagcatggccatgagatgtgtcgggattggctctagagacttcgtagagggtctttctggagcaacgtgggtagatgttgttttagagcacgggagctgcgttaccacaatggcaaaagacaaaccgactttggatatagaactattaaaaaccgaagtcacgaatccagctgtacttaggaaactgtgtatagaagcaaaaatttccaacacgacaacggacagccgctgcccaacacaaggagaggcgacattggtagaggaacaagacgcgaactttgtctgtcgtcggacttttgtagacagaggatggggcaacggatgtggattgttcggcaaaggaagccttataacttgtgctaaatttaaatgtgtaacaaaactagaagggaaaatagttcaatatgaaaatctgaaatattccgttattgtaacagttcacaccggagaccaacatcaagtgggtaacgaaagtactgagcatggcacaaccgcaacaataactcctcaagcaccaagcaccgagatacaattgacggattacggagcactcacattagactgttcaccccgaaccggactggatttcaatgaaatggtcctattaactatgaaggagaaaagctggttagtgcacaaacaatggttcctcgatctgccactaccatggacctcgggtgcaagcacaagccaagaaacttggaatcgccaagatcttttagtcacattcaaaacggctcatgccaagaaacaggaagttgtagtcctaggatcacaagaaggtgctatgcacaccgcattgaccggcgccacagaaattcagactagcggaacaactacgatatttgcaggacacttaaaatgtcgactcaaaatggataaattaacattaaaaggtatgtcttatgttatgtgcactggctcatttaagctagagaaagaagtagctgaaacacagcatgggacagtgttggtacaaattaaatacgagggtacagacgccccttgtaaaataccctttttaacacaagatgaaaaaggagtcacacaaaacggaagacttataacggctaatccaatagttactgacaaggaaaaacctgttaacatagaggctgaaccgccatttggagagtcatacatagtcataggcgctggagaaaaagcattaaagttatcatggttcaagaaaggcagttccatcggtaaaatgttcgaagcaacagcgcggggagcaaggcggatggccatactgggcgataccgcgtgggacttcggatccataggcggagtattcacaagcgtaggaaagctagttcatcagatttttggcaccgcgtacggtgtattatttagtggagtatcatggacaatgaaaattgggataggggtacttcttacctggctaggattaaatagtcgcagcacttccctgtccatgacatgtatagccgttgggttagtcacattgtatttaggagtaatggttcaagcagactccggatgtgttataaattggaagggtagggagttgaagtgtggttcaggcattttcgttacgaacgaagtgcatacatggacagagcaatataaatttcaagctgatagtccgaagcgcttatcagctgcaatcggaaaagcgtgggaagaaggggtctgcggtatacgtagcgctactcgcctcgaaaacataatgtggaaacagatatccaatgaactcaatcatattttacttgagaatgatatgaaattcacggttgtagtcggcgatgtagccggcattcttgcccaaggcaagaaaatgataagaccgcaaccaatggagtataaatattcatggaagtcctggggcaaagcaaaaatcattggagcagacgtacaaaataccaccttcatcatagacggacccaataccccggaatgtcctgatgatcagcgagcatggaatatttgggaggtagaagattacgggttcggaatatttacaacaaatatctggctaaaacttagagacagctacacccaggtatgcgatcaccgtctcatgagtgcggccataaaagattcgaaagcggttcacgccgatatgggatattggatagaatcagagaaaaacgagacttggaaacttgctagagcgagcttcatagaagtaaaaacgtgcatatggcctaaaagtcatactctttggagcaatggtgtgctcgaaagcgagatgattatccctaaaatctatggtggcccaatcagtcagcataattatcgtccaggttattttactcagaccgcaggcccttggcacctaggcaaactcgaactcgatttcgatttgtgcgaagggacaactgtcgtcgttgacgaacattgcggtaataggggtccctcgctcagaaccacaacggtgacaggtaaaattatccacgaatggtgttgcagatcatgcactttacctccattgagatttaaaggagaagatggatgttggtatggtatggaaattcgacccgtgaaagaaaaggaggaaaatctcgttaaaagcatggtaagtgcaggatcaggagaggtagactctttctcgctcggattgctgtgcatttctataatgatcgaggaagtgatgagaagccgttggtcaagaaagatgttgatgacaggcaccctagcagttttctttcttctaatcatgggacaactaacttggaacgatttgataagactgtgtattatggtaggtgctaacgcctcggatagaatgggtatgggaactacttatttagcgttaatggctaccttcaaaatgcggccgatgtttgcagttggtttactcttcagaaggttaacaagtcgagaagtgttattactaacaattgggctatcacttgttgcgagcgtagagttgcctaactcactagaagaactgggagatggtttagctatgggcataatgattctaaaattattaaccgattttcaaagccaccagttgtgggcaacattgcttagtttaacatttattaaaacaacattttctctccactatgcatggaaaactatggcaatggttttgagcatagttagccttttccctctatgtttatctacaacgagtcagaaaacaacatggctaccggtcctccttggtagcctaggatgcaaaccattaaccatgttcctgattgccgagaacaaaatctggggtagaaagagctggccgttaaatgaaggtataatggccgtaggcatcgtgagtatcctattgtcatccctcctcaaaaacgacgtacctctcgcagggcctctaattgcagggggtatgctaatagcgtgctatgttatctcgggatcatcggctgacttatcattagaaaaggctgcagaagtctcgtgggaggaagaagcggaacactctggagcgtcacacaatattttagtggaagtacaggatgatggtactatgaagataaaagacgaagaacgtgatgacacactaactattcttttaaaagctacactactagctgtatctggagtatacccactatcgataccggctactttatttgtatggtatttttggcagaagaagaaacaacggagtggtgtattatgggataccccgtcaccacccgaagtcgagagggcagtcctagacgatggtatttatagaataatgcagagaggtctattaggccgttctcaagttggagtcggggtgtttcaagagaacgtatttcatactatgtggcatgtaacacgaggagctgtcctaatgtatcaaggaaagcgactagaaccctcatgggcttcagtcaagaaagatttaatttcctatggaggcggatggcgattacaagggtcttggaatacaggtgaagaggtacaagttatcgccgtggagcccggtaaaaatccgaaaaatgtccagaccgcaccgggcacttttaaaaccagtgaaggtgaagtaggagcgattgcactagacttcaaacctggaacaagtggatcaccaattgtgaacagagaaggcaagattgtaggtctttacgggaatggagtcgttacaaccagcggcacctacgtttcggccatcgcccaagcaaaggcaagtcaagagggtcccttgccagagatcgaggatgaggtgtttcggaagcgtaacttaacaataatggatctacacccaggcagcggaaaaaccagaaggtatttaccagcaatcgtaagagaggcaataaaacgaaaattaaggaccttaattttagctccgacgagagtcgtagcttcagaaatggctgaggcactaaaaggaatgccaataagatatcagacaaccgccgtaaaaagcgaacacacgggtaaggagattgttgacttgatgtgtcacgctacttttaccatgagactattatctccagttagagtgcctaattataacatgataataatggacgaagcacactttaccgaccccagttccatagcagcgcgcggatatatttcgactagagtaggtatgggcgaagcagctgcaatattcatgacggctacaccccctggaagcgttgaagcatttcctcaatcgaacgcagtaatacaggacgaagaacgagacatccctgaacgatcgtggaactcgggctacgaatggataacagacttccctggtaagactgtttggtttgtaccgagtataaaatctggaaatgatatcgcgaattgtttaagaaagaacggtaaacgagtaatccaattatccagaaaaacatttgacactgaataccagaaaactaaaaacaacgattgggattacgtagtaacgactgatatctctgagatgggagctaactttcgagccgatagagtaattgatccgcgaagatgtctaaaaccagttatattaaaagacgggccagaaagagtgattttagcaggtccaatgccggtaaccgtagcatcggcagcacaacgcagagggcgtataggtaggaaccacaacaaagagggcgatcaatatatatacatgggacagccacttaataatgacgaagatcacgcacattggacagaagcaaaaatgttgcttgacaatataaacacgccagaaggtattatccctgcactctttgaacccgaaagggagaaaagcgcggctatagacggagagtatagattaaggggagaagcacgcaaaacttttgtagagttaatgagacggggcgatttgcccgtgtggctaagctataaagttgcttcagagggattccaatactctgatcggagatggtgttttgatggcgaacgaaataatcaggttttagaagagaatatggatgtcgagatatggactaaggaaggagagaggaaaaagctaagaccgaggtggctagatgcaagaacatatagcgaccccctcgcacttagggagtttaaggaatttgctgccggaagacgatctgtttcaggtgatttaattctagaaatcggtaaactcccacagcacttaacacagcgggcgcaaaatgcattagacaacctagtaatgttacacaacagcgaacagggtggcagggcatataggcatgcaatggaagaacttcctgacacgatagagacactaatgcttcttgctttaatcgcagtactaactggaggtgtcactttgtttttcttatcagggcgtggccttggaaaaaccagcataggtttactatgcgtcatggcctcaagcgttttgttgtggatggcgagcgtggaaccacactggatagccgcttctatcattttggagttctttctaatggtcctcctaataccagaacctgaccgccaaaggaccccacaagataaccaattagcctatgtagtaatcgggttactgtttatgatcttaacagtagcggctaatgagatgggcttgcttgaaacgacgaagaaggatctaggaataggtcatgtagcggttgaaaatcatcaccacgccgcgatgctagatgtcgacttacacccggcttctgcctggactttgtatgcagttgcaaccacgataataacgcctatgatgcgacatacaatagaaaacacaacggctaatatatctctaacagcaatagccaaccaagcagcaatattaatgggtctcgacaaaggatggccaatatctaaaatggacatcggtgttcctctactcgctctcggctgctattcacaagtgaatccgcttacacttactgccgcagtactaatgcttgtcgcccactatgccataatcggcccaggattgcaagccaaagcgactcgcgaagcgcaaaaacgaactgcagcaggaataatgaaaaaccctaccgtagatggcatagtagctatagacttagaccccgtcgtatacgacgcaaaattcgaaaaacaacttggacaaataatgcttctgatactatgcacgagccaaatactcctgatgcgtactacttgggcgctatgcgaatccattactttagctactgggcccttaacaacgctttgggagggaagcccagggaaattttggaatacaacaattgcagtatcgatggctaacatattcagaggaagttacttggcaggcgcggggttagcattttcgttgatgaaatcgttagggggcggcagacgaggaactggtgctcagggagagactttaggggaaaagtggaaaagacaattgaaccaactgagcaaatctgagttcaatacttataaaagaagtggtattatggaagtagaccgatctgaagcaaaagaaggattaaaaagaggtgagacaacaaaacatgcagtctctagaggaacagcgaaactgagatggtttgtcgaaagaaatctcgtaaaacctgagggaaaggtaatagatttgggttgtggaagaggaggatggagctattattgcgcaggtcttaagaaagtaacagaggttaaaggatacactaagggtggaccaggacatgaagaacctataccaatggcaacatatggctggaatcttgttaaattgcactccggaaaagacgtcttctttataccaccggagaagtgcgatacacttttgtgtgacattggagaatcaagtccaaaccccaccatagaagaaggaaggacattgagagtgttaaaaatggtggaaccatggttacgcgggaaccaattttgtataaaaatattaaatccttatatgccctctgttgttgaaaccctagaacaaatgcaacgtaaacatggaggaatgcttgtaagaaatcctcttagtaggaatagtacacacgaaatgtactgggtaagctgcggtactggaaatatagtgtcagccgtaaacatgacatcacggatgttattaaatagatttacaatggcacatcgaaagccaacttacgaaagggatgttgacctcggtgctgggactaggcacgtcgcagttgaacctgaagtcgcaaatttggatatcatcggtcagcggattgaaaatattaagcatgaacacaagtccacatggcattacgacgaagataacccttataaaacatgggcttatcacggctcgtatgaagtgaaaccttctggatccgcgagtagtatggtaaatggtgtagtgaaactcctcactaaaccttgggacgtcatcccgatggtaacacagatagcaatgactgatacgaccccctttggacagcaacgagtattcaaagagaaggtagatacacgaaccccaaaggctaaaaggggaactgcacaaatcatggaagtaactgccaaatggttgtggggattcttatctaggaataaaaagccacgcatttgtacgcgagaggagttcacacgaaaagtacgcagcaatgctgctataggtgccgtatttgtcgatgaaaatcaatggaacagtgcaaaagaagcggttgaagatgaaagattttgggacctggtccaccgtgaaagagaactgcataaacaaggtaagtgtgcaacatgcgtatacaatatgatgggtaaaagagagaagaaattaggtgaatttggaaaagctaaaggtagtcgggcaatttggtatatgtggttaggagctaggttcttggagtttgaagcattgggatttatgaacgaggatcactggttcagtagagagaacagtctctctggagtcgaaggcgaagggctacataaacttggttacattcttagagacataagcaaaattccaggtggcaatatgtatgctgacgacacggccgggtgggatactagaattacggaagatgatttgcaaaacgaagctaagataactgacattatggaaccggaacatgcgttattagctaaaagtatctttaaacttacgtatcagaataaagtcgtacgagtacaacgtcctgccaaaaatgggactgtaatggatgtaataagcagacgagatcaacgaggttcaggtcaagtaggaacatatggactgaacacatttacaaatatggaagcacaactaattcgacaaatggaatccgaaggaatatttagtccctcagaactagaaactccaaatctagccggtagagtcttggattggttagaaaaacatggagtcgaacgtctcaaaagaatggctatatcaggcgacgattgtgttgttaaaccaatagatgaccggtttgcgaccgcgttaaccgccttaaatgatatgggtaaagttcgaaaagatattccacaatgggagccttcaaaagggtggaacgactggcaacaagtaccattctgttctcatcatttccatcagctaatcatgaaagatggtcgagagattgtagtcccttgcagaaaccaagatgaacttgtgggaagggcgagggtcagtcaaggagctggttggtccctcagagaaacagcgtgcttgggtaaatcctatgcacaaatgtggcaactaatgtatttccatcgtagagatctacgacttgctgctaacgcaatttgttcagccgtaccggttgattgggttcctacatccagaactacatggagcatacatgcacatcatcaatggatgacaactgaagatatgcttagcgtgtggaacagggtatggatcgaagagaatccctggatggaagataaaacccacatatcatcttggggagacgtgccttatttaggcaagcgagaagaccagtggtgcggtagcctgataggactaacagcgcgtgctacctgggctacaaatattcaagtggctataaatcaagttcgaagactgattggtaacgagaattatctagattatatgaccagtatgaaacgctttaagaacgaatcagaccctgaaggggccttatggtaa

SEQ ID NO: 21678 - RNA, 9879 nt, synthetic construct
  misc_feature 1..9879: note = derived and/or modified CDS sequence (opt6) from DENV-1__FJ882548__SS-prME
  source 1..9879: mol_type = other RNA
agtgtaactatgttgctaatgttaatgcctaccgcactagcattccatcttactacacggggaggagaaccacatatgatagtgagtaaacaagaaagaggaaaatcattattatttaaaacatcagccggtgtaaacatgtgcacattaattgcaatggatctaggtgaactgtgtgaagatacgatgacatataaatgtcctagaatcacagaagctgaaccagatgacgttgattgctggtgtaacgctactgacacttgggtaacatacggaacttgctctcaaactggcgagcatcgacgagataaacgttctgttgcgttagccccacatgtaggtctagggttggaaacccggaccgagacgtggatgtcctcagaaggcgcatggaaacaaattcaaagggtagaaacatgggctttaaggcatccaggatttaccgtgatagcattattccttgcccatgcgataggcacctcaattacgcaaaaagggataatatttatactattgatgctagtaacgccaagcatggccatgcgatgcgtgggcattggatctcgggattttgtcgaaggtcttagtggagctacctgggttgacgtagtcttagaacacggaagctgcgtgacaacaatggcaaaagacaaacccacactagatattgagctattaaaaacagaagtgaccaatcctgccgtactaaggaagttatgtatagaggcgaaaatttcaaatactacaacagatagtagatgtccaacacaaggagaagcgactcttgtagaagaacaagacgctaattttgtttgtaggcgaacctttgtagatagaggatggggaaatggatgtgggctattcggtaaaggctcgctgattacgtgtgccaaatttaaatgcgttacaaagctagaaggaaagatagtacaatatgaaaacctgaaatatagtgtcatcgtaacagtacatacaggtgatcaacatcaagttgggaatgaaagtacagaacacggaacaacggcgacaataacaccacaagcgcccaccaccgaaatccaacttacggactatggcgcacttaccttagactgctcaccgcggacaggattggattttaacgaaatggtgctcctaacaatgaaggaaaaatcgtggctcgttcacaaacaatggtttcttgatctaccacttccttggacatctggagcttccacttctcaagaaacatggaatcgtcaggaccttctagtaactttcaaaactgcgcatgccaagaaacaagaagttgtagttctaggatcgcaagaaggagctatgcacacagcactaacgggagccacagaaatacagacaagtggcacaactactatatttgctggtcatttaaaatgtagacttaaaatggataaactcacacttaaaggaatgagttacgtaatgtgtacaggctctttcaaattagagaaagaggtagccgaaacacagcacggtacggtgttagttcagatcaaatatgaaggaaccgatgcaccatgtaaaatacccttctcaacacaagacgaaaagggcgtaacacaaaatggaaggctcataactgcaaatccaatagttaccgataaagagaaaccagtgaatattgaggcggaaccaccattcggagaaagctatatagtgattggagcgggtgagaaagcgctcaaactatcttggtttaagaaagggagctcaataggaaaaatgtttgaagcgactgctagaggtgcaaggagaatggccatattgggtgatactgcgtgggacttcggaagtataggcggtgtttttacatcagtaggtaagctcattcatcaaatttttggtaccgcttatggcgtactttttagcggagtaagctggacgatgaaaataggcataggcgtactattaacatggttaggactgaactccagatcaacttccttgagcatgacttgcattgccgtaggactcgtgacgttatacctcggagtaatggtacaagctgattccggatgtgttataaactggaaaggaagagaactaaaatgtggatcgggaatctttgtaactaacgaagtacacacctggacagagcaatataaatttcaagccgattcgccaaaacgcctgtcagctgcaataggcaaggcttgggaggagggagtatgcggtatcagatcggcaacgaggctggaaaatataatgtggaaacaaatatcaaatgaattaaaccatatcttactagaaaacgacatgaagctaactgtagttgttggcgacgtcgccgggattcttggccagggcaagaaaatgatacgtccacaacccatggaatataaatacagctggaaatcttggggcaaggccaagataataggcgcggatgcacaaaacactacttttataattgacggacctaatacccccgagtgtcctgacgatcagagggcatggaacatatgggaggtcgaagattacggcttcggtatatttacaacaaacatatggctaaagttacgtgactcctacacccaggtatgcgatcatcgactaatgtccgcagcaataaaagattctaaagcagtgcatgctgatatgggatactggatcgagtcggagaagaatgaaacttggaaattagcacgtgcttcgttcatcgaagtaaaaacatgtatatggccaaaatctcatacactatggtcaaatggtgtcctagaatccgagatgattatccccaaaatatatggaggacccatatctcaacataattacaggccaggatactttacacaaacagctggaccttggcatctaggaaaactagaattggattttgacctgtgtgaaggaacaaccgtcgtagttgacgaacattgtggcaatagaggacctagcctaagaactaccactgtgacaggcaagattatacacgagtggtgttgcagaagctgtacattgcctcccttaagatttcgaggcgaagacggatgctggtacggcatggagataagaccagtaaaagaaaaagaagaaaatttagtaaagagcatggtgagcgcaggtagcggcgaagtcgacagttttagtttaggtttgttgtgtataagcataatgatagaagaagtgatgcgctctaggtggtccaggaaaatgctaatgactggtaccttagcagtgtttttcctcctgatcatggggcagttaacatggaatgatttaatccgcctctgtataatggtaggcgctaacgcattcgatcgaatgggaatgggaacgacctatcttgcgcttatggcaaccttcaaaatgcggccgatgtttgcagtaggtttactatttcgccgattaacttcccgcgaagttcttctgctcactattggcctgagtttagtcgcttcagtggaattacctaacagtttagaagaattaggagatggcttagctatgggtataatgattttaaaattgctgactgacttccaatcacaccagttatgggcgactttacttagtctaacattcataaaaacaactttctcgcttcattatgcttggaaaacgatggccatggtccttagtatagtttcactgttacccctgtgtttgagtacgacaagtcagaaaacaacgtggttaccagttttattaggaagtttgggttgcaaacctttaactatgtttttgatagcagaaaacaagatatgggggaggaaaagctggcctttaaacgaaggaattatggccgtcggaatagtgtcaatactactttcttcactactcaaaaacgatgttccactggcgggcccccttattgctggtggtatgttaatagcatgttacgtcatatccggctcgtcagcagatctttcgttagaaaaagccgcagaagtatcgtgggaagaagaagcagaacactcaggggcttcacataacatattagttgaagtgcaagatgacggtactatgaagattaaagacgaagaacgggatgatacattgaccatactattaaaagctactttattagcagtgtccggtgtatacccattaagtattcccgccacactctttgtttggtatttttggcagaaaaagaaacaaagaagtggagtattatgggatactccgagtccaccagaggtggaacgggctgtgctggacgatggtatatatcgtataatgcaacgaggtctgcttggacgcagtcaagttggtgttggagtcttccaagagaacgtatttcatactatgtggcacgtaacaagaggcgctgtcctaatgtatcaaggtaaaagactcgaaccatcttgggcaagcgttaagaaagatcttatatcttatggaggtggttggcgtctaagggggtcttggaatacaggtgaggaagtacaagtaatcgccgtcgaaccgggcaaaaaccctaaaaatgtccaaacagctcccgggaccttcaaaacccctgaaggcgaagtaggagctattgccctagatttcaaaccagggacatcaggcagtccaattgtgaatagagaaggaaaaatagttggattatatggcaatggcgtcgtcacaacttcaggtacttatgtttcagctattgcgcaggcaaaagctagtcaggagggaccattacctgaaatcgaagacgaagtattccgaaaaagaaatctcactattatggaccttcacccaggctcgggtaaaactagacgctacctaccagcaatagtgcgagaagccatcaaacgtaaacttagaaccctgattttagcaccaaccagagtagtcgcctctgaaatggcagaagcgttaaaaggaatgccgatcaggtatcaaacaacggcagtgaaatcagaacacacaggtaaagaaatcgtagatctcatgtgtcatgcaacttttacaatgaggttattgtcaccagttagagtaccaaattataacatgattataatggatgaagcccactttacagacccaagtagtatcgcagcccgtggatatatcagcactcgtgtaggaatgggcgaagcagcagcaatctttatgacagcaactcctccaggttcggtagaagcatttccccaatctaatgctgtaatacaagatgaagagagggatataccagagagatcatggaatagtggtcacgagtggataacagattttcctggaaaaaccgtttggttcgtgccatctattaagtctgggaacgacatcgcaaactgcctgcgcaaaaacggtaaacgagtgatacaattgagccgtaaaacattcgacaccgaataccagaaaaccaaaaataacgactgggactatgttgttacgacggatatctctgaaatgggtgcgaactttagggccgatagagttattgatcctagaaggtgcctaaaaccggttattctaaaagatgggccagagagagtaatcttagccggccccatgcctgtcacagtagcatctgctgctcaaagaagggggcgaattgggagaaatcacaataaggaaggagatcaatacatctatatggggcaaccccttaacaatgatgaggatcacgcgcactggacggaagctaaaatgttattagataatataaatacacctgaagggattatacccgcactatttgaacctgagagggagaaaagtgcggcagttgacggtgaatatcgattaaggggcgaagcaagaaaaaccttcgtcgaactaatgagaagaggggacctacccgtatggttgtcatataaggttgcgtccgaaggcttccaatactcggacagaagatggtgctttgatggcgaacgaaacaatcaagtgctagaagaaaacatggacgttgaaatatggactaaagaaggtgaaagaaagaaattgagacctagatggctggatgcacgtacatattcggaccctctagctttgagagagtttaaagaatttgcagcaggacgaagatctgtgtcaggggatcttatcttagagattggaaagctacctcaacatcttactcagcgagctcagaacgcattagataacttagtaatgctacacaattctgaacagggcggacgagcataccggcatgcaatggaagaattaccggataccatcgaaaccctcatgctattagcattaatagcagtattaacagggggagtaacactattctttctatcagggagaggtttaggaaaaacaagcatagggttactatgcgttatggcatccagcgtactactctggatggcatccgtagaaccccattggattgctgcgagcatcatacttgaatttttcttgatggttctacttattccggagccagaccgacaaagaactccccaggataaccagttagcttatgtggttatcggcctattgttcatgatactgacggttgccgccaatgaaatgggcttactcgaaaccacaaagaaagacctaggaataggccatgttgcggtagaaaatcaccatcatgcagcgatgctagacgttgacctgcatcctgcttcggcttggactctatatgcagtagcaactacaatcataactcctatgatgcgacacactattgaaaatacaacagccaatatcagcctaactgcaatagctaaccaagcggctatactcatggggttagacaagggctggcctatatcaaaaatggacataggcgtacctttattagctctcggatgctattctcaagtaaatccattaacgcttacagccgcagtcctgatgttggttgctcattacgctattattggacccggacttcaagcaaaagctactcgagaagcccagaaacggaccgccgccggaataatgaaaaaccctacggtagacggtatagtagcaattgatctcgaccctgtggtatacgacgctaaattcgaaaagcagttaggtcaaataatgctactcatactatgtacttcacaaatactacttatgaggactacatgggccctgtgtgagagcataacactggctacaggtccgctcactacgctctgggaaggcagtccggggaaattctggaacactacgatagcagtcagtatggctaacattttccgcggatcttatttagctggagccggtttagctttttcgttaatgaaatcactaggagggggacgaagaggaaccggtgctcaaggtgaaactctaggagaaaaatggaaacggcaattaaatcagctttcgaaatccgagtttaatacttataagagaagtggaattatggaggtggacaggtcagaggctaaggagggattgaaaagaggtgagacaaccaaacatgcagtatcccgtggcacagctaagctgagatggtttgttgagcgcaatcttgtcaagcctgaaggtaaagtgatagacttgggctgtggaagaggaggatggagctattattgtgcaggtttgaagaaagttaccgaagtaaagggatacactaaaggtggtccggggcatgaagaaccaattcccatggcaacatacggctggaatctggtaaagctccatagtggtaaagacgtattctttatcccaccagagaaatgtgatacgttactctgtgatattggagaatcgtcaccgaatcctacaattgaagagggtagaaccttacgggtgctcaaaatggttgagccatggctacgagggaatcaattctgtataaaaatacttaatccgtatatgccctccgtagtggaaacactagaacaaatgcagagaaaacatggcggcatgctggtaaggaaccctctatctagaaattcgactcacgaaatgtattgggttagctgcgggaccggaaacatagtttcagcggttaacatgacatcgaggatgctactcaacagattcacaatggcacaccgtaaacctacctatgaaagggacgtggatctaggaactgggacaagacacgtcgctgtcgaacctgaagtagcaaatttagacattataggtcagcgcatagaaaatattaaacatgagcataaaagtacttggcattacgacgaagacaatccgtacaagacatgggcctatcatggaagctatgaagtaaaaccaagcggttccgcatcgagtatggtcaacggagtagttaaactattaactaaaccctgggacgttatacctatggttacgcaaatcgcgatgaccgacactacaccgttcggacaacaacgagttttcaaggaaaaagtagacacaagaacacctaaagctaaacgaggtacggcgcaaataatggaagttactgcaagatggttgtgggggtttttatctcgtaataagaagccgagaatctgcacgcgagaggagttcacccgaaaagtccggtcgaacgccgccattggagccgtattcgtcgacgagaaccaatggaactccgccaaagaggcggtggaagacgagcggttctgggacttagttcaccgcgaacgtgaactacacaaacaaggtaaatgtgcaacatgtgtttataacatgatggggaagcgtgaaaagaaactcggggaatttggcaaagcaaagggatctagagcaatatggtatatgtggctgggagcaagatttctagaatttgaggcgctaggatttatgaatgaggatcactggtttagtagagaaaattcactaagtggtgtagaaggcgaaggtttacataaattaggctatatactgcgagacattagtaaaatacctggaggtaatatgtatgccgatgacactgcgggatgggacacacggataacagaagatgatctccaaaatgaagccaaaatcactgacatcatggaaccggagcatgcacttcttgccaaagcaattttcaagttgacatatcaaaataaggtggttagagtacaacggcctgctaaaaatggaacggtaatggatgttataagtaggcgagaccaacgtggaagcgggcaagttggtacgtacggactcaacacgtttacaaatatggaagcacaactcatacgtcagatggaaagcgaaggaattttctcgccaagcgaattagaaacacctaatctagctgaacgagcacttgattggcttgaaaagtatggagttgagaggcttaagaggatggcaatatccggagatgattgtgtggtaaaaccgatagatgatagatttgccacagcattaaccgcactcaatgacatgggaaaggtaagaaaagatatacctcaatgggagcctagtaaaggatggaacgattggcaacaagtgcccttttgttctcatcattttcatcaactcataatgaaagacggacgtgaaatagtcgtcccctgccgaaatcaggatgaactcgtcggcagagccagggtgtctcaaggcgcagggtggtcactcagggaaacggcgtgcttgggcaagtcttacgctcagatgtggcagttaatgtatttccaccgtagagacctcagattggctgcaaacgcaatatgttcggccgtcccagttgactgggtacctacatcaagaacgacgtggtcaatacacgcacatcaccagtggatgacaacagaggacatgctaagcgtatggaatagagtatggatagaagaaaacccctggatggaggacaaaactcatatcagcagttgggaagatgtaccataccttggaaaacgagaggatcagtggtgtgggtcgcttattggattaaccgcaagggctacttgggcaacaaacatacaagtagcgatcaatcaagttaggagattaataggaaatgaaaattacctagactacatgacttcaatgaagagattcaagaatgagagcgacccagaaggagctttatggtaa

SEQ ID NO: 21679 - RNA, 9879 nt, synthetic construct
  misc_feature 1..9879: note = derived and/or modified CDS sequence (opt6) from DENV-1__GQ199801__SS-prME
  source 1..9879: mol_type = other RNA
tcggtgacaatgttattaatgttaatgccaacagccttagcctttcatcttacaacacgtgggggagaacctcatatgatagtcagcaaacaagaacgaggaaaatcattactattcaaaactagcgccggtgtaaacatgtgtacattaatagcaatggatttaggtgaactatgtgaagacacaatgacatataaatgtccaagaatcactgaagcagaaccagacgacgtggattgctggtgtaacgcgacagatacatgggtaacatacggtacatgttcacaaacaggagaacacaggcgtgataaaagatcagtagcacttgctccccatgtaggactaggattagaaacacgaactgaaacgtggatgagttcggaaggagcctggaaacagatacaaagagttgaaacttgggcactacgccatccaggttttactgtcattgctcttttcttggcccatgcaataggaacgtctatcacccaaaaaggaattatctttatacttcttatgcttgtaacaccctccatggcaatgagatgtgttggtatcggctccagggattttgtcgaaggactttcaggcgctacatgggtcgacgtagtactagaacatggatcatgtgtaactacaatggcaaaagataaaccaaccttagatatagaactactaaaaacagaagtaacaaatccggcggtactgaggaaattatgcatcgaagcaaaaatctctaatacaactactgactctagatgcccaacacagggcgaagcaacgctagtggaagaacaggacgcaaacttcgtgtgtaggagaacgtttgtggaccgaggctggggtaatgggtgcggtcttttcggaaagggatccttaataacttgtgcaaaatttaaatgtgtaacccgattagaaggtaaaatagtacaatacgaaaatctaaagtattctgtcatcgtcacagtacataccggtgatcaacatcaagtggggaacgaatcaacggaacatgggacaactgcaaccatcacaccacaggctccatctacagaaattcagctaaccgattacggagcccttacactagactgttcaccacgaactgggctcgattttaatgagatggtgctattaactatgaaagaaaagagctggctggtacacaaacagtggtttctggatctacctcttccgtggacctcaggcgcttccacaagccaggaaacttggaataggcaagatctactggtaacatttaaaaccgctcatgctaagaaacaagaagtcgtagtcctcggctctcaagaaggcgcaatgcacaccgcgttaacaggtgctactgagatacaaacaagtgggacgacaactattttcgcaggacatttaaaatgccgtctaaaaatggataagctaacactaaagggcatgagttacgtcatgtgcactgggagttttaaattagaaaaggaagtagcggaaacacagcacggaactgtgctagttcaaataaagtatgaaggcacggatgctccatgcaaaattccatttagtactcaggacgaaaaaggggtgacccaaaatggcaggctcataacagctaatcccattgttactgataaggagaagcctgtgaacatagaagctgaaccaccttttggagagagttacatagtgatcggtgccggagaaaaagcattaaaactctcttggtttaagaagggttcatcaattggcaaaatgttcgaagcaacagctcgtggcgcacgtagaatggccatattaggagacacagcttgggatttcggtagtatcggtggagtatttacttcagtagggaagctagtgcaccaaatatttggaactgcctacggggtattgttttccggtgtgtcatggaccatgaaaataggcataggagtgctgctgacctggctaggactgaactccagatcaaccagtttaagcatgacatgtattgcggtgggactggtaacgctctatctaggtgttatggtccaagctgattcagggtgcgttattaattggaaaggccgagaactaaagtgcggctcaggaatattcgtcactaatgaagtacatacttggacagaacagtataaatttcaggcagatagccccaagcgactatctgctgccataggtaaagcatgggaggagggcgtatgtggaattagatcggcaacaaggctagaaaacataatgtggaaacaaatcagtaatgaattaaatcatatactacttgaaaacgatatgaaattcacggtcgttgttggagatgtcgctgggatcttagcacaaggtaagaaaatgataagaccgcaacccatggagtataagtattcatggaagtcttgggggaaagcaaagataataggtgcggacgtacaaaatacaaccttcattattgatggacctaatacaccagagtgtcccgatgatcaacgggcatggaacatttgggaagttgaagattatggattcggcatatttacaacaaacatatggcttaaactcagagattcttatacacaagtgtgcgaccatagattaatgtccgcggcaataaaagactctaaggccgttcacgctgatatggggtactggatagaaagtgagaaaaatgaaacgtggaaactagcaagagccagctttatagaagtaaaaacatgcatctggcccaaatcacatacgctatggtcaaacggtgtactagagtccgaaatgataataccaaaaatctacgggggaccaatctcccaacataattatcgaccaggttactttactcagacggcaggaccgtggcacttagggaagttggaacttgatttcaatttatgtgaaggaaccactgtggtagttgatgagcattgtggcaaccggggtccctctctgcgaactaccacggtgacaggcaaaataatacacgaatggtgttgcagatcctgtactctcccaccattacggttcaaaggtgaagacgggtgttggtatgggatggaaataaggccggtgaaggagaaagaagaaaacttggtcaagagcatggtaagcgctggctctggagaagtggattcatttagcctcggattattgtgcataagtataatgattgaagaagtgatgcgttcgagatggagcaagaaaatgctaatgaccggcacattagcagtattctttctactaataatgggacaactcacatggaacgatttaatacgactttgcataatggtgggtgctaacgcttcagaccgaatgggtatggggacaacttatttggcgctcatggcaacttttaagatgagacctatgctagcagtggggttgctttttcgtagactaacaagtcgagaggtgctattactaacaataggattaagtttagtagcaagtgtagaactaccaaatagcctagaagaactaggagatggactagcaatgggaatcatgattctaaagctgttaacagatttccaatcacaccagttatgggctacattgctgtcactaacctttataaaaacaacatactctctgcactacgcatggaagactatggccatggtactaagtatagtctcgctttttccactatgcctatccacgacgtcccagaaaactacttggctaccggtgttacttggatcactgggatgtaaaccattaactatgtttctgatagctgaaaacaaaatatggggaagaaagagttggcctctcaacgaaggtattatggctgtagggatagtttcaatattgctaagcagtttactcaaaaacgacgtgcctctggctggaccgctcatcgctggaggtatgcttatagcatgttacgtgatttctggatcctcagcggatctatctttagaaaaagcagcggaagtaagttgggaagaggaagccgaacatagtggagcctcacacaatattcttgtcgaagtccaggatgacggcaccatgaagatcaaggatgaagaacgagacgatacactgacaatactattgaaagcgacgttattggcagtttctggtgtatatcccttatcgatcccagcaacattatttgtgtggtatttctggcagaagaagaaacaaaggtccggcgtattgtgggacacacccagtccgccggaggtcgaaagagcggtactggacgacgggatatatcgaattatgcaacgagggttactaggtcgatctcaagtgggggtcggagtatttcaggaaaacgtctttcacaccatgtggcacgttacgcgaggagcagttttaatgtatcagggaaaaagattggagccttcatgggcaagcgtaaagaaagacctgataagctatggtggcggatggagattacaaggtagttggaacacgggtgaggaagttcaagtaatagcagtagaaccaggtaaaaaccccaaaaacgtacaaacagctccaggcaccttcaagacaagtgaaggagaagttggagctattgcacttgatttcaaacccggaaccagtggttcacccatagtgaacagggaaggaaaaatagtcggcctctacgggaacggagtagttacaacgtcgggtacatacgtaagtgcaattgcacaggcaaaagcctcacaagaaggccccctgcccgaaattgaaaatgaggtttttagaaagcgaaatttaacaataatggacttacacccgggtagcgggaagacaagaagatacctaccggctattgttcgagaagcaattaagagaaagttacgaaccctcatactagctcctacaagagttgtcgcgtcagagatggcagaggcattaaaagggattccgatacgttatcaaacaacggccgttaaaagtgagcataccggcaaagaaatcgttgatctaatgtgtcatgccacctttaccatgagattactttcccccgtgagagttccaaactacaacatgataattatggatgaagctcactttaccgacccctccagtattgcagcaaggggatacatctccacacgcgtagggatgggtgaagctgcggcaatttttatgactgcaacacctccgggatcagtagaagcatttccacaatcgaacgctgtgatacaggatgaagaaagagatattccagaacgttcctggaactcaggatatgaatggattacggacttcccaggaaaaactgtgtggttcgtaccgagtataaagtcaggaaatgacatagctaattgtttacgtaagaatggtaaaagggtcattcaactaagtaggaaaacgtttgacacagaatatcagaaaactaagaacaacgattgggactacgtggttacaacggatatatcagagatgggagctaattttagagctgatcgagtcatagacccaagaagatgcttaaagccagttatattaaaagatggccctgaacgagtaattttagcaggcccaatgccagtaacggtagcaagtgcagcccaaaggaggggaagaataggacgaaaccataataaagaaggtgatcaatatatttatatgggtcaaccgttaaacaacgatgaagaccatgcacattggactgaagcaaagatgctgctagacaacattaataccccagaaggtataataccagcgcttttcgaacctgaaagagagaaatctgcagcaattgacggggaatacagattaagaggtgaggcaagaaaaacgtttgtggaactgatgagaagaggtgatctaccagtctggctaagttataaagtggctagtgaaggatttcaatactcggacagaagatggtgctttgatggggagcgtaacaaccaggtattagaagaaaatatggatgtagaaatatggacaaaagaaggggaacgaaagaaattacgtccaaggtggctagatgctcgtacgtactcagatcctcttgccttaagagaatttaaagaatttgctgcggggcgacgctccgtgagcggtgatcttatccttgaaatagggaaactcccacaacacttaacccaacgtgctcaaaatgctctagataatttggtaatgctacataactcagaacaaggtggtcgggcttaccggcatgctatggaggaactacccgacacaatagaaaccttaatgctgcttgctctgatcgcagtattaaccggaggtgtaacgttattctttctctccggaagaggtcttggaaaaacatctataggattgttatgtgtaatggcctcaagcgttttgttatggatggcttctgttgaacctcactggatagccgcatcaattatccttgagttcttcctaatggtactattaattccggagccagatagacaacggacgcctcaagataatcaactggcatacgtggtaataggacttttattcatgatattaactgtcgccgccaacgaaatggggttgttagaaacaaccaagaaagatcttggaatcggacatgttgcggtagaaaaccatcatcacgcagctatgctagatgtagacctacaccctgcctcagcttggactctatatgcagtagcaactacaattatcacccctatgatgcggcatacgattgaaaatactacagcgaatatctctttaaccgccatcgcaaatcaggcagctattttaatgggattggacaaaggatggcctatatcgaaaatggatataggagtcccactactcgcacttggatgctactcccaagttaatccacttactttgactgctgccgtattaatgttggtagcccattatgcaattataggaccaggtctacaagctaaagctacgagagaagcccagaaaaggaccgcggcaggaattatgaaaaatccgacagttgatgggatagtagctatagatcttgaccctgttgtctatgacgcaaaattcgaaaagcagttgggccaaataatgctattaattttatgtacatcacaaatattattaatgcgaactacctgggccttatgcgaatcaatcacactcgccacaggaccactaacaacactatgggaagggtcaccaggtaaattttggaatactacaatcgccgtttccatggctaacattttccgtggaagttatctagctggtgcagggttagcattttctctaatgaaaagtttgggaggcggaagaagagggaccggagctcagggggagacattaggggaaaaatggaaacgacaattaaatcaactaagcaagagcgagttcaatacctacaaaaggagcggaatcatggaagtcgatcgttcagaggcgaaagaaggcctaaaacgaggagaaactactaaacatgcggtctctcggggcactgcaaaacttaggtggttcgtcgaaaggaacttggtaaaaccagaaggaaaagtcattgacctaggttgcggacgaggtggttggagttactattgtgcggggctcaaaaaggtaacggaggtaaaaggctacaccaagggcggtccaggtcatgaggagccaatccccatggctacatacggttggaacttagtaaaattacatagcggaaaagacgtattctttattccgcctgagaaatgtgacacattgttatgtgatattggagagtcatcgccgaacccaacaatagaagaaggacgaaccctaagagtattaaagatggtggagccatggctcagaggtaaccaattctgtataaagatattaaacccctacatgccatcagttgttgaaactctcgaacaaatgcaaagaaaacatgggggaatgctcgtacgcaacccgttatcacgcaatagtacacacgagatgtactgggtctcatgtggtacaggaaatatagtcagtgccgtaaacatgacgtctagaatgcttttaaatcggtttactatggcccatcgtaaacctacgtatgagagggatgttgatttaggggccggtacacgtcatgtcgcagtggagccagaagtcgcaaatcttgatataattggacaacggatagaaaatataaaacacgaacataaatcgacttggcattatgatgaagataacccttataaaacctgggcataccatgggtcttatgaggttaaaccaagcggaagtgcaagtagtatggttaacggagtcgtgaaactattgaccaaaccctgggacgtaattccaatggttacacaaatcgctatgacggatactactccttttggacaacaacgtgttttcaaagaaaaggtagatacacgcacacccaaagctaaaaggggaacagcacaaatcatggaagtcaccgcgaaatggctatggggatttcttagtcgaaacaaaaagccacgaatatgcacccgagaagaatttacacgtaaagtaaggtctaacgcagcaattggggcggtcttcgtagatgaaaatcaatggaactccgctaaagaagcggtcgaagatgagagattctgggaccttgtccatcgagaacgcgaactacataaacaaggcaaatgtgctacctgcgtttacaatatgatgggtaaaagagagaagaaattaggtgagttcggcaaagcaaagggatctagagctatctggtatatgtggctaggggccagatttttggaatttgaagcattgggatttatgaacgaagatcactggttctctagagagaactcattatcaggtgtagaaggagaaggactgcataaattgggctacatcctgagagatatatccaaaatccccggcggcaacatgtatgcagacgatacagctggatgggacaccagaattacagaagatgatttacagaatgaggcaaagataacagatataatggagccagaacatgcactactcgcgaagtctatctttaaattgacctatcaaaataaagtagtacgagtgcagcgaccggcgaaaaatggtaccgtaatggacgtaataagtaggagagatcaacgagggtctggccaagtgggaacttatggccttaacaccttcactaacatggaagctcaattaatacgtcaaatggagtcggagggaatcttcagccctagcgaactcgagaccccgaatttagccggacgagttttagattggctggaaaaacacggggttgagcgactaaagcgaatggctattagtggcgatgattgtgtagttaagccaatcgatgacagatttgcaacagctcttacagcattaaatgacatgggaaaagtacgcaaagatataccacagtgggaaccaagcaagggctggaatgactggcaacaggtacctttctgctcgcaccattttcatcaactaataatgaaggacggcagagaaatcgtagtaccgtgcagaaaccaagacgagctagttgggagagctcgagtaagtcagggtgcggggtggtcattgagagagacagcgtgcttaggaaaaagctacgcgcaaatgtggcaactaatgtactttcacagacgtgatctacggttagcagccaatgcaatatgtagcgcagtacccgtagactgggttcccacatcgagaaccacgtggtccatccatgcacaccaccaatggatgacgactgaggatatgctatccgtctggaatagagtatggatcgaagaaaatccatggatggaagacaaaacccacatttcatcttggggagatgttccttatttaggaaaacgggaagatcaatggtgtgggagtctaataggtctaaccgcgagagcaacttgggcaacgaacatacaggtagctataaatcaagtacggcgcttaatcggaaacgagaattacctggactatatgacaagtatgaagaggttcaaaaatgaatccgaccccgaaggggccttatggtaa

SEQ ID NO: 21680 - RNA, 9879 nt, synthetic construct
  misc_feature 1..9879: note = derived and/or modified CDS sequence (opt6) from DENV-1__GQ199802__SS-prME
  source 1..9879: mol_type = other RNA
tcggtgacaatgctattaatgctcatgcccacggcattagctttccacctaacgactagaggtggtgagccacatatgatagtttccaaacaagaacgtggaaaaagtctactttttaaaacatccgctggggttaatatgtgtacgcttatagcaatggatttgggtgaactatgtgaagacacaatgacatataaatgcccaagaattacagaaacagaacccgacgacgtagattgttggtgcaacgccacggacacttgggtaacttatggcacgtgctcacaaacaggagaacatagaagagataaaagatctgtcgcattagcaccgcacgtaggtctaggattagaaacccgcacagaaacatggatgtcctcggaaggtgcatggaaacaaatacaaagagtagaaacatgggcgctgcggcatccgggtttcaccgtaatagctcttttcctcgcgcacgcaattggtacatcaataactcagaaaggtataatatttatactactaatgttagttactccaagtatggcaatgagatgtgtaggaattgggtctcgtgatttcgtcgaaggattatctggagcaacatgggtggatgtagttctcgaacacgggagctgtgtaaccacaatggctaaagacaaacctacccttgatatagagttattgaaaaccgaggttaccaacccagcagttttgcgtaaactttgtatagaggctaaaatcagtaatacaacaactgacagtaggtgcccaacccaaggagaagcaactctagtagaagaacaggatgcgaattttgtatgccgaagaacattcgtggataggggatggggaaacggatgtgggttattcggaaaaggatccctcatcacgtgtgccaaattcaaatgtgtgactaaattggaagggaaaatagttcaatatgaaaatcttaaatattcagtaatagtcactgttcacactggagatcaacatcaggttggaaatgaatctactgaacacggtactacagccacaattaccccgcaagcgccaaccacagaaatacaattaacagactacggagccctaactctggattgctctccgagaaccggtctagactttaatgaaatggtcttgcttacaatgaaagaaaaatcttggctggttcataaacaatggtttctggacttaccacttccctggacaagcggagcctctacttcacaggaaacatggaatcgacaagatttattggtaactttcaaaactgcacatgccaagaaacaagaggtagttgtactcggatctcaagaaggagctatgcatacagcattaactggagccactgaaatccagacaagtgggactacaactatattcgcaggccatctgaaatgcaggttgaaaatggataaactaacgcttaaaggaatgtcatatgtcatgtgcacaggaagttttaagttagagaaagaagtcgcagaaacacaacatggtaccgtattggttcaaatcaaatacgaaggtaccgatgctccctgtaagataccattttctacgcaagatgagaaaggagttacacaaaacggcagactgatcacagccaaccctattgtaacagataaggaaaagccagtaaatattgaggcagagccacccttcggcgaatcttatatagtaattggtgccggtgaaaaggcgcttaagctatcctggtttaaaaagggctcatcaatagggaaaatgtttgaagctaccgccagaggagcacgaagaatggcgatactaggagatacagcgtgggattttggatcgataggaggagtttttacttcagtcggcaaattagtacatcaaatatttggaactgcatatggggttctcttctccggagtttcatggactatgaaaatagggatcggagtcctattaacatggcttgggctaaatagtcgatcaacatcgctgtcgatgacttgcatcgcagtagggcttgtcaccctgtacttaggtgtaatggtacaggctgattccggctgtgtaattaattggaaagggagggaattaaaatgcggctctgggattttcgttactaacgaagtccacacttggacagaacagtataagtttcaggcggacagccccaaaagacttagtgccgcaataggaaaagcatgggaagagggagtctgtggaataagaagcgctactcgacttgaaaatataatgtggaaacaaatctccaatgaactaaatcacatacttttagaaaatgatatgaaattcactgtagtggttggggacgttgccgggattctagcgcagggaaagaagatgatcagaccacagccaatggagtacaagtacagttggaaaagctgggggaaagcaaaaataattggagccgacgtacaaaacacaacatttattatagatggacccaacacaccggaatgtcctgacgaccagagggcctggaacatatgggaggtagaggattacgggttcggtatattcacaaccaacatctggctaaaattaagagacagttatacacaagtatgtgaccataggctaatgtcggcagcaattaaagactccaaagcagtacacgctgatatgggatattggatagaatctgagaaaaatgaaacttggaaactggcaagagcatcatttatagaagtaaagacatgtatatggcccaaaagccacacactatggtctaatggagttcttgagtccgagatgattattccgaagatttatggaggtccaatttcacaacataactatcgcccagggtatttcacacaagccgcaggaccttggcacctaggcaaactggaattagattttgatttgtgtgaaggaacaactgtagtagtcgacgaacattgtggtaaccgaggcccttcattacgtactacaaccgtaaccggtaaaataattcatgaatggtgttgtcgttcatgcacactaccacctcttcggttcaaaggagaggatggatgttggtatggaatggaaatacggccagtaaaagaaaaggaagaaaacctcgtcaagtcaatggtgtcagctggatctggggaagttgattcctttagtctgggtctactatgtatttccataatgatagaggaagtcatgcgttcccgctggagtagacgcatgttaatgacaggcactctggcggttttctttttgcttataatgggacaactaacgtggaacgatttaattagactttgcattatggtcggtgcgaatgcatcggaccgaatgggtatgggtacaacgtatcttgctttgatggctacctttaaaatgagacctatgttcgctgttggcctattgtttcgccgccttacctcaagagaagttctattactaacgatcggtttgtcattagtagcatccgtcgaacttcctaatagtttggaagaactcggagacggcctcgccatgggtataatgatactaaagctattgacagattttcagtctcatcaactatgggctacacttttgagtctaacttttataaaaaccacgttttccctgcattatgcctggaaaaccatggctatggtcctatcaatagtaagcctattcccactctgtctgagtacaacttcccagaaaactacctggttgccggttctattgggatccttaggatgtaaacctctaacaatgtttctgatcgcggagaataaaatttggggaagaaggagttggccattaaatgaaggcataatggcggttggaatagtgagtattttgttaagtagcctactaaagaatgatgtaccattagccggacctttaattgcaggagggatgttaatagcatgctatgtaatctcaggatcctcagcagatctcagcttggagaaagcagctgaagtgagctgggaggaagaagcggaacactcaggcgcttcacacaatatcctagtagaagttcaggacgatggtactatgaaaataaaggacgaggaacgagatgatacattaacgatactcctaaaggcaacattgctagcggtaagcggggtttatccactcagtattccagctacactgttcgtatggtacttttggcagaagaagaaacaaagaagcggagtcctttgggatactccttcaccgccagaggttgagcgcgctgttctggacgacggaatctatcgtataatgcaacgaggtttgttaggacggagtcaagtaggtgtaggagtgttccaggaaaacgtatttcacacaatgtggcatgtcaccagaggcgccgtcctaatgtatcagggtaagagactggaacctagttgggcttcggtcaagaaagatttaatttcctatggtgggggttggaggttgcaggggagttggaacacaggtgaagaagtacaagttattgccgttgagccaggcaaaaatcctaagaacgtgcaaacagcgccaggaacgtttaaaactcctgaaggagaagtaggagctattgcacttgacttcaaaccaggtacgagtggttctcctatcgtgaacagggaagggaaaatagtcggattatatggaaatggagttgtcacgacctcaggtacttatgtatctgccatagcacaagcaaaagcatctcaagaggggccgctaccagaaatcgaagatgaagtattccggaaacgaaatctgactataatggatttgcatcctgggagtggtaaaacgaggcgctatttacccgcgatagtacgagaagctataaaaagaaaactaaggaccctaatattagctccaactagagtggtagcctcagaaatggctgaggccttaaaaggtatgccaataagatatcaaacaacggccgtcaaatctgaacacacaggaaaagaaattgtggatctaatgtgtcacgcaaccttcacaatgagactactgagtccagtccgggtacctaattacaacatgattataatggatgaggcacattttactgacccaagttctatagctgcgcggggatacattagtacgagagtaggaatgggagaagctgcagcaatatttatgactgcgactccaccaggatctgttgaagcctttccgcagtcaaatgcagtaatccaggatgaggaaagagacatccctgagcgatcatggaactcaggatatgagtggataactgattttccaggaaaaacagtttggtttgttccatcaataaagtcaggcaatgacatagcgaattgtctgaggaaaaatggcaagcgagtcatacaactgtcaagaaaaacctttgatacagaataccaaaagactaaaaataacgattgggactacgtagtaacgacagatatatccgagatgggagcaaattttcgcgctgatcgggtaatagatccccgaagatgtcttaagccagtaattctaaaagatggacctgaacgtgtaattttagcgggaccaatgccggtcacagttgcgtcagcagcacagagacgcggacgcatagggaggaatcataataaagaaggagatcagtacatttatatgggacaacctcttaacaatgatgaagaccacgcacactggacagaagcaaaaatgttgttagataacataaatacacctgaaggtataattccagctttatttgaacccgaacgcgaaaagagcgcagccatagacggagaatacagactaagaggagaggcaagaaaaacttttgtcgaactgatgagacgcggagacttaccagtttggcttagttacaaagttgcttcagaaggatttcaatattctgacagaaggtggtgtttcgatggtgagagaaataaccaagtcttagaagagaatatggatgtagaaatttggaccaaggaaggtgaaaggaagaaattaagaccaagatggctagacgcgcgcacatacagcgacccactggccttacgtgaatttaaagaatttgctgcaggcagaaggtcagtttcaggcgatttgatcctcgagattggcaagctaccccaacacctaacacaacgggctcaaaatgcacttgataacctagtaatgttacataacagcgaacagggtggacgtgcataccgacacgcgatggaagaacttccagacacaattgaaacactaatgttactggcactcattgcggttcttactggaggggtaacacttttctttttaagcggtcgaggacttggaaaaacttctataggactcttgtgcgtaatggcctcttcggtattgttatggatggctagcgttgaacctcattggattgcagcaagtataatcttagaatttttccttatggtacttctcattcccgagccagacagacaaagaacgccacaggataaccagctggcgtatgtcgttattggcctcctatttatgattctaacagtagcggccaatgaaatgggtttattagaaacaaccaagaaagacttaggtataggacatgtagccgtagaaaatcatcatcacgctgcaatgctggatgtagatcttcatccggctagtgcatggacgttatatgcagtcgcaaccacaattataactccaatgatgagacatacgattgagaacacaactgctaatatctcattaactgcaatcgctaaccaagccgctatactaatgggactggataagggatggccaatttctaagatggatattggtgtgcccttattagctctgggttgttactcacaggtcaaccccctgacactaacagcagcggtactaatgctagtagctcactatgcaattattggtcctggcttgcaagcaaaagcgacgagggaggctcagaaaagaacagctgcaggtataatgaaaaatccaacggttgacggtatagttgccattgatctggacccggtcgtttatgacgctaagtttgagaagcaactgggtcaaataatgcttctgattttatgcacaagtcaaattctattgatgcggacaacttgggcactatgtgagtcgattacactcgctaccggacctttaacaacgttatgggaaggctcgcctggaaaattttggaatactacaattgcagttagtatggctaacattttccgaggatcttatttggccggagcaggacttgcgttctcattgatgaaaagcctgggtggagggcgacgtgggacaggggctcaaggagaaaccctgggagaaaagtggaaaagacaactaaatcaactatcaaagagcgaatttaacacttataaaagatcaggaatcatggaagtagatagatcagaggcaaaggaaggcctcaaaaggggtgaaacaactaaacatgctgtctcaagagggacagcgaaacttcgctggtttgtggaacggaatttggtcaaaccagaaggaaaagtaattgatctaggctgtggacgaggtggatggtcatattactgtgccgggctgaagaaagttactgaggtaaaaggatatacaaagggtggtcctgggcacgaagaacctatacccatggcaacttatggttggaatctagtaaaacttcactcaggaaaagatgtattctttataccgcctgagaaatgtgatactctactatgtgatatcggcgagtcttcacctaacccaaccattgaagagggacgaacgttaagggtcttaaaaatggtagagccgtggttgagaggaaaccaattctgtatcaaaatcctcaacccgtacatgccaagtgtcgtagagactcttgaacaaatgcagcgaaaacacggcggcatgctagttcgcaatcccctttctagaaactctacccatgagatgtactgggtatcctgcggcactgggaatatagtttcggcagttaatatgacttcaagaatgttgctaaaccgattcactatggctcaccgcaaaccaacctacgagcgagacgtagaccttggagccggaactaggcatgtagctgtagagcccgaggtagccaatttggatataatcggacaaaggatcgaaaatattaaacacgaacacaaatcaacatggcattacgatgaagacaacccctacaaaacgtgggcctatcatggtagctatgaagttaaaccctcgggatccgcgtccagcatggtaaatggcgttgtaaagttattgacaaaaccatgggatgttattccgatggttacgcaaatagctatgacggacactaccccttttgggcagcagagggtgttcaaggagaaggtggatacaagaacgccaaaagcaaaacgtggaacagcacagataatggaagtaacagcaaaatggctgtgggtctttctatctcgcaataagaaaccaagaatatgtacaagggaagaatttacacggaaagtacgatcaaatgctgcaattggagccgttttcgtagatgaaaatcaatggaacagcgcgaaagaagcagtagaagatgaacgattctgggatctagtacatcgggaacgggaattgcacaaacaaggaaagtgcgccacatgtgtgtacaatatgatgggcaagcgtgagaaaaagctcggggaatttggaaaggcaaaaggaagtcgtgcaatctggtacatgtggctaggagcacgattcctcgaatttgaggccctagggttcatgaacgaggatcactggttttcacgtgaaaacagtttaagcggtgtagaaggtgagggattacataagctagggtatatccttagagacatatcgaaaatacctggaggtaatatgtacgcagacgacacagcagggtgggatacgcgtatcacagaagatgacctccagaatgaggcaaggataacggatataatggaacctgaacatgcgttactagctaaatctatattcaagttgacctaccaaaataaagtagtgagagtacagcgaccagcaaagaatggcactgtaatggatgtaatctccaggcgcgatcaacgaggctcagggcaggtaggaacttacggtctcaacacgttcactaatatggaagcccagttaattagacaaatggaaagcgagggaatattcagcccatcagaacttgagacacccaatttggctgaacgagtgcttgactggctcgaaaaatatggtgtagaaagattaaaacgaatggccatttctggggatgattgtgttgttaagccaatagacgacaggtttgcaaccgcgctaacggcgttaaatgatatggggaaagtacgaaaggacataccacaatgggagccctctaaaggctggaatgattggcaacaagtaccgttttgttctcaccattttcatcaactcattatgaaggacgggcgagagatagtagtaccttgccgaaatcaagatgagttggtgggtagagcaagagtttcgcaaggagcgggttggtcgctcagggaaactgcgtgcctaggtaaaagttatgcacaaatgtggcaattaatgtattttcatcgtcgagacctaaggctcgctgcaaatgctatttgttctgccgtacctgtagactggatccctacctctagaaccacatggtccattcatgctcatcaccaatggatgacaacggaggatatgctttcggtatggaacagggtatggattgaagaaaacccgtggatggaagataaaacacatatatctagttggggagatgtaccatacttaggaaaaagagaagaccaatggtgcggatctctcattgggctcacagcccgtgccacgtgggccaccaatattcaggtagccataaaccaagttcgacgattaattggtaacgaaaattacctggattacatgacgtcaatgaaaagattcaagaatgagagcgatccagaaggagcgctatggtga

SEQ ID NO: 21681 - RNA, 9879 nt, synthetic construct
  misc_feature 1..9879: note = derived and/or modified CDS sequence (opt6) from DENV-1__JF937597__SS-prME
  source 1..9879: mol_type = other RNA
agcgtaactatgctgttaatgctaatgcccacggctctagcattccatttgactactagagggggtgaaccccatatgatagtatcaaaacaggaaaggggcaaatcgttattattcaaaacaagcgcaggcgtaaatatgtgcactttaatagctatggatctaggcgaactttgtgaagatactatgacttacaaatgtcctagaattactgaagcagagccagatgacgtcgattgttggtgtaacgccactgacacatgggtaacatatggcacatgttcccaaaccggagagcaccggcgtgataaaagaagcgtagctctcgcaccacacgtcggcttagggctcgaaactagaaccgagacatggatgagttcggaaggggcttggaaacaaatacaaagagtagaaacttgggcactacgacatcccggatttactgtgatagctttgttccttgcccacgcgattggaacatcaataacacaaaaaggaataatatttatactactcatgctcgtaaccccatcgatggccatgaggtgtgtcggaataggttctagggactttgttgaaggcctatcaggagctacctgggtagatgtagtattggaacatggaagctgcgtgacaactatggcgaaagataaacctacactggatatagaacttctgaaaaccgaagttacaaaccctgcggtattaagaaaactctgcatagaggcaaaaatatcaaatacaactacagattcaagatgtcccacgcaaggtgaagcaactctagtcgaagaacaagatgcaaactttgtttgccgtaggactttcgtagatcgcggttggggcaatggatgtggtttgtttggaaaaggaagcctaataacatgtgccaaatttaaatgtgttactaaacttgagggcaaaatcgttcaatacgaaaatctaaagtattcggtcatagtcactgtgcatactggagatcaacaccaggtcggtaacgaaagcactgaacatggtaccacggcaaccataaccccgcaagcaccaaccactgaaatacaattaacggattatggagcattaaccttggattgttcaccacgtacaggtctagactttaacgaaatggttttgttaacaatgaaagagaaaagctggttagtacataaacaatggttcttagaccttcctttaccatggacttccggagcgagtacttctcaagaaacctggaatagacaagacttgctcgttacctttaaaacagcacatgcaaagaaacaagaggtcgtggtcttaggaagccaagaaggagcaatgcatactgcgttgacaggagcgacagagattcaaaccagtggcactaccaccatatttgctggccacctaaagtgtagactaaaaatggacaaattgacattaaaaggcatgtcatacgttatgtgcacaggatcgttcaaattagaaaaagaggtagcagagactcaacatgggacagtcttagttcaaatcaaatatgagggcaccgatgcgccatgtaaaatcccatttagtactcaggatgaaaaaggagttacccaaaatggaagactaataacagcaaacccaatagtcacagataaagaaaaacctgtgaacatagaagccgaacctccttttggagaatcatatatcgtgattggagcaggggaaaaggcacttaaacttagttggtttaagaagggatctagcataggtaagatgtttgaagctaccgccagaggagccagaagaatggcaattcttggtgacactgcatgggatttcggtagtattggtggagtatttacaagcgtaggtaagttagtccatcaaatttttggcactgcttatggagttctatttagtggggtaagctggacgatgaaaattggtataggtgttctgttaacttggctaggtttgaactcaagaagcacaagtctaagtatgacatgtatcgcggtcggtttagtgacactctatcttggagctatggttcaagccgatagcgggtgtgtcataaattggaaaggccgagaactcaagtgtgggtctggaatatttgttactaacgaagtgcacacctggacggaacaatacaaattccaagctgattcacccaaacgcttgagcgcagcaatcggaaaggcttgggaagaaggagtctgtggaatacgatcagcaacgcgattagaaaatataatgtggaaacaaatatctaacgaattaaatcacattttactggaaaatgacatgaaacttacagttgtagtgggagatgttgcgggaatactgggacagggtaagaaaatgataagaccacaacccatggaatataagtatagttggaaaagttggggtaaagcgaagattattggagctgatgcacaaaatactacttttatcatagacggacctaacacgccagaatgtccagacgaccaaagagcctggaatatatgggaggtagaagattacgggtttggaatatttactacaaacatctggttaaaattgagggatagttacacccaggtttgtgatcaccgattaatgtctgctgctataaaagatagcaaagcagtacacgcggacatgggttactggattgagtcggaaaagaacgaaacctggaaactagcgagagctagttttatagaagttaaaacatgcatatggccgaaaagtcatacattatggagcaatggtgtcctcgaatcagaaatgataatcccaaaaatatatgggggtcccatctcgcaacataattatcgaccgggatactttactcaaaccgctggaccatggcatcttggaaaactggaacttgactttgacctgtgtgaaggaaccacggtcgttgtagatgaacactgtggaaatagaggtccttcattgaggacaacaacggtaacaggaaagataattcatgaatggtgttgtagatcatgtacgctaccacctctgagattcagaggcgaggacggatgttggtatggtatggagatacgaccagttaaagaaaaagaagagaacctagtaaaaagcatggtatcagctggatccggggaagtcgattccttctcacttggattgctatgtatatcaatcatgattgaggaagtaatgcggagtaggtggagtcgtaaaatgttaatgacaggaactcttgcagtattctttcttcttattatgggacaactaacttggaacgacctgattcgtctatgtattatggttggagcaaatgctagcgacagaatgggtatgggtacgacatatttagcgttaatggcaacttttaaaatgagaccaatgttcgcagtaggattgctctttcgaagactaacgagccgcgaagtgttgcttcttaccataggtttaagcctagtagcaagtgttgaacttcctaactccttagaggaactgggggatggtttagccatgggcatcatgattctaaaacttctcacagattttcaatcgcatcaattatgggccacactattgtcactcacatttataaaaacgaccttctccttgcactacgcatggaagacaatggcaatggtcctttctatagttagcttatttcctctatgtctgtccacgacttcacaaaagacaacgtggttacccgtgctgttaggttcgctagggtgtaaaccccttacaatgttcctcatagcagaaaataagatctgggggcgtaaaagttggcccttaaatgaaggaataatggcagtcgggattgtaagcatactcttatcttcgttgctcaaaaatgacgtacctttagccggcccgttaatagcgggaggtatgttaatcgcatgttacgtcatttcagggtcgtctgcagatctgtcactggaaaaagcagctgaagtttcctgggaagaagaagcggaacattctggggcatcacataatatcctagtagaagtgcaagacgatggtaccatgaaaataaaagatgaagaacgcgatgatactctaacgatattgttaaaagcgactctattggccgtttctggcgtctatcctctgagcattccagccactttatttgtgtggtatttctggcagaagaagaaacaacgtagtggggtattgtgggatacaccgagcccaccagaagttgaaagagcggttttagacgacggaatctacagaataatgcaaaggggactcctgggtaggtctcaagtaggagttggagtgtttcaggaaaatgttttccacactatgtggcacgtcactagaggagccgtattaatgtaccaaggcaagagattagaaccttcatgggctagtgtgaagaaagatctaataagttacgggggtggatggagacttaggggatcatggaatacaggagaagaggtacaagtaatcgcagtggaacctggtaaaaaccccaaaaatgttcaaacagcccctggaacttttaagacaccagaaggtgaagtgggcgcaatagccttagattttaaacccggcacttcaggatctccgattgtcaatcgagaaggaaaaatagtcggactgtacgggaatggagtcgttacgacctcgggaacgtacgttagtgctatagcgcaggcaaaagcatcacaagagggacctctcccggaaatcgaagatgaagtatttagaaaaagaaatctcactataatggatttacaccctgggagtggtaaaacacgtcgataccttccggcgattgtgcgcgaggccattaaacgcaaattaagaaccctcatactagcaccgactagagttgtagcgtctgaaatggcagaagcactaaaggggatgcccattagataccaaaccactgcagtaaaatctgaacatacgggaaaagagatcgtggacctaatgtgccacgcaacctttacgatgcgactgctaagcccagtgagagtaccaaactataatatgataataatggatgaagcacacttcaccgacccctcaagtatagcagcccgtggatatatttcaacacgcgttggtatgggtgaagcagcagcgatttttatgaccgcgacaccaccagggtcagtggaggcatttccccaaagcaatgccgttatccaagatgaagagagagacatccctgaacgtagttggaactccggttacgagtggataacagactttcctggaaaaacagtttggttcgtcccgtctataaaatccgggaatgatattgcaaattgtctaagaaagaacggtaagagagttatacaattgtcaaggaaaacatttgacacagaataccagaaaaccaaaaacaacgattgggactacgtggtaacaactgacatatcggaaatgggcgcaaatttccgagcggacagagttatagatccacgaaggtgcctcaaaccggtgatacttaaggatggccccgaaagagtaatactcgctggaccaatgccagtcacagttgcgtccgccgcgcaacgacgaggacgtataggtcgcaatcataataaagaaggtgatcaatacatttatatgggacagccactaaacaatgacgaggatcatgctcactggaccgaagccaaaatgctgctggataatatcaatactccggaggggatcattccggcattatttgaaccggaacgagaaaaatctgcggcagtagatggtgaatacaggttacgtggtgaagcacgaaaaacttttgtagaactaatgcgcagaggcgaccttcccgtttggcttagctataaagtagcatcggaaggatttcaatattccgaccgtaggtggtgtttcgatggtgagcgtaacaatcaggtactagaagagaatatggatgtagagatatggactaaagagggggagaggaagaaattaagacctagatggttagacgcaaggacatacagcgaccccttggcacttagggagttcaaagaatttgccgctgggagacgctctgtaagtggtgatctaatcctggagataggtaaacttccccaacacctaacacagcgtgcacaaaacgcactggacaatttagtcatgttacacaatagtgagcaaggaggtagagcttataggcacgcaatggaggagcttcccgacacgattgaaaccctaatgctattggccctgattgccgtacttacaggtggtgttacgctattctttctaagcggccgaggactaggaaaaacatctatagggcttctttgcgtaatggcatcgtctgttttactctggatggcgtctgtcgagcctcattggattgccgcgagtattatactagagttctttcttatggttctacttataccggagcctgacaggcagagaactccacaagataatcaattagcctatgttgttataggcttgttgtttatgattctgacggtggcagctaatgaaatgggtttactcgagacaaccaagaaagatcttggtatcggacacgtggcagtggaaaaccatcatcatgcagcgatgttagacgtagacctccatccagcatcagcttggacattgtacgccgtggctacaacaataataactccaatgatgaggcatacaattgaaaatacaaccgcgaatatttccctgacggcgatagccaaccaggcagcgatactaatggggctagataaaggctggcctatcagtaaaatggatataggcgtcccactacttgcattaggatgttactcacaggtgaatccacttactcttacggctgcggttctgatgttagtcgcacattacgcaatcataggtcccgggcttcaagcaaaagcgacaagggaagcgcagaaaagaaccgccgccggtataatgaagaacccaaccgtagatggtatagtagcaatagacctcgaccccgtggtctacgatgcaaaatttgaaaaacaacttggacagataatgcttctgatactttgcacaagtcagatactactaatgcgaactacatgggcactatgtgagtcaataactctggctacaggtccccttactactttatgggaaggttcgccaggaaaattctggaacacgacgatagctgtatccatggcgaacatctttagaggtagctacctagcgggagctgggcttgctttttcactcatgaaatcactaggagggggacgaagaggaacaggtgcacaaggggagactctaggagaaaaatggaaacgacaactcaatcagttaagcaaatcggagtttaacacatacaaacgctctggaataatggaagtagacagatccgaagccaaggaagggttaaaaaggggagaaacaacaaaacatgctgtatctagagggacagcaaaattacggtggttcgtcgaacgaaatctagtaaaacctgaaggaaaagtcatagatttagggtgcggacgaggagggtggtcgtattattgtgcaggcctcaagaaagtaactgaagtaaagggttacacaaagggaggacccggccatgaagaaccgataccgatggctacttacggatggaatctagttaaacttcacagcgggaaagatgttttctttataccaccagaaaaatgcgacacgctattatgtgacataggagaaagttctccaaatccaacaatagaggaggggcgaaccttacgtgttcttaaaatggtagaaccatggctacgcggaaatcaattttgcataaaaatattaaacccttacatgccttcggtagtagagaccctagagcaaatgcagcgaaaacacggaggcatgttagtaagaaaccctttatcaagaaatagtactcatgaaatgtattgggtcagttgtggtacaggcaatattgtgtctgcagtcaatatgacaagtagaatgctcttgaatcgttttaccatggcacacagaaaacctacatatgaacgggacgtcgatctaggcactggtacaagacacgtcgcagtagaaccagaggtagcgaacttagacataataggacaaagaatcgagaatataaaacatgaacataaaagtacatggcattacgacgaggataatccttataagacttgggcgtaccatggaagttatgaagttaaaccctctgggtctgcaagttccatggttaatggggtagtcaaactcctaaccaaaccatgggacgttataccaatggtaacacaaattgctatgactgatacaacaccctttggacaacaacgtgtcttcaaggagaaggtcgatactagaactcccaaagcgaagcgtggaacagcacaaattatggaagtgaccgccagatggttatggggatttttatcaagaaataagaaacccaggatttgtactcgggaagaatttacccgaaaagtgagatcgaatgctgcaatcggtgcagtctttgttgatgaaaaccaatggaactctgcaaaagaggcagtagaagacgaaagattttgggatttagtccaccgggaaagagaattacacaagcaaggtaaatgcgcaacctgtgtgtacaatatgatgggaaaacgtgagaagaaacttggtgagtttggaaaagcgaaaggatcaagagcgatatggtatatgtggttaggcgcccggtttctagaatttgaggcgttaggattcatgaatgaagatcattggtttagccgggaaaattccctaagcggcgtggaaggagaagggttgcataaattaggttatatccttagggatataagtaaaataccaggaggaaatatgtacgcagacgatacagccggttgggataccagaattacagaagatgacctacagaacgaagctaaaattactgatattatggagccggaacacgctctcctcgctaaggcaatcttcaaacttacttatcaaaacaaggtggtacgagtacagagacctgccaagaatgggaccgtcatggatgtgatttctcgtcgtgatcaacgcggcagtggacaagtaggaacatatggattaaatacgttcacaaatatggaggcgcagctaatacggcaaatggaatctgaaggcatatttagtccttcggaactagagacccctaacctagcagaaagggcattaaattggctggaaaagtatggagtggaaagactaaaaaggatggcaatctcaggagatgactgtgtagtaaagcctattgatgatagatttgcgactgctttaacagctcttaatgatatgggaaaagttagaaaagatataccgcaatgggaacccagcaaaggatggaacgattggcagcaagtgccattttgcagccaccatttccaccaactaattatgaaggatggaagggaaatcgtggtaccatgcagaaaccaggatgagctagtgggcagggctcgagtcagccaaggagcaggatggtctttgagagagacagcgtgcctagggaaatcatatgcccaaatgtggcaattgatgtactttcataggagggatttaagattggcagctaatgcaatctgtagtgcggttccggttgattgggtgcctacaagtcggaccacttggagcatccatgcccatcaccaatggatgacaacagaagatatgttatctgtttggaacagagtatggattgaagaaaacccatggatggaagataaaacccatattagttcctgggaagacgtcccttatttaggcaaacgagaagatcaatggtgtggatccttaataggacttacagccagagcgacctgggcgacgaacattcaagtggcaattaatcaagtacgtagactaataggcaacgaaaattatttagattatatgaccagtatgaaacgattcaaaaacgagtcagatccagagggagccttgtggtag

SEQ ID NO: 21682 - RNA, 9879 nt, synthetic construct
  misc_feature 1..9879: note = derived and/or modified CDS sequence (opt6) from DENV-1__GQ868609__SS-prME
  source 1..9879: mol_type = other RNA
agtgtcactatgttgttaatgcttatgccgactgccctagcgttccatttaacgactagaggtggggaaccacatatgatagtaactaaacaagaaagggggaaatcattgctatttaaaacttcggcaggggtcaatatgtgtacgctaattgcaatggatttaggtgaattatgcgaagatacgatgacgtataaatgtcctcgaataacagaagctgaaccagacgatgtggactgctggtgtaatgcaactgacacatgggtaacttatgggacgtgctcacaaacaggcgaacatagaagagacaaacgatcagttgcattagcaccccatgtaggactaggacttgagacaagaactgaaacatggatgagctcggaaggagcatggaaacaaatacaaagggtagaaacctgggcactgcgacatcccggctttactgttatagcactattcttagcacacgcaatcggtacctcaattacgcagaaaggcataatatttatactactgatgctagttaccccatctatggctatgcgctgcgtcgggataggatcacgggactttgtggaaggattatcaggcgcgacgtgggttgatgtagtactggaacatggatcatgcgtcacgactatggctaaagataaacccaccctcgacatcgaattgctaaaaacagaagtaactaatccagcagtacttcggaaactgtgcatcgaggcgaaaatatcaaatacaactaccgactcacgttgccccacacaaggcgaagcgactttgatggaagaacaagatgcaaacttcgtgtgtagaagaacttttgttgatagaggttggggaaacgggtgcgggctttttggaaaaggctctcttattacgtgcgccaaatttaaatgcgtcaccaaattagagggtaaaatcgtacaatatgaaaatctcaaatatagcgtaatagtaactgtacatacgggtgaccaacatcaagtcggcaacgaatcaacggagcacggtacgaccgctacgattacaccacaagcacccacctcagaaatccaacttacagattatggagccttaacgctagactgctccccaaggacagggctagatttcaatgagatggttttactaacaatgaaagaaaaatcatggctagtacataaacaatggtttctagatctacctttgccgtggacaagtggagcttcgaccagtcaagaaacatggaatagacaagatctcttggtaacattcaaaaccgctcatgcgaagaaacaagaagtcgtcgtattgggatcacaggagggcgcaatgcacacagcattaactggtgcgacggagatacaaacatctgggactacaaccatctttgcgggacatttaaaatgtcgactcaaaatggacaaattaacgcttaaaggaatgagttatgtgatgtgcactggttcatttaaattggagaaagaagtagcggaaacccaacatggaactgtattagtgcagataaaatatgagggaacagatgcaccttgtaaaataccattctcaacacaagatgagaaaggggtgactcaaaatgggaggttgataacggccaatccaatcgttactgacaaagaaaaacctgtcaatattgaagccgaacctccgtttggagaatcctatatagtcataggggctggtgaaaaagcattaaaattgtcttggttcaagaaaggatcctcaataggcaaaatgttcgaagctacagctcggggtgcccgtaggatggcaatactaggcgacacagcctgggacttcggcagcgtgggaggggtttttacgtcagttggaaaactcgtccaccaaatatttggcacagcttatggtgtattattttcaggagtctcatggacaatgaaaattggaataggtgtattgttaacatggcttggactaaattctagaagcacgagtctttctatgacatgtatcgctgtcgggctggtcactttatatctcggcgtaatggtacaagccgatagcggatgtgtaattaattggaaaggacgagaattaaaatgcggttcaggcatatttgttaccaacgaagttcatacatggactgaacaatataagttccaagcggattcccctaaacgactatcggcagctataggaaaggcttgggaggaaggcgtttgtggtataagatcagctacaaggctagaaaacattatgtggaaacaaattagcaatgaactaaatcacatcctactagagaatgatatgaaattcactgtagttgttggagatgtagttggtattctggcacagggtaagaaaatgattagaccacaacccatggagcataaatacagttggaaatcatggggaaaagcaaaaataataggcgcagatgtacagaatacaacattcatcattgacggaccgaatactccagaatgccccgacgaccagagagcctggaacatttgggaggtagaagactacggttttggcatctttacaaccaacatatggttaagacttagagattcgtatactcaagtctgtgaccaccgattaatgtcagcagctatcaaagattcaaaagcagtccatgcggacatgggatattggatagagagcgagaaaaatgaaacttggaaattggcaagagctagcttcatagaagtaaaaacttgtatctggccgaaatcacatacgctctggagcaatggtgtgttggaaagcgaaatgataattcctaaaatttacggcggcccgatatcacaacataactatagacctggatattttacgcaaacagcaggcccatggcatctaggaaaacttgaacttgatttcgatctatgcgaaggaaccactgtagtggtagacgagcactgcggcaatagaggaccctctctacgtacaacaactgtcacagggaaaatcatccacgagtggtgttgtagatcatgtactctcccgcccttaagatttaaaggcgaggacggctgctggtacggaatggaaatacgtccggtaaaagaaaaagaagagaatttagttaagagtatggtgtctgcaggttctggtgaagtcgattcgttttcgttgggcctgctctgtatttctatcatgatagaagaggttatgcgtagtagatggtcccgaaagatgttaatgacaggaacgttggctgtatttcttttattgatcatgggtcagctcacatggaacgacttaattagattatgcatcatggtaggggccaatgcgtcagaccgcatgggcatgggtaccacatatcttgcactgatggcgacctttaaaatgcgaccaatgtttgcagtaggactattgtttcgtagactgacgagtagagaagttctactgctgactattggactgtcattggtagcctctgttgaactcccaaacagtctagaggaactgggagacggtttggctatgggtattatgatcctcaagttactaacggacttccaaagccatcaactctgggcaaccctactttctcttactttcattaagacaaccctatcactacactatgcatggaaaacgatggcgatggtcttgtcaattgtaagtttgtttccattgtgcttgtctactacatctcagaaaactacatggctacctgtactgttgggatcactaggatgtaagccattaactatgtttttaataacagaaaataaaatatggggtagaaaatcatggcctctaaacgaaggcataatggcagtgggcgttgtctcaatacttttaagtagtttactcaaaaatgatgtaccattagcgggccccttaatagccggaggaatgttaatagcatgttatgtgatctcaggaagcagtgcagatctaagtcttgagaaagctgcagaagtatcatgggaagaagaagccgagcattcgggcgcttctcacaacatcctggttgaagttcaagacgatggaacaatgaaaataaaagacgaggaacgggatgataccctgaccatattgttaaaagccacactactagctgtgtcaggtgtctatccgttatctatacccgcaaccttgttcgtatggtatttctggcagaagaagaaacagaggtccggagtactatgggatacaccgtctccaccagaagtcgaaagggcagtgctggatgatggcatttacagaattatgcaacggggtttgctgggaaggagtcaggttggagtgggagtttttcaagaaaacgtgtttcatactatgtggcacgtaacaaggggcgcggttcttatgtatcagggaaaacgtttagagccctcctgggcttcagtgaagaaagatctaataagttacggaggcggttggcggctacaaggtagctggaatacgggagaggaagttcaggttattgcagtagaacccgggaaaaaccccaaaaatgtgcaaacggctcctggaacttttaagacaccggaaggagaagttggggctattgccctggattttaagccaggtacaagtggatcaccaatcgttaacagagaaggtaaaatagtaggtttatatggaaatggagttgtgacgacaagtggcacatatgtttcagcgattgctcaagcaaaagcgagtcaagagggaccgctacctgaaatagaagacgaagtttttagaaaacgaaatctaacaattatggatttacatcctggatcaggtaaaacaagacgatatttacccgcgattgttagagaagctataaaaagaaaactccggaccctgatacttgcacctacaagagttgtggcttccgagatggcggaggcactgaaggggatgcccataagatatcaaacgacggcagttaaaagtgaacatactggaaaggaaatcgtagacctcatgtgccatgccacgttcacaatgcgactgctttctcccgtaagagttcctaattacaatatgataatcatggacgaagctcacttcactgaccccagctcaattgctgcacgaggttacatatcaacacgtgtaggtatgggggaggctgcagcaatttttatgacagcaacgcctcccggatctgttgaagcatttccacagagcaacgcagtaatccaggatgaagaacgtgacattcctgagcgctcgtggaacagcggatacgaatggatcacagactttccggggaaaactgtatggtttgtaccatcaattaaaagcggcaatgatattgcaaattgtttaaggaaaaatggtaagagagttatacagctcagtagaaaaacatttgacactgaataccagaaaaccaaaaacaatgactgggattatgtggtgacaacggatatttctgaaatgggtgcaaactttagggcggatagagtaatagatccacgcagatgtttgaagcccgtcatcctcaaggatggaccggagagggtcattcttgccggcccgatgccagttacagttgcatccgctgcacaaagaagaggtagaattggacgaaaccataataaagaaggtgaccagtacatatacatgggtcaaccattaaataatgacgaagatcatgctcattggaccgaagcaaaaatgttgcttgacaatattaataccccggaaggaataattccagcattatttgagcctgaaagagaaaaatccgcggcaattgacggagaataccgattaagaggtgaagcccgaaaaacctttgtagaattaatgcgtagaggagaccttccagtatggttaagctataaagtcgcttcagaaggctttcaatattcggaccgaaggtggtgttttgatggagaaaggaacaatcaagtgttggaggaaaatatggatgttgaaatctggactaaagaaggcgaaaggaagaaattacgtccgcgttggttggacgcacgaacatacagtgacccactagccttgagagaatttaaggaatttgccgcgggacgaagatctgtatcgggagatctcatattagaaatcggtaaacttccgcaacacttaacacagcgtgcccaaaacgctttagacaatcttgttatgctacataatagtgaacaagggggtcgcgcttataggcatgcgatggaggaattaccggatactatagaaacgctaatgttactagcgctaatcgcggtattaactgggggtgttacattattctttctgagcggacgcgggttaggtaagacttctataggattattgtgtgtaatggcatcaagtgtgcttctatggatggcatctgtagaaccacattggattgctgcttcaataatactagagttcttcctgatggtactcttaataccagaacctgaccgacaacgaacccctcaagataatcagttagcgtatgtggtaataggtctcttattcatgatactaacagtggcagccaacgagatggggcttttagaaaccactaagaaagatctcggtataggacacgtggcagtagaaaaccaccaccacgcaactatgttagatgttgacctacatcccgcaagtgcatggactctttatgctgtcgcaacaactattattactccaatgatgaggcatacaatagaaaacacgacagcaaatatatccttgaccgcaatagctaatcaagcagcaatcctgatgggacttgacaagggctggcctatcagcaaaatggatataggtgtaccattgttagcgttaggatgctatagtcaagtaaatcccttgacactcactgcggcagtattgatgctggtagcccattatgcaataatagggcccggtcttcaagcaaaagcaacaagggaggcacagaaaagaacagctgcaggaataatgaaaaacccaactgttgatggaatagtcgcaatagatttagaccccgtcgtgtacgatgccaaatttgagaaacagttggggcaaatcatgttactgatcctctgtacatcgcaaatattgttgatgaggacaacttgggcactctgtgaatcaataactctggcgacaggacctctaactaccttatgggaagggtcaccgggaaaattttggaacacaactatcgcggtttcgatggcaaacatattcagaggcagttacctagcgggggcaggacttgcattcagccttatgaagtcattaggtggaggacgtagagggacaggtgcacaaggtgagacacttggagaaaagtggaaaaggcaattaaatcaattaagcaaaagcgagttcaatatatataagagatcaggaataatggaagtagacagaagcgaagccaaagaagggctaaaacgaggtgagaccacaagacacgcagtttctaggggcaccgcgaaactaagatggtttgtagaacgcaatttggtaaaacctgaaggtaaagtgatcgatttaggatgtggacggggtggatggtcttactattgcgcaggactgaagaaagtgactgaagttaaaggatacacaaaaggaggacctggccatgaagaaccgattccaatggcaacatacggttggaacttagtcaaacttcatagtggcaaagacgtattctttactccacctgaaaaatgcgacactcttctatgtgacataggtgaaagcagtcctaatccaacaatcgaagaaggaagaaccctacgagtactaaaaatggtagagccttggctaagaggtaatcaattttgcatcaaaattttaaacccatacatgccgagcgtagtcgagactctcgagcaaatgcaacggaagcatggagggatgttggtgagaaacccattatctagaaattcaacgcacgaaatgtattgggtatcatgcggtaccgggaatatcgtatcagccgtaaacatgacaagtagaatgttgttaaacagatttactatggcacacaggaaacctacctatgaaaaagatgtagatttaggagccggaacgagacacgttgcggtagaaccagaagtggcgaacctggatataataggacaaaggattgaaaacataaaacatgagcataaatcaacgtggcactatgatgaagataacccatacaaaacttgggcctatcacggctcgtatgaagtgaagccatccggtagtgcttcatctatggtcaatggagttgtaaaacttttaacgaaaccatgggatgttatccccatggtgacgcaaatcgccatgactgatacaacaccgtttggacaacaacgggtattcaaagaaaaggtagacacgcgaacccccaaagccaaaagggggacagcacagataatggaagttacggcgcgttggctatgggggtttctcagcagaaataagaaaccaagaatttgtacaagagaagaatttactagaaaggtgcgcagtaatgcagcaatcggagctgtgtttgtggacgaaaaccaatggaactcagccaaagaagcggtagaagatgaaagattttgggatttagtccaaaaagaaagagagctccacaagcaaggaaaatgcgcaacatgcgtgtacaatatgatgggtaaacgtgagaaaaagttgggtgaatttggtaaagcaaagggcagtagggcaatatggtatatgtggttaggagctcgattccttgaatttgaagcgcttgggttcatgaatgaagatcattggtttagtagagaaaattcattaagcggcgtcgagggagagggtttacataaactcgggtacattttacgagatattagcaaaattccaggagggaatatgtatgcggatgatactgcggggtgggatactcggataactgaagatgatctccaaaatgaagctaagataacagatataatggagccagaacatgctctcctagctacttccattttcaaactaacttatcaaaacaaggttgtccgcgtacaaaggcccgctaagaatggaactgtcatggacgtgatttcgaggagagatcaacgaggttcgggacaagtcggaacatatggattaaatacttttacgaatatggaagcccaactcatacgccagatggagagtgaaggaattttcttgccaagtgaattggagactccgaacttggccgaacgagtcttagattggctggaaaaatatggcgtagaaaggctgaaacgaatggctatttccggagatgattgcgttgtaaaaccaatagatgatcgctttgcaaccgccctgacagccttaaatgatatgggaaaagtaagaaaagacattccgcaatgggaacctagcaaagggtggaatgactggcaacaagtaccattttgttcacatcattttcaccagttaataatgaaagacggtcgagaaattgttgtaccatgccgaaatcaagatgaactcgttggtcgagcgagagtaagccaaggtgctggctggtcgttaagagagacagcatgcctaggaaaaagctatgcgcaaatgtggcaactaatgtactttcatcgcagggatttaagactcgctgctaacgcgatttgtagcgcagtaccggtagattgggtgccaacaagtcgtaccacttggtctatacacgctcatcaccagtggatgactactgaagatatgttgagtgtatggaaccgggtatggatagaagaaaatccatggatggaagataaaacccatgtttctagttggggagatgttccatatctaggaaaaagagaagatcaatggtgtgggtcattaataggcttgactgcgcgagctacctgggcaagcaatattcaagttgcaattaaccaagttaggagactaattggcaacgaaaattatttagattatatgacatcaatgaaaagatttaagaatgaaggagatcctgagggagcactatggtag

SEQ ID NO: 21683 - RNA, 9879 nt, synthetic construct
  misc_feature 1..9879: note = derived and/or modified CDS sequence (opt6) from DENV-1__GQ199803__SS-prME
  source 1..9879: mol_type = other RNA
agtgtcactatgttactaatgttaatgcctaccgcgctagcttttcacctaactatcagaggtggggaacctcatatgatagtgtcaaaacaagaaaggggaaaaagcctattgtttaaaacatcagcaggagtcaatatgtgcacattgatcgccatggatctcggcgaactttgcgaagacacaatgacctacaaatgtccgcggataactgaagctgaaccagacgatgtagattgctggtgtaatgctacagatacatgggtaacatacggaacgtgcagccaaacgggagaacaccgacgtgataaacgtagtgtcgcactagcgcctcatgtaggactaggcctggaaacacggacagaaacatggatgagcagtgaaggggcatggaaacaaattcagagggtggaaacatgggccctacgccatcccggatttaccgtcatcgcactatttctagcacatgcaataggaacttcaattactcaaaaagggataattttcattttactcatgctagtgacaccgtcgatggccatgagatgtgtaggcataggttcgcgggattttgtggaaggactcagcggagctacttgggtggatgtagtattagaacacggatcgtgtgtgacaaccatggctaaagacaaaccaacactagacatcgaactccttaaaaccgaagtgacaaacccagctgtactaagaaaactatgtatagaagctaaaatttccaacacaacaaccgatagccgctgtcctacacaaggagaagcaactctggtggaggagcaggacgctaatttcgtatgcagaagaacatttgtcgatcggggttggggaaatggttgtgggctatttggtaaagggtcattaataacatgtgcaaaattcaaatgtgtcacaaaattagaaggaaaaatagtacaatatgagaatctaaaatactcagttatagtaactgttcatactggtgatcaacaccaagttggaaatgaatctacagaacacggaactacagccacgattactccacaagcccccactaccgaaatccagctaacagactatggagccctaactctagattgttctccgagaaccggtttagactttaacgagatggtcctactaacaatgaaagagaaatcatggttggtacataagcaatggtttcttgatctacctctgccatggacgtctggagctagtaccagccaagaaacttggaaccgacaagatctattagtgacctttaagacagcgcatgccaagaaacaagaagtagtcgtgttgggctcacaggaaggcgctatgcacacagcgcttactggtgccacggagatccaaaccagcggaacaacgaccatctttgcaggacaccttaaatgtagactcaaaatggataaattaactctgaagggaatgagctatgtgatgtgcactggtagttttaaattagaaaaagaggttgctgaaactcaacatgggacggttttggtgcagattaaatacgaaggaacagacgctccttgcaaaataccattttcgacacaagacgagaagggagtaactcaaaatgggagactgataacagcaaatccgattgttacagacaaagagaaacccgttaacatcgaggcagaacccccgtttggtgagtcatatattgttataggagcaggagaaaaggcacttaagttatcatggttcaagaaaggttcaagcattggaaagatgttcgaagcaacagcgagaggggctcgaaggatggccatactaggagacacagcttgggattttggaagcatcggcggtgtgtttaccagtgtgggaaaattagtgcatcaaatattcggcacagcatatggcgtactattttccggtgtatcctggactatgaagataggaataggcgtgctactcacttggctcggtctaaattctagaagtacatcactatcaatgacatgcatcgcggtagggctggtaaccttatatctgggagtaatggttcaggcagatagtggttgtgttatcaattggaaaggaagagagttaaagtgcggaagcggtatattcgttacaaatgaagtacacacatggactgaacaatataaatttcaagcagattcaccgaaaaggctaagcgccgcgataggaaaggcgtgggaagaaggtgtatgcggaattaggagcgcgacaagactggaaaacataatgtggaagcaaatatccaacgaattaaatcatattcttttagagaatgatatgaagttaacagttgtagtaggcgacgtagcaggtatactcggacaaggtaagaaaatgatacggccccaaccaatggaatataaatatagctggaaaagctggggaaaagcaaagatcattggagctgacgcacaaaatactaccttcattatagatggtccaaacacacctgagtgcccagacgatcagcgagcatggaatatttgggaagtagaagactacggctttgggatatttacaacaaatatctggctaaaacttagagattcttacacgcaagtgtgtgaccatagattgatgtccgccgcaataaaggatagtaaagcggtgcacgcggacatgggttattggatcgaatccgagaaaaatgaaacttggaagttggctagagcatctttcatagaagttaaaacatgcatttggccgaaaagtcacacgctatggtccaacggagtattggaaagtgagatgataatcccaaaaatatacgggggccctatttctcaacataactacagaccggggtacttcacccagaccgctggaccatggcatcttggaaaattagaattagacttcgatttatgcgaaggaacgacagtcgtggttgatgaacactgtggcaaccgagggccctcacttcggaccaccactgtaactggaaagataatacatgaatggtgctgtagatcatgtaccttaccacccttaagattcagaggtgaagatggttgttggtacggtatggagataaggcccgtaaaagaaaaagaagaaaatcttgtaaagtctatggtgtctgcaggaagcggggaggtagatagtttctcattagggttattgtgtattagcataatgattgaagaagtaatgcgttctcggtggagcaggaaaatgttaatgaccggtacccttgctgttttctttttgctaataatgggacaactgacatggaatgacctaataaggttatgtatcatggtaggagctaatgctagtgataggatgggaatgggtacaacgtatctcgcgctaatggcaacgttcaaaatgcgacccatgtttgcagttgggttattattccgaaggttgacatctcgggaagttctactattaacgataggtctatccttggtagcatccgtagagttaccatcaagtcttgaggaactaggtgatggcctagccatgggaatcatgatcttaaaattattaacagacttccaaagtcatcagctgtgggccactttgttatctttaacttttataaagaccgcattctccttgcactatgcctggaaaacaatggcgatggtactatcaatagtctcactttttcccttgtgtcttagcacaacttcgcagaagactacgtggttaccagttttactgggctcacttggatgtaaaccgctcactatgtttctaatcgctgaaaataagatatggggtagaaaaagctggccactcaatgaagggataatggctgtaggtattgtcagcatactattatcttcattgctaaagaacgacgtacccttagcaggaccactcattgccggtggaatgctaatcgcatgctatgtaataagtgggagcagtgcagatttatctctagaaaaagcggcagaagtgtcgtgggaggaagaagctgaacattccggagcatcacacaatatattagtagaagtccaggacgatggaaccatgaaaataaaagacgaagaaagagacgataccttgactatattacttaaagccactttactggctgtgtctggggtataccctttaagtataccagcaactcttttcgtctggtatttctggcagaaaaagaaacaaagaagtggcgtactatgggacactccaagtcccccagaagttgaacgagcggtcctagacgatggaatctaccgtatcatgcaaagaggtttactcggtagatctcaagttggtgtgggcgtattccaggaaaacgtatttcatacaatgtggcacgtcaccagaggagcagtactcatgtaccaaggaaagagactagaaccgtcttgggcctctgtaaagaaagatctaataagttatggaggagggtggcgtttaagaggttcatggaatacaggagaggaggttcaagttatagctgtggagcccggcaaaaatcccaaaaatgttcagaccgcaccaggcacatttaaaactcccgaaggagaggtgggagcaattgcgcttgacttcaagcccggaacatcagggagcccaatagtgaatagagaaggtaaaattgttggactttacggtaatggagttgtaacaacaagcggcacatacgtgtcagcaatagcccaagcgaaagcctcacaagaaggtccactcccagagattgaagatgaagtctttagaaagagaaatcttacaataatggacttacacccaggaagtggcaaaacccgcagataccttcccgcaattgtccgagaagcgataaagcgaaaattgcgaactttaatattagcccccaccagagttgtagcgagcgagatggctgaagccttgaagggcatgcctatccgatatcagacgactgctgtaaaatcagagcacacggggaaagagatagttgatttaatgtgtcatgctacatttacaatgagattactaagcccagttagggtaccgaattataatatgataataatggacgaggcacattttactgatccatcgtcaatcgcagcaaggggctacattagtacaagggtaggaatgggagaggcagcagcgatattcatgacggccacacctcccgggtccgtagaagcatttcctcaaagcaacgctgtcatacaagatgaagaacgggacatacccgaaaggtcatggaactcgggttatgaatggataacagactttccgggcaaaaccgtatggtttgtgccatcaataaagagcggaaatgacatagctaactgtttacgtaaaaacggtaagagagtcatacaactgagcagaaagaccttcgatacggagtaccagaaaacaaagaataacgactgggactatgtggtcacaacagatatatcggaaatgggtgcgaatttcagagctgatcgtgttattgacccaaggagatgtttgaaaccggtaatattgaaagacggacctgaaagagttatacttgcaggcccaatgcctgtaacagtagcttcggccgcacaaaggagaggacgcatcggaaggaatcataataaagaaggtgatcagtacatatatatgggtcagccgttaaataacgacgaagaccatgcccattggactgaagcgaaaatgttgttagataacattaacactccagagggaattatcccagcactattcgaaccagaaagagaaaagtcagcggcggtagacggtgaatacaggttaaggggcgaagcaagaaagacattcgtagaactaatgcgacgaggagacctacctgtctggttatcttataaagtagcgagtgaaggttttcaatattcagatagaagatggtgtttcgacggcgaaagaaataatcaggtcttagaagaaaatatggacgtggaaatatggaccaaggaaggagacaggaagaaattacgcccacgatggcttgatgccagaacatactccgatcctctggccctaagagagttcaaagaatttgcagcaggaagaagatctgtatctggcgatctgattttagagataggaaaattacctcaacacttaacacagcgagcgcaaaatgcattagataatttagtaatgctccataattcggagcaaggaggaagggcataccgtcacgctatggaagaattgcccgacactattgaaacgttgatgctattagcactgatagccgtactaacaggaggagtgacattatttttcctatcgggacgcggactaggcaagacgagtatagggcttttatgtgtcatggcgtcctcagtacttttatggatggcgtcggtagaaccacactggattgctgcttccataattctggagttctttttaatggtgttattaattccagaaccagatcgacaacggacaccgcaggacaaccagctagcatacgtcgtaataggtttacttttcatgatacttaccgtcgcagctaacgaaatgggtttattggaaactactaagaaagacttaggcattggacatgtagccgtggaaaaccatcatcatgctgcgatgttggatgttgatctccatcctgctagtgcttggacactttatgctgttgcaaccactataatcacaccaatgatgcgccacacgatagaaaacacgactgcaaacatctcattgactgcaatagccaatcaagcagcgatattaatgggacttgataaaggttggcctatcagcaagatggatataggagttccattgctagcattaggctgctacagccaagtaaaccctcttacattgacggcagcagtattaatgttggtcgctcattatgctatcatcggccccggactacaagcaaaagctactagggaagcccaaaagagaacagcagctggtattatgaaaaaccccaccgtagatgggatagttgcgatagaccttgatcccgtggtgtacgatgccaagttcgaaaaacaattaggccaaataatgctattaattctatgtacgtcccagatcttacttatgcgcacgacatgggcactatgcgaatcaataacattagcaacggggccactaaccaccctatgggaaggatcaccaggaaaattttggaatacaactatcgcggtctcaatggctaatatatttcgaggaagttacttggccggagcagggcttgccttcagtctaatgaaatcgttgggaggaggacggcgcggtacaggtgcgcagggagaaacgttaggcgaaaaatggaaacgacaattaaaccaactaagtaagagtgaatttaacacctataaaagaagcggaattatggaagtggatcgttctgaagcaaaagaagggctgaaacgaggggaaacaacaaaacacgccgtatcgcggggaaccgcaaagttaagatggtttgttgagaggaacttagtgaaacctgagggtaaggtaattgaccttggatgtggaagaggagggtggtcttattattgtgcaggtctcaagaaagtaaccgaagtaaaaggatacacaaaaggaggacccggacatgaagaaccaataccaatggcaacgtacggctggaacttggttaagctccactctggcaaggacgtattctttatacctccagaaaaatgtgacacattgctttgtgacataggagaatcatctccaaacccgactatagaagagggaaggacactcagagtgttaaaaatggtcgaaccgtggctaagaggtaatcaattctgtattaaaatattaaatccatacatgccgagtgttgtagagacactggaacagatgcagcgaaagcatggaggcatgctcgtaagaaatcctctttcaagaaattctacacatgaaatgtattgggtcagttgtggtactggcaatatcgtgtcagcggtaaatatgacctctcgtatgctattaaatcgtttcaccatggcccatcgtaaacctacatatgagcgggacgtagatctggggacagggacaagacacgtcgcagtagaaccggaagtcgcaaacttagatataataggtcaaaggatcgaaaatatcaagcacgaacataaaagcacgtggcattacgacgaagataacccatacaaaacctgggcgtaccatggcagctatgaagtcaagccttcaggctccgccagctctatggtaaatggtgtagtcaaacttttaaccaaaccctgggatgtaataccaatggtcacacaaattgcaatgacagacacaacgccattcggtcagcaacgggtattcaaagaaaaagttgatactagaacacctaaagctaaaaggggaacagctcaaatcatggaagttacagcacggtggctatggggttttctctccaggaataaaaagcctcgaatttgtacgagagaggaatttactaggaaagtacgatccaacgcagcaattggtgcagtgttcgtcgatgaaaatcaatggaactctgccaaagaagccgtggaagatgaaaggttctgggacttagtacacagggaaagagaactacataagcaaggcaaatgcgcaacatgtgtgtataatatgatgggtaagagagagaaaaagttaggcgagtttggcaaagccaagggaagtagagccatttggtatatgtggttaggagcacgatttttagagttcgaggccctgggcttcatgaacgaggaccactggttcagcagagagaacagtctgtcaggggtggaaggggaagggctccacaaattagggtatattctaagagatatatctaaaatacctggtggaaatatgtacgctgatgatacagcaggctgggacacacggattacggaagacgatttacaaaacgaagctaagataacagatatcatggagcctgaacatgccctgctggcaaaagcaatatttaaattaacctatcaaaacaaagttgttagggttcaaagaccggccaaaaacggaacagtcatggatgttatctctcgaagagaccaacgaggatccggtcaagttggcacttacggattaaacacatttactaatatggaggcccaattgatcaggcaaatggaaagtgaaggtatcttttctccaagtgagctagaaactcctaacctagcagaacgtgcacttgactggttggagaaatatggagtagaacgactcaaaagaatggcaatatcgggggatgactgtgttgttaaaccaatagatgatcgcttcgccactgcactcaccgcactcaatgatatgggaaaagtccgaaaagatataccacaatgggaaccatccaagggctggaatgactggcaacaagtaccattttgctctcatcatttccaccagttaataatgaaagacggtcgggaaatcgtggtcccttgccgtaaccaggacgagttggtcggacgcgctagagtcagccaaggtgcaggttggtctctgcgagaaactgcctgccttggaaaaagttatgcacagatgtggcaactgatgtattttcatagacgggacttaagattggctgctaacgctatatgttcagcagtcccggttgattgggtaccaacttcgagaacaacgtggtccattcatgcacatcaccaatggatgacaaccgaagatatgcttagtgtatggaaccgagtatggatagaagaaaatccgtggatggaagacaaaactcacataagttcgtgggaagatgttccatacttaggaaaacgagaagaccaatggtgtggaagtctcataggactcactgcaagggcgacctgggctaccaatatacaagtagcgatcaaccaagtgcggcgtctaataggaaacgaaaattatttggactatatgacgtccatgaaacggtttaaaaatgaatctgatccagaaggagcattatggtaa

SEQ ID NO: 21684 - RNA, 9879 nt, synthetic construct
  misc_feature 1..9879: note = derived and/or modified CDS sequence (opt6) from DENV-1__GQ199804__SS-prME
  source 1..9879: mol_type = other RNA
agcgttacaatgctactaatgttaatgccaacagctttagctttccacttaacaacaagaggaggagaaccacatatgattgtttctaaacaagaaagaggaaaatcattacttttcaaaacaagcgcgggagtgaatatgtgtacattaattgcaatggacctaggagaattatgcgaagatacaatgacttacaagtgtccaagaataacagaaacagaacctgatgatgtagattgttggtgcaatgcaacggatacatgggtaacctatgggacatgctcccaaacaggtgagcatagacgggacaaaagatcagtagcactcgctccacacgtaggattgggcctagagacaagaaccgagacatggatgtcatctgagggtgcttggaaacagatacaaagagtagagacctgggctctaaggcatcctggtttcacagtgatagcattatttctcgcacatgtaattggtacgtctataacacaaaaaggaataatttttatactactcatgttggtaacgccatccatggctatgcgttgtgttggtataggtagtcgagacttcgtagagggcttatcaggtgcaacgtgggtagatgtcgttctggagcatggatcttgcgtaactactatggctaaagataaaccaacattagacatagaactactaaagacagaggttactaatcctgcggtactgcggaaactatgtatcgaagctaaaatcagtaacactacgactgatagtagatgcccaacacaaggtgatgcaacgttagttgaagaacaagatgcaaactttgtctgcaggcgcacatttgtggaccgaggctggggcaatggatgtggattgtttggaaaagggtccttgataacttgtgcaaaatttaaatgtgtaactaaattagagggaaaaattgtacaatacgaaaatttaaaatactctgttatagtgacagtacataccggagatcaacatcaagtcgggaacgaaagtacagaacatggtaccacggcaacaataacccctcaagcaccgacaactgaaatacaattaaccgactacggagctttgaccttagattgttctccgagaaccggacttgattttaatgaaatggtattattaactatgaaggagaaaagctggcttgtacataaacagtggttcctagacctcccgttaccctggacatcaggagcaagtacgtctcaagagacatggaatagacaggacctattagtaacctttaaaactgcacacgccaagaaacaagaagtagtcgtactaggaagtcaggagggcgcaatgcatactgcactgactggagctacagaaatacagactagcggtacaactacaatattcgctggtcacctcaaatgtaggctaaaaatggacaagttaactcttaaaggaatgtcctacgttatgtgtacaggttcttttaaacttgaaaaagaggtagcggaaactcaacatggcactgttttagttcagattaagtacgaaggaacggatgctccatgtaagattccattttcaactcaagacgaaaagggtgttacacaaaacgggcgtctaataacagctaaccctattgtaacggacaaagaaaaaccagtcaacatagaagcagaaccaccatttggggaatcttatattatcatcggagctggcgaaaaggcgttaaaattaagttggtttaaaaagggttcaagtatagggaaaatgtttgaggccactgcccgaggagctagaagaatggcgatcttaggagacacagcctgggattttggatctataggcggagtattcacaagtgtaggcaaattggttcatcaaatcttcggcactgcgtacggagtcctcttctccggggttagctggacgatgaaaattggaatcggagttctacttacttggttaggattaaatagccggtcaacaagtttatcaatgacttgtatcgctgtcggcctagtaaccctatacttaggcgtaatggttcaggcggacagtggctgcgttatcaattggaaaggaagagaattaaagtgtggttctggaatatttgtaactaacgaagtacatacttggacagagcaatacaaatttcaggctgattcccccaaacgtttatccgctgccatcggcaaagcatgggaggaaggcgtttgtggtatacgatcagccacacgcctagaaaacatcatgtggaaacaaatctcaaatgaattgaaccacatcctcctagagaacgatatgaaatttaccgtcgtggtaggagatgttgcaggaatattagcacaaggtaaaaagatgattagaccacagccgatggaatataagtattcatggaaaagttggggaaaagcaaaaattatcggtgcagacgtgcagaacactacattcattattgatggacccaatacgcctgaatgtccggacgatcaaagagcttggaacatttgggaagtcgaagattatggatttgggatatttacgacaaacatctggttaaaacttcgagatagttacacacaagtatgcgaccacagactgatgagtgcggcaatcaaagattcgaaagctgttcacgcggatatgggatactggatcgaatccgaaaagaacgagacatggaaattagcacgagcctcattcatagaggtgaaaacctgtatttggcctaaatctcacaccctatggagtaacggggtcctagaaagtgaaatgattatacccaagatctatggaggcccaatatcccaacataactacagaccaggatactttacccaaacagcaggtccttggcatctgggcaagctagaattggactttgatctatgtgagggaactactgtagttgtagacgagcattgcggcaatcgaggaccttcattaagaaccacaaccgtaactggcaaaataatccatgaatggtgctgtagatcatgtacgttacccccattgagatttcggggtgaagacggatgctggtatggcatggaaattcggccggtcaaagagaaagaagaaaacttagtaaagtcaatggttagtgcaggatctggcgaagtggattcttttagtctaggactcctttgtatatcgataatgatagaagaggttatgaggtcaaggtggagtaggaaaatgttaatgacagggaccctagccgtcttcttcttactaataatggggcaactaacatggaatgatctaattagactctgtataatggtgggggcgaatgcatcagatcggatgggcatgggaactacgtaccttgcattaatggccacatttaaaatgagacctatgtttgctgttggcctgctctttaggagattaacctcacgcgaagtactactcctaactatcggactaagtcttgtagctagtgtagaattgcccaacagcctagaagagttgggagacgggcttgcaatgggaataatgattttaaaacttctcacggactttcagagccatcaactatgggcaacactcttatcgctaacgttcataaaaactactttctctctacattacgcctggaaaacaatggcaatggttctatctattgtctctttatttccgttgtgcttatctacgacatctcagaaaactacttggctacctgtgttattaggatcactaggctgcaagcccctgaccatgttcctcatagcagagaataaaatttggggacgtcgatcttggccactaaatgagggtataatggcagtagggatcgtgtccattttgctgagttcgttactcaagaacgatgtcccgttggcgggtcctttaatagccggtggcatgctaatagcctgctacgtcataagcgggagcagtgctgatctttctttagaaaaagcagcggaagtatcatgggaagaagaagctgaacatagcggtgcttcacataacatcctagtggaagttcaagatgatgggacaatgaagattaaagacgaagaaagagatgacaccctaacaatccttttaaaagctactctactcgcagtgtccggggtgtatcctttatctatcccagcgacattatttgtatggtacttctggcagaaaaagaaacaaagaagtggagtactgtgggacaccccgtctccaccagaagtggaacgagctgttttggatgatggaatatatcgaattatgcaacgtggtttgcttggaaggtctcaagtcggagttggagtttttcaagaaaacgtatttcatacaatgtggcacgttactcgaggtgctgtcttaatgtatcaaggtaaaaggttagagccaagctgggcgtcggttaagaaagatttaatttcctacggcggcggatggagacttcagggatcttggaataccggtgaagaagtacaggttattgcggtcgaacctgggaaaaacccgaaaaacgtgcagaccgctcctggaacatttaaaacacccgaaggtgaggtaggtgcaattgccttggattttaaaccaggtacgtctggatcacctattgtaaatcgagaaggtaaaattgttggtctgtacgggaacggagtggtaactacgtcaggcacctacgtatcagcgatcgcgcaagctaaggcaagtcaagaaggaccattaccagaaatcgaagatgaggtgtttagaaaacgtaatctaacaattatggatttgcatccaggcagtggtaaaactagaaggtacttacccgcgatagttcgagaagcaataaagcgaaagctgagaactctaatccttgcaccaacaagagttgttgcttctgaaatggctgaagcccttaaaggcatgccaataagatatcagacaacggctgtcaaaagtgagcataccggtaaagagattgtagacctaatgtgccacgcaactttcacaatgagactcctttctccagtaagagtacccaactacaatatgatcattatggacgaagctcattttaccgacccatcttctatagctgctagggggtacatatccactagagtcggtatgggagaagcagctgctatctttatgacagccactccaccgggttctgtagaagcatttccacagtcaaatgctgtaatacaagacgaagaacgcgatatacctgaaagatcctggaactcgggttatgagtggattactgactttccaggtaagacggtctggtttgtcccgtcaataaagagtggtaacgacatagccaactgcctaaggaaaaatggcaaaagggttatacagttgagcagaaaaacattcgatactgaatatcagaaaaccaaaaataatgactgggattacgtagtaacgaccgacatatcggaaatgggagcaaatttccgtgctgatagagtaatcgaccccaggagatgcctaaaaccagtgatcctaaaggatggaccggagagagtgatactagccggcccaatgcctgtaacagtggcctcagcagcacaaagacgaggaaggataggtcgaaatcataacaaagagggggatcaatacatttacatgggacaaccgttgaacaatgacgaggatcacgctcattggactgaagcgaaaatgttgctggataatataaatactccggagggtataattccagcattgttcgaaccggaaagagagaagtcagcagcaatagatggagagtatcggttgaggggtgaggcaagaaaaacattcgtagaattaatgaggcgcggtgacttacccgtttggctaagttataaagtagcatcggaaggttttcaatactcagaccggaggtggtgttttgacggagaacgcaacaatcaagtgttggaagaaaatatggacgtagaaatatggacaaaagaaggcgagcgtaagaagttacgtcctcgctggttagatgcccggacatattcagacccactagcgctaagagagttcaaagaatttgctgctggcaggagatcagtatcgggagatctgattctagaaatcggaaaacttccacaacatttaacccaacgggcacaaaatgctttagacaatttagttatgcttcataactccgaacaaggcggacgagcgtatagacatgcaatggaagaattgccggatacaatcgagacgctgatgttgctcgcattaatcgcagtgctcactggaggagtaacgttattctttctaagtggaagaggactcgggaagacctcaatagggctattgtgtgtaatggcctctagcgtgcttctatggatggcttccgttgaaccacactggattgcagcgagcataatactagagtttttcttaatggtgctattaataccggaaccagacaggcaaaggacaccacaagacaaccaattggcgtacgttgttattggtctcctatttatgattctgacagtggcagcgaatgagatgggactactagagactaccaagaaagatctgggcataggacatgtagcagtggaaaaccatcaccacgcggcgatgttagatgttgatttgcacccagcaagcgcatggacgttatatgcagttgccactacaataataactccaatgatgcggcataccattgaaaataccacggccaacattagtctaactgcaatagctaatcaagcagcaattcttatgggattagacaaaggatggccaatttcaaaaatggacattggcgtccccctccttgcacttggctgttatagtcaagtgaacccactgacattgaccgcagccgtactaatgttagtggcacattacgcaataatagggcccggacttcaagccaaagcgaccagagaagctcaaaagcggactgcagcaggcataatgaaaaaccctaccgtagatggtattgtagctatagacttagatccagtagtatatgacgccaaatttgaaaaacaacttggccaaataatgttactcatactgtgcacatcacaaattttattaatgaggacaacttgggccttatgtgaatcaataacgttggcgacagggcctctaactactctatgggaaggatcgcccggaaaattttggaatactacaatagcagtttccatggcaaatatatttaggggtagttatctggcaggagcaggactagcgttcagtttaatgaaatctctgggtggtgggaggagaggcacgggtgcgcaaggtgaaaccttaggagaaaaatggaagaggcaattaaaccaattatctaaatccgaatttaacacgtataagagaagcgggataatggaagtcgatcgaagcgaagcaaaggaaggtttgaagagaggtgaaaccacaaaacacgcagtaagtcgaggcacggctaagttgagatggtttgttgaaagaaatttagtaaagcccgaaggaaaagtaatagatcttggatgcggccgtggaggctggtcgtactactgtgctggtttgaagaaagtgacagaggtgaaaggatacacaaaaggaggcccggggcatgaggaaccaataccaatggcaacctatggatggaatctcgtaaaattacatagcggaaaagatgtattctttatcccgcctgaaaaatgtgataccttactctgcgatataggtgagtcaagtccaaatcccacaatagaagagggaagaactctaagggtgctaaaaatggtcgagccgtggttaagaggaaaccaattttgtataaagatattgaatccctatatgccctcagtggtcgaaacattagagcagatgcagcgtaaacatgggggcatgctagtcagaaatccattaagtaggaactcaacacatgagatgtattgggtctcatgcggtacgggaaacatagtctcagcagtcaatatgacatcccgaatgctactaaaccgattcactatggcccatcgaaaaccaacatacgaaagagatgtagatctaggtgctgggacaagacatgtagctgtagaaccggaggttgcgaaccttgacatcatcggacaaaggattgagaatatcaaacacgagcataaaagtacttggcattatgatgaagacaacccctacaagacgtgggcatatcacggatcatatgaagttaaaccatcaggatctgcatcatcaatggtaaatggcgtagtaaaactgcttaccaaaccatgggatgtgatacccatggtcacacaaatcgctatgaccgacacgacaccatttggtcaacaaagagtatttaaagaaaaggtagacacaaggacacctaaggcgaaaagaggaactgctcaaattatggaagtaacagcaaaatggctgtggggattccttagcagaaacaaaaagccaagaatttgcacaagagaggagttcacaagaaaagtacgcagcaatgcagcgattggagcagtatttgtagacgaaaatcaatggaactctgccaaggaagccgtggaggacgaaaggttctgggatttagtacatagagaacgcgaactacataagcaaggaaaatgcgctacctgcgtatacaatatgatgggtaaaagggagaagaaattaggggaatttggaaaagcaaaaggatcgagggcaatatggtacatgtggctaggagcgcgatttcttgaatttgaagcgcttggatttatgaatgaggaccattggtttagtagagaaaactccttatctggagtagaaggtgaaggattacacaaattgggatatatactacgagatatttcgaaaataccaggagggaatatgtacgctgacgatacagcaggatgggatacacgaatcacagaagatgatctgcagaacgaagcacgcattactgacataatggagcctgaacatgcactgttagctaaatcaatcttcaaactgacctaccaaaataaagtcgtccgagttcaaagacctgccaaaaatggaaccgtcatggacgtgatatcgaggagagatcaaagaggtagtggacaagtcggcacatatggactcaacacatttacaaacatggaagctcagttaattaggcaaatggagagcgagggtatattttcccccagtgaactagagaccccaaacttagccgaaagagtgttagattggctagaaaagtacggcgttgagagattaaaaagaatggcaatcagcggggacgattgtgttgtaaaacccattgatgataggttcgctactgcactcacggcattgaacgacatgggaaaagtgcgaaaagatattccacaatgggagccatcgaaaggctggaacgactggcaacaagtaccattctgttctcatcattttcatcagcttattatgaaagatgggcgtgaaatagtagttccatgtagaaaccaagacgagctagtaggtagagcaagggtttcacaaggtgcagggtggagtcttagagaaaccgcctgtttaggtaaatcttacgcacaaatgtggcaattaatgtactttcaccgaagggatcttcgtcttgccgccaatgcaatatgctctgccgtgccagtggattggattccgacctcaagaacaacatggtcaatacatgcccaccatcaatggatgactaccgaagatatgctttcagtttggaaccgtgtatggatcgaagagaacccatggatggaagacaaaacccacattagcagttggggtgatgtcccatatttagggaaaagagaggatcagtggtgtggaagtcttataggcttaactgccagagctacttgggctacgaacattcaagtggctattaatcaggtcagaaggttaataggaaacgaaaattaccttgattatatgacgtcaatgaaaagattcaaaaacgagtcagatccagaaggagccttatggtaa

SEQ ID NO: 21685 - RNA, 9879 nt, synthetic construct
  misc_feature 1..9879: note = derived and/or modified CDS sequence (opt6) from DENV-1__GQ199805__SS-prME
  source 1..9879: mol_type = other RNA
agcgttacaatgttactaatgttaatgcctacagcactagcattccacctgacaacacgtggtggagaacctcatatgatagtaactaaacaagagagagggaaatctctactgttcaaaaccagcgcaggggtaaacatgtgcacgttaattgcaatggacctaggagaactttgtgaagatactatgacttataaatgccctagaataacagaagccgaaccagatgatgtggactgctggtgtaacgcaacggacacttgggtaacgtatggtacatgcagccagacgggagaacacagaagagacaaacgatccgttgcccttgcgccacatgtcggactaggtctagaaactaggactgaaacatggatgtcgtcagaaggagcgtggaagcagattcaaagagtagaaacttgggcgctaagacatccagggtttactgtaatagctctatttttggcacacgttattgggacatcaatcacccagaaaggtataatcttcatactcctcatgcttgtaacaccatctatggccatgagatgcgttggaataggcagcagagattttgttgaaggtttatccggagcaacttgggtagatgtggtgttggaacatggaagttgtgtgacgacaatggctaaagacaaaccaacactagatattgagctattgaagacggaagtcaccaacccagccgtattaagaaagctatgcatagaagcgaaaatcagcaatacgacaaccgatagtcgatgtccaactcaaggggaagcgactctaatggaagaacaagatgctaatttcgtatgtagaagaacctttgttgatcgggggtggggcaacggctgtgggctgtttggaaaagggtccctaattacctgcgcaaaatttaaatgcgtaaccaaattagagggcaagatcgttcaatatgaaaatttgaagtattcagttatagtgacagtacatacgggcgaccaacatcaggtaggcaatgaaagtactgaacacggtacgacggccacaataactcctcaggcgcccacgagcgaaatacaacttactgactacggagcacttaccttagattgcagccccaggactgggcttgatttcaacgaaatggtcctgctgacaatgaaagagaagtcatggctggtgcataaacaatggttcttggacctacccttaccatggacgagcggtgcatctacaagccaggaaacatggaaccgacaagatttgctcgtgacatttaagacggctcatgccaagaaacaggaggtcgtagtactaggaagtcaagaaggcgcaatgcacacagcattaacaggagcaacggaaattcaaacatcaggtactaccacaatcttcgctggacatttaaaatgtcgtttgaaaatggataaattaacactaaaagggatgagttacgttatgtgtaccggcagctttaagttagaaaaggaagtagctgagacacaacacggaacagtgcttgtacaaataaaatatgaaggtactgacgcaccatgcaaaataccattcagtacgcaagatgagaaaggagttacacaaaatggtagattgattactgctaatccgattgtaacagataaagaaaagccagtgaatatcgaagcagagccaccatttggggagagctatatagtaataggtgccggtgagaaagcattaaaactatcttggtttaagaaagggtcgagcattggcaaaatgtttgaagccactgcgagaggggcaagacgcatggccatattgggcgacacggcttgggatttcggatccataggcggagtttttactagcgtaggaaaattggtccaccaaatattcggtactgcgtatggtgttctattttcaggtgtatcatggactatgaaaataggattgggtgtccttctcacatggttaggactaaactctcgtagcacaagccttagtatgacatgtatagcagtcggattagtaacactttatctaggtgtaatggtacaagctgattctggttgcgtgatcaattggaagggtcgcgagttaaaatgcggctccgggatatttgtgacaaatgaagttcacacgtggactgagcaatataaatttcaggcagacagccccaaaagactgtctgccgctattggtaaggcgtgggaagaaggggtatgcggcattcgttcggcaactagactagaaaatatcatgtggaaacaaatttccaatgaattgaatcatatacttttagaaaacgatatgaaatttacggttgtagtgggggacgttgtaggtatactagcacagggcaaaaagatgatacgtcctcagccgatggagcacaagtacagctggaaatcatggggcaaagcaaaaataataggcgccgacgtacagaataccaccttcataatagatggacctaatacacctgagtgtccagatgatcaaagagcgtggaacatatgggaagtggaggattacggatttggaatattcacaacaaacatatggttaaaactaagagactcacacacgcaggtatgtgaccacagattgatgagcgcagcgataaaggacagtaaagctgtccacgcagatatgggttattggatagagagcgagaaaaatgagacctggaagttagctagagcgagcttcatagaagtaaaaacatgcatttggccaaagagtcatactctatggagcaacggtgttctagagtctgaaatgattattccaaaaatatatggaggacctattagccaacataactaccgcccgggctattttactcaaactgctggaccttggcatcttggcaagctcgaattagatttcgacctatgtgaagggacaacagtagtagtagacgaacattgtgggaacagaggacccagcttgcgtactactacagttacagggaagattattcacgagtggtgttgcagaagctgcactcttccacccctccggtttaaaggagaggacggttgttggtatggaatggaaattagaccagtcaaagaaaaagaagagaacctcgtaaagtcaatggtttctgcaggtagtggggaagtagatagtttttccttaggactattgtgtatatccatcatgatagaggaagtgatgaggtcgagatggagcagaaaaatgttaatgacaggaacattagctgttttcttactattaatcatgggtcaattaacttggaacgatttgacccgtttgtgcattatggttggagcaaatgcgagcgacagaatgggcatgggtacaacatatttagccctaatggcaacctttaaaatgcggccaatgtttgcagtgggattattatttagaagactgacatcaagagaggtactcttgttgacaattggattatccttagtagcaagtgtagaattaccaaacagcttagaagaactgggtgatggacttgcgatgggtataatgatcttgaaattactaacagattttcagtcgcatcaattatgggcaacgttattaagtttaacttttatcaagacgacactaagcctacattatgcgtggaagacaatggccatggttctttccatagtttctttatttccattatgcttaagtacaacttcacagaaaactacatggttaccagtactattaggaagtcttggctgtaaaccattagctatgtttctaatagcagagaataaaatttgggggcgaaaatcatggccacttaatgaaggaattatggcggttggcgtagtaagtattcttttgtcttctctactgaaaaacgatgtacctttagctggaccattgattgccggtggtatgctaattgcgtgttacgtaatctcaggttcctcggccgacttgtcattggagaaggcagcggaagtatcgtgggaggaagaggcggaacactccggggcaagtcataatatcctagtagaagtacaggatgatggcaccatgaaaataaaagatgaagagagagacgacacattaacgattcttctaaaagcaacgctgctagcggtttcaggtgtatatcctttatcgattccagcaaccttgttcgtatggtacttctggcagaagaagaaacaacgcagcggagtcttatgggatactccctcgccaccagaagttgagagagccgtacttgatgacgggatatatcgaattatgcaaaggggacttttaggtaggagtcaagtaggagtgggagtattccaagaaaacgtctttcatacaatgtggcatgtcacaagaggagctgtactaatgtaccagggaaaaaggttggagccatcttgggcttcggtcaagaaagacctaataagctatggagggggctggcgactacaaggatcgtggaatacgggcgaggaagttcaagtaatagcggtagaaccagggaaaaatcccaaaaatgtacaaactgcaccgggaacatttaaaacgccggaaggagaagttggagcaatagctcttgattttaaaccaggtaccagtgggtcccctatcgttaaccgggaaggaaaaatagtaggactgtacggtaatggtgtagtaacaacatcgggaacatatgtttctgcgatagcacaagcaaaagcatcacaagaaggaccacttcccgaaatagaggatgaagtattcaggaaacgaaacttgacaatcatggatttgcaccccggcagcggaaaaacaagaaggtaccttccagcaatagtacgagaagccatcaaaagaaaacttagaaccctcatcctagcgccgacaagagttgtggcaagcgagatggcagaagcactgaagggaatgccgataaggtatcaaacgacggcagtaaaatcggaacatacaggtaaagaaattgttgatttaatgtgtcacgcaacatttacaatgcggttactatctcccgtacgtgttccaaactataatatgataattatggatgaagcgcattttacagacccttccagcatagcagcacgtggatacatatcgacaagagtaggaatgggtgaagctgcggcgatattcatgacggcgacaccgcccggatcagttgaagcatttcctcagtcaaatgccgtaatccaagacgaggagcgtgacatacccgaacgttcatggaactctgggtacgagtggattaccgattttcctggaaaaaccgtttggtttgttccatcaataaagtctggcaatgacattgcaaactgcctccggaaaaatgggaaaagagtgattcaattaagcagaaaaacttttgacacagaatatcagaagacaaagaataatgactgggattacgtagttacaactgatatttctgaaatgggagctaactttagagctgatcgagttatagacccaagacgatgcctgaaacctgttatcttaaaggatggcccagagcgagttatacttgccggaccaatgccggttaccgttgcatcagcagctcaacgaagaggccgaatcggcaggaaccataacaaagaaggggaccaatatatatatatgggtcagccattaaacaacgacgaagatcacgctcactggactgaagccaaaatgttattagataacataaatacccccgaaggaataattcctgcgctatttgaaccggaaagagaaaaatccgctgcgattgacggagagtataggttgagaggagaagcacggaagacatttgtagagcttatgcgtagaggggaccttccggtatggttatcttacaaagtcgccagcgaaggtttccaatatagcgatagaaggtggtgtttcgatggagagcgaaataatcaagtattagaagaaaatatggatgtcgagatttggacaaaggaaggagaaaggaagaaacttcgacctagatggttagatgcccggacatactcagaccctctagcactaagggagtttaaggaatttgcagcgggtagacgatctgtgagtggagaccttatattggaaataggaaaattaccccaacaccttacacaaagagcacaaaatgctctcgataacttagtaatgttacacaattcagaacagggtggaagggcatatcggcacgctatggaagaattacctgacaccatagaaacattgatgttattagctctaatagccgtattaactggtggggttacattattctttctatcaggccgtggacttggtaaaacttccataggactactttgtgtgatggccagctctgttttactatggatggcgagtgtggaacctcattggatcgcggcttctattatattagagttctttctcatggtgctactaattcccgaacccgacagacagcgaacgcctcaagataaccaacttgcctatgtagtaattggactcctctttatgatactgacggtcgcggcaaatgaaatggggttattagaaactacaaagaaggatctcggtatagggcatgttgcagttgaaaaccaccatcatgcgacgatgctagatgtagatctccacccagctagcgcatggacattatacgcggtggccacaacaataataactccaatgatgcgacacacaatagagaataccacagctaatataagtttaactgcaattgccaaccaagccgcaatattaatggggttggataaaggatggccaatttctaaaatggatataggtgtaccccttttagcacttggatgttactcacaagttaatcctctaactctaacagcagccgttttgatgttagttgcgcactatgccataattggtcccggtttgcaagccaaagccacacgagaggctcagaaacggacagcagctggaattatgaaaaatccgaccgtagatggaattgtcgctattgatttggacccagtagtttacgatgcaaaatttgaaaagcaactaggacaaataatgttactcatcctctgcacatcacagatactgcttatgcgaactacgtgggcactatgcgaatcaatcactttagcgacgggaccgctgacgacactctgggaggggagcccaggtaaattttggaacactacgattgcggtctccatggcgaatatattccgagggagctatctggcgggtgcaggcttagcattcagtttaatgaaatctctgggtggaggtagaagaggcacaggtgctcaaggtgaaacactaggtgagaaatggaagcgtcaacttaatcaattgagtaaatccgagttcaacatctataaaagatctgggatcatggaagtcgaccgaagtgaagcgaaagaaggcttaaaaaggggcgaaactacacgccatgcagtatccaggggtacagctaaactcaggtggtttgttgaacgaaatttagtcaaaccagaaggcaaagtaattgatctcggttgcgggcggggaggttggtcatattattgtgcaggactcaagaaagtaacagaagttaagggatatacaaaaggaggtcctggacatgaagaacctataccgatggcgacctatgggtggaatctagtaaaattgcatagcggcaaggatgtattcttcacgcctcccgaaaaatgtgacacactactttgtgatattggagagtcatcacctaatccaaccattgaagaagggaggacacttagggtattaaagatggtagaaccgtggttgcgaggtaatcagttttgcataaaaatattaaatccatacatgccgagcgttgtagaaacactagaacaaatgcaacgaaagcatggaggaatgctagttaggaatcctttaagtcgtaatagtacacatgaaatgtattgggtttcctgtggtactggaaacatcgtatctgcggtcaacatgacctcaagaatgttattgaatcgatttaccatggcgcacagaaagcccacctatgaacgtgacgtagatttaggagcagggacaagacatgtcgcggtagagcccgaagtagcaaatcttgatattataggtcagaggatcgaaaatataaaacacgaacataaaagtacatggcattatgatgaagacaatccatataaaacatgggcatatcacggaagctacgaagtaaagccaagtggatcagcaagttctatggtaaatggagtagtcaaattattaacaaaaccatgggacgtcatccccatggtaactcaaattgcgatgacagacacaactcctttcggacaacagagagtcttcaaggaaaaagtagatactcgcacacccaaggcgaagcgtggaaccgcacaaattatggaggttaccgcgagatggttatggggatttctaagccgaaacaagaaacctagaatatgcacgagagaagaatttactaggaaagtaagatctaatgcagccataggagccgttttcgtggacgaaaatcaatggaactcagcgaaggaggcagtggaagatgaacggttttgggacttggtccaaaaagagagagaacttcataaacaaggcaaatgtgccacatgcgtctataatatgatgggtaaacgcgagaagaaattaggagaatttggtaaagctaaagggtccagggctatatggtacatgtggttgggagcccgctttctcgaatttgaagcattgggattcatgaatgaagaccattggttctctagagaaaactcgttgtcaggggtagaaggcgagggattgcacaagttaggatacattcttagagacatttcgaaaataccagggggaaatatgtacgctgacgacactgcgggctgggatacacgcattacggaagacgatctacaaaatgaagcacggattacagacattatggaaccggagcacgcattactagctacgtccatatttaagctaacataccaaaacaaggtggtcagggtacagcgcccggccaaaaatggtacggtaatggatgtaataagtaggcgtgatcaacgggggtctggacaagttggcacttacggcctcaataccttcacaaacatggaggcacagttaattagacaaatggaatcagaaggaatctttctcccatcagaacttgaaacacagaatctagcagagcgtgtgcttgattggttagaaaaatatggagttgaaagactaaaacgaatggccataagtggagatgactgcgtagttaaaccaatagatgataggttcgcaacggctttaactgcactcaatgacatgggaaaagttcggaaagacataccccaatgggagcctagcaaaggctggaacgattggcaacaagtacccttttgctcacaccatttccaccaactcataatgaaagacggtagggaaatagtagtaccatgtaggaaccaagatgaattagtaggtcgagcaagagtgtcacaaggtgcaggttggagtctacgtgagacagcttgcttgggaaaaagctacgcacaaatgtggcaattaatgtattttcatcgcagagacttgcgattagcagcaaacgcgatctgttctgccgtaccggtcgattgggtgccaacgtcgcgtactacatggtcaattcacgcgcatcatcaatggatgacgactgaagatatgttaagtgtatggaatcgggtatggatagaagaaaatccctggatggaagacaagacgcatgtatcaagttggggtgatgtaccttatctcggaaagagagaagatcaatggtgtggcagcttgataggcttaaccgcacgagcaacctgggcatctaatattcaggtggctattaatcaagtacgtagactcataggcaatgagaattatctggattacatgacgtcaatgaaaagattcaagaatgagggtgaccctgaaggagcattatggtaa

SEQ ID NO: 21686 - RNA, 9879 nt, synthetic construct
  misc_feature 1..9879: note = derived and/or modified CDS sequence (opt6) from DENV-1__GQ199806__SS-prME
  source 1..9879: mol_type = other RNA
agtgtgaccatgcttctcatgcttatgccaactgctcttgcttttcatctgacaaccagaggaggagagcctcatatgatagttagtaaacaagaaagaggaaaaagtttgctctttaaaaccagcgctggagtaaacatgtgcaccttgatagctatggatttaggtgagttttgtgaagatactatgacctacaaatgcccccgcataaccgaagcagaacctgatgatgtagactgttggtgcaatgctacggacacttgggtgacatatggaacgtgctcgcaaacaggagagcacaggagagataaaaggagcgtcgctctggccccacatgtaggattggggctcgaaactagaacggaaacatggatgtcctctgagggagcatggaaacaaatccaaagggtcgaaacatgggctctaagacacccaggttttactgttatcgctctctttttagctcacgcgattggcaccagtataacgcaaaaaggcataatctttatccttcttatgttggttactccttccatggccatgcggtgtgtaggtatcggttccagagattttgtcgagggtttatctggagcaacgtgggtagacgtggtccttgaacacggaagttgtgttactacaatggcgaaagataaaccaacgcttgacatagaacttcttaaaaccgaagtaacaaacccagcaattttacgaaaactttgcatagaagccaaaattagcaacacgacaactgatagcagatgcccaacacaaggagaagccacattagttgaggaacaagacgctaactttgtatgtcgtagaacttttgtagatcgaggctggggcaacggctgcggattatttgggaaaggaagtctgataacatgcgctaaatttaaatgtgtcactaaattggagggtaaaattgtgcaatatgagaacttaaaatattcggtgattgtaacggtgcacacaggagaccaacatcaagtaggaaacgagagtacagaacacggaacaacagctacaataacaccacaagcaccttctaccgaaattcaattgacagactacggagcgttaacattagactgcagtccaaggacagggttggattttaatgaaatggtgttgttaacaatgaaagagaaaagctggttagtgcataaacaatggtttctggatttgcccctaccttggacttcgggagcgagcacatcacaggaaacatggaacagaaaagatctattagtcacattcaagacagcgcacgcaaagaaacaagaagccgtagtactaggatcgcaagaaggggctatgcacactgcattaacaggcgcgaccgaaatacaaacctctggaacgaccacgatttttgctggacatctaaaatgccgcttaaaaatggataaactcacactaaagggcatgtcgtacgtgatgtgtacaggtagctttaaattagagaaagaagttgcagaaactcaacatggaacagtcctcgtacaaataaaatatgaaggtacagatgcaccatgcaagataccgttcagtactcaagatgaaaaaggtgtcacacaaaacgggcggcttataactgcaaatccaattgttaccgataaagaaaagccagttaatatagaagcggaaccaccgttcggtgaaagctacatagtgattggggccggtgaaaaagcactaaaactgtcgtggtttaagaaaggaagctcaattggaaagatgtttgaagcaaccgcacggggagcaagaagaatggcaatattaggagacaccgcatgggactttggaagtataggaggagtgtttacttcagtaggaaagctagtccatcaaatctttgggacggcttacggagtcttatttagtggcgtaagttggacaatgaagataggaattggagtactgttaacatggttaggtcttaacagtaggtcaacttctctttcaatgacatgtatcgtagtcggactggttacattatatttaggtgtaatggtgcaggcagattcgggttgtgtaatcaactggaaaggccgcgagttaaagtgcggatccggaatttttgtaacgaatgaagtacacacgtggacggaacaatataaatttcaagcagattccccaaaacgccttagtgcagccatcggtaaggcatgggaagaaggggtttgcggcattcgctcagccactcgcttagaaaacataatgtggaaacagataagtaacgaactcaatcatatacttttagagaacgatatgaagttcacagtggtagtaggagacgtcgctgggattctggcacagggtaagaaaatgattagaccccaaccaatggaatacaaatattcatggaagagttggggaaaagcgaaaattataggggcagatgtacaaaacacaaccttcattatcgatggaccaaacactccagaatgtcctgacgaccaaagggcctggaatatatgggaagtagaagattacggatttggtatattcactaccaacatatggttgaaactaagagattcctacacacaggtctgtgatcaccgactcatgtcagccgcgataaaagatagtaaggccgtacatgcagacatggggtactggatagaatcagagaagaatgagacttggaaactagcccgtgcatcttttatagaagttaaaacttgtatttggccaaaatcacataccttatggagcaacggagtcctagaaagtgaaatgatcattccaaaaatttacggaggacccataagtcaacataattaccgtccgggctattttacacaaaccgcgggaccgtggcatcttggtaaattggagttagattttgacttgtgtgaaggtaccaccgtagtagtagatgaacattgtggaaataggggtccatccttacgtactacaaccgtcactgggaagataatacatgaatggtgctgtagatcttgcaccttaccgccattgcgattcaaaggagaagatggttgctggtatggcatggaaatcaggcctgtgaaagaaaaggaagagaacctagtaaaatcgatggtttctgccggatctggtgaagtagacagcttttcactagggttgctatgtattagcataatgatagaagaagtaatgcgatccaggtggagtagaaagatgctaatgaccgggacattagctgtattctttcttttgattatgggccaattaacctggaacgacctcattcgtttatgcattatggtgggtgcaaatgcgtccgatcgcatgggaatgggaacaacgtacctcgctctaatggcaacatttaagatgagaccaatgtttgcagtcgggctactgttccgacgtctcacttcacgagaagtattacttcttacaattggtctaagtttagtagccagcgtagaattgccaaattctctagaagaacttggagacgggttagcaatggggattatgatcctaaaattacttacagatttccagtcacaccaattatgggcaactttgctatcattgaccttcataaaaacgacattttctttacattacgcatggaagacgatggcgatggtgcttagtatagttagcctattcccactctgtctgtcaaccacttctcagaaaactacatggttacccgtacttttaggaagcctagggtgtaaacccctgacaatgtttttaatcgcggagaataaaatatggggaagaaaatcctggccgttaaatgagggcataatggccgtagggatagtaagcatattattatcatcattacttaaaaatgacgtaccactagctggaccactaattgccggaggaatgttaattgcatgttacgtcataagtggatcttctgcagatttatctctcgaaaaggctgcagaggtatcttgggaagaagaagcggaacacagtggagctagccataacattttagtagaggttcaggatgatggaacaatgaaaattaaagatgaggaacgagacgataccttaacaatattacttaaagccacgttattagccgtaagtggagtataccccttatctataccagcgacactgtttgtatggtacttctggcagaaaaagaaacaacgtagcggagtactttgggatacaccctctcctccagaagttgaacgggccgtacttgatgatgggatttaccgtattatgcaaagaggcctactcgggcgatcccaagtaggtgttggagtgttccaagaaaatgtgtttcacactatgtggcatgttacacgaggcgcagtcctaatgtatcaaggcaagcgcctcgaaccatcctgggcgtctgtaaagaaagacctcattagctatggagggggttggcgattacagggatcctggaatactggggaagaagtacaagttatagcagtagaacctggtaaaaatcctaaaaatgtacaaactgcgcctggcacttttaaaacgagtgagggagaagttggagctatagcactagacttcaaaccaggaacgtccggcagtccaatagtaaatagagaaggaaaaatagtaggactttacggaaatggagtggtcacaacctcgggtacatacgtatcggcaattgctcaagccaaagcaagtcaagatggaccgttaccagaaatagaagatgaggttttccgtaaaagaaatttgacaataatggatctacacccaggaagtggaaaaacccgtagatatctccctgctatagtaagagaggcaattaagaggaaactgaggacattgatcctggccccaacacgtgtggtagcctcagaaatggcagaggcacttaaaggaatgcctataagatatcaaacaactgctgtcaaatctgaacataccgggaaagagatagtggatttaatgtgccacgccacattcacaatgcgattactatccccagtaagagttccgaattacaacatgattatcatggatgaagcacactttacggacccgtcttcaatcgctgctcgcggctacatctccacaagagttggcatgggagaagctgccgcaatttttatgacggcaactccgcccggtagtgtcgaagcatttccccaaagcaacgccgtcatacaggacgaggagcgggacatccccgaacgcagttggaactcgggatatgaatggataacagacttccctggaaagacagtatggttcgttcccagcataaaaagtggtaatgatatagccaattgcctaagaaagaatgggaaaagagtgatacaactttccagaaaaacattcgatactgaataccagaaaactaaaaataacgattgggactacgtggtcaccactgatatatcagaaatgggtgcgaattttcgagctgaccgagtaatagaccccagaagatgtcttaaaccggtcatactaaaagacggaccagagcgtgtaattctggctggcccaatgccggttacagtagcatctgcagcccaacggcgcggccgtataggcagaaaccacaataaagaaggggatcaatacatatacatgggccaaccactcaataacgatgaagaccatgcacattggacggaagccaaaatgctcttagacaacataaatactccggaaggcatcatcccagctctgtttgaaccagaacgtgaaaaatcagcggctattgatggagaatatagattgaggggcgaagcgagaaaaacattcgtagagctcatgaggaggggcgacctccccgtatggttgtcttataaagtcgcatccgaaggttttcagtatagcgatcgaaggtggtgttttgatggagagcggaacaaccaagtattagaagagaatatggatgtggagatctggacgaaagaaggtgaacgaaagaaattgagaccaaggtggcttgatgcccgcacatatagcgatcctttagcactaagagaatttaaagaatttgcggcgggtagaagatccgtatccggtgatttaattctagagatcggaaaattaccgcaacatttaacccaacgagcacaaaatgcactcgacaatctagtgatgttgcataactctgaacaaggaggcagagcctacagacacgcgatggaggagctccccgatacaatagaaacgctcatgctgttggctttgattgcagtattaacaggaggagtaacactattctttctatccggacgaggcttgggaaagacaagtataggacttttatgcgtgatggcttcatccgtcctattatggatggcatcagtagaaccacattggatagctgccagcattatactagagttctttctcatggtattattgattccagagccagatagacaaagaacgccacaggataaccagctggcgtatgtagttattggattgctgttcatgatactaacagtggcagcaaacgaaatgggactacttgaaacgactaagaaagatttaggtataggtcacgtagccgttgaaaaccatcatcacgcagcaatgctggatgttgatctacacccagcgagtgcatggacattatatgcggttgctaccacaattataactccgatgatgagacatacaattgaaaacacaactgcgaacatatcgttgaccgcgatagctaaccaggcagcgatcttaatgggtctggataaaggatggcctatttccaaaatggacataggcgtaccgcttctggctcttggatgttattcacaggtcaatccgcttacattgacggcggcagttctcatgctagttgcgcattacgccataattggtcctgggctacaagctaaagctacaagagaagcacagaaaaggactgcggccggtattatgaaaaatcccactgttgacggcatagtagccatagatctcgatccagtagtttacgatgcgaaatttgaaaaacaattaggacagataatgctcttgatattatgtacatctcagattctgctaatgcgcacaacatgggcattatgtgagtcaataacattagcgactggtccattaaccacgctatgggagggttcacctggaaaattttggaacactacaatcgcagtttcgatggctaatatctttagaggatcatatttggccggtgctggattagctttcagtctaatgaaatcactaggaggaggaaggcgcggtactggagcccagggagaaacattaggagaaaaatggaagcggcaactcaaccaattaagtaagtcagaatttaatacttataagcgaagtggtattatggaagttgatcgatccgaggcgaaggaaggtttgaaacgtggagaaaccactaaacacgcagtaagtagaggcacggcgaaactaaggtggttcgttgaacgaaaccttgttaaacctgaaggtaaagtaatagacttgggttgcggaagaggcgggtggagctattactgtgctggactgaaaaaggtcaccgaagtcaaaggatataccaaagggggcccagggcatgaagaaccaatcccaatggcaacttatggctggaatcttgtgaagctaaattcaggaaaagatgtattctttataccgccagaaaaatgcgatacacttctgtgtgatataggtgaaagctctccaaatcctacaattgaggaaggccgtacattgcgagtacttaagatggtcgaaccatggctacgcggaaaccaattttgtatcaaaatactaaacccatacatgccttctgtcgtagaaactcttgaacaaatgcaaagaaaacatggtggtatgctagtccgaaatccactaagccgtaattctacacatgaaatgtattgggtctcatgtggaacgggaaacatagtaagcgccgtaaacatgacgagtaggatgcttctcaacagatttacaatggcccaccgcaagccgacttatgaacgagatgtagacctgggcgctggaactcgtcacgtcgctgtagaacctgaagttgctaacttagatattataggtcaacgcatagaaaacataaaatatgaacataaaagcacctggcattatgacgaggataatccttacaaaacttgggcctatcacggatcatacgaagttaaaccatcaggaagtgctagttctatggtgaatggagtggttaaacttctgacaaaaccatgggacgttatcccaatggtcacacaaatagctatgaccgataccacgccattcggccaacagagagttttcaaagaaaaagtagacacaaggacacccaaggccaaacgaggaacggcacaaatcatggaagttactgcaaaatggttgtgggggttcctttccaggaacaagaaaccgcgaatctgcacaagagaagaatttacccgaaaagtcaggtcaaacgcagcaataggtgctgttttcgtagacgaaaatcaatggaatagcgctaaagaagcggttgaggacgaaagattctgggatctcgtccatcgggaacgagaactccataaacaaggaaaatgtgcaacatgtgtttacaatatgatgggtaagcgagagaagaaacttggcgaatttggaaaagctaaaggaagtagagcgatatggtacatgtggttaggcgcaagatttttagagttcgaagcactgggatttatgaacgaggatcattggttctcgagggaaaattcgttaagtggcgttgagggggaaggtctccataaattgggttacatacttagagatattagcaaaataccaggtgggaatatgtatgcagacgatacagctggatgggacactagaataacagaagatgatctccaaaatgaggctaaaattactgatataatggaacctgaacatgcacttctagcaaaatctatttttaaattaacttaccagaataaagtggttagagtacaacgccctgccaaaaatggaacagtgatggatgtgatatctcgaagagaccaacgggggtctgggcaagtgggtacatacggcttgaatacattcacaaatatggaagcacaattgattagacaaatggaatctgagggtatatttagtccatcagaattggagacaccaaatttggcgggacgagtcctagactggttggaaaaacatggtgtagagcggctaaaaagaatggcaatttcgggggatgattgtgtcgtcaaaccaatagacgaccgattcgccacagcattgacggcactgaatgacatggggaaagtacgaaaagatataccacaatgggagccaagtaaagggtggaatgactggcaacaggtcccgttctgttcccatcatttccatcaactcataatgaaggatggaagagagatagtagtaccttgtagaaaccaagatgaactggttggacgagctcgagtttctcaaggagctggatggtcactcagggaaacagcatgcctcgggaaaagctatgcacagatgtggcagctaatgtatttccataggcgcgatttacgattagcagcaaatgctatctgttccgcagtacctgtagattgggtcccaacatcacgcacaacatggtcgatacatgcgcatcatcagtggatgactactgaggatatgctatcggtatggaaccgtgtatggatagaagaaaacccgtggatggaagataaaacacatatcagctcatgggaggacgttccatatcttggaaagcgagaggatcaatggtgcgggagcctgatagggctcactgctagagcaacctgggctacgaatatccaagttgccataaatcaagtaagacgtctcatagggaacgagaattatctggactatatgacttccatgaagagattcaaaaatgagtcggatcctgaaggagcattgtggtag

SEQ ID NO: 21687 - RNA, 9879 nt, synthetic construct
  misc_feature 1..9879: note = derived and/or modified CDS sequence (opt6) from DENV-1__GQ199809__SS-prME
  source 1..9879: mol_type = other RNA
tcagttactatgctcttaatgctaatgccaactgcccttgccttccatctaactacccgcgggggcgaacctcatatgatagttactaaacaagaacgggggaaatctttgctattcaaaacttcagcgggtgtgaatatgtgtaccctgatcgcaatggatctaggcgaattgtgcgaagacactatgacttataaatgcccaagaataactgaagctgaaccagatgatgttgactgttggtgcaatgctacagatacttgggtaacatatggtacttgtagtcaaacaggagaacatcgcagagataaacgttcggtggcgttggcaccacacgttggcctaggtttagaaactcgtactgaaacttggatgtccagtgaaggagcatggaaacaaatacaacgcgtggaaacttgggcattaagacatcctggattcaccgtgattgcactattcctagcacacgcaataggcacaagcatcacccaaaaaggtattatctttatactgctaatgctcgtgacaccgtcaatggcgatgcgatgcgtagggataggatcaagggattttgtggagggactgtctggtgccacatgggtagacgtagtgttggagcatgggtcttgtgttacaacaatggcaaaagataaaccaaccctcgatatagaattactaaaaacagaggtaacaaatccagctgtcttaaggaagttatgcatcgaagccaaaatatcgaacacaactaccgactcaagatgtccaacgcaaggagaggcaacgctaatggaggaacaagacgctaatttcgtctgtagaagaacttttgtagatcggggctggggcaacggatgcggtctatttggaaaaggaagtctgataacgtgtgccaaatttaagtgtgttacgaaactagaaggaaagatagtacagtatgaaaacttaaaatattctgtaatcgtcacagtgcacacaggagatcaacaccaagtaggcaatgaatcaacagaacacggtactaccgcaaccattacaccgcaagcacctacaagtgaaatacagctcacagattatggcgctcttacattggactgttcaccgagaactggtttagacttcaatgaaatggttctactgaccatgaaagaaaagtcttggctcgtacataaacaatggttcctcgatctcccattaccttggacatcgggggcatctacaagtcaagaaacatggaatcggcaagatttactggtaacattcaagacagcccatgccaagaaacaagaagtcgtagtacttgggagccaagaaggtgctatgcataccgcattaactggagccacagaaattcaaacttcaggcacaacgaccatatttgctggacatctaaaatgcagacttaaaatggataagctgaccctaaaaggaatgtcttacgtaatgtgtactggaagttttaagttagaaaaagaagtagctgagacacagcatggtacagtacttgtacaaattaaatacgaaggaacggatgcaccttgcaaaattccattctctacacaggacgaaaaaggagttatacaaaatggtagacttatcaccgctaatccaatagttactgacaaagaaaagccagtaaacatagaagcggagccaccgtttggcgaatcatatatagtaataggcgtgggagaaaaagccctaaaattatcttggttcaaaaagggctcgtccattggcaaaatgtttgaagctacagctcgaggtgctcggcgtatggcgatattaggtgatacggcgtgggatttcggttctataggtggggtattcacaagtgtgggaaagttagttcatcaaattttcggtactgcatacggtgtgcttttctccggtgtctcttggacaatgaaaattggtataggtgtactactaacatggcttgggctaaatagtcgatcaacttcgttaagcatgacgtgtatagctgtgggtcttgtgacattatatctgggagtaatggtgcaagcagattcagggtgcgtaataaattggaaagggcgagaattaaagtgtggatctggaatctttgttacaaatgaagttcacacttggacagagcaatataaatttcaagccgattcgcccaagcgacttagcgcagcgataggcaaagcatgggaagagggggtatgtgggattaggagtgtcacaaggttagaaaacataatgtggaaacaaataagcaatgagctaaaccatatcctacttgaaaatgatatgaaatttacagtagtagttggtgatgttgtcggtatactagcacagggtaagaaaatgattagaccacaaccgatggagcacaaatattcatggaaatcatggggtaaggcaaaaatcatcggagccgacgtacaaaacacaacttttataatagatggcccgaacactccagagtgcccagacgaccaaagagcctggaatatatgggaagttgaagattatgggttcggtatattcacaacaaatatttggttaaaactgcgagattcatacacgcaggcatgcgaccatagattaatgtccgcagcgataaaagacagcaaagcagttcatgcagatatgggatactggatagagtcagagaaaaatgagacatggaagctggctcgagctagttttatagaagtaaagacatgcatttggccaaagagtcatacattatggtcgaacggagtcttggaatcggaaatggtcataccaaagatatatggtggacccattagccaacataattatagaccaggctatttcacacaaaccgcaggaccatggcatcttggaaaattagaactcgatttcgatctgtgtgaaggaacaacggtagttgtcgacgaacattgcgggaatcgaggcccaagtttaagaacaacaactgtcactgggaaaataattcacgaatggtgctgtagatcatgcacgttacctcccctaaggttcaaaggtgaagacggatgctggtatggtatggaaattagaccagtaaaagagaaagaagaaaatctcgtaaagagtatggtatccgcaggaagtggagaagtggatagttttagcttaggattgctttgtatttcgataatgattgaggaagtaatgcgctctagatggtcacgaaaaatgcttatgactggaacgcttgcggtatttttgctacttattatgggacaattaacgtggaacgatttaataaggctatgcattatggttggagcgaatgcatctgatcgcatgggcatgggtacaacatacctagccctaatggcaacattcaagatgcgtcctatgttcgcggtaggactactttttaggcgactgacaagtagggaagtattactcctcacgattggtctaagcctagtagcttctgttgaactaccgaactcgctagaagaactaggcgatggcttggctatgggaataatgattttaaaattattaacagacttccaatctcaccaactttgggcaactttattgtcccttacatttatcaaaaccactctaagtctgcattacgcctggaaaacaatggccatggtacttagtatcgtttcactcttccctctgtgcctaagtacgacatcccagaaaactacatggttaccagtgttgttaggcagcctaggctgtaaaccactaacgatgtttttgatagctgaaaataaaatctggggaaggaagagttggccactaaatgaagggattatggcagttggagtcgtctcaattttactgagcagtctactgaagaatgatgtacctctagcaggtccacttattgcgggtggcatgctgattgcgtgctacgtcatttctgggagctccgcagatctctctctcgagaaggcagccgaggtgtcgtgggaagaggaagctgaacattcaggcgcaagtcataatatattagttgaggtccaagacgatggaacgatgaaaatcaaagatgaagaacgtgatgataccctaacaattctacttaaagcgaccttacttgcggttagtggagtttatcctctctctatccctgccacattgtttgtttggtatttctggcaaaagaagaaacaacgttcaggtgttttgtgggatactccatcaccaccggaagtcgagagggctgttctagatgatggaatctatagaattatgcaaagaggtctcctagggcggagccaagtgggggtgggagttttccaggagaatgtttttcatacaatgtggcatgtcacacgaggagcagtactaatgtaccaaggaaaacgactcgaaccttcatgggcatccgtaaagaaggatcttatcagttacggagggggatggagactacaaggcagctggaatacaggagaggaagtacaggtaatagcggtggaacccggtaaaaatccaaagaatgtacaaactgcgcccggtactttcaaaactccggaaggcgaagttggcgctattgcattagactttaagccgggtacatctggaagccccattgtgaatagagaaggtaaaatagttgggctatatggtaatggagtggtcaccacttctggtacttacgtgtcagcaatcgcccaggcaaaggccagccaagaaggtcccctcccagaaattgaggatgaagtcttcagaaaacgtaacctgacgattatggatcttcatccaggcagtggtaagacaagaagatacctacctgctatagtacgcgaggctatcaaacgtaaactgcggacactaatactggcacctactagagttgttgcgtcagagatggccgaggcattgaagggaatgccaataagatatcagactacagcagtaaaatcagagcacacaggaaaagagattgtagacttgatgtgccacgccacctttactatgcgtttattatccccagttcgagtacctaactataacatgatcattatggacgaggctcattttacggacccgtcaagcatagctgcaagaggctatatctcaactagagtgggaatgggcgaagctgcggccatctttatgactgctacaccaccgggatcagttgaggctttcccgcagtcaaatgctgtaatccaagatgaagagagagacatacctgagcgatcctggaactcagggtatgaatggataacagacttccctgggaaaacagtttggtttgtgccttctattaaatccggcaatgacatagccaactgtttgaggaaaaatgggaaaagagtaattcaactatccagaaaaacgtttgataccgaatatcagaaaactaaaaacaacgattgggactacgttgttactaccgatatttcagaaatgggtgcaaattttagagcagatagagttatagacccgaggagatgcttgaaaccagtcatccttaaggatgggccagaaagagttatacttgcaggaccgatgccagtaactgtcgcctcggccgcacaacgtcgcggtcgaatagggaggaatcataataaagagggcgaccaatacatttatatgggacaaccactgaataatgacgaagaccacgctcattggacagaagcaaagatgttactcgataatataaacacaccagaaggaattatacccgctctatttgaaccagaacgtgaaaaatcagccgcaatagacggcgaatatagattgcgtggtgaggcacgaaaaacattcgtagaattgatgcggaggggtgatttgcctgtttggttgtcctataaagttgctagcgaaggcttccaatattctgaccgcagatggtgttttgacggtgaaagaaataatcaggttctagaagaaaatatggatgtagaaatatggactaaggaaggagaacggaagaaattgcgaccgcgctggcttgacgcccgaacatacagtgacccgttggctttgcgggagttcaaagaatttgctgcaggtcgacgatccgtatcaggagacttaatcttggaaataggaaaattgccccagcacttaacacaacgagctcagaatgcactagataacctggttatgcttcataactcagaacagggcggacgtgcatacagacacgcaatggaagaattgccagacacaatagaaacactaatgttacttgcgctaatagcagtattaactggcggagtaacattgttctttttatcaggaaggggtctgggtaaaacgagtataggtttactctgtgtaatggcaagctccgtattgttatggatggcaagtgtagaaccacattggatagcagcgagtattatattagagttcttcttaatggtattactcatcccagaacctgacagacaaagaacaccacaagataaccaattagcatacgttgtaataggattactatttatgatattaacggtagccgccaatgaaatgggtttattagagacaaccaagaaagacttaggaatcggtcatgtcgccgtcgaaaaccaccatcatgcgacgatgttagatgttgacttgcatccagcatccgcatggacactctatgcagtagcaactactattatcactcctatgatgcggcatacaattgagaatacaacggctaatatctctctaactgcaatcgcaaatcaagcagctatcttaatgggactagacaaaggttggcctatctctaaaatggatataggagtcccactgctcgcattagggtgttattcgcaagtaaatcccctcacgctcacagctgcagttctcatgctcgtggcacattacgcaataatagggcccggccttcaagctaaggccacacgagaggctcaaaaacgaactgcagctggcataatgaagaatccaacagtggatggaatagtagccatagatctagatccagtcgtgtatgatgcaaaattcgaaaaacagctaggtcaaattatgttgctaatcctatgtacgtcacaaatattgttgatgcgcacaacatgggcgctttgtgaaagcataactttagctacaggaccattaacaacgttatgggaaggatcacccggtaaattttggaacactacaattgcagtctcgatggctaatatatttagaggatcgtatttagcgggtgcaggacttgcattttctctaatgaaatcactaggcgggggacgacgcggaacaggggcccaaggggaaaccctcggagagaaatggaaaagacaactaaatcaactatcaaaaagtgaatttaatatctacaaaaggtcagggataatggaagtagatagatctgaagctaaagaaggtttaaaacgaggggagactactagacatgcagtttcaaggggcacagccaaattgagatggttcgtcgagagaaatttagtcaaaccagaaggcaaggtgatcgacctcggctgcggtcggggtggatggagctactactgtgctggtctaaagaaagtaactgaggttaaaggttatactaaaggaggaccaggccatgaagaaccgatacctatggcaacatacgggtggaatctagtaaaactacactcaggtaaagatgtcttcttcacaccgccagagaaatgcgatacactactttgtgacataggagaatcaagccctaacccgacaatcgaggaaggaaggactttaagggttctgaagatggtcgagccttggctacgtggaaaccaattttgtattaaaatcttaaatccttacatgcctagcgtggtcgaaacgttggaacaaatgcaaagaaagcatgggggaatgcttgtaagaaatccattaagcagaaatagcacacatgaaatgtattgggtgagctgtggcacaggtaatatcgtttcggcggtaaatatgacaagtagaatgctactcaaccgatttacaatggcccatcggaagccaacttatgaacgggatgttgatttaggcgcagggaccagacatgttgcggtcgaaccggaagtagccaatctagatataattggtcaacggatcgaaaatatcaaacatgagcataaaagcacatggcactatgatgaagacaatccatacaaaacctgggcataccacgggagctatgaagttaaacctagtgggtctgcatccagtatggtgaatggggttgtgaaacttcttaccaaaccttgggacgttatacctatggttacgcagatcgcaatgacagacaccacgccgttcggtcaacaaagggtattcaaagaaaaagtagatacgcgcacgccaaaggccaagcgaggcactgcacaaataatggaggtaacggccaggtggctgtggggttttctcagcagaaacaagaagccaagaatttgcacacgagaggaatttactagaaaggtcaggagtaacgcagcaataggcgctgtgttcgtggatgaaaaccaatggaactctgcaaaagaagcagtcgaagatgaaaggttttgggacctggtccagaaagaacgtgagttgcataaacaaggaaaatgcgcaacttgcgtctataatatgatgggtaaaagggagaagaaacttggcgaatttggtaaggcaaaaggaagtagagcaatatggtacatgtggttaggagcaagatttctcgaatttgaagcacttggcttcatgaacgaagatcattggttcagtcgggaaaattcactatctggcgtggagggagaaggtttgcataaacttggatatatattaagagatatatctaaaatacctgggggtaatatgtacgcagatgatactgcaggatgggatacacgcattacagaagatgacctacaaaacgaagccaaaatcacagacatcatggaaccagagcacgcattattagcaacgtcgatattcaaacttacatatcaaaacaaagttgtcagagttcagagacctgcaaagaacggtacagtgatggatgttatatcacggcgtgatcaacgaggatcgggacaagtaggaacgtatgggctcaatacgtttacaaatatggaggcacaacttattcgacaaatggaatctgaaggaatattcttaccatcagaactagaaacacctaatttggctgaaagagtactagactggttagagaagcatggtgtagaaaggttgaagagaatggccatatctggagatgactgcgttgtaaaacctattgatgataggtttgcaacagccctcacagcgctcaacgacatgggaaaggtaagaaaggacatccctcaatgggagccaagtaaaggctggaacgactggcaacaagtaccgttctgtagccaccacttccatcagctcataatgaaagatggcagggaaatcgttgtaccttgtagaaatcaagatgaactggttgggagagctagagtatcacaaggagcgggatggtcgttacgagagacggcatgccttggaaaatcttatgctcaaatgtggcaactgatgtattttcatcgtagagacctgcgcttagcagcaaacgctaattgttccgccgttccagtcgattgggttccaacttcaagaacgacttggtcaattcatgcacatcaccaatggatgactacagaagatatgctttcggtgtggaacagagtatggattgaggaaaacccttggatggaagacaaaacgcatgttagttcatggggtgacgtgccatacctagggaaaagagaggatcaatggtgtgggagcttgatcggtttgacagcgagggctacttgggcatcgaacatacaggtagcgattaaccaggttagaaggctaatagggaatgaaaattatctagactacatgaccagtatgaaaagatttaaaaatgaaggagacccagagggtgcattgtggtaa

SEQ ID NO: 21688 - RNA, 9879 nt, synthetic construct
  misc_feature 1..9879: note = derived and/or modified CDS sequence (opt6) from DENV-1__GQ199810__SS-prME
  source 1..9879: mol_type = other RNA
tccgtaacaatgctgctaatgttaatgcctacagcgcttgcttttcatttaacgacgcggggtggcgaaccccatatgatagttagcaaacaagaaagaggaaaaagtctactatttaaaacaagcgctggtgttaatatgtgcacattaattgcaatggacctaggagaactatgcgaagatacgatgacatataaatgtccacgcattacagaaacagaaccagacgatgtagactgctggtgtaacgcaacggatacttgggtaacctatggaacgtgttcacagactggagaacacagacgggataaaagatccgtcgcacttgcacctcatgttggattgggactggaaacacgaacggaaacctggatgagcagcgaaggagcttggaaacaaatacaaagagtggaaacctgggcactgcgacaccccggtttcacggtcattgcattatttttagcacacgcaattggaacgtccataacacaaaaaggaattatctttatattattaatgcttgtcacaccatcaatggcaatgagatgtgttggtattgggtcaagagattttgttgaaggactaagtggtgcaacctgggtcgatgtagtactagaacatggctcctgtgtaactacgatggcaaaagacaaaccaacattagacatagaactacttaaaacagaggttaccaatcctgcagtcctccgtaaactctgtattgaagcaaaaatctcaaatacaactaccgattcaagatgtcccactcaaggagaggctaccttggttgaggaacaagatgccaattttgtttgtcgtagaacattcgtagacagagggtggggaaacggatgtggtctttttggaaaaggcagcttaataacctgtgccaaatttaaatgcgtcactaaattagaagggaagatagtccaatacgagaacctaaagtactcagttatcgtaactgttcacacgggtgaccaacaccaagttggaaatgaatcaactgaacacggaactacagcaacaataactcctcaagccccaactacggaaatacagttgacagattatggtgcgcttacgctcgactgtagtcctagaaccggtctggacttcaatgaaatggtattacttacaatgaaagagaagtcgtggttagtccacaaacagtggtttttagacctaccattaccatggacaagtggcgcctcaacttctcaagagacttggaacaggcaagatttgctcgttacttttaaaacagcgcatgcaaagaagcaagaagtagttgtattggggtcacaagaaggggccatgcacacagctttgacaggagcaacagagatacagacgtcaggaacaacaacaattttcgcaggccacctaaaatgtcgtttgaaaatggacaaactaacattgaaaggaatgagttacgtaatgtgtaccggctcttttaaattagaaaaagaagtagcggagacacaacacggaaccgttttggtacaaatcaaatatgagggtactgacgccccctgcaaaataccatttcttactcaagatgaaaagggagtaactcagaatggaaggcttataacagctaatccgatagtaaccgacaaggagaaaccggttaatatagaagcggaacctccattcggagaatcatatataataataggtgctggcgaaaaagcattaaaacttagttggtttaagaaaggtagctcaatcggaaaaatgttcgaagctactgctcgaggagcgagacgaatggcaattcttggagacactgcgtgggacttcggttccataggaggagtttttaccagtgtcggaaaattggtacaccaaatatttgggacagcttatggggttttatttagtggggtctcatggacaatgaaaataggcattggcgttctattaacatggttaggtttaaattcaagatcaacatcactctcgatgacatgcatagcagttggacttgtaacattatatttaggagttatggtacaagcagacagcggatgtgtcattaattggaagggacgtgaacttaaatgtggtagtggtatctttgtaacaaacgaagtacatacatggacagaacaatataagtttcaagcagattcacctaaacgtctgtctgcagctattggcaaggcttgggaagagggagtatgtggaatacgtagtgcaacgcgtttagaaaacatcatgtggaagcaaatatcaaacgagttgaaccatattctacttgagaacgatatgaaatttactgtagttgtcggagatgtagcgggaatcttagctcaaggcaagaaaatgataagaccacagccaatggaatataaatattcatggaaatcatggggaaaagctaaaattattggtgcagatgtccagaatacaaccttcattatagatggacccaatacaccagaatgtcctgacgaccaacgcgcgtggaacatctgggaagtagaagactatggatttggaatattcaccactaatatttggctaaaactcagagatagtcatactcaagtttgcgatcaccgccttatgtctgcagcaataaaagattccaaagcagtccacgcggatatgggctactggattgaatcagagaaaaatgaaacttggaaattggctagagcatcatttattgaggtgaaaacgtgcatatggccgaaaagccatacattatggtcgaatggggtgttagaatcagagatgataatccctaagatatatggtggcccaataagtcagcacaattaccgtccgggttactttacgcaaactgctggaccatggcatctgggtaaactcgaacttgactttgatctatgcgagggaaccactgtcgtagtagatgaacattgcggtaaccgaggaccatcactaagaacaacaactgttaccggtaaaataatacatgaatggtgttgtcgatcctgcaccctaccaccattacgtttcaggggagaagacgggtgttggtacggtatggaaataaggccagtaaaggaaaaagaagagaatctcgtcaaatcaatggtcagcgccggttctggggaagtagactctttctcattaggacttctatgtataagcataatgatagaggaagtaatgcgaagtagatggtcacggaagatgcttatgacagggacgttagcggtctttttcttattaataatgggccaattaacttggaatgacctgataagactttgcatcatggttggtgcaaacgcatcagatagaatgggcatgggtacaacctacttggcattgatggcaacatttaaaatgcgtccaatgtttgctgtgggcctgttattccgacgattaacatcaagggaggtactattgctaacaataggcttaagcctggtcgcctccgtcgaactaccaaactcattagaagagttgggcgatggtctagcaatgggaataatgatattgaaacttcttacagattttcaatctcaccagttatgggcaactctgctatccctaacatttataaagacgacattctctttacactacgcctggaagaccatggccatggtcctaagtattgtatcattattccccctctgtctgagtaccacatcacagaagaccacgtggttgccggtattgctcggatcgctaggttgtaagccgttaacaatgtttcttattgcggaaaacaagatctggggtagacgttcatggccacttaatgaaggcataatggcggtaggaattgtatcgatactcttatcctcactcctcaaaaatgatgttccattagcagggcctttaatagcaggaggcatgcttattgcatgctatgtaataagtggaagttctgcagacctctctcttgaaaaagccgccgaggtatcctgggaagaagaggtcgaacattctggagcaagtcacaacatacttgttgaggtacaagatgatggaacaatgaagataaaagatgaggagcgagacgacacactaacaatcctactaaaagctacactcctagccgtgagtggagtgtatcctctaagtataccagccaccctatttgtttggtatttttggcaaaagaagaaacagcgctcaggtgttttatgggacacaccaagtccaccagaagtcgaacgagcagtcctagatgacggtatctataggataatgcagagagggctcctaggtcgctcacaagtaggggtaggggtattccaggaaaatgtctttcacacgatgtggcatgttacacgcggtgcggtattaatgtatcaaggtaagaggctagagccgtcatgggcgagtgtaaagaaagacctcatatcatatggtggcggatggagattacagggaagttggaatactggagaagaagtgcaggtcatagccgtagaacctggtaaaaatcccaaaaatgtccaaacagcaccagggacctttaaaacaccagaaggagaagtaggtgcgatcgccttggacttcaaacctggaacatcgggatcgccaatagtaaaccgtgaaggcaaaatcgttggactatacggaaatggagttgtgacaacttcaggcacgtacgttagcgcaatagcgcaagctaaagcatcccaagaaggaccactgccagagatagaggatgaagtatttagaaaacgtaacttaacaataatggatttacatccaggtagtggaaagacaagacgttatcttcctgcaatcgttcgagaagcaataaaaagaaaactaaggactctaatactagcccctacccgtgtagttgcaagcgaaatggcagaagcattaaagggaatgcccattcgttatcagacgacagccgtcaaatcagaacacactggaaaagaaatagttgaccttatgtgccacgctactttcacaatgcgacttctgtcgccagttagagtacctaactataacatgataatcatggacgaagcgcattttactgacccgtcttctattgcagcaagaggttacatatctacacgagtaggaatgggtgaagccgcggccatcttcatgacggctacaccaccaggctccgtggaagcatttccacagtcaaatgctgttatacaagatgaggaacgagatatccccgaaaggtcgtggaatagtggctatgaatggataacagattttccagggaaaacggtctggtttgtaccaagcataaaatctggaaacgatattgcaaattgcctaaggaaaaatggtaaaagggttatccagttaagtagaaaaacctttgatacggaatatcagaaaactaaaaacaatgattgggattacgtggtaaccacagacatcagtgagatgggggcaaatttccgcgcggacagagttattgatccacgacgttgtttaaagcctgtcattttaaaagacggtccagaacgagtgatcctagctggacctatgccagtgactgtcgcatcagctgctcaaaggaggggtaggatcggtcgcaatcataacaaggagggcgaccaatacatatacatgggacaacctctgaacaatgatgaagaccacgcacattggacagaagcgaaaatgttattagacaatattaatactccggaaggcatcatacctgcactgttcgaaccggagagagaaaaatctgccgcaatagacggagaatataggttgagaggagaagcacgtaaaacattcgttgaactgatgcgtagaggggatctaccagtatggttgtcatacaaggtcgcgtccgaggggttccaatatagcgatagacggtggtgctttgatggtgaacgtaacaaccaggtgctggaagagaacatggacgtggagatatggaccaaagagggtgaacgtaagaaattaagaccacgatggctcgatgcaagaacttatagtgatccgctcgccctcagagagttcaaagagttcgcagctggacggaggtctgtatcaggcgatttaattctggaaatagggaaacttccacaacacctgactcaaagagcacaaaatgcactagacaatcttgttatgttgcataattccgaacaaggtggaagggcttaccgacatgctatggaagaacttcccgatacaatcgagacgctaatgttattagctttgatagcagtacttacaggaggagtgacattatttttcctgagtggacgtggattggggaaaacttcaataggactattatgcgtcatggcttcgagtgttctactctggatggctagcgtagagccacattggatcgcagcgtcgatcatactcgagttctttttaatggtcttactaataccggagccagatagacagaggacaccccaagataaccaattagcgtacgtagtgatcggcttactgtttatgatcctgactgtcgcggctaatgaaatgggactattggaaactaccaagaaagatctgggaatcggacacgtagctgtagagaaccaccatcacgcagcaatgttggacgtagaccttcatcctgcaagcgcgtggacactatatgctgtggctacaacaataataacaccgatgatgcggcataccatagaaaacacaactgccaacatatcactcactgcaatcgcaaaccaggcggctatccttatgggactagataagggatggcctatatccaaaatggatataggtgtaccattattagctttgggatgttattcacaagtaaaccctcttaccctaacagcagcagtactaatgctggttgcacattatgctataattggacctggtctgcaggctaaagcaacacgcgaagctcaaaaacgcacagcggcaggaataatgaaaaatccaactgtagacggcatagtggcaattgatctagatccggttgtctatgatgcaaaattcgagaaacaattgggccaaataatgctgttaattttatgtacctcccaaattttgttgatgagaacgacctgggccttatgcgaatctattacactcgctactggtccactaacaaccttatgggagggatcaccaggaaaattctggaatacaacaatagcagtgagtatggcaaacatatttcgcggatcttatttagccggtgcgggccttgcgttctctttaatgaaatcgttgggcggaggtaggcgcggtacgggggcgcagggtgaaacgttaggagagaagtggaaaagacaactaaaccaattaagtaaatcagagttcaacacctacaaaagaagtggaataatggaagtagaccgaagtgaagcaaaagaaggcttgaaaagaggggaaacgacaaaacatgctgtgtcgaggggtacagccaagctacggtggtttgtggaacgcaacttagttaaaccagaaggaaaagtaatcgatttgggttgtggacgaggaggctggtcatattactgcgcgggtctcaagaaagttaccgaagtgaaaggatatacaaaaggaggccccggacatgaagaacctattccaatggctacgtatggttggaacctagttaaacttcatagtgggaaggatgtatttttcataccacctgagaagtgcgacacattactttgtgacatcggtgagtcaagcccgaatcctacaattgaagaaggccgcacattgagagtactgaagatggtggaaccatggttgcgcggtaaccaattctgcataaagatattgaacccatacatgccatcagttgttgagactctagaacaaatgcaaagaaaacatggagggatgctagtcagaaatccgttaagtagaaactccacacatgaaatgtattgggtaagctgtggcaccggtaacattgtgtcagctgtaaacatgacgagtagaatgctattgaacaggtttactatggcgcatagaaagcccacctatgaaagggacgtagacttaggtgctgggactagacacgtagctgtagagccggagatcgctaatttggatataattgggcaaagaatagaaaacattaagcacgaacacaaaagcacatggcattatgacgaagataatccctacaaaacttgggcataccatgggtcttacgaggtaaagccttctggatcggcttcgtctatggtaaatggggtagtaaaattactgactaagccctgggatgtgattccaatggtaacacaaatagctatgacggacacaaccccatttggacaacaacgagtctttaaggagaaagttgacacacggacgccaaaagcaaagcgtggtacagcacaaattatggaagttaccgctaagtggttatggggattcctcagcagaaataagaaacctagaatctgtaccagagaggaatttacacgaaaggtaagaagtaatgccgctataggagcagtttttgtagacgaaaaccaatggaacagtgcaaaggaagcagtagaagatgaacgattttgggaccttgttcaccgtgaaagggaattacataagcaaggtaagtgcgctacgtgtgtatacaatatgatgggtaaaagagagaagaaattaggagagttcggaaaagcaaaaggctcaagagccatatggtacatgtggctaggcgctagatttttggagttcgaggcactcggttttatgaatgaggaccattggttctccagagaaaattcacttagtggagtagagggggaaggtctacataaacttgggtacatacttagagatatctcaaaaatacccggtgggaatatgtatgcagatgatactgcgggttgggacacaaggataacagaggatgatctccaaaatgaagctagaattacagacattatggaaccggaacatgcgctgttagcgaaatccatatttaagctgacgtatcaaaacaaagtcgtacgagttcagagacctgccaaaaacggcacagtaatggatgttattagtcgaagggatcaaaggggaagcgggcaagtaggtacatacggattaaataccttcacgaatatggaagcacagctcataaggcagatggaaagcgaagggatattttcaccctcggagcttgaaaccccgaatctagccgaaagagtactggactggttggagaagtacggagtggaacgacttaagcgtatggccatatccggcgatgattgtgtagtgaagccaatcgatgatcggttcgcaactgccctcacggccctgaatgatatgggaaaagttcgaaaggacatacctcagtgggagccatccaaaggctggaacgactggcaacaagtccccttttgttcacaccatttccatcaactaataatgaaagatggcagggaaatcgtagtcccttgcagaaatcaggacgaattggtaggtcgagctagagtatcgcaaggcgcaggttggtctctcagagagacggcatgcctgggcaaatcttatgcacaaatgtggcagttaatgtactttcataggcgcgacttgagattggcggcaaacgctatttgttcagcggtcccagttgattggattccaacatcccgtacgacatggtcaatacacgcacatcatcaatggatgactacagaagatatgctttcagtctggaaccgagtatggattgaagagaatccttggatggaagacaagacacatattagttcatggggtgacgttccttatttgggtaaacgagaagaccaatggtgtggatcattgattggactgacagcgagagctacctgggcaaccaatatacaggtggcaattaatcaggttcgaagactaatcggaaatgagaattatctagattatatgaccagcatgaaaagatttaaaaatgagggagacccagaaggtgcgctatggtga

SEQ ID NO: 21689 - RNA, 9879 nt, synthetic construct
  misc_feature 1..9879: note = derived and/or modified CDS sequence (opt6) from DENV-1__GQ199811__SS-prME
  source 1..9879: mol_type = other RNA
tctgtaactatgttgttgatgcttatgcctacggcattagcatttcacctgactacaaggggaggggaacctcacatgatcgtatcaaaacaagaacgtggaaaatccctgctatttaaaacatctgctggcgtaaatatgtgcacactgatcgctatggaccttggggaattttgtgaagatacgatgacttacaaatgtcctcgaatcactgaagcggaaccagatgacgtagactgttggtgtaatgcaacagatacgtgggtaacgtacggcacatgttctcaaacgggcgaacatagacgcgacaaacgtagcgtagcacttgcaccacatgtgggattaggcttagaaactagaactgaaacatggatgtcaagcgagggagcctggaaacaaatacaacgtgtagagacatgggcacttagacatccaggatttacagtaattgccctatttctcgcacacgcaattgggacgtcaataactcagaaaggaataatttttatattattaatgctagtgacgcccagcatggcgatgcggtgcgtcgggataggttccagggactttgttgaggggctttctggagcaacatgggtcgacgtagtactggaacatggatcgtgtgtaacaacaatggctaaagataaaccaacacttgacatagaactattgaaaaccgaggtaacgaatcctgcagttctacgaaaattgtgcattgaagcaaaaatctcaaatacaaccacagacagtagatgcccaacacaaggcgaagcaactctcgtagaggaacaggatgcgaattttgtttgccgcagaacatttgtagacagagggtgggggaatggatgtggtctttttggaaaagggtctcttataacttgcgcgaaatttaaatgcgttacgaaactcgaaggaaaaatagtacaatatgaaaatctcaaatatagtgtcatcgtgacagtgcacactggagatcaacatcaagtagggaatgagtctacagagcatggtaccactgccactatcactccgcaagccccatcaacagaaattcaactgacagactatggagctttaacactagattgttcaccgagaactggactcgactttaatgaaatggtcttacttactatgaaagaaaagtcatggctagtgcacaaacaatggtttttagatttaccacttccatggacgtcgggagcttcaacttcccaagaaacctggaatcgacaggatttgttagtaaccttcaaaacagcacacgctaagaagcaagaggttgtagtactagggtcgcaagaaggagcaatgcatactgcgttaacaggagcaacagaaatacagacatcaggaacaaccacgatatttgccggacatctaaaatgtcgcctaaaaatggacaaactaacactaaagggaatgtcatatgtgatgtgtacaggttcatttaaactcgaaaaagaagtggcagaaactcagcatggtactgtgttagttcaaatcaagtatgaaggtactgatgccccatgcaaaataccattcagtacgcaagacgaaaagggtgtgacgcagaacggccggctaataacggctaaccccattgttactgataaagaaaaacccgtaaatattgaagctgaaccacctttcggagagtcatacatcgttattggagctggcgaaaaagcattaaaactgtcttggttcaaaaagggttcatccatcggcaagatgttcgaagccacggcaaggggcgctaggaggatggctattctgggcgacaccgcttgggatttcggcagtataggcggcgtttttacttccgtgggaaagttagtccatcaaatcttcggaacagcatatggagtcctattttcaggggtaagctggacaatgaaaatcggtatcggtgtattactgacttggttagggttgaatagtcggtctacgtcgttaagtatgacttgcatcgcagttggcttggtaactctatatttgggcgtaatggtacaggctgatagcggctgcgtaattaattggaaaggccgagaattaaaatgtggatcggggatatttgtaactaacgaagtccatacttggactgaacaatacaagtttcaagctgattctcctaaacgactttctgcggccataggcaaggcttgggaagaaggtgtctgtggaataagaagtgcaaccagactggagaacataatgtggaaacaaatctctaacgagcttaattacatactgttagagaatgatatgaagctaacagttgttgttggtgacgtagcgggaatccttgcgcagggcaagaaaatgatccgaccacaacctatggagtacaaatattcttggaagtcttggggcaaggctaagataataggggcagatgtgcaaaatactacttttataatagacggacctaatactccagaatgtcctgacgatcaaagagcttggaatatctgggaagtggaagactacgggttcggtatatttacgacaaatatatggctgaaattgagagattcatatacacaagtttgtgaccaccgattaatgagcgcagcaataaaagactccaaagcagtgcacgcagatatgggctattggattgaatcagagaaaaatgagacctggaaactcgcgagagcgtcttttatagaagtgaaaacatgtatatggcctaagagccacacattgtggtcgaatggagtcttagaaagcgaaatgatcatacctaaaatatacggaggaccaatctcacaacacaactacagacctgggtactttactcaaacagccggaccttggcatcttggtaaattagaacttgatttcgacttgtgtgaaggaacaaccgtagttgtcgatgagcattgcgggaacagaggtcctagtttaagaacgaccacggtaactggaaaaataatacatgaatggtgctgtaggagttgcaccttgccgccattacgattcaagggggaggatggttgttggtatggcatggaaatacggcccgtaaaggaaaaagaagaaaacctggtaaaaagtatggtcagtgctggaagcggagaagtagatagcttctctcttggattattgtgcataagcataatgatagaggaagtcatgagaagtcgttggtcaaggaaaatgctaatgacaggaaccttagccgtattctttctgctgataatgggacagttaacatggaacgatttgatacgactatgcataatggtaggtgctaatgcttcagacagaatgggaatgggcactacttatcttgcactaatggcgacattcaaaatgcgacccatgttcgcagtgggcctcttatttagaaggttaacaagtagagaggttctactgttaactataggactcagtctagttgcatcagtcgaactaccaaattcattagaagaactgggagacggcttagcaatgggtataatgattttaaaactattgacagatttccagtctcaccaattatgggcaactcttttgtcattaacgttcgttaggacaacattcagtctgcattatgcttggaaaacaatggctatggttttgtctatagtcagtctatttcctctatgtttgtcaactacaagtcagaaaactacctggttacccgtactcttgggctcacttggatgtaaaccgttaacgatgttcctcatcgcggagaataaaatatgggggagaaaatcttggcctttaaacgaaggaatcatggctgttggtatcgtatcaatattactctccagcttactcaaaaatgacgtaccacttgcagggcctttaatagcaggcggaatgctgattgcatgctacgtaatatcagggtcatctgctgatttatcattagagaaagccgcggttgtctcctgggaggaagaagcagagcacagtggagccagtcacaacatcttagtagaagtgcaagacgacgggacgatgaaaatcaaagatgaagaaagagatgacactcttacaatcttactaaaggcaacgttacttgcagtctcaggcgtatacccattaagtattcctgcgaccctatttgtatggtatttttggcagaagaagaaacagagatcgggagtattatgggataccccaagtccacctgaggtcgaaagagcagttctagatgatggaatatatagaatcatgcaaaggggactactaggtagatctcaagtgggggttggcgtgttccaagaaaatgtattccatactatgtggcatgtaacacgtggagctgtcctaatgtatcaaggaaaaaggttggagccatcgtgggcatcggtcaagaaagatcttatatcatacggtgggggatggcggctacaaggaagctggaacacaggagaagaagtgcaagttatagcggtcgaacctggcaaaaatccgaaaaatgtacaaacagccccagggacttttaaaacgtcagagggtgaagtcggagcgattgcattggactttaaacccggtacttctggctcaccaatagtgaatagagaaggcaaaatcgtgggactctacgggaatggagtagtaacaacgtcgggcacatatgtctcagcgattgctcaagccaaagccagtcaagaaggtccattacctgagatagaagacgaggtgtttcgaaagcggaatctaacaataatggacttacatccagggtctggaaaaacccgcagatatttacccgcaattgttagggaagccattaaaagaaaacttaggacgctgatccttgctcctaccagagtagtagcatcagaaatggcagaagctcttaaaggaatgcctataaggtaccaaaccactgcagttaaatcagagcatacaggtaaagaaatcgttgatttgatgtgccatgccacattcacgatgcggctactcagcccagtaagagtacctaactataacatgataattatggacgaagcacatttcacagaccctagtagtatagccgctcgtggatacatctcaacaagagtcggtatgggtgaagctgcagcgatatttatgacagctacgcctcctggaagtgttgaagcattccctcaatcaaacgctgttatccaagacgaagaaagggacattcctgaaagaagttggaactccgggtacgaatggataacagacttcccaggtaaaaccgtatggtttgttccatctatcaaatctggaaatgatatagccaactgtctacgcaaaaacggcaaaagggtcatccaactatcaagaaaaaccttcgatacggaataccagaaaacgaaaaataatgactgggattacgtcgtaaccacagatatatctgaaatgggagcaaatttcagagctgacagggtgatagacccacgacgttgtttaaaaccagtcatactaaaggatgggccagaaagagttatattagctgggccgatgcctgtaactgtagcgtctgctgcacaaagaaggggcaggataggacgaaatcataataaagagggagaccagtatatatacatgggtcagccgttaaataacgacgaagatcatgcacactggacggaagcaaaaatgttattagataatataaatacgcctgaagggattatacccgcactattcgaaccggaacgcgaaaagagtgcagccatagacggagaatataggttgagaggggaagctcgaaagactttcgtagaattaatgcggaggggagatcttcccgtatggctgtcatataaggtagccagtgaaggtttccaatactccgataggcgttggtgtttcgacggagaaagaaataatcaagttctggaagaaaatatggacgtcgagatttggacgaaagaaggagaacgaaagaaattacgacctcgatggttggacgcaagaacatattcggacccactagcgctaagagagtttaaagaatttgctgcgggcagaagatcagtatctggcgatctaattcttgaaataggaaaactaccacaacatttgactcaaagagcgcaaaatgccttagataatttggtcatgcttcataacagcgaacagggagggagagcatacagacacgcaatggaggaattgccagatacgattgaaaccctaatgctattagccctgatagctgtattaacaggaggggtaacattgttctttttaagtggaagaggcttggggaagacatccataggcttattatgtgttatggccagttcagttctactgtggatggcgagcgtagaaccacactggatagccgcctccatcatcttagagttctttttaatggtcctcctaattccagaacctgatcgacagagaacaccacaagacaaccaactggcttatgttgtaattggacttcttttcatgatattaacagtagctgcaaatgaaatgggtctcttagaaacaaccaagaaagatttaggtatagggcacgttgcagtagagaaccatcatcatgcagccatgctagatgtggatttacatcctgcaagtgcatggacgctatacgccgtagccacaacgattataacacccatgatgagacatacaattgagaatacaacagcaaacatatctttaacagccattgcaaatcaggcagccatattgatgggacttgataaaggttggcctatttccaaaatggacattggtgtacctctacttgctctagggtgctactcccaagtaaatccacttactctaacagccgcagttcttatgttggtagcacattatgctattataggtccagggctacaggcaaaagcaacacgagaagcccagaaaaggacagctgctggaataatgaagaaccctaccgtagatgggatagtcgccattgacctcgaccccgtggtatacgatgccaaatttgaaaaacagctgggacaaattatgttattaatattatgtacttctcagatattattaatgcgcacgacatgggctctatgcgaatcaattacactagctactggtcctttaactacactttgggaaggttctccaggaaaattttggaatacaacaattgctgtaagtatggcaaatatatttcgaggcagttatcttgcaggggcagggttggcattctctttgatgaaatcattaggtggtggaagaagaggaacaggtgctcaaggagaaactctgggcgagaagtggaagagacagttaaaccaattaagtaaaagtgagtttaacacgtataagcgtagtggtataatggaagttgataggtctgaggcaaaagaaggactaaaaagaggcgaaacgacaaaacatgcagtgagtcgcgggacggccaaattacgatggtttgtagaacgaaacttggtgaagccagaaggcaaagttatagatttaggctgtggcagaggcggatggtcctactattgcgccggtcttaagaaagtaaccgaagtaaaaggctacacaaaaggcggtccagggcacgaggaaccgataccaatggccacttatggttggaacttagtaaaattgcactctggaaaggacgtcttctttatccctccagagaaatgtgatacgcttttgtgtgatattggcgagtcctcaccaaacccaactattgaagaaggaaggactctacgcgtattaaagatggtagaaccatggctaagaggtaatcaattttgtataaaaatactaaatccatacatgccatctgttgtcgagactctagaacaaatgcaaagaaaacatggaggaatgctagtgaggaatccattgtcacgcaattcaacccatgaaatgtattgggtaagctgcggtacaggaaatatcgtgtcggcggtgaacatgacaagtagaatgctacttaataggtttaccatggcccaccgtaaaccaacatatgaaagagacgtcgatttaggagctggcacccgacatgtggctgtagagccagaagtggcgaacctcgacataataggccagagaatcgaaaacataaaacatgaacacaaaagtacgtggcactacgacgaggataacccttacaaaacctgggcctatcacggaagttacgaggtaaaaccatcggggtccgcatcaagcatggttaacggtgtcgtaaagctactaacaaaaccctgggacgtaattcctatggtcacgcagatagcaatgactgatacaacaccatttggacaacagagagtcttcaaagaaaaagtggacactagaactccgaaggcaaaaagaggcacagcacaaattatggaagtaactgcgaaatggttatggggtttcttgagtcgaaacaagaaacccaggatctgtacacgagaagaatttacaaggaaggtgagaagtaatgcagcaatcggtgctgtttttgtagatgagaatcagtggaactctgcaaaggaagcggttgaggatgaaagattttgggatctcgtccacagagaacgtgaactgcacaaacaaggtaaatgcgcgacttgcgtgtataacatgatgggcaagagggagaagaaacttggagagtttggaaaagcaaagggaagtcgagcaatttggtacatgtggttaggggcaaggtttttggagttcgaggctctcggtttcatgaacgaagatcactggttcagcagggaaaattcactttctggggtagaaggcgaaggactacataaattaggttatattctccgggatatttcaaaaatacccggaggcaatatgtatgcagatgatacagctggatgggatactcgcataaccgaggatgatttacaaaatgaggctaagataacagacatcatggaacctgaacatgcgcttttagcgaagtctatattcaaacttacctatcagaataaggtcgtacgagtgcaacgaccagctaaaaatggtaccgtaatggatgtcatctccagaagggaccagagaggtagtggacaagtgggaacttatggcttaaatacatttacgaatatggaggcacaactaatacgccaaatggaatcagagggaatatttagtccttctgagctcgaaacaccaaatttagcgggtcgtgttctcgattggttagagaaacacggagtggaaagactaaagagaatggctatatctggagatgattgcgtagttaaaccaatagacgaccgctttgcgacagcgctgactgcattaaatgacatgggaaaggtacgaaaagatatacctcaatgggagcctagcaaggggtggaacgactggcagcaagtgcctttctgttcacatcactttcatcagttgataatgaaagatggccgagaaattgtcgttccttgccgtaatcaagacgaattagttgggagagcgagagtatcacaaggagcaggttggtccctaagggagacagcgtgtctggggaaatcttacgcacaaatgtggcagttaatgtattttcacagacgagatcttagattagcagcaaatgcaatatgcagcgctgtacctgtggattgggttcctacaagtcgaactacctggtcgatacacgcacatcatcaatggatgactacagaggacatgttgtcggtctggaatcgcgtgtggatagaggaaaatccatggatggaagataagacacatataagttcctggggtgacgtgccctatctaggtaaaagagaagatcaatggtgcggaagtctaatcgggctaactgcccgggctacatgggctacaaatatacaggtggcaatcaatcaagtgagaagactcttggggaacgaaaattacttagactatatgactagcatgaagagattcaaaaatgaaagcgatcccgaaggcgccctttggtga

SEQ ID NO: 21690 - RNA, 9879 nt, synthetic construct
  misc_feature 1..9879: note = derived and/or modified CDS sequence (opt6) from DENV-1__FJ882549__SS-prME
  source 1..9879: mol_type = other RNA
agtgtaacaatgcttttaatgcttatgccgacggctttagcatttcacctaacaacacgtggaggtgaaccacacatgatagtttcgaaacaagaaagaggcaaatctttactatttaaaacatcagcaggcgttaatatgtgcacattaatcgctatggatttgggcgaactttgtgaagacacaatgacatataaatgcccaagaatcacagaagtagaaccagatgacgtcgattgttggtgcaacacaacggatacatgggttacttacggaacatgttcacaaacaggggaacacagaagggataaaagatccgtcgccttagctccgcatgtaggattaggacttgaaacacgggctgaaacttggatgagtagcgaaggagcgtggaaacaaatccaaaaagttgaaacgtgggcactaagacatccaggattcactgtaatagctctttttcttgctcacgctattggaacttctataacgcaaaaagggataattttcatactgttaatgctagtaactccatcgatggccatgcgttgtgtcgggatcggatcaagggatttcgtggaaggactttcaggcgcaacgtgggtagacgtagttttagaacatggctcatgtgtaacgactatggcaaaagataaacccacactagacatagaattattgaaaacagaagtaacaaatcccgccgtactccgtaaactgtgtatagaagcaaaaattagtaatacaacgacagattcaagatgtccaacgcaaggcgaagcaactcttgtagaagaacaagatgccaattttgtatgtagaagaaccttcgttgatagaggatgggggaatggatgcggcttgtttggaaaaggatcactaataacttgcgcaaagttcaaatgcgttacaaaactggaaggcaaaatagtacaatatgaaaatctaaaatattcagtcatagtgactgtacacacaggtgatcaacaccaagtggggaacgaatctaccgaacatggtacaaccgctacgattacacctcaagcaccgacgtcagaaatacaactaaccgattatggtgcactaaccctagactgttcacctagaacaggcctagatttcaatgaaatggttctgcttacaatgaaagaaaaatcttggctagttcacaagcaatggtttttagatttaccactaccatggacctccggagccagcacctcacaagaaacctggaataggcaagacctgctcgtaacatttaagaccgcacatgccaagaaacaagaagttgtcgtgcttggttctcaagaaggtgccatgcatacagcgctgactggagcaactgaaatacaaacatcaggtacaactactatatttgctgggcatttaaagtgcaggcttaagatggataaattgacccttaagggcatgtcatacgttatgtgtacaggatcttttaaattagagaaagaagtagctgagacacaacatgggacagtattagtgcaaataaaatacgaaggcacggacgcaccatgtaaaatacccttttccacccaggacgaaaaaggagtaacacaaaacggaaggttaataacagctaatcctatagttaccgataaagaaaaacctgttaacatagaagctgaaccgccgtttggtgaaagctacattgtcataggagcgggcgaaaaagcacttaaactctcatggtttaaaaagggatcgtcaattggtaagatgttcgaagcgactgcgcggggtgctcgaagaatggccattcttggtgacacagcatgggattttggatcaattggtggtgtttttacgtcggtgggaaaacttgtacaccaaattttcggaactgcatatggtgttctgttcagcggcgtgagctggaccatgaaaatcggaattggcgttctacttacatggttaggattaaacagcagaagcacatcgttatccatgacatgcattgctgttggattagtaacactctacttaggtgtcatggtgcaagctgactccggttgtgttattaactggaaagggagggaactaaaatgtgggtcaggaatatttgtgactaatgaggtacatacatggactgaacaatacaaatttcaagcagactcgccaaaaagattatcagctgcaattggtaaagcctgggaagagggagtatgcggaatccgtagtgcaacccgcctagaaaacattatgtggcgtcaaataagtaacgagttaaaccatattctcttagagaacgacatgaaattcacagtggttgttggggatgtagtaggaatattagctcaagggaagaaaatgataagaccccagccgatggaacacaaatacagctggaaatcatggggaaaagctaagataataggagccgacgtccaaaatactacattcataattgacggacctaatacacctgagtgtcctgacgatcagcgcgcttggaatatctgggaagtggaagattacggtttcggaatatttactacaaatatatggttaaagctacgtgacagttacacacaagtgtgtgatcaccgcttgatgtcggcggccataaaagactcaaaagctgtacacgccgatatgggttattggatcgaaagtgaaaagaacgaaacatggaaactagctagagctagcttcattgaagtaaaaacttgcatatggccaaaatcacatacactatggtcaaacggggttttggaatcagagatgatcattccaaaaatctacggtggtcccatatcacagcataactatcgacccggttacttcacccaaacggctggaccctggcacctagggaaactagaattagactttgacctttgcgaagggacaacagttgtagtagatgaacattgtgggaacaggggaccttcattaaggactactacagtaactggaaaaataatacacgaatggtgttgccgatcgtgcacccttccgcccctacgctttaaaggggaagatggatgttggtacggaatggaaattagaccagtcaaagaaaaagaggaaaatctcgtaaaatcaatggtgtctgcaggaagtggagaagttgactcttttagtttgggtttgctgtgtatcagcatcatgatagaggaagtaatgcgatcgcgttggtctcgaaaaatgctcatgacgggtaccttggcagtatttttcctattaataatggggcaacttacatggaacgatctcattcgtagttgcattatggttggagcaaatgcatcagaccgcatggggatgggcacaacttatttagcactaatggccaccttcaaaatgaggccaatgttcgcggtaggattgctgtttaggcgattaacttcccgagaagtattactattgacaatcggtctcagtctcgtagctagcgtagaactacctaacagtttagaagaattaggcgatggtctggccatgggtataatgattttaaagctccttactgattttcaatcatatcaattatgggccacgctattatccctaacgttcataaaaacaacgttttcacttcattatgcttggaaaacgatggctatggttctatccattgtctcccttctacccctgtgtctaagcacaacttctcaaaagactacttggctcccggtactactaggctcactaggttgtaagcccttaactatgtttcttattgcagaaaataaaatatggggtagaaaaagttggccattgaatgaagggataatggctgtgggtatagtgtcaattctattatcaagcctgctcaaaaatgatgtaccactagcaggaccattaattgcaggcggcatgcttattgcgtgctatgttatttccggatcaagtgcagatctaagccttgaaaaggccgcggaagtaagttgggaagaggaagccgagcatagcggagcatctcataatatattagtagaagttcaagacgatggtaccatgaaaataaaagatgaagaaagggatgacacgttaaccatattgctcaaagcgacattattagctgtttccggtgtatacccgttaagtatccccgcaacacttttcgtgtggtatttttggcagaaaaagaaacaaagatctggtgtcttgtgggatactccatcacctcctgaagtagagagagcagtactagacgatggaatatatagaataatgcaaagaggactgctaggtagatcacaagtaggtgtcggcgttttccaggagaatgtttttcatacaatgtggcacgtgacacgtggtgcagtgcttatgtaccaaggcaaacgcctagaaccttcttgggcgtcagtcaagaaagatttgatctcatatggaggaggttggaggctacaagggagttggaatacgggagaggaagttcaggtaatagccgtcgagccaggtaaaaatcctaaaaatgttcaaactgcccccggtacgtttaaaactcctgaaggcgaagttggggcgattgctttagattttaagccgggaacatcgggcagcccaatagtaaaccgggagggcaaaattgtcggcttatatggaaatggggttgtaacaacatcaggcacctacgtttcagcgatcgcgcaagccaaagcatctcaagaaggaccgttgccagaaatcgaagacgaagtattcaggaaaagaaatcttaccataatggacttacatccaggtagtggtaaaactaggcgatatttgccagcaatagtacgcgaggcaatcaagagaaaactccggacacttatattggctcctacgagagtggttgcctcggaaatggcagaagcccttaaaggcatgcccattagatatcaaaccactgcagtaaaaagcgagcatacaggacgtgaaatagtagatcttatgtgtcacgcaacgtttacaatgcggcttttaagtcctgttcgagtcccaaactacaatatgataataatggacgaagcacattttacagatcctagctctatagctgccaggggctatattagtacgagagtaggaatgggtgaagcagcagcaattttcatgacagctacaccacctggttcggtagaagcgtttccccaaagtaatgcggttattcaagatgaggaaagagatattccggaacgaagttggaatagtggatatgaatggataaccgatttccctggtaaaaccgtatggttcgtgccttcgattaagagtggcaatgacattgcaaattgtttaaggaaaaatggaaaacgtgtaatccaactaagcaggaaaacatttgacactgaatatcagaaaacaaagaataatgactgggattacgtggtaacaacggatatttcagagatgggtgcgaattttagagcagatcgcgtcattgatcctcgaaggtgcttaaagccagttatacttaaagatggaccggagcgagtgattttagcaggaccaatgccggtaaccgtagcttcagccgcacaacgaagagggagaattggtagaaatcacaacaaggagggcgatcaatatatttacatgggtcaaccacttaataatgacgaggatcatgcgcattggacagaagcaaaaatgttacttgataatataaatacccctgagggaataatcccagcactgttcgaacctgaacgagaaaagtcggccgcgattgatggtgaatatcgtctacgaggcgaagctagaaaaacatttgtagagctcatgcgaaggggcgatttgccagtatggctaagctataaagttgcatctgaaggattccaatacagtgatagacgatggtgcttcgacggggaaaggaataaccaagtgctcgaagaaaatatggatgtagagatatggacgaaggaaggagagagaaagaaactacgtccgcgatggctagacgcaagaacatactctgatcccctagcactccgagaatttaaggaatttgctgctgggcgtcgttcggtttcaggtgatctaatcctagaaattggcaagctacctcaacacctcacgcagagagcccaaaatgccttggataatctagtcatgcttcataattcagaacaaggaggtagagcatataggcatgcaatggaagaactaccagatacgattgagacactaatgctcctcgctctaatagccgttcttacaggtggggtaaccttattcttcctgagtggaaaagggttaggaaagacaagcattgggttactatgtgtgatggcatcatccgcactgctctggatggcctctgtggaaccgcactggatagcggcgtcaatcatattagagttcttcctaatggtacttctaatcccagaacccgaccgacaaagaaccccgcaagataatcaactagcctacgttgtaatcggattgcttttcatgatccttacggtagccgcaaatgagatgggtttactggaaacaaccaagaaagacttgggaataggtcatgtggcagtagaaaatcatcatcacgcaacaatgcttgacgttgacctgcacccagcctcagcttggacgctttatgctgtagcgactacaattatcacccctatgatgcgccacacgattgaaaataccacagctaatataagtttaacagcaatagccaaccaagcagccatactcatgggacttgataaaggatggccgatttccaagatggatataggagtgcccctgttagcccttggatgttactctcaagtaaacccactaacattaacagctgcagtactaatgttggtggctcactatgcgataataggccccggtctacaagcaaaagcaactagagaggcacagaaaagaactgctgccggtataatgaaaaatccaaccgttgatggaatagttgccattgatcttgatcctgttgtttatgatgctaagtttgaaaaacaactagggcaaataatgctcttaatcctttgcacgtctcaaattcttttaatgagaacgacgtgggctttatgtgagtcaataacgttagcgaccggtccactaacaactttgtgggaaggatcacctggaaaattctggaacactaccattgcagtaagcatggcaaatatttttagagggtcgtatttagcaggcgcgggtttagccttttctcttatgaagtcattgggaggaggacgtagaggaacaggcgcgcaaggtgaaacacttggagagaaatggaaaagacagttaaaccaactcagcaagtcagaatttaacacatataaaagaagcggcataatggaagtagatcgtagtgaagcgaaagaagggcttcgtcgcggcgaaacaaccaaacatgcggtctctaggggaacagctaagttacgatggttcgtagagaggaatttagtaaaacctgagggcaaagtaatagacttaggatgcggaagaggcggatggagttactactgcgcaggactaaagaaagttacagaagtgaaaggttacactaaaggcggccctgggcatgaagaaccaataccaatggccacatacggctggaacctagtaaaattacatagcggcaaagacgtctttttcataccacccgaaaaatgtgacacattactctgtgatattggagaatcctcgccaaatccaacaattgaagaagggcgaactttacgtgtactgaaaatggtagaaccctggctaagaggaaatcaattctgcattaaaatccttaacccgtatatgccgtctgtagttgaaacattggaacaaatgcaacggaaacacggtgggatgctcgttagaaatcccctgagtagaaatagcacgcatgaaatgtattgggtgagttgtggaacagggaacatcgtaagtgctgttaacatgactagcaggatgcttctcaacagatttacaatggcacataggaaaccgacgtacgaacgcgacgttgatcttggtgctggcacacgacacgttgcggtcgagcccgaagtggctaatctagacattataggacaaagaatagaaaatataaaacacgaacataaatcgacatggcattacgatgaagacaacccttataaaacatgggcataccatggctcatacgaggtaaaaccttctggaagcgcctctagcatggtcaacggagtggtgaaattactaactaagccgtgggatgtgatacctatggttactcagatagccatgactgacactactcccttcggacaacaacgtgttctaaaagaaaaagtcgatacgagaactccaaaggcaaaacgaggtaccgcacaaattatggaggtaactgctaaatggctctggggtttcttaagtagaaacaagaaacctagaatatgtacccgtgaagagttcaccaggaaggtccgaagtaatgccgcaataggcgcagtttttgttgatgaaaaccaatggaacagcgcaaaggaagcagtcgaagatgaaaggttttgggacttggttcacagagagagagaactacataaacaaggaaaatgtgcgacgtgtgtgtataatatgatgggaaaacgcgaaaagaaacttggagagttcggcaaagctaagggttcacgagcaatatggtatatgtggcttggagctagattcttggaatttgaagccctagggttcatgaacgaagatcattggttctcaagagaaaactctttaagtggtgtagaaggcgaaggtcttcataaattggggtacattcttcgcgacataagcaaaataccgggaggcaacatgtacgctgatgatactgcaggatgggatactcgaataaccgaagacgatcttcagaacgaggcgaaaattacagacattatggaacctgaacatgcacttcttgcaacctcgatattcaaattaacataccaaaacaaagttgtgcgagtacagagaccggcgagaaatggaacggtaatggatgtaatatctcgcagagaccaaaggggtagtggtcaagtgggcacctatggtcttaacacatttaccaacatggaagcgcaattaataagacaaatggagagcgaagggatattctcaccgtccgaactagaaacgcccaatttagcagagcgtgtcttagactggcttgaaaagcatggtgttgaaagactgaagagaatggcgatttctggtgatgattgtgtagtcaaaccgatcgatgaccgtttcgcgacggccttgagcgctttaaatgacatgggaaaagttcgaaaagatattcctcaatgggagcccagtaagggatggaatgattggcaacaggtaccattttgctcacaccattttcatcaattgataatgaaagacggtcgggaaatcgtagtcccttgtaggaaccaagatgaacttgtagggcgtgcacgagttagccaaggtgcaggatggagcctcagagaaacagcctgcttggggaaatcgtacgcacaaatgtggcaactaatgtactttcaccgaagagaccttagactagcggcaaatgcaatttgctcggcagtaccagtagattgggtacctacttcgcgaactacttggtccatacatgcacatcaccaatggatgacaactgaagatatgctctccgtttggaatagagtgtggatagaagaaaacccctggatggaagataaaacgcatattagtagctggggagacgtaccatacctcggcaaacgggaggatcaatggtgcggatcgttaatcggcttgacggcaagagcaacctgggctactaatatacaagttgcaataaaccaagtccgaagacttatcgggaacgaaaattatttggactacatgacgtcaatgaaacgctttaagaatgaaagtgaccccgagggcgctttgtggtaa

SEQ ID NO: 21691 - RNA, 9879 nt, synthetic construct
  misc_feature 1..9879: note = derived and/or modified CDS sequence (opt6) from DENV-1__GQ199814__SS-prME
  source 1..9879: mol_type = other RNA
tctgtcactatgctattaatgctaatgccgactgcactagcatttcatcttacgactcggggaggtgaaccacacatgatagtttcaaaacaagagcgagggaaatctctgctattcaaaacaagtgcgggggtaaacatgtgtacgttgatcgcaatggacctaggagaattttgcgaagatacaatgacatataaatgcccgagaattacagaggctgaaccagatgatgttgactgttggtgtaacgcaacagatacatgggtgacatatggaacctgctcgcaaacaggagaacatagacgagacaaacgcagcgtagcccttgccccgcatgtgggactaggtcttgaaacgagaacggagacatggatgagtagtgaaggcgcgtggaaacaaatccaaagagttgaaacgtgggcgcttaggcacccagggtttaccgtaattgctctatttctagcacacgctattggaacttcaataacacagaaaggaatcattttcatattactcatgcttgtcactccatcaatggctatgcgttgtgtaggcatagggtcgcgagactttgtagaaggtctaagcggagctacgtgggtagatgtagtactggaacatggaagctgcgtaaccacaatggctaaagacaaaccaacacttgacatagaattactaaaaacagaggtaactaatccggcggtcctccggaaattatgcattgaagcaaaaatttctaatacaactacagactctagatgtccaacacaaggagaagcaaccctggttgaagaacaagacgcaaacttcgtgtgcaggagaacattcgttgatcgcggttggggaaatggttgcgggctgtttgggaaaggatctcttattacctgtgctaaatttaaatgtgttacaaaactggaaggaaaaatagtacaatatgaaaacttaaagtatagcgttatagtgacagttcatacaggcgaccaacatcaagtcggtaacgaatcaaccgaacacggtaccactgctaccattacgccacaagcaccttcaacagaaatacaactcactgattatggtgcgcttaccctggactgtagtccccggacaggcctcgattttaacgaaatggtcctgctaacaatgaaagaaaagagctggcttgtccataagcaatggtttcttgatttgcctctaccatggacctctggagcttcaacctcccaagaaacttggaataggcaagatctcctggttacgttcaagactgcgcacgcaaagaaacaagaagtagtagtattaggttcacaagagggagctatgcacacagctttaactggagcaactgaaattcagaccagtggtacgactacaatattcgcaggccatttgaaatgtaggttgaaaatggacaaattaaccttaaagggaatgtcgtacgtaatgtgtacaggaagttttaaactagaaaaagaggtcgcggaaacacaacacggaacggtcctggtgcaaataaaatacgaaggcactgacgctccgtgtaaaataccattctcgacgcaagatgaaaagggtgtcacacagaacggacggttaatcacggctaacccaatagtgactgacaaagataaaccagttaatattgaagctgaacctccatttggcgaatcatacatagtaataggcgcaggagaaaaggccctaaaactgtcttggtttaagaaaggttcgtccataggaaagatgtttgaggccactgcccgaggtgctcgtcgaatggctatcctaggagacacagcatgggatttcggttccataggaggggtatttacatctgttggaaaattggtgcatcaaatatttggcacggcttatggcgtattattcagcggtgtatcatggacgatgaagattgggattggggtcttgctcacgtggctggggctaaatagtcgtagtacgtcattgagtatgacctgtatagcagtgggcctggtaaccctttacttgggggtcatggtacaagctgactccggttgtgttattaattggaaaggtagagaactaaaatgtggatcaggaatttttgtgactaatgaagttcacacatggacagaacaatataaatttcaagctgatagtcctaaacgactgtcagcagcaatagggaaggcatgggaagaaggagtatgtgggatcagaagtgctactcgtctagaaaacatcatgtggaagcaaatctcaaatgaattaaatcatatattactggaaaatgacatgaagttcacagtagtggtaggtgatgttgcagggatactcgcccagggcaagaaaatgattagaccacaacctatggaatacaagtatagttggaaatcgtggggaaaggctaaaatcattggagcagatgttcagaatacaacatttataatagatgggcctaacacaccagaatgtccagacgatcaacgagcgtggaatatatgggaggtcgaagattatggctttggtatatttacaaccaacatttggctcaaattaagagattcttacacacaggtatgcgaccaccgacttatgtctgcggcaattaaagacagtaaagccgtccatgctgatatgggatactggatagaaagcgaaaagaacgaaacatggaaattagcaagagccagcttcatagaagtaaagacatgcatatggccaaaaagccacacattgtggtcaaatggagtactcgagtctgaaatgatcattcccaagatatatggaggacccatttctcaacacaactatagacctggctattttacacaaacagcaggaccctggcacttagggaaacttgagcttgattttgacctgtgtgaaggaacgacagttgtggttgatgagcactgtggaaaccgaggaccctctttacgaacaacaacagtcacgggtaagatcatacatgagtggtgttgtcgttcatgtaccctgcctccacttagattcaagggcgaagatggttgttggtacggaatggaaattagaccagttaaagaaaaagaagaaaaccttgtaaagtccatggtatcagcagggtcaggtgaggtagattcattctcgctaggtttactatgtatttcaattatgactgaggaggtaatgcgatcgcgctggtctagaaaaatgttaatgactggcacccttgcagtattctttttactcattatggggcaattgacctggaatgatttaattagattatgcataatggtaggtgcaaatgcaagtgatagaatgggcatggggacaacatatctggctcttatggctacatttaagatgcgacctatgttcgcagtaggtttattatttagaagattaacctcccgagaagttttattattaacgattggtttatctctagttgcgtctgtggaacttcccaattcattagaagaactcggcgacggcttggctatgggaataatgatcctcaaactgttgacagattttcagtcccatcaattatgggctaccctacttagccttacgtttattaaaacaaccttttctctacattatgcctggaagacaatggcaatggtgctatccatagtttcgctgtttcccctatgcttgagcaccacttcgcagaagacaacatggttacctgtactactggggtcactaggctgtaaacctttaacaatgttcttaatagcagaaaataaaatctggggtagaaagagctggccattaaacgaaggaatcatggcagtgggtatagtcagtatattactatcatctctcctaaagaatgatgtcccattagcaggccccctcattgcaggaggcatgcttatagcttgttatgttatcagcggtagttcagctgacttaagccttgagaaggcagcggaagtaagttgggaggaagaagcagaacatagcggagcttcacacaatattctagttgaggtacaagatgatgggactatgaaaatcaaagacgaagaaagagacgacactctaacaatactgcttaaagcgacactcctagctgtctcaggtgtatatcccctatcaatcccagcgaccctatttgtatggtatttttggcagaagaagaaacaaagatcaggagttttatgggacacaccatcgccaccagaagtagaaagagcagtattagatgatggaatttatagaattatgcagaggggtctattaggaaggagtcaagttggggtaggggtatttcaagaaaatgtctttcatacaatgtggcatgttaccagaggcgctgtattaatgtatcaaggaaaacgactagagcccagttgggctagcgttaagaaagacttgatatcttatggaggaggttggcgactacagggatcgtggaacaccggagaagaggtacaagtgatagctgtcgaaccggggaaaaatccaaagaacgtccagacagcaccaggtaccttcaaaacctctgaaggggaagtaggagcaatagctctggatttcaaacccggaacgtcaggaagcccaattgtaaatagggaaggaaaaatagtcggactttacggtaacggagttgtaaccacttcgggtacctacgtctcggcgatcgcacaggcaaaagcgagccaagaaggacctctacccgaaatagaggatgaagtattcagaaaaaggaacctcacaatcatggaccttcatccgggaagtggtaagacgagaagatatctccccgcaattgtacgcgaagctattaaaagaaaattgcgaacgttgattctcgcacccacaagagtcgtagcatcagaaatggctgaggcactaaaaggtatgccgatccgctaccaaacaacggccgttaagagcgaacacactggcaaagagatcgtagacctcatgtgccatgctactttcacaatgcgactactttctccagtaagagtccctaattataacatgattattatggatgaagcacacttcaccgatccaagttcaattgcggcaagaggatacatttccacaagggttggtatgggagaagcggcagcaatattcatgacagcaacacctcccggttccgtcgaagccttcccacagagtaacgcagtgattcaagatgaagaaagagatataccagaaaggtcttggaactctgggtacgaatggatcaccgattttcccggcaaaacagtgtggtttgttccttcgatcaagagcggtaatgatatagcaaattgcttaagaaagaatgggaaaagagtgatccaattatcaagaaaaacgtttgatactgaataccagaaaacgaaaaacaatgattgggattacgtagttaccacagatatatcagaaatgggagcaaatttccgagcagatcgagtcatagatccgcggaggtgtttaaaacccgtaatattaaaagacggtcctgaacgggtgatattagcaggtcctatgccggtgactgtagcttcggcagcgcaaagacgagggaggataggtcggaatcataataaggaaggagaccaatatgtatacatgggccaacctttaaataatgatgaagatcacgcgcattggacagaagctaaaatgttattagacaacattaacacaccagaaggcattataccagcattattcgagcctgagcgggagaaaagtgctgcaatcgatggagagtacaggctgagaggagaagcgcgaaaaaccttcgtagaacttatgcgcagaggagatctaccggtgtggctaagctataaagtggcgagcgaaggattccaatattctgatcgtagatggtgtttcgatggagagaggaataaccaggttttagaagaaaatatggatgtcgagatttggactaaggaaggagaaaggaagaaattgagacctcgatggctagatgccagaacttattcggatcccctagcacttcgagaatttaaggaatttgccgcaggacgtcgctccgtgagcggagatttgatattagagatcggaaagctgcctcagcatttaacacaaagggcacaaaacgctctcgataacctagtgatgcttcataattcagaacaaggcggtagagcttataggcatgcaatggaagaattaccagatactatagagactcttatgttgctagcattgatagcggtattgaccggaggcgtaacgctattctttttgtcaggccgtggattgggaaaaacttcaattggactattgtgtgttatggcatcaagcgtcttattatggatggcatccgtcgaaccacattggatagctgctagtattatacttgagttctttttgatggttttattaataccagaacctgaccgacaaagaactcctcaggataatcagttagcttacgtcgtcatcggacttttatttatgatactaacagttgccgcgaacgaaatgggtctactagaaacaacaaagaaagatttaggaatcggtcatgttgcagtagagaaccatcaccatgctgcaatgctagatgtggacctacatccggctagtgcatggactctttatgctgtagcaactacaataataacaccaatgatgcgacacacaatagaaaatacaacagccaatatttcattgaccgcaattgcaaatcaggctgctattctcatgggattggataaaggatggcctatcagcaagatggatatcggagtgccactacttgcgctaggttgttacagtcaagtaaatccgctaactttaacagctgccgtcctaatgctagttgctcattacgccattatcgggccagggctgcaagctaaagctactagagaggctcaaaagagaacagctgccggaattatgaagaacccaacagtagatgggatagttgcaatagacttagatcccgttgtatacgacgcaaaatttgaaaagcaattgggccaaataatgctattaatattatgtacctcgcaaatcctgttgatgagaacaacttgggcgctatgcgagagcataacacttgccaccggcccgcttacaacgctatgggaaggttcaccaggtaaattttggaatacaactattgcagtatcaatggcgaacattttcagagggagttatttagctggtgcaggtctggcctttagcctgatgaaatctctgggtggaggtagaagagggacgggagcacaaggtgagactttaggtgaaaaatggaaacgtcagttaaaccaattaagtaaatcagaatttaacacatacaaaagatcaggaattatggaggtcgacagaagcgaagctaaagagggattgaaaagaggtgaaacaacaaaacatgcagtaagtcgtggcacagccaagctaaggtggtttgtcgaaagaaatcttgtgaaaccggagggtaaagtaatagatctaggctgcggacgaggcggatggtcttattattgtgctggcctcaagaaagttacagaagtaaaaggttatacaaagggtggtccaggacacgaagaaccaattccgatggcgacatacggttggaacctagtcaaattacatagcggaaaagatgtcttctttataccaccagaaaagtgcgatactctactatgcgacataggcgagtcttcaccaaatcccacaattgaagaaggtagaaccttaagggtactaaaaatggtagagccctggctacggggaaatcaattttgtattaaaatattaaacccttatatgccttcggtggtagaaaccctggaacaaatgcaaagaaagcatggaggtatgttggtaagaaatccactttctagaaacagtacacatgagatgtactgggtcagctgtgggacaggtaacatcgtgtcagcagtcaatatgacttctcgtatgcttcttaatcgatttaccatggcgcaccgcaaaccaacatacgaacgagacgtcgatctcggtgcaggtacgagacacgtcgcggttgagcctgaagtagcgaacttggatattataggacagagaatcgaaaatatcaaacatgagcacaaaagcacttggcattacgatgaggataacccctataaaacttgggcataccacggaagctatgaagtaaaaccgtccggttctgcatctagtatggtcaatggtgtggtaaaattgttaaccaaaccatgggatgttataccgatggttacacaaatagctatgacagatacgactccttttggacaacaaagagtcttcaaggagaaagtcgacactcggacacccaaagcaaaacgtgggacagcacaaattatggaagtaacggcaaaatggctgtggggcttcttatcacgaaacaagaaacctcgaatatgcaccagagaggaatttacaagaaaagtaagaagcaacgctgcgataggggcagtttttgtagacgaaaatcaatggaactccgctaaagaagctgtggaggatgagcgattttgggatctagtacaccgagaacgtgaactacataagcaggggaaatgtgctacatgtgtgtataatatgatgggtaaaagagagaagaaactaggagaatttggcaaagccaagggcagcagagccatttggtatatgtggctcggcgctagatttctagaatttgaagcgttaggatttatgaatgaagatcattggtttagtcgagaaaactctctctctggggtcgaaggagaaggcttacacaaattgggctatatattacgagatatttcaaaaatcccgggcggcaatatgtatgctgatgacaccgccggttgggatacaaggattactgaagatgacttacaaaacgaagcaaaaataactgatattatggagcccgaacacgccctgttagcaaagagcatctttaaattaacgtaccaaaataaagtcgtaagagtacagagaccggcgaaaaatggaacggtcatggatgtaatctcaagaagagatcaaagaggcagcggacaagttggcacgtatggattaaatacatttacaaacatggaagctcaactgatacggcaaatggaatccgaagggatatttagtccctctgaattagaaacaccaaacctagcaggtcgcgtgttagattggctagaaaaacatggcgtggaacgtctaaaacgaatggccataagtggagacgattgtgttgtgaagccaattgacgataggtttgcaactgcactaacagccctaaacgacatgggcaaggtacgaaaagatattccacagtgggagccaagtaagggctggaatgattggcaacaggttccattttgctcacaccacttccaccaattaatcatgaaggatggaagagaaattgtcgtaccatgtagaaaccaagacgagttagtagggagagctagagtgtcacaaggggcaggatggagtttacgagagacagcgtgcttgggcaaaagttacgcgcaaatgtggcagttaatgtatttccaccgcagggatctgcgtctagcagctaatgcaatatgctcagctgtaccagtagattgggttcctacgagtagaactacttggtccatacacgcccatcatcaatggatgacgaccgaagatatgttatcagtctggaacagagtatggatcgaagaaaatccatggatggaagataaaacacatatttcttcttggggagatgttccgtacttagggaagagagaagatcagtggtgtggtagtctgattggtttaacagccagggcaacatgggcaacaaatattcaggtagcgatcaatcaagtccgaaggctcattggaaacgaaaattacctagactatatgacttctatgaagagatttaagaacgaaagtgatcctgaaggagcattatggtaa

SEQ ID NO: 21692 - RNA, 9879 nt, synthetic construct
  misc_feature 1..9879: note = derived and/or modified CDS sequence (opt6) from DENV-1__GQ199816__SS-prME
  source 1..9879: mol_type = other RNA
tcagtaactatgttattaatgttaatgcccacagcgctggcattccatttaacaactagaggcggtgaaccacatatgatagttagtaaacaagaaaggggaaaaagtctgctttttaaaacaagtgcaggggtgaacatgtgtactttaatagcaatggatttaggtgaattttgtgaagacacgatgacctataaatgcccccgaataacggaagcagaaccagatgatgttgattgttggtgcaatgcaacagatacttgggtaacttatggtacctgttctcagactggagaacacagaagggacaaacgtagtgtagcactggcaccccatgtgggccttgggcttgaaacgagaaccgaaacctggatgtcaagtgaaggggcttggaaacaaatacaaaaagtagaaacgtgggcactacgccatcctgggtttacagtaatcgcattattcctagcccatgcgatcggaacgtcaatcactcaaaaaggaataatatttattctgctgatgctagtaactccatcgatggcgatgaggtgcgtaggaatcggaagtagagattttgttgaaggtctaagcggtgctacttgggtggatgttgtcttagaacatggttcgtgcgttactacgatggctaaagataaacctacattggacatagaattacttaaaaccgaggtgacaaaccctgctgtactgcggaaactatgcatagaagcaaaaataagtaacaccacaacagatagcagatgtccgacacagggagaggcgactctagtagaagaacaggacgcgaattttgtatgccggagaacattcgttgatagaggctggggaaacgggtgtggattatttggaaaaggaagcctaataacatgtgcaaaattcaaatgcgttacaaaactggaaggaaaaaccgtacaatatgaaaatctaaaatacagcgttatagtgacagttcacacaggtgatcaacatcaagtgggaaatgagtctacagaacatggaacaaccgctactataacccctcaagcaccctcaactgaaatccagttaaccgactacggggctttaacactggattgctctccgagaaccggactagatttcaacgaaatggtattgttgactatgaaagaaaaggcatggctcgtgcataaacaatggtttctagatctaccgttaccatggaccagtggtgcctcaactagccaagaaacttggaaccgtaaagatttattagtaacatttaagacagcccatgcgaagaaacaagaagtcgtagttctagggtcacaagagggtgctatgcacaccgcattaactggagcgacagaaatacaaacgtcaggaacgacgacaatatttgcgggccatcttaaatgtcgtttaaagatggataaactaaccttgaaaggtatgtcatacgtaatgtgcactgggagctttaaacttgaaaaagaagtcgcagaaactcaacatggcacggtactggtccaaataaaatacgagggaacagatgcaccctgtaaaattcccttcagtacccaagatgagaagggagtaactcaaaatggtagactcattacagccaatccaatagtaactgataaagaaaaacctgttaatattgaagctgaacctccttttggggagagctatattgttatcggggcgggtgaaaaagcactgaaattaagttggtttaagaaagggtcatcaatagggaaaatgtttgaagccacggcaaggggagcgagaaggatggccatactaggcgacactgcctgggattttggatctattggaggtgtattcaccagtgttggaaagttagtgcaccaaatatttggtactgcttatggcgtcttgttcagtggagtaagctggaccatgaagataggcattggggtattattaacttggctaggattaaacagcaggtcaaccagtttatcgatgacatgcatagcggtgggtctagtaacattatacttaggagtcatggttcaagcggattcaggttgtgtaatcaattggaaaggaagagaattaaaatgcggtagcggtatatttgtaaccaatgaagtacatacatggacagaacaatataagttccaggccgattcgcctaaacgcttgagtgcggcaataggaaaagcatgggaagaaggtgtttgcgggattcgttcggcaacgcgtcttgaaaacataatgtggaaacaaatttcgaatgaactaaaccatatcctattagaaaacgacatgaaatttactgtggttgtgggagatgttgcaggtattctggcccaaggcaagaaaatgatccgaccgcaacctatggaatacaagtattcttggaaaagctggggtaaggcgaagataatcggcgccgacgtacaaaacgcgacctttataattgatggccctaatactccagaatgtccagacgatcagagggcctggaatatatgggaagtagaagactatggattcgggattttcactacgaatatatggcttaaattaagagactcttacacacaagtttgcgatcataggctaatgtccgcagcaatcaaagattccaaagcagtacatgccgacatgggctattggatagaaagcgagaaaaatgaaacttggaagttggcgagagcttcttttatcgaggtaaaaacatgcatatggcctaaaagccacacattatggagcaatggtgttctagaaagtgagatgatcatccctaaaatatatggtggaccaatatctcaacataactaccgtccgggatattttacacaaacggcgggaccgtggcatctaggaaaactagaactggattttgatctatgcgaaggtacaacagttgtcgttgatgagcactgtgggaaccgaggcccttcattgagaactactacagtcacaggaaagataatccacgaatggtgttgtagatcctgtactctacccccactacgcttcaagggtgaagatggatgttggtatggtatggaaataaggccggtgaaagagaaagaagaaaatttagtcaaaagtatggtctcagctgggagtggagaggtagattcattctccttgggtttgctgtgtatttcgataatgatagaggaagtaatgagatcaaggtggagtcgaaagatgcttatgacaggtattcttgcggtatttttcttactcatcatgggacagctgacgtggaatgacctaattaggctatgcattatggtgggagcaaacgccagcgaccgcatgggaatgggtactacttatctggcacttatggccacttttaagatgaggccaatgttcgcggttggtcttctgtttcgcagattgacttctagagaagttctattattgactataggactttccctagtagcttcagtggaattgccgaatagtttagaagaactaggcgatggactagctatgggtattatgatattaaagttactcaccgattttcaatcccaccaactatgggcaacattattgagtctaacattcataaaaacaacgttttcgctacattatgcatggaagacgatggctatggttttgtctatcgtatcactgttccctctatgtttgtcaaccactagccaaaagactacttggttgcctgtgcttttgggttccttgggctgcaaacccctaaccatgttcttaatagcagaaaataaaatatgggggcgaaaatcgtggcctctaaatgaaggaataatggccgttggtatcgtctctattcttctaagcagcttactcaaaaacgacgtcccattagcggggccactaatagccggtggaatgctaatagcctgttatgttatatcgggatcctcagctgacttatcgctagaaaaggccgccgaagtatcatgggaagaggaagctgagcattcgggggctagtcataatatcttagtggaggtacaggacgatggaacgatgaaaatcaaggatgaagaacgggatgatacccttacaatattgttaaaggctaccctcttggccgtttcaggtgtttacccgttgtccataccggctactctttttgtttggtatttttggcaaaagaagaaacaacgtagcggtgttttatgggatactccatcgccgcccgaagtagaacgcgctgtactcgacgacggaatatataggatcatgcaacgaggacttttggggagaagtcaagttggagtaggagtttttcaggagaacgtatttcataccatgtggcacgtaactagaggcgctgttctaatgtatcaaggtaaaagactagaaccatcatgggcatcggtcaagaaagacctcatttcatacgggggcgggtggagactgcaagggtcatggaatactggtgaagaagtacaagtgatagcagtagaaccggggaaaaaccctaaaaatgtacaaactgcacctggaacattcaaaacgagcgaaggtgaagtgggagcaattgcacttgactttaagccgggcacctcaggaagccctatcgtaaatagagagggaaaaatagtagggttgtatgggaacggtgtggtgacgacctctggaacatatgtctctgctattgcgcaggctaaagccagccaggaaggcccactgccagagatagaagatgaggtttttcgaaaacgaaacttgactataatggaccttcaccctggctctgggaaaactcgccgttatttacctgcgattgtacgagaagccattaaaaggaaactacggactctgatccttgccccaactagggtagtagcgagcgagatggctgaagccctaaaagggatgccgataagatatcaaacaacagctgtgaagagtgaacacactggaaaggaaatcgtcgacttgatgtgtcatgcgacatttaccatgcgcctattaagtcccgtgagagtcccaaattacaacatgattattatggacgaggcacactttacagacccctctagtatagcggctagaggttatatatcaaccagagttggcatgggagaagccgcagcaatattcatgactgcgacgccaccaggaagtgtggaggcatttccacagagtaatgctgtaattcaggatgaagagagagacatcccggaaaggtcgtggaactcagggtatgaatggatcacagatttcccaggtaaaactgtttggtttgtaccgagtattaaaagcggtaatgatattgcaaattgtttacggaaaaatggaaagagggtaatacaattgtctaggaaaacgtttgacacggagtaccagaagactaaaaacaacgactgggattatgtagttaccacagatataagtgaaatgggcgcgaacttccgagccgatagagtaatagatccaaggaggtgtctgaaaccggtaatactcaaagatggcccggagagagttatcctagccggaccaatgccagtaaccgtagcgtcagcagcacaacgccgaggacggattggtcgaaaccataataaagaaggagatcaatacatatatatgggtcaaccactaaataatgatgaagatcatgcacactggacagaagctaaaatgctattggacaacataaacacaccggagggaataataccagcgttattcgagcctgaaagagagaagagtgcggcaatagatggtgaatacagactaaggggtgaggctaggaaaacctttgtagaattgatgaggagaggagatctaccagtatggctaagctataaggtcgcaagtgagggttttcaatatagcgataggcggtggtgctttgacggagaacgtaataatcaagtgctcgaagaaaatatggacgttgaaatatggacaaaagagggagaacgaaagaaactgcgaccaaggtggctagacgcgcgtacatactcagatccactagctctacgcgaatttaaagaatttgcagcgggacgtcgtagcgtgagtggagatttgatactagaaattggaaaactcccgcaacacttaactcagcgagcgcaaaatgcacttgataatctcgtaatgctacataattccgaacaagggggcagggcttataggcatgcaatggaagaattgccagacacaattgaaacattaatgttgctagctttaatagccgtattaacaggaggagtaactttatttttcttatcgggaagaggactgggaaaaacaagtataggtcttctatgtgtgatggcatcatcagtactactatggatggcaagtgtagagccacattggatagctgcttctataatacttgagttcttccttatggtgttactcatacctgaacctgaccggcaaaggactccacaggacaatcaattagcgtatgtagtcataggcttactatttatgatacttactgtagctgccaatgagatgggacttttagaaaccactaaaaaggacctagggatcgggcatgtagcagtagaaaatcatcatcacgcggcaatgctagacgtagaccttcacccagcctcagcatggacattatacgccgtggcaacaacgatcataacgccgatgatgagacacactatagaaaatacaacggcgaatatcagcttaacggcgattgcaaatcaagcagctattttgatgggcctggacaagggttggcccatatcaaagatggacataggtgtgccattactggcgctaggatgttattctcaagtaaaccctctaacgttaactgcagcagttcttatgctggtagctcattacgccattatagggcccggtttgcaggcaaaggccacaagggaggcccaaaagaggacagctgcggggattatgaaaaaccctacagtagacgggattgtagcaatagatctagatccagttgtatacgacacgaaattcgaaaaacaacttggacaaatcatgttactcattctatgtaccagtcaaattttattaatgcgaactacatgggctttatgcgaatctattacattagctacaggtccactaacaacactttgggaaggctctccagggaagttttggaataccactatagcagtatcaatggcaaatatatttaggggttcatatctggcgggagcaggattagcgttctcgttaatgaaaagtctgggcggaggcagaagggggacgggtgctcagggagaaacacttggagagaaatggaaacgacaactaaatcaactctcgaaatcagagttcaatacatacaaacgatcaggaatcatggaagttgaccgtagcgaagcaaaagagggcttgaaaagaggtgaaacaacaaaacatgctgtctcccgtggaacagctaaactaagatggtttgtcgagagaaatcttgttaaaccagaaggcaaagtcatcgatcttggttgtgggagaggtggttggagttactattgcgcaggactaaagaaagttacggaggtcaaaggatatacgaaaggcggaccaggacatgaagaaccaatcccaatggcaacttatggatggaatttagtaaaactgcatagtggtaaggacgtatttttcataccacccgaaaaatgcgacacattattgtgcgatataggtgaatcgagtcctaatcccacaatagaggaaggaagaacattacgggtgttaaagatggttgagccatggctacgaggaaatcaattttgcataaagatattaaatccctacatgccgagtgtagtagaaacgctcgaacaaatgcaaagaaaacacggcggaatgctagtacgcaacccactgtcccgaaattcaacgcatgaaatgtattgggtgagctgtggcactggaaatatagtaagcgcggtaaatatgaccagtcggatgctacttaatcggtttacaatggcacaccgaaaaccaacctatgagagagatgtagacttgggtgcaggaacgagacacgtagcagtcgaaccggaggttgcgaacttagatattataggacagagaattgaaaatataaaacatgagcataaaagtacatggcactacgatgaggataatccttacaaaacatgggcctatcacggatcatatgaagtaaaaccgtcaggatctgccagtagtatggttaacggtgtcgtaaaactattaacaaaaccatgggacgtaatacctatggttacacaaatcgctatgaccgacacgaccccttttggtcaacaaagagtatttaaagagaaagtggacactagaactccaaaagcgaaacgaggaacagcacaaataatggaagttacagcaaaatggttatggggatttttaagtaggaacaagaaaccacgtatatgcacacgtgaagagttcactagaaaggttcggtcaaatgcggctattggggcagtgtttgtagatgagaatcagtggaatagtgcaaaagaggctgtcgaagatgagcgattttgggatcttgtccacagggaaagggagttacataaacaagggaaatgtgccacttgcgtatataacatgatgggcaaaagagagaagaaattaggcgagtttggcaaagcaaaaggctcaagggcaatatggtatatgtggttaggtgcacgatttttggagtttgaagcgttaggctttatgaatgaagatcactggttctcgagggaaaattctcttagtggtgtcgaaggggaaggcttgcacaaattgggatacatacttagagacatctctaaaattccagggggtaatatgtatgcagacgacacagcggggtgggataccagaataacagaagatgatctacaaaatgaagcaaagataacggatatcatggaacctgagcatgcccttctcgctaaatcaatattcaaactgacctatcaaaacaaagttgtacgtgtacaaaggccagccaaaaacggaacagttatggatgtcatcagtaggagagatcaacggggcagtggtcaggtggggacgtatggattgaatacgtttacaaatatggaagcacagctcataaggcaaatggagagcgaaggaatcttttcaccctcggaattagaaacccctaacttggcaggacgggttttagattggctagaaaaacatggagtcgagagactaaaaagaatggctatcagtggtgacgattgcgtagtaaaacctatagatgacagatttgcgacagctctaacggccctaaatgatatgggaaaagtaagaaaagatataccacaatgggaaccaagtaagggatggaacgattggcagcaggttcccttctgcagtcatcatttccaccaattaataatgaaggatggacgagagattgtcgttccatgtagaaatcaagatgagctagtgggtcgagctagggtttcgcaaggggcagggtggtctctaagggaaacagcatgtctcggaaaaagttatgctcaaatgtggcaacttatgtactttcacagacgagatttgcgcctagcagctaatgcaatatgttctgctgtaccagttgactgggtaccgacttccagaacaacgtggtcgatacacgcacaccaccaatggatgactacagaagacatgctatcagtttggaatagggtttggatagaagagaacccatggatggaagataaaacccatatatcctcttggggagatgtgccatatcttggaaaaagggaggatcagtggtgcggatcgttaattgggttgacagccagagctacatgggccacaaacattcaagtggccattaatcaagtcaggcgattaataggaaatgagaactacctcgattatatgacctctatgaaacggttcaagaatgaaattgatccagaaggcgcattatggtaa

SEQ ID NO: 21693 - RNA, 9879 nt, synthetic construct
  misc_feature 1..9879: note = derived and/or modified CDS sequence (opt6) from DENV-1__GQ199817__SS-prME
  source 1..9879: mol_type = other RNA
tccgttactatgttacttatgttaatgcctacagctttagcttttcatcttacgactagagggggtgaaccacacatgattgttagcaaacaagaaaggggtaaatcattactctttaaaacttctgcaggagtgaatatgtgtactttaatagctatggatttaggggaattttgcgaagatacaatgacttacaaatgccctagaataacagaagctgaacctgacgacgtagattgttggtgtaatgccactgacacctgggtcacctacggtacctgttctcaaaccggggaacaccgacgcgacaaaagatccgtagcgctcgcacctcacgtcggattgggactggaaacacgcactgaaacttggatgagtagtgaaggagcttggaaacaaattcaacgagtcgaaacatgggcactgcgacatcccgggtttacagttatagcgctatttcttgctcatgctattggaaccagcataactcaaaaagggataatatttatattgctaatgctagtgacaccctctatggcaatgagatgtgtcggaataggctcaagagacttcgtagaaggcttatcgggagcaacttgggttgatgttgtattagaacatggctcatgtgtaacaacaatggcaaaagataaaccgactctggatatagaattactaaaaactgaagtaacaaatccagcggtacttagaaaattatgtattgaagcaaaaatctcaaatactacaacagacagcagatgcccaactcaaggagaagccactctcgtagaagaacaagacgcaaattttgtatgcagacgtacatttgtcgatcgaggatgggggaatggttgcggacttttcggcaaaggttccttgataacatgtgcaaaattcaaatgcgttaccaaattagagggtaagatagtacaatatgaaaatctaaaatattcagtaatcgtcacagtacatacaggggaccaacatcaagtagggaatgaatccacagaacatggaacaactgcaactataactcctcaagcacctagtactgaaatacagctaactgactacggagctttaacacttgactgttctccaaggactggtttagacttcaatgaaatggttttattaacgatgaaggagaaaagttggcttgtacacaaacagtggttccttgacttaccattaccgtggacaagtggagcatcgactagccaggaaacttggaatcgacaagatctactggtaacgttcaaaactgctcacgctaagaaacaagaagtagtagtgttgggcagtcaagaaggcgcaatgcatacggctcttactggcgcaactgaaatacaaacaagtggtacgacaacaatatttgcggggcacttaaaatgtagacttaaaatggacaaattgactctaaaaggtatgtcatacgtgatgtgcacaggatcattcaaactagaaaaagaagtggcagagacacagcacggtacagtgttagtacaaattaaatatgaaggtacagacgctccatgtaaaataccttttagcacacaagatgaaaaaggagtgacacaaaacggacgtttaattacagcaaatcctatcgttactgataaagaaaaacctgtaaatatagaagccgaacctccgttcggagagtcctatatcgtaataggtgcaggagagaaggcgttaaagctatcatggttcaagaaaggaagctcgatcggcaagatgtttgaagcaactgcaagaggtgcgcgcaggatggctattcttggcgatacagcgtgggacttcggtagtataggaggggtttttaccagtgttggaaaactggttcatcagatatttggaacagcttacggtgttctattcagcggagtaagctggacaatgaaaatagggatcggcgtgttgctgacttggctaggattgaactctagatccacttcgctttccatgacatgcattgctgttggcttggtcactctatatttaggagttatggtgcaagcggactcaggatgtgttataaactggaaagggagagaattaaaatgcggaagcggaatattcgttaccaacgaggttcatacatggaccgaacaatacaaatttcaagctgacagtcctaaaaggttgtcggcagctatcggaaaggcttgggaggaaggggtatgtggtatcagatcagcgactaggctagaaaacataatgtggaagcaaatttccaatgaactgaatcatatattactagaaaatgacatgaaactaaccgttgtcgtgggcgatgttgcaggaatacttgctcaagggaagaagatgattagacctcaaccaatggaatacaagtatagctggaaatcctggggtaaagcaaaaatcataggggctgacgtacagaacactacattcataatagatggccctaatacgccggaatgcccggacgaccagagggcttggaatatatgggaagttgaagattacgggtttggaatcttcacaaccaatatttggcttaaattgagagattcctatacgcaagtttgtgatcatagattaatgtcggctgcgataaaagattcgaaagccgtccacgcagacatgggatactggatagaatctgagaaaaatgaaacatggaaattagcacgcgcttcatttatagaagttaaaacatgcatatggccgaagagtcatacactttggtcaaatggagttctagaatctgaaatgataatcccaaaaatatatggcgggccaataagccaacacaattacagacccggatactttacacaaaccgcgggaccgtggcatttaggcaaattagaattagattttgacttatgcgaaggaaccactgtagttgtcgatgaacattgtggtaacagaggcccttcattgagaaccacaacagtaactggaaaaattatacacgaatggtgttgcagatcatgtacacttcctcccctacgctttaaaggagaagacggatgctggtatggcatggaaatcagaccagtgaaggaaaaagaagaaaatcttgtaaagagtatggtaagcgccggttcaggagaagtagactccttttcactgggtttattatgcatctcgattatgattgaggaagttatgaggtcacgatggtcacgtaaaatgcttatgactggaaccttagcggtcttctttctgttaatcatgggtcagctaacgtggaatgatttaataaggctttgtataatggtgggtgctaatgcttctgatagaatggggatgggcacgacatatcttgctctaatggcaacttttaagatgaggcccatgttcgcggtaggattactctttaggagactaacaagtagagaagtccttttattaaccattggtttgtccttagtagcaagtgttgaacttccaaactcacttgaggagctcggagatggcttagccatgggcattatgattctgaaattattgactgactttcaaagtcaccaactgtgggcaacactcttatcactgacattcataagaacaacattcagcttacattatgcatggaaaacaatggcaatggtgctctcaattgtttctttaatcccattatgcctgagtactacaagccagaaaaccacgtggctaccagtacttttgggaagtctaggttgcaagccgttaacaatgtttctaattgcggaaaacaaaatttggggtagaaaaagttggcccttaaatgagggaataatggcagttgggatagttagtatcttactatctagcctactcaaaaatgatgtgccactagcaggtcctctgatagccggtgggatgttaatcgcatgttatgtcatttcgggaagctcagccgatttatcactagagaaggcagctgaagtttcatgggaagaggaagctgaacattcaggtgcttcgcacaatatcttagtagaagtacaagatgatggaacaatgaaaataaaagacgaagaacgagatgacacattaaccatactcttaaaagccacccttctagcggtttcaggagtatatccattaagtataccagcaaccttgtttgtgtggtgtttctggcaaaagaagaaacagcgatcgggggttttatgggacacaccctccccaccagaagtcgaacgtgcggtgttggatgacggaatatatagaattatgcagcgcggattgcttgggagatctcaggtaggagtaggggtcttccaggagaatgtattccacactatgtggcacgtcacccgtggagccgtactaatgtaccagggcaagagacttgaaccgagctgggcctcagtcaagaaagatcttatatcatatggaggcggttggcgcctacaaggaagttggaatacgggtgaggaagtacaagtcatagcggtcgaacctggcaaaaatcctaagaatgtgcaaactgccccaggcacatttaaaacaagcgaaggtgaggtgggtgccatagcgctggattttaaaccaggtacaagtggatcgcctatagtaaacagagaaggaaaaattgtaggattatatggtaatggcgtggttactacaagcggaacatatgtcagtgcaatagcccaagcaaaagcatcgcaagaaggacctttaccggagatagaagatgaggtatttcgcaaacgtaatttgacgataatggatttacatcctggaagcggcaaaactcgtagatatctacctgccatcgtgagagaagcaattaaaagaagattaagaacactaatactagcaccaactcgcgtggtggcatctgaaatggcggaagcactcaaaggaatgccaattagataccaaactacagcagttaaaagcgaacatactggtaaagaaattgtggaccttatgtgccacgcgacatttacgatgcgcttgcttagtccagtacgcgtaccaaattacaacatgattatcatggatgaagctcattttacagacccctctagtattgccgcgagaggttatatttccactagagttggaatgggagaagcagctgcgattttcatgacagccacccctcctggaagcgttgaggcctttcctcaaagcaatgcggtaatccaagatgaagaaagggacatccccgagagaagttggaactcgggatatgagtggatcacagacttcccaggaaaaactgtgtggtttgttccaagcatcaaaagtggaaatgatatagcaaactgtcttagaaagaatggtaaacgtgttatacaactatcaagaaaaacgttcgatacggaataccagaaaaccaaaaataacgattgggattatgtagttaccacagacataagcgagatgggggctaactttcgggctgaccgagtcatagacccccgacgatgcttgaaaccagtaattctgaaagatggaccagaaagagtcatactggcaggtccgatgccggtgacagtcgctagtgcggcgcagcgaagaggacgaattgggcgtaatcataacaaagaaggggaccaatatatttacatgggacaaccacttaataatgacgaagatcatgcccactggacagaggcaaaaatgctactcgataacataaatacaccggaagggataatacctgccttgtttgaaccagaacgtgaaaagtcagcggcaatagacggtgaatacagactaagaggggaagcgcgcaaaacttttgtagaattaatgcgtcgaggcgatctccctgtatggttgagctataaagttgcgagcgagggatttcaatattctgatagaaggtggtgcttcgatggtgagaggaataatcaggtattggaagaaaatatggatgtagaaatctggacaaaagaaggagaaaggaagaaactacgacccaggtggttagatgcgcgtacttactcagatcctctagctctacgtgaatttaaagaatttgcagcgggaagaaggtccgtcagcggagacctcatactcgaaatcggcaaattaccacaacatttaacacagagggctcaaaatgccttagacaatttagtgatgctacataactcagaacagggtggtcgcgcttacaggcacgcaatggaggaattacccgatacgattgaaacattgatgttgttagcgctaatagcagtactaacagggggagttactttattcctacttagtgggcgaggattaggcaaaacgagcataggattgctgtgcgttatggcttcttcagttctactttggatggctagtgttgaacctcactggattgcagcgtcgattatattagagttctttctgatggtgttattgataccagaaccagacagacaaagaacacctcaagataaccaattagcgtatgtcgtaatcggacttctctttatgattcttacagtcgctgcgaacgaaatggggcttctagaaacaactaagaaagatctaggaataggtcatgtagcagttgagaatcaccatcatgccgcgatgctagatgtagatttacacccagctagtgcttggaccctgtacgcggtagcgaccaccataatcaccccgatgatgcggcacacaatcgaaaacacaacagcaaatatctcattgacagctatcgctaaccaagctgccattttaatgggattagataaagggtggcctatatcgaagatggacataggagtaccattgttagcattgggctgttatagccaagtcaacccgcttacactcactgcagccgtactgatgctggtggcacattatgcaataatagggccgggactccaggcaaaggctacaagggaggctcagaaaaggacagcggcagggataatgaaaaatccaactgtcgacggaatcgtagcaatagacctcgatccagtagtatacgacgctaagtttgagaagcaattaggtcagattatgttgctaatcctttgtacttcacagatactattaatgagaacgacatgggcactatgtgaaagtataactcttgctacaggaccactgaccacgttgtgggagggaagtccaggtaagttttggaatacgactatagctgtttccatggcaaacattttcaggggatcatacctggctggagctggcctagcattcagtctgatgaagagtctgggtggtggaagaagaggtacaggagcccaaggtgaaacgttaggagaaaagtggaaaaggcagcttaatcagttaagtaaatcagagttcaatacgtataaacggagtggtattatggaagtagatcgatccgaagcaaaagaagggctaaaacggggcgagactacaaagcatgctgtgagcagaggaaccgcgaaactaaggtggttcgtggaaaggaatttggttaaaccagaagggaaagttattgaccttgggtgcggtcgaggtggatggagctactattgtgcaggcctcaagaaggtaacagaagtgaaaggatatactaaaggagggccgggccacgaagaaccaataccgatggctacatacggatggaatttagtaaaactgcactcagggaaggatgtattctttataccacctgaaaaatgcgacaccttactttgtgacataggggagagtagtcctaacccgaccatagaagaaggccgcacactacgtgtgttaaaaatggttgaaccctggctacgcggtaatcaattttgtataaaaatcctcaatccatacatgccaagcgttgtggaaacattagagcaaatgcaacgaaaacatggcggtatgcttgtcagaaatccactgtctagaaattctactcatgaaatgtactgggtgtcgtgtggtaccggaaatatcgtttcagcggttaatatgacatctagaatgttgttaaacagattcacaatggctcatcgaaaacctacgtatgaaagggacgtcgacttaggcgcaggcacaagacacgttgcggtcgaaccagaagtcgcaaatttagatataattggtcaacgaatcgagaatattaagcatgaacataaaagcacctggcattatgatgaggataatccatacaaaacttgggcgtatcatggaagttacgaggtcaagccctcaggatcagcttcatcaatggttaatggtgtagttaaacttttaaccaaaccctgggatgtaatacctatggtgacacaaatagccatgactgacacaacaccttttggacagcaaagggtatttaaagaaaaggtcgacactaggacacccaaggcaaaacgaggaacagctcaaataatggaggtaaccgcaaaatggctatgggggttcctatcacgtaataagaaaccacggatatgtactcgagaggagttcacgagaaaagtcaggagcaatgcagccataggcgctgttttcgtagatgagaaccaatggaactcggcaaaagaagctgtggaagacgaacgcttttgggatctcgtacatcgagaaagagaactacacaagcaaggaaagtgtgcgacatgtgtatataacatgatgggaaaaagagagaagaaacttggggaatttggaaaggcgaaaggtagtcgtgccatttggtatatgtggttaggcgctaggttcctagaatttgaggcactcggatttatgaacgaagaccattggttttcgcgagaaaacagtctgagtggggtcgaaggcgagggtttgcataaactcggatacattttaagggacatttcgaaaattccaggcgggaatatgtatgccgatgataccgctggctgggatacccgaatcacagaagatgacctacagaacgaagcaaagattacggacataatggaacccgagcacgccctattggctaaaagtatcttcaaattgacctatcaaaataaagttgtaagagtccagcggccagctaagaatggaacagtgatggatgtaatatccagacgagatcaaagagggtcgggccaggtaggaacatacggtctcaacacatttactaacatggaagctcaattaattcgtcaaatggaaagcgaaggaatattcagcccatcagaactagaaacaccaaacttagcgggccgagtacttgactggcttgagaaacatggcgtagaacggttgaaaagaatggcaatatcgggcgatgactgcgtggttaagccaatagacgaccgtttcgcgacagctctgacagcattaaatgatatgggaaaagtcaggaaggacatcccacaatgggaaccttctaaaggctggaatgattggcagcaagttccattctgctctcaccacttccaccagttgatcatgaaggatggtcgagaaatagtcgtgccgtgtagaaatcaagatgagttagtaggaagggcacgggttagccaaggagcagggtggagtctaagagaaaccgcctgcctaggaaagtcttatgcacaaatgtggcaattaatgtattttcatcgtcgggatttgcgcctggctgcgaacgcgatctgttcagcagtaccagtagactgggttccgacttctcgaacaacctggtcgatacatgcccatcaccagtggatgacaacagaagacatgttatcagtgtggaatagagtctggatcgaggagaacccatggatggaagataaaacacacgtctcttcatggggtgacgtgccctacctaggaaaaagagaagatcaatggtgtgggtcgttaattggactgaccgccagagcaacttgggcaacgaatatacaggttgccataaaccaagttagaagattattaggaaatgaaaactatctcgactacatgacatcgatgaaaaggtttaaaaatgagagcgacccagaaggtgcgctgtggtaa

SEQ ID NO: 21694 - RNA, 9879 nt, synthetic construct
  misc_feature 1..9879: note = derived and/or modified CDS sequence (opt6) from DENV-1__FJ882550__SS-prME
  source 1..9879: mol_type = other RNA
tccgtgacaatgctgttaatgctaatgcctacagcgttagcatttcacctaacaacgaggggtggggaacctcatatgatagtgacgaaacaagaaagaggaaaatctctactattcaagacttcagctggtgttaatatgtgcactcttatagcaatggatcttggtgaactatgtgaagatacaatgacttataagtgtcctcgaattacagaagcagaaccggacgatgttgattgttggtgtaatgcaactgacacctgggttacctacggtacgtgctcgcaaacgggagaacaccgccgtgataaaagaagtgtagcattagcacctcatgtaggtcttggcttagaaacgcgaactgaaacatggatgtcatcggaaggtgcctggaagcaaattcaaagggtcgaaacatgggctcttaggcacccaggttttactgttattgctttattcctggcccacgctataggaaccagcatcacacaaaaaggaataatattcattctgttaatgctcgttactccatcgatggcaatgagatgtgtcggcattggaagtcgagattttgtcgaaggactatccggtgctacatgggttgacgtagtattggaacacggaagttgcgtgacgacaatggccaaagataaaccaacattagacatagaattattaaaaactgaagttacaaatcctgcggttctgaggaaactttgtatagaagcaaaaatatccaatacaacaaccgacagtcgttgtccaacacaaggagaagcaaccttgatggaggaacaagacgcgaattttgtttgtagacgaactttcgtcgatagaggatggggtaacggatgtggcctatttggcaaaggatcactaattacatgtgcgaaatttaaatgcgtaactaagttggaaggaaaaattgttcagtacgaaaatctaaagtacagtgttattgtgacagttcatactggagatcaacatcaagtagggaatgaatcgacagaacacggtaccactgccacgataacacctcaagctcctacttctgagatacagttaacagattacggagccttaaccttagattgctcaccaagaacaggtttggactttaatgaaatggttttgttgactatgaaagaaaagtcatggttggtacataagcaatggtttcttgatctaccactgccttggacaagtggagcgtcaacatcccaagaaacctggaaccgccaggatttattagtgacatttaaaactgcacacgccaagaaacaagaggtagtggttctagggagtcaagagggagccatgcacaccgcactaactggtgctacagaaatacaaacaagtggtatgacaacaatctttgcgggacaccttaaatgccgccttaagatggacaaactgaccttaaaaggcatgagctatgtcatgtgtacaggctcattcaaactggaaaaagaggttgccgaaacgcagcatgggacagtcttagtacaaatcaaatatgaaggtacggatgctccttgtaaaatcccgttctcaactcaagatgagaaaggcgtaactcaaaatggaagacttatcacagcaaatccaatagtgacagacaaagagaaacctgtaaacatagaagcggagcctccttttggggagtcttatatcgtaataggagcaggcgaaaaggccctaaaactctcctggtttaagaaaggatcgagtataggaaagatgttcgaagcaacagcacgtggagcacgacgaatggccatactaggggacacagcgtgggattttggatcagttggaggtgtgtttacaagtgtagggaaattagtacatcaaatctttggaactgcttatggagtactcttctcaggagtatcctggaccatgaaaattggaataggggtcctgttgacatggttaggtctaaatagccgatcaacaagtctgtctatgacgtgcatagccgtaggactggtgacattatatttaggagtcatggtgcaagctgattcgggatgtgtgattaactggaaaggtagagaattgaaatgcgggtcaggcatttttgtgacaaatgaagtacatacctggactgaacaatacaaattccaggcagattcgccaaaaagactatccgctgcaatcgggaaagcgtgggaggaaggtgtatgtggtattaggtctgcaactagattggaaaatataatgtggaaacaaatttcaaatgaactaaaccatatactgttagaaaatgacatgaaattcactgtagtagtcggcgatgttgtaggtatcctcgcacaagggaagaaaatgatccgaccacagccgatggaacataaatattcttggaagagttggggcaaagccaaaatcattggcgcggatgtacagaacacaacctttataattgatggaccaaacacacccgagtgccccgatgaccaaagggcatggaatatatgggaggttgaagattacggctttggaatatttactacgaacatttggctaaaattgagggattcatatacacaggtgtgcgaccatagactcatgtccgctgcaattaaagatagtaaagctgttcacgcagacatgggttattggatcgagtccgagaaaaatgaaacgtggaaattagcacgagctagttttatcgaggtaaagacatgtatatggccaaagagtcacacattatggagtaatggcgtactggagtccgaaatgataatcccgaaaatatacggtgggccgatcagccaacataattacaggccggggtattttacacaaaccgctgggccctggcacttaggtaaactagagcttgactttgatttgtgcgaaggtactactgtggtcgttgacgaacactgtggaaatcgaggaccatcactccgtacaacgacggttacgggtaaaataatacatgaatggtgttgcaggtcatgtacactgccgcccctaaggttcaagggagaggacggatgttggtatgggatggagataagacccgttaaagaaaaagaagaaaatctagtaaagagcatggtatctgcaggtagtggagaagtagattcgttcagcctagggctactctgcatttcaattatgatcgaagaggtcatgcgttctaggtggagcagaaaaatgttaatgacaggtacgttagctgtatttctgcttttgattatgggacaattaacatggaacgacctgataagactttgtattatggttggagctaatgccagtgatcgaatgggaatgggaaccacctatctagctctaatggccacttttaagatgcgacctatgtttgcggtaggtctgctatttagaagacttacatcaagagaagtcctgctattaactataggattatcccttgttgcaagtgtcgagctgccaaattctttggaagagttaggagacgggttggcgatgggcatcatgattttgaaactactgaccgattttcaaagtcaccagttatgggctacgctactatcccttactttcattaaaactacattaagtttacactacgcatggaaaaccatggccatggtgttatccattgttagcttattccctctgtgcttaagtactacgtcgcaaaagacaacatggttgcctgttttattagggtctttaggttgtaaaccgcttactatgtttctgatcactgagaacaaaatatgggggcgtaaatcatggccactgaatgaaggtattatggcagttggcgtggttagcatccttctatcaagtctactgaagaatgatgtacccttggccggccctctaattgctggaggaatgctaattgcgtgttatgttataagtggcagcagcgccgacttaagtttagagaaagcagctgaagtctcatgggaggaagaagccgaacattcaggtgcatcccacaatattttagtggaggttcaagacgacggaacaatgaaaattaaggacgaagagagagatgataccctaacaatattactaaaggccacattactagcagtcagcggcgtttatccactgtcaatacccgccactctatttgtttggtacttttggcagaaaaagaaacaacgatctggagtgttgtgggacacacctagtcctccggaagtagagagggcagtcctcgatgatggaatttaccgaataatgcagcgaggattgttaggccgatcacaagtaggagttggagtctttcaagaaaatgtgttccacacaatgtggcatgttacaagaggggcagttctgatgtatcaaggcaaacgcttggaaccgtcatgggcatcagtaaagaaagatctcatatcttatggaggaggatggagactccaaggtagttggaataccggcgaagaggtccaggttatagcggtagagcccggcaagaatccaaagaacgttcaaacagctccagggaccttcaaaacaccggagggcgaagtaggagctatcgctttagactttaaacctggaacaagcggtagccctatcgtaaacagagaaggtaagatagttgggctatatgggaatggagtagtcacaacatcaggaacatacgtgtccgctatcgcgcaagccaaagccagtcaggagggaccacttcccgaaatagaagatgaagtttttagaaagaggaaccttacaatcatggatttacaccctggaagtggtaaaacgagaaggtatttacctgcaatagtacgtgaagcaataaaacgaaagctacgtacgttaatactggcaccaacgcgagtggttgcgtcagagatggcagaagcattaaagggcatgccgataagatatcagactacagcagttaagtcagaacatacaggcaaagaaattgtagacttgatgtgtcatgcaacgtttacaatgcgattgttgtcaccagtaagagtacctaactacaacatgatcattatggacgaggcacactttacagatccgagtagtatagccgcacggggctatatttctactcgagtaggaatgggagaggccgcggctatatttatgaccgctacgccaccaggatcagtcgaagcattcccccagagcaacgctgtaatacaggatgaagaaagggatattccagaaaggagttggaactctggatatgaatggatcacagactttcctggaaaaacagtatggtttgtgccatccattaaatcgggtaacgatatcgccaattgtctgaggaagaatgggaaaagagtcatccagctatctcgtaaaacatttgacaccgaatatcagaaaaccaaaaataatgactgggattatgtggttaccactgacatatcagagatgggagctaacttcagggccgacagggtcatagatccacgacgatgtctgaaaccagtaatcctcaaagatggtccagaaagggttatattggcaggacctatgccggttacggtggcatccgcagcccagaggagagggcgtataggtagaaatcataacaaggaaggagaccagtatatttacatgggacaaccccttaataacgacgaagatcatgcacattggacagaagctaaaatgctactagataacattaatactccagaaggcattattccagctctatttgaaccggaaagagagaaaagcgcagctatagacggagaatatcggctacggggtgaagcacgtaagacattcgtagaattaatgaggagaggtgatcttcccgtatggctatcatataaagtagcatctgaaggatttcaatacagtgatagaagatggtgctttgatggtgagcgaaataatcaggtacttgaggaaaatatggatgtcgaaatatggaccaaggaaggcgaaaggaagaaacttaggccaagatggttagacgcacgcacctattcagatcctttagcgttaagggaatttaaagagttcgcagccggtaggcgaagtgtctcaggcgacttaattttagaaataggaaaattacctcaacatcttacacaacgagcgcaaaatgcattagataatctagtaatgctacacaatagcgaacaaggaggaagggcgtaccgccacgcgatggaagaactaccagataccattgagacacttatgttgctagcactcatcgcagtactcacaggtggggtcacactattcttcctaagcggtagaggactgggaaaaacatcgattggcttattatgtgtcatggcaagcagtgtattactttggatggcatcggttgaacctcattggatcgccgcttctattatactagagttctttctgatggttttattaataccagaacctgatcgccagcgcacgcctcaagacaatcaattagcgtatgttgtaataggactattattcatgatcttaaccgttgcagccaacgaaatggggttgttagaaacaacaaagaaagatctcggcatcgggcatgtcgctgtagagaaccaccaccacgccactatgctcgacgtggatctccacccagcctccgcatggaccttatatgcagtagcaacaacaataattacgcccatgatgcgccatacaatagaaaacacaacagccaatatctcattaacagcgattgccaatcaagcggcaatactaatgggtttagataaaggctggccaatatccaaaatggatatcggagtccccctactcgcactagggtgctatagtcaagtcaatcccctgactctgacagcagctgtattaatgctcgtagcccattacgctatcataggacctggattgcaagcgaaagcaacacgggaggcccagaaacgaacagctgcgggaataatgaaaaacccgacagtcgatggcatcgtcgcaatagacctagacccagtagtatacgatgcgaaattcgaaaaacaattgggccaaataatgttgttaatactatgcacgtcccaaattctccttatgagaacaacgtgggcgttatgcgaaagtatcacattagctacaggacctttgactaccttatgggaaggatctcctggaaagttctggaacacaacaatagctgtatctatggccaacatatttcggggatcgtatctagccggtgctggtctcgccttttcgcttatgaaatcactgggcggcggaagaagaggtactggagcgcagggcgaaacattaggagagaaatggaagcgtcagctgaaccaattaagtaaatcagagtttaatatttacaaaaggtcggggataatggaggtggatagatcagaagcaaaagaaggactaaaaaggggcgagactaccagacacgcagtatcaagaggaacagcaaaattaaggtggtttgtggaaagaaaccttgttaaacccgaaggaaaagttatcgaccttggttgtggtagaggcggttggagttactactgtgctggtctcaagaaagttactgaggttaaagggtatactaaaggaggtccaggtcatgaagaacccatacctatggctacgtatggctggaatctagtaaaactacactcaggaaaagacgtattctttacaccgccggaaaagtgcgacaccttattgtgtgatattggagagagtagcccaaacccgactatagaggaaggacgaacactgcgagttttaaaaatggtagaaccatggttacgtggaaatcaattttgcataaagattctgaatccgtacatgccatcagtagtggaaacattagaacagatgcagagaaaacacggcggaatgcttgtaagaaacccactaagcagaaattcaacccatgaaatgtattgggtctcttgtggaacaggtaacatcgtgagcgcagtaaacatgacttcaagaatgctactgaatagatttaccatggcacatagaaaacccacttatgaaagagacgtagatctcggagcggggacaagacacgttgccgtggaacccgaagttgcaaacttagatataataggccagagaatcgagaatatcaaacatgaacataaatcaacctggcattatgacgaagacaatccatacaaaacgtgggcataccatggctcatatgaagtaaaaccatcgggatcggcaagtagcatggtaaacggagttgttaaactactaacaaagccctgggatgtaattcctatggtaactcagatagcgatgacggatacaacaccgtttggacagcaaagggtatttaaggaaaaagttgatacccgaacgcccaaagccaaaagaggaaccgcgcaaataatggaggtaacagcgcggtggctctgggggttcctttctcgtaataagaaaccacgaatttgtacacgagaagagttcacgagaaaagttcgatcaaatgcggccataggggctgtcttcgtagatgagaaccaatggaactcagcaaaagaagcagtagaggacgaaaggttttgggatttggtacaaaaagaacgtgagctacataaacaaggcaaatgcgcaacttgcgtatacaatatgatgggtaaaagagagaagaaactcggagaatttggaaaagcgaaaggctctagagcaatctggtatatgtggttaggagcaagatttctggagtttgaggcactgggattcatgaatgaggaccactggtttagtcgcgaaaacagcttatccggagtagaaggtgaaggactacataaactcggttatatactcagagacataagtaagattcctggaggtaatatgtatgccgacgatactgccggttgggatacgagaatcacagaagacgatcttcaaaatgaagctaaaataactgacataatggaacccgaacatgcattattagccacttcgatattcaagctcacatatcaaaacaaggtggttagagtccagcgaccagcaaagaacggaaccgtaatggacgtaatctcacggagagaccagagaggctcagggcaagttggaacttatggtctaaacacatttaccaatatggaagctcaattgatccgacaaatggaaagcgagggaatctttctaccatctgaattagaaacacccaatttagcggaacgtgtgttagattggttggaaaaatatggggttgagcgattgaaacgaatggcaatctcaggtgatgattgtgttgtaaagcctatagatgacagattcgctacagcacttacagctttaaacgatatgggcaaagtacgaaaggatattccacaatgggaaccttcaaagggctggaacgattggcaacaagtaccattctgttcacatcatttccatcaactaataatgaaagatggacgagaaatagtcgtgccctgcagaaatcaagacgaactggtaggacgagcaagagtatctcaaggagccggttggagcttaagggaaactgcctgcctgggaaagagctacgcacaaatgtggcaactcatgtacttccaccgtcgagacctgcgacttgcagccaatgctatttgttctgccgtacccgtagactgggtgccaacttcacgaaccacatggtctattcacgcacatcatcaatggatgactacagaagatatgttgagtgtatggaatcgagtatggatagaggaaaacccttggatggaagacaagacacatgtcagctcatggggagatgtaccttatctcgggaagagagaggaccaatggtgtggttcacttataggtcttaccgcacgagccacatgggcatctaatattcaggtggcaattaaccaagtaaggcgcttaatagggaatgaaaactatttagactatatgacttctatgaagagatttaaaaatgaaggagatccagaaggtgcgctatggtaa

SEQ ID NO: 21695 - RNA, 9879 nt, synthetic construct
  misc_feature 1..9879: note = derived and/or modified CDS sequence (opt6) from DENV-1__FJ882551__SS-prME
  source 1..9879: mol_type = other RNA
agcgttacaatgctgttgatgctcatgcctactgcgttggctttccacttgacaacgagaggaggagaaccacacatgatagtttcaaaacaagaacgcggaaaatcattgcttttcaaaacaagtgcaggagtaaatatgtgtacattaatagcaatggatttaggcgaattttgtgaagacaccatgacatataaatgcccacgaataactgaagcagaacctgatgacgttgactgttggtgcaacgcgactgatacatgggtgacatacggcacgtgtagtcaaactggtgaacatcgtagagataaacggtcagtagcactggctcctcacgtaggactggggctagaaacccgtactgaaacatggatgtcatcggaaggagcatggaaacaaatacaaagagtggaaacctgggcattaagacatcccggttttacagtaatagcattatttttggcacatgcgataggaacctcaattacgcaaaaaggaataatattcatactgcttatgctagtgaccccctcaatggcaatgaggtgcgtcggaatcggatcccgtgacttcgttgaaggattatcaggcgcaacttgggtcgatgtagtattagaacatggcagctgcgtcacaactatggccaaggataaaccaactcttgacatagaactgctaaaaacagaagtaaccaatccagcagtgttacgcaaattatgcatcgaagcaaagattagcaatactactacagactccaggtgtccgacacagggagaagcaaccctagtagaagaacaagatgcaaactttgtttgtaggcgaacttttgtagatagagggtggggtaacggatgcggattatttggcaaaggatccctaataacgtgtgcaaaattcaaatgcgttacaaaattagaaggaaagattgttcaatacgagaaccttaagtattcagtaatcgtgacagtacatactggtgaccaacatcaggtaggaaatgagagcactgaacatgggacgactgcaacaattactccacaagcacccagtacagaaattcaattaaccgattacggcgcactaacactggactgttctccaaggacaggtttagattttaatgaaatggtgctgttgactatgaaagagaaaagctggcttgtacataaacagtggtttttggacctacctctaccatggacatctggcgcatcaacaagccaagaaacgtggaaccgacaagatttattagtaaccttcaaaacagctcatgccaaaaagcaagaagtagttgttctcggctctcaggagggagcaatgcacacagctctcactggtgcgacagaaattcaaacgagtggtacaacaacgatatttgcgggccatcttaaatgtcgacttaagatggacaaacttactttaaagggtatgtcttacgtaatgtgcacaggatcgttcaaattggagaaggaagttgcagaaacccagcacggaacagtgttggtccaaataaaatacgaaggcactgatgcgccatgtaaaatacccttcagtactcaggacgaaaagggtgtaactcaaaatgggcgcctaataacggcaaatcccattgttacagacaaagaaaaacccgttaatatagaggcagagcctccatttggagaaagctacattgtaatcggtgcaggagaaaaagcattaaaattatcctggttcaagaaaggttcctcgataggtaaaatgtttgaagcgacagcaagaggagcccgacgaatggcaattttgggagataccgcctgggacttcggcagcatagggggtgtttttacttcagttggaaaattggtacatcagatatttggtactgcctacggcgtcttgttttcgggcgtgtcgtggacgatgaaaataggaataggcgtgcttctaacgtggcttggtctaaattcaagaagcacaagtctgtcaatgacatgtatcgcagtcggattagttacactttacttgggagttatggtacaagctgacagtggttgtgtcataaattggaaagggagagaactaaaatgtggctcaggtatttttgttacgaacgaagtacatacttggactgaacaatataaattccaagctgactctccaaaaaggctaagtgcagccattggtaaagcctgggaagaaggtgtgtgtgggatccgcagtgcgaccagactggagaatataatgtggaaacagatatccaatgagttaaatcacatactcttggagaatgatatgaagttaacagttgttgtgggggatgtagcaggaatactagcccaaggtaagaaaatgattagaccacaaccgatggaatacaaatattcatggaaaagctggggaaaggccaaaattataggggcagatgttcagaatactactttcattattgatggaccaaatacaccagaatgtccagatgaccaaagagcttggaacatttgggaagtagaagattatggttttggcatatttactacaaacatctggctgaaacttagagatagctacacccaagtatgtgatcatagactaatgtccgctgcaattaaagatagcaaggcagtacacgctgacatgggctattggatcgaatctgagaaaaatgagacatggaagctagctagggccagctttatcgaggtgaagacatgcatatggccaaaaagtcacacactgtggtcaaatggcgtcttagagagtgaaatgattatacccaaaatatatggcggaccaacttcacagcataactatagacccgggtacttcactcagacagcaggaccatggcacctaggtaaattggaacttgacttcgacttgtgtgaaggcacaacagttgtagtagacgaacattgtggtaaccgtggaccctcactaagaactacaacagtgaccggtaaaataatacatgaatggtgttgtaggtcttgtacattgccgcctcttagattcaaaggtgaggatggctgttggtacggtatggaaattagaccagtgaaagagaaagaagaaaatctggtcaagagtatggtaagtgcaggttcaggagaagtcgactcgtttagcctgggactattatgcataagcataatgattgaagaagttatgagatcaaggtggagccgaaagatgttgatgactggaactttagctgtattctttctgctaataataggccaactaacatggaacgaccttatccgcctatgtataatggttggtgctaacgcgtcggatagaatggggatgggtacaacgtatttggctttaatggctacctttaaaatgcgtccgatgtttgcagtgggtctgttatttcgacgtttaacttcaagagaagttctccttctcacgataggtctcagcttggtagcatcagtcgagttgccaaatagtttagaagaattaggggatggactagccatgggaatcatgatactaaaattgttaaccgactttcaaagtcaccaattatgggctacattactgtctctaacattcatcaggaccactttctcactacactatgcttggaaaacaatggcaatggtactaagcatagtcagcttgttccctttatgtttatcaaccacaagccagaaaactacttggttaccggtactcttaggttcgctcggttgcaagccgctgacaatgttcttaatagctgaaaataaaatatggggtcgtaagagttggccattaaatgaggggataatggccgtcggtatagtgtccatattattatcatcacttctaaagaacgacgtaccgttagcaggtccactaatagctggtgggatgttaatagcatgttacgtaatttcaggatcaagtgctgacttgtctctagaaaaagctgcagttgtctcatgggaagaggaagccgagcattcaggagcaagtcacaacatcttagtggaggtgcaagatgacggtacgatgaaaatcaaagacgaagaacgcgacgacactcttaccatacttctaaaagctactcttctcgcagtgagtggtgtgtatccattatcaatacccgctacattattcgtctggtacttctggcagaaaaagaaacaaagatcaggtgtattatgggacactccaagccctcctgaagttgaaagagcggtattagacgacggtatatatagaattatgcaaagaggcttactaggcagatcacaagtgggagttggtgtctttcaggaaaatgtatttcacacgatgtggcatgtaactcgcggagctgtactcatgtatcaggggaagaggcttgaacctagttgggcttcggttaagaaggatctaataagctacggaggcgggtggagattacaaggatcatggaacacaggcgaggaagtacaagttattgcagtggaaccaggcaaaaaccccaagaatgttcaaaccgcaccaggcacctttaaaaccagcgaaggagaagtgggcgctattgcattagacttcaaaccaggaacctcaggttccccaattgtaaatagagaaggaaagattgtgggcctatacggaaatggtgtcgtcacgacaagtggcacttacgtatctgcaatagcacaggcaaaagcatctcaggagggcccgctaccagaaatagaggatgaagtttttagaaaaaggaatttgactataatggatctgcaccctgggtcaggcaaaaccagacgttatttacctgcaatcgtgcgtgaggccatcaaaagaaaactaaggacgcttattttggcaccgaccagggtagttgcgtccgaaatggcagaagcattaaaaggaatgcctatacgctatcagaccacagcggtcaaatcagagcacactggaaaagagatagtagatcttatgtgccacgccacattcactatgagattactgtctccagttcgagttccaaactacaatatgataattatggacgaagcccactttaccgatccaagttcgatcgctgcacgaggatatatcagcactagagtcggcatgggagaagccgccgcaatattcatgacagcgacaccacctggtagtgtagaagcgtttccccaaagtaacgcagtgatacaggatgaagaaagagacattcctgaaagaagctggaactcaggatacgaatggattacagattttccaggcaaaactgtatggttcgttccatctattaagtcaggaaatgacatagcaaactgtttaagaaagaatggtaaaagagtaatacaattatctaggaagacattcgatacagagtatcaaaagaccaaaaacaacgattgggattatgtggtaacaacagatatatctgaaatgggagcgaactttagagctgatagagtaatagatccccgaaggtgtttaaaacccgtaattcttaaagacgggccggaaagagtaatcttagcaggtccaatgcctgtaacggtcgcgagtgccgctcaacggagaggaagaataggcagaaatcataacaaggaaggagatcaatacatatatatgggacaacctttaaacaatgacgaagatcacgcacactggacagaagcaaaaatgttactagataacatcaatacgccagagggcattatacctgctctctttgaaccagaaagggaaaaatctgcagctatcgatggcgaatataggctacgcggagaggcaagaaagactttcgttgaactgatgcggagaggagatctaccagtatggctatcccacaaagtcgcatcggaaggatttcaatatagtgaccgacgctggtgttttgacggtgagaggaataatcaagtgttggaagaaaatatggatgtggaaatttggactaaagaaggagaacgaaagaaacttagaccaaggtggctggatgcacgcacgtattccgatccgctagctttaagggaatttaaagaatttgccgcaggtaggagatctgtgtcaggcgatctaatacttgaaataggaaaactacctcaacacctgactcagagagcacaaaatgcactggataatcttgtgatgctgcataatagtgaacaaggtggccgcgcgtaccgtcacgccatggaagaactccctgatactatagagacattgatgttattagctctgatcgcagttctgacaggaggagtaaccttattcttcttatctggccgaggattaggcaaaacctcaattggcttactatgtgtcatggcaagctcagtgctactatggatggcgtcagttgaaccacactggattgccgcgagcattattctggagttcttcttaatggtactattaataccagaaccagatagacaacgtactccacaagacaatcaactcgcttacgttgtaatcgggttactattcatgattctcacagtagcagcaaacgaaatgggacttctagaaaccacaaagaaagatttaggtataggccatgttgcagttgagaatcaccatcatgcagctatgttagacgtagatttacatcctgcttctgcttggacgctatatgcagtcgctaccacaataataacgccaatgatgagacatacaatagaaaatacaacagcaaatatcagcttaaccgcaattgcgaaccaagctgcaattttaatgggattagacaagggatggcctataagcaagatggatataggagttccgcttcttgcgctcggttgttacagtcaggtaaatccattaactctaactgccgcagtactaatgctcgttgctcattatgctattatcggtccaggtctgcaggcaaaggctacgcgtgaggcgcagaaaaggacagcggcaggtataatgaaaaatccgacagttgatggaatagtggccatagatctagaccccgtcgtctacgacgccaaatttgaaaaacagttagggcaaatcatgttattaatattatgtaccagtcaaatcctcctaatgcgcaccacatgggcactctgcgaatcaattactctagctacaggaccgctgacaacactatgggaaggtagtcccgggaagttttggaacacaactatagctgtttcaatggctaacatatttaggggttcatatcttgcgggtgctggcttagcattctcattaatgaaatcactaggaggagggcgtcgtggcaccggagcccagggtgagactcttggtgaaaaatggaaacgacaactaaaccaattaagtaaaagcgagtttaacacttataagaggtcgggaattatggaggtagatagaagcgaggctaaagaagggctaaaacgcggagaaactaccaaacacgcagtttctcgagggactgccaaactccgctggtttgttgagcggaatctcgtcaaaccagaagggaaggtaatagatctaggatgtggtcgaggaggctggtcatactactgtgcagggcttaagaaagtaacggaagtgaaaggttacacaaaaggcggacccgggcatgaagaaccaattccaatggctacatatggatggaacctggtaaaattgcacagtggcaaagatgtcttctttatacctccagaaaaatgcgacacattactgtgtgatataggagaaagcagtccgaatcctactatagaggaaggacgcacattaagggtacttaaaatggttgagccatggttacgaggaaatcaattttgcatcaaaattttaaatccatatatgccaagtgtcgtagagacgttagaacaaatgcaacgtaaacacgggggaatgctagttcgaaatcctttaagtagaaattcaactcacgaaatgtattgggtttcatgcggtacaggaaacatagtctctgccgttaatatgacgagtcgtatgttgcttaaccggttcacaatggcacatagaaaaccgacttacgaacgtgatgtcgacctaggagctggaacaagacatgtagcggtagaaccagaggttgcaaacctagatatcataggtcagcgaattgaaaacataaaacaagaacataagagcacctggcattacgatgaagataacccatacaaaacatgggcttatcatgggtcttatgaagtaaaaccgtccggatccgcttcatcaatggtaaatggagtagttaaattacttaccaaaccttgggatgtcattcctatggttacacagattgctatgactgacactacaccgttcggccaacaaagagttttcaaggaaaaagtcgacactcgcacacccaaagcaaagaggggtacggcacaaataatggaggttacagcgaaatggttatggggcttccttagtcggaacaaaaagcctcgaatttgtactcgagaggaatttacccgtaaagtgagatctaatgcagcgataggtgcagttttcgtcgacgaaaatcaatggaacagtgcaaaggaagcggttgaggatgaacgcttctgggacttggtacatagagaacgcgagttacacaaacaagggaagtgtgcgacatgtgtgtacaacatgatgggcaaaagagagaagaaactaggggagttcggtaaagctaaaggttcaagggcgatttggtatatgtggctgggggcgaggtttctcgagttcgaagcgctagggttcatgaacgaggaccactggtttagccgagaaaattcgctatctggagtagaaggtgaaggcttacacaaactaggatatattcttcgagacatatcaaaaataccgggcggaaatatgtacgctgacgatacagcagggtgggatacccgtataaccgaagatgatctacaaaacgaggcaaaaataactgatataatggaaccggagcatgcattgttagccaaatcgatattcaaattaacctatcaaaataaagtcgttagagtgcaaagacctgccaaaaacggcaccgtgatggacgtgatttcaagaagagatcaaagaggatcaggtcaagtaggcacatacggattaaacacattcaccaacatggaagctcaattaatacgacaaatggaaagcgaaggtatcttttcgcctagtgaattagagacgcccaatctcgcaggtagagtattagattggctcaagaaacatggtgttgagagattgaaaaggatggcgatttcaggggacgattgcgtagtaaaaccaatagatgacagattcgcaacggcattaaccgctttgaatgatatgggtaaagttagaaaggatataccacaatgggaacctagcaaaggttggaatgattggcagcaagtgccattctgtagccaccattttcaccaattaataatgaaagacggccgtgaattggtagtcccatgtaggaatcaagatgaactcgtcgggagagcaagggtatctcaaggagcaggatggagcctccgagagacagcatgtctcggtaaatcgtacgcacagatgtggcaactcatgtattttcatcgacgagatttacgtctggcggcgaatgcgatttgcagtgcagttcccgtagattgggtaccgacaagtcgtacgacatggtcaatccatgcccatcatcaatggatgacaaccgaagacatgctgtccgtatggaacagagtttggatcgaagagaacccatggatggaagacaagacccatatcagttcctggggtgatgtaccatatctaggtaagagagaggatcaatggtgtggaagtttaattggattaacggcacgagctacttgggccacaaatatacaggtggcgattaatcaagtacgtagacttttaggtaatgaaaactatttagattatatgacatctatgaaacgattcaaaaatgaatccgatcctgaaggagctttgtggtaa

SEQ ID NO: 21696 - RNA, 9879 nt, synthetic construct
  misc_feature 1..9879: note = derived and/or modified CDS sequence (opt6) from DENV-1__FJ882552__SS-prME
  source 1..9879: mol_type = other RNA
tcagtcacaatgctactcatgctcatgccaacggcacttgcatttcacttgacaacgcgagggggagaaccacatatgattgtatctaaacaggaacgaggaaaatctttattattcaaaacgtcagctggagtgaatatgtgcacactaatagccatggatctaggggaattttgtgaagataccatgacatacaaatgcccaaggataaccgaggctgaacctgatgacgtcgactgttggtgcaatgcgacggacacatgggtgacatatggaacctgttctcaaacaggtgaacacagaagggacaaaagaagtgtagcactggcaccccatgtaggtctgggactagaaacaagaaccgaaacctggatgagctcagaaggtgcatggaaacaaatccagagagtagaaacatgggccttgcgtcatccaggttttacagtgatcgcccttttcttagcgcacgctattggaacatcgataactcagaaagggatcattttcattcttcttatgcttgtcacaccaagcatggcgatgagatgcgtcggaattggatctcgagactttgtcgaaggcttaagcggtgcgacatgggtagatgtggttcttgaacatggatcttgtgtcacgactatggctaaagacaaacctacactagatattgaactactcaaaacagaagttacaaatcctgcagtattgaggaaactctgtatagaggcaaaaatttcaaatacaacaactgactcaagatgtccaacccaaggtgaggctactctcgttgaagaacaagacgctaatttcgtgtgcagacgtacctttgtggatagggggtgggggaatggatgtggattattcggcaaaggatctttaattacatgtgccaaattcaaatgtgtgacgaaacttgaaggaaaaacagtccaatacgaaaatcttaaatatagcgtaatagtgacagtacatacaggcgatcaacatcaggtaggaaatgagtcaacagaacatggtacaactgctactataaccccacaagcacctagtacggagatacaattaaccgactatggcgcactaacattagattgctcccccagaaccggattagattttaacgagatggtgttactaacaatgaaagagaaaagttggctcgttcataaacaatggtttctggacctaccgcttccatggacgtctggtgcgtctaccagtcaagaaacatggaataggaaagatctcttagtaacgtttaagacagcacacgccaagaaacaggaggtcgtggttctaggaagtcaagagggggctatgcatacagcattgactggtgcaacggaaatacagacaagtggtacgactaccatttttgctggtcacttaaaatgtagactaaaaatggacaaactgacgcttaagggaatgagctatgttatgtgcacaggatcatttaaattagagaaagaagtagcagaaacacaacacgggaccgtgcttgtacaaattaagtatgaagggaccgatgcgccatgcaaaatcccttttagtactcaagacgaaaagggggtcacgcaaaatggaagattaataacagcgaaccctatagtaaccgacaaagaaaaaccagtaaacattgaagccgaaccaccattcggagagagctacattgttataggagcaggagaaaaagctctgaaattgtcttggttcaagaaaggatctagtataggaaaaatgtttgaagctacggctcgaggcgccaggcgcatggctatcctaggagataccgcatgggattttggttctattgggggagtcttcacttcagtaggaaagttagtgcatcaaatatttggtacagcgtatggagttttgtttagtggggtgagctggaccatgaagattggcattggagttctactcacctggctcgggttaaatagtcgctctacatcactatccatgacatgtatagcagttggcctagtgacgctatatttaggagttatggtacaagcagattcaggatgtgtcatcaactggaaaggacgagaactcaaatgtgggtctgggatattcgttacaaacgaagtacatacgtggactgaacaatacaagtttcaagccgatagcccaaagcggttatctgcagcaattgggaaggcgtgggaggaaggcgtttgcggaataaggtctgcgacacgcctagaaaatattatgtggaaacaaatcagcaatgaactaaatcatatattactagaaaatgatatgaagtttaccgtagtggtaggggacgtagctggaatactcgcgcaaggcaagaaaatgatccgaccgcaaccgatggagtataaatattcatggaaaagctgggggaaagcaaaaataattggtgcggatgtgcaaaacacaacgtttataatcgacggacctaatacaccagaatgtcccgacgaccaaagagcatggaatatatgggaagttgaagattatggttttggaatctttacaacaaatatatggttgaaacttcgagattcctatacccaggtatgtgaccatcgcctaatgtctgcagctatcaaagatagtaaggcagtccacgcggacatgggatactggattgagtccgagaaaaatgagacatggaaattggcccgtgctagctttattgaagtaaagacatgtatatggcctaagagtcacacattgtggagtaacggggtattagaaagcgaaatgattataccgaagatatatggcggtccaatcagtcaacataattatagaccaggctattttacacagactgcaggaccgtggcacttgggtaaacttgaactggacttcgatctatgcgaaggaactaccgtggtcgtcgacgaacactgtgggaacagagggccctcattgcgcacaacaaccgtcacgggaaagatcattcatgaatggtgttgccgttcttgtactttaccacctttaaggtttaaaggtgaagatggatgttggtatggtatggagattagacccgtaaaagagaaagaagaaaatcttgtaaagtcaatggtttcagccggctctggtgaagtggacagcttttccttagggcttctatgcataagcataatgattgaagaagtaatgcgtagtcgatggagcaggaaaatgcttatgactggaactctagccgtgttctttctacttataatgggtcaattaacttggaatgatctcattagactgtgtataatggtgggcgcaaatgcaagcgatcgaatgggaatgggcaccacctatctagccctgatggccacattcaaaatgcgtcctatgtttgcagtaggtcttttatttagaaggttaacctcgagagaagtacttcttctaaccatagggttaagtctagttgcgtcggtagaattaccaaactcattagaagagttaggtgacggattagctatgggaataatgatacttaaactactcacggacttccagtcacaccaactctgggcgacactgctcagcttaacattcattaagactacatcatccctacattatgcgtggaaaacaatggcgatggttctaagtatagtctcactcttcccgctatgcttatccacaacatcacaaaagacaacctggctgcccgtcctcctaggaagcctcggatgcaaaccattaacaatgtttctaatagctgaaaacaaaatatggggcaggaaatcctggccattgaatgaaggaattatggcagtaggaatcgtaagtatattactgtcctcactgctcaagaatgacgtaccattagcaggccctttaatcgcgggcggaatgctaatagcgtgctatgtgataagcggtagtagcgctgatctttcactcgagaaagctgcagaagtatcttgggaggaagaagccgaacattcaggagcaagtcataatattttagtagaggtccaagacgacggaaccatgaagatcaaagacgaagaacgagatgatacactaactatactattgaaagcgacgttactcgctgtatcaggcgtctatcctttgtcaattcccgcgactctcttcgtatggtatttttggcagaagaagaaacaacgtagtggtgtactctgggatacgccgtccccacccgaagtagaaagggcggtcctagacgatggaatatatcggattatgcaaagaggcctactaggaaggtctcaagtaggggtaggagtgttccaagaaaatgtttttcacacgatgtggcatgtgacgagaggagctgtattaatgtaccaagggaaaagattagaaccaagttgggctagcgtcaagaaggacttaatcagttatgggggtgggtggagactccagggtagttggaacacaggggaagaggtacaagtaattgcggtcgaacccggtaagaatccgaaaaacgtgcagacagcgcccggtacatttaaaacgtcagaaggcgaggtgggagccatcgcgctcgacttcaaaccgggcacaagcggctcgccaatagtgaatagagaaggaaaaatcgttggattatatggtaatggcgtagtaaccacatcaggaacgtacgtttcagcgatagctcaggcaaaagcatcacaggaaggtcctttacctgaaatcgaagacgaagtgtttagaaaacgaaacctaactataatggatttacatccagggtcaggaaaaacaagacgatacctgcccgcaatcgtccgagaagccataaaaaggaagctcagaacattaattctcgcccctactagggtggttgcatccgaaatggcagaagctctaaagggtatgccaatcagataccaaaccacagctgtaaaatccgaacatacaggtaaagaaatagttgatttaatgtgtcatgcaaccttcacaatgcgcttactatcaccagtcagagtacccaactataatatgattataatggacgaagcacattttacagacccttcaagtattgcagcacgaggatacattagtactcgagttggcatgggagaagctgcagcgatattcatgacagctacacctccaggatctgttgaggcatttccccaaagcaacgcagtcatacaagatgaggaaagggatataccggaaagaagttggaactcagggtatgaatggataacagactttcccgggaagactgtctggtttgtccccagtataaaatccggaaatgacatagccaactgtttaaggaaaaatggtaaaagagtcatccaactatctcggaaaacatttgataccgaatatcagaaaaccaagaataatgattgggactatgttgtaacaactgatataagcgagatgggagctaatttccgggctgatcgggtaatagaccctagacgatgtctcaaacctgtaatattgaaagatggtcctgaaagggttatactagctggaccaatgcccgtaaccgtcgcatcagctgctcaaagaagggggcgaatcgggagaaatcataataaagaaggtgaccagtacatatatatgggacaacctttaaataacgatgaagatcatgcacattggacagaagcaaagatgttgttagacaatataaacaccccagagggtattattccagcactttttgaacctgaacgggagaaaagtgcagcaattgacggcgaataccgattacgaggtgaggcacgaaaaaccttcgtagaattaatgagaagaggcgacttgccagtctggttgagttacaaagttgcttctgaaggatttcaatactcagacaggcgatggtgcttcgacggggaaagaaataaccaagtattagaagaaaatatggacgttgaaatttggacaaaagaaggagaacgaaagaaactcagaccacgctggttagatgcaagaacgtacagcgacccattagcgctaagagaatttaaagagttcgcggcaggcagaagatcagtaagtggagacctgatattagaaatcggaaagctgccccaacatcttacccaaagagcacaaaatgctttagataacctagtaatgctgcataacagtgaacagggtggtagagcctatcgacatgccatggaagaacttccggacacaattgaaactctgatgttactggcattaatagcagtgttaacagggggagtaaccctattctttttatcgggaagagggctcggcaagacttcaattggtcttttatgcgtcatggcgtcatcagttttactctggatggcatccgtggaacctcactggatagcagcaagcataatacttgagttctttctaatggtgctacttataccagagcctgacagacaaagaactccacaggataatcagctcgcctatgtagtcatcggcttattattcatgatattaacagtcgcagctaacgaaatgggcttactagaaacaaccaagaaagatctaggaataggacatgtcgcagtagaaaaccatcaccatgcggcaatgttagacgtagatttacaccccgcatcagcatggactttgtacgctgtagccacaaccataataacaccgatgatgagacatactatagaaaatactacagcgaacatctctttaacagcaattgcaaatcaggctgctatattaatgggactcgataagggatggccaataagtaaaatggatatcggtgtgccacttttagcccttggatgttatagccaagtaaatccactaaccttaactgcagctgttctaatgctggtagcacattatgctataattgggcccggattgcaagcaaaggcaacccgtgaagcccaaaaacgaacagcagccggtataatgaagaatcctacagtagatggaatcgttgcaatagacctcgatcctgtggtctacgacgccaaatttgaaaaacaactcggtcagataatgttactgatattatgtacgagtcaaattttgctaatgagaacaacgtgggcactatgcgaatcaataacattggcaacgggacctttgaccacactttgggaaggaagtcctggaaaattctggaacacgacgatagctgtgagtatggctaacattttcagaggatcgtacttagccggtgctggattggcattctccctaatgaaaagtttgggcggtggacggagaggaactggcgcacaaggtgagacgctaggagagaaatggaaaagacaattaaatcaattgagtaaatccgagttcaacacatacaaacgatctggtataatggaagtagatagaagcgaagccaaggagggccttaaaaggggagagactacgaaccacgccgtctctagagggacagcaaaactcagatggttcgtggaaagaaacttggtaaaacctgagggtaaggtaattgatcttggatgtgggaggggtggatggtcttattattgtgcaggtctcaaaaaggtcacagaagtgaaaggttacaccaaaggcggacccggtcatgaagaaccaataccaatggcgacatatggatggaatttagtaaagttacactccggcaaggatgtgtttttcatccctccagaaaaatgtgatactctattatgtgatatcggtgagagttcaccaaatcctactatagaagaaggaagaacattaagagttttaaaaatggttgaaccatggctgcgcggaaatcagttttgtataaaaatactcaatccgtatatgccctctgtagtggaaacattagagcaaatgcaaagaaagcatggtggcatgttagtgcgcaaccctctctcccgtaactcgacacacgaaatgtattgggttagctgtgggactggaaacattgttagcgcagttaatatgacgtcgcgaatgttattaaataggtttacaatggcgcatagaaaacccacatatgaacgagatgttgatcttggtgccgggacgaggcacgtggcggtagaaccagaagttgcaaatttagatataataggacaacgcattgaaaacattaaacatgaacacaagagtacatggcattacgatgaagataatccgtacaaaacatgggcttatcatggttcatacgaagtcaagccttcaggatcagcgtcatcgatggtgaatggagtagtgaagctgctaacaaagccctgggacgtaatacctatggtaactcagatcgcgatgaccgacacaacaccttttggacaacagagggtttttaaagaaaaggtagatacgagaacgcccaaagcaaaaagaggcacagcccaaataatggaagtgaccgccaaatggttatggggatttttatctagaaacaagaaaccgagaatatgtactcgagaggagttcacccggaaagtaagaagtaacgcagcaataggagctgtatttgtggacgaaaaccagtggaactctgctaaagaggctgttgaagatgaaagattctgggacttagttcaccgagaacgcgaactgcataagcagggaaaatgtgctacttgcgtttacaatatgatgggaaaaagggagaagaaactaggtgaatttggaaaagccaagggttctagagcaatatggtatatgtggctgggtgctcgcttcctcgaatttgaagcgctagggttcatgaacgaagaccattggtttagtagagagaactcactcagcggtgttgagggggaaggcctacacaaacttggttacatactacgagatatatcgaaaattccaggtggtaacatgtatgcagacgataccgcgggctgggatacccgtataactgaagacgacctccagaatgaagccaagataactgatatcatggagcccgagcacgcgctattagctaaatcaatctttaaactaacctatcaaaacaaggttgtgagagtacaacgaccggccaaaaatggaacagtaatggacgttataagtagacgagatcaacgtggatcaggtcaagtaggtacgtatgggcttaatacttttacaaatatggaagcccaactaattcgccaaatggaatcagaaggaatattttcaccttcagagttagaaactccgaatttagctaggagagtattagattggttggaaaaacatggtgtcgaaagacttaaaaggatggcaatctctggggatgattgcgtggtcaaacctatcgacgatcggtttgcgacagctttaacggcactcaatgatatgggtaaagtacgtaaagacataccgcaatgggaaccctcaaagggatggaacgattggcagcaagtacctttctgctcacaccattttcatcaattaattatgaaagatggccgtgagatagtcgtaccatgtaggaatcaagatgagctagtcggaagggcacgcgtttcacaaggtgcaggatggtctctacgcgaaacagcatgcctgggtaaatcctatgcacaaatgtggcaacttatgtacttccacagacgtgacttacggcttgccgcaaatgcaatttgttctgccgtccctgtagattgggtaccgacttcgagaacaacgtggagcatacacgcacatcatcagtggatgaccacagaagacatgttaagtgtttggaatagagtatggatagaggaaaatccctggatggaagataagacacacattagttcttggggagacgtaccatatcttggcaagagagaggatcaatggtgcggatctttgatagggctaactgcacgcgcgacatgggctaccaacatacaggtggctataaatcaggtgagacggttaatagggaatgagaattatttagattacatgacctctatgaaaagatttaagaacgaatcggatccggagggagcactgtggtaa

SEQ ID NO: 21697 - RNA, 9879 nt, synthetic construct
  misc_feature 1..9879: note = derived and/or modified CDS sequence (opt6) from DENV-1__FJ882553__SS-prME
  source 1..9879: mol_type = other RNA
tctgtaacgatgttattaatgttgatgccaactgcactcgcttttcacctaacaaccaggggcggagaaccacacatgattgtatctaaacaagaacgtgggaaatccttgttatttaaaaccagcgccggagtaaatatgtgtacactaatcgcaatggacttgggcgaattatgcgaagatacaatgacctacaaatgtccgagaattacagaaacagaacccgatgatgttgattgctggtgcaatgcaaccgatacgtgggtaacgtacggaacctgtagtcaaactggcgagcaccgtcgagacaaaagaagcgttgccttagcaccacatgttggactaggactagaaactagaactgaaacatggatgtcaagtgaaggtgcttggaaacaaattcaaagagtggaaacctgggctttacgacacccaggttttacagttatagcacttttcttggcacatgccataggtacttctataacgcagaaaggtataatctttatattacttatgttagtaactccttcgatggcaatgcgttgtgtaggtattggttcacgagatttcgtagagggactgtcaggcgcaacttgggttgacgtagtactagaacatgggtcttgcgtgacaaccatggccaaagataaacccacacttgatattgagttattgaaaacggaagttaccaacccggctgttcttagaaaactatgtattgaagcgaaaataagcaatacaacaaccgacagcagatgtccaacacaaggagaagcaacgctagttgaagaacaagacgcaaattttgtttgtcgaagaacgtttgtagatcgaggttggggcaatgggtgtgggttattcggcaaaggatcactaattacatgcgcgaaatttaagtgtgttaccaaattagagggaaagatcgtacaatacgaaaacctgaaatactcagttatcgtaacggtacatacaggagatcaacaccaagtcggaaatgaatccacagagcatggaactaccgctactataacacctcaagcccctacgactgaaattcagttgacggactacggcgctctcactttagattgttcgcctagaacgggactcgacttcaatgaaatggtcttgttaacaatgaaggagaaatcctggttagtacataaacagtggtttttagacctcccgctaccatggacatcgggtgcatcaacatcgcaggagacatggaatcgtcaagatttactggttacgtttaaaactgcacatgctaagaaacaagaagtcgtagttttaggttcacaagagggagctatgcatacagcccttacaggcgccacagaaatccaaacatcgggaaccacaacgatatttgcaggacacctcaaatgtcgcttaaaaatggacaaattgactttaaaaggtatgtcttatgttatgtgtactggcagctttaaattggaaaaagaagtcgcagaaactcaacatggtacggtgcttgttcaaataaagtatgaagggaccgatgccccatgcaaaatacccttttctacacaggacgagaagggagtcactcaaaacggcagattaattacagccaacccgatagttacagataaggagaaacctgtgaacattgaggcagagcctccgtttggtgaaagctatatagtcatcggagcaggagagaaagcacttaaattaagttggttcagaaaagggtcgagcatcggtaaaatgtttgaagccacagcgcggggtgcacgcaggatggctatactcggtgatacagcctgggatttcggaagtataggaggagtatttacatccgtaggtaagctagtccatcagattttcggaacggcctacggtgtcttattttccggtgtaagctggacaatgaaaatcggtatcggagttttgcttacgtggcttggcctaaatagtagaagcacttcgctttctatgacttgtattgctgttggccttgtgacactatatttaggtgtaatggtacaggctgactcaggttgcgtgataaattggaaagggcgagaactcaaatgcggtagtggaatatttgtaactaacgaagttcacacttggactgagcaatacaaatttcaagcagacagtcccaaacgattgtcggccgccataggtaaagcatgggaagagggagtctgcggcatccgttctgctacacggctagaaaatataatgtggaaacaaatatctaacgagctaaatcacatattactggagaatgatatgaagttcacagttgtagtaggtgatgttgcaggtatcctagctcaaggtaagaaaatgatacgaccacaacccatggaatataaatatagttggaaatcttggggcaaagctaaaataataggagccgacgtgcaaaataccacatttatcattgatggacctaacacgccagaatgtccggacgaccaacgagcatggaatatttgggaagtagaggactatgggttcggcattttcactaccaatatatggctaaaacttagggattcatacacccaagtttgcgaccatagacttatgtcagcagccattaaagactcaaaagcagtccacgccgatatgggctattggattgagtcagaaaagaatgaaacgtggaaacttgcaagggcctcgtttatcgaagtcaaaacgtgcatctggcccaaatcacacacactctggtcaaatggcgtcttggaaagtgagatgataatccccaagatatacggagggcctatatcccaacataattatagacccggttacttcactcaaacggcaggcccatggcacttgggtaagctagaattagatttcgacctatgcgaaggaacaaccgttgtcgtagacgaacactgtggtaatcgtggaccaagcctccgaactacgactgtcacgggaaaaataatccacgaatggtgctgtagaagttgcacactccctcctttaagatttagaggtgaggatgggtgctggtatggtatggagattcgaccagtaaaagaaaaagaagaaaacctcgtgaaaagtatggtatcggcaggtagtggagaagtcgactccttttctttagggctactttgcatttcaataatgatagaagaagtaatgagatcgcgttggtctagaaagatgctaatgacaggtacgttagctgtattctttctattaattatgggacagttaacatggaatgacctaatccgtttatgcatcatggttggggcaaacgcatcagatcgtatgggcatgggtactacatatttagccctgatggccacttttaaaatgagacctatgtttgcggtaggattgttgtttagaaggttgacttcacgtgaagtgcttttactaacaattggactttctctagttgcaagtgtagaactccctaattccctggaagaactaggggacggattagccatgggaattatgatcctaaaattacttaccgattttcaatcgcatcagctatgggcaacattactctccctgactttcattaaaacgacgtttagccttcattacgcatggaaaactatggcaatggttttgagcatagtttccctatttcctctctgtttatcaaccacgtcacagaaaacgacatggctacccgtactcctaggcagtctcgggtgtaaaccgcttactatgtttttaattgcagaaaacaagatttgggggagacgttcctggccattaaatgaagggattatggcagtaggcatcgtttctatacttttatcatctctccttaaaaacgatgtcccattagcaggtcctcttattgcgggtggaatgttgattgcgtgttacgtaatatcaggaagttccgcagatctgagtttggaaaaagcggcagaagtgagttgggaagaagaagcagaacatagtggagcatcacacaatattttggtagaagttcaagacgacggtacaatgaaaattaaggatgaggaacgggatgacacgctaactatcctactaaaggcaacactcctggctgtcagcggcgtataccccctcagtataccggccacactgtttgtatggtatttctggcagaagaagaaacaacgaagcggtgtattatgggacacaccaagcccaccagaagttgagcgagcagtcctggatgatggaatatatcggataatgcaaagaggattattgggtaggagtcaagtaggtgttggagtttttcaagaaaatgtttttcacactatgtggcatgttactcgaggagctgtgttaatgtatcagggaaaacgactcgaaccaagttgggcatccgttaaaaaggacttgatctcttatggtggaggatggagactacaaggttcctggaatacaggcgaagaagtgcaagtgatagctgttgagccgggcaaaaaccccaaaaacgtccaaacagcgccaggaacgttcaaaacgcccgagggtgaagtaggtgctattgctctcgacttcaagccgggaacatccgggtccccgatagtaaatcgtgaagggaaaatagtcggactttatggtaacggggttgtaacaacatcaggtacatacgtaagcgccatagcacaggcaaaagcaagtcaggaaggaccgctccctgaaatagaagatgaagtctttaggaaacgtaacttgacaataatggatttacaccctggatctgggaaaacgaggagatacctacctgcaattgtaagagaagcaattaaaagaaagctacgtacactgatcttagccccgacccgcgtagtagcatcagaaatggcagaggctctaaaaggaatgcccattagataccaaacaactgccgtcaaatccgaacacacaggcaaagaaattgtggacctgatgtgtcatgcaacttttacaatgcgactactctcaccggtgcgagtgcctaactacaacatgataataatggacgaggcacatttcaccgatccatccagtattgcagccagaggttatatatccacgagagttggtatgggggaggcagccgcaatcttcatgacagcaacaccaccaggatcagtcgaggcttttccacagtctaacgctgtaattcaggacgaagaaagagatattccagagaggagttggaatagcggatacgaatggatcacggattttcctggtaaaaccgtatggtttgtacctagtataaagtctggaaatgatatagcaaactgtttaagaaagaatggaaaaagggtgattcagctttctaggaaaacttttgatacggaatatcagaaaaccaaaaataatgattgggattatgtcgtcacaacggacataagcgaaatgggagccaactttcgtgccgatagagttatagacccgcgaaggtgtttgaaacccgtaatacttaaagacgggcctgaaagggtgatattagcaggacctatgcctgtcacagttgcgtcagccgcacaaagaagaggtcgcataggccgaaaccacaacaaagagggtgatcagtatatatacatggggcaaccactgaataacgacgaagatcatgcacattggactgaagcaaaaatgctgttagataacatcaacacgccggaaggtattattcctgcactatttgagcctgaaagagagaaaagtgctgctatagacggagaatacagattacggggagaagctagaaaaacattcgtagaacttatgagacgcggagacctgcccgtatggctaagttataaggttgctagtgaaggatttcaatattctgatagaaggtggtgcttcgatggcgaacgcaataatcaagttttggaggaaaatatggacgtagagatctggacgaaagaaggcgaacgaaagaaacttagacctcgatggctcgatgccaggacctacagtgatccgcttgccttaagggagtttaaagaatttgcagcaggacgacgttcagtctcaggagacttaatccttgagatcggcaaattgccacaacaccttacacaaagagcccaaaatgcacttgataatcttgtcatgctgcacaattcagaacaaggaggacgtgcatatcgacacgctatggaagaactaccagacactattgagacgttaatgctgctagccctcattgcagtactgactggaggggtaaccctattctttctatcgggacgaggcctaggtaagacaagtatagggctcctatgcgttatggcaagcagcgtcctactttggatggctagtgttgaaccgcattggattgcagcgtcaataattttagagttctttctgatggtattactaattcccgaacctgataggcaacgcacaccccaagataatcaattggcatacgtagtaataggactccttttcatgatactaacagtagcagctaatgaaatgggtttattagaaacaacaaagaaagacctaggaataggtcacgtagcagttgaaaatcatcatcatgctgctatgctagacgtagatttgcaccccgcatcagcatggacattatatgcagtcgcaacgacaattataactccaatgatgagacacacaatagaaaatactaccgccaatatctcactcacagccattgctaatcaagccgcaatcttaatgggattagataaaggatggcctataagcaaaatggacatcggggtaccgctattggctcttggttgctactcacaagtaaacccactcacattaactgcagccgtactaatgttggtcgcacactatgcaatcatcggaccaggactccaagccaaagctactagagaagcccaaaaacgaacggccgcagggattatgaagaatcctactgtagatggcatagttgctatagacttagacccagtggtatatgacgcaaagtttgaaaaacagcttggacagataatgttactaatactatgtacttcacaaattctgttaatgagaaccacatgggccctatgcgaatctattacactggcaacaggaccactcacgacactatgggagggcagcccaggaaagttttggaatacaactatagcagtttcaatggcaaacattttcaggggatcataccttgctggagcgggtttggcattttcattaatgaaatctttaggtggaggcaggcgcggtacgggagctcagggcgaaactctaggtgaaaagtggaaacgccaacttaatcaattgagcaaaagtgaatttaatacgtacaagaggtctggaattatggaagtagatcgaagcgaagcaaaagaagggttgaaacgtggcgaaactactaaacatgctgtcagtcgtggaacagcgaaattacgatggttcgtggagcgcaatctcgtgaaacctgaaggcaaagttattgatctggggtgtgggagagggggttggagttactattgcgcaggattgaaaaaggtgacggaagtaaaaggatacacaaaaggaggaccaggtcacgaagaaccaatcccgatggcaacatatggatggaatcttgtaaagttacactccggcaaggacgtgttctttattccaccagaaaaatgtgatacccttctctgcgatataggagaatctagtccaaaccctacaattgaagaaggtcgtacgctcagggtattaaaaatggtagaaccatggttaagaggaaatcaattctgtattaaaatattgaatccctacatgccatccgttgtagaaactctggaacaaatgcaacgcaagcacgggggcatgctagtaaggaatcccctgtctcgtaattcaacgcacgagatgtactgggtttcttgcggaactgggaacattgtctctgcagtcaatatgacatctcgaatgctacttaacagattcacaatggcacaccgcaaaccaacatatgaacgtgatgtggatctaggagcagggacgaggcatgtcgctgtcgagccagaggtggctaatcttgacatcattggccaacggatagaaaacataaaacatgaacataaatcaacctggcattatgacgaagataatccttataagacctgggcctatcatggaagttacgaggtgaaaccatcgggatccgcaagctctatggttaacggtgttgtcaaattgttaacaaagccatgggacgttataccaatggtcacgcagatcgcaatgacggacacaacaccctttggtcaacaaagagtatttaaagaaaaagtagacaccagaacaccaaaagctaaaagaggtactgctcaaataatggaagttacagcaaagtggctttgggggttcttaagtaggaataagaaacctaggatttgtacacgagaggaatttactcggaaagtgcgatcaaatgccgctatcggagcagtttttgtggatgaaaatcaatggaactcagcaaaagaggctgtagaagacgaaagattctgggatttggtacaccgagaaagagaattacacaaacaagggaaatgtgcgacatgcgtatacaatatgatgggtaaaagagagaaaaagttaggcgaatttggaaaggcgaaaggaagccgcgcaatttggtatatgtggcttggggctcgatttctcgagttcgaagcattaggttttatgaatgaagatcattggttttccagagaaaacagtttgagtggagtagagggagaaggtttacataaactaggctatatattgcgagacatttcaaaaataccaggaggaaatatgtatgccgacgacacagccggatgggatacaagaatcacggaggacgacttacagaatgaagccagaattactgatataatggaaccagaacatgcgctcttagcaaaaagcatatttaaattaacttatcaaaacaaagtagtaagagtacagagaccggccaaaaatgggactgtcatggatgtaatttcccgccgggatcaacggggtagcggtcaagtaggaacatacggattaaatacatttactaacatggaagcccaattgataaggcaaatggagagtgaaggcatattctcaccatcagaacttgagacacctaacttggcggaaagggtattggattggttagaaaaatatggcgtagaaagacttaaacgaatggcaatatctggtgatgactgtgtggtaaagcccatagatgacagatttgcaacagcactcacagctctaaatgatatgggtaaggtccgtaaggatattccccaatgggaaccgagtaagggatggaatgattggcaacaagtgcccttttgtagccaccattttcatcagcttataatgaaagacggcagagagatagtagttccgtgtcgaaaccaagatgaactcgtcgggagagcacgtgtatctcagggtgctgggtggagtctaagagaaacggcctgccttgggaaatcatatgcacagatgtggcagttgatgtactttcacagaagagatctaagattagcagccaacgcaatatgcagtgctgtgccagtagattggattccgacgagtcgtacaacatggtccattcatgcacatcatcaatggatgacgaccgaagacatgctttctgtatggaatcgggtatggattgaggagaacccatggatggaagataaaacacatatctcgtcatggggagacgtgccttatttgggcaaacgcgaagatcaatggtgtggcagtttaataggtttgacagctagagcaacgtgggcaactaatatacaagtagcaataaatcaagtccggaggttaattggcaatgaaaattacttagactatatgacatcaatgaaacggtttaaaaatgaatcagaaccagaaggtgcactatggtaa

SEQ ID NO: 21698 - RNA, 9879 nt, synthetic construct
  misc_feature 1..9879: note = derived and/or modified CDS sequence (opt6) from DENV-1__FJ882554__SS-prME
  source 1..9879: mol_type = other RNA
tcagttacaatgttgctaatgttaatgccgactgcactggcttttcatctaactacgagagggggcgaaccccacatgattgtaagcaaacaggaaagagggaaaagcctactgtttaaaacaagtgccggtgtcaatatgtgcacattgatagcaatggacttaggagaattatgtgaggacacaatgacatacaaatgtccacgtattactgagactgaaccagacgacgtagattgctggtgcaacgcaacggatacctgggttacatacggtacgtgcagccagacaggtgagcatcggagagacaaaagaagtgttgcacttgcaccacatgtaggtttaggactagaaacacgaacagaaacatggatgagtagtgaaggtgcatggaaacaaatacagcgagttgaaacatgggcacttagacaccctggttttacagtaattgccttattcttagctcacgctattgggacaagcataacgcaaaaagggataatatttatcctactaatgctagtgacaccatcgatggctatgaggtgtgtcggcatcggctcgagagatttcgttgagggattatccggagctacttgggtcgacgttgtcttagagcatgggtcatgcgtgaccaccatggcaaaagataaaccaacactcgatatcgaacttttaaaaaccgaagtcaccaaccccgctgttctacgcaaattatgtatagaagcaaaaatttctaataccacaaccgattctcgatgcccaactcagggtgaagccacgcttgttgaagaacaagacgctaactttgtttgtagacgcacattcgtagatcgagggtggggaaacgggtgcggactatttggtaaaggctcactaataacatgtgcaaaattcaaatgtgtcacaaaattagaaggtaaaatagttcaatatgaaaacctgaaatacagtgtaattgtgacggtacataccggagatcaacaccaggtggggaacgaaagtacagaacatggaacaacggccacaatcactccacaagcaccaaccaccgaaatccaactcacagattacggcgcactaacattagattgttccccaaggacgggactagatttcaacgagatggttttgcttacaatgaaggaaaaatcatggctagtacataagcaatggtttttagacttacccctcccatggacatctggagcaagtacatctcaagagacatggaatcgtcaagatctcttagtaactttcaaaactgcacatgctaagaaacaagaagttgttgtattaggatcacaggaaggagcaatgcatactgcactgaccggcgcaactgaaatacagaccagcggaaccacaaccatattcgctgggcatcttaaatgtaggttaaaaatggataaactcacattaaaggggatgtcatatgtaatgtgcacaggcagcttcaaattagaaaaagaggttgcagaaacccaacatgggacagtactggtacaaataaaatatgaaggaactgatgcaccatgtaaaataccattcttgacgcaagatgagaaaggagtgacacaaaacggtcgtctaataactgcaaaccctatagtaaccgacaaagaaaaaccagtgaatatcgaggccgagccaccatttggtgaaagttatatcgtaattggggccggcgaaaaagcacttaaactaagctggttcaagaaaggtagcagcataggcaagatgtttgaggcaacagcacgaggtgccagaaggatggcgatattaggtgatacagcttgggattttggatctataggtggggtttttactagcgtaggaaaactcgtacaccaaatttttggtacagcttatggagtgctcttttctggagtatcatggacaatgaagattggaattggagtattacttacctggctaggtctaaattcaagaagcacttccctgtctatgacatgtatcgcggtcggccttgtaactctttacttgggagtcatggtccaagcggactcaggatgtgtaataaattggaaaggtagggaactaaaatgtggttctggcatatttgtaaccaacgaggtccatacatggacagagcagtacaaatttcaggcggattccccaaaacgcttgtccgctgctatcggaaaagcatgggaagaaggagtgtgtggaataaggagtgcaacgagattggagaacataatgtggaaacagatttcaaacgaactcaaccatattctattagaaaacgacatgaaattcaccgtagtagttggtgatgtggccggtatcctagcacaaggtaagaaaatgattaggccacaacctatggaatacaagtactcatggaagtcgtggggtaaggcgaaaatcattggcgcagatgtccaaaatactacgtttataatagatggcccgaacaccccggaatgccctgacgatcagcgcgcgtggaacatttgggaagtcgaagattatggatttggcatctttacaacgaatatttggcttaaactacgagacagttatacacaagtatgtgaccaccgtcttatgtctgcagctataaaagattctaaagcggttcacgcagatatgggatactggatagaaagcgagaaaaatgaaacgtggaaactggcgcgggcatcctttatcgaggtgaaaacttgtatatggccaaaaagccatactttatggagtaatggagttctggaaagtgaaatgatcatacctaaaatatacggaggacctatttcccaacataattaccgaccgggatacttcacacaggcagctggcccatggcacttgggaaagttagaattggatttcgacttatgtgaaggaactacagtcgtcgtagacgagcattgcgggaacagaggaccaagccttcgaactacaacggttaccggtaaaataatacacgaatggtgttgtagatcatgcactttaccacctttacgattccgtggtgaagacgggtgctggtatggaatggaaattcgaccggtaaaagaaaaagaagagaatttagtcaaaagcatggtaagtgctggctctggagaagtcgactcattctcgttggggctactttgcatttctattatgatagaagaagttatgcgatccagatggtcgaggagaatgctgatgacagggacgctagcagtattctttcttcttattatgggacaattgacttggaacgatctcataagattgtgtataatggtgggggctaatgcttccgaccgaatgggaatgggaactacatatttggcacttatggccaccttcaaaatgcgacctatgttcgcggtaggactgctatttagaagattaacatcgagggaggtcttactcttaacaattgggctttcacttgtagcctcagtagaattaccaaattccctagaggaattaggcgacgggctcgctatgggcataatgattttaaaactactcacagatttccagtcacaccaactttgggctacactcctatctttgacatttataaaaactacatttagtcttcattatgcatggaaaacgatggccatggtgctcagcatcgtctcattgtttcccctttgtctcagcactacttcccaaaagacaacatggctgcccgtcctgcttggctcattaggctgtaaaccgctaacaatgtttcttatagcagaaaataagatttgggggagaagatcatggcccctcaacgaaggaataatggctgtgggaatagtatcaatactattgtcaagtctcctcaaaaatgatgtgccgttagcagggccactaatagccggaggaatgctaatagcttgttacgtgataagtggatctagtgcggatttatcacttgaaaaggctgcggaagtgtcatgggaagaggaagcagaacactcgggcgcatctcataacatcctggtcgaagttcaagacgacggcacaatgaaaataaaggatgaggagagggacgatacgttgactatcttactaaaagcgacattactagcagtatcaggagtatatccgttatcaatacctgcaacactcttcgtctggtatttttggcagaaaaagaaacagcgtagtggcgttttatgggatacaccttctccacccgaggttgaacgtgcagtattagatgatggaatatatcgaattatgcaacggggattactgggtcgatcacaagttggagtgggggtgttccaagaaaacgtatttcacacaatgtggcacgtcactcgaggagcagtactgatgtatcagggtaaacgtttagaaccaagttgggcatcagttaagaaagatctaataagctacggaggagggtggagattacaaggctcatggaatacaggggaagaggtgcaggtaattgcggttgaaccggggaaaaatcctaaaaatgtccagacggcgcctggaacatttaaaactcctgagggtgaagttggagcaatagccctagacttcaaaccaggaactagcggtagtcctattgttaatagggaaggtaaaatcgtagggctttacggcaatggtgtggttacgacgagcggaacatatgtgtcagcgatcgctcaagcaaaagccagccaagagggtccgttaccagagatcgaagatgaagtattccgaaaaagaaatttaactataatggacttgcatccaggtagcggtaaaaccaggcgatatttacctgctatagtcagagaggcgattaaaagaaaattgagaaccctgatattagcaccaactagggtggtagcaagcgaaatggcagaggctttaaaagggatgcctataagatatcaaacaacagcagtaaagtccgagcatacaggaaaagaaattgtagacttaatgtgccatgcgacgttcaccatgagattacttagccctgtgagggtaccaaactacaacatgataataatggatgaagcccattttaccgatccttatagcattgctgcacgcgggtacataagtactagggtcgggatgggcgaagcggcagcaatattcatgactgcaacccctcccggaagcgtggaggctttcccccaatcaaatgcagtaataaaggatgaagaaagagatatacccgaaaggtcctggaatagtggttatgagtggataaccgattttcctggcaaaacagtttggttcgttccatccatcaaaagtggaaatgatatagctaactgcttaaggaaaaatggcaaaagagtaattcagttaagtagaaagacttttgacactgaatatcagaaaaccaaaaataatgactgggattatgttgtaacgactgatataagcgaaatgggcgccaattttagagcggatagagttatagacccacgcagatgtctaaagccagtcatcctaaaagatggacctgaaagagtaatactagcaggacctatgccggttactgtcgcgtcagcggcacaaagaagaggcaggatcggcagaaatcacaacaaagaaggtgaccaatatatctacatgggacaacccttaaataacgacgaagatcatgcgcactggacagaagctaagatgttactagataatattaatacgccagaaggcataataccagcgttgtttgaacctgaaagggaaaagtctgcagctattgacggcgaatacagacttagaggagaggcacggaagactttcgttgaactaatgcgacgtggagatttacctgtatggctaagttataaggtagcttcagaaggttttcaatactcagatcggcgctggtgtttcgacggtgaaagaaataatcaggtactggaggaaaatatggatgttgaaatctggacgaaagagggcgaaaggaagaaattaagaccgaggtggttggatgcaaggacatatagtgatcctttagccctaagagaatttaaagaatttgctgcaggaaggagaagtgtatcaggggatctcattcttgagattggcaagttaccgcagcacttaacacaaagggcacagaatgctcttgacaatctggtaatgttgcacaattctgaacaaggagggagagcataccgacatgcgatggaggaattaccggacacaattgaaactttgatgctactagccttgattgcagtactgactggaggggtaacactattctttctatccgggagaggattaggcaaaacatcgataggattattatgtgtcatggcatccagtgtactgctttggatggcatcagtagaaccccattggatagctgcatctataattctagaatttttccttatggttttattgatacctgagccagacagacaacgtaccccacaggacaatcaacttgcttacgttgtaataggactactatttatgattttaacagtagctgccaatgaaatgggactgttggaaacgaccaagaaagatctaggcataggacatgtagctgtcgagaatcaccatcacgcggccatgttggatgtggatctacatcctgcaagcgcttggactttatacgcagtagcaactactataatcacgcccatgatgaggcatacgatagagaataccaccgcgaatatctcattgaccgcgattgctaaccaggcagcaatcttaatgggtctcgataaaggatggcctattagtaaaatggacatcggcgttccattgttggcgctaggctgttacagtcaggtaaaccctttaactctgacagcagcagttctaatgttagtagctcattacgcgataatcggtccgggactacaagcaaaagcgacaagagaggcacaaaagcgaaccgcagcaggaataatgaaaaatcccacagtagacggtattgttgcaatcgatctagatccagttgtgtacgacgccaagtttgagaaacaattggggcagataatgctgttaatactatgcacgagccagattctcctaatgaggactacgtgggcattatgtgaaagcataactctagccacaggccccctaacaactttatgggagggaagccctggaaaattctggaatacaaccattgctgtatccatggcaaacatattcaggggaagctacctagcaggggctggactcgcgttcagtcttatgaaaagtctaggaggtggccgacggggaacaggggcacaaggggaaactctcggcgaaaagtggaaaagacaactaaaccagctatccaaaagcgagtttaacacatataaaagatcgggtataatggaagtggataggagtgaggccaaagagggtctgaaaagaggtgagaccactaagcacgcggtgagcagaggcacagccaagttaagatggttcgtagagagaaatctagtcaaaccagaagggaaggtaatcgatctaggctgcggaagaggaggatggtcttactactgcgcaggtctaaagaaagtaacagaggtaaaaggatatacgaaaggaggtccagggcacgaagaaccaattcctatggcaacttatggttggaatctagtaaaattgcattcaggcaaagatgtgttctttataccgcccgagaaatgtgatacacttctatgtgatatcggggaatcttctcctaatccaacaattgaagaagggagaaccttgagagtgttaaagatggtcgaaccctggttaagagggaatcaattttgtataaagattctaaatccgtatatgccttctgtggttgagacattagaacagatgcagagaaaacatggcggaatgttagtgaggaatcctctaagcagaaatagtacacatgagatgtattgggtcagttgcggtactggaaacatagtcagtgctgtaaatatgacaagtaggatgttacttaacagattcaccatggcgcacaggaaacctacgtacgaaagggatgttgacctaggtgcaggtacaagacatgtagcagtggagccagaagtagctaacctcgatatcataggacagcggatagagaacatcaagcacgagcacaagtctacatggcactacgatgaagataatccatataaaacatgggcgtaccatggaagttatgaagttaaaccatcaggcagcgctagctcgatggtcaacggcgtggtcaaattattaacgaaaccatgggacgtaatacctatggtaacacagatagcgatgactgataccacgccatttggtcagcaaagggtatttaaagaaaaagtagacacaagaacaccaaaagccaaacgaggtacagctcaaataatggaagtaacggcaaaatggctgtggggatttttatcaagaaataagaaaccaaggatctgtacacgtgaggagtttacaagaaaagtaaggtcgaacgcagcaattggggctgtttttgttgacgagaaccaatggaactcagctaaagaggctgtggaagatgagagattttgggacctagtacatcgcgaaagagaattgcataaacaagggaagtgtgcgacgtgtgtgtataatatgatggggaaacgcgaaaagaaactcggagaatttgggaaagcgaaaggatcgagggctatatggtacatgtggttaggagccagattcttagagttcgaagcactcggatttatgaatgaagaccattggtttagccgtgaaaattcactctctggagtcgagggcgaaggacttcataaattgggatacatacttcgtgatatatccaagattccgggaggcaatatgtacgcagatgatacagcgggttgggatacaaggataacagaggacgatttacaaaatgaggcccgaataacagatattatggaacccgagcacgcgttactagcaaagtcaatttttaagctgacataccaaaataaagtagtaagagtccagcgtccagccaaaaacggaacagtcatggacgttatttcacgaagagatcaacggggtagtggacaagtaggtacatatggtttaaatacatttactaacatggaagcccagttaatccgccaaatggaatccgaggggatttttagtcccagcgaattggaaacgcccaacttagcggaacgagtactagattggttagagaaatatggtgtagagagattgaaaagaatggcgataagcggagacgactgtgttgtgaaacctatcgacgatagattcgctaccgcactgaccgcattaaacgatatgggaaaagttagaaaggacattcctcaatgggagccgtcgaaaggttggaacgactggcaacaagtcccattctgttcccaccattttcaccaactaataatgaaggacggaagggaaatagtggttccttgtagaaaccaagacgaattagtcggtagagcacgcgtctctcaaggagccgggtggagcttacgagaaacagcgtgcttgggaaaatcttatgcgcagatgtggcagttgatgtattttcataggagggatctacgactagcagcgaacgcaatatgttccgctgtacctgtagactggatacctacatccaggaccacttggtctatccacgcacaccaccaatggatgacaactgaagacatgctcagtgtatggaatcgagtttggatagaggaaaatccctggatggaagataagacacacatatcctcttggggagacgtgccctacttgggaaagcgagaagaccaatggtgtggttcactgatcggactaacggctcgtgcaacctgggccaccaatatccaagtagcaatcaatcaagtaagacgccttatagggaacgagaattatttagattacatgacaagtatgaaacgattcaaaaacgaaagcgaccctgagggggcattatggtaa

SEQ ID NO: 21699 - RNA, 9879 nt, synthetic construct
  misc_feature 1..9879: note = derived and/or modified CDS sequence (opt6) from DENV-1__GQ868610__SS-prME
  source 1..9879: mol_type = other RNA
agtgtaacgatgcttttgatgctaatgccaacggcattagcattccatctaactactagaggaggggaaccacatatgattgtaactaaacaagaaagaggtaaatctttattattcaaaacaagtgctggagtcaatatgtgtaccctcatagcaatggatttaggtgaattgtgtgaagatacaatgacttacaaatgccctagaattactgaagcagaacccgacgatgtagattgctggtgtaacgcaacggacacatgggttacgtacggaacttgtagtcaaacgggagaacacagaagagacaaaagaagtgtagccttagccccacatgtggggctcggattagaaactagaacagaaacatggatgtcaagtgaaggtgcatggaaacaaatacaaagggttgaaacctgggcacttagacatccaggatttacagtgatagccctattcctggctcatgctatcgggacgagtattacccaaaaaggaatcatttttatattgcttatgctagttactcctagtatggcaatgcgctgcgtaggaataggctctagagacttcgttgaaggcttatccggggctacatgggtagatgtagttctagaacacggatcgtgtgttactaccatggcaaaagataaaccgactttagatattgaactacttaaaactgaagttacgaacccagcagtattaagaaaattatgcattgaagcaaaaatttctaacacaacaacagatagtagatgtccaacgcaaggcgaagctacgctaatggaagaacaagatgccaactttgtttgccgtaggacttttgttgaccgaggatggggaaatggctgtggcttattcggtaaaggttctttaattacatgtgcaaaattcaaatgtgtaaccaaattagaaggaaaaatagtccaatatgaaaacttaaagtacagtgtgattgtaactgtacacacaggtgaccaacaccaggtcggaaatgaaagcacggaacacggtacgactgctacaattactcctcaagccccaacttcggaaatacaattgactgattacggagcactgaccctggactgcagtccgcgaacaggactcgactttaatgaaatggttctgctaacaatgaaggagaaaagttggctagtccataagcaatggtttttagatctaccactaccttggacatctggggcgtcaacatcacaagaaacatggaacaggcaagatttacttgtcacatttaaaaccgctcacgcaaagaaacaagaagttgtcgtccttggaagccaagaaggcgccatgcatacagcgttgaccggtgcaactgaaattcagacgtcaggtacaacgactatcttcgctggacatctcaaatgtagactgaagatggacaaattgacactgaaaggaatgtcgtatgttatgtgcactggatcatttaaattagagaaagaagtagccgaaacacagcatggaacagtactggtccaaatcaagtacgagggaactgatgcaccatgcaaaatcccattctcaacacaagacgagaaaggtgtaacacagaacggtagactgattactgcgaatccgatagtgactgataaagaaaaaccggtcaatatagaggcagagccaccattcggagaatcttatattgttataggtgcgggggaaaaggcattaaaattgtcatggtttaagaaaggttcatctatcggcaaaatgtttgaagccacagctagaggcgctaggaggatggcaattcttggcgacacagcttgggattttgggtccataggcggcgtatttacatcggtaggtaaacttgttcaccagatttttggaacagcatacggggtgttgttctcaggcgtctcatggactatgaaaatcggcataggcgtacttttgacatggcttggcttaaactcacgaagtaccagtctaagcatgacatgtatagcagtcgggctgattacactttacctgggagtcatggtacaagcagactctggttgtgtaataaattggaagggaagagaacttaagtgcgggagtggcatatttgtaacgaacgaggttcatacttggactgaacaatataaattccaagctgacagtccgaaaagactatctgcggctattggaaaagcatgggaagaaggtgtctgcggaatacgtagtgcgactaggctagaaaatataatgtggaaacaaatatcgaacgagttaaatcatatattacttgagaatgacatgaaattcacggtcgtggtcggggatgttgtagggatattagctcaagggaagaagatgattcgtccccaaccaatggaacacaagtatagctggaaatcctggggaaaagcgaaaattatcggagcagacgtgcaaaatactactttcataattgatggtcccaatacaccagagtgtcccgacgatcagagagcctggaatatttgggaagtggaagactatggctttggtatattcacaacgaatatatggttgaaactgagagatagttatacccaagtatgtgatcacaggcttatgtcagccgcaattaaagattcaaaagcagtgcatgcagacatgggatactggatagaaagcgagaaaaatgagacgtggaagctggcgagagcatcgtttatagaagtgaaaacatgcatatggccaaaaagtcacaccttgtggtcaaatggagttctcgaatcagaaatgatcataccaaaaatatatggcggacctatttcgcaacacaattatagaccagggtattttacgcaaactgcaggcccgtggcatttaggaaaacttgaattggattttgatttgtgcgaaggaacaaccgtcgtagtcgacgaacattgtggtaacagagggccatcgctgcgtacaacaaccgttaccggaaaaattatacatgaatggtgttgcagaagttgtacccttccaccattacggtttaaaggagaagatggatgttggtacggaatggaaatcagaccagttaaggaaaaggaggaaaacttagtgaaaagcatggtatcagctggatccggtgaggtagactcattctccctaggattactatgtataagtataatgattgaagaagttatgcgatcaaggtggtcacgaaaaatgctgatgactggaactctggcagttttcttattgttaattatgggccaattaacttggaatgatctaattagactttgtataatggtaggggcaaatgccagtgatcgaatgggaatgggcactacatatctcgcactaatagcaacttttaaaatgagaccaatgtttgctgtgggcttgttattcagaaggctaacttcaagggaagtactactgctaacaatcggtctaagcctagtagcatcagttgaacttcctaattctctagaagaactaggagatggattggctatgggcattatgattttaaaactcctcactgacttccaatcacaccaattatgggctacattgttatcattcacattcattaagactacattaagtctacactatgcttggaaaactatggcgatggtgctttcaatagtcagtttatttcccctatgtctgagtacaacctctcagaaaaccacatggctaccagtactattgggaagtctaggatgcaaaccgttgactatgtttttgatcgccgaaaataagatatggggccgaaaaagctggcctcttaatgaaggaataatggcagttggtgtggtttcaattttactatcatctctactcaagaatgatgtaccgctagcgggaccattaatcgctggcggaatgcttatagcctgttatgtcatctcaggtagtagtgcagacttatcattagaaaaagcggcggaggtatcctgggaggaagaagcagaacatagtggtgcatcacacaatatacttgttgaagtgcaggacgatggaacgatgaaaataaaagatgaagaacgtgacgatacactgactattctcttaaaagcaacactcctagcagttagcggcgtatatccgttaagcattccagcaacattatttgtttggtatttctggcagaagaagaaacaaagaagtggcgtattatgggacacgccgtctccacctgaagtagaacgagcagtattagatgatggaatctatcgaataatgcagcgaggattattaggaagaagccaagtgggtgtaggcgtatttcaagagaacgtttttcatacgatgtggcatgtcacacgcggagctgttctgatgtatcaaggaaaacgacttgagccttcatgggcctcagtaaagaaagatttaataagttatggcgggggttggaggcttcaaggttcgtggaatactggcgaagaggttcaagtcatagctgtagaaccgggtaaaaatcccaaaaatgtccagacagcaccaggaacattcaaaacgcccgaaggtgaggtaggagcgatcgcgctcgacttcaagccaggaacaagtggctcaccaattgtaaaccgtgaaggcaaaattgttggtctttatggcaacggcgttgtaaccacaagcggcacatatgtaagtgctatcgcacaagccaaggcttctcaagaaggccctcttccagagatcgaagatgaagtgttccgtaaaagaaacttgactataatggacttacatccaggcagcgggaaaacgcgacgctatcttccagctatagtccgagaagcaataaagagaaaattacgtacactcatactagctcccaccagagtagtagcctcagaaatggcggaagcattaaaagggatgccaatacgatatcaaactactgcggtcaagagtgagcatacaggcaaagaaatcgttgatttgatgtgtcacgccactttcaccatgcggttattatcaccagttagggtaccaaactacaatatgattataatggacgaagcacattttacagatccctcaagcattgcagcccgagggtacataagtactagagtgggaatgggggaggctgcagcaattttcatgacagccactcccccaggaagtgttgaggctttcccacaatctaatgcagttatacaagatgaggaacgagacataccagaacggtcttggaactctggatatgaatggataacggattttccaggaaaaacagtgtggttcgtcccatctataaaatccggtaatgacatagccaattgcctgagaaagaatggcaaacgcgtaatacagttatcgcgaaaaacctttgacacagagtatcagaaaaccaaaaacaatgattgggattacgttgttacgacagacatatcagagatgggggcgaactttagagcggatagagttatagacccacgccgatgtctaaagccagtaattttgaaagatggaccggagagagtaattttagcggggcctatgcctgtaactgtcgcatcggcagcccaaagacggggccgtataggtagaaaccataataaagaaggagatcaatatatatacatgggacagccattaaataacgacgaggaccacgctcattggacagaggcaaaaatgcttctagacaatattaatacaccagaaggaatcatcccggctttatttgaaccagaaagggagaaaagcgcagcaattgacggtgagtatagactaagaggcgaggcaagaaaaactttcgtggaattaatgcgtaggggagatttaccagtttggttaagttacaaagtcgcatctgaaggatttcagtacagcgaccggcgttggtgctttgatggggaacgcaataaccaagttttggaagaaaacatggatgtcgagatctggactaaagaaggagaaaggaagaaactcagaccaagatggcttgatgctagaacctacagcgatcctttggccttgagggaatttaaagaatttgccgcaggaagaaggtccgtttccggagatctaattttggaaattggcaagctcccccaacaccttacccaaagggcacagaacgcactagataatttggtgatgttacataattcagaacaaggtggtagagcatataggcatgcaatggaggaacttccagacactatagaaacattaatgctattagctttaatagcggtattaactggaggagttacactattctttctgtcagggagagggctcggcaaaacatcaataggcttattgtgtgtaatggcgtcctcggttctattatggatggcgtccgtcgaaccacattggatagccgcaagtatcatattagagtttttcctgatggtattacttatcccggagcctgatagacaaaggacaccacaagataatcagctcgcttacgtagttattgggctactttttatgatccttacagtggcagctaatgagatgggattattagaaactacgaaaaaggaccttggtattgggcacgtagcagttgagaaccaccatcacgcaactatgctggatgtagatctccacccggccagtgcatggacgctatacgcggtagcgacaacgattattacaccaatgatgagacatacgatagaaaatacaactgctaacatctccttaacagcgatcgcgaatcaggcagcgattttaatgggacttgacaaaggatggcccatctccaaaatggatattggagtaccactattagcactagggtgctatagccaagtcaacccgcttaccttaactgcagcggtactaatgctagttgcgcattacgccataattggtcccggattacaagctaaggctactagggaagcacagaaacgtaccgcagcaggtatcatgaagaatccgactgtagatggaatagtagccattgatttagatcctgtagtttacgatgccaaatttgaaaaacagctcggacaaataatgttgctaattctctgtacatcccagattcttcttatgaggactacatgggccctttgcgaatctataactcttgccacgggacctttgaccacattatgggagggatcgcctggtaagttctggaataccacgatcgcagtttccatggctaacatttttagaggtagttatctagcgggcgctggtttagctttctcattaatgaaatcattaggtgggggtagacgggggactggcgcccagggggaaactcttggtgaaaaatggaagagacaacttaaccaattatccaaatctgagttcaacacttataaacggagtggaataatggaggttgatagaagtgaggcaaaagaaggtctaaagcgtggggaaacgactcgacacgccgttagcaggggaacagccaaacttagatggttcgtagaaagaaatctcgtcaaaccagaaggaaaagttatcgatttaggatgtggtcgaggcggatggagctattactgtgcaggacttaagaaagtcactgaagttaaaggatatactaaaggcggtcctggccacgaagaaccgattccaatggctacatacggatggaacctagtaaagctacattcaggaaaagacgttttctttaccccaccggagaagtgtgatacgcttttatgtgacataggcgaatcctcacccaatcccacgatagaggaaggtaggacattaagagtactaaagatggtagaaccatggttaagggggaatcagttttgcattaaaattctaaacccctacatgccctcagtagtcgaaactctagaacaaatgcaaaggaagcatggtgggatgttggtgcggaatcccctgagccgtaattcaacgcacgagatgtattgggtatcttgtggaaccggtaatatagtaagtgcagtaaatatgaccagtcgtatgctcttgaatcgctttacgatggctcataggaaacccacatacgagagagacgtagacctgggcgcaggaaccagacatgtagctgttgaacccgaagtagccaatttagatattataggacaaagaattgaaaatatcaaacacgaacacaagtcgacgtggcactacgatgaagataacccatacaaaacttgggcctatcatggttcgtacgaagtgaaaccgagtggatctgctagtagcatggttaatggagttgttaaattattaacaaagccatgggatgttattccgatggtcacccagatagccatgacagacacgacaccttttggccaacaacgcgtgttcaaagaaaaggtagatactcgaaccccaaaggccaaaagaggtactgcacagatcatggaagtgacggcgaaatggctctggggtttcttgtcccgcaacaagaaacctaggatatgcacgagggaagaatttactagaaaagtacgttcaaatgccgcaataggagctgttttcgtagacgaaaatcagtggaactcggccaaggaggcagttgaggacgaaaggttctgggacctcgtccaaaaagaacgtgaacttcacaaacaaggtaagtgtgcaacatgtgtttataatatgatgggaaagagagagaagaaattaggcgaatttgggaaggccaagggatcgcgggcaatatggtatatgtggttgggagctaggtttttagagttcgaggcgctcggattcatgaacgaagatcattggtttagtagggagaactctttgtcaggagtcgaaggagaaggcctgcataaactgggatatattctgagagatataagtaaaatacctggaggaaacatgtacgctgatgacactgctggatgggatactaggatcacggaagatgacctccaaaacgaagctaaaattacagacataatggaaccagaacacgctttgttagcaacaagtatattcaaactaacttaccaaaataaagttgtaagggtacaaaggccagcgaaaaatggcacagtaatggatgttatcagtcgtcgcgaccaacgtgggagtggccaggtaggaacttatggattaaacacttttactaacatggaggcgcagcttataagacaaatggaaagtgaaggcatatttttgccctcagaattggagacacctaacttggcagaaagagtactagactggctggagaagtacggagtagaaagattaaaacgcatggcaataagcggcgatgattgcgtagtaaagcctatcgatgaccgatttgcaactgcattgaccgcattaaacgatatgggaaaggtacgaaaagacatccctcaatgggagccatctaaaggatggaacgactggcaacaagtgccattctgttctcatcatttccatcaacttatcatgaaagacggacgggaaatagtagttccgtgcagaaaccaagacgagttagttggtcgagcacgagtcagtcaaggtgctggttggtcattaagagaaacggcatgtctaggcaagagttacgcccaaatgtggcagctgatgtatttccatagacgggatctccgacttgctgcaaacgccatatgtagtgcagtaccagtggactgggtgccgacatctcgcactacgtggagtattcatgcacaccatcaatggatgactacagaagatatgctctcagtatggaatcgtgtatggatcgaagaaaacccgtggatggaagataaaacacatgtaagttcgtggggagatgtaccatacttgggtaaacgagaagatcaatggtgcggttccttaataggactaaccgcaagagcaacgtgggcatctaacatccaagttgcaattaaccaggtaagaagactaattggaaacgaaaattacttagattatatgacgtcgatgaagagattcaaaaacgaaggagatcctgagggggccctatggtaa

SEQ ID NO: 21700 - RNA, 9879 nt, synthetic construct
  misc_feature 1..9879: note = derived and/or modified CDS sequence (opt6) from DENV-1__GQ868611__SS-prME
  source 1..9879: mol_type = other RNA
tcagtaactatgtttttaatgttaatgcccaccgcacttgcatttcatttaacaacaaggggtggagaacctcatatgatagtcagcaaacaagaacggggaaaatcattactttttaaaacttcagccggtgtgaatatgtgtacacttatcgcaatggacttaggtgaactttgtgaggatacgatgacatacaaatgtccccgcataacagaaacagaaccagatgacgtcgactgctggtgtaacgcaacagacacatgggttacttacggaacttgctcacaaacaggtgaacacaggcgtgacaaaaggagtgtcgcgttggctcctcatgtcggcttaggacttgaaacaagaacagaaacatggatgtcaagcgaaggagcgtggaagcaaatacaaagggtagaaacatgggctttaaggcaccctggctttaccgtcattgctttgtttctagcacacgcaataggaacttctatcacacaaaaaggtataatatttatattactaatgttggtaacgccaagcatggcaatgagatgcgtaggtataggctctagggatttcgtggaaggactgagtggggctacttgggtagacgtagtactcgaacacgggtcatgcgtaactactatggcaaaagataaaccaacattagatatcgaactcctgaaaactgaagtaaccaatccagcagtattacgaaaattatgtatagaagcaaaaataagtaatacaacgacagactctaggtgccctacacaaggagaggctactttggttgaagaacaagatgctaatttcgtatgcagacgaacttttgtagaccgagggtggggcaacggttgtggcttatttggaaaaggctcactaatcacatgtgctaaattcaaatgcgtaacaaaattggaagggaagattgtacagtacgaaaacttgaagtatagtgtaatagtaactgtacatacgggcgaccagcaccaagttggaaacgagtcgacggagcatggaaccacagcgactatcactccacaagccccaacgacagagatacagttgaccgattacggagcacttactcttgattgctcacctagaacgggattagatttcaatgaaatggttttactgacaatgaaagagaaaagttggctagtccataaacaatggtttctcgatttaccattgccttggacaagcggcgcatctacctctcaagaaacatggaacagacaagacttattagttacatttaaaaccgctcacgcaaagaaacaagaggtcgtagttctcggtagtcaagaaggagccatgcatactgctctaacaggcgcaacagaaattcagacttcagggaccacaaccatttttgccggccatctaaaatgccgacttaaaatggacaagttgacgctaaaaggtatgagttacgtcatgtgcactgggtccttcaaacttgaaaaggaactcgctgaaacacaacacggtacggtgctggttcaaattaagtatgaaggaacagacgctccatgtaaaatacctttttctacacaggatgagaagggtgttacacaaaacggaagactaatcacagcaaatccaattgtgacagacaaagaaaaaccagttaacatcgaagccgagccaccattcggcgagtcatacatagttatcggtgccggcgagaaagccttaaaactcagttggtttaagaaagggtcctcgatcggaaaaatgtttgaagctacagcaagaggtgctaggcgcatggctattttgggtgatactgcatgggactttggtagtatcggtggagtgtttacatcagtaggcaaactcgttcaccagatattcggaaccgcctatggcgtattgttttcaggtgtatcttggacaatgaaaataggtataggagtattattaacctggctaggtcttaatagtcgatcaacttcattatcaatgacctgtatagcagttggcctagttacattgtacttaggtgtcatggtacaggcagattcaggctgtgtgattaactggaaggggagagaattaaaatgtggtagcggtattttcgtaacgaatgaagtgcacacatggactgaacagtataaatttcaggctgatagtccgaaacgtcttagcgccgcgataggtaaggcttgggaagaaggcgtatgtgggatcagaagtgccaccagacttgaaaacattatgtggaaacaaatatcaaacgaattaaatcatatactgttagagaatgacatgaaattcaccgtcgttgtcggagacgtggcaggcattctcgcacaaggcaagaaaatgataagaccccaaccaatggaatataaatactcttggaaatcctggggcaaagccaaaatcatcggtgcggacgtacaaaatacaacgtttatcatagatggaccaaacacgccggaatgccctgatgaccaacgcgcatggaatatatgggaagtcgaggattatggctttggtattttcactacgaatatatggctaaaactaagagactcttatacacaagtctgtgatcacagattaatgtcggctgctataaaggatagcaaagcagtccacgctgatatgggatattggatagaatcagagaaaaatgagacatggaagttagcgcgagcatcttttattgaagtaaagacctgcatatggccgaaatctcatactctatggtcaaacggggtgctagaaagcgaaatgataatacctaaaatatatggcggccctatctcgcagcataattatagaccaggatacttcacacaaacggccggcccttggcacttaggaaaattggaacttgattttgacctttgcgaaggtacaactgtagtggttgatgaacattgtggtaatagaggccccagtctaaggacaacaactgtaaccggcaaaattattcatgaatggtgttgccgctcatgtaccttgccaccccttcgatttcgaggtgaagatggatgctggtacggtatggaaattcggccggtgaaagagaaagaagagaatctggtcaaaagtatggtatctgctggcagtggagaagtagattctttttctttaggattactgtgtatatctataatgatagaggaagttatgaggtccagatggagtcgaaagatgcttatgaccggcacattagccgtattctttctgttaataatgggacaattaacatggaacgatctcataagattatgtataatggtaggtgccaatgcgtcggaccgcatgggaatgggaacgacgtacctggctctaatggccacatttaaaatgagacctatgttcgcagttggcttactctttagacgactaactagccgagaagtcctgctgcttacgataggtttgagtctcgtcgctagcgtcgaattacctaattcattagaagaactaggagatgggctagccatgggaattatgatccttaagctattaactgactttcaatcacaccagttgtgggcaaccctattgtcattaacattcattaaaacaacatttagtctacattatgcttggaagaccatggcaatggtgttatccatcgtcagcttgtttccattatgcctatctacaacgtcacagaaaacaacctggctaccagttctccttggtagtctaggatgtaagccattaacgatgtttcttatagctgaaaataaaatctggggtcgccgttcctggcctttgaacgaggggattatggcagtcggaatagtatctatcctgttatcatccctcttgaaaaatgatgtgcctctagcaggtccgttaattgcaggagggatgctgattgcatgctatgtaattagtgggagttctgctgatttaagcctagagaaagctgcagaagtatcttgggaagaggaagcggagcattcaggggcctcccacaacatcctagttgaggtacaagatgatggaactatgaaaattaaagatgaagagagagatgatacattaactattttgctcaaagctactttattagcagttagtggagtctaccctctatccattcccgcaacactttttgtatggtatttttggcagaagaagaaacaacgaagcggagttctctgggacactccatccccaccggaagtagaacgtgcagttcttgatgatggaatatacagaattatgcagcgaggcttgttaggacgatcacaggttggagtcggagtgtttcaagaaaatgtgttccatacaatgtggcacgttaccaggggtgccgtattaatgtaccaagggaaacgtcttgaaccatcatgggcctcggttaagaaagacttaatttcatatggaggaggatggaggttacaaggctcttggaacaccggagaagaagttcaagtaatagctgtagaacccggcaaaaatcccaaaaacgtacaaactgcgccagggacattcaaaacgccagaaggagaagttggagcaatagcacttgactttaaacccggaaccagcggcagtccaatagtaaatagagagggaaagatagttgggctgtatggaaatggggtagtgaccacttctggtacatatgtctcagctatcgctcaagcaagagcgtctcaggaaggaccattgccagaaatagaggacgaggtttttcgcaaacgaaatctcaccatcatggatttacacccaggttccgggaagacccggcgatatctacccgcaattgtaagagaggctattaaacgaaaactccgaacattaatactagcccctacccgggtagtagcgtctgagatggccgaagcactaaaaggaatgccaatacggtaccaaactactgctgtgaaaagcgaacacactggaaaggaaattgttgacctgatgtgccacgcaaccttcactatgagattgttgagcccagtaagagtcccaaattacaacatgatcataatggatgaagcacattttactgatccatcatcaattgctgctagaggttatatcagtactagagttggaatgggtgaggccgcggcgatctttatgacagcaactccaccaggttcagtagaggctttcccccagagtaatgccgtcatacaagacgaggagagagacatcccggagagaagttggaactcgggttacgaatggataacggattttccagggaaaacagtctggtttgtaccttctataaaatccgggaacgacatagcaaattgcttgcgtaaaaacggaaagagagtcatacaattgtcaagaaaaacttttgatactgaatatcagaagacaaagaataatgattgggattatgtcgtgacaacagacatttcagagatgggggcaaacttccgtgctgacagagtaattgacccgaggaggtgtttgaaaccagtgattcttaaggatggccccgaacgagtaatactagctggaccaatgccagtaacagtagcttcagcggcacaaaggagaggcaggattggtagaaatcataataaagaaggcgaccaatatatctacatgggccagcctttgaacaacgatgaagatcatgcccattggacagaagcgaaaatgttgctggataatataaataccccggaaggtataataccagctctatttgaacccgaaagagagaaaagcgcagctattgacggtgaatacagactacgaggggaggcacgcaaaacgttcgtagagttaatgagacgtggtgatttgcccgtatggttatcgtataaggttgcatcggaagggttccaatatagtgacagacgatggtgttttgacggagaacgcaacaatcaagtactagaggaaaacatggacgtagagatctggaccaaagaaggtgaacggaagaaactcagacctcgatggttagacgctcggacttatagcgatccgttagcccttcgcgaatttaaagaatttgccgctggaagaaggagcgtatcaggagacctaatactagaaatcggaaagttaccacaacatctaacgcaacgcgcacaaaacgccctagataacctcgtaatgctgcataatagcgaacaaggagggagggcttaccgacacgcaatggaagaacttccggatacgattgaaacattaatgcttctagcactaattgcggtgctgactgggggagtcacactatttttcttatcaggaaggggtttaggaaaaacgagtatcggtttattatgcgtaatggcttctagtgtattgttatggatggcctcggtggaaccacactggatagcagcaagtataattttagagttctttctgatggttttacttatacccgaaccagatagacagcgcacaccacaagataaccagttagcttatgtcgtaataggattactatttatgattttaacggtagccgcaaacgaaatgggcctattagaaacaacgaagaaagatttaggcataggacatgtcgctgtagagaaccatcaccacgctgcaatgttagatgttgatttgcatccggcaagcgcttggactctctatgctgttgccactacgatcattactccaatgatgcggcatactatagaaaacactacggcaaatattagtctaacagcaatcgcaaaccaagcagcaatactgatggggttagataaagggtggccgattagcaagatggacattggtgtcccactcctcgcattagggtgctattctcaagtcaacccactaacgttaaccgctgccgtcttaatgttagtcgcccactacgctatcattggaccagggctccaagctaaagctacccgagaagcacaaaaacgaactgccgccggaatcatgaaaaaccctacagtagatggaatagtagcaatagatctagacccggttgtatacgacgcaaaatttgaaaagcaactaggacagatcatgcttttaatactctgtacaagtcaaatcctgttaatgagaactacgtgggccctgtgtgaatctattacactagcaacaggcccactaacaacactgtgggaaggtagccctggtaaattctggaatactacgattgcagtgagcatggcaaatatatttagaggctcgtatttggccggtgcggggttagcattcagtctaatgaaatctttaggcggagggcgtagaggtacaggggcacaaggagaaacgttgggagagaaatggaaaagacagctaaaccaactctcaaaaagtgagtttaacacgtataagcgttctggcataatggaggtagatcgaagtgaagccaaggagggactgaaacgcggagagacaaccaagcacgcagtgagtagaggtactgccaaattgagatggttcgttgaacgcaacctcgtcaagccggagggtaaagttatagacttaggctgtggtaggggaggatggtcatattattgtgctggcctgaagaaggttacggaggtaaagggatatactaagggcgggccagggcacgaggagccaattcccatggctacatacggttggaatctcgtcaaactccattccggaaaggatgtattctttattccaccagaaaagtgcgacaccttattgtgtgatattggtgaatcatcacctaacccaacaattgaagaaggcaggaccttacgggtactaaaaatggtggaaccatggttacgaggcaaccaattttgtattaagatactaaatccatacatgccgagtgtagtagaaaccctcgagcaaatgcaaaggaaacatggtggaatgttggtaagaaaccctcttagtagaaattctacacatgaaatgtattgggtctcgtgcggcactggaaatatagtctcggctgttaacatgacaagtagaatgcttttaaaccgattcacgatggcacacagaaagccaacttatgaacgagacgtggatttaggagcaggtacaagacatgtagctgtagaaccagaagtagcaaacttggatataataggacaacgtattgaaaatatcaagcacgaacataagagtacgtggcattatgatgaagacaatccttacaagacttgggcctatcacggtagttatgaagtaaagccgagtggtagcgcctcgagtatggttaatggtgtagtaaagttattgacaaaaccttgggatgtaataccaatggtaactcaaattgcgatgacagatactactccttttggacaacaacgtgttttcaaagaaaaagttgatacaagaactccgaaagcaaaaagggggacagctcaaataatggaagtaacggctaagtggttgtggggattcctgtctagaaataagaaacctcgaatatgtactcgggaggaatttacgagaaaagttaggtctaatgcggcaataggagcggttttcgtagatgaaaatcagtggaactcagctaaagaggcggttgaagacgaacgattttgggacttagtgcacagagagcgagaattgcacaagcagggcaaatgtgcgacttgtgtctataacatgatggggaagagagagaagaaactaggagaatttggaaaagccaaaggatcaagagcgatatggtacatgtggttaggagctcgctttctagaatttgaagcactaggatttatgaacgaagatcattggtttagcagagaaaactcattaagcggggttgaaggggagggattacacaaattaggttacatcttacgcgacatttcaaaaatccctgggggaaatatgtatgcagacgataccgcagggtgggatacgcggatcacggaagatgatcttcaaaacgaagcgagaatcacggacattatggaacctgaacatgccttgctcgctaaaagtattttcaagctgacctatcaaaacaaagtcgtcagggtacaaaggcccgctaaaaatggtacggttatggacgtcataagtcgaagagatcaaagggggagtggacaagtaggcacatacggtttgaatactttcacaaacatggaggcacaattgattcgacaaatggagtcagaagggattttctcgccaagtgagctcgaaacacccaatttagcggaaagagtcctcgactggttggaaaaatatggggtagaacgacttaaaagaatggcaatatctggcgatgattgtgtggtaaaacctatagatgataggttcgctactgctttgactgcattaaatgacatgggaaaagtacgaaaagacattccacaatgggagccctcgaaaggatggaacgactggcaacaagtaccgttttgttcgcatcattttcaccaactgattatgaaagatgggcgtgaaatagttgtaccgtgcagaaaccaagacgagctagtagggagggcaagggtatcacaaggagccggatggtcattgagagaaactgcctgcttaggcaaatcgtatgcacaaatgtggcaactcatgtactttcacagaagagacctgaggttagcagccaatgcaatttgttctgcagttcctgttgactggatacccacatcacggaccacatggagtatccatgcacatcatcaatggatgacaacagaagatatgctatcggtatggaaccgagtatggattgaagaaaatccatggatggaagacaaaacccacatatcatcgtggggtgatgtaccatacttaggaaaaagggaagaccaatggtgtggctcgttaatcggtcttaccgccagagcaacttgggcgaccaacatccaagttgctataaatcaggtaaggagattgattggaaatgaaaactatttagactacatgaccagtatgaagaggtttaaaaatgaaagcgacccagagggagctttatggtaa

SEQ ID NO: 21701 - RNA, 9879 nt, synthetic construct
  misc_feature 1..9879: note = derived and/or modified CDS sequence (opt6) from DENV-1__FJ882555__SS-prME
  source 1..9879: mol_type = other RNA
agtgtaacaatgctactcatgttgatgccgacagcgttggctttccatttaacaacaagaggaggagaacctcacatgatagtatctaaacaggaaagaggaaagagcttgttattcaaaacatcagcaggagtgaacatgtgtaccttgattgcaatggacttaggtgaattttgcgaagataccatgacgtataaatgtccaagaataacagaagcagaaccggacgacgtcgactgttggtgtaatgcaaccgacacatgggtgacatatggaacgtgttctcaaactggagaacacagaagagataagaggtccgttgcattagcaccacatgtaggattgggcttagaaactcgaactgaaacatggatgtcatcagaaggggcctggaaacaaattcagagagtagaaacatgggcacttcgacatccaggttttacagttattgctctatttctcgcacatgcaattggaacctcaatcactcaaaaaggtataatatttattttgctaatgttagtaacgccatctatggcaatgcggtgtgtagggataggatcgagagatttcgttgaaggtctaagtggagcaacttgggtcgatgtggtattagaacatggcagttgtgtaacgaccatggcaaaagataaacctaccttagacatagaactattgaaaaccgaagtaacaaatccagcagtactaagaaaattgtgtatagaagcaaaaatttcaaacacgactacagatagccgttgtcctacacagggtgaagctaccctagttgaagaacaagatgcaaacttcgtgtgtagaaggacgtttgttgatagaggctgggggaatggatgcggactattcggaaaaggctcactaataacatgcgctaaatttaaatgtgttaccaagctcgaaggaaagattgtacaatatgaaaacctaaaatactctgtgatcgtaactgtgcacaccggcgatcagcatcaagtcggaaatgaaagtacggaacacggaactacggccaccattactcctcaagcgccgtcaaccgaaattcaacttacagattacggagcactgacattggattgttctcccagaacagggttggacttcaatgaaatggtactactaacaatgaaagagaaaagctggctagtacacaaacaatggttcctagatcttcctttgccgtggacctctggcgcaagcgcttcacaagaaacatggaatcgtcaagatcttctagtaacttttaaaacggcacacgcgaagaaacaagaggttgttgtcctaggttcacaagaaggagcaatgcacacagcattaaccggtgcaacagaaatacaaacaagtggtaccacgaccattttcgccggacatttaaaatgtaggttaaagatggacaaattaacgctaaagggaatgtcgtacgtaatgtgcacaggttcattcaaactagaaaaagaggtagcagagacacaacatggtactgtattggtccaaatcaaatacgagggaaccgatgcgccttgcaaaataccgttttcgacacaagatgaaaaaggtgttacacagaatgggcgcctcataactgctaacccgatagtgacagataaagaaaaacctgtaaacatagaggctgaaccgccatttggagaaagctatatcgttattggtgctggagagaaagcgctgaagctatcctggtttaagaaaggatcgtcgataggcaaaatgttcgaagcaactgcaaggggagccagaagaatggcaatactaggtgacacggcctgggattttggatcaataggtggagtgtttacgagtgtaggaaagctcgttcatcagatttttggaactgcatatggagtgctattctcaggtgtatcatggactatgaagattggaataggagttttattaacttggttaggactaaacagtaggagtacatcattaagtatgacctgcatcgccgtaggattagtaacattatacctgggagtaatggtccaagcagacagtggttgcgtaatcaattggaaaggccgagagttgaaatgcgggtcaggcatttttgtgaccaacgaagtgcacacttggacagaacaatacaaattccaggcagattccccaaagagactgtctgctgctattggtaaggcgtgggaagagggtgtgtgtgggataaggagcgcaacacgtttagaaaatattatgtggaaacaaatcagcaacgagctaaatcatatattattagaaaacgatatgaaattaactgtagtagtcggtgatgtagcgggcattctagcacaaggtaaaaagatgataagaccgcagccaatggaatataaatacagctggaaaagttggggaaaagctaaaataataggcgctgatgtgcaaaatactactttcataatagacggtcaaaacacgccagaatgccccgatgaccaacgagcatggaacatatgggaagtggaagattatggatttggcatatttacaacaaacatatggcttaaattgagggactcatacactcaagtttgtgatcacaggttgatgagtgcagccataaaagattcaaaagcagtacacgctgatatgggttattggatagagtctgagaaaaacgaaacatggaaattggcgagagccagtttcatagaggtaaaaacctgcatctggccaaaatcccatacgttgtggtcgaacggagtattagaatccgagatgattataccaaaaatatatggaggaccaatatctcagcataattaccggccaggctactttacccaaactgctggcccgtggcatttaggaaaattagagttagattttgatttatgtgaaggaacaacagtagtagtggacgaacactgcggaaacagaggccctagtcttcgaacaaccacggtcactggaaagataattcacgagtggtgttgcagatcgtgcacattaccacctttacgatttaaaggagaagatggctgttggtatggaatggagatacgacctgtaaaagagaaggaggaaaatttagtaaaatctatggtatcagccggctctggtgaagttgatagtttctcactgggtttactatgcattagtataatgatcgaggaagtaatgagatcacgttggtcaaggaagatgttgatgactggaaccttagcagtgttctttttacttataatgggccaattaacctggaatgacctcataaggttatgtataatggtgggtgcgaatgcatccgatagaatggggatgggaactacctatctagcattaatggcgacctttaaaatgagacccatgtttgctgtaggactcctcttcaggcgacttacatcaagagaagtactactactaactataggattatcactggtcgcttcagtagagctcccgaactctttggaagaactcggagacggattagccatgggaataatgatcctaaaacttctaacagatttccaaagtcaccaactctgggctaccctcttaagcatgacatttatacgaactactttttcacttcattacgcgtggaagactatggcaatggtactctccattgtctcactcttcccgctttgtttaagcactacgagtcagaagacaacttggctgccagtcttattgggatcattagggtgcaaaccattaacgatgtttttaatagcagaaaataaaatctggggcagaaaatcttggccgcttaacgaaggaataatggctgttggaattgttagcatcctgctgtccagcctgctcaaaaatgatgtgcctcttgccggaccgcttattgccgggggtatgctaatagcatgctacgtaatttctgggtcaagtgccgacttaagtttggagaaagctgccgttgtatcctgggaagaggaggcagagcattcaggagcttcacataacatcctagttgaagttcaagacgacggcacaatgaagataaaagatgaagaacgtgacgacactttgactattcttctaaaagctacacttttagcagttagtggagtatatccactcagtatacccgcaactttgttcgtatggtacttctggcagaagaagaaacaacgaagtggagttctatgggacaccccatctccaccggaagtcgagagggcggtacttgacgatggtatatatagaatcatgcaaaggggtcttttaggtcgaagtcaagtaggagttggcgtgtttcaagaaaatgtatttcatacgatgtggcacgttactagaggggcagtattaatgtatcaaggtaaacgtttagaacccagttgggcaagcgttaaaaaggacctcattagctatgggggtgggtggcgattacaaggaagctggaatactggagaagaggttcaagttatcgctgtcgaacccggcaaaaatcccaaaaacgtacaaacggcaccaggcacatttaagacgtcagagggcgaggtaggagccatagcactggatttcaagccaggtacatcgggctcacccattgttaatcgtgagggtaaggttgtaggcttgtatggaaatggcgtagttacaacgagtggaacgtatgtttcagctatagcgcaagcaaaagcgtctcaagaagggccactacctgaaatagaagacgaagtcttccgaaaacgcaatctgacaatcatggatttacatccagggtctggtaagactcgcagatatctaccagctatagtaagagaagcaataaaaagaaaactacgcacactcatattagcacctacgcgtgtggtagctagtgaaatggcagaagcgctcaaaggaatgccgatcagatatcagacgacagcagtaaaatcggaacatactggtaaagagatagtggacttaatgtgtcacgccacttttactatgaggctgttaagtccggtacgagtacctaactacaacatgatcattatggacgaagctcacttcaccgaccctagctcaatagccgcgcgcggctatatttcaacaagggttggtatgggagaagccgccgccatttttatgacagcaaccccacctggaagcgtcgaggcttttccgcagagcaatgcggtcattcaagatgaagaacgggacatccctgaaagaagttggaactccggttatgaatggattacagattttccaggtaagacggtatggtttgtaccaagtatcaagtcgggcaatgacatcgctaattgcctaaggaaaaatggaaagagggtgatacaactatcaaggaaaacattcgataccgaatatcagaaaactaaaaataacgactgggactacgttgttactactgacatctcagaaatgggagcaaactttagagcagatcgtgtaatagatccacgaagatgtctaaaacccgtgatacttaaagatggtccagaacgagtgatactagcaggtccaatgccagtaacagtagcgagtgctgcacaacgacgtggacgaatcggaagaaatcacaacaaagaaggagatcaatatatatatatgggacaacctctgaacaatgacgaagatcatgcgcactggaccgaagctaaaatgttattagataatatcaacactcccgaaggtattataccagctctatttgaacccgaacgagagaagagtgccgcgatagacggggaatataggctaagaggagaagcacgaaaaaccttcgtggaactaatgaggagaggagaccttccggtatggttaagttataaagtagcttctgaggggtttcaatatagcgaccgacgttggtgttttgacggtgaaagaaataatcaagtattagaagaaaatatggacgtagagatatggacaaaagaaggtgaaaggaagaaactacgaccaagatggctggatgcaagaacctatagtgacccgttagccctaagagagttcaaggagttcgcagctggacgaagaagcgtatccggagacctaattttggaaattggtaaacttccccagcatctgacgcaacgcgcgcaaaatgcattagataacctcgttatgttacacaactcagaacagggaggtcgcgcatacagacatgcgatggaagaactaccagacactatcgaaacgctcatgcttttagccttaatagccgttcttactggaggcgtgactcttttctttttaagtgggagaggcttagggaagacctcaataggacttttgtgcgtcatggcaagtagtgtattgttatggatggcgtctgttgaaccacactggatagcagctagtataattttagagttctttctaatggtattgttgatccctgagccggacagacaaagaacgccccaagataatcagctagcatacgtcgtcatcggcctgctgttcatgatattaacggttgctgctaacgaaatgggtctgttagaaaccaccaaaaaggacttgggtataggacatgtagctgtagaaaaccatcaccatgcagctatgctggacgtagatttgcatccagctagtgcgtggaccctctacgcagtagcaacaaccataataacacccatgatgagacacacaattgagaacacaactgctaatatatccttgacagctatagcgaatcaagccgccatcctaatgggactagataaaggatggcccatttcaaaaatggacattggagtcccgttattggccctagggtgctactcacaggtaaatccgttgacattaacagccgcagtactgatgcttgtggctcactatgcaattataggccccggcttgcaggcaaaagcgacacgggaagctcagaaaagaacagctgcaggtataatgaaaaacccaacagttgacgggatagtggcaatagatctagatccagttgtatacgatgcgaaatttgaaaaacaactaggacagataatgttattaatattatgtacatcacaaatattattaatgagaactacatgggcattatgtgagtccataactcttgcgacagggcccttgacaacattatgggaagggagtccaggtaagttttggaatacaacaatagcagtttcaatggccaatatattcagaggatcatatcttgcaggggctggattagctttcagtttaatgaagagtctcggtggcgggaggagaggcacgggagcccagggagagacactaggagaaaaatggaaaagacagcttaatcaactttccaaaagcgaatttaatacatacaaacgaagtggaattatggaagttgatagaagtgaagcaaaagaaggcctcaagagaggagaaacaacgaaacatgccgtatcacgtgggactgcgaaattaaggtggttcgtagaacggaatcttgtaaaacccgagggaaaggttatagatctaggatgtggtcgtgggggctggtcgtattactgtgcaggtttgaagaaagttactgaagtaaagggctataccaaaggtggcccaggacacgaagaaccaatacctatggctacgtatgggtggaatctggtaaaattacacagtggaaaagatgtgttctttataccgccagaaaagtgtgacacactcctctgcgatattggagagagctcacctaatccaacaattgaggaaggtcgaactctgcgcgtattaaaaatggtagagccgtggctgcgggggaatcaattctgcatcaaaatactaaacccttatatgccctccgtcgtagagaccttagaacaaatgcagcgaaaacacggtggaatgctcgtccgtaatcctttaagtcgtaattcaactcatgaaatgtattgggtgagttgtggtacaggaaacatagtttcagctgtaaatatgacgagcaggatgctcctgaatcggttcacaatggcgcatagaaaacctacatatgaaagagacgtagatttaggtgccggcacaagacatgttgcggtggagccagaagtggccaacttagacataataggccagagaatagagaatattaaacacgaacacaaatctacgtggcattatgatgaggacaatccctacaagacatgggcctaccatggaagttacgaagtgaagcctagtggatcagcgagtagtatggtaaacggggtcgtaaagctactaacaaaaccatgggacgtaattcctatggtgacacaaatagctatgaccgacacaacaccctttggacagcagagagtttttaaggagaaagtagacaccaggacaccgaaggcgaaaagaggaacagcacaaataatggaggtaactgccaagtggttatggggttttcttagcagaaataagaagcccaggatatgtacaagagaagagttcacacggaaggtaaggtcgaacgctgcgatcggagcagtgttcgttgatgagaatcagtggaatagtgcgaaagaggcagtggaagacgaacggttttgggatttggtccacagagaacgcgaacttcataaacaagggaaatgtgctacgtgtgtatataacatgatgggaaagagagagaagaaattgggagagttcggtaaagcaaagggatcaagggcaatttggtatatgtggctaggagccagatttcttgaatttgaagcgctaggcttcatgaatgaagatcattggttcagcagggagaatagtttaagcggagtagaaggggaaggacttcataagctaggatatatactgcgggatataagcaaaataccgggcggtaatatgtacgctgacgacacggccggttgggacacaagaataacagaggatgatttacagaacgaagctaagatcaccgatataatggaaccagagcacgcacttttagcgaagtcaatctttaaacttacatatcagaacaaagttgtgcgagtacaacgcccggccaaaaatggcaccgttatggatgtaatatctcgccgagatcaaagaggtagcggccaagtgggaacctacggattaaacaccttcacgaacatggaagcgcagctcatacgacaaatggaaagcgagggaatattcagtccctcggaattggagacacctaatttagcaggtagggcattagactggctagagaaacatggagttgagaggttgaaaagaatggcaatatctggagacgattgcgtagtaaaaccgatcgacgatcgttttgcgacagcactgactgccttaaatgatatgggcaaagtacggaaggatattccccaatgggaaccttccaagggttggaacgactggcaacaagttccattttgctcccaccattttcaccaattaatcatgaaagatggacgcgaaatagtagtcccttgtcggaaccaggacgagttggtagggagagcaagagtttcacagggagcaggctggagtctaagagaaactgcatgtctggggaagtcatacgctcaaatgtggcagctcatgtatttccaccgaagagatttgcgccttgctgcgaacgctatctgctccgccgtacctgttgattgggtacccacaagtagaacaacatggagcattcatgcccatcatcaatggatgacgactgaagacatgttaagcgtctggaatagagtgtggattgaagagaacccatggatggaggataaaacccacatatctagttggggagatgttccttacctaggtaaacgggaagatcagtggtgcggatcattaataggtctaacagctagagcaacgtgggcaaccaatattcaagtcgcgattaatcaagtcagaagactgttgggtaatgagaattatcttgattatatgacaagtatgaaacgatttaagaatgagagtgatccggagggagccctgtggtga

SEQ ID NO: 21702 - RNA, 9879 nt, synthetic construct
  misc_feature 1..9879: note = derived and/or modified CDS sequence (opt6) from DENV-1__GQ199821__SS-prME
  source 1..9879: mol_type = other RNA
tcagtaaccatgcttttgatgctaatgccgactgcacttgcctttcaccttacaacccggggtggagaaccccatatgatagtctccaaacaggaacgcggcaaaagtctactgtttaaaacatctgccggcgtaaacatgtgtacattaattgccatggatctaggcgagttctgtgaagatactatgacttacaaatgtccccgaattacagaagcggaacccgacgacgtggactgctggtgtaacgcaactgatacatgggtaacatacggcacctgtagccaaacaggtgaacatagaagagataaacgtagcgttgcgcttgcgccacatgttggtctaggactagaaacaagaacagaaacgtggatgtcctcagaaggtgcttggaaacaaattcaacgggtcgaaacatgggccttacgccatccagggtttacagttatagccctttttctagctcacgcaattggcacaagtattacacagaaaggcataatcttcatcctactaatgctggtcacaccaagtatggcaatgcgttgcgtgggtatcggaagtcgcgactttgtagagggattatcaggagctacctgggtcgacgtggttcttgagcatggtagctgtgttacaactatggcaaaagataaacccacactagacatcgaattattaaagacagaagtcacaaatccagcagtcttgcgcaagttgtgcatcgaagcaaaaatatctaatactacgacggatagtagatgtcctacacaaggggaggcaacgttagttgaagaacaagatgctaatttcgtatgtaggaggacatttgtggatcggggctggggaaacggatgtggattgtttggcaaaggatccctaataacatgtgctaaatttaaatgcgtaacaaaacttgaaggaaaaacggtacagtatgaaaatttaaaatattcagtgatagtgacggtgcacaccggcgatcaacaccaagtaggaaatgaaagtaccgaacatggaacaacagcaactattacgcctcaagctccatccacagaaatacaactaacggattacggggcgttaaccctcgactgctcaccccgaactggactcgactttaacgagatggtgctactaacaatgaaagagaaatcctggttagtgcataaacaatggtttttagatcttccgcttccatggacaagtggagcaagcacttcccaggaaacatggaaccgcaaagatttattagttacatttaaaacagcgcacgcaaagaaacaggaggtagtagtcctcgggagccaagaaggtgcaatgcatactgcattgacgggagcaaccgaaattcagacaagtggcacaacaacaatttttgcaggccatctaaaatgtaggttaaaaatggacaaactgactttaaagggaatgtcatatgttatgtgcactgggtctttcaaattagaaaaagaggtagcagagactcaacatgggacggtcctagtacaaatcaagtatgaaggtacagacgccccttgtaaaatccctttcagtacacaagatgagaaaggagttacgcagaatggtcgattgataactgcaaatcctattgtcacagacaaagagaagcccgtcaatattgaagcagaaccaccatttggagaatcttatatagtaataggcgcaggagaaaaggcactaaagttatcttggtttaaaaagggctcatcaataggaaagatgttcgaagcaacggctcgtggagcccgacgaatggcaatattaggagacacagcctgggattttgggtcgatcgggggcgtttttacgtctgtaggtaaacttgttcatcaaatttttggcacggcatatggagtcttatttagtggtgtttcatggacaatgaaaataggaattggggtattgctcacatggcttggtctaaatagtagatccacatcgttatcaatgacttgcatcgtagttgggctagtcactttatatctaggtgtgatggtccaggccgacagcggctgcgtaataaactggaaagggagagaactgaagtgcggatctggaatttttgtaacgaacgaagtgcacacgtggacggaacaatacaaattccaagctgattcacccaaaagactctccgcggcaataggaaaggcatgggaagaaggggtatgcggaataaggtctgcgacccgactggaaaacattatgtggaagcaaatttcgaatgaactcaaccatatactacttgaaaatgatatgaagttcacagtagtagtaggtgacgtagccggcatattagcgcagggtaagaaaatgataagaccccaacctatggaatataagtacagttggaaatcgtggggcaaggcaaaaattattggtgcagacgtacaaaacactacatttataattgacggcccaaatacacctgagtgtccggatgaccaaagagcgtggaacatttgggaagtggaagactatggttttgggatatttacgactaatatatggctgaaattaagggactcatacacgcaagtatgtgaccacagattgatgagcgcggctattaaggactcaaaagcagttcacgcggatatggggtactggatagagagcgagaaaaatgaaacttggaagctagcacgtgcttcattcatagaggtaaaaacctgtatttggcctaaaagccacacattgtggtctaacggggtacttgaatccgagatgataatcccgaagatatatggcggtcccatatcacaacacaactaccggccagggtatttcacacaaacagccggcccatggcatttaggtaaactcgagctagacttcgatctgtgcgaaggaactactgtcgtagtggacgaacattgtggaaaccgaggaccgtcactaaggacaacgacggtgacaggcaaaataatccatgaatggtgctgtcgttcatgtacactcccaccattgcgatttaaaggcgaagatggctgctggtatggtatggagataagaccggtcaaagaaaaggaagaaaacctggtaaaaagtatggtatcggcaggttctggtgaagtggactctttttcattggggttgttatgcatatcaatcatgatcgaagaagtaatgcgatcaagatggagtcggaaaatgttgatgacagggaccttagcagtattctttctgctgattatgggtcaattaacatggaatgatttaatacgcttatgtataatggtaggcgccaacgcgagcgatagaatgggtatgggtacaacatatcttgctttaatggccacattcaaaatgagaccaatgttcgctgtcggattattatttagaagattaacatcccgagaagtattactattaacaattggcttgagtctcgtggcttctgtagaactgcctaacagtctagaagaactcggagatggactagcaatgggtatcatgatactcaagttactaacagattttcaatctcatcaactctgggccacactactcagcttaacatttataaagactacatttagtctacattatgcatggaagactatggccatggtattaagtatagtatcgttattccccttatgtctaagtacaacaagtcagaagaccacatggcttcctgtgcttctaggcagtttggggtgtaaaccactaactatgtttctaatagcagaaaacaaaatatggggaagaaaaagttggcctttaaacgaaggtataatggcagtcggaatagtttccattttattatcctcattgctcaaaaatgatgttccgctagcagggcctttaatagcgggtggaatgctgatagcctgctatgttataagtggtagtagcgcagatcttagcttggaaaaagccgccgaagttagttgggaggaagaggcggaacatagtggagccagtcacaatatattagttgaagttcaggatgacggtacaatgaaaattaaagacgaagaacgcgacgacacgctcactattctacttaaagcaacactactagcagtatctggagtatatccgctaagtataccagcgactctctttgtgtggtatttttggcagaagaagaaacaacgatcaggcgtattatgggatactccgtcacctccagaggttgagagggcggtattagatgacggcatatacagaataatgcaaagagggcttctaggccgttcccaggttggagtaggagtatttcaagaaaatgtatttcatacaatgtggcatgttacacgtggtgcggtactaatgtatcaaggaaaacgactagaaccgtcatgggcgtccgttaaaaaggatctaataagttacggtggaggttggagattgcaaggtagctggaatacaggagaggaagtacaagtaattgctgtggagcccggtaagaaccctaaaaacgttcaaacagctccaggtacattcaagacaagtgaaggagaggtaggagccatcgcactagacttcaagccaggaacatcgggatcgccaatagttaatagagaaggaaaaattgtaggtttatatggaaatggcgttgttacaactagcggaacttacgtatccgctatcgcacaagcaaaagcatcacaggaaggacctctacctgaaatagaggatgaggtcttcagaaaaagaaacttaacaatcatggacttacatccgggctcgggaaaaacccgtagatacctacctgccatagttagagaagctattaagagaaagctcagaactttaatactagctccgacgcgagtcgttgccagtgaaatggcagaagcacttaaaggtatgccaataagataccaaacaaccgctgttaagagtgaacacacgggcaaggaaattgtagatttaatgtgccatgccacttttactatgcgcttgttgagtcctgtaagagtaccaaactataatatgatcataatggatgaggcgcattttacagacccttcgtctatcgccgctaggggttacatctcaactagagttggtatgggcgaggcagccgcaatctttatgacagcgacgcctcctggatccgtggaggcctttccgcaatccaatgcagttatacaagacgaagaaagggacatacctgaaagatcttggaactcaggttacgagtggataacagattttcctggaaagacggtctggttcgtgccgagtataaaatcaggaaatgatatagcaaactgcttacgcaaaaatggaaaaagagtgatacaattatctcgtaaaacatttgatactgaatatcagaagaccaaaaacaatgactgggattatgttgtcactaccgacattagtgaaatgggtgcaaactttagggcagatagagtaatagatccccgcagatgcctaaaaccagttattttgaaggatggtccggaacgagttatattagctggtcctatgcccgttacagttgccagtgcagcacaaagaagagggcgtataggacgaaaccataacaaagagggtgatcagtacatctatatggggcaaccacttaacaacgatgaagatcacgcgcattggaccgaggccaaaatgctactggataacatcaatacacccgaaggtataataccagcactattcgaaccggaaagagagaaaagtgcagctatagacggtgagtataggctaaggggtgaagcacggaaaacatttgtagaactaatgaggagaggagacctgccggtatggctatcgtataaagtagcttcagaaggatttcaatactcggatagacgatggtgttttgatggtgaaagaaataatcaagttctcgaagagaatatggacgtagagatctggactaaggaaggagagagaaagaaactaagaccaagatggctggacgcccgtacgtactctgacccgcttgccctacgtgaatttaaagaatttgcggcaggaagaaggtcagtatcaggtgacttaatactagaaataggcaagctgccccagcacctgacacagcgtgcgcaaaacgcacttgacaatctcgtcatgttacacaattcagaacaaggcgggagggcctatcgacatgcaatggaagagttaccagacacaatagaaactttaatgctgttagcattaattgctgtcttaaccggaggggttacactgttctttctgtcagggagagggttgggaaaaacttcaataggattattatgtgtgatggcgtcctccgccctattgtggatagccagtgttgaaccgcactggatcgctgcaagtataatcctagaatttttcttaatggtattactaatacccgaaccagatcgccagagaacacctcaagataaccaacttgcatatgttgtcattggcttattatttatgattttaacagttgcagcgaacgaaatgggattactagagacaacgaagaaagacttaggaattggacatgtagctgtagaaaatcaccaccatgccgcaatgctagacgtagatttacatccggcgagtgcctggactctttatgcggtagcaacgaccattataactccaatgatgagacataccatagaaaatacaacagcaaatatctcactcacagctattgctaatcaggcagcaattctaatgggattggataaaggttggccaatatcaaaaatggatattggtgtaccccttcttgccttgggctgctacagtcaagttaatcctttaacactcacggccgcagtactcatgcttgtagcccattatgcaataataggtccaggactacaagcgaaagcaaccagagaggcacagaaaagaactgcagcaggaataatgaagaacccaacagtagatggcatagtagctatagacctggaccctgtagtttacgatgctaaatttgaaaagcaacttggtcaaataatgcttttgattctatgcacaagtcaaattttattaatgcgaactacctgggctttgtgtgaatcaataacacttgctaccggtcccttaactacactttgggaaggcagtccgggcaaattttggaatacaacgatagcagtttcaatggcaaatatctttcgtggttcttacttagcaggagcaggtttagctttttcgctaatgaagagtttgggtggaggcagaagagggacgggggctcagggtgaaacactgggagaaaagtggaagagacaattgaatcagctgtcgaaatccgaatttaatacatataaaagaagtggaattatggaagtcgaccggagcgaagcaaaggaaggactaaagagaggagagactaccaagcatgccgtgagtaggggaaccgcaaagttacgttggttcgtggagagaaatctagtaaaaccagaggggaaagtgatcgatctagggtgtggtcgaggaggttggtcttattattgtgcgggcttaaagaaagttaccgaagtaaaagggtatacaaaaggaggaccaggtcatgaagaacctatacctatggcaacatacggctggaacttggtaaaacttcatagtgggaaagatgtattctttattccaccagaaaaatgcgatacattattatgtgatatcggagagtcctccccaaaccctacgatcgaagaagggaggaccttacgcgtgttaaaaatggtagaaccctggctaagggggaatcaattctgcattaagatattaaatccctacatgcctagtgtagtagagacacttgaacaaatgcagagaaagcatggaggaatgctagttagaaacccattgagtcgaaatagtactcatgaaatgtattgggtctcatgtggcaccggaaatattgttagtgccgttaatatgacgtccagaatgctcttgaatagatttacaatggcccaccgcaagcccacttatgaaagagatgtggacttaggagcaggtacccgacacgtagccgtagaacctgaagttgcgaacctcgacattattggacaacgtattgagaacattaaacatgaacacaaatcgacctggcattacgacgaagataatccatataaaacctgggcatatcatgggagttatgaagttaaaccatccggcagtgcgtcctctatggtaaatggggtagttaagttattgacaaaaccttgggacgtgatacctatggtcacccaaatagcaatgacggatacgactccctttggtcaacaaagagtatttaaagagaaggtagacaccagaacgccgaaggctaaaaggggaactgcacagatcatggaagtaactgcaaagtggctttgggggtttctctcaagaaacaaaaagccaagaatatgtacacgagaggaatttaccagaaaagtacgatcgaatgcagctatcggtgccgtctttgtggatgaaaatcagtggaatagtgcgaaagaggcagtagaagatgaacgattttgggaccttgtgcatagggaacgagaattacataaacaagggaagtgtgctacatgcgtatacaatatgatgggcaaacgagagaagaaactcggcgaatttggcaaagcaaaaggaagtagagccatatggtatatgtggctcggagctcgttttctggaatttgaagcacttggatttatgaacgaggatcattggttttcacgtgaaaactccctaagcggggttgaaggcgaaggattgcataaactaggctatatcctacgagatatatccaaaattcctggagggaatatgtatgccgacgacacagcaggctgggatactcgtataactgaggatgacctccaaaacgaggccaaaatcacagatataatggagcctgaacatgcattgttagcaaaatcaatattcaagctaacctatcaaaataaagtagttcgggtacaaaggcctgccaagaatggaacggtaatggacgtcataagccgacgagaccaaagaggttccggacaggtaggaacttatggtttaaacacattcactaatatggaagcgcaactaatacgtcagatggaatccgaaggtatatttagccccagcgagttggaaaccccaaacttggcgggacgcgttttagattggctcgaaaaacacggtgtggaacgtctaaaaagaatggccataagcggggacgattgtgtcgttaaacccatcgacgacagatttgcaacagcactcaccgcactaaatgatatgggaaaagtgagaaaagacatacctcaatgggaaccgagtaagggctggaatgattggcaacaagttccgttttgttcccatcattttcaccaattaataatgaaagatggtcgtgagatagtagtgccgtgccgcaaccaggatgaattagtaggcagagctcgcgttagccaaggggcaggatggtcgctaagagaaacggcttgtttaggaaaatcctacgcacagatgtggcaactaatgtattttcacagaagagatcttcgtctggcggccaacgccatctgttccgcagtaccagtggattgggttcctacaagccgaacaacgtggtcaatacatgcacatcaccaatggatgactactgaagacatgctctctgtctggaatcgagtgtggatagaggaaaacccatggatggaagataaaacgcatataagttcatggggagatgtaccatatttaggaaagagggaggatcaatggtgcggtagtctaataggcttaaccgccagagcaacctgggcaacaaatatccaagtagcgattaaccaagttagaagattaataggaaacgaaaattatttagattacatgacttctatgaagcgatttaaaaatgagtccgatccggaaggagcgttgtggtag

SEQ ID NO: 21703 - RNA, 9879 nt, synthetic construct
  misc_feature 1..9879: note = derived and/or modified CDS sequence (opt6) from DENV-1__FJ882556__SS-prME
  source 1..9879: mol_type = other RNA
agtgttacaatgctattaatgttaatgccaacagcacttgctttccatttaaccactcgcggaggagaaccacatatgatagttagcaaacaagaacggggaaaaagtttactttttaaaacttccgcgggagtaaatatgtgcaccctgatagcaatggatttaggtgaattgtgtgaagatactatgacatataaatgtccacgaataactgaaactgaaccagacgatgttgattgttggtgtaatgcgacggatacttgggtgacatatggaacttgttcgcaaactggcgaacatagaagggataaaaggtcagtcgcattagctccacatgttggcctgggcttagaaaccagaactgaaacctggatgagtagtgaaggagcttggaaacaaatccaaagagtagaaacctgggcattaagacatcctggattcacagtaatagcactttttctagcccatgcaatcggcacaagcattactcaaaaagggataatctttattttgttaatgctagtcaccccttcgatggcgatgagatgtgttgggataggctctagagatttcgtagagggactaagcggggctacatgggtagacgtggtactggaacatggttcgtgtgtaactacaatggctaaagataaacctacacttgacatcgagctacttaaaacagaagtaacaaatccagctgtactgagaaaattgtgtatagaggcaaaaatttcaaacaccacaacagatagccgctgtcccacacaaggagaagcaaccttagtagaagaacaagatgcaaattttgtttgcagacgaactttcgtggatcggggttgggggaacgggtgtgggttatttggaaaaggatcattaataacttgcgctaaatttaaatgtgttacgaaactggaaggaaagattgtgcaatatgaaaacctaaaatatagcgtgatagttacagtccacaccggagatcaacatcaagtaggtaacgaaagtacggaacatggaacgacagcaaccataacacctcaagcacctacaactgaaatacagcttacagactatggagctttaacgttggactgttcccccaggacaggattggatttcaacgaaatggtcttgttaacgatgaaggaaaagagctggttagtgcataagcagtggtttctagaccttccactgccatggacatcaggcgcatcaacttcccaagaaacctggaatagacaagatctgttggtgacgtttaaaactgctcacgcgaaaaagcaagaagtcgttgttctaggctcacaggaaggtgcaatgcatacagcactaacaggtgccaccgaaatacaaactagcggaacaacgacaatcttcgcaggacacctgaaatgcagactcaaaatggacaaattgacccttaaagggatgtcatacgtaatgtgcaccggatctttcaaactggaaaaagaagtggcggagacacaacacggtacagttttagtacaaataaaatacgagggcaccgatgccccgtgtaaaataccattctctacacaggatgaaaaaggagtaactcaaaatggaaggttaataacagcaaacccaatcgtaagcgataaagaaaaacctgtcaacatagaagccgaaccaccatttggcgaatcctacatagttataggtgctggagaaaaggctttaaaattgtcttggtttaagaaaggcagctctatcggaaaaatgttcgaagcaactgcaagaggtgcaagacgtatggcaatattgggggatacagcgtgggactttggtagtataggaggagtatttactagcgtaggcaaattggttcaccaaatctttggtacagcatatggcgtgttgtttagcggtgtatcctggacgatgaaaataggtattggggttctattaacttggcttgggcttaattctagatctacgtcattatctatgacttgcattgctgtgggattggtcactctctatttaggtgtgatggttcaagcagacagcggttgtgtgataaactggaaaggtagagaattaaaatgcggttcaggaatattcgtaacgaatgaagtgcatacatggacagaacaatacaaattccaggcggactccccgaaaagattaagtgcggcaataggtaaagcatgggaggaaggcgtctgtggtattcggtcggcgacaagacttgaaaatattatgtggaaacagatttctaacgaactgaaccatattttactagagaatgacatgaaatttactgttgtagttggagatgttgcgggcattctggcgcaaggcaagaaaatgattcgcccccaaccgatggaatataaatattcatggaagtcttggggtaaagctaaaataataggtgcagatgtgcagaacaccacctttattattgatggacccaacacaccagaatgtccagacgatcaaagggcatggaacatatgggaagtagaagattatggttttggaatattcacaaccaatatatggctaaaactaagggatagttatactcaagtttgtgatcatagacttatgtccgcggctattaaagattcaaaagcagtccatgcggacatgggctattggattgaatcggagaaaaatgaaacctggaaactagcacgggcctcctttatagaagttaagacttgcatttggcctaaatcgcataccttatggtccaacggtgtcctggaatcagaaatgatcattccaaaaatatacgggggcccaattagtcaacataattaccgccccggatattttacacaggctgctggaccctggcatctcggaaaattggaattagactttgatctttgcgaaggaactacggttgtagtcgacgagcattgtgggaatagaggaccttcattaaggaccacgacggtaacaggaaaaataatccatgagtggtgttgccggtcatgcacattgccaccattgcgttttcgaggggaggatgggtgttggtatggtatggagattagaccagttaaggagaaggaggaaaacttagtaaaaagtatggtaagtgccggtagtggggaagtagattctttcagcttgggtctactatgcataagcatcatgatagaggaggttatgcgttcaagatggagccgaagaatgttaatgacagggacattagcggtgttctttttactcattatgggccaactgacatggaatgacttgattcggctatgcataatggtaggagcgaatgcaagtgatcgaatgggaatgggaacgacctatctggcacttatggccacattcaaaatgcgtcctatgttcgcagtaggtctactttttcggagattgaccagccgtgaagtgctcctcttaacaatcgggctgtcactcgtggcatcagtagagctccccaatagcttagaagaacttggagacggactcgcaatgggcatcatgatcctgaaattactcacagactttcaatctcatcaattatgggcaacacttttgagtttgacattcatcaaaactaccttttcgcttcactatgcctggaaaacgatggcaatggtactatcaatcgtttctcttttccccttatgcctgtcaaccacatctcagaaaacgacatggctaccagtactattaggtagtcttgggtgcaaacctctcactatgtttctgatcgcagaaaacaaaatttggggtaggagaagctggccgctgaatgaaggtatcatggccgttggaatagtaagtattttactaagctccttattgaaaaacgacgtgccacttgccgggccgttaattgctggtggaatgctaatagcatgttatgtaattagtgggtcgagtgcagatttaagcctagagaaagcagctgaagtatcatgggaggaagaggcagagcactcaggagcatcacacaatatacttgtggaggtacaagacgacggaactatgaagattaaagatgaggaacgtgacgacaccctgaccattctcttgaaagcgactttacttgccgtctcaggggtgtatcccctttcaataccagctactctattcgtgtggtacttttggcagaaaaagaagcaaagaagcggtgtactctgggatactccatcacctcctgaggtcgaaagagccgtcttagacgatggaatatatcgaataatgcaacgagggcttttgggtaggtctcaagtaggcgtcggcgttttccaggaaaatgtattccatacgatgtggcacgtaactaggggagcggtactaatgtatcaaggaaaacgtcttgaaccttcttgggcaagtgttaagaaagatctcataagttacggtggaggctggcgcttgcaaggttcgtggaatacaggtgaggaagtacaagttattgccgtcgaacccggcaaaaatcccaaaaatgtacaaaccgctcccggaaccttcaaaacacctgaaggagaagtgggggccatcgcattagactttaagccaggtacctcaggctcaccaattgtgaacagagaaggcaaaatagtggggttgtacggcaatggagtcgtgactacgagtggtacttacgtttcagctattgcccaagctaaagcatcccaggaggggccactaccggaaatagaagatgaagtatttcgtaaacgaaatctaactattatggacctacatcccggttcagggaagactagaagatacttaccagcgatagtacgcgaagctataaaacgaaaactaagaacactgattctagcccccacacgagtagttgccagtgaaatggcagaagcactaaagggcatgccaatcagataccaaactacagccgtaaaaagtgaacacacaggtaaagaaattgtagatctaatgtgccatgctaccttcacgatgagactcttaagtcctgtgcgagtgccgaattataatatgataattatggacgaggcccacttcacagacccctctagtattgccgcaaggggatacatttctaccagggtgggtatgggtgaggcagcagccatttttatgacagcaactcctccaggctccgtggaagcgttcccgcagagcaacgcagtgatacaagatgaggaaagagatatccctgagcgttcatggaactctggatatgaatggataacagatttccctgggaaaacagtgtggttcgttccatctattaaaagtggaaatgatatagcgaactgtctccgtaagaatggcaaaagggtcatacaactaagtaggaagacatttgatactgagtaccagaaaaccaaaaataacgactgggattatgtggtcacaaccgatatatcagaaatgggtgccaactttagagcagacagagtaatagatccacgacgatgtttgaaaccagtcatattaaaggacggacctgaaagagttattcttgcgggcccgatgccagtcactgtagcttcagctgcccagcgtagaggaagaataggacgaaaccataataaagaaggagatcagtacatatatatgggtcagccattaaacaatgatgaagatcacgctcactggacggaggctaaaatgttactggacaatataaatactcctgaaggtataattcctgcactttttgaaccggaacgtgagaaaagcgcagcgattgacggggaatatcgccttcgaggagaagcaaggaagacatttgtcgaattgatgcggagaggggacttgcccgtatggttaagttacaaagtagcttcagaaggattccaatatagtgaccgtcggtggtgcttcgatggagaaaggaataaccaagtcctcgaggaaaatatggacgttgaaatatggaccaaggagggggagcgaaagaaactcaggcccagatggttagatgcaaggacgtattcggatccgcttgcattaagagaatttaaagaatttgctgcgggacgccgaagcgtcagtggagacctaatcttagagatcggaaaattaccgcagcatctaacacaacgagcccaaaatgctttagacaatctagtcatgctgcacaatagtgagcagggtggtagggcttacagacacgcaatggaagagttaccagatactatcgaaacactaatgctgctcgcattaatagcggtattaacgggtggcgtgacacttttcttcttatcgggtagagggcttggaaaaacctcaataggactgctgtgcgtaatggcatcatctgttttactatggatggcgagtgtagaacctcattggatagcagcgtcgatcattctagagttctttcttatggtactattaatccccgaaccagaccgacagcgaactccacaagacaatcaactagcctacgttgtcataggtctcctcttcatgatattaacagtcgcagcaaacgaaatgggtttacttgagaccacaaagaaagatttgggtatcggacacgtggcagtagaaaaccatcatcatgcggcaatgcttgacgttgacttacatccagcttctgcatggaccttatatgctgttgcaaccacaataataaccccgatgatgcgacacacgatcgaaaatactacggccaacatatcgctaactgctattgccaatcaggcagcgatactgatgggattagataaaggttggccaatatctaaaatggacataggtgtacccttattggctctgggatgttattctcaggtaaaccctcttacgttaactgcagctgttttaatgctagttgcacattacgcaattataggaccaggattacaagcaaaagcaacgagagaggctcaaaagagaacagccgctggcatcatgaaaaatcctacagttgacggaattgttgcaatagatttagatcccgtggtatatgatgctaaatttgaaaaacagttggggcagattatgcttttaatcctatgtacgagccagatactattaatgaggaccacctgggctttatgtgaaagtattaccctagcaacgggtccactaacaactttatgggaaggaagtcccgggaaattttggaatacaactattgcagtttcaatggcaaatatctttcggggaagctacttagcaggagctggattagcattttccctaatgaagtctcttggcggtggacgacggggaacaggagctcaaggagaaactctaggcgaaaagtggaagaggcaattaaatcaactttccaaatcagaatttaacacgtacaaaaggagtggcatcatggaagtcgacagatcagaagcgaaagagggtctcaagaggggagaaacgacgaaacatgcagtgagcaggggaacagctaagctaaggtggtttgtagaaagaaacctagtcaaaccagaaggaaaagttattgacctaggatgcggtcgaggaggatggagttattattgcgcaggtctcaagaaagtaactgaagttaaaggttatacaaaagggggacctggacatgaggagcctatacccatggctacatatggttggaatctagttaaattgcacagcggaaaagacgtattctttataccacccgaaaaatgcgataccttactttgcgatattggagaaagttcaccaaacccaacaattgaggaaggtcgaacgttaagggttttaaaaatggtcgaaccatggctcagaggaaaccaattctgcattaaaatattgaatccatatatgccatcagtggtagaaactctagaacagatgcaaaggaaacacgggggaatgctagtacgaaatcccttaagtcgtaactcaactcatgaaatgtactgggtctcatgcggcacgggcaatatagttagtgcggtaaacatgacttcacggatgttgttaaatagatttacgatggcccatagaaaaccgacttatgaacgtgacgtagacttgggagctggaactagacacgttgcagtagagccagaagtagcaaatctagacatcattgggcaacgtattgagaacataaaacatgaacataaatcaacgtggcattacgatgaggataacccgtataaaacatgggcctaccacggaagttatgaggttaaaccgtcaggttctgcctctagtatggtaaatggggtagttaaactcctaacaaaaccatgggatgttattccgatggtaacacaaattgcgatgactgacacgacaccattcggtcagcaaagggtatttaaagaaaaagtggatacaagaacaccgaaggcgaaacgcggcacggcgcaaatcatggaagtaacagcaaaatggctctggggcttcttaagcagaaataagaaaccacgtatatgcactagagaagagttcaccagaaaagtccgttcaaatgcggcgataggggcagtgtttgtcgatgaaaaccaatggaatagcgcaaaagaagccgtggaagacgaacgtttttgggaccttgtccaccgagaacgagaattacataaacaaggaaaatgtgccacctgtgtgtacaatatgatgggaaaaagagaaaagaaacttggtgaatttggaaaagcaaaggggtcaagggcgatatggtacatgtggttaggggcaagatttctagaatttgaggccctaggcttcatgaatgaggaccactggttctcgagagagaatagcttaagcggcgtagaaggagaaggactacacaaattagggtatattttacgtgacatcagtaaaatcccaggtggaaacatgtacgccgatgatacggctggctgggataccagaattacagaagacgatctccaaaatgaagcaagaataacggatataatggaaccagaacatgctttactagcgaagtctattttcaaacttacctaccagaacaaagtggtgagagttcaacggcctgccaaaaatggaacggttatggacgttatatcccgtagggatcaaaggggatctggtcaagttggaacttatggcttaaatacattcactaacatggaagcacaattgatacgccaaatggagagcgaaggaatatttagtccttcagaactagaaacaccaaatctcgcagaacgagtactagattggctggagaagtacggtgtcgaaaggcttaaaagaatggctatttcaggagatgactgtgttgtgaaaccaatagatgatagattcgctactgctttaacagcattaaatgatatgggtaaagttagaaaagacataccacaatgggagccgagcaaaggttggaacgattggcaacaagtaccgttttgttcacatcatttccatcaacttataatgaaagacgggcgggagatagtcgtcccatgcagaaatcaggacgaattagttggcagagcaagagtctcacaaggcgctggatggtcactccgcgagacagcgtgtctgggaaagtcgtatgcacagatgtggcaattaatgtattttcatcgaagggaccttcgactcgcggctaacgccatatgttctgcagtacccgtagattggatacccactagcagaacaacatggagtatacacgctcatcaccaatggatgacgaccgaggatatgttatcagtatggaatcgagtatggatagaagagaacccttggatggaagataaaacacatatttcgtcttggggcgatgtaccatatttaggaaaacgagaagaccaatggtgcggaagtctcataggactgaccgcacgcgcaacgtgggcaactaatattcaagtggcgatcaatcaagtgagaagactaataggcaatgaaaattacctagactatatgacttctatgaaacgcttcaaaaatgaaagtgatccagagggagctttatggtga

SEQ ID NO: 21704 - RNA, 9879 nt, synthetic construct
  misc_feature 1..9879: note = derived and/or modified CDS sequence (opt6) from DENV-1__GQ199822__SS-prME
  source 1..9879: mol_type = other RNA
agtgtaacaatgcttctgatgttaatgcctactgctctagcttttcatttaacaacccggggaggagaaccacacatgatagtaactaaacaagagcgtggaaaaagtttgctctttaaaacatcagcgggagtgaatatgtgtacgttgattgcaatggacttaggggagttatgtgaggatacgatgacatataaatgtcctcgcattacggaagcagagcctgatgatgtggattgctggtgtaacgccacggacacgtgggttacttatggtacatgctcacaaactggagaacatcgtagagataaacggtcagtagccttggcaccgcatgtgggattagggttagagactagaaccgagacttggatgtcgtcggagggagcctggaaacaaatacaacgtgtagaaacatgggctctaagacacccaggcttcactgttattgcactgttcttagcacatgcgataggcacaagtattactcaaaaaggaataatttttattctactaatgctcgttacaccttccatggctatgcgatgtgtaggaataggttcgagagatttcgttgaaggtctatcaggtgcaacatgggttgacgttgtattagagcacggttcctgcgttactacaatggcaaaagataaaccaacattagatatagaactattaaaaactgaagttactaatccggctgtactccgaaaactatgtattgaagccaaaatttccaatacaactacagattcacgatgtccaacccaaggtgaggcgactctaatggaagaacaagacgcaaatttcgtgtgcagaagaacatttgtcgatcgaggatggggaaatgggtgtgggttattcggaaaagggagtctcattacatgtgcgaaattcaaatgtgtcactaaattagagggcaaaattgtccaatatgaaaacctaaaatattccgtaattgttacagtccacacaggggatcaacaccaagtggggaatgagtctacggagcacggaacaacagcaacgataactccccaagcaccaacttcagaaatacaactaacagattatggggccttaacgttagattgtagtcctagaacaggcttagattttaatgaaatggtattattgacaatgaaagaaaagtcctggcttgtccacaagcagtggttcctggatttaccattaccatggacttccggcgcttccacaagccaagagacctggaatcgtcaagacctcttagtgacctttaaaaccgcacacgctaagaagcaggaagttgtggtactcggatctcaagaaggtgccatgcacaccgcgcttacaggcgcgacagagatacagacttcgggtacaaccacgatatttgctggacatttgaaatgccgattaaaaatggacaagctaacccttaaaggtatgtcctatgtaatgtgtactggttctttcaagctggaaaaagaggtagctgaaacccaacacgggaccgtcctagtacagattaaatatgaaggcacagatgcaccgtgcaaaataccttttagcacgcaagacgaaaaaggcgtgacccaaaatggcagactaataactgcaaaccccattgtgaccgacaaagaaaaacctgtaaatatagaggctgaaccaccgtttggagaaagttatatagtaatcggtgcgggagagaaagccctaaaattatcttggtttaagaaaggttccagtataggcaaaatgtttgaagcgactgctcggggtgctcgaaggatggccattctaggggacacggcatgggattttgggagcgtaggtggcgtttttacatccgtcggaaaacttgttcaccaaatctttggaacggcatatggggtattatttagtggcgtcagctggacaatgaaaattggaattggagtgctactaacatggttaggtttaaattcacgaagtacttcgctatcaatgacatgcatagcagtagggctggtgacgctctatttgggagttatggttcaagcggacagtggatgtgttataaactggaagggtagggaacttaagtgcgggagtggaatcttcgttactaatgaagttcatacatggacagagcaatataaatttcaagcggattcccctaaaagactctccgccgccattggcaaggcatgggaagagggagtttgcggcatacggtccgcaacccgacttgaaaatattatgtggaaacaaatttctaacgaactgaatcatatactgctagaaaacgatatgaagttcacagtggtcgtaggtgatgtagtgggaatattagcgcaaggtaagaaaatgattcgacctcaacccatggaacataaatatagttggaagtcatggggtcgagctaaaataataggagcggacgtacagaacacaactttcattatagacgggccaaacacaccggaatgcccagatgaccaaagggcctggaacatttgggaagtagaagattatggctttggaattttcaccacgaacatatggctaaaacttagagacagctatacacaagtatgcgatcatagacttatgtcagcagccatcaaagatagcaaagctgtgcacgcggatatgggatattggatcgaaagtgaaaagaatgaaacttggaagctagcgagggccagctttatcgaagtcaaaacctgtatctggccgaagagtcataccctctggtcaaacggagtcttagaaagtgaaatgattatcccgaaaatctacggaggtcctatctctcaacataattatagaccgggttattttacacaaaccgcaggcccatggcacctaggtaagttggaattagatttcgatctctgtgaaggaactacagtagttgtagatgaacattgtggtaacagaggaccctccttgagaacaaccacagtaacaggtaaaataattcacgaatggtgttgtagatcgtgtacgctaccacccttaagatttaaaggagaagatggttgttggtatggtatggaaatacgaccggttaaagagaaagaggaaaacctcgtgaaaagtatggtttcggcaggatcaggtgaggtagatagcttttcattaggcctactgtgcatctcaattatgatagaagaagtaatgcgcagtaggtggtctcggaaaatgttaatgaccgggacacttgcagtgtttttactactgataatgggacaactaacatggaacgacctgatacgcttatgtatcatggtcggagcaaatgcgagtgatagaatggggatgggtaccacttaccttgcactgatggccacatttaaaatgagacctatgtttgctgtgggacttctatttagaaggttaacctctcgcgaagtcttgctattaacaattggactaagtctggtagcatcagtagaattaccgaactctcttgaagaactaggtgatgggcttgcaatgggaattatgattctaaaacttctaactgatttccagtcacaccagctgtgggcgacacttctgagcttaacatttataaaaacgactctatccctgcattatgcatggaagaccatggcaatggtattatccattgtttcattattcccattatgtctatcgactacttctcagaaaactacatggcttcccgttttattaggctctctaggttgtaaaccactcactatgtttttaattacggaaaataaaatatgggggaggaagtcctggccactcaacgaaggtataatggcggtgggcgtcgtatcgatcttactcagcagtttactcaaaaacgatgttccgctagccggcccgctgattgcaggagggatgctaatagcttgttatgttataagcgggagttcagcggacctcagcttagagaaagcagctgaggtatcatgggaagaagaagcagaacatagtggagcgagccacaatatattggtagaagtgcaagatgatggaacaatgaaaataaaagatgaagaacgagatgatacattaacgatactgttgaaagctactttgctagctgtatcaggtgtatatccactttccatacccgcaacattatttgtgtggtatttttggcagaagaagaaacaaagaagcggagtgctctgggatacaccttctccgcctgaggttgaaagagcagttttggatgatggtatatatcgcataatgcaaagagggctattaggacgtagtcaagtcggtgtaggagtgtttcaggaaaacgtattccatacaatgtggcatgttacaagaggggcagttttaatgtaccaaggtaaacggctggaaccctcctgggcttcagtaaagaaagacctaattagctatggaggagggtggaggttgcaaggctcatggaacaccggtgaagaagttcaagtgatcgcagtggagccaggcaaaaatcccaaaaatgtacagactgcgccaggaacattcaaaactccggaaggcgaagtcggtgccatagcattggattttaaaccaggaacttctggctcacccattgtgaacagagaaggtaaaatagtaggactctacggaaatggggttgtgaccacaagtggaacatatgtgtcggccattgctcaagctaaagccagccaagaagggccattaccagaaattgaagacgaagtttttagaaaaaggaacttaacaattatggacctacatccgggcagcggaaaaacccgacgataccttccagccctagtccgtgaggcaattaaacgaaaactaaggacactaatattagctccaacgcgagtagtagcaagtgaaatggccgaagccctcaaagggatgccaatacgctatcaaaccactgctgtgaaaagcgaacatactgggaaagagatagtagacttaatgtgtcacgctaccttcaccatgcggttgctgtctcctgttcgcgttcccaattacaatatgatcataatggatgaggcacattttactgacccgtcaagcatagccgcgcgaggatatatatccactagagtgggaatgggagaagctgctgccatatttatgacagctactccaccagggtcggttgaagcatttccgcagtctaatgcggttatacaggatgaggaacgagatattcctgaaagaagttggaatagcgggtacgaatggataacagatttccccggcaagactgtatggttcgtaccttccattaagtcaggtaacgatattgctaattgtcttaggaaaaatggaaaacgcgtgatacaactttccagaaagacatttgatacggaatatcagaaaaccaaaaataacgattgggactatgtggttaccacagacatttcagaaatgggggccaacttcagagctgaccgggtaattgatccacgaagatgtttgaaaccggtcattttaaaggacggaccagaacgtgtgatacttgctggtcccatgcccgtaacagttgcgagcgctgctcaacgtagaggaaggattggtagaaatcacaataaagaaggagatcaatacatatatatgggtcaaccgctaaataacgacgaggaccatgcacattggacagaggccaagatgttacttgataacataaatacgcccgaggggataatcccagctctttttgaacctgaacgagaaaaatctgcagccattgacggagaatatagattacgaggcgaggcgaggaagacctttgttgagttgatgcgaagaggtgaccttccggtctggctaagctataaagtcgcgtcagaaggctttcagtactcagatagaagatggtgctttgacggcgaacgcaataaccaagttctcgaagaaaacatggacgttgagatatggactaaggaaggcgaaaggaagaaactgaggcctagatggttggacgcacgcacttacagtgatccattagcgcttagagaatttaaagaatttgccgcaggcagacgatcagtctctggagacttaattctagagatagggaagttgcctcaacacttgacgcaacgagcacaaaacgcattggataatttagtaatgctccacaactcagaacaaggcggccgggcatatagacacgctatggaagaactaccagataccatagagactttaatgttattagcactaattgctgtccttacaggaggagtcacattattctttctcagtggtagagggcttggtaaaactagcattggactattgtgtgtaatggcttcgagcgtcctactgtggatggcctcggttgaacctcactggatagcggcgtctattattttggaatttttcttaatggtcctactcattccagaaccagacagacagcgtacaccccaagataatcaactagcttatgtagtaatcgggctccttttcatgatattaacggtcgcagccaacgagatgggattattggaaacaacaaagaaagatttaggcataggacatgtagcggtggagaaccaccaccatgcaactatgcttgatgttgacttacatccagcatcagcatggacactttatgcagttgcaacaaccataatcactccgatgatgagacacaccatagaaaacacgacagcgaacatatcgcttacagcgattgcaaaccaagctgctatattaatggggcttgataaaggatggcctatatccaaaatggatataggtgtcccgctcctagcactcgggtgctatagtcaggtaaacccacttacccttactgcagcagttctaatgttagtcgctcactacgcaattatagggccgggactacaagccaaagcgacacgtgaagcccagaagagaacagctgcaggtattatgaaaaatccgacggtggacgggattgttgctattgatctagaccctgtagtgtacgatgctaagtttgaaaaacaactaggacaaattatgcttttaattctctgcacttcacaaattttgctaatgcgaactacgtgggctctttgtgaatcaataaccctggctacaggaccactcacgaccctgtgggaaggtagtcctgggaagttttggaacacaacaattgcggttagcatggcaaatatcttcagaggatcatacctagcaggagcgggcctagctttttcattaatgaaaagccttggtggtggcagacgaggcactggagcacaaggggagacactcggcgagaaatggaaacggcaactgaatcagctttcaaaatcggaatttaatatatataaaagatctggtattatggaagtagatagatctgaagcgaaagaagggttgaagcgtggcgaaacgacaagacatgcagtctcacgaggaactgcgaaattgaggtggtttgtcgaacggaacttagtcaaacccgagggtaaagtgatagatttaggttgtgggagaggaggttggtcatattactgcgccggactcaaaaaggtcacagaagtaaaaggttatacaaaagggggtccgggtcatgaagaaccaatcccaatggcgacgtacggctggaatctggttaaattgcatagtgggaaagacgtcttctttacaccaccagagaaatgcgatacactgctttgcgatataggagaatcaagtccaaatccaacgattgaagaagggaggacactaagagtcctaaaaatggtggaaccctggcttcgcggaaatcaattttgtataaaaatattaaatccgtatatgccttcggttgtagaaactttagaacaaatgcaaaggaaacatggtggtatgttagtcaggaaccccctctcaagaaattcaacacacgaaatgtattgggtcagttgtggaacaggcaatattgtatcagcagttaacatgacatccagaatgctgctgaaccgttttactatggctcacagaaaacctacctatgaaagagatgtagatttgggagctggtacgagacatgttgcagtggaacctgaagtagcaaatttggatataatagggcaaagaattgaaaacataaagcacgagcataagtcgacttggcactacgacgaagataatccttacaaaacgtgggcgtaccacggctcgtacgaagtgaaaccaagtggatctgcctcatccatggtgaatggagtcgtaaaactgctgacaaagccatgggacgttattccaatggtaacacaaatcgcgatgacagacacaacaccttttggccaacaaagggtatttaaggaaaaagttgacacacgaacaccaaaagcaaaaagaggaacagcacaaataatggaagttacagcccgatggctttgggggtttttgagtagaaacaaaaagcctaggatatgtactagggaagaatttacgcgaaaagtccgcagtaatgcagctatcggtgccgtatttgttgatgagaatcaatggaactctgcaaaagaagcagttgaagacgagagattttgggacctggtacaaaaagagagggaattacacaaacagggtaaatgcgccacatgcgtttacaacatgatgggaaagcgagagaagaaacttggagagttcggtaaagctaaaggaagtcgcgctatttggtatatgtggttaggtgcgcgtttcctagagttcgaagctctaggattcatgaacgaagatcattggttcagcagagaaaattcattatcaggtgtcgaaggagagggactacataaattaggatatatcctacgggatataagtaagatcccagggggaaatatgtatgccgatgacaccgcagggtgggatacacgaataactgaagatgatcttcaaaacgaagctaaaattaccgacattatggagccggaacacgcattgctagcaacgtcaatctttaaattaacatatcaaaataaagtcgtccgggtacaacgacccgctaaaaacggtacggtaatggatgttataagtagaagggatcaacgtggttctggacaggtcggaacttatggactaaatacttttaccaatatggaagcacagctaatacggcaaatggagtctgaaggaatctttttgccatcggaacttgaaacccctaacttagcggagcgagtactcgactggctagagaaatacggggtagaacgcttaaaacgcatggctatttcaggagatgactgtgtagttaaaccaatagatgatcgattcgccacggcattaacagctcttaacgatatgggaaaagtacgaaaggatattccacaatgggagcctagtaaggggtggaatgactggcagcaggtacccttttgctcacatcacttccatcagttgattatgaaggatggtcgtgaaatagtagtgccatgcaggaatcaagatgaacttgtagggcgggcaagagtatcccaaggggcaggttggtcattacgagaaaccgcctgcctaggaaaaagctatgcgcaaatgtggcagctaatgtattttcatcgcagggatttaagactagctgcaaacgccatctgctcagccgttcctgtggattgggtgcctacttcgcgaactacgtggtcaattcatgcacatcaccaatggatgacaaccgaggatatgctttctgtatggaatcgcgtatggattgaagaaaatccatggatggaggataagacacatgtaagcagttggggagatgtaccttatctcggaaaacgggaagatcaatggtgtggcagtttaataggcttaaccgcacgagccacatgggcatctaacattcaagttgcaatcaatcaagttaggcgactaataggaaatgaaaattatcttgactatatgacaagtatgaaaagatttaagaacgagggcgaccctgaaggggcattatggtga

SEQ ID NO: 21705 - RNA, 9879 nt, synthetic construct
  misc_feature 1..9879: note = derived and/or modified CDS sequence (opt6) from DENV-1__FJ882557__SS-prME
  source 1..9879: mol_type = other RNA
tcagtaactatgttactgatgttaatgccgacagcattggcctttcacttaacaacccggggcggcgaaccgcatatgatagtatcgaaacaagaacggggcaaatcgctactcttcaaaacaagtgctggagtcaacatgtgtactttgattgctatggatcttggagaattatgtgaagacactatgacgtataaatgtccccgaatcacagaagctgaaccagatgatgtagactgctggtgcaatgcaacggacacttgggtaacgtatggaacgtgttcacaaactggggaacacagaagggataaacgctcagtggcactagcgccccatgttggattaggtttggaaacgcggacagagacatggatgtcatcagaaggggcctggaaacaaatacaacgagtggaaacgtgggcattaagacacccaggttttactgttatagcactatttctggcacatgccattggtacaagcataacacaaaaaggaatcatattcatactactaatgttagtaacaccgagtatggcaatgcgttgtgttgggataggttcaagagattttgtcgaaggtttaagcggagcaacatgggtggatgtagttctagaacatggatcgtgtgttacaaccatggccaaagacaaaccaactttagatatagaattactaaaaactgaagttaccaaccccgccgtattgagaaaactatgcatcgaagcaaaaattagcaacaccactacagacagtagatgtccaactcaaggagaagcaacgttggtagaagaacaagacgcaaacttcgtatgccgccgtacatttgttgatcgcggctggggtaacgggtgtggacttttcggaaaaggtagtttaataacttgcgcaaaattcaaatgtgttactaaactagaagggaaaatcgttcagtatgaaaacctaaaatacagtgtcatagttacagtacatacgggagaccaacaccaagtcgggaatgaatctacagaacatggaaccacggcaactataacgcctcaagcccctacaactgaaattcaattaacagactatggggcattgactctagactgttcaccacggacaggattagattttaacgaaatggtactacttactatgaaagaaaaatcttggcttgtacataaacaatggtttctagatctgcctctaccctggacatctggtgcttcgacgtctcaagaaacatggaatcgacaggacctattggttacttttaaaacagcacacgcaaagaaacaagaagtagtagttctaggatcccaagaaggcgcgatgcatacagcattaacaggtgctactgaaatccagacatcggggactacgacaatattcgctggacacttaaaatgtcgactaaaaatggataaactaactctaaaaggaatgagttatgtaatgtgtactggttccttcaaactggaaaaagaagttgcggaaactcaacatggcacggtattagtccaaattaaatatgaaggcacagacgcaccctgtaaaattccattctccacgcaagatgaaaaaggagtaacacagaatggcagattaataactgctaatcctatagtaacggacaaagaaaagcctgttaatatagaagcggaaccgcccttcggcgaaagttacatcgtcattggggctggcgagaaagcgctaaaactgtcatggttcaagaaagggtcaagcataggcaaaatgtttgaagctacagctagaggggcgcgtaggatggcaatattaggtgacacagcttgggactttggcagtatcggaggcgttttcacgagcgtaggcaaactaatccaccagatatttggtactgcttatggagtactcttctcaggagtttcgtggactatgaagataggcataggagtcttgttaacatggctaggcctaaattctaggtcaacctcgctctctatgacctgtatagccgtaggacttgttaccttgtacttaggagtgatggtgcaagcggacagtggatgtgtgataaactggaagggtagggaattaaaatgcggatcaggcattttcgtcactaatgaagtccacacttggactgagcaatacaagtttcaggcagatagtcctaaaagactgagcgcagcaattggaaaagcgtgggaagagggtgtatgtggcataagatcagcaacccgtttagaaaatataatgtggaagcaaatcagcaacgagctgaaccatattcttttagagaatgatatgaaacttacagtggtggtaggtgacgtagcaggcatccttggacagggtaagaaaatgatacgaccgcaaccaatggaatataaatatagttggaagagttggggaaaagcaaagatcataggtgccgatgcacaaaataccactttcataattgacggaccaaataccccagaatgcccagatgatcaaagagcctggaacatttgggaggtagaagactacggatttggtatattcacgacaaacatctggttaaaactcagggactcttacactcaagtgtgcgatcacagactaatgtcagcagccattaaagattcgaaagctgttcacgcggacatgggctattggatagaatccgagaagaacgaaacctggaaattagcgcgagcgtccttcatagaggttaaaacatgcatttggcctaaatcacatactctatggagcaatggggttcttgagtccgagatgatcatacctaaaatctacggaggcccgattagccaacataattatagaccaggatacttcactcagacggctgggccttggcatttaggtaagttagaattagactttgatctttgtgaagggaccacagtggttgttgatgaacactgcggaaacagagggccctcgttaagaacaacgacagtaactggtaaaattatccatgaatggtgttgtcggtcatgtacactacctcccttacgattcagaggagaagatggatgttggtacggaatggaaatcagacctgtaaaagaaaaagaagagaatttagtaaaaagcatggtttcagcaggctcaggagaggtagactcgtttagtcttggtctactttgcatatctataatgatagaagaagtaatgcgaagtcgatggagtcgaaagatgctcatgaccggaacattagcagtatttttcctgttaatcatggggcaactaacgtggaacgatcttataaggctttgtataatggtaggtgcaaatgccttcgaccggatgggtatgggaacaacctatttagcactaatggcaacttttaagatgcgtcccatgtttgcagtcgggttactctttcgaagattaacatctcgggaagtgctattactaaccatcggtttaagccttgtagcaagtgttgaacttccaaattccttagaagaactcggtgatggactcgctatgggaatcatgatcctaaaactactaacggactttcaatcacaccaattatgggcgacgctacttagtcttacctttatcaaaactacgttctctttacattacgcttggaaaacaatggcaatggtacttagtattgtcagcttatttcccctctgtctaagtacaacgtcacagaaaaccacatggctccctgtcctattaggcagtctaggatgcaagcctctaactatgttcctaatagcagaaaataaaatatggggaagaaagagctggcctttaaatgaagggataatggccgtcggtatagtaagtattctcctaagtagtttactaaagaatgatgttccattagcagggcctcttatagccggtggaatgttaatcgcatgttacgtaatctcgggatcttcagcagacctttccctcgagaaagcggctgaagttagctgggaagaagaagcagaacattctggtgcttctcacaacatactcgtggaagtacaggatgacggtaccatgaaaataaaagacgaagaaagagatgacactcttacaatcttattgaaagcaaccttacttgctgtaagtggagtctaccccctgagtattcccgcaacgcttttcgtttggtatttctggcagaagaagaaacaacgtagcggtgttctatgggacacacccagtccacccgaagtagaacgtgcagtattagatgatggtatatacagaatcatgcaaagaggtcttcttggacgaagtcaagtcggtgttggcgtttttcaagaaaacgtttttcatacaatgtggcacgtgacgcgtggtgcagtattaatgtatcaaggtaagagactagagccatcgtgggcatctgtcaagaaagacctaataagttatggcggtggatggagattaagagggtcttggaatacgggcgaagaagtacaagtcattgcggtggaaccaggaaagaaccctaagaacgtgcaaaccgcacctgggaccttcaaaactcctgaaggagaagtgggtgcaatagcattagattttaagccaggcacttcaggctccccaatagttaatcgagaagggaaaatagttggattgtacggaaatggagtagttacaacttcaggaacatatgttagcgcaatagcacaagcgaaggcgtcacaggaaggaccactcccagaaattgaggatgaagtattcagaaaaagaaatttaacgattatggacttacaccctggctcaggtaaaactaggaggtatcttccagctatcgtacgagaggcgattaaaagaaaattacgtacactaattctagccccaactagagtagttgctagcgaaatggcagaagcactaaaaggtatgcccatacgatatcagacaacggctgttaagagtgaacacacgggtaaagagatcgtagacttgatgtgccatgcgacattcactatgaggttactatcgccggtacgagttccaaattacaacatgatcattatggatgaagcacactttacagatcccagttcaattgcggcaagggggtacatttcgaccagggtaggcatgggcgaagcagcggcaatatttatgactgcaactccgccagggtcggtggaggcatttcctcaaagcaatgctgtcattcaagatgaagaaagagatataccagaaagatcctggaactcaggacacgaatggattacagattttccaggtaagactgtgtggtttgttccaagtatcaaatcaggcaatgatattgctaattgtttacgtaaaaatgggaaacgcgtgatacagctcagtagaaagacgtttgatactgaatatcagaaaactaagaacaatgactgggactacgtagtgaccacagatatatcagaaatgggagcaaattttagggcagatagggtaatagatccaagaagatgtctcaaaccagtgatactgaaagacggtccggaacgagttatattagcgggaccgatgcctgtaacagtagcttccgctgcgcaaagacgtggaagaattggccgaaaccacaacaaggaaggtgatcagtacatatacatgggacaaccattaaataacgatgaagatcacgcacactggacagaagctaaaatgcttctcgacaatattaacactccagaaggcattatcccggcattattcgaacccgaacgggagaaaagtgcagctgtcgacggagagtataggctacgaggagaagctagaaaaacctttgtagagttaatgcgcagaggggatttaccggtttggctatcctataaggttgcgtcagaagggtttcaatattcagatagaaggtggtgctttgatggagaaaggaataatcaagtattagaagaaaatatggatgtagaaatatggaccaaagagggtgaaaggaagaaactacgtccaagatggttagacgcacgaacctatagtgacccacttgccctcagagagtttaaagaatttgcagcaggacgccgttctgtttctggtgacttaatactagaaattggtaaacttccacagcacctaacccaaagagcacagaacgcacttgataatcttgtgatgctgcataactccgaacaaggcgggagggcatacaggcacgccatggaagaactgccggacaccatagaaactctgatgttactagcattgattgcagtattaaccggtggggtaacattattctttctctcaggtcgaggacttggaaaaaccagtatcggattactctgtgttatggcatcatcagttctgttgtggatggcaagcgtcgaacctcactggatagccgcatcaataatcttagaatttttcctcatggtactgttaattccggaaccggaccgccaaagaacaccacaagacaatcagttggcttatgtagtcataggtctgttatttatgatactgacagtagcagccaatgaaatgggattacttgaaacaacaaagaaagaccttggaattggccacgtggccgtagaaaaccatcatcatgccgcaatgttagatgtagatctgcatccggcatctgcatggacactttacgccgtagctacaaccattataacccccatgatgagacatacaattgaaaatactacagctaatatatcactgacagcaattgcaaaccaagccgccatactgatgggtctcgataaaggatggccgattagtaagatggatattggagtgcccctacttgcattgggttgctactctcaagtcaatcccttaacaatgaccgcagctgtcttgatgctagtggcccactacgcaattattggccctggattacaggctaaagcaactagagaagcacaaaaacgaacggcggctggtattatgaaaaatccaactgtggatgggatagttgcaatcgacctcgatccagtagtatacgatgcgaaatttgagaagcaactaggccaaataatgttactcatactgtgcaccagccaaatattactgatgagaaccacctgggcgctatgcgaaagtattactttagctacaggaccgttaacgacgctatgggaaggtagcccgggtaaattttggaacacgacaattgctgtcagcatggccaacattttcaggggttcatacttagcgggagccggcttggcttttagtttaatgaaatcattgggaggaggtagacgtggaacaggtgcacaaggagaaacgttaggagaaaaatggaaacgccagctaaatcaacttagcaaaagcgaatttaacacctataagcgttcgggtattatggaagtagatagaagtgaagcaaaggaaggacttaaaagaggtgaaacaacaaaacacgcagtttcccgcgggacagccaaattgcgctggtttgttgagcggaatttagttaaaccagaaggaaaagtcattgatttaggatgtggaaggggaggatggtcctattattgtgcaggacttaagaaagtcactgaagttaaagggtatacaaaaggaggacctgggcatgaagaacccatacctatggcaacatatgggtggaatcttgtgaagctacactcagggaaggatgtatttttcataccaccggaaaaatgtgacacactgctatgcgacatcggtgagagcagtccgaatcctacaattgaggagggtcgaacacttcgtgtactgaaaatggttgaaccctggcttcgaggtaaccaattttgcataaagatcctaaatccgtacatgccgtcagtagttgagaccctagagcagatgcagcgtaagcacgggggaatgttagttcgaaaccctctatctagaaattcgacacatgagatgtattgggtatcgtgtgggactggaaatatagtttcagccgtaaatatgacgtcacgcatgctattaaataggttcacaatggcgcacagaaagccaacctatgaaagagatgtagatttggggacaggaactagacatgtggccgttgaacccgaggttgctaacctcgatataataggtcaaagaatagaaaatataaagcacgaacacaagagtacttggcattacgatgaagataatccttataagacatgggcgtatcatggatcctatgaagttaaaccaagtgggtcggcgtcatcaatggtgaacggtgttgtgaaattattaaccaaaccatgggatgttattcctatggtaacccagattgcaatgacggatacaacaccgtttggacagcagagggtattcaaggaaaaagtagacactcggacgcctaaagcaaaaagaggaactgctcaaataatggaagtcactgcacgatggttgtgggggttcctatcccgaaacaaaaagccaagaatttgcacacgtgaggaatttacaagaaaagtgcgatcaaatgcagccataggtgctgtgttcgttgacgaaaaccaatggaatagtgcaaaagaggccgtggaggacgaaagattttgggatctcgtacacagagaaagagagcttcataaacaaggtaaatgtgcgacatgcgtttacaatatgatgggaaagagggagaagaaactgggagagttcgggaaagcaaaaggtagtagagccatatggtacatgtggcttggagcacgatttctggagttcgaggcattaggttttatgaacgaagaccattggttttcgcgtgaaaattctttaagtggggtggagggggaagggttacacaagttaggttatatattacgagatataagtaaaatcccaggtggtaatatgtacgcagacgacactgcaggatgggatactagaataacggaagacgacttacaaaacgaggcaaaaattacagacatcatggaacctgaacatgctctactcgcaaaggcaatatttaaattaacataccaaaataaagttgttcgtgtacaaagaccagccaaaaacgggacagtcatggacgttatatcacgccgtgatcaaaggggtagtggtcaagtcggtacatacggcctcaatacttttaccaatatggaagctcaactaattaggcaaatggaaagcgaagggatattttctccatccgagctagaaacacctaatctggccgaaagagctttagattggcttgagaaatatggtgttgagcgactaaaaagaatggccattagcggggacgactgtgtagtgaagccgatagatgatcgatttgctactgctttgaccgcactaaatgacatggggaaagtgcgaaaggacattcctcaatgggagccctccaaaggctggaatgactggcaacaagtcccattctgctctcaccactttcatcaattaattatgaaagatggaagggaaattgtcgttccgtgtagaaaccaggacgagttagtcggaagggcaagggtctcacaaggagcaggttggagtctaagagagacagcctgtttgggaaaaagttacgcacagatgtggcaattaatgtacttccatcgtagggacctacggctagcagcaaacgcgatatgcagcgccgtaccagtagattgggttccaacaagcagaacgacatggagtatccacgcacaccaccagtggatgacaactgaggatatgctatctgtctggaacagagtttggatagaggaaaacccatggatggaggacaaaacacacatctcatcttgggaggatgtgccttatctgggaaaaagagaagatcagtggtgtgggtccctaataggactaacggcgcgtgcgacctgggcaacaaatattcaagtagcaatcaatcaagttcggagactaattggtaacgagaactacttagattatatgacctcgatgaaacgatttaagaacgaatctgatcccgagggggcactctggtaa

SEQ ID NO: 21706 - RNA, 9879 nt, synthetic construct
  misc_feature 1..9879: note = derived and/or modified CDS sequence (opt6) from DENV-1__FJ882558__SS-prME
  source 1..9879: mol_type = other RNA
tcagtaactatgcttctgatgttaatgcccacggcattggcatttcatttaactactagaggtggagaaccacatatgatagtgtcaaaacaagaaaggggtaaatcgcttctgttcaaaacaagcgcgggtgtaaatatgtgtactctcatagctatggatttgggagagttctgtgaagacacaatgacttacaaatgtccaaggataacggaagctgaaccagatgatgtagattgttggtgtaatgcaacagacacatgggtaacctacggaacttgcagccaaacgggagaacataggagagataaaagaagtgtcgctcttgcaccacatgtcgggcttggcttggaaacgagaaccgaaacatggatgagtagcgaaggagcgtggaaacaaattcaacgagtcgaaacctgggcattaagacacccaggctttacggtaatagcactttttctcgcacatgctattggaacttccattacacaaaaaggaatcatattcattttgttaatgctggttacaccgtcgatggcaatgaggtgcgtcggaatcggttcacgagacttcgttgaaggtctaagtggtgctacttgggtagatgtcgtattagaacacggtagttgcgtaacaacaatggctaaagacaaacctacccttgacatagaattactaaaaacagaggttacaaacccagcagttctacggaaactatgcatagaggccaaaatatccaacacaacgactgattcacgatgcccaacacaaggtgaagcaactttagttgaggaacaagatgccaactttgtatgccggcgtacattcgtagacagaggatggggaaatggatgcggactttttggtaaaggcagtttaattacttgcgcaaaattcaaatgcgtcaccaaactggagggtaaaaccgtgcaatatgaaaaccttaaatactcggtaatagtgactgtacataccggggaccaacatcaggtaggcaatgaatccacggaacatggaacaaccgcgaccataacacctcaagctcccagcacggaaattcaattgaccgattacggggctttaacacttgactgttcaccgagaactggtttggacttcaatgaaatggttcttcttacgatgaaagagaaatcgtggctggtacacaaacaatggttccttgatcttcctttaccgtggacaagtggagcttctacgagtcaggagacatggaaccgtaaggacttgctagttacatttaagactgctcatgccaagaaacaggaagtagtagtccttggctcccaggagggagctatgcataccgcactcaccggcgctacggaaatccaaaccagtgggacaacaactatatttgcagggcacttaaaatgccggcttaaaatggataaattgaccttgaaaggaatgtcatacgtaatgtgtaccggcagctttaaattagaaaaagaagtcgcagaaacgcaacacggaaccgtactggtacagatcaagtatgaaggcacagatgcaccatgtaaaatccccttttctacacaagacgagaagggcgttactcaaaatggaaggttgattactgcaaatcctatagtaacggataaagaaaaacccgtaaatatagaagccgaacctccatttggagaatcttatattgttattggagcgggagagaaggctttaaagctgtcttggttcaagaaaggaagctcaatcggtaaaatgtttgaagcaacggcgagaggagctcgaagaatggcaatcttgggagatacggcgtgggacttcggttcaataggcggcgtctttactagcgttggaaagctcgtacatcagatttttggtaccgcctatggagtcttattctcaggagtaagctggacaatgaaaatagggataggggtcttgttaacttggttaggtttgaatagcagaagcacttctttatcaatgacatgcatagcagttggcttagtaacgctgtatttaggcgtgatggtacaagcagactctggatgcgtcataaactggaaaggacgcgaacttaagtgcggatcaggaatctttgtgacaaatgaagtgcatacgtggacagaacaatacaagttccaggcagacagtccaaagagactttcagctgcaattggtaaagcatgggaggaaggcgtatgtggtataagatcagctactagactagaaaatataatgtggaaacaaatatcaaatgagttaaaccatatattgttggaaaacgatatgaagttcaccgtggtagtaggagatgttgcaggcattttagctcagggtaaaaagatgataaggccacaaccgatggagtataaatactcctggaaatcatgggggaaagccaaaataataggtgcagatgttcagaatacaacgtttataatcgacggacctaatacacctgagtgtccagacgatcaaagagcttggaacatctgggaggttgaagattacggtttcggaattttcactaccaatatatggttaaaattaagagattcgtacacccaggtatgcgatcataggctaatgagcgctgcaatcaaggattccaaagcggtccacgctgatatgggatattggatcgaatccgagaaaaatgaaacatggaaactagctagagcgtcttttatcgaagtgaaaacgtgcatttggcctaaatctcatacgttgtggtctaatggtgttttagaaagtgagatgataattccgaaaatctatggtggaccaatatcgcaacataattatcgaccagggtatttcactcaaacagcaggtccatggcatctaggaaaattggaactggatttcgatttatgcgaaggaaccacagtggttgtagatgaacattgtgggaacagaggaccctcactacgaacaacaactgtaaccggtaaaatcattcacgaatggtgttgcagatcatgcactctcccaccactaagattcaaaggtgaggatgggtgctggtacggaatggagattagaccggtcaaggaaaaggaagaaaatttagttaagagcatggtttctgcaggaagcggagaagtcgacagctttagcttgggattgttgtgtatctccataatgattgaagaggtaatgagatcgagatggtcacgaaaaatgttaatgacaggaactttagctgttttctttcttcttataatgggtcaactgacatggaatgatttaataagactatgcataatggtaggagccaatgcaagtgatagaatgggaatgggaactacatatttggctctcatggcaacgtttaaaatgaggccaatgttcgccgtgggcctactatttaggagactaacaagccgggaagtactgttgttaacaataggattaagtttagtagccagtgtcgagctacctaatagtctagaagaattaggcgacggtttagctatggggattatgatactaaaacttttaaccgacttccaatcacatcagttatgggccacgttactatcgttaacttttataaagactacattctcactccattatgcatggaaaactatggctatggtgctaagtattgtcagcttattcccgttatgtttgtcaacaacatctcagaaaaccacttggctaccagttctactagggtcattaggctgtaaaccgctgaccatgtttttaattgcagagaataaaatatggggacgtaagagctggccattgaacgaaggcataatggcagttggaattgtaagtattttactcagttccttgctcaaaaatgatgtaccactagccggtccactgatagcgggaggaatgctaattgcatgttacgtgatttcgggctcgagtgcagacttatccctagagaaagcagctgaagtatcgtgggaagaagaagctgaacactccggagccagtcacaatatccttgtagaggtccaagacgacggaaccatgaaaataaaagatgaagaaagagacgacacactcactatcttattaaaagctacactattgacagtatcaggagtttatcctttatcaatacccgcgaccctatttgtgtggtatttttggcagaagaagaaacaacgaagtggtgtattgtgggatacaccctcgcctcccaaggtagaacgagccgtcctggatgatggtatttataggattatgcaacgcggattattggggagatcacaggtaggcgttggtgtatttcaagaaaatgtattccacacgatgtggcatgttactagaggagctgtattaatgtaccaaggaaaacggctagaacccagttgggcatcggtgaagaaagacctaataagctacggaggtggctggagattacaaggtagttggaatactggagaggaagttcaagttatagccgttgagcctggcaaaaaccccaagaacgtacagaccgctcctggaacgttcaaaacatcagaaggggaggtgggcgccattgcattagatttcaaaccgggaacttcggggtcaccgatagtaaaccgagagggcaaaatagtaggattatatggcaacggcgttgtgacaacatctgggacgtacgtaagtgcaattgcccaagcgaaggcctcccaagaaggtccattaccagaaattgaagatgaagtatttcgtaagcgaaacctaacgataatggatttacatccgggatcaggaaaaacacgcagatatcttcccgccattgtacgcgaagccattaaaaggaaactacgtactctcattctcgcgcctacaagagttgttgccagtgaaatggctgaagctctaaaaggtatgccaatcagatatcaaacaacagcagtcaaatcagaacatactggaaaggagatagtagatttaatgtgtcacgccacattcacaatgcgtcttctatcaccagtccgggtaccaaattataatatgatcataatggacgaagcacattttaccgatccctcatccatagctgcgagaggttatatctcaacacgtgttggcatgggagaagcagcagccatattcatgactgccactcccccaggctcagttgaggcttttccacaatctaatgctgtgattcaagatgaagaacgcgatataccagaacgttcttggaatagtggttacgaatggataacagactttccaggaaaaacagtctggttcgtaccaagtatcaaatccgggaatgatattgcaaattgtcttcgaaagaatggaaagcgtgtaatacaactttcccgaaagactttcgacacagaataccagaaaacgaaaaacaatgactgggattatgtcgtgactacggatataagtgaaatgggggcaaatttccgagcagatagagtgatcgaccctagaagatgtttaaaaccggtcatcttaaaagacggtcctgaaagggtcatcttggcaggccctatgcctgttaccgtagcgagtgcagctcagagacgcggaagaataggacggaatcacaataaagagggcgaccaatacatttatatgggccaaccactgaataacgatgaagatcacgcacactggacggaagcgaaaatgcttttagacaacattaatacaccagagggcataatacccgctttatttgaaccagaaagggaaaagagcgcggcgatcgatggtgaatataggctaagaggagaggctcggaagactttcgtagagctaatgcgtagaggagatctaccagtatggctgagctataaggttgcatcagaaggatttcaatacagtgacagaagatggtgcttcgacggagaacgcaataatcaggtgttggaggaaaatatggacgttgaaatatggacaaaagaaggagagcgaaagaaattacggcctcgttggctagacgcccggacctattcagaccctctagctctgcgagagttcaaggagttcgctgccggtagacgttccgttagtggtgatctaattctggagataggaaaacttccacaacatctgactcaacgagcacagaatgccttggacaacttggtaatgctacataatagcgaacaaggtgggagagcatatcgacatgcaatggaagaattacctgacacaatagagactatgatgctattagcattgattgcagttctaacaggaggagttacgctattctttctcagcggaagagggctaggaaaaacttctataggattattatgtgtcatggctagcagcgtactgctctggatggcttccgtcgaaccgcattggattgctgcatcaatcattttggaatttttcttgatggtactattaataccggaacccgacagacaaagaacaccgcaagataatcagctagcttatgtagttataggcctactcttcatgatattgacagtagctgcaaatgaaatgggacttctcgaaacaaccaagaaagacttaggaataggtcatgttgcagttgaaaaccatcaccatgccgctatgttggatgtcgatcttcatccagctagcgcgtggacactgtatgcagtagctactacaattatcacccctatgatgagacatactattgagaacaccacagcgaacattagcttgacagctatagcaaatcaagcagcaattctaatgggtctagataaaggatggcccattagtaaaatggatataggagtacccttattggcattaggatgctactcgcaagtaaacccattaacgttaactgccgctgtgctcatgttagtagcccactacgctataattggacccggattacaagcgaaagccacccgcgaggctcagaaacgcacggcagcaggaatcatgaaaaatccaaccgtagatggtatagtggcaatagacttagatccggttgtgtatgacgctaaatttgaaaaacaattaggccagattatgctactaatcttatgcacatcccagatcttactgatgcgtacaacttgggctttatgtgagagcataactttagcaaccggtcccctaactacactttgggaaggcagtcctggcaaattttggaatacaacaattgcggtgtcaatggctaacattttccgtggatcatatttagccggtgcaggattagcttttagcttaatgaaaagtctgggaggtggaagaagaggaacaggagcacaaggtgaaaccttaggtgaaaaatggaaacgacagttaaatcaactctcaaaatccgagtttaatacctataaacgttcaggtataatggaggtcgaccgatcagaagctaaagaaggcctaaagcgaggagagacgacgaagcacgccgtatcaagaggaacagctaaattacgatggtttgtagagcggaatttagttaaacctgaaggtaaggtgatagacttaggttgcggtagaggtgggtggtcgtattactgtgcaggtcttaagaaagtcactgaggtaaaaggctacacgaaaggaggaccaggacatgaggagcccataccgatggcaacgtatggatggaacctcgtaaaactgcattcaggcaaagacgtcttctttatcccacccgaaaaatgtgatacgctactctgtgatatcggagagtcttcacctaaccctactatagaagaagggagaacactgcgagtactgaaaatggtagaaccatggttacgcggaaatcaattttgcatcaagatccttaacccatacatgccaagcgtcgttgaaactcttgaacaaatgcaacgtaaacatggcggtatgcttgttaggaatccgttgtctagaaattcgactcatgaaatgtactgggtctcatgtggtactggaaacattgtatcagctgtaaatatgacatctcgtatgttactaaatagatttacaatggctcatcgaaaacccacatacgaaagagacgtagacttgggtgcaggaacaagacatgtcgctgtcgaaccagaagtagcgaacttagatataataggtcagaggatagaaaatattaaacacgaacataaatcgacgtggcactatgatgaagataatccatacaaaacgtgggcctaccacggatcgtatgaagtgaaaccgtcagggagcgctagtagtatggtaaacggtgtcgtaaaattattaactaaaccttgggatgtcattcctatggttacacagatcgcaatgaccgatacgacaccgttcggacaacagagggtttttaaagaaaaggtcgacacacggacccctaaagcaaaacgtggaactgcacaaattatggaagttacagccaagtggctatggggctttttgagtaggaataaaaagccgcggatttgcacaagggaagaatttacaaggaaagtaagatcaaatgccgccattggtgcggtatttgtagacgaaaatcagtggaactcagcgaaagaagccgtcgaagatgaaagattttgggatttagtacatagagaacgggaattacataagcaaggtaaatgcgcaacatgtgtatataatatgatgggaaaacgcgaaaagaagttaggtgaatttggaaaggcgaaaggtagcagagcaatatggtacatgtggttaggtgccagatttttggagttcgaggcactgggatttatgaatgaagatcattggtttagcagggaaaattccttatcgggtgtggaaggtgaaggtttgcataaactcggctatattctgcgcgatatttctaaaatacctggaggaaacatgtatgccgacgatacagccggatgggacacacgtattactgaagacgatctgcaaaatgaagccaagataacagacataatggaacctgaacacgctttactagcaaagtcaatatttaaactcacataccaaaataaagttgtacgagtacaacgaccagcgaaaaatggaacagtaatggacgtaatttcgagacgtgatcaaagaggctcgggtcaagtaggtacatatggattaaatacatttacgaacatggaggcacaactgatacgacagatggaatcagagggtatattttcaccttcagaactagaaactccaaacctagctcgacgcgtcctcgactggttggaaaaacacggcgtagaaagattaaagagaatggctataagcggcgatgattgcgttgttaaaccgatagatgatagatttgctacagctctcacagctttaaatgatatgggaaaagtaagaaaagatatccctcaatgggaaccctccaaaggttggaacgattggcaacaagtaccattctgttctcatcattttcaccaattgatcatgaaagacggccgcgaaattgtagtaccctgtagaaatcaagacgagctagtgggcagagcaagagtcagtcaaggagccggctggagcctgagagaaaccgcatgcctgggaaagagttatgctcaaatgtggcaattgatgtacttccacagacgagacctacgattagctgcaaacgcaatctgctcagccgtacctgttgattgggtaccgacaagtagaacaacttggtcaatccacgcacaccaccaatggatgacgacagaagatatgttaagcgtatggaatagagtgtggatagaagaaaatccctggatggaagataaaacacacatcagctcgtggggcgatgtaccgtacttgggtaagcgtgaagaccagtggtgcggaagccttatcggattaactgcccgcgcaacatgggccacgaatatccaggtagcgattaaccaagtgcgacgactaataggcaacgagaattatttagattacatgacctctatgaagagatttaagaacgaatcagaccctgaaggggccttatggtaa

SEQ ID NO: 21707 - RNA, 9879 nt, synthetic construct
  misc_feature 1..9879: note = derived and/or modified CDS sequence (opt6) from DENV-1__GQ199824__SS-prME
  source 1..9879: mol_type = other RNA
tcagtcacaatgctgcttatgcttatgcctacagcgttagcttttcacctaacaaccagaggaggtgaacctcacatgatagtttcgaaacaagaaagaggaaaatcactattattcaaaacttcggcgggagtaaacatgtgcacccttattgcaatggatctaggagaattttgcgaagacaccatgacatataaatgccctcgaataactgaagcagaaccagacgacgtagattgctggtgtaacgcaaccgatacatgggtaacatacggaacttgcagccaaacaggagaacatagaagagataaaagaagtgtggcgctagcgccacatgttggtctcggacttgagacaagaacagaaacctggatgagctccgaaggagcatggaaacaaatacaacgtgtagaaacatgggcattgcgacatccagggttcactgtaatagcactgtttttagcacatgctataggaacaagtatcacccaaaaagggataatttttatactcttaatgttagtaacaccttcgatggcaatgagatgcgtgggaatcggaagccgagactttgtagaaggactgtcaggcgctacctgggtagatgttgttttagaacacggttcgtgtgttacaactatggccaaagataaacctacattggacattgaattattgaaaactgaggtaactaacccagcggtattaaggaaactttgtatagaagcaaaaatatctaatactaccacggatagccgatgcccaacccaaggtgaagcaaccctcgtcgaggagcaagacgccaacttcgtttgccggaggacctttgtagacaggggttggggtaatggatgcgggttattcggtaaaggcagcttgataacatgtgcgaaatttaaatgcgtgacgaaactagaagggaaaaccgtacaatatgaaaatctgaaatactctgtgatagtaacggttcacacaggagatcaacatcaagttggcaacgaaagcacagaacacggaactaccgcaactattacgccacaagcaccaagtactgagatacaacttactgattatggcgcactcacactagactgcagcccacggacaggattagattttaatgagatggtcctccttactatgaaagagaaaagctggctggtccataaacaatggttcttagatctacctttaccttggacaagtggagctagcacaagtcaagaaacctggaatcgaaaagatctacttgtaacatttaaaactgcacatgctaagaaacaagaagtggtggtactagggagccaagagggcgccatgcatacggctcttaccggagcgactgaaatacaaacctcaggaacaacaactatatttgcaggccatttaaaatgcagactcaaaatggataaattaacactcaaaggtatgtcatacgtaatgtgcactggttctttcaaactagagaaagaagtagctgagactcaacacggcacagtcctagttcaaattaaatatgagggtactgatgctccatgcaaaataccttttagtacacaagacgaaaaaggggttacccaaaatggtaggttaattactgcgaacccaatagttacagataaagaaaaacctgtaaatattgaggctgaaccacctttcggtgagagttatatcgtaatcggagcgggagagaaggctttaaaattgagttggttcaagaaaggttcaagcatcggaaaaatgtttgaagctacggcccgaggcgcaaggagaatggcaatattaggcgatactgcgtgggattttggatcaataggaggtgtgtttacttcagtgggcaagctagtacatcagatttttggaacagcatatggtgttctatttagtggagtatcctggacaatgaaaataggcataggggtgcttttgacctggttaggattgaactcaagaagcacaagtttaagcatgacttgtatcgcggtagggctagtaactctttacttaggagttatggtgcaagctgactcaggctgcgtaataaactggaagggtagagagttgaagtgtggaagcggaatttttgtaacaaacgaggtacatacttggacagaacaatacaaatttcaagctgacagcccaaaacgtttatctgcggcaatcggtaaagcatgggaagaaggcgtatgtggaatcagatctgcaactaggctagagaatataatgtggaaacagatattaaacgaattaaaccacattcttcttgagaacgacatgaaatttacggtggttgtaggcgacgtagctggtattctcgcacaaggtaagaaaatgattaggccacaacctatggaatataaatatagctggaagtcatggggaaaagctaagataattggtgcagacgtacaaaacactaccttcataatagatggtcctaacacacctgagtgccccgatgatcaaagagcctggaatatatgggaagtagaagattatggatttggaatatttacaactaacatatggttaaaacttagagattcatatactcaagtctgtgatcatcgtttaatgtccgcagcaataaaagattctaaagccgtccacgcggacatgggatattggatagaatccgagaagaatgaaacctggaaactagcacgggcaagttttattgaggtaaaaacatgtatctggcccaagagtcacacactatggagtaacggtgtgttagagtccgaaatgataatcccaaaaatatatggaggcccaattagccaacacaattataggccaggatactttacgcagacagccgggccatggcacttgggtaagctcgagttagattttgacttgtgcgaaggtacgacagtagtagtagatgagcattgcggaaacagagggccatcattgaggacgactacagtgacgggtaagattatacatgaatggtgctgcaggtcgtgtacactcccaccgctgaggttcaagggggaagatgggtgttggtacggaatggaaatccgaccagttaaggaaaaagaagaaaatcttgtaaagtctatggtttcagccggcagtggggaagtggacagttttagcttgggcttgttatgcatttcgattatgattgaagaagtcatgcgatccagatggagtcgcaaaatgttaatgacaggaaccttagcagttttctttctactaataatgggacagttaacgtggaatgatttaatcagactctgcataatggtaggcgcgaatgcgtcggacaggatgggtatgggaaccacttatctggcattgatggccacttttaaaatgaggcccatgtttgccgtaggattattattcaggagattgacgagtcgagaggttttattgctcacgatcggtctaagtcttgtcgcatcggtcgagctgcccaacagtttggaagaactcggggatggcttagctatgggtattatgattctaaagctactcaccgactttcaatcgcatcaattatgggctacattactgagtcttacctttataaaaacaactttttcgcttcattacgcctggaaaaccatggctatggttttgtcaatagtttcgttatttcctttatgcctttctacaacttcacagaaaaccacatggttaccagtgctattgggaagtttaggttgcaaaccactcacaatgttcttaatagctgagaacaaaatttggggcagaaaatcctggccattgaatgagggaataatggctgtgggaattgttagcatcttgttaagtagtctgctcaaaaatgatgttccattagcgggacctctcatagcaggaggaatgctaatcgcgtgttacgtgatttcgggaagttcagccgatctttctctggaaaaagctgcagaagtgtcctgggaagaagaagctgaacatagcggagcaagtcacaatattttagtggaagtgcaagatgatggaactatgaaaataaaagacgaagaaagggacgatacactaacaatactactaaaggcaaccttattagcagtcagtggagtctacccacttagtataccagctactttatttgtctggtatttttggcagaagaagaaacaacgctctggtgtactatgggatacaccatcgccgcccgaggtggaacgagccgtcttagatgacgggatatacaggataatgcaaagaggccttttgggccgcagccaagtcggagttggagtttttcaagagaacgtattccacacaatgtggcacgtaactagaggagccgtactaatgtaccaaggaaaaagattagaaccatcttgggccagtgttaagaaggatttaatatcatatggaggtggctggcgtttacaaggtagctggaacacaggtgaagaagtccaagtcatcgctgtcgagccgggcaagaaccccaaaaacgtacagacagctccagggacattcaaaaccagcgaaggagaagttggtgcaatcgcgttagacttcaaacctggaacttcgggctccccaatcgtaaacagagaaggcaaaatagtgggactgtatggcaatggtgtagtaactacgtctggtacgtacgtttcggcaattgctcaagccaaagcaagccaggaaggtccattacctgagatcgaagatgaagtattccgcaaaaggaacctaacaattatggatttacatcctgggtctggaaaaactagaagatatttaccagccatagtccgggaagctataaagcgaaaactacgcacgctaattctagctcctacaagagtcgtggcatctgagatggctgaagctctcaaaggcatgccaattaggtatcaaacaacagcagtaaaatcagaacataccggaaaggagatcgttgacctaatgtgccatgccacttttaccatgagattactttctccagttagagtccctaattacaacatgataatcatggacgaggctcactttacggacccatcgtcaattgcggctcgaggctatattagtaccagggtgggaatgggagaggcagcagcaatctttatgactgctactcctcctggttcagtagaggcctttccacaaagcaatgcggtaatacaagatgaagagagagacatcccagaacgtagttggaactctggttacgaatggataacagacttccccggcaagacggtctggtttgtgccatcgataaaatcgggcaatgatatagcgaattgtctaagaaagaatggcaaaagagtaatccaactatcaaggaaaaccttcgacaccgaataccagaaaactaagaataatgattgggattatgtagtgactacggacatatcagaaatgggagctaattttagagctgatcgtgtgatagaccctcgtagatgtctaaaaccagtcatcctaaaggatgggcccgagagagttatattagctggcccaatgcctgttactgttgcaagtgccgctcaacgtagaggtagaattggcagaaaccacaataaagaaggcgaccaatatatttacatgggacaaccattaaacaacgatgaggatcacgcgcattggactgaggccaaaatgctactcgataatataaatacaccagaaggtattatcccagcactttttgaaccagaacgagaaaagagcgctgcaatagatggcgaatatagactacggggtgaagccagaaaaactttcgtagaactgatgaggaggggtgatttgccagtctggctatcctataaagtcgcatcagaaggtttccaatatagcgaccggcggtggtgctttgacggagagcgaaataatcaagtattagaagaaaatatggacgttgaaatttggaccaaagaaggagaaaggaagaaactccgtcctagatggttagacgctagaacatactctgatccactagctctcagggaatttaaggagttcgccgctggtagaagatccgtaagtggtgatctaattttggaaatcggtaaattacctcaacaccttactcaacgagcacaaaatgcactggataatttagtgatgctacataatagtgagcagggcggcagggcatatagacacgccatggaagaactgcccgacacaatagaaacactaatgcttttagcacttatcgctgttttgacaggcggcgtcacattatttttcttatcgggtcgaggtctagggaaaacatcaataggtctactatgcgtcatggcgagttcagttctactatggatggcatcagtagaacctcattggatagcagcaagtataatattggagttctttctcatggttctactgatccctgaaccagacagacaacgaacgcctcaagataaccaattagcttatgttgtaattggacttcttttcatgattctaactgtagctgcaaacgaaatgggacttctagaaactacgaagaaagacctaggtattgggcacgttgccgtcgaaaatcatcaccacgcggcaatgctagacgttgacctacatcccgcatcagcatggaccctatatgcagtggcaaccacgataattacgcctatgatgcgacatacgatagaaaatactacggcgaatatctcccttacagcgatagcgaatcaagctgctatactaatgggactggataaaggatggccaattagcaagatggatataggagttcctttacttgcattaggttgttacagtcaagtaaaccccttgacattgactgcggccgttttgatgctagtagcacattacgctataataggaccgggactccaagcaaaagccacccgagaagctcagaaaagaaccgcagctggtataatgaagaatcctactgttgatgggatagtagccattgacctagatccagtagtctacgatgcaaagttcgaaaaacaactaggacaaattatgctactaatattatgcacatctcaaatactactaatgagaacaacatgggcactgtgcgagtcaataactctagcaactggtccattgacgacactatgggaaggatcgccaggtaaattttggaatacaacaatcgcagtttctatggctaacatatttagaggctcgtatttagcaggcgcgggtttagcattctccttgatgaagagtctcggcggaggcagacggggtactggcgcacaaggagagacccttggcgaaaaatggaaaaggcagttaaatcagctaagtaaatcggaatttaacacgtacaaacgttcaggaatcatggaagtagatcggtcagaggctaaagagggccttaaaagaggagaaacgacaaaacacgcggtctcgcgaggcactgcgaaactgcgatggttcgtagaacgtaatctggtcaaaccagaaggaaaagtaatagatttaggatgtggtcgtggaggctggtcgtactactgtgcaggactcaagaaagttaccgaagtaaagggttatacaaaaggtgggccaggacacgaagaacccatcccaatggcaacctatgggtggaatttagtcaaattgcattctggaaaagatgtattctttattccaccagagaaatgtgataccctgttatgcgacatcggcgaatcgtctcctaatccaacaattgaagaaggtagaactctacgcgttctgaagatggttgagccctggcttcgcggcaatcaattttgtattaaaatactcaacccatatatgccatctgtagtagagacgttagaacagatgcaacggaaacacggcggcatgcttgtccgcaatcctctgtctaggaactcaactcatgaaatgtactgggttagctgcggcacaggtaatatcgtaagtgccgtaaatatgacatctagaatgttattgaacagattcacgatggcacatagaaaaccaacgtatgaacgtgacgtggatcttggagcaggcacaagacatgtagccgttgagccagaagtagctaacttagacataataggacagcgcattgaaaatattaaacatgaacacaaaagcacatggcactatgacgaagataatccctacaaaacatgggcataccatggctcttacgaagtaaaaccgtccggttcagcaagttcaatggttaatggagtcgttaaactccttacaaaaccttgggatgtaataccaatggtaacacagatagctatgacagataccacaccatttggacagcagcgtgtatttaaggaaaaagtggatacaagaacacctaaggcaaagagaggaacagcacaaattatggaagttactgcaaaatggctctggggatttttatcgagaaacaagaaacccagaatatgtaccagagaggagttcaccagaaaagttcgaagcaatgctgcaatcggcgcagtatttgtagacgagaatcagtggaactctgccaaagaggctgtcgaagatgaacgcttctgggacttagttcaccgcgaaagagaactgcataagcaagggaaatgcgctacatgtgtatacaacatgatgggaaagagggagaagaaattaggagagttcggtaaggccaaaggatctagagcaatatggtatatgtggttgggcgctagattccttgagttcgaagcattagggtttatgaatgaagatcattggttctcccgagaaaatagtttatcgggcgtggaaggagagggtctacataaactcggatacatcctaagggatatttcaaaaatacccgggggtaatatgtacgctgatgacacagcagggtgggatactcgaataacagaggacgatttgcagaatgaagcaaaaatcacagatatcatggagcctgaacatgctctcctcgctaaatcaatctttaaattaacataccaaaataaagtagttagagtgcaaaggccagctaaaaacggtactgtcatggacgtcatctccagaagagatcagcgcgggtcaggtcaagttggaacgtatggtttaaatacttttacgaacatggaagcgcaactgattaggcaaatggaatcagaaggcatcttcagtccatcagaattagaaacaccgaacttggcaggtcgagttttagattggctagagaaacatggggttgagcgacttaaacgaatggccatatccggtgacgattgtgttgttaaacccatagatgaccgcttcgctaccgccttaaccgcgcttaatgacatgggaaaagtacgcaaggacatcccgcagtgggaaccatctaagggctggaatgactggcaacaagttcccttctgttcacaccattttcatcaacttataatgaaagatggcagagaaatagtagtcccttgtagaaaccaagatgagttagttgggcgagcacgtgtctctcaaggcgcgggatggtctttacgagaaactgcttgcctaggcaaatcatacgcccaaatgtggcaattgatgtactttcacagacgggatttacgcctggcagcaaacgccatatgtagcgctgtaccggtagactgggtccccacatcaagaacgacttggtcaatccacgcacaccaccaatggatgactaccgaggacatgctctctgtttggaatagagtatggattgaagaaaatccatggatggaagacaaaacacacatttcttcctggggagatgttccctatctgggtaagagggaagaccaatggtgtggcagcttaataggacttacagcccgagccacctgggctacaaatatacaggttgcaataaatcaagtacgtagactgataggcaacgagaactatttagactatatgacatctatgaaacgtttcaaaaatgaaagtgacccagaaggtgcattatggtga

SEQ ID NO: 21708 - RNA, 9879 nt, synthetic construct
  misc_feature 1..9879: note = derived and/or modified CDS sequence (opt6) from DENV-1__FJ882559__SS-prME
  source 1..9879: mol_type = other RNA
tccgtgacaatgctattaatgctcatgccaacagcattggctttccatctgaccacacgcggaggtgaaccacatatgatcgtatcaaaacaagaacgaggtaaatctttgcttttcaaaacttcggctggtgtgaatatgtgtactcttatcgcaatggatttgggtgaattttgtgaagacacaatgacatataaatgtcctaggattacagaagcagaacccgatgacgtggattgttggtgtaatgcaacagatacgtgggtaacttacggaacttgctcacaaacgggagaacatcgaagggataaaagaagtgtagctctcgcacctcacgtagggctaggactagaaactcggacagaaacttggatgtcaagtgaaggcgcatggaagcaaattcaacgtgtcgaaacctgggccttacgacatccaggattcacggttatagctctattcctcgctcatgctataggcacaagcataacacaaaaaggaattattttcattcttttaatgttagtcaccccatccatggcgatgcgttgcgtaggcattggaagcagagattttgtggaagggttatcaggggcaacctgggtcgacgttgtcctagaacatggatcctgcgtaactacaatggctaaggataaaccaactcttgacatagaattactaaaaacagaagtcacgaatccagctgttttgcgcaagttgtgtatcgaggcgaaaatatccaacacaaccacagacagtcgttgtcctacacaaggcgaagcaaccctagtggaagaacaagacgcgaacttcgtttgtagaagaacctttgttgatagaggctggggaaacgggtgtggtctatttgggaaaggaagccttatcacatgtgccaaattcaaatgtgtaactaagctagaaggaaagattgtccaatatgaaaacctaaagtattcagtcattgtaacagtgcatactggtgatcaacatcaagtaggaaatgagagtacggaacacggtacgacagccacgataacaccccaagcacccagcacagagatacaactaacagattacggagcacttaccttagattgcagtcctcgaactggcttagactttaacgaaatggttctgctgacaatgaaggagaaaagttggttagtacataaacagtggttcctagacttacctttgccgtggacatctggagcatctacttcacaagaaacttggaatcggcaggacctactggtcacctttaagaccgcacacgctaaaaagcaagaagtggtagtattggggtcacaagaaggagcaatgcacaccgccttaacaggcgcaactgaaatccaaacaagcggaacaaccactatatttgcaggacacttaaaatgtcgtctaaaaatggataaattaacgctaaaaggaatgagctatgtaatgtgtacaggttcctttaaattagaaaaagaagtcgcagaaacccaacacggcacggtcttagtacagataaaatacgaaggtacagatgctccgtgcaaaatccctttctctacccaagatgaaaagggcgtaacccaaaatggccgtttgataacagcgaatcccatagtgacagataaagaaaaacctgttaatatagaagcagaaccaccattcggtgaatcctacattgtaataggagctggcgaaaaagcattaaaactatcgtggtttaagaaggggagtagcataggcaagatgttcgaagcaaccgcgcggggagcgagaagaatggcaatattaggtgatactgcgtgggactttggatcgataggaggagtcttcacaagcgtagggaaacttgtacaccaaatctttggtactgcatacggtgtattgttttctggcgtgtcttggacaatgaaaataggaatcggggtgttgttaacatggcttggtcttaatagcagatctacgtctctttcgatgacgtgcattgccgtgggattggtaactttatatctcggggttatggtacaagcggactccggctgtgtgataaattggaaaggcagagaattaaagtgcggttccggaatattcgtgacgaatgaagttcatacatggactgaacagtataaatttcaagccgactctcctaaaagactttctgctgcaataggtaaagcgtgggaagaaggagtttgtggcattcgttcagccacaagattagaaaatatcatgtggaaacaaatttctaatgaactaaaccacattttgctggaaaatgacatgaaatttactgtagttgttggtgatgttgcaggcatcttagctcagggcaagaaaatgattcgaccacaaccgatggagtataaatatagctggaaaagctggggaaaagcaaggatcatcggagcagacgttcaaaatactacatttataattgatggccctaatacaccggaatgcccagatgatcaacgagcgtggaacatatgggaggtcgaagattatggtttcgggatatttactaccaacatttggttaagattacgtgacagttacacacaagtttgtgaccacagactcatgtccgcagctataaaagacagcaaagcagtccacgcagatatgggatattggatagagagtgaaaagaatgaaacatggaaattagcccgggctagtttcatcgaagttaaaacctgcatttggcctaaatctcatactctatggagtaacggtgtattagaatcagaaatgattataccaaagatttatggaggaccgatcagccaacacaactatagaccaggatatttcactcaaactgccggaccatggcacttaggtaaactcgaattagatttcgatctctgtgaaggtaccactgtcgtagtcgacgaacactgtggaaatcgaggcccatctttacggactactacagtgactgggaaaatagtccacgagtggtgttgcaggtcatgcacactgccaccactgaggttcaaaggcgaagacggatgctggtatggtatggaaatacgcccggtaaaagaaaaagaagaaaatctggtaaaatctatggtatcagcaggttccggagaagtagattctttttctctgggattactctgtataagcattatgatcgaagaagttatgaggtcaagatggagtagaaaaatgttaatgacgggaacactggctgtatttttcttactcatcatggggcagttgacatggaatgatttaatcagactgtgtatcatggtaggagcaaacgcatcagacagaatgggaatgggaatgacatacctcgctttgatggcgacatttaaaatgcgacctatgtttgccgtgggactgctatttcggcgccttacaagcagggaagtactcctcttaacaatagggctttccctagtggcatcagccgaattaccgaatagtctcgaggagctaggtgatggattagcaatgggcataatgatactaaaacttctaacagattttcaatcacaccaactttgggcaaccttactctcactgacattcattaaaacaacattcagtctacactatgcatggaagacaatggcaatggtcttatcgatagtttctctgttcccactttgtctgtctactacctcacagaaaacgacttggttgccagttttactagggagtttgggatgcaagcctctaacaatgtttctgattgcagaaaacaaaatctgggggcgtaaatcatggcccctaaatgaaggtattatggcagtaggaatagtgtcaatactgctaagttccttactaaagaatgacgtacccttagcaggtccgctgatcgcgggtggtatgctaatcgcttgctatgtgataagcggatcgtcagcagatctcagccttgagaaagcggcagaagtatcttgggaggaagaagcagaacacagtggtgcaagtcacaacatactcgtggaggttcaagatgacggaacaatgaaaatcaaagatgaagagagagatgacaccttgactatcttattaaaagccaccctactagcggtttcgggcgtatacccgctttccattcccgccacattattcgtctggtatttttggcagaagaagaaacaaaggagtggagtactttgggacacacccagcccaccagaggttgaaagggcagttctcgatgatggcatctatcgaataatgcaaaggggattattaggcagatctcaggtcggagtgggagtctttcaagaaaatgtattccacacgatgtggcacgttactcgaggggctgttctaatgtatcaagggaaacgactagaaccgtcatgggcatcagttaagaaagatttaatatcttatggcggtggatggcgcctgcagggaagctggaacactggagaagaagtccaggtaatagcagttgagcctggcaaaaatcctaaaaacgtccaaacagcaccaggaacttttaaaacatctgaaggagaagtaggagccattgcattagattttaaaccaggcaccagtggaagccccatcgtgaatagggaaggtaagatagtcggcctatatggaaacggggtagttactacatcaggcacctatgtatcagcaatagcacaagcgaaggcctcacaagaaggcccattgccagaaatagaggatgaagttttccggaaaagaaatctaacaataatggacttacatccgggttctggcaaaacgagaaggtatctacctgccatcgtgagggaagcaataaagagaaagctgagaacactaattttagcaccaacccgtgttgttgcttcggaaatggcagaggcactgaagggaatgccaatacggtaccaaactacagcagtaaaatccgaacatacgggcaaggaaatcgttgacctcatgtgtcatgcaacctttacaatgcgacttttatccccagtaagggtacctaactataatatgataattatggatgaggcccatttcacggacccgagttcgatagcagcaaggggttatataagtactagagttggcatgggggaggcagccgcaatattcatgaccgctaccccacctggaagcgtcgaggcttttccgcagtcaaatgctgtcattcaagatgaggagcgagacatacctgagaggagctggaactcggggtacgaatggataaccgatttcccaggtaaaactgtttggttcgtgccaagtataaaaagtggaaatgacatagcaaattgcctaaggaaaaatggaaaacgcgtaatccaactttcaagaaaaacttttgacactgaatatcagaaaacgaaaaataatgattgggactatgttgtaaccactgatattagcgagatgggagctaatttccgagcggatcgggtcattgatccgcgccgttgcttaaaacccgtaattctgaaagatgggccagaaagggttatactagcaggaccaatgccagtgaccgtagcaagcgcagcgcaaagacgggggagaattggaagaaatcataacaaagaaggtgatcaatacatatatatgggacaacctttaaacaacgacgaagaccacgcccactggacagaagcgaaaatgttgctagacaacataaacacaccagaaggaatcatacccgctctatttgagccagaacgagagaagagtgcagctatagatggagagtacagattaagaggagaagctcggaaaacttttgtagaactaatgcgaagaggggatctccccgtttggttaagctataaagtcgcttcagaaggattccaatactctgaccgacgctggtgcttcgacggcgaacgtaacaatcaagtattagaggagaacatggatgtagaaatatggaccaaagaaggcgaacgcaagaaacttaggccaagatggctagacgcccgtacatatagtgacccgcttgcgttaagggaatttaaagaatttgctgctggacgaaggagtgtatcaggagacctcattctcgaaatagggaaattgcctcagcatttgactcaaagggcgcagaacgccctagacaatctggtaatgttacataatagcgaacaaggaggtagggcatatcgccatgctatggaagaattacccgacacaatagaaactttaatgctactagctttgatcgctgtactaacagggggagtaacactattctttttaagtggcagaggccttggaaagacaagtatcggattgctttgtgtaatggcatcatcagttttattatggatggcctccgttgaaccgcattggattgcagcttccatcatacttgaatttttcctaatggtactactaatccctgaacccgacaggcaacgaacaccacaagataatcagttagcgtatgtagtaattgggttattatttatgatactcaccgtagctgctaatgagatgggactactggagactacaaagaaagatttaggtatcgggcacgtagcagtagaaaatcatcatcatgctgcgatgttggatgtcgatttacatccagcgtctgcatggacactctatgcagtcgccactacaattataactccgatgatgaggcacacaatagagaatacaacagcgaacatctcacttactgccatagcgaaccaagcagcgatattaatggggttagacaaaggctggcccatatctaaaatggatataggagtgccattactcgcacttggatgttatagtcaagttaaccctttgacactaacagcagctgttctgatgctagtagctcattacgccattattggtcctggattacaagcaaaagcaactcgagaagcgcagaaacggactgctgcaggaataatgaaaaatccaacggttgatggtatcgttgcaatagacttagatcctgtggtttatgatgcaaaattcgaaaaacagttaggacaaatcatgctactcatactatgtacatcgcagatattattgatgcggaccacatgggcactctgtgaatcaatcacattagcaaccggaccactcacaaccttatgggaagggtcacctggaaaattctggaataccactatagccgtaagtatggcaaatatatttagaggcagttatttagcaggggccggattggcttttagtctcatgaaatcactagggggtggaagaagaggaacgggagcacaaggcgagacattgggtgagaaatggaaaagacagctgaatcaactcagcaaatctgaatttaatacttacaaaagatctggaataatggaagttgatagaagtgaagcaaaggaaggactgaaacgaggagaaactaccaaacatgctgtttcacgaggcacggcaaaattaagatggtttgtggaaagaaatttagtaaaaccagagggtaaagtaatagaccttggatgtggcagaggtgggtggtcttattactgcgctgggctaaagaaagttacagaagtgaaaggctatactaaaggcggtcctggtcacgaggaaccaattcctatggctacgtacggatggaacctagtaagactacatagtggcaaagacgtattctttactcccccagaaaaatgtgacacactcttgtgcgatatcggcgaatctagtccgaaccctacaatagaggaaggacgcaccctccgagtactcaaaatggtagaaccctggttgagaggcaaccagttttgcatcaaaatactgaacccatatatgccatctgttgtagagacattggaacagatgcaacgaaaacacggcgggatgcttgtgagaaaccccttgtcacgtaactccacgcatgaaatgtattgggtttcctgcggcacagggaacatcgtgagtgccgtaaacatgacttctcgaatgctcttaaacagatttactatggcacatcgcaaacctacgtatgagagagatgttgatttaggcgcgggtacgcgacatgtcgctgtggaacctgaggtggctaacttggatataataggacaaagaattgaaaatataaaacatgaacacaagagcacatggcactacgatgaggacaacccatacaaaacatgggcctatcatgggtcatatgaagtaaaaccatcaggtagtgcttcatctatggtaaacggcgtcgtgaagttactaaccaaaccatgggatgtcatacctatggtcacacaaattgcaatgactgatacaaccccatttggtcaacagcgcgtatttaaggaaaaagtagacacacgcactccgaaagcgaaacgaggcaccgtgcagataatggaagtgactgcaaaatggctttggggattcttatcaaggaataagaaaccgcgaatttgcacgcgggaagaatttacacgaaaagtcagatctaatgcagctataggggcagtttttgtagatgaaaaccaatggaactccgcaaaagaagcagtagaggatgaaagattttgggatcttgtacaccgagagcgggagttgcataaacaaggaaaatgtgcaacatgtgtatacaatatgatgggcaaacgcgagaagaaattgggtgagtttggaaaagccaaaggatcacgcgccatatggtatatgtggttaggagcaagatttttagaatttgaagcattaggttttatgaacgaagaccattggtttagccgagaaaatagcctatcaggtgtcgaaggtgaaggccttcacaaactcggatatattctacgggatatttcaaagatccctggcggaaacatgtacgcagatgatacggcaggatgggacactcggataactgaagatgacttacaaaacgaggcaaaaataacggacataatggaacccgagcatgcattgctagcaaaaagcatatttaaactgacttatcagaataaagttgtacgagtacaacgcccagcgaagaacgggacagtcatggatgttattagtagaagagatcagaggggctctggtcaggtaggcacatatggtctaaatacctttactaatatggaagcacagttgataagacagatggaaagtgaagggatattttcaccatctgaactcgagacaccaaacttagcagaaagagctttggactggttagaaaaacacggagtcgaacgtttaaaacgcatggcgatatctggagacgactgcgtagtgaaaccgatagatgatagattcgcgactgcattaactgctttgaatgacatgggtaaagtcagaaaagatattccacagtgggagccttcaaaagggtggaatgattggcagcaagtaccattttgtagtcatcattttcatcaactaataatgaaagatggaagagagatcgtagttccgtgtagaaatcaagatgagttagtaggacgagcacgggtttcacaaggagcaggatggagtctaagagaaactgcctgtttaggcaagagctatgcccaaatgtggcaacttatgtatttccatagacgagacctccgattagctgcaaacgcaatatgttcagcagtaccggtggactgggtcccaactagccgtactacatggtccattcatgcgcaccatcaatggatgactaccgaagatatgctatcagtttggaatcgtgtatggatagaggaaaatccttggatggaagacaaaacacatatttcatcatggggtgacgtgccatacctaggtaaaagagaagatcagtggtgcggaagcctaattgggctaactgccagggctacatgggcaacgaacatacaagtggctataaatcaagtaagaaggcttattggcaatgagaattatttggactatatgacaagcatgaagaggttcaaaaatgaaagtgaccccgaaggagcactttggtga

SEQ ID NO: 21709 - RNA, 9879 nt, synthetic construct
  misc_feature 1..9879: note = derived and/or modified CDS sequence (opt6) from DENV-1__GQ199828__SS-prME
  source 1..9879: mol_type = other RNA
tctgttacaatgctattaatgttaatgccgacagctctagcttttcatttaacaacgcgtgggggagaaccacacatgatagtttcaaaacaagaaagaggcaaatctctgctctttaaaacgtccgcaggagttaatatgtgcactttaatagcaatggatctaggagagctatgcgaggacaccatgacttataaatgcccacgaataactgaagcggaacctgatgatgtcgattgctggtgtaatgcaacagacacatgggtaacatatggaacttgctctcaaactggggagcatcgcagagacaaaagatcagtggcgctcgcaccgcatgtaggtttggggttagaaacgcgaactgaaacatggatgagcagtgaaggagcttggaaacaaatacaaagagtagaaacatgggcattaagacatcctggctttaccgtaatagctttattcttagcacacgctatcggaacaagtataacacaaaaaggtataatatttatccttttaatgctagttacgccttcaatggcaatgaggtgtgtaggaataggatctagagattttgtagaaggattaagtggtgcaacatgggtagatgtggtcttagaacatgggtcgtgtgttacaacaatggcaaaagacaaacctactttggatattgaactgcttaaaacggaagttaccaatccggcggtgttacggaaactatgtattgaagctaaaattagcaatactactaccgatagcagatgcccaacacagggagaagcaactttagtcgaagaacaggacgccaatttcgtttgtagaagaacttttgttgaccgcggctggggaaacggctgtggtttgtttggtaaagggagtttaataacttgtgctaaatttaaatgtgttaccaagttagaaggcaaaattgtacaatatgaaaatttaaaatattcagtaatcgttacagtacatacaggtgaccaacatcaagttggaaatgaatccacagagcacgggactacagctacgattacaccacaagcaccaacaacagaaatacaactaacagattacggagctcttacattagattgtagtccacgcacgggcctagattttaatgaaatggtactgctgacaatgaaggagaaaagttggttagtacataagcaatggttccttgatctcccgttaccatggacaagtggcgcttccacaagccaggaaacatggaataggcaagatttattagtcactttcaaaacagcccacgcgaagaaacaagaggtagtggttttaggatcacaagagggtgccatgcatacagccctaaccggagcaaccgagatacaaacgagcggtacaacgacaatatttgctggccacctaaagtgcagactaaagatggataagttaacgttaaagggcatgtcatatgtaatgtgcaccggaagttttaaactagaaaaagaagttgctgaaacccaacatggaactgtgctagtacagattaaatacgagggaactgacgcgccgtgcaaaataccattctcgacacaagatgaaaaaggagtaacacagaatggacgtttaataacagcgaacccaatcgtaactgacaaggaaaaacccgtaaatattgaggctgaacccccgttcggggaatcatatatagtaatcggcgcgggtgagaaagctctaaaattaagctggtttaagaaaggaagcagcataggaaaaatgtttgaagctaccgcaagaggggcacgcagaatggcaattttgggtgacacagcatgggacttcggatcaatcggtggagtctttacctccgtcggaaaattagtacatcagattttcgggactgcgtatggtgtactattttctggtgtatcatggacaatgaaaatagggatcggtgttcttctgacatggctcggtttaaactcacgttcaacttctttaagtatgacatgtattgctgtcgggttagtgactttatatctcggggttatggttcaagcggatagcgggtgtgtaattaattggaaaggccgcgagctgaaatgtggatccgggatttttgttactaacgaagtgcatacctggacagaacaatataagtttcaagccgattctccgaagagactatcagcagcaatcggtaaggcttgggaagaaggcgtatgtgggataaggtccgcaaccagattagaaaatataatgtggaaacaaatttccaatgagctaaaccacatccttttggagaatgacatgaagctgaccgtagtagttggcgacgtagcaggcatcctcggacaaggaaagaaaatgattaggcctcaacctatggaatataaatactcttggaaaagctggggtaaagctaaaataattggtgctgacgcccaaaacaccacctttattatcgatggtcccaacactccggaatgtccagatgaccaacgggcatggaatatatgggaggtggaggattatggattcggaatcttcacaactaatatatggcttaaattaagagactcctacacacaagtttgtgaccatagactcatgtcagcagcaattaaagactctaaggccgtacacgctgatatgggatattggattgaaagtgagaagaatgaaacctggaaacttgcacgcgcttcttttattgaggtaaagacctgtgtctggcccaaatcgcatacgctatggtctaatggagttagagaatcagaaatgataataccaaaaatatatggaggacctatctcccaacataactacagacccggttactttacacaaacggcaggcccttggcatcttggtaaattagagctagacttcgacctgtgcgaaggaacaacggttgtggtagatgaacactgtggaaacaggggacctagcctaagaaccactaccgtaaccggtaaaataattcacgaatggtgttgcagaagttgtactctaccaccattacgatttagaggagaagacggttgttggtacggtatggagatacgccctgtgaaagaaaaagaagaaaacttagtaaaaagtatggttagtgcaggctcaggagaagtcgactcatttagtctaggtttactttgcatatcgataatgatagaagaagtcatgcgttcccgctggtcacgtaagatgctgatgataggcaccttagctgtattctttctattaattatgggacagcttacgtggaacgacctaatcagactgtgtatcatggttggggccaatgcctcagatagaatgggcatgggcaccacatatttggccttaatggccacattcaaaatgaggccaatgtttgccgttggtctgttatttcgacgtttaacatcgagggaagtgttgttacttacaataggactcagtttagtggcaagtgtagaattacccaatagcctagaggagcttggtgatggtctagcaatgggaataatgattttaaaacttctgacagattttcaatcgcatcaattatgggctaccctgctctctttaacatttattaagaccacatttagcctacattacgcatggaaaacaatggctatggttttatccattgtttctttatttcctttgtgcctttcgactacatcacagaaaaccacttggcttcctgtactcttgggatcattgggatgtaagcctttaacgatgttcctaattgcagaaaataagatatggggtagaaagtcatggcccctgaatgaaggtattatggcagtaggtatagtaagtattttattatctagcctgttaaagaatgatgttcccttagccggacccttgatagcaggaggaatgttaattgcatgttacgttatttcaggatcttccgcagacttaagtttagagaaagccgctgaggtttcgtgggaggaggaagcagagcatagtggtgctagtcataatatccttgttgaggtacaagacgatggtaccatgaaaatcaaaaacgaggaacgtgacgatacccttaccatacttttaaaagcaactctattagcagtcagcggagtttaccctttgagtataccagccacactttttgtttggtatttctggcagaagaagaaacaaagatctggagtcttatgggataccccatcacctcctgaagttgaacgagcagtattggatgatggtatctataggatcatgcaaagaggtctacttggacgatctcaggtgggagtgggggtctttcaagagaatgtgtttcatactatgtggcacgtaacacgaggtgcagtactaatgtatcaagggaagcgtctagaaccttcatgggcctccgttaaaaaggatctaatttcatacgggggaggttggagactaagaggatcgtggaatacaggagaagaagttcaagtgattgcagtcgaaccgggcaaaaatcccaagaacgtacagaccgcgccagggacctttaaaactcccgaaggggaagttggggcaatcgctttggatttcaaacccggaacatcagggagtcccatagtaaaccgagaagggaaaatagtaggcctctatggaaacggtgttgtgactacatctggaacctacgtatcagcaatcgcacaggcaaaagcgagtcaagaaggaccactgccagaaatagaagatgaggtctttagaaagaggaatctaacaataatggatttacatcctggaagtggtaaaactagacgatatctacctgcaatcgttagggaagcgataaagcggaagttaagaacattaatactagcaccgactcgcgtcgtagcttctgaaatggcagaggccttaaaaggaatgcctattagatatcaaacaactgcagtaaagtcggaacacactggcaaagagattgtcgatcttatgtgccacgccacgtttacaatgcgactattgtcccccgtaagggtacccaattacaacatgattattatggacgaggcgcatttcacagacccatcaagcatagcagcaaggggctacatatctacacgagttggaatgggtgaagccgcagcgatattcatgacagccacacctcccggttccgttgaagcatttcctcaaagtaatgccgttatacaggacgaagaacgcgatattccagaaaggtcatggaactcaggatacgaatggattacagattttccaggcaagacggtctggtttgtcccttctataaagagcgggaatgacattgccaactgcttaaggaaaaatggtaagagagtgatccagctaagccgaaaaacttttgatacagagtatcagaaaaccaaaaataatgattgggattacgtagttactaccgacatctcggaaatgggcgcgaatttcagggcagacagggtgatagaccccaggcgatgtttgaagcccgtgatccttaaggatggaccagaaagggttattctagcaggtccaatgcctgttacagtagcctcagctgcgcaacgaagaggtagaataggacggaaccataataaggagggagatcaatatatatatatggggcaaccgttaaataatgatgaagaccatgcacactggacagaagcaaaaatgttgctggataacattaatacaccagaagggataattccagcattattcgaaccagaaagagagaaaagtgccgctgttgatggcgagtatagacttagaggagaagcgagaaagacatttgtagaactaatgaggcggggagatctacctgtatggctcagctataaagtagcctcggaaggtttccaatattcggatagaagatggtgttttgacggcgaacgaaataatcaagtactcgaagaaaacatggatgttgaaatctggaccaaagagggagaacgaaagaaattaagaccccgttggctcgatgcccgaacatatagtgacccacttgcattaagagaatttaaagaatttgcagcaggaaggcgatcagttagtggtgacttgattttagaaataggtaagttgcctcaacatttaacacaacgagcccaaaacgccttagacaacttggttatgttacacaactccgaacaaggcggacgagcatatagacatgctatggaagaacttccagatacaatcgagactcttatgttactggcattaatagctgtgctaactggaggcgtcacattattctttttgtcgggtagaggtttaggtaagaccagcattggattactatgtgttatggcaagtagtgtacttttgtggatggctagtgtcgagccacattggatcgctgcgagtatcatcctggagttctttctaatggttttactaatacctgaaccggataggcaacgtacaccgcaagacaaccaacttgcgtacgtcgtcattggtcttctctttatgattctaacagttgctgctaacgagatgggtttattagaaacaaccaagaaagatctgggaataggacatgtagccgtcgaaaaccatcaccacgctgcaatgctcgatgtagacttacatccagcaagtgcttggacgctctacgccgtagcgactacaattattacaccaatgatgcgacacacaatagaaaatactaccgcaaatatcagtctaacagcaatagcaaatcaggctgcgatcttaatgggtttagataaaggatggcctatcagtaagatggatattggagtaccacttctcgcactaggatgctactcacaagtaaatcctctgactttaactgcagcagtacttatgctagttgcgcattacgcaataattggtcctgggctacaagcaaaagccaccagagaggctcagaaaaggacagctgcaggtataatgaaaaaccccacagtggacggtatcgttgcaatagacctggatccagtcgtatatgatgccaagttcgaaaaacaattaggtcaaataatgctcctgatactatgcacatcccagatattactaatgagaaccacatgggccttatgcgaatcgataacactcgcaactggaccattgacaacattgtgggaaggatctcccggaaaattttggaacacgacaattgccgtgtcaatggcaaatattttccggggttcctacttagctggagcgggcttagcattttctttgatgaagtcattaggaggcggccgaaggggaaccggcgctcaaggtgaaactttgggtgaaaaatggaaacgacagctaaatcaattgagtaaatcagagttcaatacgtacaaacgttcgggaattatggaagtggacaggagtgaagcgaaagaaggacttaagcgtggagaaaccacaaaacatgccgtaagccgaggcacagccaaattgcgatggtttgttgaaaggaatcttgtaaaacctgaaggtaaggttatcgatttagggtgtggaagaggaggatggtcatattattgcgctggcctaaagaaagttacggaagtcaaaggttacacgaaaggtggacccggacatgaggaaccgatacctatggcgacatatgggtggaatctagtgaagttacactcgggcaaagacgtgttcttcatcccacccgaaaaatgcgacacgctattgtgtgatataggagaatcttcaccgaatccaacaatcgaagaaggtagaacattacgtgtgttaaaaatggtagaaccatggcttaggggaaaccaattttgcatcaaaatcctaaatccatatatgccatccgtggtagaaactcttgaacagatgcaaaggaaacatggagggatgctcgttcgaaatccgctatcaagaaactcgacacatgagatgtactgggttagttgcggcactggaaatatagtttcggccgttaatatgacgtccaggatgttactcaatagatttacaatggcacatagaaagccgacatacgaaagagatgtggacttggggacagggactcgacacgtagcggttgagcctgaagtcgcaaatttagatattataggacaacggatcgaaaatatcaaacacgaacataagtcaacatggcattatgacgaagacaatccctataaaacctgggcgtaccatggctcatatgaagtcaaaccttctggaagtgcaagctcaatggttaatggggtagtaaaattgctgacaaaaccgtgggatgtaataccaatggtaacgcaaatcgcaatgacggatacgacgccatttgggcaacagagagtgttcaaggaaaaagtcgatactcgaacccctaaagctaagagaggaacagcacaaataatggaagtgactgctagatggttatgggggttcttatcccgtaataaaaagccaagaatatgtactcgagaagaatttacacgaaaagttcgttcgaatgcggctataggcgcagtatttgtggatgagaaccagtggaatagcgcaaaagaagcagtggaagatgagagattctgggatctagtccacagagaaagagaattacataaacaaggtaaatgtgctacgtgtgtgtacaatatgatgggtaagcgagaaaagaaactgggtgaatttggaaaagctaaagggagtagagccatatggtatatgtggcttggagcaagatttttggagttcgaagcgctaggtttcatgaatgaagaccactggtttagccgagaaaatagtctaagcggagttgaaggggagggcttgcataaacttggttatattctaagagatatcagcaaaattcctgggggaaacatgtacgcagacgacacagccggatgggacactaggataaccgaagatgatttgcaaaatgaagcgaaaatcacggacattatggaacccgagcatgctttattagctaaagcgatatttaaattgacgtaccagaataaggttgtgcgtgttcaacggcccgctaaaaatggaactgtaatggacgtgatttctaggagagatcaacgtgggtctggtcaagtaggaacttacggcttgaatacgtttaccaatatggaagcacaactaattagacaaatggaatcagaagaaatttttagtccgtctgaattggaaacacctaatttagccgaaagagcgttagattggctcgaaaagtacggagtagaacgattgaagcgtatggcgatcagtggtgatgattgtgtagtaaaacctatcgacgatagatttgcaacggcattgactgcactcaacgatatggggaaagttaggaaggatatcccgcagtgggagccgagcaagggatggaacgattggcaacaagtaccgttctgtagtcatcatttccatcaattgataatgaaagacggaagggaaatcgtagtaccatgtagaaaccaagacgaactcgtaggtagagcacgagttagtcagggagcaggatggagcttgcgagagactgcttgccttgggaaatcatacgctcagatgtggcagctcatgtattttcacagacgcgatctaagactagctgacaaagcaattggtagtgcggttccggtggactgggttcctacgtctagaacaacttggagtattcatgcacatcatcaatggatgacgaccgaagatatgctgtcagtttggaatcgtgtatggatagaagagaatccctggatggaagacaaaacacacatttcatcctgggaggacgtaccgtaccttggcaaacgggaagaccaatggtgcggctcattaattggacttactgcacgcgctacctgggccaccaatattcaagtagctataaatcaagttcgacgattaattggtaatgaaaactatctagactatatgacttctatgaagaggttcaaaaatgaatctgatcccgaaggcgcattatggtaa

SEQ ID NO: 21710 - RNA, 9879 nt, synthetic construct
  misc_feature 1..9879: note = derived and/or modified CDS sequence (opt6) from DENV-1__GQ199829__SS-prME
  source 1..9879: mol_type = other RNA
tctgttacgatgcttctaatgttaatgccaactgctctagcattccatttgactacaagaggaggagaacctcatatgatagtatcaaaacaagagcgtggaaaatccctcttattcaaaacaagtgctggagtaaatatgtgtacgcttatcgcaatggatttgggagaattgtgtgaagataccatgacttataaatgccctagaataacggaaaccgaaccagatgatgtagattgttggtgcaacgccacagatacatgggtgacctatggaacatgctcccaaacaggagagcatcgaagggataaaaggtcggtggccctcgcgccacacgtaggacttggtctagaaacaaggacagagacatggatgtcgtccgaaggggcatggaaacaaattcaacgagttgaaacttgggcacttagacatccaggattcacggttattgctttgttcctggcacacgctatcggaacgtcaataacccaaaaaggaattatcttcatactattaatgttagtaactccgtcaatggcaatgagatgcgttggaattgggagtagagatttcgtggaaggcctgagcggagcaacctgggtagatgtagttctcgaacatgggtcttgtgtcactacaatggcaaaagataaacctacgttggacattgagttactaaaaacagaagtaaccaaccctgcagtactcagaaaattatgcatagaagcaaaaatttctaatacgacaacagactcacggtgcccgactcaaggtgaagctacactcgtagaggaacaagatgctaactttgtatgcagaagaacattggtagatagaggttggggaaacggatgtgggttatttggaaaaggatccctaattacttgtgctaaatttaaatgtgtaaccaaattagaagggaaaattgtacaatatgaaaacttaaaatatagcgtaattgtgactgtacacactggtgatcaacatcaagtcggaaacgaaagtacagagcatggaacaacagctacaattaccccacaagctccaacaaccgaaattcaacttacggattacggagctctcacccttgattgttcgccccggactggattagacttcaatgaaatggtgctattaactatgaaagagaaaagctggcttgttcataaacaatggtttctggacctaccgttaccgtggacaagcggagcatcgacctctcaggaaacgtggaatcgccaagatctattagtgacttttaaaacagcacatgccaagaaacaggaggtagttgtgttaggtagtcaggagggagcgatgcatacagctctcacgggagcgacagaaatccaaacaagcggtacaacaactatattcgccggacacttaaaatgcaggctgaaaatggataaacttactttaaaaggcatgtcgtatgtaatgtgtacgggaagttttaaattagaaaaagaagtagccgagacacaacatggaactgtccttgtccaaattaaatatgaaggcacggacgcaccctgcaaaatccctttcagcacccaagacgaaaaaggagtaacacaaaacggtcgattaataacagccaatccaattgtaacggataaagagaaacctgttaatattgaagctgaacccccattcggtgagagttacattgtcataggtgctggagagaaagcgttaaaattaagctggtttaaaaagggtagttcaataggtaaaatgtttgaagcgaccgcgagaggagcgcgtaggatggcaatattaggcgatacagcttgggattttgggagcattggaggagtgttcacttccgtaggaaaattagtgcatcaaatattcggtacggcgtacggtgtgctattttctggcgtctcatggaccatgaaaatcggaatcggtgttttacttacttggctgggtttaaattcacgatccacaagtctatcaatgacatgtatagcagttggtttagttacactatacttgggtgtaatggtgcaagcagattcaggctgcgttataaactggaaaggcagggaactgaagtgcggcagtggaatatttgtaacaaacgaagtacacacttggacagaacaatataaattccaagctgattccccaaaaaggctatcagctgcaataggtaaggcttgggaggagggagtctgcggcattcggagtgctacaagattagaaaatattatgtggaagcaaattagtaatgaacttaatcatatactgctagaaaatgatatgaagtttaccgtagtagtcggagatgtagcgggtattttagcacaaggaaagaaaatgatcagacctcaaccaatggaatataaatattcgtggaaatcttggggaaaagctaaaataataggtgctgatgtgcagaacactacattcattatcgatggcccaaatacacctgaatgtccagacgatcagcgagcgtggaatatttgggaagttgaagactacgggtttggtatcttcacaaccaatatttggttaaaattacgggacagctatacgcaagtatgcgaccacaggctaatgagtgcagccataaaagattctaaagccgtgcatgcagacatgggatactggatcgaatcagagaaaaacgaaacttggaaactggctagggcttcctttattgaggtaaagacgtgtatctggccccgttctcacacactctggtcaaacggagttttagaaagtgaaatgattattccaaaaatttacggcgggccaatatcgcaacacaattacaggccggggtactttacacaagcggctggaccatggcatctcgggaaacttgaattagatttcgatttatgtgaaggtactaccgttgtagttgatgaacattgtggcaatagaggaccatcacttcggactacaactgttactggtaaaattatacatgagtggtgttgccgatcatgcactcttcccccactaagatttagaggagaagatgggtgttggtacggcatggaaatcaggccagttaaagaaaaagaagaaaatctagtgaagtctatggtaagcgcagggtcaggcgaggtggactcattttcactggggctgctatgtatatcaatcatgattgaggaagtaatgcgtagccgctggagcagacgtatgctgatgacaggaactctagccgtctttttcttactgattatgggacaacttacttggaatgatttgattcgcctatgtattatggtgggcgcaaatgctagcgacagaatgggaatgggcacaacgtatttggcattgatggctaccttcaaaatgagaccaatgtttgcagttggtctactcttcagaagattaacatcaagagaagtactgctactaaccataggactatccttagttgcgagtgtagaattaccgaactccctagaagaacttggggatggactcgctatgggaatcatgatattgaaactgctgacagattttcaatcgcatcagttatgggcaactcttcttagcctaacatttataaagacaactttcagtctccattacgcatggaaaaccatggccatggtactttcaatcgtctcgctatttccattatgccttagtacaacaagtcagaaaactacgtggcttccggttttactaggttctttaggatgcaagccactgactatgtttctgattgctgaaaataaaatatggggtagaagatcttggccgctaaacgaaggaattatggcagttgggatagtatctattctactgtcatcgctgctcaaaaacgatgtcccactagcgggtccactaattgcgggaggaatgctaatcgcctgctacgtgatatcaggatcaagcgctgatctcagcttagagaaagctgccgaagtaagttgggaagaagaagccgaacacagcggagcttcgcataacatattagtagaagttcaagatgatggtaccatgaaaataaaagacgaagaaagagatgatacactcacaatactgttaaaagcaaccctattggccgtatcaggagtgtatccactctcgataccggccactctgtttgtatggtatttctggcaaaagaagaaacagcgtagcggagtactttgggatacaccatcccctcctgaggtagaacgagcagtattagatgacggaatatatcgaattatgcaaaggggtttactgggccgtagtcaagtcggagtaggagtcttccaagagaatgtttttcacaccatgtggcatgttactagaggagccgtattgatgtatcaaggcaaaagactcgaaccttcatgggcttccgtcaagaaagatttaatctcctatggcggaggttggcgtttgcagggctcatggaatacgggtgaggaagtacaagtgatagctgttgaaccaggcaaaaaccccaagaacgttcaaactgcacctggtacgttcaaaacgcccgaaggggaagtaggagccattgcacttgacttcaagccgggaacatccggaagtccaattgttaatagagaaggaaaaattgttggattatatgggaacggcgtcgttacaaccagcggaacttatgtatctgcaattgcacaagcaaaagcatcacaagaaggacccctaccagaaatagaggatgaagtgttcaggaaacgtaatttaacgataatggacttacaccctggaagcggcaagactagacgttatctaccggcaatcgttagagaagcgataaagcgtaaattaagaactttaatattggcgcctactcgagtagtagcatcagagatggcagaagctctaaaaggaatgccaataagatatcaaactacagcagttaaaagtgaacacaccgggaaagagatagtcgatttaatgtgccacgccacatttaccatgcgattattatctcctgtccgagtaccaaactataacatgattataatggacgaagcacacttcacagatccatcaagtatagccgcaagaggttacatttcaacacgtgtcggcatgggcgaggctgctgctattttcatgaccgccacccctccgggatctgtagaggcattcccacagagtaatgcagtcatacaggacgaagaaagagacataccagaaaggagttggaatagcggatatgaatggattactgattttcctggtaaaaccgtttggttcgttccgagtatcaaatcaggtaatgatatagcaaattgtctccgcaagaatggaaagagagttattcaacttagtagaaagacatttgacacagaatatcagaaaaccaaaaataatgattgggattacgtggtgacaactgacattagtgaaatgggcgctaacttccgtgctgacagagtgatagatcctagacgatgcctaaagccagtaatcctcaaagatggtccagaacgcgtcattcttgctgggccgatgccagtaactgttgcctccgcagcccaacgaaggggacgaattggaagaaatcataataaagaaggagatcaatatatttatatgggacaaccattaaacaacgacgaagatcacgcacattggaccgaagcaaaaatgttactcgataatatcaacactcctgaaggtattattccggcactattcgagcctgaacgcgagaaatcggcggcaattgatggggagtatagattacgtggagaggcacgtaagacttttgtagaacttatgcgacgaggagatcttcccgtgtggctttcgtacaaagtagcctccgaaggttttcaatatagtgacagaagatggtgttttgacggcgaacgtaacaaccaggtattggaagaaaatatggacgttgaaatttggacaaaagaaggcgaaaggaagaaacttaggccccgctggctggatgcacgaacatactcagaccctctagcgttgcgagaatttaaagaatttgccgcaggtagacgaagtgtgagtggagacctaattctagaaattggaaaattaccgcagcacttaacgcaaagagcacaaaacgcgttggataacctagttatgctacataattcagaacaaggtgggagagcctataggcatgccatggaggaactaccggatacaattgaaactctcatgcttttggcactaatagcagtcctaacagggggcgtgaccctattctttctctcaggtcgtggtttaggtaaaacttctatagggcttctttgcgtaatggcctctagtgtactcttatggatggcatcagtcgaaccacattggatagcagcgagtattattctagaatttttcctaatggtcctattaattccagagccagatagacagcggacgcctcaagataatcagctagcatatgttgtaatagggctcctgtttatgattttaacagtcgcggcaaacgaaatgggtctgcttgagactaccaagaaagatctaggcataggacacgtagctgttgaaaatcatcatcatgctgctatgttagacgttgacttacacccagccagcgcttggacactgtacgcagtagcgaccacgattatcacccctatgatgaggcatacaattgaaaatactacagcaaatatcagtttaaccgctatagcgaaccaggccgcgattctaatggggcttgacaaaggctggcccataagtaaaatggatattggcgtccctttactagcattaggttgctatagtcaagtaaaccctttaacactaacggcagccgttttgatgcttgtagcgcattacgcaattatcgggccaggactacaagccaaagccactcgagaagcccaaaagcgcacggcagccggtatcatgaaaaaccccactgtcgatggaattgtggcaatcgatttagatccagtagtatatgacgcaaaatttgagaagcagctagggcaaataatgctcctaatcctttgtacatcacaaattctattaatgagaacgacgtgggccctatgcgagagtatcaccctcgcaactggacctttgacaacgttatgggagggttccccaggaaaattctggaacacaactatagctgtatccatggctaatattttcagaggttcgtacttagccggtgctggtttagcattttctcttatgaaatcacttggaggtgggcgacgaggtactggagcgcaaggagagactcttggtgaaaaatggaaaagacaattaaatcaactttcaaaaagtgaatttaatacttacaaaaggtctgggattatggaagtagatagaagtgaagccaaggaagggttaaaacgtggagagacgacaaaacatgcggtcagtcgaggtaccgcaaagttacgttggttcgtggaacgaaacctagttaaacctgagggaaaagttatcgatcttggatgtggaagaggtggatggagttactactgtgcagggctcaagaaagttaccgaggtcaaagggtataccaaaggtgggccaggccacgaagaacctatccctatggcgacgtacggatggaatttagtcaagttgcacagcgggaaagacgtgtttttcatcccaccagagaagtgtgacactttattatgtgatattggggagtcttcaccaaaccctacaatagaagaaggaaggacattacgtgttcttaagatggtggaaccatggctgcgaggtaatcaattttgtattaaaatattaaatccatatatgccctcggtagtcgaaactctagaacagatgcagcgaaaacatggtggtatgcttgtaaggaatcctttgtcaagaaatagcactcatgaaatgtactgggtatcgtgcggcactgggaacatcgtatccgcggtgaatatgacaagccggatgctcttgaaccgctttacaatggctcatcgaaaacccacatacgaacgagacgtggatctaggagcaggcacacgacacgtagcagttgaacctgaggtagccaacctagatataatagggcaaagaatagaaaatatcaaacacgaacacaagagcacctggcactatgatgaagacaatccgtataaaacttgggcctatcatggatcatacgaagtcaagccttcaggaagcgcaagttcaatggtaaatggtgttgtgaagctgttgacaaaaccttgggatgttatacccatggttacacaaatagccatgacagatacaacaccttttgggcaacaacgtgtatttaaagaaaaggttgacacgcgcacaccaaaagccaagagagggactgctcaaataatggaagtaaccgctaaatggttatggggatttctatctagaaataagaaaccaagaatttgtacccgagaagaatttacaagaaaagtacgcagtaatgctgcgattggagccgtctttgttgacgaaaatcaatggaactcggcaaaagaagcagtagaagacgagagattctgggatttagtccacagagagagagaattacataaacagggtaaatgtgcaacatgtgtttataacatgatgggcaaacgagagaagaaactaggagaatttggaaaagcaaaaggatctagagcgatttggtatatgtggcttggagcgagattcctagaatttgaggctttaggtttcatgaacgaagatcattggttttcgagagaaaattcactctccggcgtagaaggagaaggtttacacaaactaggctacatactccgagatatttcaaaaattccaggaggaaatatgtatgctgacgacactgccggttgggatacacgaatcacggaagatgacctacagaacgaagcaaggataaccgatatcatggaacctgagcatgcactactggcaaaatcaatatttaaactcacgtaccaaaacaaagtagtgagggttcaacgccctgccaagaatgggacagttatggacgtaataagtcgacgagaccaacgtggaagcggtcaggttgggacatacggtttaaacacttttacaaacatggaagcacagctaataagacaaatggaaagtgaagggatcttctcgccgtcggaattagaaactcccaacttagcagaacgagtcctagattggttagaaaaatatggagttgaaagactgaaaagaatggcaatatcgggagatgactgcgtcgtgaagcccatcgatgaccgttttgcaactgcactaacagcgctgaacgatatgggaaaagtacgtaaagatataccacaatgggaaccgtctaagggttggaatgactggcagcaggtccccttttgttcacaccacttccaccaattaatcatgaaagacggacgtgaaattgttgtaccttgcagaaaccaagatgaactcgtaggacgcgcgcgtgtgtcacaaggcgcaggatggagtcttagagaaacagcttgcttaggaaaaagctatgctcagatgtggcaattgatgtacttccacagacgagatttacgtctcgctgctaatgctatttgttcagcagtgccagtcgattggataccaacgtctagaacaacttggtctatacacgctcaccaccaatggatgacaaccgaagacatgctaagtgtatggaatagagtttggatagaggaaaatccatggatggaagataaaactcatattagttcgtggggtgacgttccatatttagggaagcgcgaagatcaatggtgcggatcactcatcggcctaaccgcacgtgcgacttgggctacaaatatacaagtagccattaatcaagtacgtaggttaattggaaatgaaaattatttagactacatgacctcaatgaaacgcttcaaaaatgaaagtgatccagaaggagctttgtggtaa

SEQ ID NO: 21711 - RNA, 9879 nt, synthetic construct
  misc_feature 1..9879: note = derived and/or modified CDS sequence (opt6) from DENV-1__FJ882562__SS-prME
  source 1..9879: mol_type = other RNA
tcagttactatgcttctgatgctcatgccaactgcgcttgcattccatttaactactagaggaggcgaaccacacatgatagttagcaaacaagaaagaggaaaaagcctgcttttcaaaacgagtgctggtgtaaacatgtgcactctcatcgcaatggatctcggagaattatgtgaagacacaatgacctacaaatgtccacgcattaccgaagctgaaccggacgatgttgattgctggtgcaacgcgacagatacatgggttacctacggcacatgtagccaaaccggggaacatagaagagataaacgctccgtggcgttggcaccgcatgttgggttaggcttagaaactcgtaccgaaacttggatgtcgtctgaaggcgcatggaagcaaattcaacgagtagaaacttgggctctgagacatccagggtttactgtgatagcactattcctagcacacgctataggaacaagcataacacaaaaaggcatcatattcatactgttaatgctagtaacaccttctatggccatgagatgcgttggaatcggatctcgcgactttgtagaaggactttctggagccacatgggtcgacgtagtactggaacatgggagttgcgtaacaaccatggcaaaagataaaccaactctcgatatagaattacttaaaaccgaagtgactaatcctgcagtgttaaggaaactctgcatagaagcaaaaatttcaaataccacaacagattcaaggtgcccaactcaaggagaagcaaccttagtcgaagaacaagatgcaaacttcgtgtgtaggaggaccttcgtggatagaggatggggaaatggttgtgggcttttcggaaaaggctcgctgataacgtgcgcgaaattcaaatgcgtcacaaaattggaaggcaaaatagttcaatacgaaaatttaaaatattcagtaatagtaactgtccatacaggggatcaacatcaagtgggaaacgaatcaacagaacatggaaccactgccacgataactccccaagcccctacgacggaaatacagctaaccgattacggtgcattaactttggattgctcacctaggactggattagattttaacgaaatggttttgttaactatgaaagaaaaatcatggcttgtacacaaacagtggtttttagacttgccccttccgtggacgagtggagctagtacaagtcaagaaacatggaatagacaggacttattagtaacctttaaaactgcacatgccaagaaacaagaggtggtcgtattgggatcacaagaaggggcaatgcataccgcgctgacgggcgctacagaaattcaaacatcaggaactacaacaatcttcgcagggcacctaaaatgtcgtcttaaaatggataaactaaccttaaaaggtatgagttatgtaatgtgtaccgggagctttaaacttgaaaaagaagtagcggaaacacaacatggaacggtgttggtacaaatcaagtatgaaggaaccgacgcaccctgtaagattcctttcagcacacaagatgaaaaaggagtcacacaaaacgggagactgattacagcgaatccaatagttacagataaggaaaaacccgtgaatattgaagcggaaccaccattcggggaatcatacatagtcataggagcgggcgaaaaggctctaaaactcagctggttcaagaaaggatcgtcaataggtaaaatgtttgaggcaacagcacgcggcgccagaagaatggcaattttaggtgataccgcatgggacttcggaagtataggaggactatttacgtcagtgggaaaacttgtacaccaaatctttggaacagcttatggggtactcttctcaggagtaagctggactatgaaaataggaattggggtcctattaacatggttagggttaaactctagaagcacttcactaagcatgacttgtatagcggttggattagtaactttgtacttaggagtaatggtacaagctgactcgggatgcgtaataaattggaaagggagggaactcaagtgtggaagtggtatttttgtcaccaatgaagttcatacttggactgaacaatacaaattccaagctgactccccgaaacgtttatctgctgctattggcaaagcatgggaggaaggcgtgtgtggtattcgttcggcgactcgattagaaaacattatgtggaaacagatatcgaacgagttaaaccatattttattggaaaatgatatgaaattaacggtagttgtaggtgatgtagcaggcatacttgcacaaggaaagaagatgatccgtccacagcctatggagtacaaatactcttggaagagttggggaaaggccaaaatcatcggagcagatgcacaaaacacaacattcattatagacggacctaatacgccagaatgccctgatgaccagcgagcatggaacatttgggaggttgaagactacgggttcggaatattcacgaccaacatttggttaaaactaagagactcatatacacaggtgtgtgaccatagacttatgagtgctgcaatcaaagattccaaggcagttcacgcggacatggggtattggatcgaaagcgaaaagaacgagacttggaagctagcacgagcctcttttatcgaagtaaaaacctgcatttggccaaaatctcacacgttatggagtaacggggtattagagtctgaaatgattataccgaaaatctacggtgggcctatttcacagcataattatagacctggatatttcactcaaaccgcaggaccatggcatttaggcaaattagaattggatttcgatctgtgtgagggcactacagtagtagtcgatgaacattgtggaaacagaggaccatcactgagaacaactactgttacaggaaaaataatacatgagtggtgctgtcgatcatgcaccctcccacctttacgatttagaggtgaggatggatgctggtacggtatggaaatccggccagtcaaggaaaaagaagaaaatttagtgaaatcaatggtctcggcgggaagcggggaagtcgattcattctcattaggactgttgtgtatatcgatcatgattgaggaagttatgcggagtagatggagccggaagatgctaatgacgggcactttagccgtattctttttgctcatcatggggcaattaacttggaatgatctaataagattatgtataatggttggcgctaacgcatccgatcgtatgggaatgggaaccacttatttagccttaatggctacattcaaaatgaggcctatgtttgcggttggccttttattcaggcggctcacctcacgggaggttttgctactaacaataggtctaagtttagttgctagtgtagaactccctaattctctggaagaacttggcgacggactagcaatgggtattatgatattgaaattgttaacggattttcagtctcaccaactgtgggctactcttctatcgttaacttttattaaaacaacattttcactccattatgcctggaagacaatggccatggtgctatcaatcgtttcattgttcccactttgcttaagcacgacctcccagaaaaccacatggttgccagtacttttagggtcacttggttgcaaaccgttaacgatgttcttaatcgccgaaaataaaatatggggaagaaaaagttggccactcaatgagggtataatggctgttggtatagtatcaattctcctctcaagtctacttaaaaatgacgtacccctagccggcccactaattgcaggcgggatgctcatagcatgttatgtaatcagcggatcaagtgcagatctctctcttgaaaaagcggcagaagtgtcttgggaagaagaagccgaacactccggtgctagccataatatactcgtcgaggttcaagatgatggaactatgaaaataaaggatgaagaaagagatgatacgctaaccattctacttaaagcaacacttctagcagttagcggtgtctatccgctatctattccagcaaccctattcgtttggtacttttggcagaagaagaaacagagaagcggtgtattgtgggatacacctagccctccagaagtagaaagagcagtgctcgacgatggcatatacagaataatgcagcgcgggttactcggacgatcacaggtgggggtgggtgtgttccaagaaaatgtatttcatacgatgtggcatgtaactcgaggagcagtcttaatgtatcaaggtaagcgactggaaccatcttgggccagcgtcaagaaagatcttataagttacggtgggggatggagattgcaagggtcctggaatactggggaagaggttcaagtcatagcagttgagccagggaaaaatcccaaaaacgtacaaactgcgccaggtacgtttaaaactcctgagggagaggttggagcaatagcacttgattttaaaccaggcacatcaggttcacctattgtaaatcgcgaaggtaaaatagtaggactctatggaaacggcgtggtcactaccagtggtacttatgtatcagccatagcgcaagcgaaagcgtctcaagaaggccctctaccagaaatagaagacgaagtttttcgaaaaaggaatttgacaatcatggatctacatcccggttcaggaaagaccaggcgttatctaccagctattgtgcgtgaagcaattaaaaggaaattgaggactttgattcttgctccgacaagagtagtggccagcgaaatggcagaggctttaaaaggaatgccaataaggtaccaaactaccgcagtcaagagtgaacacaccggaaaggagatagtcgatctcatgtgccatgctacgttcacgatgagattgttgagcccggtgcgagtacctaactataacatgataattatggatgaagcacactttaccgacccttcatcgatagcagcaagaggatacatatccacacgtgtaggaatgggcgaagctgcagctatatttatgacggctaccccgccgggaagtgtggaagcctttccacaaagtaatgcagtaatacaagacgaagaacgtgatatcccggaacgcagctggaactcaggctacgaatggataacagatttcccgggtaaaaccgtatggtttgtaccttcaatcaaaagtggaaatgatattgcaaattgcttaagaaagaatggaaaacgggtaatacaactttcacgaaaaacttttgatacagaataccagaaaactaaaaacaatgattgggattatgtggtaactacagatatatcagaaatgggcgcgaatttcagagccgacagagttatagatcctcgaagatgcctaaaaccagtgatacttaaagatggtccggaaagagtaatactggctggaccaatgcccgtgacagttgcatcagctgctcaaagacgcggtaggataggtagaaatcataacaaggaaggagatcaatatatatacatgggccaacccctaaataacgatgaagaccatgcacattggaccgaagcaaaaatgttgttagacaatataaatacaccggagggcattatccctgcattattcgaaccagaaagagagaaaagtgcagcaatcgatggagaatatagactgagaggcgaggcacgaaaaacatttgtagaactaatgagacgaggagatctaccggtttggctgagttacaaagtcgcttcagagggcttccaatattctgacaggcggtggtgcttcgatggagaaagaaacaaccaagttcttgaagaaaatatggacgtagaaatctggacaaaagaaggggaaaggaagaaattaagaccgagatggttggatgcacgtacatattcagatcccttagccttacgggagttcaaagaatttgcagcaggtagaagaagtgtgtctggagatcttattctagagatcggaaaacttccacaacatctcacacaacgggcccaaaatgcattagacaatctggttatgcttcacaattccgaacaaggagggagagcatatagacatgcaatggaagaacttcccgatacaatcgaaactctaatgttattagcgctaatcgctgtacttacagggggagtaacattattctttctatctggcaggggtttaggaaagacgagtattggtttactttgtgttatgacaagttctgttcttctatggatggcgtcagtcgagcctcattggatagcagcttccattatacttgagttctttttgatggtattattaataccagaaccagatagacaaaggacaccgcaggataatcaacttgcttacgtagttattgggttactcttcatgatccttacagtagccgccaacgaaatgggattgcttgagacaacgaaaaaggacctaggaattggtcacgtagcagttgaaaaccatcaccatgcagcaatgctggatgttgatttgcaccctgctagcgcatggacactctatgctgtagctaccacaataataacgccgatgatgcgacacacaattgaaaatacaaccgctaatatcagtcttacagccatagcaaaccaggcggccatactaatgggcctagacaaagggtggcctatctctaaaatggacataggcgttccactcctcgcattaggatgctattctcaagtaaacccattaaccttaacagctgcggtattaatgctggtcgcacattatgcaataataggcccaggcctccaagcaaaagcgactcgagaagcacaaaaacgcacagctgcaggaataatgaaaaatccaaccgtcgacgggattgtagcaatcgatctcgacccagtagtttatgatgctaaattcgagaaacaacttggacagattatgttattaattctatgcacatctcaaatacttttaatgcgtaccacatgggcgctgtgtgagagcatcacactggctactggacccctaaccacactctgggaaggatcacctggaaaattttggaataccacaatagctgtatctatggccaacatcttcagaggaagttaccttgccggtgcagggttagctttcagccttatgaaaagcctcgggggaggaaggcgtggtacgggcgctcaaggcgaaacattaggggaaaaatggaaacgacagctaaatcaactgagtaaaagtgaatttaacacatataaacgatcgggaataatggaagtagaccgatcagaagctaaagaagggttgaagagaggagaaaccacgaaacacgcggtgtctagaggcaccgcaaaacttcgatggtttgttgagagaaatctagtaaagcccgagggaaaggtaatagatttgggatgtggtcgaggtggatggagttactattgtgcaggactaaagaaagtaacagaagtcaaaggctacactaaagggggaccaggccatgaagaacctattcctatggccacgtatggctggaacctcgtgaaattacactctggaaaggatgtatttttcattccaccagaaaagtgtgacactctattgtgcgatattggtgagtcctccccaaacccaactatagaagaaggcaggaccttaagggtactcaagatggttgagccgtggttaagaggcaaccaattttgcattaaaatcttgaatccttatatgccctctgtggtagagacattagagcaaatgcaaagaaagcacggtgggatgctggtcagaaatcctttatcaagaaattccacacacgaaatgtattgggtatcatgcggaactgggaacatagtgtccgcagtcaatatgacatctcggatgctactgaatagatttacaatggcgcaccgaaaacccacctatgaaagagatgtagacctaggaacgggaacccgacatgttgcagtcgaacccgaggtagccaacctcgacatcattggacaaagaatcgagaatattaaacatgaacataaaagcacttggcattacgacgaagacaatccctataagacatgggcttaccatggaagttatgaggtgaaaccttctggcagtgcgtcctcgatggttaatggggttgtaaaactattaaccaaaccatgggatgtaatacctatggttactcaaatagcaatgacggacaccacaccattcgggcagcagagagtctttaaagaaaaagtagatacaagaacacctaaagctaaaagaggtacagcacaaatcatggaagttactgcgaggtggctttgggggtttctttccaggaataagaaacctcgtatctgcacccgagaggaatttacacgcaaggtacgatccaatgcggctataggtgctgtcttcgtggatgaaaaccaatggaatagtgctaaagaagcagtagaagacgaacgtttttgggacctagttcaccgtgaacgcgagttacacaaacagggaaaatgcgcaacatgtgtatacaatatgatgggcaagagagaaaagaaactcggggagttcggtaaggccaaaggaagcagggcgatttggtatatgtggcttggagctcgattcctagaatttgaggcattaggattcatgaacgaagaccattggtttagtagagaaaatagcttaagcggagtcgagggagaaggcttacacaaattgggttatatcttgagggatatttcgaaaatcccaggtggaaacatgtatgcagatgatacagccgggtgggatacgcggattaccgaagatgacttacagaacgaagcgaaaataacagatattatggagccggaacatgccctacttgccaaagctatatttaaattaacttatcaaaataaagttgtgcgggtacaacggcctgcgaaaaatggcactgtgatggacgtaatttcccgacgagatcagcgaggcagtgggcaagtgggtacatatggattaaatacattcacaaatatggaggcacagctaatccgacaaatggaaagcgaaggtatattttcaccctcagagctggaaacacctaacttggcagaacgggcactagactggttagaaaaatatggagtcgagcggctaaaacgaatggcaatcagcggagacgactgtgtggtaaagccaatagatgacagattcgccacagctttaacggcgttgaatgacatggggaaagtgaggaaagacatcccgcaatgggagccaagtaaaggatggaatgattggcaacaagtaccgttttgcagccaccatttccaccagctgattatgaaggatggtcgggaaatagttgtaccatgcagaaatcaagacgaattagtgggacgggcaagggtttcacaaggagcgggttggagtcttagagagaccgcttgtctaggtaagagctacgcacaaatgtggcaacttatgtacttccatcgacgcgatctaagactagctgccaatgcgatatgcagtgcagttccagtagactgggtaccgacctctagaaccacgtggtcaatacacgcccatcaccaatggatgaccactgaggacatgctttcagtatggaacagggtctggatagaggaaaatccttggatggaggataaaacacatatatcatcatgggaagacgttccgtatctagggaaaagggaggaccagtggtgtggttctttgatagggcttactgcccgcgctacatgggcgactaacatacaagttgcaataaatcaggttagaagactaataggaaatgaaaattatttggattacatgacttccatgaagaggtttaaaaatgaaagtgacccagaaggggcactatggtag

SEQ ID NO: 21712 - RNA, 9879 nt, synthetic construct
  misc_feature 1..9879: note = derived and/or modified CDS sequence (opt6) from DENV-1__FJ882564__SS-prME
  source 1..9879: mol_type = other RNA
tcggttactatgcttctgatgctgatgccaacggcgttagcatttcacttgacaactagaggaggggaacctcatatgattgtaacaaaacaagaacgcggtaagagcttgctttttaaaacaagtgcaggggttaacatgtgtacccttatcgcaatggacttaggggagctgtgtgaagatactatgacgtataagtgcccacgcataacagaagcagagccggacgacgtagattgttggtgtaatgctacagatacgtgggtaacgtacggtacatgcagtcaaacgggagaacacagaagagataagcgttcagttgctttggccccacacgtcggactgggcctcgaaacacgtacagaaacatggatgtcttctgaaggggcatggaaacaaatccaacgagtcgagacctgggctttaaggcatcctggttttactgtaattgcattatttcttgctcatgctataggaacttccataacacaaaaaggtataatttttatattgttaatgctggtcactccgtcaatggcaatgcgatgtgtgggaataggatccagggactttgtagaaggtctgtctggagctacttgggtcgacgtagtactcgaacacggtagctgcgtaacaaccatggcaaaagataaaccaacgcttgatatagaattgttaaaaactgaagtcactaatcctgcagtattaaggaaactatgcatagaagcaaaaattagtaatactactactgattctcgctgcccaacacaaggagaggcaactttaatggaggaacaagacgctaattttgtctgccgtcgcaccttcgttgatcggggatggggaaacggttgcggactctttggaaaaggtagtttgataacatgtgcaaaattcaaatgtgttaccaaacttgagggcaaaattgtacaatatgaaaacttaaaatattctgtaatagtaaccgttcacacgggggaccaacaccaagtgggtaatgaatcgacagagcatgggactactgcgacgataacaccacaagccccaacttccgaaatacaattaacagactatggtgccttaacactagattgtagtccgaggacaggactcgactttaatgagatggttcttcttactatgaaagaaaaatcctggttagtccacaaacaatggtttttagatttaccactaccctggacatcgggcgcctctacttcacaagaaacatggaatagacaagatcttctagtgacgtttaaaacagcacatgccaagaaacaagaagtagtagtgctaggatcacaagaaggagccatgcatacagctctcacgggggctaccgagatacaaacaagcgggaccactactattttcgccggacacctcaagtgccgacttaaaatggacaaattgacattaaaaggcatgtcttacgtgatgtgtactggtagttttaagttggaaaaggaggtagcagaaactcaacatggcacagtattagtccaaatcaagtatgagggaactgatgcgccatgcaaaatccctttttctactcaagatgaaaaaggagtgacgcagaatggcaggttgatcacagcaaaccctatcgtaactgacaaagaaaaaccagtaaacattgaagcggaaccaccctttggtgaatcatatatagtaatcggtgccggagagaaagcactcaaactctcatggtttaagaaaggttcatccataggtaaaatgtttgaagcaaccgcaagaggagcaagacgtatggcaatccttggcgatacagcatgggactttgggtcaattggtggagtctttacaagtgttggaaaattggttcatcaaatatttgggaccgcatacggcgtactattcagcggcgtaagttggacgatgaaaataggcatcggagtcctgctcacctggctagggttgaatagtcgttcgacttcattgtcgatgacatgtatagcagtcggtctggtcacactctacttaggcgtaatggttcaagcagattcagggtgtgtaatcaactggaaaggcagggaattgaaatgcggaagtggaatctttgtcacaaatgaggtacatacatggactgaacaatacaaattccaggctgactcaccaaaaagactaagtgcggccatcggcaaggcatgggaggaaggagtatgcggaattagaagtgctactaggcttgaaaatataatgtggaaacaaatttcaaacgaattaaaccatatactgttagaaaatggaatgaaatttaccgtagtagttggtgatgtggtaggcattcttgcgcaagggaagaaaatgatacggccacaacctatggagcataagtactcatggaagtcctggggaaaggcaaaaataattggtgcagacgtgcagaataccacatttataattgacggtcctaacaccccagaatgtcctgatgaccaaagagcgtggaacatttgggaagtcgaagattacggattcggtatatttacaactaacatttggctaaaacttcgagacagttacacccaggtgtgtgaccaccgtttaatgtcagccgcaataaaagatagtaaggccgttcatgcagatatgggttattggatcgaatcggaaaagaatgaaacgtggaaacttgcacgtgcctcttttattgaagttaaaacgtgtatatggccaaaaagtcacacattatggagtaatggagtactagaatccgaaatgattataccgaagatttatggaggtcctataagtcaacataactataggcccggttacttcactcaaaccgctggaccttggcacctgggtaaactagagctagattttgatctatgtgaagggactactgtcgtggtggacgagcattgcggtaatcgaggccctagtctgcgaactacaacagtgaccggcaaaataatacacgaatggtgttgtcgaagttgtacactgccgccactgagatttaaaggtgaagatggctgttggtatgggatggagataagaccggtaaaagaaaaggaagagaatttagtaaaatcaatggtttcagccggttcaggagaggtagatagcttctcgttaggactattatgtacctcaataatgatagaagaggtaatgcgtagccgttggtccagaaaaatgctgatgactggtacattggcagtatttctactccttataatgggtcagttaacatggaatgacctcatacgtctgtgtataatggtaggggcaaatgcaagcgatagaatgggtatgggaactacttacttagcccttatggcgactttcaaaatgaggccaatggtagcagtaggactactcttccgaagattgacgagtcgagaggttctattacttaccatcggtttgtctctggtcgccagtgtggaattgccaaattcgcttgaggaacttggtgatggattggcaatgggaattatgattttaaagttacttaccgattttcaatctcatcaattatgggccacacttctttctttaacttttattaagactactctgtcattacattatgcttggaaaactatggctatggtgttaagtattgtatcattatttccgttatgtctatcgacgacaagtcagaagaccacctggctacccgtattattaggctctcttggatgtaaaccactaacaatgtttcttattgcagaaaacaagatatgggggcgaaaatcgtggccacttaatgaaggtatcatggcagtcggcgtggtatccatccttctgagtagcttactaaagaacgacgtacctctagccggtcccttaattgcgggaggtatgctaattgcctgttacgttattagcggttcgagtgcggatttatcgctagaaaaagcagctgaagtgtcatgggaggaggaagcagaacattcaggagcatctcataatatcttagtggaagtccaagacgatggtaccatgaaaataaaagacgaagaacgggatgacaccttaactattctgttgaaagcaacactattggcagtctctggagtgtatcccctttccatcccagctactttattcgtctggtatttttggcagaaaaagaaacaacgaagtggagtcttatgggatactccgtcaccaccagaggtagaacgggcagtccttgacgatggtatttatcgaataatgcaacgaggtttactgggacgttcacaagttggggtaggggtgtttcaagaaaacgtgtttcatacgatgtggcacgtaacgcgcggagcagtattaatgtaccaaggaaaacgactggagccatcctgggcgtcagtgaaaaaggacctgatttcatacggagggggatggcggttacaaggcagctggaatactggtgaggaagtacaagtcattgcagtcgaaccaggaaagaatccgaaaaatgtacagacagctcccggtacctttaagaccccagaaggtgaagtgggagcgatagcactcgatttcaaacctggcactagcggttcaccaattgttaacagggagggaaaaatagtcggactctatgggaatggtgttgtcaccaccagcgggacatacgtatccgcaatcgcacaagcaaaagcatcccaagaagggccccttcccgaaattgaggacgaggtattcagaaaacggaaccttacaataatggacctacaccctggatcaggaaagacacgtaggtatctcccggccatcgtcagagaagctattaaaagaaagttacgaacccttattcttgcaccaacgagggttgtcgcaagtgaaatggctgaagcattaaaagggatgccgataagatatcaaacaaccgccgtaaaaagtgaacataccgggaaagaaattgttgatctcatgtgtcacgcgactttcacaatgagattattatcaccagtacgagtcccaaattacaacatgattataatggatgaagcacattttacggatccaagcagtatagccgctagagggtacattagcacaagagtcggaatgggggaagcagctgcaatctttatgaccgctacaccaccaggatccgtagaagcattcccacaaagcaacgccgtcatacaagatgaagaaagagacattccagaacgatcatggaatagtggctacgaatggataacggactttccaggtaaaactgtgtggtttgtcccatctattaaatctggtaacgacattgctaactgtctaaggaaaaacggaaagcgtgttatacagttaagtcgtaaaacgtttgatacagaatatcagaaaacgaaaaataatgactgggactacgtagttacgaccgatatatcagagatgggcgcaaatttccgtgccgaccgcgtaatagatccgagaaggtgtttaaaacctgtcatattaaaggatggaccagaacgagtcattttagcaggcccaatgccagtgactgtagcatcagcagcccaaaggaggggtagaataggtcggaatcataataaagagggagatcaatatatctatatgggacaaccactaaataacgatgaagaccatgcgcactggacggaagctaaaatgctattggataacataaatacaccggaaggaataattcccgctttgtttgaacccgagagagaaaaatccgcagccatagatggagaataccgcttaagaggagaagcccgtaagacattcgtagaactaatgaggcgaggtgacttaccagtatggcttagctataaagttgcgagtgaaggttttcaatatagcgataggcgatggtgctttgacggagagcgaaacaaccaggtactagaagaaaatatggatgtcgagatttggacgaaagagggagaaagaaagaaattaaggccaagatggctagatgcaagaacttactctgaccccctagccttacgagaatttaaagagttcgcggctggacgtagaagcgtatcaggcgatttaattcttgaaattggaaagttgccacaacacctcacacaacgggcccaaaacgctttagataatcttgtgatgttacataactcggaacaaggtggaagggcatatcgtcatgcaatggaggaattaccggatacaattgagacgttaatgttattagctctaattgcagtgctaacgggcggtgtgacattattctttctctcaggccgtggccttggtaagacgtcaattggacttttatgcgtaatggctagttcagtactactatggatggcaagtgtagaaccccattggatcgcagcctcaattattctagaatttttcttaatggttctactaatacccgagcccgaccgacagagaacgccacaggataaccaactggcatatgttgtcattggccttctctttatgatactaacagttgccgcaaacgaaatgggattactagaaacaactaagaaagacctgggaatcggtcatgtagcagtagaaaaccatcaccatgccacaatgctcgacgtggacctacatcctgcatcagcgtggactttgtacgcggtcgcaacaaccattattacacccatgatgagacatactatagagaacaccacagcaaacatctctcttacggcaatagccaatcaagcagctatactcatgggtctagataaaggttggcctattagtaaaatggatataggggtaccattgttggcactcggatgttatagccaagtgaaccccttaaccctgacagccgcggtcctaatgctagtggcacactacgcaataataggccccggcttgcaagctaaagcaacacgagaggcgcagaaaaggacagcagcgggtataatgaaaaacccaacggtagatggcatcgtagcgatagatttagaccctgtggtttatgacgccaagttcgaaaagcagttaggtcaaataatgttactaattttatgtacatcacaaattttgttgatgagaaccacatgggcactgtgtgagagcataactctggcgacaggtcctctaacaacgctatgggaaggctcaccggggaaattttggaacacaactatagcagtgtcgatggctaacatcttccgtggatcttatttagctggagccggactagcgtttagtttaatgaagtctttgggaggcggccgtcgtggaacaggtgcgcaaggtgaaactttaggagaaaagtggaaacgacaactcaatcaattaagtaaatcggaatttaacatatataaaagatctgggatcatggaagtagatagaagcgaggcaaaagagggcttaaaacgcggtgaaaccacgcggcatgccgtaagtcgaggaaccgctaaattaagatggttcgtggaaagaaacttagtaaaaccagaaggtaaggtcatagatctaggctgtgggagaggtggttggtcatactattgtgctggtctaaagaaagttacagaagtcaaagggtatacaaagggaggtcctggacatgaagaaccaatccctatggcgacctacgggtggaacttagtcaaattgcactccggcaaagatgtcttctttacaccacccgaaaagtgtgataccctcttgtgtgacattggagaatcatcgcccaaccctacaatagaagaaggtaggactttaagagtactcaaaatggttgaaccttggcttagggggaatcagttctgcattaaaatattaaatccttatatgccctctgttgttgaaacgctagaacaaatgcaaagaaaacatggtggaatgttagtgagaaaccccctcagtcgaaacagcacacacgaaatgtattgggtgtcttgcggtactgggaatatcgtatcagcagtaaatatgacctcacgaatgctattgaatagatttacaatggcgcacaggaaacctacatatgagagagacgtagatttgggtgcggggacgaggcacgtagcggttgagccagaggttgctaacctagatataataggacaacgaatagagaacattaaacatgagcacaagtctacatggcattacgatgaagataacccatacaaaacgtgggcataccatggcagctatgaagtcaaaccatcaggcagcgcatcgagcatggtaaatggagtagttaaattattaacaaaaccatgggatgttatacctatggtgactcaaatagcgatgacagacacaaccccctttggacaacaacgagttttcaaagagaaagtagacacaagaactcctaaggcaaaaagaggtacagcccaaattatggaagtaactgcacgctggttatggggatttctcagtaggaataagaaaccgcgaatctgcacaagagaagaatttacgcgaaaggttcgatcaaacgcagccattggcgccgtgttcgttgacgaaaatcaatggaacagcgctaaagaagccgtagaggatgaacggttttgggacctcgttcaaaaagaacgcgagttgcacaaacagggaaaatgtgcaacatgcgtatataacatgatgggtaaaagagagaagaaattaggtgaatttgggaaagctaagggatcaagggcaatatggtatatgtggctaggggcaagatttttagagtttgaagcattagggttcatgaatgaagaccattggttttcacgagaaaattcactttcgggagtagaaggcgagggtctccataaattaggttacatacttagggatatttcaaagattccaggcgggaatatgtatgctgatgacacagcaggatgggatacaaggataacagaagatgatctacaaaacgaggcaaaaataactgacataatggagccagaacacgcactattagcgacaagtatatttaagctgacgtatcaaaataaggttgtaagagtacaaagacctgccaaaaatggcactgtaatggatgttattagtcgccgggatcagagaggaagtggacaagttgggacatacggattaaacacgtttactaatatggaagcccaattaattcgtcaaatggaatcggagggaatctttctaccaagtgaattggaaactcctaatttggccgaacgagtacttgattggttagaaaaatatggcgtagaaagattaaaaaggatggcaataagcggagatgattgcgtggttaagcccattgatgaccgcttcgctactgcactaacagcattgaacgacatgggtaaagtgagaaaagatattccacaatgggagccaagcaaaggatggaatgattggcaacaagtccccttttgctctcatcattttcatcaattgatcatgaaagacgggagagaaattgtcgtaccatgcaggaatcaagacgagctagtaggcagagcaagagtatcccaaggggctggatggagtttacgagagacggcgtgcttaggaaaaagttatgcccaaatgtggcagctaatgtatttccacagaagggatctgagactggctgcaaacgcaatatgctccgccgttccagttgactgggttccaacttcccggacaacgtggagtatacatgcccaccatcaatggatgactacagaagatatgctcagtgtctggaatagggtctggatcgaagaaaatccatggatggaggacaaaacgcatgtctccagctggggagatgtgccctatttaggtaagcgcgaagatcaatggtgcggttcgctaataggtttgacagctagagctacttgggcatctaatatccaagtagcgataaatcaagtccgtagattaatagggaatgaaaattatctggattatatgacatcaatgaaacgcttcaaaaatgaaggtgacccagagggagctctatggtaa

SEQ ID NO: 21713 - RNA, 9879 nt, synthetic construct
  misc_feature 1..9879: note = derived and/or modified CDS sequence (opt6) from DENV-1__FJ882565__SS-prME
  source 1..9879: mol_type = other RNA
agcgtaactatgctactgatgctaatgccaactgcacttgcatttcatttaacaacccggggaggagaaccacacatgatagtaactaaacaagaacgtggaaaaagccttctttttaaaacatctgcaggcgtaaacatgtgtactttgatagcaatggacttaggcgaattatgtgaagatacaatgacatataaatgtccacgcattactgaagcagaaccagacgatgtagactgttggtgtaacgcaacagacacatgggtcacatatgggacttgttcacaaactggtgaacatagacgcgataaaagatcggtcgcgctagcaccacacgtgggtctaggactagaaactcggacggaaacatggatgtcttcagaaggcgcatggaaacaaatccaacgagttgaaacctgggctttaaggcatcccggtttcacagtaatagctctgtttctagcacacgcaataggtacatctattacacaaaaagggataattttcatcctcctaatgttagtgacaccaagtatggcgatgcgatgtgtcggcatcggtagcagagatttcgtcgaagggcttagcggagctacttgggtagatgtagtcctagaacatggaagttgtgtaacaacgatggcaaaagataaaccaacgctcgatattgaattgttgaagacggaagtaactaacccagccgtattacgcaaattgtgtatagaagcgaaaattagcaataccacaaccgacagtagatgcccgacacaaggtgaagcaacacttatggaagaacaagatgctaacttcgtatgtcggaggacttttgtagaccgtggttgggggaatggatgcggactcttcggcaagggcagtctaatcacctgtgctaagttcaaatgcgtaaccaaacttgaaggaaaaatcgtccaatatgaaaacttaaaatactcggtcattgtaactgttcacactggagatcaacaccaagtcggcaatgaaagtacggagcacggaacaacagctacgattacaccccaagcacctacatctgagatacaattaacagattatggagccttgacattagactgtagccccaggaccggactagattttaacgaaatggtcttattaaccatgaaagagaaaagctggctagttcataaacaatggtttttagatctgccgcttccctggacatcaggagcgagcacatctcaagaaacgtggaacaggcaagatctattagtcacttttaaaacagcccatgcgaagaaacaggaggtagtagtactaggttctcaggaaggggctatgcacactgcactaacaggggcaaccgaaatacagacgagcggtaccaccacaatatttgcaggccaccttaagtgccgactaaaaatggataaactaacattgaaaggaatgtcctacgtcatgtgtactgggtccttcaaactagaaaaagaggtagcagaaacacagcatggaacagttttagttcaaataaagtacgaaggaactgatgcgccatgtaaaatacccttcagtacacaagatgaaaaaggtgttacacaaaatggcagattaattacagcaaaccctattgtaacagacaaagaaaagccagtaaacatagaagcagagccaccctttggagaatcatacatagtaataggtgcaggagagaaggccctcaaattaagttggtttaagaaagggagcagtattggaaaaatgtttgaagcaacagctcgtggtgcgaggcgaatggccatcctcggagacacagcatgggacttcgggtccataggcggagtattcactagcgttggaaaacttgtgcaccaaattttcggaaccgcttacggagttttatttagtggagtttcctggacgatgaaaatcggcataggtgttctgctaacttggttaggcttgaatagcaggtctacatccttatcgatgacgtgtatagcagtaggactcgttacactttaccttggcgtcatggttcaagcggatagcggctgcgttatcaattggaaaggacgagagttgaagtgtggtagcggtatatttgttaccaatgaagtccatacttggaccgaacaatataaatttcaagcagatagcccaaagagactttcagcagctattggtaaggcttgggaagaaggtgtttgcgggataagaagcgctacacgattagagaatattatgtggaaacaaattagcaacgaattaaaccatatcttgctagaaaacgatatgaaattcaccgtagttgtcggagatgtggtgggtattttagctcaaggtaaaaagatgattcgacctcaaccgatggagcacaagtactcctggaaatcctggggaaaagcaaagataataggagcagacgttcagaatacaaccttcatcattgatggtcctaatacaccggaatgtcctgatgatcaaagagcctggaatatttgggaagtcgaggattatgggtttggtatatttactacaaatatatggcttaaactacggggcagttatactcaagtatgtgaccatagacttatgagcgctgctattaaagactcaaaagcagtacatgcggacatgggatattggattgaatcagagaaaaatgaaacctggaaactagccagagccagctttatagaggtgaagacatgcatttggcctaagagccataccttatggtccaatggagtactcgaatcagaaatgattatacctaaaatatacgggggacctatatcgcaacataattatcgaccaggttattttacacagacagcaggcccatggcacctcggtaaattggaacttgacttcgacctatgtgaaggaacaacagttgtagtcgatgaacactgtggcaacaggggacctagcctcagaacgactacggtaactgggaagataattcacgagtggtgctgtagatcctgcactttaccaccgttacgctttaagggagaagacggttgctggtacgggatggagattagacctgtaaaagagaaagaagaaaacctggtaaaatcaatggtaagtgctggcagtggagaagtggatagtttcagccttggattgttatgtatctcaataatgattgaagaggtcatgaggtcacgttggtcacggaagatgctaatgacaggtacattagcagtgttcctcttactgataatggggcaattaacttggaacgatttaataagactttgtataatggtaggggctaacgcatctgatagaatggggatgggaacaacatacttggcactgatggcgacatttaagatgagacccatgtttgcagtgggtcttctattccgcaggctcacttctcgtgaagtattgttgctaacaataggactttctctagtcgcatcggtggaattacctaattctttggaggaattaggagatggattagcaatggggataatgatactgaaattattaactgattttcaaagtcaccagttatgggcgacactcctgagtttaacgtttataaaaacaaccttatcattacattatgcttggaaaacaatggctatggtgttaagcatagtctcgctctttcccctctgcctgtcaacaacaagtcagaaaaccacttggttaccagttctgttaggctcactcggatgcaagccacttaccatgttcttaatagcagaaaacaaaatctggggcagaaaatcgtggcccctaaatgagggaattatggcggtaggagtggttagcattttgctatcaagtctgttgaaaaatgacgtaccattagcaggacccttaattgccggtggtatgttaatagcatgctatgtcataagcggatcttcagcagacttgtcacttgaaaaagccgccgaagtttcgtgggaagaagaagcagaacattcaggggctagtcacaacatcctcgttgaagtacaggacgacggaacaatgaagattaaggacgaagagagggatgatactttaacgatactactaaaagcaacattattagccgtctcaggagtttatcctctatcaatcccagcgacattatttgtttggtacttctggcagaagaagaaacaaaggtcaggggttctttgggatacaccatcaccgcctgaggttgagcgtgcagtccttgatgatggcatttatcgaataatgcaaagagggctattaggcagatcacaagttggtgttggcgtgtttcaagagaatgtttttcataccatgtggcatgtcactcgtggcgcagttttaatgtatcaaggaaaacgtcttgagccgagttgggccagtgtcaagaaagatttaatctcttacggcggaggatggagattgcaaggatcttggaacactggtgaggaggtccaagtgatagcagttgaaccgggcaaaaatcccaagaacgtccaaactgccccaggcacctttaaaacgcccgaaggtgaagtaggagccatcgcactcgacttcaaacccggaaccagcgggtcgcccatagtaaatagagaaggtaagatagtaggcttgtatggaaatggagtagtgacaacatcgggtacatacgtgagtgctattgcacaggcaaaggccagtcaagaaggccctctaccggagatagaagatgaggtattcagaaaaaggaatttaactataatggatttacacccagggtccggcaagactagaagatatctaccagctatagtcagagaggctatcaaacgtaaactcagaacattaattctagcacctaccagagttgttgctagcgaaatggcggaagccttaaaaggcatgccaatacgataccaaaccacggctgtcaaatcggaacataccggtaaagaaatcgtggacctgatgtgccacgctacatttaccatgcgactattatcgcctgtgagagttccaaattataatatgattattatggacgaggcacatttcacggacccaagttcaattgcagcgcgtggatatatctcaacaagagtaggtatgggagaagcggctgcaattttcatgactgccacacctccggggtcggtggaggcttttccccaaagtaatgcggtaattcaagacgaagaaagagatatacctgaaaggagctggaatagtgggtatgaatggattactgattttcctgggaaaactgtatggtttgtcccatcaataaaatcaggcaatgacatagcaaattgtctgaggaaaaatggaaagagggtgatacaattaagtaggaaaacgtttgatacagaatatcagaaaactaaaaacaatgattgggattacgttgtaacgacagacatatctgaaatgggggcgaactttagagcggatagagtaattgacccgcggaggtgtttaaagccagttatccttaaggatggaccagagagagtcatcctggcggggcctatgcccgtgacggtagccagcgcggcacaacgacgtggtagaattggaaggaatcacaataaggagggcgatcaatatatatatatgggacaaccactcaataacgacgaggatcatgcacattggacagaggctaaaatgctcttggacaatattaacacgccagaaggtatcataccagcattatttgagccagaaagagaaaaatcagctgctattgatggagaatataggttacgaggagaagcccgaaagacgtttgtagaattaatgcgtaggggagatctgccggtatggctaagttacaaagtggcatcagaagggtttcaatatagcgaccggagatggtgttttgacggcgaaagaaataaccaggtactcgaagagaatatggatgttgagatctggacaaaggaaggtgaaagaaagaaattacgtccccgttggttagacgccaggacatattcagaccccttggcattaagggagtttaaggagttcgcagccgggcgaagatcagttagcggggatctcatcttagagataggaaagttaccccagcaccttacacaaagagcacaaaacgctttagacaatctagtaatgttacacaattcagagcaaggaggacgagcatatagacacgcgatggaggaactaccagatacaatcgaaaccttgatgttacttgcactgattgctgtacttacgggcggtgtaaccctgttctttctatctggtagaggtctaggaaaaacatcaataggactactatgtgtaatggcaagcagtgtgttactgtggatggcatcagtggaacctcactggatagcagcatccattattttagagtttttcttaatggtgcttctgattccagagccagatagacaaaggaccccgcaggacaaccaacttgcttacgtagtgattgggctgctatttatgattcttacggtcgccgcaaacgaaatgggacttctcgaaaccacaaagaaagatttaggaatcggccatgttgcggtagagaatcatcatcacgcaacaatgctagatgttgatcttcatccggcttccgcttggactttatatgcagtggcaacaacaattattacacctatgatgcgccacaccatagaaaatacaacagctaacatatctttaactgcaatcgccaatcaagcagcaatactcatggggctggataaaggttggccaataagtaaaatggacattggcgtgccactacttgccctaggatgttacagtcaagtcaaccccttgacactaacggctgctgtactaatgcttgtagcacattacgcaataattggacccggacttcaggccaaagctacccgcgaagcacagaaaagaacggcagcaggaataatgaaaaatccaacggtcgacggaattgtagctatagatctagacccagtcgtttacgacgcaaaatttgagaaacaattggggcaaatcatgcttttaattttgtgcacatcacaaattctcctaatgcgaactacatgggcactatgtgagtctattacactcgcgacaggcccattaactacattatgggaaggaagcccaggaaaattttggaacactacaatcgcagtaagcatggcaaacatttttcgcgggagttatttagcaggagcaggtcttgcattctcattaatgaaatcactaggaggaggacgacgggggacgggagcccaaggtgagacgttaggagaaaaatggaaaagacaactcaatcaactatcaaagagcgagttcaatatttataaacgatcaggaatcatggaagtcgaccgatccgaggccaaagaaggcttaaagagaggagagacaactcgtcatgctgtatcaagagggaccgccaagttgagatggttcgtagaaagaaatttagtaaaaccagagggaaaagtgatagacttaggatgcggcaggggtggatggtcctactactgcgccggactcaagaaagtcacagaggttaaaggatacactaagggaggacccgggcacgaggaaccaataccgatggcgacatatggatggaatttagtaaaattgcacagcggtaaggatgtctttttcacgccgccagaaaagtgtgatacattgttgtgcgatattggagaatcttctccgaatcccacaatagaggagggtagaacattgcgggtccttaagatggtcgaaccgtggctgagaggaaatcagttttgtataaaaattcttaatccatatatgcctagtgtggtagaaactttagaacaaatgcaaagaaagcatggaggaatgctcgtaagaaacccactgagccggaactctacgcacgaaatgtactgggtttcctgcggaacagggaacattgtgagcgcagttaacatgacatcgcgcatgctactaaatagattcacgatggcgcatcgtaaaccgacctacgaacgagacgtcgaccttggagctggtacacgacatgtggcagttgagcctgaagtagcaaacttggacataatcggacaaaggatagagaatatcaaacacgaacataaaagcacatggcattacgacgaagataacccctataaaacctgggcatatcacggctcgtacgaagtgaaaccatctggttcggcctcaagcatggtaaatggggtcgtaaaactgttaacaaagccgtgggatgtaataccaatggtaactcaaatcgctatgaccgatacaacgccttttggacaacagcgagtatttaaggaaaaagttgataccaggactccaaaagcaaaaaggggtaccgcacaaataatggaagtgacagctagatggctttgggggtttctctcgcgaaacaaaaagcctcgaatatgtaccagagaggagtttacgagaaaagtacgatcaaacgcagcaataggagccgtttttgtagacgaaaatcaatggaactcagcaaaagaagcggtcgaagatgagcggttctgggatttagtacaaaaagaaagggaattgcataaacaagggaaatgcgccacatgcgtatataatatgatgggcaaaagagagaagaaattaggagagtttggaaaagcgaaaggttcaagggcgatctggtacatgtggttgggtgcaagattcctagagttcgaagcactcgggttcatgaacgaagatcactggttctcgagggaaaattcattatctggggtggaaggagagggtctccataaacttggttatatactaagagatatatctaaaatcccaggaggcaatatgtatgccgacgacactgcaggatgggacacccgaatcactgaagacgacttgcaaaatgaggcaaaaataacggatattatggagcccgaacatgcactactagctacatcgatattcaaactaacttaccaaaataaggttgtaagagttcaaagaccagccaaaaatgggacggttatggacgtcatatccaggagagaccaaagaggcagcggtcaagtcggtacttatggacttaatacttttacaaatatggaagcacaactaattcgccagatggaaagtgagggaatattcctcccatcagaattagaaactccaaacctagcagaacgagttctagattggttggaaaagtacggtgtggaacgtttaaagaggatggcaattagcggtgacgattgcgtggtaaaaccgatcgacgataggtttgctaccgcgttaactgctttgaacgatatgggtaaagtccgaaaagatatcccgcagtgggaacctagtaaaggatggaatgattggcaacaagtgccgttttgttcacatcattttcatcaactaatcatgaaggatggccgtgaaatagtggttccatgcaggaaccaggatgaacttgtcggtcgcgctagagtgtcgcaaggagcaggttggagtctgagagaaacggcatgtttaggcaagtcatatgcgcaaatgtggcaattaatgtatttccatcgtcgtgatttaagactggctgcaaacgcaatatgctcggcagtaccagttgattgggtacccacaagtagaactacttggagcatccacgcacatcatcaatggatgacgacagaagatatgctaagcgtatggaatagggtatggattgaagaaaacccttggatggaagataaaactcatgtgtcatcctggggtgacgtaccatatttaggaaaacgagaggaccaatggtgtggttcactaattggacttacggcaagagctacatgggcctcaaatatccaagttgctatcaatcaggtgcgcaggttgatcggcaatgagaactatttagactatatgaccagtatgaaaagatttaaaaacgaaggcgacccggaaggagccttatggtga

SEQ ID NO: 21714 - RNA, 9879 nt, synthetic construct
  misc_feature 1..9879: note = derived and/or modified CDS sequence (opt6) from DENV-1__FJ882567__SS-prME
  source 1..9879: mol_type = other RNA
agtgtaactatgctattaatgctaatgccaacagctctcgcttttcacttgacgacacgcggaggcgaaccgcatatgatagttacaaagcaagaaagaggtaaatcattattatttaaaacttcggcaggggtaaacatgtgtacattaatagctatggatctaggagaactatgtgaagatacaatgacctataagtgtccgaggataactgaggctgaacctgacgatgtagactgctggtgtaacgcgactgacacatgggtaacatacggaacatgtagtcaaactggcgagcataggagggacaaacgtagtgtagcacttgcaccacatgttgggttaggactcgaaacccgaaccgaaacttggatgtcaagtgaaggagcatggaaacaaattcaaagggtcgaaacatgggcacttcgtcacccgggattcacagtgattgcactattcttagcgcacgcaataggaacatctattacccaaaaagggattatattcatcttactaatgctcgtgacaccgtctatggccatgcgatgcgttgggataggctcgagagattttgtagagggattatcaggggcgacttgggttgatgtagtcttagaacacggatcttgtgtgacaacgatggcaaaagacaaacctactctggatattgaactgttaaaaacagaagtaacaaacccagcggtgttacgtaaattatgtattgaagcaaaaatatcaaacacaactacggacagtagatgccccacacagggagaggcaacccttatggaagaacaagatgcaaactttgtctgcagacgtactttcgtagacagaggatggggaaacggttgcggcctatttggaaaaggatcattaataacatgtgcgaaattcaaatgcgtaacaaaacttgaagggaaaatagtacaatacgaaaatttgaaatacagcgttatagttacggtacacaccggtgaccaacatcaggtaggtaatgaatctactgaacatggaacaaccgctacaataacaccccaagcacctacgtcggaaatccaattaacagattatggagctctcactttagattgctctcctagaaccggattggatttcaatgaaatggttctccttacaatgaaagaaaagagctggttagttcataagcaatggtttcttgatctaccgttgccttggacatcaggtgcatctacatcccaagaaacatggaacagacaagatctattggttacgtttaaaacagcgcacgcaaagaaacaagaagtcgttgtcctaggaagtcaagaaggagccatgcacacagcattaaccggtgcaacggaaatccaaacatccgggacaactacgatatttgcaggtcatcttaaatgcagactgaaaatggataaactgactctgaaggggatgagctatgttatgtgtaccggatccttcaaattagaaaaggaggtagcggaaacacaacatggaacagtacttgtacagataaaatacgagggaacagacgcgccatgcaaaattccctttagtacacaagatgaaaaaggagtgacccaaaatggtagattaataacagccaatccaatcgtcacagataaagaaaagcctgttaatattgaagccgagcctccatttggtgaatcgtacatcgtcataggcgccggcgagaaagcattaaagctaagttggtttaagaaaggatcttcgatagggaagatgttcgaagctactgctagaggagcaaggagaatggctatccttggggacactgcatgggatttcggaagtatcggaggggtgtttacatctgttggaaaattagtccatcaaatattcggtacagcatatggtgtattattcagcggtgtttcttggacaatgaaaatcggaataggagtattattaacctggcttggtttaaatagtcgaagtaccagtttaagtatgacctgcattgccgtgggtctagtaacactatatctaggggtaatggttcaagctgattcaggctgtgtaataaattggaaaggaagagaattaaaatgcggctcaggcattttcgtcacgaatgaggtgcacacgtggacagagcaatacaaatttcaagcagattcaccaaaacgattgtctgctgcaataggaaaggcttgggaggagggtgtatgtgggataagaagtgcaacaagactagaaaacattatgtggaaacaaatatctaatgagttaaaccatattttgttagaaaacggaatgaaattcacagtagtggttggagatgtggtagggatattagcacaaggcaaaaagatgataagaccacaacctatggaacataaatatagctggaaatcttggggaaaggcaaagattataggcgcggacgtccaaaataccactttcataatcgatggaccaaatacacctgaatgtccagatgaccagcgagcgtggaatatatgggaggttgaagattacggctttggcatattcacgactaacatttggttaaaattgcgagacagctacactcaagtttgtgatcatcgacttatgtcagcggcaatcaaggatagtaaagcggtccacgcagatatgggatattggattgagtcggagaaaaatgagacctggaaattagctagagcctcgttcatagaggtgaagacatgcatctggcctaagtctcacactctgtggagcaatggtgtactggagagcgaaatgatcatacctaaaatatatggaggacctatatcgcaacataattacagacctggatactttacacaaacggcggggccatggcatttagggaaactcgagttggattttgatctatgtgaaggcactacggtagtcgttgacgaacactgtggaaacaggggtccgagtttacggacgactacagttacaggaaagatcattcatgagtggtgttgtagatcctgtactcttccacccctacgtttcaaaggagaagacgggtgttggtacggtatggagataagaccggtcaaagaaaaagaagaaaatctagtcaagtcaatggtctcggctggctcaggagaagtagatagcttttcattgggtctattatgcacttccataatgatcgaggaagtaatgagatctcggtggtcaaggaagatgttaatgaccggaacactcgcagttttcctcctcctaataatgggtcaactcacatggaatgatcttattaggctctgtatcatggtgggagctaatgcaagtgacaggatgggaatgggaacaacttacttagccttgatggctacttttaagatgcgcccaatgtttgcagtaggtctcttatttagacgtctaaccagtagagaagtacttctactcaccataggactaagtctagtcgcatctgttgaattaccgaatagcttagaggaattgggagatggtctagcgatgggcattatgatattgaagctgctaactgacttccagagtcatcaattatgggcaacgttgctaagtcttacctttatcaaaacaactttatcacttcactacgcgtggaagaccatggctatggtattatcgattgtttccttatttccgttgtgcttgtctacaacatctcaaaagactacttggttacccgtcctattaggatccttaggttgtaagccactaactatgttcctaatcgcagaaaacaagatatggggccgcaaaagctggccattaaacgaagggataatggcagtgggagtagtgagcatactcttaagttcattactcaaaaacgacgtgcccctagcggggcccttaatcgcagggggtatgttgatagcatgttatgtcataagtgggagcagtgcggatctgagcctggaaaaggctgcagaagtctcctgggaggaagaagccgagcatagcggggctagtcataatattttagtagaagttcaagacgatggaacgatgaaaattaaagatgaagaacgcgacgatacgctaacaattttacttaaggcgacattactagctgtgagtggagtctacccactatccatacccgcgactctatttgtatggtatttttggcagaaaaagaaacaacgaagtggagtactctgggatactccaagccctccggaggttgagcgtgccgtgctggatgatggcatttacagaataatgcaacgaggactgctgggtcgatcgcaggtaggggtcggtgtgttccaggaaaacgtctttcatactatgtggcatgtaacccggggtgcggtactaatgtaccagggaaaaagattagaaccatcatgggcgagtgttaagaaagacctaatatcttatggagggggatggagactccaaggatcatggaatacgggggaagaagtacaagttatagccgtcgagcctggcaaaaatcccaaaaacgttcagacagccccaggcacgttcaaaacacctgagggtgaggtcggtgcaattgcccttgactttaaacccggtacatcgggttcaccaattgtcaacagggaaggcaaaattgtagggctatacggaaatggggtagtaaccacgtctggaacgtatgtatctgccatagctcaggcgaaagcatcacaggaaggacctttacccgagattgaagatgaagtctttcggaaacgaaacttaaccataatggacctgcatcctggaagcggcaagactaggcgataccttccagctatagtgagggaagccatcaaacgcaagctaagaactttgatactcgctccgactagagtagttgcctcagaaatggcagaagcgttaaaaggcatgccaataagataccaaacaactgctgttaaatctgaacatacgggtaaagaaatcgttgatctgatgtgtcatgctacttttactatgagactactatctccggtaagggtaccgaattacaatatgataattatggatgaagcacatttcacagatcctagctcaatcgctgcaaggggttacatatcaacccgtgtggggatgggagaagctgcggccatctttatgacagccacccctccgggatcagttgaggcgtttccccagagtaatgcggtaatacaagacgaagaaagagatataccggagcggtcttggaatagcgggtatgaatggatcaccgatttccctggtaaaactgtatggtttgtaccaagcattaaatcaggtaatgacatagcaaattgccttaggaaaaatggcaaaagagtaatccagctatccagaaaaacttttgatacagaataccagaaaaccaaaaataatgattgggactatgttgtaacaaccgatatttcagagatgggtgccaattttagagcagacagagtaattgacccacgtaggtgtctaaaaccagtaatcttgaaggacggtcccgaacgtgttattcttgctggaccaatgccagtaacagtagcatcagcggcacaacgaagaggtagaattgggcgtaaccataacaaagaaggcgatcaatatatttatatggggcagccgctaaacaatgatgaagaccatgcccattggacagaagctaaaatgcttcttgataatattaatacacctgagggaatcattccagcactatttgaaccagagagagaaaaatcagctgccatagatggggaataccgtctgaggggcgaggcgaggaagacatttgttgaactaatgcgaagaggtgatctcccagtttggttatcatataaagttgcgtcggaaggatttcaatatagcgatagaaggtggtgctttgacggtgagagaaataaccaagtattagaagaaaatatggacgttgaaatttggacaaaagaaggtgaacgaaagaaactaaggccaagatggttagatgcaagaacatacagcgacccactggcattgagagaatttaaagaatttgcagcgggtcgcaggtccgtctcaggcgaccttatactagaaataggtaaattgccgcaacatttgacgcaaagagctcaaaacgcattagataatttagtaatgctacataattccgagcaaggagggagggcgtatagacatgcaatggaagaattgccagacacaatcgaaacattaatgctgttagcgcttatagcagtacttaccggaggagtaacgctctttttcttatcaggaagaggtcttggtaaaacttccataggactcctatgtgtaatggcgtcctcggtccttttgtggatggcatccgttgagcctcactggatagcagcgagtattatactagagttctttttaatggtacttctaatcccagagcctgacaggcaaagaaccccgcaagataatcaacttgcatatgttgttattggccttttgtttatgatactaactgttgcggcgaatgagatgggtctattagaaacaaccaagaaagatctaggtatagggcacgtagcagtagagaatcatcaccatgcgaccatgctagatgtcgacctacatcctgctagtgcatggacactttatgcggtagcaactacaatcatcacaccaatgatgagacatacaattgaaaatacaacagcgaacatttccttaactgcaattgccaatcaagcagctatactaatgggattagataaaggttggccaatatccaagatggatataggggttccactgttggctctaggatgttattctcaggtaaatcctcttacgctgacagccgctgttctaatgctagtggcacactatgctatcattggaccaggtcttcaagcgaaagcaactcgtgaagcgcagaagagaacagctgcagggattatgaaaaatccaaccgttgacggaattgtagcaatagatctagatcctgtagtgtatgatgctaaattcgagaaacaattgggccagataatgctgttaatcctttgtacttctcaaatacttttaatgagaacaacctgggctctctgtgaaagtataaccttagcaactggaccgctcacaactttatgggaaggttcccctggaaaattctggaatacaacaatagcagtgagcatggcaaatatctttaggggatcctacctcgctggcgcgggcctagcttttagcttgatgaagtcactcggaggcgggagaagaggcaccggagctcaaggtgagactcttggagagaagtggaaaagacaattaaatcaactctctaaaagtgaatttaacatatataagagatctggaataatggaagtagatagatccgaagccaaagaaggattgaaaagaggagaaaccacaagacatgctgtttcgcgaggaactgccaaattacgatggttcgtagaaagaaacctagttaaaccggagggaaaagttatagatttaggctgtggacggggcggatggagctattattgtgcgggcttgaaaaaggtcacggaagtaaaaggctacactaagggaggtccaggacacgaggaacccataccaatggctacatacggttggaatctggttaaacttcactcaggtaaggatgtattctttacacctccggaaaaatgtgatacattattatgtgatatcggagaatcttctccaaatccaacgatagaagaaggaagaacattacgggttcttaagatggtagagccgtggctgcgtgggaatcagttctgcataaagatactaaatccatatatgccatcagtagttgaaactctagaacaaatgcaacgaaaacatggaggaatgttagttagaaatccattaagtcgtaattcaacacacgaaatgtactgggtaagttgcggtacgggaaatatagtgagtgcagtaaatatgacatctcgaatgttactgaacaggttcacaatggcacatcgtaagccgacttatgagcgggatgtagatctaggcgcaggtacaaggcatgtagcagtggaacctgaagttgcaaaccttgatattattggtcaaagaatagaaaacataaaacacgagcacaagtcaacatggcattatgatgaagacaacccctacaaaacgtgggcctatcatgggtcttacgaagtgaaaccgagtgggtctgccagttccatggttaatggagtcgttaaattgttgacaaagccatgggatgttatacccatggttactcaaatagcaatgactgacaccacaccatttggccaacaaagagtctttaaggagaaggtagatactcgaacaccaaaagccaagcgtggtacagcacaaataatggaagtgacagctcgatggttatggggctttttatcaagaaataaaaagccccgaatatgtacaagagaagagttcactcgaaaagtccgaagtaacgcagccatcggagctgtcttcgtggatgaaaaccagtggaactcagcaaaagaggctgttgaagatgaacgcttctgggacttagtacagaaagaacgagaacttcacaagcagggaaagtgtgcaacttgtgtttataacatgatggggaaaagagagaagaaactaggtgagttcggaaaagctaaaggttcacgcgcaatttggtacatgtggctaggggcacgatttttagaatttgaagctctgggcttcatgaacgaagatcactggttttcccgcgaaaactccttatcaggagtagaaggagaaggactgcataaactaggctatatccttcgagatatatctaaaatacctggcgggaatatgtacgcagacgacacggcgggatgggacacaagaattacagaggacgatcttcaaaatgaagcaaaaataaccgacataatggaaccagaacacgcgcttctagccacgtctatattcaaattgacgtaccaaaacaaggttgtgagggtacaaagaccagctaaaaatggcactgttatggatgtaatatctagaagagaccaaagaggaagcgggcaagtaggtacctatggtctgaacacatttaccaacatggaagcccaacttatcagacaaatggaatcggaaggaatattcttaccaagtgaattagaaacaccaaatttggcagaaagagtattagactggttagaaaaacacggggttgaaagactaaaaagaatggcaatatccggtgatgactgtgtagtaaaaccaatagatgatcggttcgctacggcactaacagcactgaatgatatgggtaaagtacgcaaagatatccctcaatgggaaccctctaagggttggaatgactggcagcaagtcccgttttgcagtcaccacttccaccaactaataatgaaagatggcagagaaattgtggtgccctgcaggaaccaagatgagctggtgggtagagcaagagtttcccaaggtgcgggatggtctctacgcgaaactgcatgtcttggaaaaagttacgctcaaatgtggcaattaatgtattttcatcgtagagacttaagattagcagcaaacgcaatctgcagcgctgtgccagttgattgggtaccaacctctagaacaacatggtccatccatgcacatcatcaatggatgacaactgaagacatgctatcagtatggaacagggtctggatcgaagagaacccatggatggaggataagacacatgtgtcttcgtggggagacgttccatatttgggtaaacgagaagaccaatggtgcggttctcttatcgggttaacagcccgtgctacatgggcatctaacatccaagttgcaatcaatcaagtacgtcgacttattggtaacgagaattatttggattatatgacgagcatgaaaagattcaagaacgaaggtgatccagagggcgctttatggtag

SEQ ID NO: 21715 - RNA, 9879 nt, synthetic construct
  misc_feature 1..9879: note = derived and/or modified CDS sequence (opt6) from DENV-1__GQ199831__SS-prME
  source 1..9879: mol_type = other RNA
agtgttacgatgctattgatgctgatgccgactgccctggcatttcatttaactactagaggaggagaaccccatatgatagtaactaaacaagagcgtggcaaatcactcctctttaagacttctgccggagtaaatatgtgtacgcttatcgcgatggatctgggggagctttgtgaagatactatgacctataaatgtccccgaatcactgagacagaacctgatgacgtagattgttggtgcaatgctacagatacatgggtaacgtatggtacgtgctctcaaacaggtgagcacagacgagataaaagaagcgtagcattggcaccgcatgtgggacttgggttagaaacacgaactgaaacctggatgtcttccgaaggcgcttggaaacaaatacaaagggttgaaacatgggcattaagacaccccggattcactgttattgccctatttctggctcatgcaataggcaccagcataacgcaaaagggaataattttcatacttttgatgctcgtaaccccgtcaatggcaatgcggtgtgtgggcatagggagccgtgactttgttgagggcttgagtggcgcaacgtgggttgacgtagtactcgaacatggctcttgcgttacaactatggcaaaagacaaacccacgctagatattgaactacttaaaaccgaagtaaccaacccagctgttttaagaaagctctgcattgaggcgaaaatctcaaataccaccactgattctcgttgtccaacacagggagaagcaacgttaatggaggaacaagatgcaaattttgtctgccgacgaacatttgttgatcgaggctggggaaatggatgtggtctattcggaaaaggcagtcttattacttgcgctaagtttaaatgcgttacaaaacttgaggggaagatagtacaatacgaaaatcttaaatattcagtgattgtaactgtacatacgggagatcaacaccaagtaggaaatgaatccactgagcacggtacaacagctaccataacaccgcaagctccaacatccgaaatacaattaacggactatggagcattaaccctcgactgcagtcctagaacaggtttagacttcaatgaaatggtcttactaacaatgaaagaaaagagttggttagttcacaaacaatggtttttggatcttccactaccatggacttcaggagcctctacaagtcaagaaacatggaatagacaagatctattagtaacctttaaaactgcacatgcaaagaaacaagaggtagtagttcttggtagccaagaaggtgcgatgcacacagcgctaacaggcgctaccgagatacaaacaagtggaacaacgactattttcgctggacatttaaaatgtagactgaaaatggataaattaacattaaagggaatgagttacgtgatgtgcacaggatcattcaaattagaaaaggaagtggctgagacacagcacggcacagtccttgtacagattaaatatgaaggaactgacgccccctgtaaaataccattcagtacacaagacgagaaaggcgttacacaaaacggacgattaattacggcaaatcctatagtcacagacaaagagaaaccagttaatatagaggctgaaccacctttcggcgaaagctacatagtcattggagccggtgaaaaagcacttaaattaagttggttcaagaaaggaagcagtataggtaaaatgtttgaggccacagcaaggggagctcgacggatggcaatcttaggagatactgcctgggacttcggatcaatcggaggcgtgttcacaagtgttggaaagctggtccaccagatattcgggacagcatacggcgttctattttccggagtctcatggacgatgaaaataggaataggagtactactaacatggctaggacttaactcacgttccacaagtctatcgatgacatgtatcgcagtaggcctagtaactctttatttaggtgttatggtacaggcagattctggttgcgtaataaattggaagggtcgcgaactgaaatgtggaagcgggattttcgttacgaatgaagtccatacatggactgaacaatataagtttcaagcggattctcctaaacgcttaagcgctgccataggaaaagcatgggaagaaggagtgtgtggtataagatcagcaacaagattggaaaatattatgtggaagcaaataagtaatgagttaaatcacattcttttagaaaacgacatgaagttcacagttgtagttggcgatgtcgtcggtatattagcacagggtaagaaaatgattaggcctcaaccaatggagcataagtatagttggaaatcgtggggtaaagccaagataataggtgccgatgttcaaaatacaacctttataattgatggtcccaataccccagaatgtcctgatgaccaaagagcatggaatatatgggaagtcgaagactatggctttggaatatttactactaatatatggctgaagctacgcgattcttacactcaagtgtgtgatcatagactcatgtccgcagcgattaaagatagtaaggcggttcacgccgacatggggtactggatagaatcggaaaagaacgaaacatggaaactggcaagggccagttttatcgaagtcaaaacctgcatttggcctaaatctcacactctttggtctaatggagttctggaaagtgaaatgattatacctaagatatacggaggcccaatttcccagcataactatcgaccgggatattttacccaaacagctggtccatggcatctaggaaaactagagctagattttgatctatgcgaaggaacgacagtagtcgtagatgaacattgtggaaatcgtggaccctctcttcggaccacgacagtcacaggtaaaataattcatgagtggtgttgcagatcgtgcacattaccaccactccggtttaaaggggaagatggatgttggtacggtatggaaattcgtcctgtcaaagaaaaagaggaaaatttagtaaaatccatggtctccgctggtagcggtgaagtcgatagtttctcactaggtttactgtgtatctccatcatgatagaagaagtaatgcggtcacgctggagtagaaagatgctaatgacaggaacactggcagtatttctattacttatcatggggcaactcacctggaatgatctcataagattatgtataatggttggggcaaacgcgagtgatcggatgggaatgggtaccacatatctggctcttatggcaacgtttaaaatgagaccaatgttcgcggtaggattgctttttagacgattgacaagtcgcgaagtattgctcctcaccataggcttgagcctcgtagctagcgtcgaacttcctaactcgcttgaagaattaggagacggactcgccatgggaattatgatattgaagctactaaccgatttccaatcgcatcaactatgggcgaccctcctaagcctaaccttcataaaaacaactttatcacttcattatgcatggaaaaccatggcaatggttttaagtatagtgagtttatttccactatgcttgagcacaacctcacagaagactacatggctcccggtattgctaggtagcctcggttgcaagccactgacaatgtttctaatagctgaaaacaagatatggggtagaaagagttggccccttaatgaggggattatggccgtaggcgtagtaagcatcttacttagttcattacttaaaaatgacgttccgttagcgggtcccttaattgctggtggtatgcttatagcgtgctacgtaataagcgggagctcggcggacttgagtctcgaaaaggctgctgaagtttcgtgggaagaagaagcagaacatagtggcgcaagtcataatattctcgtagaggttcaagacgatggtacaatgaaaataaaagatgaggaaagagacgataccttgacgatactattaaaggctacattgctcgctgtatcgggtgtctaccccttatcaattccggcaactctttttgtctggtacttttggcagaagaagaaacagcgctctggcgtcttgtgggacacaccaagtccgccggaggtagagagagcggtgctcgatgacggtatttaccggattatgcaaaggggtttactaggacgcagtcaagttggagttggcgtgtttcaagaaaatgtatttcacacaatgtggcatgtaacaagaggtgctgtattaatgtatcaaggtaaaagacttgaaccaagttgggcgagcgtgaaaaaggatttgattagttacggtggagggtggagactacaagggtcatggaatacaggagaggaggtccaagtcatagccgtggaacctgggaaaaatccgaagaatgtacaaaccgcgcctggaacatttaaaactcctgagggagaggtaggggctatagcacttgacttcaagcccgggacaagtggatcaccaatagtgaatcgtgaagggaagatagttggactatatgggaacggagtagttacgacgagcggtacttatgtcagcgcaattgcacaagccaaggcatctcaggaaggtccgttaccggaaattgaagacgaagtcttcagaaagagaaatttgacaattatggatttacaccctggatctggtaaaacccgaagataccttcctgctatagtcagagaagcaatcaagaggaaactaaggaccctcatcttggcgccaactagagtcgtggcctcagagatggcagaagcacttaagggaatgcccatacgctaccaaaccacagctgttaagtcagaacatacgggtaaagaaatagtagatctaatgtgtcatgcaacctttacaatgcgattactgagccccgtaagggttcctaactacaatatgattataatggatgaagctcatttcaccgacccatctagcatagcagctagaggctacatatcaacaagagtagggatgggcgaagctgcggcaatatttatgacagcgacgccacccggatcagtggaagcctttccgcaatcgaacgctgttatacaggatgaggagcgtgacatacctgaacgctcatggaatagtggttatgaatggataacagattttccaggcaagacagtatggtttgtaccaagtattaaatctgggaacgatatagcaaattgcttaagaaagaatggaaaacgagttatacaactaagtcgaaaaacattcgataccgaataccagaaaactaagaataacgattgggactacgttgtaactacagatataagtgaaatgggtgctaattttcgagccgacagagtcattgatccaagacgatgcctgaagcctgttatacttaaagacggtcctgaacgagttatattggcgggtccaatgccagtgacagttgctagtgcagcacaaagacgagggagaataggaaggaaccacaataaagagggtgaccaatacatttacatggggcaacctttaaataatgatgaagaccacgcgcactggactgaagccaagatgctacttgataatatcaatactcctgaaggtatcattccggctctattcgaaccagaacgtgaaaaatcggcagcaatagacggtgagtatcgactacgtggagaagcaagaaaaacattcgttgagttaatgcgtcgtggcgacttgcctgtttggctatcatacaaagtcgctagtgaaggcttccagtattcggacagacgatggtgtttcgatggagaaagaaataatcaagtacttgaggaaaatatggacgtagaaatatggaccaaggaaggagaaagaaagaaactacggcctaggtggctggacgccagaacctattcggatcccctagccttaagggagttcaaagagttcgcagcagggcgaagaagtgtgtctggagatttaatactcgaaatcggaaagttgcctcaacatttaacacaaagggcccaaaacgcgttagataatcttgtcatgttgcataattcagaacaaggcgggagagcatatcgacacgctatggaagaactccccgacaccatagaaactttaatgttgctagcacttatcgctgtactaactggaggtgttacgttgttctttttaagcgggcggggacttggaaagacctcaattggcctactatgtgtgatggcttcctcagtcctgttgtggatggcatcggttgagcctcactggatagctgcatcgataatactagaatttttcctaatggtattattgatccctgaacccgacagacagagaactccccaagataatcaacttgcctatgtggtgatagggcttttgttcatgatactaacagtggcagccaatgagatggggttattagagacaaccaagaaagatttaggcattggacatgtcgccgtcgagaatcatcatcacgccacaatgttagatgtggatttacatccagcgagcgcatggacattgtatgctgtagcaactacaatcataacaccaatgatgcggcacaccatagaaaacacaaccgcaaacataagccttacagctattgctaatcaagcggcaatactcatgggactagataaaggatggccaatttctaaaatggacataggtgtaccgctccttgcactagggtgctatagtcaagtcaaccctcttacccttacggcagcggttctaatgttggtcgcgcattatgctattatcggacctggtctacaagcgaaagcaactcgagaagcgcagaagagaacagctgcaggtataatgaagaatccaactgttgacggaatagttgcgattgacctcgatcccgtggtttatgatgcgaaattcgaaaaacaactaggacaaataatgttattaatcctgtgtacgagccagattctactaatgagaacaacttgggccctatgtgaatcgataactctagcgacgggtccattgacaacgttatgggaaggctcacctggaaaattttggaatacaaccatagcagtctctatggcaaatatctttagaggatcatatctagcgggagccggtcttgcattcagtttaatgaaatcattaggtggcgggaggaggggtactggagcccaaggtgaaacactcggagagaaatggaagcgtcaattaaaccaattgagcaagtcggagttcaacatatataaacgctcaggaatcatggaagtcgatagaagtgaagcgaaagaaggcctcaaaaggggcgagacaactaggcatgcagttagtcgcggtacagcaaaactgagatggttcgtagagagaaatttagtaaaacctgaaggaaaagtaatcgatcttggttgtggaaggggtggctggagttactactgtgctgggttaaagaaagtcacagaagtaaaaggttacactaaaggcgggcctgggcacgaagaaccgatcccaatggccacatatggttggaacctagtaaaattacatagtggtaaagacgtcttctttactcccccagagaaatgtgatactttgctatgcgacattggggagagtagtccaaatcctactattgaggaaggtagaacattaagggtcttaaaaatggtagaaccttggttgagaggtaatcaattctgcatcaaaatacttaatccgtatatgccatcggtagtagaaacattagaacaaatgcaacgaaaatacggagggatgcttgttaggaaccccttatcacgaaacagtacgcacgaaatgtattgggtatcttgcggaacaggtaatattgtatccgcggttaatatgacatctcgaatgttattaaatagatttaccatggctcaccgaaaacctacatatgagagagacgtagatctcggtgctggaactaggcatgtcgctgtcgaacccgaagtagccaatttagatataataggtcaacggatagaaaatattaagcatgaacataagtcgacatggcattatgatgaagataatccatataaaacatgggcctaccacggtagctatgaggtaaaaccttccggaagtgcaagttctatggtaaacggggttgtgaaattattgacaaaaccatgggatgtcatacccatggtaacgcagatagcaatgactgacacaacaccttttggacaacaaagagtcttcaaagaaaaagtcgatacaagaactcctaaagccaaaagagggacagctcaaattatggaagtaacagcaagatggttatggggttttcttagcagaaataagaaacctcgcatatgtaccagggaggagtttacaagaaaagtgaggagcaacgccgctatcggtgcagtcttcgtagacgaaaatcaatggaactccgcaaaagaagcggttgaagatgagcgattctgggacctagtccaaaaagaaagagaattacacaaacaaggaaaatgtgcgacatgtgtgtacaatatgatggggaaaagagaaaagaagttaggagagtttggaaaagctaaaggaagccgcgcaatatggtatatgtggcttggagcgagatttttagaatttgaagcactcggatttatgaatgaagatcactggttctctagagaaaattcactgagcggtgtggaaggagaaggattgcacaaacttggatacatactaagggacatttcaaaaatacccggagggaatatgtacgcagatgatactgcaggatgggacacaagaataactgaagatgaccttcagaatgaagcaaaaattaccgacataatggaaccagaacatgcattattagcaacctccatatttaaattaacgtatcaaaataaggtcgtacgagttcagcgcccagcaaagaacggtactgtcatggacgtaatatctagaagagaccaacgtggttcaggacaagtaggaacatatggcctaaatacatttacaaatatggaggctcaacttataagacaaatggaatccgagggtatatttctcccatccgaattagagacaccgaacttagctgagagagtattagattggttagagaaatatggagtagaaaggctaaaaagaatggcaataagcggtgatgattgtgttgtcaagcctatagatgacagatttgccactgcattaacagctttaaatgatatgggtaaagtacgaaaagatataccgcagtgggaacccagtaaaggatggaatgattggcaacaggtccccttctgctcccaccacttccatcagttaattatgaaggacggtcgagaaatagtcgttccatgtcggaatcaagacgaattagtaggcagagccagagtctctcaaggtgccggttggtctttacgtgagacagcatgtttaggtaaatcttatgcacaaatgtggcaactcatgtattttcacaggagagatctaagattagccgcaaatgcgatttgctcagccgatcctgttgattgggtccccacatcacgaacgacttggagtattcacgcccatcatcagtggatgacaacagaagatatgttaagcgtctggaatagggtctggatcgaagaaaacccctggatggaggataaaacacacgtttcatcctggggcgacgtgccttacttaggaaaacgggaagatcaatggtgcggtagtttgatagggcttacagctcgggcaacctgggcttcaaacatacaagtggcaataaatcaagtccgaagactcatcggaaatgaaaactatctagactatatgacttccatgaaaagattcaagaacgagggggaccccgagggagcactatggtag

SEQ ID NO: 21716 - RNA, 9879 nt, synthetic construct
  misc_feature 1..9879: note = derived and/or modified CDS sequence (opt6) from DENV-1__GQ199832__SS-prME
  source 1..9879: mol_type = other RNA
tcagttactatgctcttaatgttaatgcccacggcactagcttttcacttgacgactaggggaggagaacctcatatgattgtgactaaacaagaaaggggtaaaagtctcctgtttaaaacttcggccggtgtaaatatgtgcacattgatagccatggacctaggtgaactatgcgaagacacaatgacttacaaatgcccacgtataacagaagcagagccagatgacgtggattgttggtgtaatgcaacagacacgtgggtaacatatgggacatgcagtcagaccggagaacacagaagagacaaaaggagcgtggctctggcaccgcatgtaggtttagggttagaaacaagaacagagacgtggatgtcatcagaaggcgcttggaaacagatacagagagtagagacatgggcgttacgacatccaggatttacagtaatcgcactatttttagctcatgcgattgggacaagtattactcaaaaaggaattatatttatactcttaatgttagttacaccatcaatggcgatgagatgtgtaggaatagggagtcgggattttgtagaagggttatcaggggcaacatgggtcgacgtcgtgctagaacatggtagctgcgtaacaaccatggctaaagataaacccaccttagatatcgagctgcttaaaactgaagtgaccaaccccgcagtcttacggaaactatgtatagaagcaaaaatctcgaatactacaaccgactctcgctgcccaactcagggagaagcaactctaatggaagaacaagatgcaaactttgtatgccgtcgaacctttgtagatagaggttggggaaacggatgtggactattcggaaaaggatccttaattacttgtgctaaatttaagtgcgtcaccaaactagaaggaaaaatagtacaatatgagaacctcaaatactcagtgattgttaccgtacatacaggagaccagcatcaagttggaaatgaatcaacggaacatggtactacagctactatcaccccgcaagcacctacaagcgagatacaacttaccgactatggggcgctgaccctagattgcagccctaggacaggactagacttcaacgaaatggtcctcttaaccatgaaagagaagtcctggttagtacacaaacaatggttcctagacttaccacttccctggacatctggtgcttctacaagtcaagaaacttggaatcgacaggatctattagtgacattcaagaccgctcacgcgaaaaagcaagaggtcgtggtattgggatcgcaagagggagctatgcacactgcactaacgggtgcaactgaaattcagacatcaggaactaccactatatttgctggacacctaaagtgccgcttaaagatggacaaattaacgctaaaaggaatgtcttatgtaatgtgcaccggcagctttaaactagaaaaagaagttgcagaaacacaacacgggacagtacttgtccagatcaaatacgaagggacagatgcaccgtgcaagatacctttctcaacacaagacgaaaaaggagtcacccaaaacggacgattaataactgcaaacccaatcgtgactgataaagaaaaaccagtaaatattgaagcagaaccccctttcggcgaaagctatatcgtaattggagctggtgaaaaagcactgaaactttcgtggtttaagaaaggttcgagtattggtaaaatgtttgaagcaacagcaagaggcgctagaagaatggcaattcttggtgacacggcatgggattttggatccatcggaggcgtctttacgagtgtcggaaagctagtacaccagatttttggaacagcatacggagttctcttctcaggggtgtcatggacaatgaaaatagggattggagtccttttaacatggctgggcctaaatagcaggagcacatctttatctatgacatgcatcgctgtaggattggtaacattatatctaggcgtaatggtacaggcagatagtggatgtgtgattaactggaaagggcgtgaattaaaatgtggcagtggaatcttcgttacaaatgaagtgcatacatggacggagcaatataaattccaggcagacagcccaaaacgattaagcgccgctataggtaaagcgtgggaagaaggagtatgcggcataagaagtgcgacaagactagaaaatataatgtggaaacaaatatccaacgagcttaaccacatcttactcgaaaatggtatgaaattcactgtagttgtcggagatgtagtcggcattctcgcacaagggaagaaaatgatacgaccgcagccaatggagcacaaatattcatggaaatcctggggcaaagctaaaatcataggtgctgatgtgcagaatactactttcataatagatggtcccaatacgcctgaatgtcctgatgatcaaagggcttggaatatctgggaggtcgaagattacggatttggtatatttacaactaacatctggctaaaactccgggatagttatacccaagtgtgcgatcaccgattaatgtccgcggcaataaaagattcaaaagcagtacatgcagacatgggttattggattgaaagtgagaaaaatgaaacctggaaattagcaagagcaagttttattgaggttaagacatgtatttggcccaagtcacacaccttatggagcaacggagtattggagagtgaaatgataattccgaaaatttatggtgggccaatttcacaacataactataggcctggctactttacgcagaccgccggaccatggcatttgggtaaactagaattagactttgacttatgcgaaggaaccacggttgtagtagatgagcattgtgggaataggggaccttcgcttcgtacgactacagtgacgggtaaaataatacatgaatggtgctgccgaagttgcacattacctccccttcgctttaaaggggaggacggatgctggtatggcatggaaataaggcccgtgaaagaaaaagaagaaaacttagtgaagtccatggtgtcagccgggagtggagaagttgactcattttccctagggttactctgcacgagtataatgatcgaggaggtaatgagaagccgctggagtaggaaaatgctgatgacaggaaccctagcagtattcttattgttgatcatgggtcaactaacttggaatgatctaatacgtctctgcataatggtaggtgccaatgctagcgatagaatgggaatgggaacaacatacctggcattaatggcaacgtttaagatgcgtcctatgtttgcagtaggactacttttccgcaggctgaccagtcgcgaagtattgcttctgacaattggtcttagtctcgtagcaagcgttgaactcccaaactcattggaagaattgggtgacggactagcaatggggataatgatactaaagctcctgacagatttccagtcacatcaattatgggcaaccttgctctctcttacttttattaagacgacactatcattgcactatgcgtggaaaactatggcaatggtactatccattgtaagtctatttccactatgcctcagtactacatcacagaaaactacatggctaccagtacttttgggttctctcggctgcaaaccgttaactatgtttcttatagctgaaaacaaaatatggggtaggaaaagttggcccttaaacgaaggtataatggcagtaggcgtggtctctatattattgagcagtttactgaagaacgatgtaccattagctgggcctctcattgcaggaggcatgttaatcgcttgctacgttatttcaggaagctcagctgacctttcacttgaaaaagccgcagaagtcagttgggaagaggaggccgaacattcaggagcctcgcacaatatccttgttgaagtgcaagatgacggcacgatgaaaataaaagacgaagaacgagatgacacgctaactattttactaaaagcaaccttactcgctgtatccggagtatatccactttcaattccagcgactctcttcgtctggtatttctggcagaagaagaaacaaagaagtggagtactttgggacacacctagtccacccgaagtagagcgtgcagttcttgatgacggtatttaccgtataatgcaaagggggttactaggtagatcacaggtaggcgtaggtgtattccaagaaaatgtatttcatacaatgtggcatgtaactcgcggagctgttctgatgtaccaaggtaaaagacttgagcccagttgggctagcgtgaaaaaggacctaataagttatggtggaggatggcgattgcaaggctcctggaatactggagaggaagttcaagttatagctgtggaacctgggaagaaccctaaaaatgttcaaacggcccctggtacttttaaaacgccggagggtgaagttggcgcaatagccttagattttaaacctggtacatctgggagtcccattgtaaatagagaaggaaaaatcgtagggttatacggtaatggagtcgtcacaacttctggaacatacgtttcagcgatcgcacaagccaaggcttcacaggaaggaccactaccagaaatagaggatgaggttttccgaaaaagaaacctaactattatggatctgcatcctggtagtgggaaaacgcgcaggtatctacccgcaatagtgagagaagcaataaaacgaaaattaagaactttaatactagcacctacccgtgtcgtcgcatccgaaatggcagaagctctaaaggggatgcctataagataccagacgactgcggtcaagtcagagcatacggggaaggaaattgtggatctaatgtgtcacgctacattcacaatgaggcttctctctcccgtgagagtccccaactacaacatgataataatggatgaagctcatttcacagatccttcgagtatagcggcaagaggatatatctcaactagggtaggtatgggtgaagcagctgccatctttatgacggctacaccaccagggagtgtagaagcgtttcctcagtcaaacgcagtaatacaagacgaggaaagagacattcctgagaggtcttggaactcaggctatgagtggatcactgattttccgggaaaaaccgtgtggtttgtgcctagcataaaaagtggaaatgatattgcaaattgccttaggaagaatggaaaaagagtaattcagttatcccgcaagacttttgataccgaatatcaaaagacgaagaataacgactgggactatgtagtaactaccgatataagcgaaatgggcgctaactttcgggcagatcgggtgattgatccaagacggtgtctcaagccggtaatcctgaaggatggaccagaaagggtaattttagcgggtccaatgccggtaacggtggcttcggcagcacaacgcaggggtcgaattggaagaaatcacaacaaggaaggagaccagtatatttatatgggacaaccgttaaataacgacgaagaccatgcgcattggacagaagcaaaaatgcttttagacaatataaatacaccagaaggaataatacccgcactgttcgaacccgaaagagagaaaagcgcagccattgatggagagtataggctacgtggggaagcacggaaaaccttcgtagaactgatgagaagaggagatctcccagtctggttgagttataaagttgcaagcgaaggatttcaatactcagataggaggtggtgcttcgacggtgaacgcaataatcaagttttagaggaaaatatggacgtggagatttggacgaaggaaggagaaagaaagaaattaaggccacgttggcttgacgcaagaacatactctgacccactagcactgagagaatttaaggagtttgccgcaggacgtagatcggtaagcggagacttaatcctcgagattggcaagttaccacaacacctaactcaacgtgcccaaaacgcactggataaccttgttatgctccacaattcagaacagggtggacgtgcttacaaacacgccatggaagaacttccagatacaatcgaaactctcatgctacttgcgctaatagcggtcttaactggaggcgtgacgctattctttcttagtggcagaggtttaggcaaaaccagcataggacttttatgtgttatggcatccagtgttctgttatggatggcatcagtagagcctcactggattgccgctagcattatattagagttctttttaatggtactactaataccagaacctgataggcaacgcacaccacaagataatcagttagcatatgttgtgataggattacttttcataatattaaccgtagcggccaatgaaatgggattattggaaacaacaaagaaagacctaggaatcggacacgtggccgtagaaaaccatcatcacgccaccatgttagatgtagatttacacccagctagtgcatggacattatacgccgtagcaacaacgattatcacaccgatgatgagacatactattgaaaacacgaccgctaacatatcattaaccgcgatagcaaatcaggcggcgatattaatgggcctagataagggatggcccatatccaaaatggatataggagtgccattattagcgcttggctgttactctcaagtaaacccattaactctcaccgctgcagttcttatgctagttgcccactatgcaattataggcccaggactgcaagcaaaagcaacacgtgaggcacaaaagaggacagctgcgggaataatgaaaaatccaactgtggacggaatcgtagctatagatcttgatccggtggtttacgatgcgaagtttgaaaaacaattaggacagattatgttacttattctttgcacgagtcaaatcttattaatgcgtacaacttgggcgttatgcgaaagtataaccctcgctacagggcccctgactactctgtgggagggttcacccggtaaattctggaataccacgattgcagtatctatggcaaacatcttccgaggctcatatcttgcgggggcaggattggcgttctctctaatgaaaagtttaggaggtgggcgtagaggtacaggtgcacaaggtgaaactttgggggaaaagtggaagcgccaattgaatcagctatcgaaatcagaatttaatatctataaacgaagcggaataatggaggtagataggagcgaagctaaagaagggctgaagcgtggggaaacaacaagacacgcggttagtagaggtaccgccaaattacgatggtttgtagaaagaaacttggtaaaaccagaaggaaaagtaattgacctaggatgcggacgaggaggttggtcatattactgtgcaggactcaaaaaggttacagaagtaaaaggttacaccaagggcgggcctgggcacgaagaaccaataccaatggctacttatggctggaatttagtaaaactacacagcgggaaggacgtattctttatacctccagaaaaatgtgataccctactttgtgatatcggagaatcgtcgcccaatccaacaatagaagaaggaagaacactacgggtattaaaaatggtcgaaccttggcttcgaggcaatcaattctgcatcaagattctcaatccctacatgccatccgtagtagaaactttagaacaaatgcagaggaaacatggcggaatgcttgtaaggaatccgctcagcagaaattctacacacgaaatgtattgggtatcttgtggaacaggaaacatagtatcagcagtaaatatgaccagtcgaatgcttttaaatagattcacgatggcccatagaaaaccaacatacgagcgtgatgtagatttaggagcgggaacaaggcatgtagctgtagaaccagaagtcgctaatttagacatcataggacagaggatcgaaaatataaagcacgagcacaagtctacatggcattatgatgaagataatccgtacaagacctgggcatatcatggatcttatgaagtaaaaccttcaggaagcgcctcaagcatggtaaacggagttgttaaactattaactaaaccatgggacgtcatacctatggtaactcaaatagccatgacagatacaacgccatttggtcaacaaagggtcttcaaagaaaaagtagatactcgtacaccgaaagcaaaaagggggacagcgcagattatggaggtaactgccagatggctgtggggattcttaagtagaaataagaaaccccgtatatgtacgcgcgaggagtttacgcgcaaagtcaggtcaaatgcggccataggggcagtgtttgttgatgaaaatcaatggaactcagcaaaagaggcagttgaagacgagaggttctgggatctagtacaaaaagaacgagaactccacaaacaaggcaaatgtgccacatgtgtctacaatatgatgggtaagagagagaagaaacttggggagtttggaaaagccaaagggagtagagcaatatggtatatgtggttaggagcaaggtttctggaatttgaggctttaggtttcatgaatgaagatcattggttttcaagagaaaattcattatcaggggtagagggagaaggactacataaactcggttacattctgagggacatatcaaaaatacctgggggcaatatgtatgcagatgatacagccggatgggatacaagaattacagaagatgaccttcaaaacgaggctaaaataaccgatataatggaacccgagcatgcattattagcaacatcaatctttaaattaacttaccaaaacaaggttgttcgtgtgcaaagaccagccaaaaacgggactgttatggacgtgataagccgaagagatcaacgtggatcagggcaagtaggtacatacggattaaacacgttcacaaatatggaagctcagttgatcagacaaatggaatctgagggaatattcctacctagtgagctagaaacgccaaatttagctgaacgagttctcgattggcttgaaaagtatggggtcgaaagactcaaacgaatggcaatatccggcgatgactgtgttgtaaaaccgatagatgatcgtttcgcgacagccctgacagcgctaaacgatatgggaaaagtaagaaaagacattccacagtgggagccaagtaaaggatggaatgactggcaacaagtacctttctgtagtcatcacttccatcaattaatcatgaaagatggccgggagatcgtcgtgccgtgccgaaaccaagatgaattagtgggtagggctcgtgtaagtcagggagcgggttggtccttaagggaaactgcatgcttaggaaaatcatatgcacaaatgtggcaacttatgtattttcaccgaagagatttacgtctggcagcaaacgctatatgttcggctgtaccggtagactgggtccctacaagccgcacgacttggagtatacacgcacaccaccaatggatgacaacagaagatatgttaagtgtatggaatcgtgtgtggatagaagaaaatccgtggatggaggacaaaacccatgtatcatcgtggggagatgttccttatttgggaaaacgtgaagaccagtggtgtggatctttaatcggattaaccgcaagagcaacttgggcctcgaatattcaagtcgcaattaaccaagtaaggagactaattggcaatgagaactatttggactatatgacaagcatgaagcgatttaaaaacgaaggtgatccagaaggagccctatggtaa

SEQ ID NO: 21717 - RNA, 9879 nt, synthetic construct
  misc_feature 1..9879: note = derived and/or modified CDS sequence (opt6) from DENV-1__FJ882568__SS-prME
  source 1..9879: mol_type = other RNA
tcagttacaatgttactgatgttaatgcctacagcgttagcatttcacctaacgactaggggaggtgaaccgcacatgatagtgacgaaacaagaacgtggtaagagcttactgttcaaaacatccgctggagtcaacatgtgtactctgattgcaatggatctgggtgaactgtgcgaagatacaatgacttataaatgtccacgaataacagaagccgaaccagatgacgtcgattgctggtgtaacgcgacagatacgtgggtgacatatggaacttgcagccaaacaggagaacaccgcagagataaaaggtcagtggcattggcgccgcatgtcggattaggactcgaaacaagaacagaaacttggatgagcagcgaaggagcatggaaacaaatacaaagagttgaaacctgggcacttcgacaccccggattcactgtaatagcactgttcctggctcacgccattgggacatcaatcactcaaaaagggatcattttcattctattaatgttggttacacccagcatggcaatgaggtgcgttggaattgggagcagggattttgtagaggggttgtcaggagccacatgggtggatgttgttttggaacacggttcgtgtgtaacaactatggcgaaagacaaacctactttggatatagaactactaaaaacagaagtcacaaatcctgcagtcctacgaaaattatgcattgaagctaaaatttccaatacaacaacagatagtaggtgtcctacacaaggggaggcgacattaatggaagaacaagatgctaacttcgtatgcagaaggacagtcgtcgatagaggttggggtaacggatgtggattgtttgggaaaggatctctaatcacatgtgctaaatttaaatgtgttaccaaactagagggaaagatagttcaatacgaaaacttaaaatactccgtaatagttaccgtacatactggagaccaacaccaagtagggaacgaatcgacggagcatggaactacagctactattacaccacaagcaccgacaagcgagattcaattaacagactatggagctctcactctggactgtagtccacgtacgggcttggacttcaatgagatggtgctactaactatgaaagaaaaatcctggttggttcacaaacaatggtttttggatttacccttaccttggacatcaggagcttcaacaagtcaagagacttggaacagacaagaccttctagttactttcaaaacagcacatgccaaaaagcaggaagttgttgtcttgggaagtcaggaaggagcaatgcatactgcgttgacgggcgccacagaaatacaaacttcaggaacgaccacaatattcgctgggcatcttaaatgtcgtttaaaaatggacaagttaacgttgaaaggaatgagttatgttatgtgtacaggttctttcaaattggaaaaagaggtagctgaaacgcaacatggtacggtgctggttcaaattaaatacgagggcacagacgcaccttgcaaaattccatttttaactcaagatgaaaagggagttacacagaatggtaggctaataacggcaaatcccatcgttacagataaagagaaaccagtaaatatagaagctgaaccaccatttggtgaaagttatattgtaataggagctggtgaaaaggcattaaaactaagttggttcaaaaagggtagcagcatcggcaaaatgtttgaagcaacagcacgcggagctagaagaatggcgatcctcggagataccgcatgggattttggaagtataggaggtgtatttacgtcagtaggcaaattagtccatcaaatatttggtacagcatatggggtcttattcagcggggtgagttggactatgaaaatcggaataggtgtcttattaacatggctcgggttaaattctagatccacctcgctgtctatgacatgcatagccgtaggcttagtaacactgtatttaggagtaatggtccaagcggattcgggctgcgtgatcaactggaaaggaagggaactcaagtgcggttccggtatttttgtaaccaacgaagtacatacctggactgagcagtataagtttcaagccgacagtccaaaaagattatcagcggctataggaaaagcgtgggaagaaggagtctgtgggataagatctgctacccgattagaaaatattatgtggaaacaaatctcgaatgaattaaaccacatattattggagaatggtatgaaatttacagtagtcgttggagatgtggtggggatcctggcacaaggcaagaaaatgatacgacctcaacccatggaacacaaatacagttggaaatcctggggcaaagctaaaataattggtgctgatgtacaaaacacaacattcatcatagatggcccgaatacccctgagtgtcctgatgatcaaagagcttggaatatttgggaggtcgaagattatggctttggcatttttacgacgaatatatggctaaaattgagggactcttatacgcaagtatgtgatcaccggctaatgtctgccgcgattaaagattccaaagcagtacatgcagatatgggctattggattgagagcgagaaaaatgaaacctggaagttagcaagagcaagttttatagaagtaaaaacatgcatatggcccaaatctcacaccttatggagtaatggtgtattggaatcagaaatgataatacccaaaatttacggtggcccaatatcacaacataattatcgtcctggatactttacacagaccgcaggaccatggcacttgggtaaactagaactagattttgatctttgtgaaggcaccacagttgtagtagacgaacactgtggtaatagaggaccatcattaagaaccacaactgtcacaggaaaaatcatccacgaatggtgctgtagaagctgcacgttacctcctcttcgatttaaaggtgaggatggatgttggtatggcatggaaataagacccgtaaaggaaaaagaagaaaacctagtgaaatcgatggttagcgctggttcaggcgaagtggattcatttagtctcgggctactctgtacatcgatcatgattgaggaagtaatgaggtccagatggtctcgaaaaatgctaatgacagggacactggcagtatttcttttactgattatgggccaactaacctggaatgaccttataagattgtgtataatggtcggagcaaatgcttctgaccgcatgggcatgggaacaacatatctagcgttaatggccacctttaaaatgcgaccaatgtttgccgtcggtttgttgtttagaagacttacgagtagggaagtattgctattaacgatcgggttatcccttgtagcttcggtagaattgccgaatagtctagaagagttaggtgacgggctagcaatgggtatcatgatactaaaactactaacagactttcagagccaccaactatgggcaaccttgctaagtttgacgttcataaagaccacactatccttacattatgcatggaaaacgatggcgatggtgcttagtattgttagtctctttccattatgcctcagtacgacatctcaaaagacgacctggctcccagtgctattggggtctttaggatgtaagccccttacaatgtttttaatcgcagaaaataaaatatggggccgtaaatcatggccacttaatgaaggtataatggcagttggtgtggtttcaatactactctctagcctactcaagaacgacgtcccactagccggacccctaatagcaggaggaatgttaatagcttgttacgttatttctggctcaagcgcagacttatcactagaaaaagctgcggaagtcagctgggaagaggaagcagagcattccggggcgtctcataatattcttgtagaagtgcaagatgacggaacgatgaagataaaagatgaagaacgcgacgatactctcactatattgctaaaggctacgctcctagctgtatcgggcgtttatccgctaagcatacctgctaccttattcgtatggtacttctggcagaagaagaaacaacgttcgggagtgttatgggatacacctagtccccctgaagtagaaagagccgtactcgatgacgggatctatcgtataatgcaacgaggtttgctaggacgtagtcaagtcggcgtgggcgtatttcaggaaaatgtgtttcatactatgtggcatgtaactagaggggcagtgcttatgtatcaaggaaaacgtctagaaccatcatgggcatctgttaaaaaggacttaatttcatacggcggaggatggaggttgcaaggaagctggaatactggtgaggaagtacaagttatcgctgttgaaccgggcaaaaaccccaaaaatgtacaaacggcaccgggcacctttaaaaccccggaaggtgaggtaggtgctatagcgctggattttaaacccgggacgagcgggtcacctatcgttaacagagagggcaagattgtaggactctatggtaatggtgtggtcactacaagcggcacatacgtaagtgcaatagctcaggcaaaagcatctcaagagggaccgttaccagagattgaagacgaagtattcagaaaaagaaacctaacaataatggacttgcatccaggctcaggtaaaacaagaagatatttgcctgcaatcgtacgggaagcaattaaaagaaaactgcgtactctcatattagcacctacaagagttgtggcttctgaaatggctgaggcattgaagggaatgccaatcagatatcaaacgacagcagtaaagtcggaacatactggtaaagaaatcgttgatttaatgtgccatgctacgtttacaatgcgattgttaagccccgtccgcgtgccgaattataatatgatcattatggacgaagcacatttcaccgacccttcatctatcgccgccagagggtacatttcgacgagagtaggaatgggagaggcggcagcaatatttatgaccgcaacgccgcctggatcagttgaggctttcccacaatcaaacgccgtaatacaagatgaggagagggatatccccgaaaggagttggaactcagggtacgaatggatcacagattttcctgggaaaactgtgtggttcgtaccatcaataaaatcaggaaatgatatagcaaattgtttaaggaagaatgggaaacgcgtaattcaattaagtagaaaaacgtttgatacagaataccagaaaaccaaaaataatgattgggactacgtagtgacaacagatatctcagaaatgggcgcaaacttcagagccgacagagtcattgaccctcgccgatgccttaaaccagtaatcctaaaagatgggccagaaagagtaattttggcaggccccatgcccgtaaccgtagcatcagcagcgcaaagacggggacgcatcggacgtaatcataacaaagaaggggaccaatatatttacatgggccaaccattgaataacgatgaagaccatgcgcattggactgaggcaaaaatgttactagacaacataaacacgcctgaaggtatcatccccgcactattcgagcctgaacgagagaaaagcgctgctattgacggagaataccgacttcgaggggaggcccgaaaaacgtttgtcgaactaatgcgtcgaggagatctgcctgtttggttatcatacaaggtagctagcgaggggtttcaatacagcgaccgacgctggtgctttgatggtgaacgcaacaatcaggtattagaagaaaatatggatgttgaaatttggactaaagaaggagagaggaagaaactgagaccaagatggttggacgcaagaacctacagcgatccactagctttacgagagtttaaggagttcgcagcaggacgaagatctgttagcggagatttaatactagaaataggcaagttgccacaacacctgacacaacgggcgcaaaacgctttagataatttagtgatgttgcataacagtgaacaaggtggacgcgcctatagacatgcaatggaagaattacctgatactatcgaaactcttatgttactggctttaatagcagttctaacaggcggagtgacactatttttcctttcgggaagaggattaggaaagacatcgatcggtctattatgcgtgatggcatctagtgtcctgttatggatggctagtgttgaacctcattggatagcggccagtattatattggagtttttcttaatggtattattgattcctgaacccgatagacaacgtactccacaagacaaccaattagcttatgtcgttataggtctcttatttattatactaacagttgccgccaatgaaatggggttattagagacaaccaagaaagatttgggaatagggcacgtagccgtagaaaatcaccaccatgcgacaatgctagatgtagatctgcatccagcatcagcctggactttatatgcagtggctacgacgatcataactccgatgatgcgacataccatagaaaataccactgccaacattagtttgacagcaatcgctaaccaagcagcaatattaatgggcctggataagggctggccaattagtaaaatggatataggagtcccactactagccctgggctgttacagtcaagttaacccgctaaccctgacagctgctgtattaatgcttgttgctcactatgctataataggcccaggactacaggctaaagccacaagagaggcgcagaaacggactgcagctggcatcatgaaaaatcctacagtggatggaatagttgcgatagatttagatccggtcgtttacgatgcaaaatttgaaaaacaattgggtcagattatgctcttaatactgtgcactagccaaatattactaatgcgtacaacatgggccttatgcgagtccattacactagcaacaggaccgttaactactttatgggaaggatcccccggaaaattttggaataccacaatagcagtcagcatggcaaacatctttcgcggaagctacctcgctggtgctgggttagcgttttcactgatgaaatcactaggcgggggacgaagagggacaggagctcagggtgaaactttaggtgaaaaatggaaacggcagcttaatcaattgtcgaaaagcgagttcaatatctataaaagatccggaattatggaagtagatcgctctgaggccaaagaaggcttaaagcgaggtgaaacaacaaggcacgcggttagtaggggaacagccaagctacgttggttcgtggaaagaaacctggtaaaaccagaaggaaaagtaattgatctaggatgtggccgaggcgggtggtcttattactgcgctggcttgaagaaagtaactgaagttaaagggtataccaagggtggtccaggtcacgaagaacccatcccgatggccacctatggctggaacctagtaaaactacattcagggaaagatgtgttcttcacgccacccgaaaaatgcgatacactactttgtgacattggagaatcatcgccgaatccaaccatagaagaaggaagaacactgagagttctcaagatggtagaaccctggttaagaggcaatcaattctgcattaaaatcttaaacccatacatgccatcggtagtcgaaaccttagaacaaatgcaacgaaaacatggcggtatgcttgttaggaaccctttgtcaagaaattccacacacgagatgtattgggtctcatgtggaacaggaaatatcgtgtccgcagtaaatatgaccagcaggatgttactcaatcgatttacgatggcccatagaaaacctacttatgaaagagatgtcgatttgggagcggggactaggcatgtcgccgtagaaccagaagttgctaatcttgacatcattggtcaacggatagaaaatataaaacatgaacataaatcgacgtggcattacgatgaagataatccatataagacttgggcataccatgggagttatgaagttaaacccagcgggagcgcatcctcaatggtaaacggtgtggtcaaactactaacaaagccgtgggacgttataccaatggtgacgcaaatagcaatgactgatacgacgcctttcggacaacaacgtgtatttaaagaaaaagttgatacacgtacaccaaaggcaaaacgtggaactgctcaaataatggaggtcaccgctaggtggttatggggtttcctatccaggaataagaaacctaggatatgcaccagagaagagttcaccagaaaagtgcgctctaatgcggctatcggagccgtgttcgtggatgaaaatcaatggaactcagccaaagaggcagtagaagacgaaaggttctgggatctagtacaaaaggaaagagaattgcataagcaaggcaaatgcgcaacttgcgtatataacatgatgggaaaaagggagaagaaattaggtgaatttgggaaggccaaaggtagtagggctatatggtacatgtggttaggagctagatttctggaatttgaagccctgggcttcatgaacgaagatcattggttttccagagaaaattcattaagtggtgttgagggggaaggactgcacaaactgggctatatcttaagagatatatctaaaatacccggaggcaacatgtatgctgatgacacggcaggatgggatacaagaataaccgaggatgatcttcaaaatgaagcaaaaattacggatataatggaaccagagcatgcgctgttggctacttcaatctttaaattaacatatcaaaataaggtcgtacgagtacaaaggcctgctaaaaatggcacggtcatggacgtaatatcaagaagagatcagcgtggctcgggacaggtggggacatatggactaaacacattcaccaacatggaagcacaattaattaggcagatggagtctgaggggatatttcttcctagtgaacttgaaacgccgaacttggctgaacgtgtgttagactggttggaaaagtacggtgtggaaagattaaaaagaatggcaatttctggagacgactgtgtagttaaacccatagacgaccggtttgctacggcactcacggctctaaatgatatgggaaaagtcagaaaggatataccacaatgggaacctagtaagggttggaacgattggcagcaagttcctttttgcagtcatcattttcatcaacttataatgaaagacggcagggagattgtagtcccttgtcgaaatcaggacgagttagtcggcagggcacgggtaagtcagggggccgggtggtcccttagagaaacagcatgtctaggcaaaagttacgctcaaatgtggcaacttatgtactttcacagaagagatctaagactagcagcaaatgcaatatgctcagcagtacccgtagactgggtacctacatcacggactacttggagtatacatgcacatcaccaatggatgacaacagaagatatgctcagtgtttggaaccgtgtttggatagaagagaatccctggatggaagataaaacccatgtatcttcatggggcgatgtaccttatctgggaaaaagagaagatcagtggtgtgggtctttaataggactaacagcaagggccacttgggcatctaatatccaagtggcaatcaatcaagtaagacggcttataggaaatgaaaattatttagactatatgacatccatgaaaaggttcaaaaatgaaggcgatcccgagggagcgctatggtga

SEQ ID NO: 21718 - RNA, 9879 nt, synthetic construct
  misc_feature 1..9879: note = derived and/or modified CDS sequence (opt6) from DENV-1__FJ882569__SS-prME
  source 1..9879: mol_type = other RNA
tccgttactatgttactaatgttaatgccaacggctctagctttccacttgacaacaagaggaggagaaccccacatgattgtgactaaacaagaaagagggaaatcgcttctgtttaaaacatcagccggtgttaatatgtgcacactaatagcgatggatctcggtgaactatgtgaagatactatgacttataaatgccctcgtataacggaagcagaaccagatgatgtagactgctggtgcaatgcaactgacacatgggtaacatatggaacctgttcacaaacgggagaacaccgcagggataaacgatccgttgcattagcaccacacgtcggactcgggctggaaacaagaacggaaacttggatgagtagtgaaggagcctggaagcaaattcaaagagttgaaacttgggctttgcgacaccctgggttcacagtaatagctctattcctagcacatgcaataggaacttcaataacccaaaaaggaatcatattcattttactcatgttagtaactccatcaatggcaatgaggtgtgttgggatcggatcaagagactttgtcgaaggacttagtggagccacctgggtagatgtcgttctcgaacatggatcatgcgtaacaactatggcaaaagataaacctacacttgatatagaacttttaaaaacagaagtgacaaacccagcagtactacgtaaactatgcatagaggcgaaaataagtaatacaactactgactctcgctgtccaacacaaggagaagcaacgcttatggaagaacaagatgccaacttcgtctgcagacggacttttgttgatcgagggtggggtaatgggtgcggtctcttcgggaaaggatctttgataacatgtgcaaaatttaaatgtgtaacgaaacttgaaggaaagattgttcaatatgaaaatctcaagtattccgtcattgtcactgtacatacgggagatcaacatcaagtgggaaatgaaagtactgagcatggaactacagctacaataaccccacaagcaccaacctccgaaatccaattaactgactatggtgcattaactctcgattgtagtccgagaaccggtttagattttaacgaaatggttttactaacgatgaaagaaaaatcatggctggtacataaacaatggttcttagacctcccgcttccctggacaagcggagcatctacaagtcaagagacttggaatcgtcaagatctattagttacattcaaaaccgcgcacgccaagaaacaggaagtcgtcgtcttgggaagtcaagagggagcaatgcacaccgctctaacaggagcaactgaaatccagacttctggtactacaacaatttttgcgggacatcttaaatgcagactaaaaatggataaactaacgctaaaagggatgagttatgtaatgtgtaccggatcctttaaactcgagaaagaagttgcagaaacacaacatggtactgtcttagtacaaataaaatatgagggcacggacgcaccctgcaaaatcccattcagtacacaagacgaaaaaggggtaactcaaaacggacgtctaattaccgctaatccaattgtcacggacaaagagaaacccgtcaatatcgaagctgaacctccatttggagaatcgtatattgtcataggtgccggagaaaaggctttaaaattaagttggttcaaaaaggggtcgtccatcggaaaaatgttcgaagcaaccgcgcgaggagctagaaggatggcaatcctcggagacactgcatgggattttggctccatcggaggggtattcacatcagtcggaaaattagtacaccaaatttttggtacggcttatggcgtcctttttagcggagttagctggactatgaaaataggtataggtgtcttgttaacttggttaggacttaacagtagaagcacgtcgttatcgatgacttgcatagccgtgggcctcgttacgctttatttaggagttatggtgcaagcagactcaggttgcgtaataaactggaaaggacgagaattaaaatgcggtagcggtatctttgtcactaatgaagtgcatacatggaccgaacagtacaaattccaagcggacagccctaaaagactctcagcggccatagggaaagcatgggaagaaggtgtttgtggtattagatccgcgacacgactggagaatataatgtggaaacaaatatctaatgaattgaatcacatacttctagaaaacggcatgaaattcacggtggtggtaggggatgtagttggcattcttgcacaaggtaagaaaatgattagaccacagcctatggaacataaatactcatggaaatcatggggtaaagcgaaaatcattggagcagatgttcagaacacaacctttataattgatggaccaaatacacccgaatgtcctgatgatcaacgagcatggaacatatgggaagtcgaagattatggttttggtatatttactacaaatatttggttaaaactaagggacagttacacccaggtttgtgatcaccgcttgatgtcagctgcaataaaagactccaaagcagtgcacgctgacatgggttattggattgagagcgagaaaaatgaaacctggaaacttgcaagagcgagttttatagaagtgaaaacttgtatttggcccaagtctcatacgctctggtctaatggcgttttggaaagcgaaatgataataccaaaaatatatggcggtcccatcagtcaacacaattaccgccccggttattttacgcaaactgcgggcccatggcaccttggtaaattagaattagatttcgacttatgtgaagggactacagtcgtagtagatgaacactgtggaaacagaggtccaagtctaagaactacgacggtaacaggcaagataatccatgaatggtgttgccgatcatgtacgctacccccgcttagatttaagggggaagatggttgctggtatgggatggagataagaccagtaaaggaaaaagaggaaaatctggtaaagtcaatggtatcagcgggttcaggtgaagtcgatagcttttcgttgggcttattatgcacatcaatcatgattgaagaagttatgcgatcacgatggtcaagaaaaatgttaatgactggcaccttagctgtctttctcctactgataatgggccaactaacgtggaacgacttgatacggttatgtatcatggtaggggcgaatgcctctgaccgtatgggaatgggaactacttatctcgcattgatggctaccttcaaaatgagacctatgtttgcagtaggactactctttcgtagattaacctcacgagaggtccttttattgaccattggattatcattagttgcctcagtggaactccccaacagtctggaagaattaggcgatgggctcgcaatgggaattatgatcttaaaattactaacagattttcaatcccaccagttgtgggcaactttactctcattgacattcatcaaaacaaccctctcccttcattacgcatggaaaactatggcaatggtcctgtcaattgtatcactattcccactttgtctttccacaacctcccagaaaacaacgtggctaccagtcttattgggttctctaggctgtaaacctctgacaatgtttctaatagcagagaacaagatttggggcagaaggagctggccccttaatgaaggcatcatggctgtaggtgtagtatcaattctattatctagccttcttaaaaatgacgttccattagctggtccattaatagcaggaggaatgctcattgcttgttacgtcatctcaggatccagtgctgacctttccctagaaaaagctgctgaggtttcatgggaagaggaagccgaacactcaggtgcatcacacaacatcctagtagaagtccaagatgacggtacaatgaaaattaaagacgaagaaagagatgacacgttaactattttattaaaagctacgctgctagcagtttccggagtatacccactgtcgataccagctactttgtttgtttggtacttctggcaaaagaagaaacaacgatctggagttctatgggataccccaagcccaccagaggtagaaagggcggttctagacgatggtatctaccgaataatgcaaagggggttacttggaaggtcgcaagtaggagtcggcgtctttcaagagaatgttttccacactatgtggcacgttacaagaggagcggttttaatgtaccaaggaaaacggttggaaccgtcgtgggcctctgtaaagaaagatctcataagttatggcgggggctggcgtcttcaaggtagctggaacaccggagaagaagtccaagtaatagctgttgagccaggcaaaaatccgaagaacgtacaaacagccccaggtacttttaaaacgcccgagggggaggtaggagccatcgcactagattttaagcctgggacatcaggctcaccaatagtaaaccgtgaaggcaaaattgtaggtttatacgggaacggagttgttaccacaagtggtacttacgtatcagcaatagcacaagctaaagcctcgcaagagggcccgctcccggaaatagaagacgaagtattcaggaaacgaaacttgactataatggacctacacccagggtctgggaagacacgaaggtacttaccggcaattgtccgggaggcgataaaaagaaaacttagaactttaattttagcaccaacaagagtggtggcatccgagatggctgaggccctaaagggtatgccaataagatatcagacaaccgctgtgaaaagtgaacacacaggtaaagagatagtagacctaatgtgccatgcaacattcacaatgagactattgtcacctgtccgcgtacctaactacaatatgattataatggacgaagctcactttaccgatcctagttcgatcgctgcgcgaggatatatttctactcgcgttggtatgggtgaagccgcagccatattcatgaccgcaactcctccgggtagtgtcgaagccttcccgcaatcaaatgcagtgatacaagatgaagaaagagatatcccagaaagatcttggaactcgggatacgaatggatcacggatttcccgggaaaaactgtatggtttgtcccatcgataaaatctggtaatgacatagccaactgtttaaggaaaaatggcaagagggtaattcaattatcgagaaaaacatttgacacagaatatcagaaaactaagaacaacgactgggattacgttgttactacagatataagtgaaatgggagccaatttcagagcagatcgagtgatagatcctaggaggtgtctaaaaccggtaattctcaaagatggaccagagagagtaatattggcaggacctatgccggttactgtcgcgtcagcagcacaaaggagaggaagaattggacgtaatcataacaaagaaggtgatcaatatatttacatgggacaacctcttaacaatgacgaagaccacgcacactggaccgaggcaaaaatgttactagacaatataaatactcctgaggggattatacccgcgttgttcgaacccgaaagggaaaaatccgcagcaatagatggagaataccgactccgaggagaggcacgcaaaacgttcgttgagctaatgcgacggggagatctccccgtatggctgtcatacaaagttgcatccgaaggatttcagtattccgacaggagatggtgtttcgatggagaacgtaacaatcaagttctagaggaaaacatggacgtcgagatttggactaaagaaggcgaaaggaagaaactgaggccccgctggcttgatgctaggacctacagcgaccctctggcactacgtgaatttaaagaatttgccgcaggacgccggtccgtcagtggcgatttaatactagaaataggcaagctaccacagcatttaacacaaagagcacaaaacgcactcgacaacttagtaatgctccataattcggagcaagggggtagagcataccgacacgccatggaagaattacctgacactatagaaactctgatgttattggctttaattgcagttttaaccggaggggtaacactattcttcttatcaggaagaggccttggcaaaacatctattggtttattatgcgtaatggcctcaagtgtactgctgtggatggcatccgtagaacctcattggatagccgcatcaataattctggagttctttcttatggtgcttcttataccagagcctgataggcagagaactcctcaggataatcaattggcctacgtcgttattggcctattgtttatgattctaaccgtggcagcgaacgagatgggactattagaaaccactaagaaagatctaggaataggacatgttgcagtcgaaaatcatcaccatgcaaccatgctcgacgtagatttacaccccgcctcggcatggacgctatatgcagtcgctactacaatcattactcccatgatgcgccataccatagaaaatacaacagctaatataagcctcacagcgatcgccaatcaagcagcaattttaatgggattagataaaggatggccgatatccaaaatggacatcggggtccctctactcgctctaggatgctattcccaagttaatcctctcacattaacagcagctgttttaatgctagttgctcactatgctataataggtccaggtctacaagccaaagctacaagggaggctcagaaaagaacagccgctggcataatgaaaaacccaacagtagacggaatagtagccattgatctagatcctgttgtgtatgacgctaaatttgagaaacaactaggtcaaataatgctactaattttatgcacctctcaaatattgttaatgagaacaacctgggcattatgtgaatcaataacgttagcgacggggccattaaccactctatgggaaggcagccctggcaaattctggaatacaactatcgcggtgtctatggcaaatattttcagaggttcatatctggcgggagcagggttagcctttagtttaatgaaatcccttggaggcggaaggcggggcactggagctcagggtgagactctaggtgaaaaatggaagaggcaattaaaccagctgtcaaaatcagagttcaatatttataagagaagtggtataatggaagtagatagaagtgaagccaaggaagggttaaaacgaggggaaaccacacgacatgctgtaagtaggggaactgcaaaattaagatggtttgtggagcgaaatctagtgaaaccggaggggaaggtaattgacttaggctgcggaaggggaggttggtcttactactgcgcaggcctaaagaaagtaaccgaggtaaaagggtacactaagggagggcctgggcatgaagaacccataccaatggctacatatggatggaacttagtaaaattacactcaggtaaagacgtattctttacaccccctgaaaaatgcgataccttactgtgtgatattggagaaagcagtccgaatcctactatagaggaaggtcgtaccttaagagtcctaaaaatggtagagccctggctacgcggtaatcaattctgtataaagatacttaatccctacatgccatccgttgttgagacattagaacagatgcaaagaaaacacggaggaatgctggtaagaaatccattgagccgcaatagcacgcacgaaatgtattgggtgagctgcggtacgggtaatatcgtaagcgctgtgaacatgacttcaagaatgctcctaaaccgctttacaatggctcatcgaaaaccaacttacgaacgagatgttgatttaggagcggggactaggcatgtggcagtagagccggaggtagcgaatctggacattataggacagcgtatagaaaacatcaaacatgaacataagtcaacctggcattacgatgaagataacccttataaaacctgggcttaccacggatcttatgaggtaaaaccaagtggatctgccagttcaatggttaatggagttgtgaaactgctgacaaaaccatgggacgttatccctatggtaactcaaatagctatgacggatacaactccttttggccaacaaagagtattcaaggagaaggtagacacccgaacaccaaaagcaaagcggggcactgcacaaatcatggaagtcacggcacgatggttgtggggattccttagccgaaacaagaaacctagaatttgtacgagagaggagtttacccgaaaagttagatcaaatgcagccattggagcggtattcgttgatgaaaaccaatggaactcagcgaaagaagcagttgaagacgaacgattttgggatctagtacagaaggaaagagagttacataagcagggtaaatgtgctacgtgcgtttataacatgatgggaaaaagagagaagaaactgggagagttcggaaaggcaaaaggaagcagagcaatttggtatatgtggctgggggccagatttttagaatttgaagccttgggcttcatgaatgaagaccattggttttcaagagaaaattcgttatcgggtgtcgaaggggaaggtctgcataaattaggttatattctaagagatatttctaaaataccgggagggaatatgtatgcagacgatacggcagggtgggatacaagaatcactgaagatgatttgcaaaacgaagcaaaaattaccgacattatggaaccagaacacgcgctattggcaacttctatatttaaattgacctatcaaaacaaagttgtacgtgtccaacgtccagctaaaaatgggacagttatggatgtaattagtcgaagagatcaaaggggatctggtcaagtaggaacttatggactgaatacattcacaaatatggaagcacaacttataagacaaatggaatctgagggaatatttctcccatcagaattggaaacgccaaacttagcagaaagggtactagactggttggagaaatatggggttgagagactaaaaagaatggcaattagcggagacgattgtgtcgtaaaaccaatcgatgacaggttcgctaccgcgttgacagctctcaatgatatgggaaaagtacgcaaagacattccacagtgggagccaagtaaagggtggaatgactggcaacaagtccccttttgtagccaccacttccaccaacttataatgaaagatgggcgagaaattgtagtgccgtgtagaaatcaagacgaattagtagggcgggcacgagtatcgcaaggcgcaggttggtccttacgagaaacagcatgtctcgggaaatcctatgctcaaatgtggcaactcatgtactttcatagaagagacttaagattagccgccaatgcaatatgtagtgcagtaccagtggactgggtaccgacctctcgaacgacatggtcgatacatgcacatcatcaatggatgacaacggaagacatgctttcagtatggaatcgagtgtggatcgaggaaaatccatggatggaggataagacccatgtaagttcttggggcgacgttccatatttaggaaaaagagaagaccagtggtgtggttctttaattgggttaacagcaagagcaacatgggcgagcaatatacaagttgctattaaccaagtaagacgtcttatcggtaatgaaaattatttggactacatgaccagtatgaaacggtttaaaaacgaaggggatccagaaggggccttatggtga

SEQ ID NO: 21719 - RNA, 9879 nt, synthetic construct
  misc_feature 1..9879: note = derived and/or modified CDS sequence (opt6) from DENV-1__GQ199833__SS-prME
  source 1..9879: mol_type = other RNA
agcgttacaatgttattgatgctgatgccaacggcgttagcgttccacttaacgaccaggggaggcgaaccacatatgatagtcaccaaacaagaacgggggaaatcattactatttaaaacaagtgccggagttaatatgtgtacgctcatagcgatggatttgggtgaattatgtgaagatactatgacctacaaatgccccagaataacggaagcggaaccagatgatgttgattgttggtgtaatgcaaccgacacgtgggtaacgtatggaacatgctcacaaacaggggaacatcgtagagacagaagatctgtcgcattagctccacacgttgggttgggtttagaaaccaggaccgaaacatggatgtctagcgaaggggcgtggaagcaaattcaaagagtagagacctgggctcttagacaccctggttttactgtcatagccctatttttggcacacgcaataggtacatccatcactcaaaaaggaattatttttatcttattaatgttggtaacaccctcaatggcaatgagatgtgtgggcattggctcgagggactttgtagaaggcctcagtggagctacatgggtagatgtggtattagaacatggaagctgcgttactacaatggcgaaagataaacctacgttagacatagaactgctcaagaccgaagtaactaatccggccgtcttacgtaaactatgcattgaagcaaaaatcagcaacacgaccactgattctagatgtccaacccaaggggaagccacacttatggaagaacaagatgctaattttgtatgtagaagaacatttgttgatcgaggttggggtaatgggtgtggtttgtttggtaaagggagcttaattacttgtgctaaattcaaatgtgttacaaaacttgaaggaaagatagttcaatacgaaaacctgaaatattctgtgattgtaactgtacatacaggggaccaacaccaagtcggtaatgaaagtacagaacacggtaccactgctactatcacaccacaagccccgacgtccgaaatacaacttacagactacggagctctaacattggactgctcaccacgaacgggtttagattttaatgaaatggtgttattaacaatgaaaggaaaatcttggcttgtccataaacaatggttccttgacctaccattaccatggacctccggtgcttccacatcgcaagaaacctggaatcgtcaggatcttttagtaacttttaagacggcacacgctaagaagcaagaagtggtagtcctaggtagccaagaaggagcaatgcacacagcattgaccggagccaccgaaattcaaacgtcaggaaccacaactatttttgcagggcatttaaaatgtaggttaaaaatggataaactgacgcttaagggtatgtcttacgttatgtgcacaggaagtttcaaactagagaaagaggttgctgaaactcaacatgggactgtgctagttcaaataaaatatgaaggcacagatgctccgtgtaaaatcccgttcagtactcaggatgaaaagggggtcacccagaatggacgccttattacagccaacccaatagtaacagacaaggagaagccagtcaatattgaagcagaaccgccttttggagagtcatatatagttataggagctggagagaaagcgttaaaattatcatggttcaagaaaggaagctctattggtaaaatgtttgaagcaacagctcgaggagcaagacggatggcgatattaggggacactgcatgggacttcggaagtatcggaggtgtttttaccagtgtagggaaactcgttcatcagatctttggcaccgcttacggtgttttattctcgggcgtctcgtggacaatgaaaataggaattggagtcttacttacatggttaggattaaacagccgctcgacatctttaagtatgacctgtatagctgtaggtttagtaacactttaccttggagtaatggtacaagcagattcgggatgtgtaattaactggaaaggtcgagagctaaaatgtggtagcggaattttcgtaactaacgaagttcatacatggactgaacaatacaagtttcaagcagattccccaaaaagactatcggctgcaattggaaaggcatgggaggaaggagtctgcggtataagaagtgcaacaagactagagaacataatgtggaaacaaataagtaatgaactcaaccatattctattagagaatggaatgaagtttacagtagtagtgggtgacgttgtcggcattttagcccaagggaagaaaatgatccgtccacaacccatggaacataagtactcatggaaaagctggggaaaagcaaaaattattggcgcagatgttcagaatactacgtttataatagatggaccgaacacaccggaatgtccagatgatcagcgagcttggaatatatgggaagttgaagactacgggttcggaattttcacaacaaacatatggctaaaacttagagattcatacactcaagtatgtgaccaccgattaatgagtgcagccatcaaggattccaaagctgtacacgcagacatgggatattggatcgaaagtgaaaagaatgaaacgtggaaattagcaagagcatcattcatagaagttaaaacttgcatatggccgaaaagtcacacgctttggtctaacggagttctagaaagtgaaatgatcataccgaaaatatacggtggccccatctctcaacataactaccgtccaggatattttacgcaaacagcaggaccatggcacctcggaaaactagagcttgactttgacctgtgcgaaggaacgacggtcgtagtggacgaacactgcgggaaccgaggccctagtctaagaacaactacagtaacaggcaagattattcatgaatggtgttgtcgctcgtgtaccctaccaccattaaggttcaaaggagaagacggctgttggtacggtatggaaattcggcctgttaaagaaaaggaagaaaatttggtcaaatcaatggtgtctgcgggcagtggagaggtcgattcattttctctcggtttactgtgtatatcaatcatgattgaagaagttatgagatctagatggagtaggaaaatgcttatgaccggaacactagctgtttttctattgcttatcatgggtcaattgacatggaatgatttaatacgattatgcatcatggtcggagcgaatgcctccgatcgtatggggatgggaacaacttatttagctttaatggcaactttcaaaatgagaccaatgttcgctgtcggtctgttatttaggagactcacaagccgtgaagtattattactcaccataggactatcgttagtagcatcagtagaactacctaactcactagaggaacttggagacggtctggcaatgggaataatgattcttaaacttcttaccgactttcaaagtcaccagttgtgggccactcttctgtcgctcacattcataaaaactacgctatccctacattacgcgtggaaaacgatggcaatggtgctaagtatagtatcccttttccccctatgcttaagcacaacttcacagaaaactacctggctgcctgtacttttaggaagtttgggctgtaagcccctaacaatgttcttgatagccgaaaacaagatttggggaagaaagagttggcctttaaacgaagggataatggcggtgggtgtggtgtctatattattatcttcactacttaaaaacgatgtaccactagcagggccactaatagccggtggcatgctaattgcttgttatgtcatatcgggcagttctgcagacttatctctcgaaaaagcagctgaggtaagttgggaggaggaagctgaacattctggagctagtcataatatcttagtggaagtacaagacgacggaacaatgaaaattaaagacgaagaaagagatgacactttgacaatactgttgaaagcgactctgctagcagtgtcaggggtttacccattaagtatacctgctacattgtttgtgtggtacttctggcaaaagaagaaacaaaggagtggcgtactttgggacaccccttcacctccagaagtagaacgtgctgtacttgacgatgggatatatcggataatgcaaagaggcctactgggtagatcacaagtaggagttggagtctttcaggaaaatgtatttcacacaatgtggcacgtaacacgcggagcagtgttaatgtatcaaggaaaacgtctagagccgagctgggcttcggtaaagaaagatttgatttcatatggcggcggatggcgactacaaggaagttggaacacgggagaagaagtacaagttattgcggttgagcctggtaaaaatcccaaaaatgtgcaaaccgcaccaggaacattcaaaacgccagaaggagaagtaggcgcgatcgccctagacttcaagcctggaacaagtggatcacccatcgttaacagggaaggtaagattgtcgggttatatggcaatggcgtagtaactacgagtgggacatatgtatcagcgatagcccaagcaaaagcaagccaagaaggccccctccctgaaatcgaggacgaagtatttcggaaacgaaaccttacaattatggatcttcatcctggttctggaaaaacccggagatacttaccagcaatagtaagagaggctattaagcgaaaacttaggacgttaatattagctccaacgagggtcgtagcaagtgagatggcagaagcactcaaagggatgcccataagataccagacaacagcggtgaaatcagagcatacaggaaaagaaatagttgaccttatgtgtcatgcaacatttacaatgcgcctgttatcccctgtacgcgtaccaaattataatatgattatcatggacgaagcccattttactgatccgagcagtatagcggcccgaggatatatatcgacacgagttgggatgggagaggccgcagctatatttatgacggccacaccacctgggtctgtagaagcatttccacagtccaacgcagtaatacaggacgaggagcgggatatcccagaaagaagctggaactcgggttatgaatggataaccgattttccaggaaaaacggtttggttcgtccctagcattaaaagtggtaatgacatagcaaattgtttaaggaaaaatgggaagagagttatacaactaagtcgaaaaaccttcgacacggaataccagaaaactaaaaataacgattgggattatgtcgtgacgactgatatatccgaaatgggtgctaacttcagagcagaccgtgttattgatcctcgaagatgtctaaaaccggtgatcctaaaagacggaccagaaagagtcatattggctggccccatgccagtaacagttgcatctgcagcccaacgacgtggacgcataggaaggaaccacaacaaggaaggtgaccagtatatctacatgggccaaccattaaacaatgacgaagaccacgcgcactggactgaagcaaaaatgttactagataatataaacactccagaaggtataattcctgcgctttttgagcccgaacgagagaaatcagcagctatagacggtgagtaccggttacgaggagaagcaaggaagacttttgtagaacttatgagacgcggagatctccccgtgtggctttcttataaggtagcgtcggaaggatttcaatacagcgatagacgatggtgtttcgatggagaacggaacaaccaggtattagaggagaatatggatgtggaaatatggactaaggagggagaaagaaagaaactgagaccacgttggctagacgcacggacatacagcgatcctctagcactaagggaatttaaagaatttgctgcgggaagaagaagtgtctctggtgatctgatcctcgaaattggaaaattacctcaacaccttacacaacgagcacagaatgccctggataatttggtaatgctacataatagcgaacagggaggcagggcttaccgacacgcaatggaagaacttcccgacacgatagagacgctaatgctcttggcattaatagcagtactgacaggaggagtaacccttttcttccttagcgggcgaggtctcggtaaaacttctataggattattgtgcgtgatggcatctagcgtactattatggatggcaagtgttgaacctcactggattgctgcaagtattatactagagttcttccttatggtactacttatcccagaaccagaccgtcaaagaacgcctcaagacaaccaacttgcgtacgttgtaattggattactatttatgatccttacagtcgctgcgaacgaaatgggattactcgagactaccaagaaagatttaggtataggtcacgtagccgtcgaaaaccatcatcacgcgacaatgttggatgtggatctgcatccagcgagtgcctggaccctatacgccgtggctacaacaatcattacaccaatgatgaggcacacaatagaaaacacaacagccaacatctccctaaccgcaattgccaatcaggctgcaatactgatgggattagataaaggttggccgattagcaaaatggatattggagtccccctcctagcgttgggttgttacagtcaggtaaacccgctaacactgacagcagcggttctgatgttggttgctcattacgcgataattggtcctgggttacaagcaaaagcaactagagaagcacagaaaagaactgccgcagggataatgaaaaatccaacagtagatggcatagtagccattgacctagaccctgtagtatatgatgccaaatttgaaaagcagcttggccaaataatgttacttatactatgtacgtctcaaattctcttaatgagaacaacttgggcactatgtgaatccatcacgcttgcaactggtcctttgactacattatgggagggcagccccgggaaattctggaacacaacaattgccgtaagtatggcgaatatatttcgaggatcatacctagccggcgcaggactagcgtttagtctaatgaagtcccttggtggaggccgaagaggtactggggcacaaggtgaaactctaggagagaaatggaaaagacagctaaatcaactatcgaagtctgagttcaatatctataaaaggtcagggataatggaggttgacagaagtgaggctaaggaaggactaaagaggggagaaaccacaagacacgctgtctctcgaggcacagccaaattaagatggtttgtcgagagaaatttagtaaaacctgaagggaaagtaattgacctagggtgtggtagaggaggatggtcctactactgtgcaggtctaaagaaggtgactgaagttaaaggatatacaaagggtggccctgggcatgaggaacctattcctatggctacttatggatggaacctggttaagttgcacagtggaaaagacgtattctttacacccccagaaaaatgtgacactttgttatgtgatataggggaatcaagccctaacccaacaatagaggagggccgaacactgagagttttgaaaatggtagaaccctggctccgaggaaatcaattctgcattaaaattttgaatccttacatgccaagtgtagtggaaacattagaacagatgcaacgtaaacacggaggaatgctagtgaggaacccattatctcgcaactctacacacgaaatgtattgggtaagttgtggtacaggaaatattgtttcagcagtaaacatgacaagcagaatgttactaaataggtttacgatggcacatcggaaaccaacatatgagagagatgtggatctcggagcggggacaaggcacgtcgccgtagaacctgaggttgccaacctcgacataataggtcaacgaatagaaaatataaaacatgaacataaatcaacttggcactatgatgaagataatccatataaaacctgggcctaccatggctcttacgaagtaaaaccttcgggcagcgcatcatcgatggtaaacggtgtcgttaagctgttaacgaaaccttgggacgttattccaatggtaacacaaattgcgatgacagatacaactccttttgggcagcaaagagttttcaaggagaaggtagacacaagaaccccaaaagccaaacgaggaacggcccaaataatggaagtcacagcaagatggttatggggatttctatccagaaacaagaaaccaagaatatgtacgagagaggagtttacaagaaaggttcgttcaaatgcggccataggagcagtattcgttgacgaaaatcagtggaatagtgcaaaagaagcggtggaagatgagagattttgggatttagtccagaaagaaagagaactacataaacaaggtaagtgcgcaacctgtgtttataatatgatgggtaaaagggaaaagaaacttggagagttcggaaaagctaaaggttctagagcaatttggtatatgtggctgggcgcaagattcttggagttcgaagcgcttggatttatgaatgaggatcactggttttcacgcgaaaatagcctatcaggagtcgaaggtgaagggttacataaactcggttatatacttcgtgacatcagcaaaatccctggtggaaacatgtatgcagatgacactgcaggttgggacacacgaatcaccgaggacgatctacagaacgaggccaagattacagacataatggaaccggaacatgcactactggcaacttccatttttaaacttacgtaccagaataaagtggtgcgagttcaacgcccagccaaaaacggaactgtaatggatgtaataagtaggcgagatcaacgaggttctggtcaagtgggaacctatggattaaatacatttactaatatggaagcacaattaattagacagatggaatcagaaggtatatttttgccttcagaactggaaacgccaaatctagcggaaagagttcttgactggttagaaaaatatggagtggaacgtctcaaacgaatggcaatatcgggggatgactgtgtagtaaaaccgatagatgatagatttgcgactgctcttactgctctaaatgacatgggaaaagttcgtaaagatatacctcaatgggaaccttcaaaaggctggaatgattggcaacaggtacctttctgtagccatcatttccatcaattgattatgaaagatggccgagaaatcgtcgtgccgtgcagaaaccaagacgaattggtaggcagggcgcgagtctcccaaggagcaggatggagtctaagagaaactgcgtgtctaggaaagtcatatgcacagatgtggcaattgatgtactttcacagaagggatttgcgattagcggcaaatgccatttgttccgcagttccagtggattgggtaccaacttcccgaacaacgtggtcgatacacgcccatcatcaatggatgacaactgaggatatgctatcagtttggaatagagtgtggatagaagaaaatccatggatggaagataaaacacatgtaagtagttggggagacgttccatatttgggtaagcgagaggaccaatggtgtggatctttgatcggtttaacagccagggcgacctgggcgtctaacatacaagtggcaatcaatcaggtaagaagactaattggaaacgaaaattatttggattatatgacctcgatgaaacgattcaaaaatgagggcgatcctgagggggctctatggtga

SEQ ID NO: 21720 - RNA, 9879 nt, synthetic construct
  misc_feature 1..9879: note = derived and/or modified CDS sequence (opt6) from DENV-1__FJ882570__SS-prME
  source 1..9879: mol_type = other RNA
tcagtaactatgttactaatgttgatgcccaccgctttagcttttcacctaacaacacgtggaggagaacctcatatgattgtaacaaaacaagaaagaggaaaaagcctcttattcaaaacttctgcaggagtaaatatgtgtacattaatcgcaatggacttaggcgaactatgtgaagataccatgacatacaaatgcccccgaattacggaagcagaacctgatgatgttgactgttggtgcaacgctacagatacctgggtgacttacggcacatgttcgcaaacaggtgaacaccgccgagataaacgttctgttgcactagctccacatgttggactaggtctggaaacgcggactgaaacttggatgtccagtgagggagcatggaaacaaattcaaagggtagagacgtgggctttgaggcaccccggttttactgtaatagccttattcctcgcacatgcaataggaacctctataactcaaaaaggtataatattcatactgttaatgttagtaacgccaagcatggctatgagatgtgtaggaataggatccagggattttgttgagggcctttcaggtgccacctgggttgatgttgtcttagaacatggatcatgcgtaacgacgatggcaaaagataaaccaacattagacatcgaactattgaaaactgaggtaactaatcctgcagtcttaagaaaattgtgcatagaagcaaaaataagcaacacaactacggatagtaggtgcccaacacagggtgaagcgacacttatggaggaacaggatgcaaacttcgtatgcagacggacctttgtggacagagggtggggcaatggatgtgggctattcggaaaaggaagcctaataacctgcgctaaatttaaatgtgttactaaactggaaggaaaaattgtacagtacgaaaatttgaaatattctgttatcgtgacagttcacactggagaccagcatcaagtgggaaacgagagcacagagcacggaaccacagccacaattacaccacaagcaccgacctcagaaattcagctcacagactatggtgcgcttaccttggactgcagtcctaggactggtttagattttaacgaaatggtcttactaacgatgaaagagaaatcatggttagttcacaaacaatggtttctcgacctaccgctaccttggacatcgggtgctagtactagccaagaaacatggaatagacaagatttattggtaacctttaaaactgctcacgccaagaaacaagaagttgtagtattgggaagtcaggaaggagctatgcacactgccctcacaggagcaacggagattcagacaagtgggactacaactatattcgctggtcatctcaaatgcagactcaaaatggataaattaacgctaaaaggtatgagctatgtaatgtgcacggggtctttcaaattggaaaaagaagtggcggaaacacaacacggaacggttttagtacaaattaaatatgaaggcacagacgccccttgtaaaattccgttttcaactcaagacggcaaaggtgtcacacaaaacggaagactcattacggcaaatccgatagttacagacaaagaaaaaccagtaaatatcgaagcggaaccacccttcggtgaatcatatattgtaataggcgctggggagaaagcactaaaactctcctggtttaagaaaggatcatccattggaaagatgttcgaggctaccgcgcgtggagctcgccgcatggcgatattaggcgacactgcgtgggactttgggtctataggaggcgtgttcacatctgtaggcaaattggtgcaccaaatctttggtacagcatatggagtactattctcgggagtatcctggaccatgaaaatcggtattggtgtattgctaacgtggctcggattaaactcaagatcaacttctttgtcaatgacttgtatcgcagtcgggttagtaaccttatacttgggagtgatggtgcaagcagactctggttgcgtaatcaactggaaggggagagaactaaaatgtggttcaggaatatttgttactaacgaggtgcatacgtggacagagcagtacaaatttcaagcagacagtcctaaaagactatcggctgcgattggtaaggcttgggaggaaggggtatgtggaatcagaagtgctactagattagaaaatataatgtggaaacaaataagtaatgaattaaatcacatactactagagaatgggatgaaattcacagtagtcgtaggagatgtcgtaggaatccttgctcaaggcaagaaaatgatacgtccacagccaatggagcacaaatattcatggaaaagttggggaaaggctaaaatcatcggagccgatgttcaaaatactacgtttataatcgatggacctaatacacccgagtgcccagacgatcaaagagcatggaacatatgggaggtagaagactacgggtttggaatttttacgaccaatatatggctcaaactcagagattcttatactcaagtatgcgaccatcgattaatgtcagccgcaattaaggattctaaagcggtccatgcagatatgggatattggatagaatctgagaaaaacgaaacatggaaacttgcccgcgctagttttatagaagtgaaaacttgcatatggcctaaaagtcacactctatggtcaaatggagtacttgaatcagagatgatcataccgaaaatatacggaggaccgatatctcagcataattatagaccagggtattttacacaaaccgcaggaccatggcatttaggcaaattggaacttgattttgacctctgtgaaggtacaacggtcgttgttgacgagcactgtggtaatcgcggtccatcactgaggactacaacggtaaccggtaaaataatacatgaatggtgttgtcgatcatgcactctacccccactgagatttaaaggcgaggacggttgctggtatggcatggagattagaccagtaaaagaaaaggaagaaaatctggtcaagtccatggtgtcagcaggaagtggtgaagtagattcattttcattaggccttctatgtacctcgatcatgatagaagaagtaatgagatcacgatggtctcgtaagatgcttatgacaggaactttagccgtatttttgctactaattatgggacaattaacctggaacgaccttatacgcttatgcattatggttggagctaacgcgtccgatcggatgggcatgggcactacataccttgctcttatggccacattcaaaatgagaccaatgtttgcagtcggcttactatttagacgattgacatcccgagaagtactcttacttacgataggccttagcttagtagcatcagtcgaactacccaatagcttagaagaactaggcgacgggctagccatgggtatcatgattcttaaattactgaccgattttcaaagccatcagctgtgggcgaccctactcagtttaacatttatcaaaacgactctatcattacactatgcctggaagacaatggcaatggtcctctcaattgtttcactttttcccctttgtttatctacgaccagccaaaagactacatggctccccgttttattaggatcactcggttgcaaacctttgacgatgttcctcatagctgaaaataaaatttgggggcgcaagagctggccactaaatgaaggtattatggcagtgggcgtcgtttccattctactatcgtctctgttgaagaacgacgtgcccctagcaggcccgttaatcgctggcggtatgttgatagcatgttatgtcataagtggaagttcggctgaccttagccttgagaaagcggcagaggtctcttgggaggaagaagctgaacattctggggcgagtcataatatttttgtagaagtccaagatgacggaacaatgaaaattaaagatgaggaaagagatgatacattaacaattttacttaaagctacgcttttagccgtcagcggagtatatccgttatcaattccagcgacactgtttgtttggtatttctggcagaagaagaaacaacgatctggagtgctatgggatactccatcaccaccagaagttgaaagagcagctttagacgacggaatttatcgcataatgcaacgcggattgctgggtcgcagccaagtgggagtcggagtattccaagaaaacgtgtttcacacaatgtggcatgtcacgagaggagcagtcttaatgtatcaagggaaaagactagaaccaagctgggcgagcgtgaagaaagatttaataagctacgggggtgggtggcgactacaaggatcttggaacacaggagaagaggtgcaagtgatagcagttgaaccaggcaaaaatcctaaaaatgtacagactgcaccaggaactttcaagacgccagagggtgaagttggcgcgattgcattagatttcaaaccaggtacaagtggaagtcctatagtcaatagagaaggaaagattgttgggctgtacggaaacggagtagttactacaagtggtacctacgtttcagccatagcacaggcgaaagcatcacaagaaggtccattgccggagattgaagatgaagtttttagaaagagaaacctaactataatggatttacaccctgggtcaggcaaaaccagaagatatttacccgcgattgtaagagaagccataaagcgaaaactacgtactctgatattggctcccacccgcgtcgtagccagtgagatggcagaagctctaaaaggtatgccgatccgttatcagactactgcagtaaaaagtgagcacacaggaaaagaaatagtagatctaatgtgtcacgctacattcactatgagactattatccccagtacgagtaccaaactataatatgattataatggacgaagcacatttcactgatcctagttcaatagcagctcgtggctacatttctacacgagtagggatgggggaagcagcagccatatttatgacagcaacaccaccgggttctgtcgaagcgtttcctcagtcaaacgcggttattcaagatgaggaacgcgatattccggagcgaagttggaactctggttacgagtggattaccgacttcccggggaaaacagtatggtttgtcccgtcaatcaaaagtggcaatgatatagctaactgtttgagaaagaatggaaaacgagttattcaactgtcacgaaaaaccttcgacaccgaatatcagaaaactaaaaataatgactgggactacgttgtgacaacagatataagtgagatgggggcgaactttcgcgcagatagggtaatagatcctagaagatgtctaaaacccgtcatactgaaagacgggccggaaagagtaatcttggcaggaccaatgcccgttactgtagcaagtgcagcgcagcgacgcggtagaattggacgaaatcacaataaagaaggtgatcagtatatttatatggggcaaccattaaacaacgatgaagatcacgcccactggactgaagcgaaaatgctattagataatataaatacgcctgaaggaattataccagcactatttgaaccagaacgggagaaaagtgccgcaatcgatggtgaatataggttaaggggagaagctcggaagacattcgtggagctcatgagaagaggagacttgccggtatggttgagttacaaagtagcttccgaagggtttcagtacagtgatcgaaggtggtgtttcgatggtgaacgtaacaaccaggttttggaggaaaacatggatgtcgagatatggacaaaggagggagaaagaaagaaattaagaccgcgctggttggacgcaagaacgtatagcgacccgctggccctacgcgagtttaaagagtttgcagctggccgaaggagcgtctcaggcgatttaatattagaaatcggaaaacttccacaacacctgacacaaagagcgcagaatgcattagacaatctagtgatgcttcataatagcgaacaaggaggtagggcttatcgacatgcaatggaagaattacctgacactatagagactctcatgttactagcattaatagcagttctaaccggaggggtcacattattctttttaagtggacgaggtctcggcaaaaccagtataggtttgctttgtgtcatggcttcatcagtacttttgtggatggcttcagtggaaccacattggatagctgcatcaatcatcctcgagtttttccttatggttctgctaatccctgaacccgaccggcaacgtacccctcaggataatcaactagcatatgtagtaataggacttctttttattattctaacagtggcagccaatgaaatgggactactagaaacaactaagaaagatcttgggataggccatgtcgcagttgaaaatcatcaccacgcgacaatgttagacgttgacctacacccggcctctgcttggaccttgtatgctgttgccactacaataataactccgatgatgcgtcacacaatagaaaatactaccgcaaacatcagtcttacagcaattgcgaatcaagcagctatacttatgggtctcgataaaggctggccaatcagtaaaatggatataggagtaccactattagcattaggctgttactcacaagttaatccactaactctaacagctgcagtattgatgttagtcgcacactacgccataattgggccaggcttacaagcaaaagccacacgcgaggctcaaaaacggaccgctgcaggtattatgaaaaacccgacagtagatgggatcgttgcgattgatttagatccagttgtgtatgatgcaaaattcgaaaaacagctaggccaaatcatgctactaatattatgcacaagtcaaattttattaatgagaaccacttgggcgctctgcgagagtatcaccctcgccacaggaccattgactacactgtgggaaggaagtccgggtaaattttggaatactactatcgctgtaagtatggcaaacatatttagaggaagttatctcgcgggggcagggttggcgttctctctaatgaagtcgcttggaggtggaagaagaggaacaggcgcacaaggcgagacccttggagagaagtggaaacgccaattaaaccaactgagcaaaagcgagttcaacatctacaaaagatcgggaataatggaagtggataggtcagaggctaaagaaggactaaagagaggggaaacaacaagacatgctgtttcccgtggaacagcaaaattaagatggtttgtcgaaagaaaccttgtcaaaccagagggcaaagttattgatttaggatgcggcaggggaggttggtcttattattgcgcaggactgaagaaagtgactgaagtaaaaggatataccaaaggagggccgggacatgaggaaccaattccaatggcaacgtacgggtggaacttagttaaattacatagcggcaaagatgtattctttacaccacctgaaaaatgtgatacgctattatgcgatataggagagtcttcccctaatcctactattgaagaaggaaggaccctaagagtcctgaaaatggtagagccatggttaagaggaaatcaattttgtattaaaatactaaatccgtacatgccaagtgtggtggaaacactcgagcagatgcaaagaaagcacggagggatgttggtacgaaaccctttgtccagaaattctacgcacgaaatgtattgggttagttgcggaactggaaatattgtgtcagcggtgaatatgacatcacgtatgctcttgaacaggtttacaatggctcatcggaagcccacgtatgaaagagatgtcgacctaggagctggaactagacacgtggcagtggaaccagaagtagccaatctagacattattggccagcgtattgaaaatatcaagcacgagcacaaatcaacctggcactacgatgaggataatccatataaaacgtgggcatatcacggttcttacgaagtaaaacccagcggcagtgcttcatcaatggtgaacggtgttgtaaagttacttacgaaaccttgggatgtgattccgatggtaactcaaatagcaatgacagataccactccctttggtcaacaaagagtttttaaagaaaaagtagatacgcggacaccaaaagcaaagaggggcaccgctcaaataatggaggtaactgctagatggctatggggatttttatcgaggaataagaaaccgagaatttgtaccagggaggaatttaccagaaaggtccgaagtaacgcggcaattggagcggttttcgttgatgaaaaccaatggaatagtgcaaaagaagctgttgaagatgagcgattttgggacttggtacagaaagaacgagaactacataaacagggcaagtgcgcaacatgtgtttacaatatgatgggtaagagagagaaaaagctaggagaatttggcaaagccaaagggagtagagcgatttggtatatgtggctaggtgcgagattcttggaatttgaggccctagggttcatgaacgaagaccactggttttcaagagaaaattccttatcgggtgtggaaggagaaggtctccataaattaggttatatcctacgggatatatcaaaaattccaggtggtaacatgtatgcagatgacacggccggttgggatacgcggatcacagaagatgatttacaaaacgaagcaaagataaccgatataatggagcctgaacatgcacttttagcgacctcaatattcaaattaacataccaaaataaggtcgtaagagttcagcgccccgccaagaacggaactgtgatggacgttatcagccggcgcgatcaacgaggaagtggtcaagttggcacatacggtctaaatacgttcactaatatggaagcgcaactcatacgacaaatggaatcagaaggaatctttctaccctctgagctagagacacctaacctagctgaaagggtgttagattggctagaaaaatacggtgtagaaaggcttaaaaggatggcgatctcaggcgatgattgcgtagtcaagccgatagatgacagatttgcaacagctctaacagcactaaatgatatgggaaaggtacgcaaagatataccgcaatgggagccatctaaaggttggaatgattggcaacaagtacctttctgttctcatcattttcatcaactaattatgaaggatgggagggaaattgtagttccttgtcgcaatcaagatgaacttgtcggcagggcccgagtaagccaaggagccggatggagcctaagggaaaccgcatgtttaggaaaatcttatgctcaaatgtggcaattaatgtattttcataggcgggatctcagacttgcagcgaacgcgatttgttctgcagtaccagttgactgggtccctacgtccaggacaacatggagtatacacgcgcaccaccaatggatgacgaccgaagatatgctatccgtatggaaccgtgtgtggatagaggaaaatccatggatggaggacaaaacacacgtgtctagttggggtgacgttccgtaccttggtaaacgggaagatcaatggtgtggtagcctaataggattaactgcgcgagcaacatgggctagtaacatccaggtggccatcaatcaggttagaaggttaataggtaacgaaaattatctggattatatgacgtcaatgaaaagatttaagaatgaaggcgatccagaaggagcgctttggtaa

SEQ ID NO: 21721 - RNA, 9879 nt, synthetic construct
  misc_feature 1..9879: note = derived and/or modified CDS sequence (opt6) from DENV-1__GQ199834__SS-prME
  source 1..9879: mol_type = other RNA
tccgttacaatgcttcttatgctaatgcccactgccctcgcttttcatttaaccactcgaggaggggaaccgcatatgatagtaacgaaacaagaaagaggtaaatcattgctttttaaaacaagcgccggagtaaacatgtgcactttaattgcaatggatttgggtgaattatgtgaagataccatgacatacaaatgccctagaattactgaagcagaacctgatgatgtggattgttggtgcaacgcaaccgatacttgggtgacttacggtacctgtagccaaacaggagaacaccgaagagacaaaagaagtgtggcattagccccacacgttggactagggttggaaacacggacagaaacttggatgtcatctgaaggtgcgtggaaacaaatacagcgagtagaaacatgggccctaaggcatccaggtttcacagtaatagcgttatttctcgcacatgcaatcggaacttcaataacgcaaaaaggtataattttcatactgctaatgttggttaccccatctatggcaatgcgatgtgtaggtattgggtcgcgggattttgtcgagggcctgtcaggagccacgtgggtagatgtggtattagagcacggctcatgcgtcaccacaatggcgaaagataaacctacactagatatcgaattactaaaaactgaggtcacaaatcccgccgtacttcgcaaactctgtattgaagcaaaaatatctaatacgacaactgattcaagatgtcccacgcaaggtgaagccacacttatggaagaacaagacgctaactttgtgtgccgtcgaacattcgtagaccggggatgggggaacggttgtggcttatttggtaaaggatcattaatcacttgcgcaaaattcaaatgtgttacgaaattagagggaaaaattgtgcagtatgagaacttaaaatatagcgtgatagtaactgtacatactggagaccaacatcaagtggggaatgaaagcacagagcatggaacaaccgcaacaataaccccacaagcgcccactagcgaaatacaactcacagattacggtgcactaacactggattgctcaccgaggacgggcttagatttcaacgaaatggtgttactaactatgaaagagaaaagctggctagtacataaacaatggttcctggatttacctttaccttggacgtcaggagcctcgacttctcaggaaacctggaatagacaagatctgctcgttacgtttaagacggcacatgccaagaaacaagaggttgtagtacttgggtcgcaggaaggggcaatgcacacggcgttaacgggcgccactgaaatacaaacctccgggacaaccacaatattcgccggccatttaaaatgtagattaaaaatggataaattgaccttaaaaggaatgtcatacgtaatgtgtacaggatcctttaaattagaaaaagaactagcagaaacacagcacggtacagttttggtccagatcaaatatgaaggtaccgacgcaccttgtaaaatcccctttagcacacaagatgaaaaaggcgtgacacaaaatggccgcttaataactgcaaatccgattgtgacagataaagagaagcccgttaatatagaagcagaaccaccctttggtgaaagttacatcgtaataggagcaggagagaaagcactaaaactaagttggtttaagaaaggtagtagtatcggcaaaatgttcgaagcgacagcgagaggagctagaaggatggctatattaggagacacggcatgggattttgggtccataggaggggtcttcacgtccgtaggaaaattagtccaccaaatattcggaacagcatatggcgtgctattttctggagtcagttggactatgaaaataggaatcggagtcttacttacgtggttaggcttaaatagtaggtcgaccagtctatcaatgacttgcatagcagttggacttgttacgctgtatttgggagtaatggtacaagctgattctggatgtgtgattaattggaaggggcgggaactaaaatgcggctctggaatttttgtgactaatgaggtacacacttggactgaacaatataagttccaagcggattctccgaagcgtcttagtgctgcaatcgggaaagcatgggaagaaggtgtatgcggcataagatctgcgacaagattagaaaatatcatgtggaaacaaatatcgaacgagctaaaccatattctcctcgaaaacgggatgaaatttactgtcgtagttggagacgtcgatggcattctagcgcaaggcaagaagatgataagaccacaacccatggaacacaaatattcatggaagtcttggggaaaagctaaaataataggtgccgatgttcaaaatacaacttttatcatagatggccctaacacacctgaatgcccagacgaccagagggcgtggaacatatgggaagtagaagattatggctttggtatcttcactactaacatctggttaaaattaagagacagttacactcaagtttgcgaccatcgcctaatgtctgcagcaattaaagattccaaagcagtgcatgcagatatgggctactggatagaatcagagaaaaatgagacgtggaaactagcacgagcatcattcattgaggttaaaacatgtatttggcctaaaagccatacactttggagtaatggagttctggaatcagaaatgatcataccaaagatatacggcggacccataagtcaacacaattataggccaggatattttacgcagactgcgggaccatggcatttaggcaagttagagttagactttgacttatgtgaaggaactacagtcgtagtggatgaacactgcggtaatagaggaccttcactccgcacaacaaccgtgacgggaaaaatcattcatgaatggtgctgtcgctcatgcactctaccccctttaagatttaaaggtgaagatggttgctggtatggtatggaaattcgaccggtaaaagagaaagaggaaaatctagtcaaaagcatggtatcagcagggagcggagaagtagattcttttagcctaggactactttgtatttccataatgatagaagaagtaatgagaagtagatggtcaagaaagatgctaatgactgggacacttgcagtcttcctcctactcattatgggacaacttacttggaacgatttaattcgattatgcataatggtgggtgctaatgcgagtgaccggatgggaatgggaacaacttacctagcgttaatggcaacatttaaaatgaggccaatgttcgcagtcggactcttatttagaagactaacttcgcgtgaagtacttttattaacgattggtctttctttagttgccagtgtggaactacctaattcattagaggaacttggtgatggcctagcaatgggcataatgattctaaaactgttgacagactttcaatctcatcagttatgggcaaccttgttaagtcttacttttataaaaacaacattaagtttacattacgcatggaagacaatggcaatggttctcagcattgtttcgttgttcccgctatgcctaagtactacaagtcagaaaactacatggttgcccgttttattaggatcactagggtgtaaacctcttactatgttcctcattgcagaaaataaaatttgggggaggaaaagctggccattgaacgagggcatcatggcagtcggagttgtgtcaattctattatcatcgcttctcaaaaatgacgtgccattggccggacctttaatagcaggaggtatgctaatagcatgttatgtaataagcggaagcagcgctgatttaagtttagagaaagccgccgaagtgagctgggaagaagaggcagaacattcaggcgcgagtcataacatccttgtagaagtacaagatgacgggactatgaaaattaaagatgaggaaagagatgacacactaacgattctccttaaagcgacgttattagccgtatccggcgtctatccacttagtatcccagcaacccttttcgtctggtatttttggcagaagaagaaacaaagaagtggcgtgttatgggatactccttctccacccgaggtcgaacgtgcggtgttggatgatggaatatatagaattatgcaacgaggcttattaggtaggtctcaagttggcgtcggtgtattccaagaaaatgtctttcatacaatgtggcatgtaacgcgcggagcggttcttatgtatcaaggtaagagattagaaccatcgtgggcgtctgttaagaaagatctgatctcatacggaggcggatggagattacagggatcatggaacaccggtgaggaggttcaggtaatagctgttgagcctggcaaaaatccgaaaaacgtccaaacggctcctgggacgtttaaaaccccagaaggagaagtcggtgccatcgctttggattttaaaccaggcacttctgggtcaccaatagtcaacagagaaggaaagattgtcggactttatggtaatggtgtagtcacgacctcagggacatatgtaagcgcaatagcccaggctaaagcaagccaagaaggccctttaccagaaatcgaagacgaagttttcagaaaaaggaatttgaccataatggatctgcaccctggatcaggaaaaacacgaagataccttcctgcaatcgtcagagaagcaattaaaagaaaactacgaacattaatcctcgcgcctactcgagtcgtagccagtgaaatggcagaggcactaaaaggtatgccaattagatatcaaacgaccgctgtgaaaagcgaacatactgggaaagagattgtggatcttatgtgtcacgcgacattcacaatgcgcctgctatcaccagttcgagtaccaaattataatatgataataatggacgaagcacatttcactgatccaagctcgattgcagccaggggctacatttccacgagagtaggaatgggagaggcagccgcgatcttcatgacagctactccaccaggatctgttgaagcatttccacaaagtaatgcggtgatccaagacgaagaacgagatataccagagagatcatggaatagcggatacgaatggattacagatttcccaggtaaaacggtatggttcgtgcctagtataaaaagtggaaatgacatcgccaattgtctcaggaaaaacggaaaaagagttatacaattgtcaaggaaaacattcgacacagagtatcagaaaactaagaataatgattgggactatgtagtaacgactgatatatccgaaatgggagcaaatttccgagccgacagagtaatcgatccacgccgatgtttaaaacctgtaatactaaaggatggccccgaaagggtgattctagcaggccccatgcctgtaactgtcgcaagtgcggcgcaaagacgaggaaggataggaaggaatcataacaaagagggagaccaatatatctatatgggtcaaccgcttaacaatgatgaagaccacgcccactggacggaagctaaaatgttgcttgataatataaatacacccgaaggtataatacccgcactttttgaaccggagcgggagaaatcagcagcaatcgatggcgaatatcggttaaggggtgaagcgaggaaaacatttgtagaactcatgaggcgaggtgacttaccagtatggctatcatacaaagtagcaagtgagggtttccaatatagcgaccgacgatggtgcttcgatggagaacggaataatcaggtacttgaagaaaatatggacgtagagatatggactaaagaaggagaaaggaagaaattaagaccgcgctggctagacgcacggacatactctgatcccctagctctacgggaatttaaagagtttgcagccggcaggagaagtgtatcaggagatttaattcttgaaataggaaaattaccccagcacttgacccagagggctcaaaatgccctagataatctagtgatgctacataattccgaacaaggcggacgagcataccgccacgcaatggaagaactcccagatacaatagagacactaatgctactcgctctaattgccgtactaacaggaggagtgacacttttcttcctatcaggccgaggattggggaagactagcatagggttgttatgtgtcatggcttccagtgtattactatggatggcttcagtggaaccgcattggatagcggcatctattattttagagttcttcttgatggtattgctaatcccagagccagataggcaacgtacacctcaagataaccaactggcatatgtagtaattggcttactgttcatgattttgaccgttgctgcgaacgagatgggattactggagacgacgaagaaagacttaggaataggacacgtagctgtagaaaaccaccaccacgcgacaatgttagatgtggacttacatccagcatcggcatggacgttgtatgctgtggcaaccaccattataacacccatgatgcgtcatactatagaaaatacaactgcgaatataagtttaactgctatcgctaatcaggcagcgattctaatgggcctagataaaggttggcccatatctaagatggacattggcgtcccacttttagcactaggttgttattcacaggtaaacccattaacactgaccgctgccgttctaatgctagtagcacattatgcaataatcggtcctggattacaagcaaaggccactcgtgaagcacagaaaagaaccgcagccggaattatgaaaaatccaactgtggacggcatcgtagctattgacttagatccggtcgtttatgacgcaaaattcgaaaagcaacttgggcaaattatgcttctaatactatgtacatctcaaatattattgatgcgtactacctgggctttatgcgagagcattacattggctacgggtccattaacaacactctgggagggaagccctggaaaattttggaacacaacaatagcagttagtatggcgaacatattcaggggctcgtatttagcaggagcggggttagcattttccttaatgaagtcattaggaggcggaagacgggggactggggcccagggtgaaacactaggtgaaaaatggaagcgacaactgaatcagttgagtaaaagtgagtttaatatttacaagagatcaggtataatggaagtagatcgatcggaagcaaaggaaggattgaaacgaggtgagacaactaggcatgcagtttcaagaggaacagcaaaattgagatggtttgtagaaagaaacttagtaaaaccggaaggaaaagtaattgatctaggatgcgggagaggaggttggtcctattactgtgccggtctcaagaaagtaacagaggtaaaaggttatacaaaagggggacctggccatgaagaaccgataccaatggcaacttatgggtggaatttagttaagttacactctggaaaagatgtattctttacgccccctgaaaaatgtgatactttattatgcgatattggagaaagttcacccaatccgactatcgaagaaggacgaacactacgagtccttaaaatggtggaaccatggttgagaggaaatcaattctgtatcaagatcctgaatccctacatgccttcagtagtcgaaacgttagagcaaatgcaacgcaagcatggaggaatgttggttcgcaatcccttatcccggaactcaacacacgaaatgtattgggtgagttgcggtaccggtaacatagtatcagcagtcaatatgacttcacggatgttgttaaaccgtttcaccatggcacatcgtaaacctacctacgagagagatgtagatctaggagccggcacgagacatgtcgcagtagaaccggaagtagccaacttggacataattggacaaagaatcgaaaatattaagcatgaacataaaagtacatggcattatgatgaagataatccttataaaacctgggcgtaccacgggtcatatgaagtcaaacccagtggaagcgcatcaagtatggtaaatggggttgtgaaattattgaccaaaccctgggatgtaatcccaatggtcacacagatagcaatgactgatacgacaccttttggccaacaaagagtatttaaagagaaagtcgacactaggactcccaaagccaaaagagggacagctcaaatcatggaagtaacagccagatggctgtggggatttttgagtagaaacaagaaacctcgtatctgcactagagaagagttcactcgaaaagttcgatcaaatgcagcaattggagcagtctttgtagacgagaaccaatggaactctgcaaaagaagccgttgaagatgaaagattttgggaccttgtgcaaaaagagcgagaactacataaacaaggaaaatgcgccacatgtgtatacaatatgatgggtaagcgcgagaaaaagctcggagagttcggaaaagcaaagggatctagagcgatctggtatatgtggttgggggcgagattcttagagttcgaagcgttaggttttatgaatgaagatcactggttcagccgagagaactctctaagcggagtggagggggaaggtttacataaactaggttacatacttagagatatatctaaaatccctggaggaaacatgtacgcagacgacacagcgggttgggatacacgtataaccgaagatgatctccaaaatgaagcaaaaattacagatattatggaaccagaacatgccttacttgctacaagcatattcaagctaacttatcagaataaggtggtaagggtacaaaggcccgcgaaaaacggaacagtcatggatgttattagcagaagagatcagcgaggttctggtcaggtcggaacttatggactaaacacatttaccaacatggaagcacaattgattagacaaatggaaagcgaagggatatttctcccaagtgagctggaaacacccaaccttgctgaacgagttctcgattggctggagaagtacggagtagagcgtctaaaaaggatggcgatttcgggagatgattgtgtagtgaaacctatagatgatcggtttgcaacagccctaacagcgcttaacgatatggggaaggttagaaaggacattcctcaatgggagccatctaagggatggaatgattggcagcaagtccctttctgtagccatcatttccatcaattgataatgaaagatggccgtgagattgttgttccctgcagaaaccaggatgaactggtcggcagagcaagagtatcgcaaggcgctgggtggtcactaagggaaacagcatgcctaggtaaatcatatgcacaaatgtggcaattaatgtacttccacagacgagacttaagattagcggccaacgctatttgtagtgcggtcccagtagactgggtcccaaccagtagaacgacatggagtatacatgcacatcatcaatggatgactacggaagacatgttgagtgtctggaatcgtgtatggattgaagaaaatccgtggatggaagacaaaacgcatgtcagttcatggggtgatgttccctacctaggaaaacgagaggatcagtggtgcggatccttaatcggcttaacagcaagagccacatgggcatcaaatattcaagttgctataaaccaagtaagaagactgataggtaatgaaaactacttagactacatgacttctatgaagcgcttcaaaaacgagggtgatccggaaggcgcactctggtaa

SEQ ID NO: 21722 - RNA, 9879 nt, synthetic construct
  misc_feature 1..9879: note = derived and/or modified CDS sequence (opt6) from DENV-1__GQ199835__SS-prME
  source 1..9879: mol_type = other RNA
tccgtaactatgttactgatgctaatgcctactgcgcttgcatttcatttgacaactagagggggcgagccacacatgatagtgaccaaacaagagagaggaaaatcactactctttaaaacatcggcaggggtaaatatgtgtacccttattgcgatggaccttggagaactctgtgaagatacaatgacctataaatgtccccggataacagaagccgaaccagatgatgttgattgttggtgtaacgcaacagacacatgggtaacgtacggtacatgctcacaaactggagagcatagaagagataaaagaagtgtagctttagctcctcatgttggtttaggattggaaactagaacggaaacatggatgagcagtgaaggagcttggaaacagattcaacgcgtagaaacatgggctctaagacacccaggatttactgtaatagctttgttcctcgcacatgcgatcggaacaagtataactcaaaaaggtattatatttattttgttgatgttagtcacgccgtcaatggcaatgagatgcgtcgggatagggtcgagagactttgttgagggtttatctggtgcaacatgggtcgatgtagtccttgaacatggatcgtgtgtcacaactatggccaaagacaaaccaacactagatattgagctattaaaaacggaagtgactaatccagctgtattgagaaaattgtgtatagaggccaaaatatctaatacaaccacagattctaggtgtcctactcaaggtgaggctacactaatggaggagcaagatgccaattttgtatgccgacggacatttgttgaccggggttggggaaatggatgcggactttttggcaaaggcagtctgataacatgtgccaaatttaaatgtgtaactaaactcgaagggaaaatagttcaatacgaaaacttaaaatactctgtaatcgtcactgtacatactggagatcaacaccaagtcggcaatgaaagcactgaacacgggacaaccgcaactatcacaccacaagctccaacgtcagaaatccaattaacagactacggtgccctaactctcgattgctctccacgaacaggcttagacttcaatgaaatggtattattaaccatgaaagaaaaatcttggttagtacataaacaatggttcttagacttgcctttgccttggacaagtggagcgagcaccagtcaagaaacttggaacagacaagacctgttagttacttttaaaacagctcatgctaagaaacaggaagtagtagtcttaggatcgcaagagggcgctatgcacacagcacttacaggagcaactgagatccaaacgtctgggacaacaacaatttttgcgggacatcttaaatgtagattaaaaatggataaacttaccctaaaaggtatgagttatgtaatgtgtacaggttcgttcaagctagaaaaggaagtggcggaaacacaacacggaactgtattagtccaaattaaatatgaagggaccgacgcgccatgtaagatacctttctcgacccaggatgagaaaggagtgacgcaaaatggtcgactcattacagcgaatccaattgtaaccgacaaagagaaaccagtgaatattgaagctgagcccccgtttggagaatcgtatattgtaattggcgccggagagaaagccctaaaattaagttggtttaagaaaggatcgtcaatcggaaaaatgttcgaagcaactgccaggggagcacgacgtatggctatactaggtgatacggcatgggactttggctcgatcggaggtgtcttcacgtctgttgggaagttggtacaccagatttttggcacagcgtatggagtactcttcagtggtgtctcttggactatgaagataggtataggagttctcttaacatggttgggactgaacagtcgatcgacatcactctcaatgacttgcattgcagtgggacttgttaccttgtatttaggagtaatggttcaggcagactcaggatgcgttatcaactggaaaggaagagagctcaaatgtggctctggaatattcgtgacaaacgaggtgcacacttggacggaacaatacaagtttcaagcagattcacccaaacgattatcagcagctattgggaaagcgtgggaagaaggggtttgcggaattagaagcgctacaagacttgaaaacataatgtggaaacaaatttctaatgaattgaatcacatacttctagaaaacgacatgaaatttacggtcgttgtcggtgatgttgtggggatattagctcaaggcaaaaagatgataagacctcaacccatggagcacaagtattcttggaagagttggggaaaagccaagattataggtgctgacgtgcaaaatacaacttttatcattgacggacccaatacaccagaatgcccagacgaccaacgagcttggaatatttgggaggtagaggactacggctttggaatctttactacgaatatctggctaaagctcagggattcctacactcaagtctgtgaccacagacttatgagtgctgcgataaaagattcaaaagctgtacatgctgacatgggttattggatagaaagtgaaaagaacgaaacatggaagctggcacgggcttcgtttatcgaagtaaaaacatgcatttggccaaagtctcatacattgtggtcgaacggcgtactggaaagtgaaatgataattccaaagatttacggagggccaatcagtcaacataattataggccaggatatttcacacaaacagctggaccttggcatttaggtaagttagaattagattttgatctttgcgaaggaacaactgtagtagtagatgagcactgtgggaacagggggccatctttaagaacaacaaccgtcactgggaaaattatacatgaatggtgttgtagatcatgtacactccctccattaagattcaagggcgaggatggatgttggtacgggatggagattcgacctgtaaaggagaaagaggagaacctagtcaaaagtatggtgtccgctgggtctggagaagtagattcgtttagcctaggattactttgcattagtatcatgatagaggaagttatgaggagccgctggtcaaggaaaatgctaatgacaggtacacttgctgtctttttattacttatcatggggcaattaacgtggaacgatctgatacgcctctgtatcatggttggagcaaacgcatctgaccgtatgggaatgggaacaacgtatcttacattaatggctacgtttaaaatgagacccatgttcgctgtaggactgttacttaggcgactgacgagcagagaggtattgttactaaccattggattaagtttagtagctagcgtggaattaccaaatagcctagaggaactaggtgatggcctagctatgggaattatgatactgaaattattgacagacttccagtctcatcagctttgggcaaccctgttatcattaacatttatcaaaacaactctaagcctccactacgcttggaagactatggcaatggtattaagcatagttagcttatttccactatgcttaagcacaacaagccaaaagacaacttggcttccagtactccttgggtctttaggctgtaaaccactaacaatgttcctaattgcagaaaacaagatatggggaagaaaaagttggccactgaatgagggtattatggcagttggagttgtgtcaattctgttatcctcgctactcaaaaatgatgtaccactcgccggtccacttatagcgggtgggatgttaatagcttgttacgtgatatcaggatctagtgcggaccttagtttggaaaaagcagcggaagtcagctgggaagaagaagctgagcacagtggcgcctcacacaacatattggtagaagtccaagatgatggaacaatgaaaataaaggacgaagaacgagacgatacgctaacaatattactgaaagcaaccttgttggcggtttctggagtttacccactgagcattccagctactttattcgtttggtatttttggcagaagaagaaacaaagatctggagtactatgggatactccgtctccgcccgaagtagaacgtgcagtgttagatgacggaatttaccgaataatgcaaagaggtttgttaggcagaagtcaggtaggtgtcggggtgtttcaagaaaatgtgtttcacacgatgtggcatgtaacccggggagctgtgcttatgtatcagggcaaacgcctagaaccgtcatgggcatctgtcaagaaagatttaatcagttatggtggagggtggcgcttgcaagggtcgtggaatactggtgaggaggttcaagtaatagccgtagagccaggtaaaaatcctaaaaacgtacaaacagcgcctggtacgtttaagacacctgaaggagaggtaggtgctatagcactagattttaaaccagggaccagcggatcacccatagttaatagagaaggtaaaattgtaggtctttacggcaatggggtcgtaaccacatccggaacatatgtgagcgccatagctcaagctaaagcatcacaggagggcccattaccagagattgaagacgaagtgtttaggaaaagaaatctgactataatggacttacaccccggctcagggaaaactagaagatacttaccagctatagttagagaggcaatcaaaagaaaattacggacactaattctcgctccaacgagagtagttgcttcagaaatggcagaggcattaaaaggtatgcccattagatatcaaacgactgctgtaaaatcggagcacaccggaaaggagatagtcgatttaatgtgtcatgctacatttacaatgcggctattaagtccggttagggtaccaaattataatatgataataatggatgaagcacattttacagacccttcttcaatagcagccagaggatatataagtactagagtaggcatgggggaagccgcggcaatatttatgacagcaacacccccaggaagtgttgaagccttcccccaatctaacgcggtcatacaagatgaagaaagagacatccccgaaagatcatggaactccgggtatgagtggatcacagactttcctggtaaaacagtgtggtttgtaccgagcatcaaatctgggaatgacatagcaaattgtcttcggaaaaatggaaaaagagtcatccaattgagcagaaagacatttgatacagagtatcagaaaactaaaaataatgattgggactatgtcgttacaacagatatatcggaaatgggcgcgaatttccgtgcagatcgagttattgacccaaggcggtgcttgaaaccggtcatccttaaggatggcccagaacgcgttatccttgcaggccccatgccagtcacagttgcatcagctgcacaaaggaggggtagaataggcagaaatcataacaaagagggtgatcaatatatatacatgggacaaccactaaataacgacgaagatcatgcacattggacagaagccaagatgctccttgataacatcaatacgccggagggcataataccggccttatttgaacctgaaagggagaaaagcgctgcaatagatggtgagtatcggcttagaggggaagcgagaaaaacgtttgtagaacttatgagacgcggagacttaccggtatggctctcatataaagtagcgtcagagggcttccaatacagtgacagaaggtggtgttttgacggcgagagaaataaccaagtcttggaggaaaatatggatgtagagatctggactaaagaaggcgaaaggaagaaactgcgcccaagatggttagacgccagaacttactcagatccactagcccttcgggaatttaaagaatttgcagcagggcgtaggagcgtcagcggagacctaattctcgaaatcggaaaacttccacagcatctcactcagagggcccagaatgcactcgacaacttggtaatgctacataattcagaacaaggagggcgggcttatcgtcatgcaatggaagaactacctgataccattgaaactctaatgttactagctcttatagcggtacttactggaggggtgaccctattctttctgtcggggagagggctaggcaagaccagtataggactactatgcgtcatggcatccagtgttctattgtggatggcaagcgtagaaccccactggatagcagcaagcattatactagaatttttcctaatggtactgctaataccagaacctgataggcaaagaacaccacaagacaatcaacttgcttatgttgttataggtttacttttcatgattctcacagttgcggctaacgagatgggactattagaaactactaagaaagacctaggtatcggacacgttgctgtcgaaaaccatcaccacgcaacaatgttggacgtcgacctgcatccagcaagtgcatggactctttatgcagtggctactactatcatcacgccaatgatgcgacacacaatcgaaaatactaccgcaaatataagtctaacagcaattgcaaatcaagcagcaattttaatggggttagataaaggatggccaatctctaagatggatataggcgtgcctctactcgcattaggttgctattcacaagtcaatcctttaacattgacagcagccgtgttaatgctagtagctcactacgcaattataggcccaggtttgcaggcaaaagctacacgagaagcccaaaagcggactgcagcaggaattatgaaaaatccaacagtcgatggaatagtagcgatagatttagacccagtagtttacgatgctaaattcgaaaaacaactaggtcagattatgctactaatattatgtacgagccagatccttcttatgagaactacatgggctttatgcgaaagtatcacactagctacgggtccacttacaacactatgggaaggctcaccgggaaagttttggaatacgacaatagccgtgtctatggcgaacatcttccggggcagttatttagcaggagccggcttagctttcagcttgatgaagtcattgggcggaggaagacggggcaccggcgcccagggagaaactttgggagaaaaatggaaaaggcagttgaatcaactgtcaaaatctgagtttaacatttataaacgcagcgggataatggaagtagatcgtagtgaagctaaagaaggtttaaagcgaggagagacaactcggcatgccgtttcacgcggaacagccaaattaaggtggttcgttgaaagaaatcttgtaaaaccagaaggaaaagtgatagatctgggatgtggtagaggaggatggtcatattactgcgctgggctaaagaaagttaccgaagtaaagggatatacgaagggagggccagggcatgaggagccaatcccaatggctacttatggctggaacctagttaaacttcacagcggtaaagatgtattctttactccacccgaaaaatgcgacaccctactttgtgatataggcgaatcatctcccaaccccaccatcgaggagggtcgaactcttcgagtactaaaaatggtagaaccatggctaaggggtaatcagttctgtataaaaattttgaatccatacatgcctagtgtagtagaaaccctagagcaaatgcaacgaaaacatggaggcatgttggttaggaatccactttcacggaacagcacgcacgaaatgtactgggttagttgcggaactggtaatatagtatcagctgtgaacatgacaagtaggatgttgctgaacaggtttacaatggcgcatagaaaacccacatacgaaagggatgtggaccttggagcaggaaccaggcatgtggcagttgaaccagaggtagcaaacttagatattatcggccaacgcattgaaaatataaaacatgagcataaaagcacatggcattatgatgaggataatccgtataaaacctgggcataccatggtagctacgaagtaaaaccaagtggttcggcctcaagcatggtaaatggtgtcgttaagctattaacaaagccatgggatgtaataccaatggttacacagatagcaatgacggatacaactccattcggtcagcaacgagtattcaaagaaaaagtggatactcgaacacctaaagccaagcggggtacggctcaaataatggaagtcactgcgagatggttatggggctttttgtctcgcaacaagaaacccaggatatgtacgcgcgaagagttcacaagaaaagttagatccaacgcggctatcggtgcagttttcgtcgatgaaaatcagtggaactcggctaaagaggcggtggaagatgagcgtttttgggatctcgttcaaaaagaaagagagctacacaagcaaggcaaatgcgcaacatgtgtatataatatgatggggaaacgtgagaagaagctaggagagttcggaaaagcaaagggatcacgtgccatctggtatatgtggctaggagccagattcttagagttcgaagcactgggttttatgaatgaagaccattggtttagccgtgagaactctttatccggagtagagggtgaaggtttacataaattaggttatattctccgtgacatttcaaaaatacccggaggaaacatgtatgctgacgataccgcgggttgggatacccgtataactgaagacgatttacaaaatgaagcaaagataacagatattatggaaccagagcatgccttattagccacatctatctttaaattaacatatcaaaataaagtagtcagagtgcagagaccggccaaaaatggcacagttatggatgtaatctctcggcgagatcagcgaggatctggacaagtaggcacttacggactgaacacatttaccaatatggaagctcaattgatacgacaaatggagagtgagggaattttcttgccttcggagttggaaacgccgaatttagcagagagagtgttagactggttggaaaaatatggtgtagaacgactcaaacgaatggctatttctggtgatgattgcgtcgttaaaccgatcgacgacaggttcgcgactgcactcaccgctctaaatgatatgggaaaagttagaaaagatataccccaatgggaaccatcaaaaggatggaacgattggcagcaagttcctttttgtagccaccatttccatcaacttatcatgaaggatggtagagaaatagtagttccttgtagaaaccaggatgagctggtaggtagagcacgagttagtcaaggcgcgggttggtccttaagagaaacagcatgccttggaaaatcatatgcacaaatgtggcaattgatgtattttcacagaagagatctgcgattagcagcaaacgctatatgtagtgccgtgccagttgattgggtaccaaccagccgtactacatggagtatacatgcgcaccatcaatggatgacgacagaagatatgttatctgtatggaatcgggtatggatagaagaaaacccatggatggaagataaaactcacgtttcatcctggggcgacgtcccatacctaggaaaacgagaagaccaatggtgtggctcgttaatcggattaacagcaagggctacctgggcatctaatatacaggttgctataaatcaagtgaggaggttgataggaaatgaaaattacttggattatatgacatcgatgaaaaggtttaaaaatgaaggagatccggaaggagcattatggtag

SEQ ID NO: 21723 - RNA, 9879 nt, synthetic construct
  misc_feature 1..9879: note = derived and/or modified CDS sequence (opt6) from DENV-1__FJ898386__SS-prME
  source 1..9879: mol_type = other RNA
agtgtcactatgcttctgatgctaatgcctactgcattagctttccatttaaccacccgaggtggggaacctcacatgatagtgacaaaacaagaaaggggtaaatccctactttttaaaacaagtgcgggcgtaaatatgtgcaccttaattgcaatggacttaggtgaactatgtgaagataccatgacctataaatgtcctcgaataactgaagctgaaccagatgatgtagattgttggtgcaatgccacagacacatgggttacgtatggtacctgctcacaaactggtgaacacagacgcgacaaacgatcagtggcattagcccctcacgtcggcttaggtttggaaacacgtacagagacatggatgagctcagaaggggcatggaaacaaatacaacgagtggaaacatgggctttacgacaccctgggtttacagtcatagcacttttcctagcacatgcaataggaacaagtataacccaaaaaggtataatcttcatcctattgatgctggtcacaccgagtatggcaatgagatgtgttggaatcggaagtagagattttgtagaaggccttagcggagcgacttgggtggatgtagtccttgaacacggatcttgcgttacaactatggctaaagacaaaccgactctcgacatagaacttctgaagacagaagtgaccaaccccgcagtgttaaggaagctatgtatcgaagcaaaaatatcaaatacaactacagactcgaggtgccccacccaaggcgaagctactctcatggaagaacaagacgcaaattttgtatgtaggagaacctttgtagatagaggatggggtaacggttgtggtctgtttgggaaaggttcattaataacatgcgcgaaatttaaatgtgtcacgaaattagagggcaaaatagttcaatatgaaaacttaaagtattcagttatcgtaacggttcatacaggcgaccagcatcaggtaggtaatgaaagcacagaacacggtacgactgccaccatcacgcctcaagcaccgaccagtgaaattcaattgaccgattatggagcactaacgttagactgctctcctaggacaggcttagattttaatgaaatggtcttattgaccatgaaggagaaaagttggttagttcataaacagtggtttttagatttgccactcccgtggacttcgggggctagcacgtcacaagaaacctggaatcgtcaagatctcttggtgacatttaaaacggcgcatgccaagaaacaagaagtagtagtactaggttcacaggagggtgcaatgcacacagcactaactggcgcaacagagattcaaacaagtggaacaacaactattttcgctggccacctaaaatgccgcctcaaaatggataagttaacattgaagggaatgtcatatgtcatgtgcaccggaagttttaaattagagaaggaggtcgccgaaacgcaacacgggactgtcttagtgcaaattaagtatgaaggcacggatgctccctgcaaaataccattttctactcaagacgaaaaaggcgtgactcaaaacggacgacttataacggcaaatccgatagtcaccgataaagaaaaacctgttaatatagaagcggaaccaccatttggagaaagttatattgtgattggagctggcgaaaaagctctaaaattgagttggttcaagaaaggatcatcaatcggtaaaatgttcgaagcaaccgccagaggcgctagacgaatggcgatccttggtgataccgcttgggatttcgggtctattggtggcgtttttacttccgtcggaaagttggttcaccaaatttttggtacagcctatggtgtgctttttagtggcgtatcctggaccatgaaaattggaataggcgtgctattgacctggctcggtctcaactccagaagcacaagtttgagtatgacatgcatagctgtgggcttggttacactatacctaggagtaatggtccaagctgactcagggtgcgttattaattggaaaggacgggagcttaagtgcggatccgggatctttgtaaccaatgaagtacacacttggactgaacagtataaattccaggctgattcccccaaacgattgtcggcagcgataggcaaagcatgggaggaaggagtatgcggcatacgaagtgcgacccgcctggaaaacataatgtggaaacaaatctcaaatgaattgaaccatattttattagaaaacgatatgaaatttacggtagtagttggggatgtagtaggtatccttgcccaggggaagaaaatgatcaggccacaacctatggaacacaagtattcatggaaatcgtggggcaaagccaagattataggagcagatgtacaaaatacgaccttcataattgacggcccaaatacaccagaatgcccagacgaccaaagagcgtggaatatctgggaagtagaggattacggctttggcatatttacaacaaacatttggctaaagctacgcgacagctatacccaagtatgcgaccatagactgatgtctgcagctataaaagacagcaaagcggtccatgcagacatggggtactggattgaaagcgagaaaaatgagacatggaagctggccagggcttcatttatcgaggtaaaaacatgtatatggccaaagagtcacacactctggtcaaatggagtattggaatctgagatgattataccaaaaatatacggtggtcctatatcacaacacaattataggccaggttactttactcagactgcgggcccttggcatttaggcaaactagaactagactttgatctatgcgaaggaaccacagttgtagtcgatgagcattgcggaaatcggggccctagtcttcgaactactactgttaccggaaaaataattcatgagtggtgctgtaggagttgtaccttaccgcctctacgattcaaaggagaagatggatgttggtatggaatggagattaggcccgtaaaagagaaggaagaaaacttagttaagtcaatggtgtcagcgggttcgggtgaagtagattcattttctttaggtctgctttgtatcagtataatgattgaggaggtaatgcgcagcagatggagccgaaaaatgttaatgacgggaactttagcagtttttcttcttctaataatggggcaattgacatggaacgacttaattaggttatgcattatggtaggagcaaatgctagcgatagaatgggaatgggcacaacttatctagcgcttatggccaccttcaaaatgagaccgatgttcgcagtaggtttacttttcagaagactcacttcaagggaagtgctattactgacgatcggattaagcctagttgcgtctgtagagctaccaaattccctagaggaacttggtgatgggttggcaatgggtataatgatcttaaaacttctcacagactttcaatcacatcaattatgggcaactttactgagtctgacgtttataaagactacattatccttacactacgcttggaaaactatggcaatggtcttatcaatcgtatcattatttccactatgcttgtcgacaacgtcgcaaaagacgacatggttaccagtattactggggagcctagggtgcaaaccgctcacgatgtttttgatagccgaaaataagatatggggtcgcaagagttggcctctaaatgaaggaattatggcggtcggcgttgtatctatactgctctcatccttgctcaagaacgacgtcccgcttgcaggaccattgatagccgggggaatgctcattgcgtgctacgtaatcagtggatctagtgcagatctttcactcgaaaaggcagctgaagtttcatgggaagaggaagcggaacactcaggagcatcacataatatcctagttgaagtccaagatgatggtaccatgaaaataaaagatgaggaacgtgatgataccctcacaattcttcttaaagctactttattagccgtaagcggtgtgtatccactatccataccagctacattatttgtatggtatttctggcagaagaagaaacagcggtccggtgtactttgggacacaccaagtccacccgaggttgaaagagccgtgcttgatgatggcatctacagaatcatgcagagagggctattgggacgctcgcaagtaggggttggagtatttcaagaaaacgtctttcacaccatgtggcatgtcactagaggagctgttttaatgtaccaaggaaaaagattggaaccatcgtgggctagtgtaaagaaagatttaattagctatggtgggggttggaggctacagggaagttggaacaccggtgaggaagtacaagttattgctgtagagccgggcaaaaatcctaagaatgtccaaacagcaccaggaacgttcaaaacacctgaaggcgaagtaggtgcaatagcactagattttaaaccagggacaagtggttctccaatagttaatcgtgaaggcaaaatagttgggctttatgggaatggagttgtcacaacatcaggaacctatgtgtcggcaattgcccaagcaaaagccagtcaagaaggacccttgcccgaaatagaagatgaagtattccgaaaacgaaacctaacgataatggacttgcacccgggatctgggaaaacaagacgttacttaccagcaatcgttcgagaagctatcaaaaggaagctccgaacgttgattctagctccaactcgtgttgtagccagcgaaatggctgaagcattaaaaggaatgcctatacgttaccagacaactgctgtaaagtctgagcatactggtaaagaaatagtagacttaatgtgtcacgccacatttacaatgagattacttagtccggtccgcgtacccaattacaatatgattataatggatgaggctcattttacagacccgagcagtatcgcagcaagaggctacatatcgacacgcgttggcatgggtgaagcagccgccatatttatgactgcaacacctccgggatctgtagaagcatttccacaatctaatgccgtgatacaagatgaagaaagagacatacccgaacgtagctggaacagtggatatgaatggattacggatttcccaggaaaaactgtttggtttgttccatctataaaaagcggaaatgacattgcgaattgtttaaggaagaatggaaaacgagtaatccaactaagtagaaaaacattcgataccgagtaccagaaaacgaaaaacaatgactgggactatgtcgtaacgacagacattagcgaaatgggcgcgaacttcagagctgatagagtaatagatccgcgaagatgtttaaagcccgtaatattgaaagatggtccggagagagttattttggctggcccaatgccagtaacagtagcgagtgcagcccaacgtaggggaagaattggaagaaatcataacaaggaaggagaccaatatatctacatgggacagccattgaacaatgatgaagatcatgcgcactggacagaagcaaagatgctacttgataacataaatacccctgaggggataatcccagcactattcgaacctgaaagagagaaaagtgcagctatagatggtgaatatagactacgaggtgaagcacgcaagactttcgtggaattaatgcgaagaggagacctcccagtctggttgagttataaggtggcatcagaaggttttcaatactcagatcgaagatggtgtttcgacggggaaaggaataatcaagtcttagaggaaaatatggatgttgagatatggacaaaagaaggagaaagaaagaaattgaggccaaggtggttagatgcccgtacctactcagaccctctagcccttagagagttcaaagagtttgcagcaggtagaagatcggtatcaggagatctaatacttgaaataggtaaattgccacaacatctgacccaacgcgcacaaaatgctctagataacttggtaatgttgcacaattctgaacagggtggacgagcgtatcgacatgcgatggaagaattaccagacactattgaaacattgatgttactagcgctcattgccgtcttgacaggtggagtcactttattctttctatcaggtcgaggacttggtaaaacctcgataggcttactctgtgtgatggcctcgtcagttttactatggatggctagtgtagaaccacactggattgctgcctcaatcattctagaatttttcctaatggtactattaataccagaacctgacagacaaagaacaccccaagacaatcaattagcttatgtagtaataggattgctattcatgattcttacagtggctgcaaatgaaatgggtttgttagaaacgaccaagaaagacttgggcatcggtcacgtagcagtggagaaccaccaccacgctacaatgttggatgtagaccttcaccccgcgtcagcttggactctttatgcagtcgcgacaacgataataacgcccatgatgagacacacaattgagaacacaacagccaatatttcgttaaccgcaatcgcgaatcaagcagctatactaatggggttagataaaggatggcccatctcaaaaatggatataggtgtacctcttctagctttagggtgctacagtcaagtaaatccactaactttaactgccgcagtgttaatgctcgttgcgcattacgctattattggtccagggcttcaggcaaaagccaccagggaggcgcagaaaagaaccgcagctggaataatgaaaaaccctacggtggatggaatagttgctatagacttagacccagtcgtatatgatgctaaattcgaaaaacaactaggtcaaatcatgttgttaattctttgcacctcacaaatactacttatgcgaacaacatgggcattatgtgaaagtatcacactggcaactggacccttgacaacattgtgggaaggaagtcctggtaaattctggaacaccacaattgcggtatccatggcgaatatcttcagaggaagctacctcgctggagccggcctggcattctcgcttatgaaatctcttggcggcggacgtagaggtactggagcgcaaggtgagacactcggagaaaaatggaaacgacagctaaatcaactatcgaaaagcgaatttaatatatataagagaagtggaataatggaagttgatagatctgaagcaaaggagggattgaaaaggggtgaaacaactcgacacgcggtttcaaggggtactgctaagctaagatggttcgtagaaagaaatctggtaaagccggaaggcaaggtaatagaccttggctgcggccgaggagggtggtcttactactgtgcaggactcaagaaagtgacagaagtcaaaggatataccaaaggaggaccaggtcatgaagaaccgattcccatggcaacatacggatggaatcttgtcaaattacattcaggtaaagatgtatttttcacaccccctgagaaatgcgacactttattgtgtgacatcggcgaatcatcacccaatcccacaatcgaagaaggtcgaacacttagagtcctaaaaatggttgaaccctggcttagaggcaatcaattctgtataaaaatcctaaatccttacatgcctagtgtagtggaaacactagagcagatgcagcgcaaacacggaggaatgcttgtaaggaacccgttgagtagaaattccacacatgaaatgtattgggttagttgcgggaccggtaatatagttagtgccgtcaatatgactagccgcatgttattaaacagatttacaatggcgcacaggaaacccacatatgaaagagacgtggacttaggtgctggaactagacacgtcgcagttgaaccagaggttgcgaaccttgatattataggtcaacgcatagaaaacataaaacatgaacacaaatctacatggcattacgacgaggataatccttataaaacatgggcatatcatggatcatatgaagttaaaccttctggttcagcatccagcatggtaaatggcgtagttaagttattaacaaaaccctgggatgttattccaatggttacgcaaatagcaatgacagacacgacgccttttgggcagcagcgagtattcaaagaaaaggtcgatacgcgtacccctaaagccaaaagaggaacagctcaaatcatggaagtaactgccagatggttgtggggatttttgagcaggaataaaaagccgcgaatatgcactagagaagaatttactagaaaggttagaagtaatgctgcgattggagcagtcttcgttgatgaaaatcaatggaacagtgctaaggaagctgtggaagacgaacgattttgggacctagtacagaaggagcgggaactacacaagcaaggcaaatgtgcaacctgtgtatataatatgatgggcaaaagggagaagaaattaggcgagttcggtaaagcaaagggaagccgagctatctggtacatgtggttgggtgcaagatttttagaatttgaagcacttggattcatgaacgaggaccattggttttctcgagaaaacagtttaagtggggtcgagggagaaggactacataagctcggatacatattacgagacatatcaaaaattccaggcggtaatatgtatgcagacgatactgctggatgggacacgcgtataacggaggatgatttacaaaacgaagcaaaaatcacagacattatggagccagaacatgctctgctagctacatcaatttttaaattgacgtatcaaaataaggtggtcagggttcaacgtcccgccaaaaatggaactgtaatggatgttatatctcgtcgagatcaacgtggaagtgggcaagtgggcacatacggcttaaataccttcactaatatggaggcacaacttatacgacaaatggaatcggaaggaatattcctaccttctgaactagaaacacctaatctagccgaacgcgtcttggactggctagaaaaatatggagtggaaagattaaaaagaatggcgatttcgggcgacgactgcgttgttaagccaatagatgatagatttgcgactgcactaaccgcattaaatgacatgggtaaagtacgaaaagacataccacaatgggaaccaagtaaaggatggaatgattggcaacaggtcccattttgtagccatcactttcatcaactgataatgaaagatggaagagaaattgtggttccttgtcgaaaccaagacgagctagtcggaagggctagagttagccaaggtgcaggatggagcttacgggaaacggcgtgtttagggaaaagttacgcgcaaatgtggcaattaatgtattttcatagaagggatctacgcttagcagcaaatgcaatatgtagcgctgtacccgttgactgggtgcctacatcgaggacaacgtggtccattcatgcccatcaccaatggatgactacagaggatatgttaagtgtttggaacagagtctggatagaagaaaatccttggatggaggataaaacgcatgtatcctcatgggaggatgtaccatacttaggaaagcgagaagaccaatggtgtggttcgttgattggactcacagctagggcaacttgggcatctaacattcaagtagcaattaaccaagtgcgccgactaataggaaacgagaattacctcgactatatgacctcaatgaaaagatttaagaatgaaggggacccagaaggagcgttttggtag

SEQ ID NO: 21724 - RNA, 9879 nt, synthetic construct
  misc_feature 1..9879: note = derived and/or modified CDS sequence (opt6) from DENV-1__FJ898387__SS-prME
  source 1..9879: mol_type = other RNA
tcggtaacaatgttattaatgcttatgccaacggctttggctttccatttgacgactagaggtggcgaacctcatatgatcgtcagcaaacaagaacgtggtaaatcccttctttttaaaaccagcgcaggcgttaatatgtgcacactcatcgcaatggacctgggtgaattttgtgaagatactatgacatataaatgtcctcgaattacagaagcagaacctgatgatgtggattgctggtgtaacgcgacagatacgtgggtcacatatggaacctgttctcaaacaggagaacatcgaagagacaaaagaagcgtagcgttagctccacacgtaggtttaggtcttgaaacacgtacggaaacgtggatgagcagtgaaggggcatggaaacaaatacaacgagtcgaaacatgggcattaagacacccaggtttcacagtaatagcactatttttggcgcacgcaataggtacctccataacccagaaaggaataatctttattctactgatgctagtcactccaagcatggctatgcgatgtgtggggatcggtagccgtgacttcgtggaaggtcttagcggggctacctgggtggatgtagtgttggaacacggatcatgtgttactactatggctaaagataaaccaaccttagatattgaattactaaaaactgaagtcaccaatccagccgtactacgtaaactttgtatagaagctaaaatttctaatacgacaaccgatagtagatgcccgacacaaggagaagctaccttggtcgaagaacaagacgctaacttcgtctgtaggagaacatttgttgatagaggttggggaaatggatgtggactctttggaaaaggttcactaattacatgcgctaagttcaagtgtgtgactaagctcgaaggcaaaacagtacaatatgaaaatttaaaatactcagtaatagtcactgttcacactggagatcaacaccaagtcggaaatgaatccacagaacatggaacaacagcaactataaccccacaagctccatcgacagaaatccagctcactgattatggtgctttaacactagattgttcccccagaacaggtcttgactttaatgagatggttttactaaccatgaaagaaaaatcttggcttgtacacaagcaatggtttcttgatttaccattaccatggacatctggagccagtacctctcaagaaacatggaatagaaaagatctattggtaacatttaaaacagctcacgccaagaaacaagaagtcgtggtactaggatcacaagaaggtgccatgcatacagcgctaacaggcgccaccgaaatacaaacaagtggtacgactacaatatttgccgggcacttaaaatgccgtttaaaaatggataaactaactctaaaaggcatgtcctacgtcatgtgcacaggttcgttcaaactagaaaaagaagttgcagaaacacaacatggaaccgtactggtccaaattaaatacgaaggaaccgatgcgccgtgtaagattccattcagtacacaagacgaaaagggcgttacgcagaatgggagacttataactgctaatccaatagtaacggacaaagaaaagccggttaacatagaggctgaaccacctttcggagaatcttacatagtaatcggggcgggtgaaaaagctctgaaattgtcatggttcaagaaaggatcttcaataggaaaaatgtttgaagcgacggcacggggagcccgtagaatggcaatccttggagatacagcctgggatttcggaagcattggcggagtatttacgtcagtcggtaaactcgtgcaccaaatatttgggactgcttacggtgtcttattctcgggcgtaagctggaccatgaaaataggaattggtgttcttctgacttggttaggactaaattcacgctccacatcattatctatgacatgcatagcagtaggtctcgttacgctttatttgggggtcatggttcaggcagatagtggatgtgtaataaattggaaagggagagaactaaaatgcggatcgggtattttcgtgacaaatgaggtgcatacatggactgagcagtataaatttcaagctgactcaccaaaacggttatcagcagcaattggtaaagcatgggaagaaggggtgtgcggcataagatcagctacaaggctagaaaacataatgtggaaacaaatctccaatgaacttaaccacattcttctagaaaatgatatgaagtttacagtagtagtgggcgatgttgcgggcatacttgctcaaggaaagaaaatgatacgacctcaacccatggagtataaatattcttggaaatcatggggaaaagctaaaataataggtgctgatgtccaaaatacaacgttcattatagacggaccgaacacaccagaatgccctgatgaccaaagagcatggaatatctgggaagtagaagattacggatttgggatctttaccactaacatttggctgaaattaagggattcatacactcaagtatgcgaccatagattaatgagcgcagctattaaggacagtaaggctgtacatgcagatatgggctattggatcgaaagtgagaaaaatgaaacctggaaattggcaagagccagctttatagaagttaaaacatgcatttggccaaaatcccatacgttatggagcaatggagtgctagaatccgaaatgataatccctaagatctacggcggtccaataagccaacataattacagaccaggatacttcacacaaacagcaggtccttggcatctgggaaagctagaattagattttgatttatgcgaggggacaacagtagtcgtagacgaacactgcgggaatcgaggcccgtctctcagaactacaaccgttaccggtaaaattatacatgaatggtgctgtcggtcatgcacgttacctccactacgattcaaaggagaggacggatgctggtatggaatggaaatccggccagtcaaggagaaggaggagaatcttgtcaaaagcatggttagtgcgggtagcggggaggtagactccttcagcttagggctattatgcataagcatcatgatagaggaagtcatgcgctctcgatggagcagaaagatgcttatgactggaacgttggcagtcttctttttacttatcatgggccaattaacatggaacgacttaatacgtctttgcatcatggtaggagcaaatgctagtgaccgtatgggaatgggtaccacgtacctagctctcatggcaaccttcaaaatgagacctatgttcgcagtgggactcctgttccgacgtctaacctcacgagaagtactcttgttaacaataggtcttagtttggtagcgagcgtagaattgcctaactcattggaagaattaggggatgggttagccatgggaatcatgatcttaaagctgctcactgacttccaatcacatcagctttgggcaacattgttgtctttaacgtttattaaaaccacgttttcgcttcattatgcctggaaaaccatggccatggtactcagcatagtatcattgtttcccttatgtttaagtacaacctcgcagaaaactacgtggctacccgttcttcttggatcgcttggctgtaaacctctaactatgtttctcatcgccgaaaataagatctgggggcgtaagtcctggccactaaacgaaggtataatggcagtcggaatagtaagtatattattgagtagtctcttaaagaacgatgttccattagctggacctttaatagctggaggaatgttaatagcatgttacgtaataagcggctcaagtgctgatctatccttagaaaaggctgccgaagtctcatgggaggaagaagctgaacatagtggcgcatcacataatatactggtggaagtacaagatgatggtacaatgaaaattaaagatgaagaacgcgatgatacgttaaccatattactgaaagcgactctactggcggtatcaggtgtatatccacttagtatcccagcaaccttgtttgtgtggtatttttggcagaagaagaaacagaggtcaggggtactatgggatacacctagtccacccgaagtagagagggctgtacttgacgatggcatatatagaataatgcaacgaggtttgctcggtcgttcccaggttggggttggagtatttcaggagaacgtctttcacacaatgtggcacgtgactcggggtgcggtcttgatgtatcaggggaaacgtctagagccatcgtgggcgagcgtaaagaaagacttaatttcgtacggaggaggttggcgattacagggatcgtggaatacaggtgaagaggtccaggttatcgcagtagaacccggtaaaaaccccaaaaacgtacaaacagcaccagggacctttaaaaccagcgagggtgaagtaggagccatagcactagatttcaaacctggcacaagtggaagtccaatagtcaatagggagggtaaaatagtgggattgtacggtaatggagttgtcacaacttccggcacctacgtatctgccatagctcaggctaaagcatcacaagagggacccttacccgagatagaagacgaagtatttaggaaaagaaacctgacgataatggatctgcatccaggatccgggaagacaagacgttatttacccgcaattgttcgagaagccataaaacgtaagctgagaacacttatccttgcaccaactcgggtagtagcgtcagagatggccgaagcgctaaagggaatgccaattaggtatcagacgacagcagtaaaatcagaacataccggaaaagaaatcgtagatctaatgtgccatgcaacattcactatgagattattgtcgccggtcagagtaccaaactataatatgatcataatggatgaggcacatttcacggaccctagttctattgccgccagaggatacatcagtaccagggtcggaatgggggaagcggcagctatcttcatgacggcaacgccgcctggaagcgtagaggcatttccccaatcaaatgcagtaatacaggatgaggaaagagatataccagaacgaagttggaacagtggatatgaatggataacggattttcccgggaagacagtatggttcgttccatcaataaagtctggcaatgacatagccaactgtctgagaaagaatggtaaaagggttattcagttaagtagaaaaacgttcgataccgaatatcagaaaactaaaaacaatgattgggattatgtagtaacgactgatattagtgaaatgggtgcgaactttcgtgcagatcgggttattgatcctcgcagatgcctaaaaccagtaattctaaaggacgggcccgaaagagtaatcctagctggacctatgcctgttacagtcgcaagtgctgcacaaaggagaggacgaataggaagaaaccataacaaagaaggagatcagtatatatatatgggacaacccttgaacaatgatgaggatcatgcgcattggactgaagctaagatgttattagacaatattaatactccggaaggaataatacctgcattatttgaacccgaaagagaaaaatcggcagccattgacggagaataccggttaagaggagaagctagaaaaacttttgtggaattaatgcgaagaggtgatttaccagtatggttaagttataaagtcgctagtgaagggttccagtactcggatcgacgttggtgtttcgatggcgaaaggaataatcaagttttagaagagaatatggatgtagagatatggacaaaagaaggcgaaaggaagaaactccgcccaaggtggcttgatgctaggacctattctgatccattagcgttgagggaatttaaagagttcgctgcaggccgtagatcagtaagtggagatctgatactcgaaataggtaaactaccacaacatctcacacaaagggctcaaaatgcacttgataacctagtaatgttacataactccgaacagggtggtagggcctatagacatgcaatggaggaactcccagacacgatcgagaccttaatgctattagctttgatagcggttttaacagggggtgtaacattattcttccttagtggtagagggttagggaagacatccatcggattattatgcgtaatggcaagtagcgtcttactttggatggcaagtgtagaaccccattggatcgctgcaagcataatattagagttctttctaatggtcctactgataccagaaccagataggcagcgtaccccacaagataaccaactagcctatgtcgtaataggcttactgttcatgattcttacagtagcagccaacgaaatgggtctattggaaacaaccaagaaagatctgggaatcggacacgtagcagttgaaaaccaccatcatgccgcaatgttagacgtcgatctacacccagcgtctgcttggacactttacgcggttgcgaccacaattatcacacctatgatgcgtcatacaattgaaaatacaacagcaaacatatcactaacggcgatagcgaaccaagccgcaattttaatgggtctggataaaggctggccaatatccaaaatggatattggtgttccgctcttagctctagggtgttattctcaagtaaatccactgacgctaacagcggcggttcttatgttagtcgcgcactacgctataataggtcccggcttgcaagcgaaggccacacgtgaagcacaaaagagaacagcggctggtattatgaaaaatccaacagttgacggcattgttgcaatagatttagatccagtggtatacgacacaaaatttgagaagcaattgggacagatcatgctcttaatattatgcacttcacaaatactacttatgcgtacaacctgggcactctgtgagagcataactctcgctacaggtcccctaactacgctctgggagggttcacccggaaagttttggaataccacaatagcggtatcaatggcgaacatcttcagaggatcatatctagcgggtgcaggtctggcattctcgttaatgaagtcgttaggtggaggcaggaggggtacaggtgcacaaggcgagacattaggagaaaagtggaaacgacaacttaatcagctatctaagtccgagttcaacacctataagagatctggaataatggaagtagacagaagtgaagcgaaagaaggactgaaaagaggtgagaccaccaaacatgcagtatccagaggtacagccaaactaagatggttcgtggaaagaaatttagtcaagccagagggaaaagtgatagacttaggatgcggaaggggtgggtggtcatactattgcgccggattgaagaaagtaactgaagtaaagggatacacaaagggaggaccagggcatgaagaaccaatcccaatggcaacatacggttggaacttagtaaaacttcactcaggtaaagatgtctttttcattccgccagaaaaatgtgatacactgctatgtgacataggagaaagctcaccaaatccaactattgaagaggggcgcacacttagagtgttaaaaatggtagaaccgtggctcagaggcaaccaattctgtattaagattctcaatccatatatgccctcagtagtagaaacattagaacaaatgcaaaggaagcatggaggtatgcttgtcagaaaccccctttcccggaacagcacacacgagatgtattgggtatcatgcggcactggtaatatcgtcagcgctgtcaacatgacaagtagaatgcttttaaatagatttactatggcacatcgaaagccaacttatgagcgtgacgtcgatttaggagcgggtacgcgtcacgtagctgtagagcctgaagtggccaatctagacatcataggtcagaggatagaaaatataaaacacgaacacaaaagtacatggcactatgacgaggacaatccctataagacttgggcataccatggtagttatgaagtaaaacctagtgggagcgcatcctccatggtaaatggtgtagttaaacttctcacaaaaccatgggatgttatcccaatggtgacacagatagcaatgactgatacaacaccattcggtcagcaacgagtgttcaaagaaaaagtagacacaagaacaccgaaggcgaaacgtggaacggcacaaatcatggaagtaacagccaaatggttatggggatttttatcaaggaacaagaaacctcgtatatgtactcgagaggagtttacacgtaaagtaagaagcaatgcagctatcggggcagtattcgtcgatgagaaccaatggaactctgcaaaagaagctgtcgaagacgagagattctgggatttagttcatagagaaagggaactacacaagcaaggaaagtgtgccacgtgtgtctataacatgatgggtaaaagagagaagaaactgggggaatttggcaaagctaaaggatcacgtgctatatggtacatgtggctaggtgcaagattcttagagttcgaagcgctaggtttcatgaatgaagaccattggttctctagggaaaattctctaagcggcgttgagggtgaaggactacacaaacttggatacatattaagagacatctcgaaaatccctggcggcaacatgtacgccgatgatacagcgggctgggatacacgaataacagaagatgatttacaaaatgaggcaaaaatcactgatataatggaaccagagcacgccttgttagcaaaatcgatttttaagctaacatatcaaaacaaggttgtgcgtgtccagcgaccagccaaaaatggcacagtaatggatgtaataagtagaagagaccaaaggggatcaggtcaagtaggaacgtatggcttaaacacgtttacgaatatggaggcgcaacttataaggcaaatggagtctgagggcatatttagcccaagtgagcttgaaacaccgaatttagcaggacgtgtactcgactggcttgaaaaacacggtgtagaaagacttaaacgtatggctatctcgggcgatgattgtgtcgtaaaaccaatagacgataggtttgctactgctctaacagcattaaatgatatgggaaaagtaagaaaagatattcctcaatgggaaccttcaaaaggatggaatgactggcaacaagtacccttttgttctcatcatttccaccaactaataatgaaggatggaagagaaatagttgttccatgccgaaatcaggatgaattggtcggtcgcgcgagagtaagtcaaggcgctggatggtcactgagagaaacggcatgtttgggtaaaagttatgcccaaatgtggcaattaatgtattttcataggcgcgatttaaggctcgctgcaaatgccatatgcagcgccgtcccggtagactgggttccaacatcacgaacaacctggagtatccatgcccaccatcagtggatgacaactgaggatatgcttagtgtttggaacagggtttggatagaagaaaatccatggatggaagacaagacacacatatcaagttggggagatgtgccatacttaggcaagcgtgaagatcagtggtgcggatcgctaataggattgacagcacgggcaacatgggcaacgaatattcaagtagctataaatcaagtaaggaggcttataggtaacgagaattatttagactatatgacgtctatgaaaaggtttaaaaacgagtcggatccggaaggtgctctatggtag

SEQ ID NO: 21725 - RNA, 9879 nt, synthetic construct
  misc_feature 1..9879: note = derived and/or modified CDS sequence (opt6) from DENV-1__FJ898389__SS-prME
  source 1..9879: mol_type = other RNA
tcagtgacgatgttactgatgttaatgcctacggctcttgcttttcatttaacaacgagaggaggcgaacctcacatgatagtgaccaaacaagaaagagggaaatccttactctttaaaacgagcgctggggtcaatatgtgtaccttaattgccatggatttaggagaactatgcgaagacaccatgacgtacaaatgtcctagaataactgaagcagaaccagatgatgttgattgttggtgtaatgcaactgatacatgggttacatacgggacatgtagccaaacaggtgagcacagaagggataaaaggtcggttgcgctcgcaccgcacgttggacttggattagaaactcgaacagaaacttggatgagctcagaaggcgcatggaaacaaatacaacgtgtggaaacttgggcgttaagacatccaggttttactgtaatagctttatttctagcacatgctattggaacatcaattactcaaaaaggcataatttttatattgttgatgctcgtcacaccctccatggcgatgcgatgtgtcggtataggatcccgagacttcgttgaaggactatctggggctacatgggttgacgtagttttagaacatggatcttgcgtaactacaatggctaaagacaaaccaacactggacatagaactattgaaaactgaagttacaaaccccgcagtattaagaaaactctgcattgaagccaaaatttcaaatactaccacagactctcgttgcccaacccaaggggaagctactttaatggaggaacaagatgctaactttgtctgtaggcgaacgtttgtagatagggggtgggggaatggctgtggattattcgggaagggctctttaattacgtgcgcaaagttcaagtgtgttacaaaactggaagggaagatcgtccaatatgagaatcttaagtatagcgttattgtgacagtacatacgggcgatcaacaccaagtaggcaacgaatcaaccgagcacgggaccactgcaactataacacctcaagcaccaacttcggaaatacaattaaccgattatggtgccttaactttagactgtagtccgaggactggattagacttcaacgaaatggtacttttaacgatgaaagaaaaatcttggttggtacataaacaatggtttttagatttaccgctcccgtggacgtccggagctagcacttctcaagaaacttggaatcgtcaagacctacttgtaactttcaaaacagcccacgcaaagaaacaagaggttgtagtattgggaagtcaagagggtgcaatgcacacagctttaacgggagccacagaaattcagacatccggaacgactacaattttcgcaggtcaccttaaatgtcgacttaagatggacaaattgacacttaaagggatgtcctatgtgatgtgcacgggtagtttcaaattagaaaaagaggttgcagaaacacaacacgggacagttttagtacagattaaatacgaaggaaccgatgctccctgtaagattccattctctacccaggatgagaaaggtgttactcaaaacggaaggctcataacagctaatcctatagtcacagacaaagagaagccagttaatatagaagctgagccgccctttggagagagttacatcgtgattggagccggcgaaaaagcattaaaactgtcctggttcaagaaaggatcttcaatcggtaaaatgttcgaggcgacagcacgaggagcacggagaatggctatcctaggtgatacagcatgggattttggctccattggcggagtcttcacttcagtgggaaaactggtacaccaaattttcggaacagcatatggagtgttattttcgggggtttcgtggaccatgaaaataggcataggagtactcttaacctggttaggactaaattctagaagtacaagcctcagcatgacttgtatagcagttggcttagtaaccttatatctaggtgtaatggtacaggccgattcgggctgcgtgatcaattggaaaggacgagagttgaagtgtggatccggtatatttgtcacgaatgaagtccatacatggaccgaacaatataagtttcaggctgattccccaaaacgactttcggctgcaataggaaaggcatgggaagaaggagtatgcgggataagaagtgccacaaggttggaaaatatcatgtggaaacaaataagtaatgaattaaaccacattttattggaaaatgatatgaaattcacggtagtcgtgggggatgtcgtaggaatccttgctcagggcaagaaaatgatacgacctcaaccaatggagcacaagtactcgtggaaatcgtggggtaaggcaaaaatcataggggcagacgtacaaaatacgaccttcataatcgatggtcctaacaccccagagtgtccggacgatcagagagcatggaacatatgggaggtcgaagattacggatttggtatttttacaacgaatatatggcttaaacttagagattcatatactcaagtgtgcgaccataggttaatgagcgcagcaataaaggattctaaagccgttcacgcggacatgggatactggatagaatctgagaagaatgaaacatggaagttggccagagcatcttttatagaggtcaagacatgcatatggccgaaatcacatacattatggtctaacggagtattagaatctgagatgataattccgaaaatatacggaggacctatatcacaacataactacaggcccgggtactttacccaaacagccggtccttggcatttggggaaattagaattagatttcgatttatgcgagggaaccactgtagttgtagacgagcactgtggcaaccgaggaccaagtttacgaacaacgacagtaaccggaaagataattcatgaatggtgctgccgcagttgtaccctgcctcccctcaggttcaaaggagaagacggctgctggtatggcatggagattagaccagtgaaagaaaaagaagaaaatctagtcaaatcgatggtatcagctggaagtggggaagtagatagtttcagtttgggcttgctttgtatcagtataatgatagaagaggtcatgagatcgagatggagccgcaaaatgttaatgactggcaccttggcggtcttcttatttctgattatgggacaattaacttggaacgatctaatccggctctgcataatggtaggcgctaatgcatccgacagaatggggatgggtacaacttatctggccctaatggcaacatttaagatgcgaccaatgttcgcggtaggactattatttcgtcgattgacatcacgtgaagttttattactaacaatcggattatctcttgtagcatcagttgaattacccaatagcctagaagagttgggggatggtttagcaatgggtatcatgatattaaaattactaacagactttcagagccaccaattatgggccacactattaagtttaacatttatcaaaacaaccttatcattgcattatgcgtggaaaacaatggcaatggtcctctccatagttagcctatttcctttatgtctatcaacgacttcacagaaaacaacttggttacctgtattattaggaagttttggatgcaaaccacttgcaatgtttctaatcgcggaaaacaaaatttggggacgcaaatcatggccgttaaatgaaggtattatggctgtgggagttgttagtattctcttaagctctttactaaagaatgacgtgcccttagccggaccactcattgctggaggcatgcttatagcttgctacgtaatcagtggatctagtgcagatctgtctttagagaaagcagcagaagtatcatgggaagaagaggcggaacatagtggcgcctcccataatatattagtggaagtacaagacgatggaactatgaaaataaaggatgaagagagagatgatactttaaccatattacttaaggcaacattattagcagtttcgggagtataccctctttccattccagctacattattcgtatggtatttttggcagaaaaagaaacaaagaagcggagttctttgggacactccatctccgccagaagtggagcgggcggtccttgatgacggaatctatagaataatgcaaagaggtctgttgggcagatcacaagtaggtgttggtgtattccaagaaaatgtattccatacgatgtggcacgttacaaggggcgccgtacttatgtaccagggaaaaagattggagcccagctgggcttccgttaagaaagatttaatctcctacggaggtggttggaggctacagggatcatggaacacaggggaagaagttcaggtcatagcagttgagccaggaaagaaccccaaaaatgtacaaacagctccgggcacgtttaaaacgcctgagggcgaagtaggggcaatagcattggattttaaaccagggacaagcggcagtccaatagttaacagggaaggcaagatcgttggactttacggtaacggcgttgtaaccacatccggcacatacgtatcagcaatagctcaggctaaagcgagccaagaaggaccgctaccagagattgaagacgaagtattcagaaaaagaaatctaactataatggatcttcatcctggatcgggtaaaacacgcagatatctccctgcaatagtacgcgaagccataaagcgaaaactaagaacactaattttggcgcctacaagagtagtcgcctccgaaatggcggaagctctcaaaggaatgcctatacggtaccagacgactgctgttaaatcggaacacaccggtaaagaaatcgtcgacctgatgtgccatgctacgttcacaatgagattactttcgccagttcgggtgccaaattacaatatgataataatggatgaggcacattttactgatccttttagtattgcggcacgtggctacataagcacccgcgtaggaatgggagaggctgcggcgatatttatgactgcgacacctcctggttccgtcgaagcgttccctcagtccaatgcggttatacaggacgaagagagggacatcccagaaagatcatggaatagtggatacgagtggataacggacttccccggtaagaccgtttggtttgtaccttcaatcaaaagtggcaatgatatcgcgaactgcctaaggaaaaatggaaagcgggtcattcaactaagtaggaaaactttcgacacagaataccagaaaaccaagaacaacgattgggattatgtcgtaacaacggacataagtgagatgggtgccaactttagagcagacagggtcatagatccacgtcgatgcctgaaaccagtaattctcaaagacggacctgaaagagtaatcctagcgggacccatgccagtcactgttgctagtgcagcgcaaaggagaggacgtataggtagaaaccacaataaagaaggtgaccaatacatatatatgggccagccactaaataatgatgaggatcatgcccactggacagaagccaaaatgcttctggataatataaacacacctgaaggaattatcccggcacttttcgagcccgaacgagaaaaatcggcagccatagatggcgaatatcgtttgaggggagaagcaagaaaaaccttcgtagaacttatgcgacgtggcgatctaccagtttggttatcctacaaggttgcatctgaaggattccaatattcagatagacggtggtgctttgacggagaacggaacaaccaagtactagaagaaaacatggacgtggaaatttggactaaagaaggagaaagaaagaaattaaggcccaggtggttagacgctcgaacttacagcgacccactagccttgagagagttcaaggagttcgccgcaggtcgccgtagtgtcagcggagacttaatattggagattggaaaactgccacaacacctgacacaacgagcgcagaacgccttagataacctcgtaatgcttcataatagcgaacaaggaggcagagcctatagacatgctatggaagaactccctgacacaatcgaaaccttgatgttgctagcactaatagcagtactcactggaggagtgacattgttcttcttgagtggcaggggtttaggaaagacaagtattggactactatgtgtaatggccagtagcgtattgttatggatggcctcagtagaaccacactggattgctgccagcattatcttagagttcttcctaatggtactattaatacctgaacccgatcggcaacggacccctcaagacaatcaactcgcatatgtagttattgggctgctgttcatgattctaacagtggcagcgaacgaaatggggttacttgaaacaaccaagaaagatctagggatcggccatgtagcggtagagaatcatcaccacgcaacaatgttggatgtcgatctgcaccctgcctcagcatggaccctatatgcagtcgctacaacaataattacgccaatgatgcgacatactatagaaaacaccactgctaatatcagcctaacggccatcgcaaatcaagcagctatattaatggggttggataaaggatggccaatatccaagatggatattggcgtacctttactagcattaggttgctacagtcaggttaatccattgacactaacagctgcggttttaatgttagtagcacattacgctatcattggcccaggtctacaagccaaagctacaagggaagcacaaaaacgaacagcagcaggaataatgaaaaaccctactgtggatggtattgtggcaattgacctggatccagtagtatacgatgctaaatttgaaaaacagctaggacaaataatgctgttaattctgtgtacgtcacagattcttttgatgagaacaacttgggctctctgtgaaagcataaccctggccacaggccctctaactacattatgggaaggaagtcctggaaaattttggaatacaacaatagcggtatccatggccaatattttcaggggatcatatctagcaggcgccggccttgcgttttcattaatgaaatcactcgggggaggtagacgaggaacgggagcacaaggagaaacactcggagaaaaatggaagagacaactaaaccaattatcgaagtccgagttcaatatctataagcggagcggtataatggaagttgaccgttcggaagctaaagaaggcttaaaaagaggagagactacgagacacgccgttagtcgcggaacagctaaactacgctggtttgtagaacgtaatctagtcaaaccggaaggaaaagttattgatttgggttgcggaagaggaggttggagctactactgtgctggtttgaagaaagtgactgaagtaaagggatataccaagggtggacctggtcatgaagaaccaataccgatggcgacttacggatggaatctcgttaaattacatagcggtaaagacgtattctttacgccacctgaaaaatgtgacactttactttgcgatataggtgagagtagtcctaatccaacaattgaagagggcagaacccttagagtcctgaaaatggtagaaccgtggctacgagggaatcagttctgtatcaaaatactgaacccttatatgccatcagtggtagaaacactggaacagatgcagagaaaacacggcggaatgctcgttagaaatcccctatctaggaactcaacacatgagatgtactgggtctcctgcggtacaggaaatatagtatctgcagtaaatatgacttcccgtatgttgttaaatagatttacgatggcacacagaaaacctacctatgaaagagatgtggatttaggggcaggaactcgacatgtcgcagttgaaccagaagtagcaaatttagatataataggacaacgaatcgaaaatataaagcacgaacataagagtacatggcattatgatgaagacaacccatacaaaacttgggcctatcatggtagttacgaagtaaaacccagtggaagtgcctcctcaatggtaaacggtgtagtaaaattgctaacaaaaccttgggatgtaatacccatggttactcagatagccatgactgacaccacaccattcggccaacagagagttttcaaagaaaaggttgatacacgaacgcctaaagcgaaacgaggaacagcacaaataatggaagttaccgcccgatggctatggggattcttgtctagaaacaagaaacctcgtatttgtacgagggaagagtttacgcgaaaagttcgctcaaacgcagcaataggtgcagtgtttgtagacgaaaaccaatggaactcagccaaggaagctgttgaagatgaaaggttttgggatctcgtccaaaaagaaagagagttacataaacaaggcaaatgcgctacttgcgtatataatatgatgggcaagcgtgagaagaaattaggagagtttgggaaagctaaaggatcgagagcaatatggtatatgtggctgggtgccagattcctcgagtttgaagccctaggcttcatgaacgaggatcactggttttctagggaaaatagtttatccggagtagaaggggagggactgcacaaactgggatatattctacgagatatttctaagatccccgggggcaatatgtatgcagatgatacggccggatgggatacaagaattacagaagatgacctacaaaacgaagcaaagattacggacatcatggaacctgaacatgctttgcttgccaccagtatatttaaactaacttaccaaaataaggtggtaagagtacagagaccagccaaaaatggcacagtcatggacgtaatatctagacgcgaccaaaggggatctggtcaagttggcacttatggcctaaatacatttacaaatatggaagcacaactaataaggcaaatggaatcggaaggaatatttttaccctctgaactggaaacccccaatctcgcggagagagtactagattggcttgaaaaatatggtgtggaaagattaaagcgaatggcgatttcgggagatgattgtgtagtaaagccaatagatgatagatttgctacagcccttacagcgctaaacgacatgggtaaagtaagaaaagatataccacaatgggagccaagtaaaggatggaatgactggcaacaagtaccgttttgcagccatcattttcaccaactcatcatgaaagatggacgagagattgtcgttccatgtcgtaatcaagatgagttagtaggacgagcaagagtatcacaaggagctggttggtcccttcgagaaacagcgtgtcttggaaaatcttatgctcaaatgtggcaactaatgtacttccacagaagagatttgagactagcagcgaatgctatatgttcggcagtaccagtagattgggttccaacatctcgcacgacgtggtcgattcatgcacatcaccaatggatgacaaccgaagacatgcttagtgtatggaacagagtctggattgaagaaaacccctggatggaggacaagactcatgtaagctcctggggagatgttccttacttgggaaagagagaagaccaatggtgtgggtccttaatcgggctgaccgcgcgagctacatgggcctcaaatattcaagttgctatcaatcaagtgcgacggctaataggaaatgaaaactatctcgattatatgacctctatgaagcggttcaaaaacgaaggcgatcctgaaggggccctatggtaa

SEQ ID NO: 21726 - RNA, 9879 nt, synthetic construct
  misc_feature 1..9879: note = derived and/or modified CDS sequence (opt6) from DENV-1__FJ898390__SS-prME
  source 1..9879: mol_type = other RNA
agtgtaacgatgctgttaatgcttatgccgactgcattggcatttcatttaactacaagaggaggggaaccacacatgatagtgacgaaacaagaacgtgggaaaagtttgttatttaaaaccagtgcaggggtaaatatgtgtacgctaattgcaatggacctaggcgaactgtgcgaagacactatgacctataaatgtccacgcattacggaagcagaaccagacgatgtggattgttggtgcaacgcaacagacacgtgggtcacctacggaacctgcagccagaccggggaacatagacgagacaaacgatcagtcgcgctagcacctcacgtaggactcggcctagagacaagaaccgaaacctggatgagtagcgaaggtgcatggaaacaaattcaacgtgtagaaacatgggcattgcgccacccaggctttactgttattgcacttttcctggcgcatgctataggaacttcaataacccaaaaaggtatcatttttattctcttaatgctcgtgacgccaagtatggcaatgagatgtgtgggaatcggatcgcgagacttcgtggaaggtctgtcaggtgcaacatgggtggacgtggtattagaacacggtagttgcgtgacaaccatggcaaaagacaaaccaactttagatattgaacttcttaaaactgaagttacaaatcccgccgtacttcgaaaattatgtatcgaggctaaaatttcaaatacgacaacagacagcagatgccctacccaaggagaagcgaccttgatggaggaacaagatgcaaattttgtttgtcgaagaactttcgttgaccgaggttggggaaatggatgtggactattcggtaaaggctctctaattacatgcgctaaattcaaatgcgttacaaaacttgaaggaaaaattgtccaatatgagaacctcaaatatagcgtaatagtaacagtacacactggagaccaacaccaagtgggtaatgaatcgacagaacacggtactacagccacaattacccctcaagctccgacaagcgagatacaattgacggattatggtgcattgacattagactgttcaccgcgtactggcttggattttaatgaaatggttctactaacgatgaaagagaaaagttggctagtccacaaacaatggtttctcgacctaccactcccatggacgtcgggcgcttctacgtcgcaggaaacatggaatcgtcaagatcttctggtcacttttaaaacagctcatgccaagaaacaagaagttgttgtcctgggcagtcaagaaggtgcaatgcatacggcattaaccggtgcaaccgaaatacaaacaagtgggacaactacaatttttgctgggcatttaaaatgcagattgaaaatggacaaactgacgttaaaaggcatgagctacgtcatgtgcacaggtagcttcaaattagagaaagaagttgctgaaactcaacacgggacagtgttagtccaaattaaatatgagggaacggacgcaccatgcaaaattccgttttccacacaagatgaaaaaggggtaacgcaaaacgggcgtctcattacagcaaacccaatagtcacggataaagaaaaacccgtaaatattgaagcagaaccgccttttggggagtcttatatagtaatcggagtgggggagaaagccctgaaactctcatggtttaagaaaggctcatccatcggtaaaatgttcgaagccacagcccgaggggctcgacgtatggctatactaggagatactgcttgggatttcggaagcataggaggggtttttacgtccgtagggaaactggtccatcaaatatttggcaccgcatatggggtgctatttagtggagtctcttggactatgaaaataggtataggggtactacttacatggctaggactaaactcacgttcaaccagtttaagcatgacgtgcattgccgtaggattagtcacgttatatttaggcgtgatggtccaagctgatagtggatgtgttataaattggaaaggacgcgagttaaaatgcgggtctggaattttcgtgactaatgaagtccacacatggacagagcaatacaaatttcaagcagactccccaaaaagactttccgccgctataggtaaggcttgggaagagggagtatgtggcataagatcagcaacacgcttagaaaatataatgtggaaacaaattagtaatgaacttaatcacattttactggagaacgatatgaaattcactgtagtcgtaggtgatgtagttggcatattagcccaaggcaagaaaatgatccgcccccaacctatggaacataaatacagttggaaaagctggggtaaagcaaaaataattggtgcagacgtccaaaatacaacatttattattgacggcccaaacacacccgagtgtcctgatgaccaaagggcctggaatatatgggaggtggaagactacggtttcggtattttcacgactaatatttggctaaaattgagagattcatatacgcaagtgtgtgatcatcgactgatgagtgcagctataaaagactccaaggcggttcatgcagatatgggatactggatagagagtgagaaaaatgaaacttggaagttagcgagggccagctttatagaagtaaaaacctgtatttggccaaagtctcacactctttggtcaaatggagttttagaatctgaaatgataattcctaaaatctatggtgggccaatatcacaacacaattataggccaggatattttacacaaacagccggaccgtggcatctgggcaaattagaactggattttgacctatgcgaaggcactactgtggtcgtagatgagcattgtggtaacagaggaccaagtttacgtacaaccacagttacaggtaaaatcatacatgagtggtgctgccgttcctgcacactccctccactgcgcttcaaaggagaagacggttgttggtacggcatggaaataaggccagtgaaggaaaaagaggaaaacctagtaaaatcaatggtatcggctgggtcaggagaagtggatagtttttcgttaggattactttgtataagtatcatgatcgaagaagtaatgaggagtcgttggtcaaggaaaatgcttatgacaggcacgctcgcagtatttcttcttttgataatgggccaattaacatggaacgacctgattcgattgtgtatcatggttggtgcaaatgcatccgaccgaatgggcatgggaacaacatacttagcgctaatggcaacgttcaaaatgagaccaatgttcgcggtaggactacttttcagaagacttacgtcacgcgaagttctcttacttactataggcctcagcctcgtagcgagcgtagagctcccaaactcacttgaggaattaggagatggacttgcaatgggtataatgatcttaaaactcttgacagacttccaatctcaccaactatgggctactttacttagtcttacttttatcaagactacccttagcctgcactatgcatggaaaacgatggcaatggtacttagcatagtcagccttttccctttatgcctatctacaactagccagaaaacaacatggctccctgtacttttaggaagtttaggctgcaaaccactgaccatgtttttaatagcagagaacaaaatatggggaaggaaatcatggcctttaaacgaaggtatcatggcagttggggttgtttccattctgctgagttcgctactcaaaaacgatgtaccgttagccggacccttaatagcaggcggcatgttaattgcatgctatgtgattagcggaagtagtgcagatctaagcctcgaaaaagcggccgaagtgagttgggaagaggaagcagaacattccggagcatctcataatatacttgtagaagttcaagatgacggcacaatgaagataaaagatgaggaaagggacgatacactgacaattttacttaaagcaactttactggccgttagcggggtttatccattatctattccagccaccctttttgtttggtatttttggcagaagaagaaacaaagatctggcgtattgtgggatactccttcgccaccagaggttgaaagagccgtgcttgatgatgggatatatcgaataatgcaaagaggacttctcggacgatctcaagtaggagtaggcgtatttcaggagaacgtctttcatacaatgtggcacgtaacgagaggagccgttcttatgtaccagggaaaacgattagaaccgtcatgggcgtccgtcaagaaagatctaatttcatacgggggtgggtggcgtctacaaggctcatggaatacaggtgaggaggttcaagtcatagcagttgaaccgggcaaaaaccccaaaaatgtacagacagccccaggtacatttaaaactccagaaggcgaagttggcgcgatagcgttagatttcaaacctgggacttcaggctcgcctatagtcaatcgcgaaggaaaaattgtaggcctttacggaaatggggtggtaactacatcaggcacctatgtaagtgctatcgcgcaagcgaaagccagtcaagaagggccattgccggaaattgaagatgaagtattcagaaaacgaaatctcacaatcatggacttacatcccggaagtggtaaaactcgtagatatcttcctgcaattgtgcgagaagcaattaaaaggaaacttcgaactttaatattggcaccgacaagagttgttgcaagcgagatggcagaagctctaaaaggaatgcccataagatatcaaactacagcggtaaaaagcgaacataccggaaaagaaatagttgatctcatgtgccatgcaacgttcactatgcgacttctgtccccagtccgagttcccaactacaatatgataataatggacgaagcccactttactgatcccagtagcattgccgcaagggggtatatcagcacaagagttggaatgggagaagcagctgcaatattcatgactgcaaccccacccggctcggttgaagcatttccgcaaagtaatgccgtcattcaagacgaagaaagagatattccagagcgatcttggaactctggttatgaatggatcacagactttcctggtaaaactgtttggttcgttccatcaataaaaagcggaaatgatattgcaaattgtcttcggaagaatggtaaacgagtaatccaattatctaggaagacattcgatacagagtatcaaaagactaaaaacaatgactgggactacgtggtaactactgacataagcgaaatgggagcgaattttagggctgacagggttatagacccgagacgttgtttaaaaccggtaattctgaaggacgggcctgaaagagttattttagccggaccaatgccagtaactgtggcgtcagcagcccagagaaggggtagaataggacgcaatcataacaaagagggagaccaatacatttatatgggtcagcctttaaacaatgacgaagatcacgcacactggaccgaagcaaaaatgttactagataacataaatacacctgaaggtataatacctgcactttttgagccggaaagagaaaaatccgcagctattgacggtgagtatcggttaagaggagaggcaagaaagacgtttgtagaattaatgagacgaggcgatcttccagtttggctttcatataaggtggcctccgaaggatttcaatattcagacagacggtggtgcttcgatggagaacgcaataaccaagtgttagaagaaaatatggacgttgagatttggaccaaagaaggggagaggaagaaactaagaccacgatggttggatgcgaggacgtactccgatccattagccttacgagaatttaaggaatttgcagctggtcgcagaagtgtaagtggagatttgattctcgaaataggaaaactacctcaacatcttactcaacgagcccagaatgcgctggataatctcgttatgctacataacagtgaacaaggaggacgcgcataccgacacgcaatggaggaattaccagatactatcgagacactaatgttacttgctctaatcgcggtccttaccggtggcgttacactcttctttctatcgggccgggggctgggtaagacatcgataggattactttgcgtgatggcatcgtcagtgttactatggatggcaagcgtagagccacattggatcgccgcctccataatattagagttctttctaatggtgctactaatccctgaacctgacagacaaagaactccacaggataatcagctagcatatgttgtaatcggtttactatttatgattttaacagtagcggcgaatgagatgggtttactagaaactacaaagaaagacttgggcatcgggcatgtagctgttgagaatcatcatcacgcaactatgctggacgtagatttacatcctgcgagcgcttggactctgtatgccgttgcaactacaattattacaccaatgatgcgccataccattgaaaataccacagccaatatcagtttgacagccattgcgaaccaagccgcaatattaatgggccttgacaaaggatggcccatttcaaagatggatataggcgtaccattactcgctctaggttgctacagccaagttaatccactcactcttactgctgccgtattaatgttagttgcccattatgcgataataggacctggcctacaagctaaagctacaagagaagcgcagaaaaggactgcagcaggtatcatgaagaatcctactgtagacggtatagttgctatcgacctggatccagtagtttacgatgcaaaattcgaaaaacaacttggtcaaataatgctcctaatcctatgcaccagtcaaatattactaatgcgaacaacttgggctctatgcgaatccataactctggcaactggtccactcacaactttatgggaaggttcgccaggcaaattctggaatactacaatagcagtttcaatggctaatatattcagaggatcttatctcgccggtgcgggactcgctttttcccttatgaaaagccttggcggagggaggagaggtacaggagctcagggagagacgttgggagaaaaatggaaacgtcaattaaatcagttgtccaaatcagaatttaatatatacaagagatctggtattatggaggtcgatcgatcagaagcaaaggaaggtttaaaaagaggggaaacgacgcgacacgcagtatctcgagggacagccaagttaagatggtttgtagaaagaaacctagttaagcccgagggtaaagtcatcgacttaggatgcggtcgtggtggttggtcatattattgtgcagggctaaagaaagtcacagaagtcaaagggtatacgaaagggggcccgggtcacgaagaaccaattcccatggctacatatgggtggaatcttgtcaaattgcactcgggcaaagacgtgttcttcaccccaccagaaaaatgcgatactctgttatgtgatattggagaatcttcaccaaaccccacaattgaggaaggacgtacattacgcgttttgaagatggtggaaccttggctccgaggaaaccaattttgtatcaaaatactcaatccgtatatgcccagtgtggttgagaccctagaacaaatgcaaaggaagcacggtggcatgttggtccgaaatcctttgagcaggaatagcacccacgaaatgtattgggtttcgtgtggaacaggtaatattgtgagcgcagtaaacatgacatcaagaatgctcttaaatcgatttacaatggcgcatcgaaaacctacttacgaaagagacgttgatctaggggcgggtacaaggcatgtagctgtagagcccgaagtcgctaatttagatataatcggtcaacgaatagagaatattaaacatgaacataaatccacgtggcactacgatgaggataatccctacaaaacttgggcatatcatgggtcctacgaggtgaaaccatcgggatctgcatccagcatggtaaatggagtcgtaaaattactaacgaaaccatgggatgtaataccgatggtcactcaaatagccatgactgacacaacaccattcggccaacaacgtgtatttaaggaaaaggtggacaccagaacaccgaaggcaaaacgagggacagcacaaataatggaagtaaccgctcggtggttatggggttttctaagtcgcaacaagaaaccaaggatatgtactagggaagaatttactcgcaaagtcagaagtaatgctgccattggggcagtcttcgtagatgagaatcagtggaacagtgcaaaagaggctgtagaggacgaaaggttttgggatttagtccaaaaggaaagggaactgcataaacaagggaaatgtgctacttgtgtttataacatgatgggtaaacgagagaagaaacttggagaatttgggaaagccaagggctcaagagctatttggtatatgtggctaggggccaggttcttagagttcgaagcactagggttcatgaatgaagaccactggttttctagagaaaactctctaagtggagttgaaggagaaggactacacaagctaggctatatacttcgagatatatctaaaattccagggggcaatatgtacgctgatgatacggctggctgggatacccgaataacagaagatgatttacagaacgaggcaaagattaccgatataatggaacctgaacatgccttgcttgcaacttcgattttcaaacttacctatcaaaataaagttgttcgagtgcaacgcccagccaaaaacggcacggtcatggacgtaatatcaagaagagaccagcgagggtcaggtcaagtcggaacttatggcttgaatacctttacgaatatggaagcccagttgatacgtcaaatggaatcagaaggaatttttctccccagcgaattagaaactccgaatttagcagaacgcgttttagattggttggaaaaacatggagtggaacgtctaaaaagaatggccattagtggggatgattgtgtcgttaagcctattgacgataggtttgccacagctctaactgcactaaacgacatgggtaaagtcagaaaagacataccacaatgggaaccaagcaagggttggaatgattggcaacaggttccattttgctcgcatcattttcatcagctaataatgaaagatggacgtgaaatagtggtgccgtgtaggaatcaggatgagttagtaggaagggcaagggtttcgcaaggtgccggttggtctttaagagagacagcatgtcttggtaaatcctatgcgcaaatgtggcagctaatgtactttcatagaagagatctcagactagctgctaacgcaatatgtagcgccgtacctgtcgactgggtaccaacaagtcgaacaacctggtcaatacacgctcaccatcagtggatgacaacagaagacatgctaagtgtatggaaccgtgtgtggatagaggagaatccgtggatggaagataaaacacatgttagctcgtggggagatgtaccttacctagggaaacgcgaggatcaatggtgtggatccttaatcggtctcacagcgagagcaacatgggcaagtaacatccaggtagcgatcaatcaggtgagaagattgattggaaatgaaaactaccttgattacatgacatctatgaagagatttaaaaatgagggagaccctgaaggtgcactgtggtga

SEQ ID NO: 21727 - RNA, 9879 nt, synthetic construct
  misc_feature 1..9879: note = derived and/or modified CDS sequence (opt6) from DENV-1__FJ898391__SS-prME
  source 1..9879: mol_type = other RNA
tccgtaacaatgttattaatgctaatgcccacagcattagcatttcacctcactacacgaggaggtgaaccacatatgattgtgagtaaacaagaaagagggaaaagtttgttatttaaaacaagcgccggtgttaatatgtgtacactaatagctatggatcttggtgagttctgcgaagacacaatgacttataaatgtcccagaatcacagaagctgaaccagatgatgtagattgttggtgtaatgctacagatacgtgggtaacatacggaacatgttcccaaacgggcgaacataggcgagataaaaggtccgtcgcactagcaccacatgtaggacttggtcttgaaacacgtactgaaacatggatgagctctgaaggtgcttggaagcagattcaaagagtggaaacctgggcgttaagacatccaggttttacggtcatcgcattatttctagcgcatgccatcggaacgtcaatcacccaaaaaggaattatattcattttgctaatgttggttaccccgtccatggcaatgcgatgtgttggaataggatcccgcgactttgtcgaaggactatcgggagcaacttgggtggatgttgtcttagaacatggtagctgcgttacaacaatggccaaagataaaccgactttggatatagaattattaaaaacagaagtaacaaacccagctgtattacgaaaactctgcatagaagcgaaaataagtaatactacaaccgacagtcgttgtcccactcaaggagaggcgaccctggtagaagaacaagatgcaaattttgtatgtagaagaacgttcgtagatagaggatggggcaacggctgcggattatttggtaaagggagtttgataacatgcgctaaatttaaatgtgttactaaactagaaggaaaaaccgtacaatatgaaaatctcaaatactctgttatcgtaacggttcatactggagaccaacatcaagttggcaatgaatcaacagaacatggaacaacagctaccattacccctcaagcgccaagtactgaaatccaactaaccgattatggagcattgactttggattgctcacctaggacaggacttgacttcaatgaaatggttctattaacgatgaaagagaaaagttggttagttcacaaacaatggtttttagacctaccattaccatggactagcggagcttcaacaagccaagaaacatggaatagaaaagatctattagttacgttcaaaacagcgcacgccaagaaacaagaggtagtggttcttggttcccaagaaggcgcaatgcacactgcactaacaggtgcaacagaaatacagacctctggaacaacgacaatttttgctggtcatttaaaatgcagattgaaaatggataaactaacgctaaaaggtatgtcctatgtgatgtgtacggggtcttttaaattagaaaaagaagtagcggaaacccaacacggaacggtattagtacaaattaaatacgaagggacagacgcaccctgtaaaatcccgttctctacacaagatgaaaaaggagtgacacagaacggaagattaattacagcgaacccgatagttactgataaagaaaaaccagtcaacatcgaggctgagcctccgtttggggaaagctatattgtgattggagctggtgaaaaagcattgaaattaagctggttcaagaaaggttcgagcattggcaagatgttcgaagcaacggcacgtggagcacgcaggatggctatattgggtgatacagcatgggacttcggatctatagggggagtgttcacatctgttggaaaacttgtacaccaaatatttggcacagcgtatggagtgttattctcaggcgtaagttggacaatgaaaattggtataggagttcttctaacttggctaggtttaaattcaagaagcacaagtttgagtatgacatgtattgcagtagggctagtaaccttgtatcttggagttatggtgcaagcagactccggttgtgtgataaattggaagggaagagaacttaaatgtggcagtggtattttcgtgaccaatgaagttcacacttggaccgagcagtataaatttcaggctgactcgcctaagagattgtctgctgcaattgggaaggcatgggaggaaggagtatgcggcatacgatccgcgacaaggctagaaaacatcatgtggaaacaaatatccaatgagttaaaccatatacttttagaaaatgacatgaaatttacagtagtggtaggagatgtcgcaggaatactagcccagggaaagaaaatgataaggccgcagccaatggaatacaagtattcatggaaatcatggggtaaagctaaaataatcggagcggatgtgcagaacactacatttattatcgatggaccaaacacaccagaatgtcctgacgatcaaagagcctggaacatatgggaagttgaggactatggattcggcatcttcaccaccaatatatggttaaaactgagagacagctacacacaagtatgcgatcacagattgatgagtgcagcgatcaaggattctaaggccgtgcatgcagacatgggatattggattgagtccgagaagaacgaaacttggaaactcgcgcgtgcgtcattcatagaggtgaaaacatgcatatggccaaaatcacacactctgtggagtaacggagtattagaatcagagatgattatacctaaaatatacggtggaccgatatcacaacataattatagacctggatactttacgcaaaccgctggtccgtggcacctaggcaaactcgaattagactttgatctatgtgaaggaacgacagtagtggtagatgaacactgtggaaatagaggcccctcattacgtacaacgacagtgacaggtaaaatcattcacgagtggtgctgtaggagttgtacccttccacccctcaggttcaaaggagaagatggctgctggtacggtatggaaattcgcccggtaaaggaaaaggaagaaaatttggtaaaatcgatggtctccgctggttctggcgaagtagattcatttagcttggggctactgtgcatatcaatcatgatcgaagaagtaatgcgatctagatggtcaaggaagatgcttatgactggaacgctagcggtattctttttactaataatggggcagctaacttggaatgacttgattcgtttatgcataatggtcggggctaacgcctcggacagaatgggaatggggacgacttatctagccttaatggcaacatttaagatgcgtcctatgttcgcagtaggtttactcttcaggcgattaacaagccgagaagttctgcttctaaccataggtctaagtttggttgcatcagtcgaactgccaaattcactagaggagctaggagatggattagccatggggataatgatacttaaacttcttacagacttccaatcccatcaattatgggcaacattactaagtttaacctttataaaaaccacattttctctacattacgcatggaagacaatggcaatggtactaagcatagtttcactattcccactctgtctaagcacaacaagtcaaaagacgacatggttaccagttttactgggatcgctaggttgcaagcccttaaccatgtttttgattgcggaaaacaagatttggggtaggaagagttggcctctgaatgaaggcataatggctgttggaatagtcagtatacttcttagtagcctccttaaaaacgatgtcccattagcgggcccattgatagcaggcggaatgctaattgcttgctatgtcatatcaggaagtagtgctgacttaagccttgaaaaagcagcggaggtatcatgggaggaagaagctgaacattcaggcgcgagtcataacattttagtggaagtgcaagatgatggtacaatgaagatcaaagatgaagaaagggatgatacgttaaccatactattaaaggcaacgttactagcagtttctggtgtgtatcccctgagtattccagcaacactttttgtctggtacttttggcagaagaagaaacagcgtagtggagtactatgggatacaccaagtcctccagaggttgagagagcagtgttagatgacggtatataccgaatcatgcaaagaggcttactaggaagatcacaggtaggtgtaggtgtgtttcaagaaaatgtgttccatacgatgtggcacgttacaaggggagccgtgctcatgtatcagggtaaacgcttggagccgagttgggcatcagtgaagaaagacttgatttcttatggtggagggtggcgcttacagggatcgtggaacacaggggaagaggttcaagttattgcagtagaaccaggcaaaaatccgaaaaatgtacaaacagccccaggtacattcaaaacttcagagggtgaagtaggagcaatcgcattagactttaagcctgggacaagtggatccccaatcgtcaacagagaaggaaaaatcgtcggactatatgggaatggagtcgtcactacctcagggacatatgtaagcgcaattgcacaggcgaaagctagccaggagggcccgcttcctgagatcgaagatgaagtctttagaaaaagaaacttgactatcatggacctacatcccggaagtgggaaaacacgccgttatcttcccgctattgttcgagaggcaataaaacgtaaactacgtacgctaatactagcacctacccgagtagtagcctccgaaatggctgaagctctaaaaggaatgccaataagatatcaaacaacagcggttaaatctgaacacactggaaaagaaatagtagacctcatgtgccacgctacgttcacaatgcgacttttatctcctgttagagtacccaattataatatgatcataatggatgaagcccacttcaccgatccaagtagcatagccgcgaggggatatatatccacgcgcgtgggtatgggggaagcggccgctatcttcatgaccgcgaccccgcccgggagtgtagaagccttcccacaatcaaatgctgtgatacaggatgaagaaagagacatcccggaacgatcatggaatagtggatatgagtggataactgattttccaggtaagactgtatggttcgttcccagcataaagtcaggtaatgacatagcaaactgcttgaggaaaaatggtaaaagagtaattcaattgtcgagaaagacattcgatacagaataccagaaaaccaaaaataatgattgggattacgtagtcactacagacataagcgaaatgggtgccaatttcagagctgaccgcgtgatagatccgagaagatgtttaaaaccagtaatacttaaagatggcccggaaagagttatattagccggaccgatgccggtaacggttgcatctgcagcacagcggcgtggtagaataggtaggaatcataataaggaaggagatcaatatatatacatgggtcaacctctaaataacgatgaggatcacgctcactggaccgaagctaaaatgctcttagataatatcaacacaccagagggcataataccagcattgtttgaacctgaaagagagaaaagcgcagcaatagacggtgagtacaggttgaggggtgaagcaagaaaaactttcgttgaattgatgcgaagaggggatctgcccgtttggcttagttataaagtggctagcgaaggtttccaatattcggaccgaaggtggtgcttcgatggagagagaaataatcaggtactagaagaaaatatggatgttgaaatatggacaaaagagggcgaaaggaaaaagctgcgaccacgatggttggacgcacgtacctatagcgacccacttgcactcagagaatttaaagagtttgctgcaggaagaagatcagtttcgggagatttgatacttgagataggtaaattaccacagcacctaacacagcgggcccaaaacgcactagataacctagtaatgctgcataactctgaacagggtggccgggcatatagacacgccatggaagaattgccggatacaatagagacgctgatgcttttagctcttatagctgtgttgactggtggagttacattgttctttttatcaggtcggggattgggaaagacctccatagggttactttgtgtaatggcctctagtgttttactgtggatggctagtgtagaaccacattggattgctgcgtctataattttagaatttttcctaatggtacttcttatcccggaaccggaccgtcaaaggactccacaggataaccagcttgcatatgtagtaatcggactgttattcatgatactcacagtagcagcaaatgaaatggggttattagaaactaccaagaaagatttaggaattggacatgttgctgtagaaaatcaccatcatgcggccatgttggatgttgatttgcatccagccagtgcgtggaccctgtacgccgtggcaacaacaataataacacctatgatgagacatactatagaaaacactacagctaatatttctttaacagcgattgcaaaccaggcagcgatattaatgggcttagataaagggtggccaatatcaaaaatggacataggggtcccattacttgcattaggatgctatagtcaggtgaatccattaacattaacggcagcagtcctaatgttagtcgcacattacgcaattattggccctggactccaagccaaggctacacgagaagcacaaaaacgtacagctgctggaataatgaaaaatccaacagttgatggcattgtagctatagacctagaccccgtagtctatgatgcaaaatttgagaaacaattagggcagataatgctactgatattatgcaccagtcagatactcctaatgcggacaacgtgggcactatgcgagtcgataacattagcaactggaccgcttactacattatgggaaggaagtccagggaaattctggaataccactatcgcagtctcaatggcaaacatatttagaggttcttatttagcaggagcaggtttagctttttctcttatgaaatcattagggggtggtagacgaggaacaggggcgcagggagaaactctaggggagaagtggaagaggcaattaaatcaactaagtaaaagcgagtttaatacctacaaacgaagcggcatcatggaagtcgatcgttcagaggctaaagaggggttaaaaaggggtgaaactacaaaacacgcggtgagccgaggtacagcaaaactgagatggtttgtagaaagaaatcttgtgaaaccggaagggaaggtaatagatttaggctgcggtcgaggtggttggagttattattgtgcgggactcaaaaaggtaacagaagtaaaagggtacacaaaaggaggtccaggacatgaggaaccaatccccatggctacttacgggtggaacctagtaaagttgcatagtggaaaagacgtcttcttcattccgcccgagaaatgtgatacattattatgcgatattggggaatcgtcacctaatcctactatcgaagaggggagaactttaagagttctgaaaatggtagagccatggttgcgaggaaaccaattctgtattaaaatactaaatccgtatatgccatcggtggtagagactctagaacaaatgcaacggaaacacggaggaatgctagttaggaaccccttatctaggaatagtacacatgaaatgtactgggtatcgtgcggtacgggaaatattgtaagtgcagtcaacatgacttcacgaatgcttctaaaccgattcacgatggcacacagaaaacctacatacgagagagatgttgaccttggtgcaggtacccggcacgttgccgtagaacctgaagttgctaatttagatatcatagggcaacggatagagaacatcaaacacgaacacaagtcaacttggcactacgatgaggacaacccctataaaacttgggcataccacggcagttacgaagtaaaaccaagtgggagtgcgtccagtatggtaaatggagtagttaaactacttactaaaccatgggacgtcattccaatggtgacgcaaatagcaatgactgacacaacaccatttggacaacaaagagtgttcaaagagaaagttgacacacgtaccccgaaagcaaaacggggtactgcacagatcatggaagttactgcaaaatggctttggggtttcctatcgcgtaacaaaaagccgaggatatgtacaagggaggaatttacaaggaaagttcgaagtaatgcagcaataggagccgtttttgtggacgaaaaccaatggaactcagcaaaagaagcagtcgaagatgaacgattctgggacttagttcacagggaacgggagttacataagcaaggtaaatgcgctacgtgtgtttacaatatgatgggcaaacgcgagaagaaattgggagaatttggcaaagctaagggctcaagggccatatggtacatgtggctcggagcgaggttcttggagttcgaagctctaggatttatgaatgaagaccattggttttcacgagaaaatagcttatccggagtggaaggtgaaggtctacataagctgggatacattttgcgagatatttcaaaaatacctgggggcaacatgtacgcagatgataccgctggatgggatactcggataacagaggatgaccttcaaaatgaagctaaaatcactgacataatggaacccgaacatgctttacttgctaaatcaatttttaaattaacatatcaaaataaagtagtgcgagttcaaagaccggccaaaaatggtactgtaatggacgtaatatcaagacgggaccaacgtggtagtggtcaagtaggaacttatggtctaaacacctttacgaatatggaagcgcaactgattaggcagatggaaagcgaaggaatatttagcccatctgaactagaaactccaaatttggcgggtcgtgtcttggactggttagaaaaacacggggtggaaagactcaaacgaatggctatatccggagacgattgcgtcgtgaaaccaatagacgaccgatttgcgacagcattgaccgcgctcaatgacatgggtaaagttcgaaaagacataccacaatgggaaccctcaaagggctggaatgattggcagcaagtgcccttttgttcgcatcactttcaccaactaattatgaaagatggtcgtgaaatagttgtgccttgtaggaaccaagacgagttagtagggcgagcaagggtgagccaaggtgcaggctggagtttaagggagacagcatgtctcggcaagagctatgcacaaatgtggcaactaatgtattttcatcgcagagacctgcgtttagcagctaacgcgatatgttccgctgtacctgttgattgggtgccaacgagtagaactacatggtccatccacgcgcatcatcaatggatgacaacagaagatatgttaagcgtatggaatagggtgtggatcgaagaaaatccatggatggaggacaaaactcatatatcatcgtggggagatgttccgtaccttggtaaaagagaagaccaatggtgtggttctttaataggattaactgctagagccacatgggcaacgaatatacaagtagctataaatcaagtcagacgtttgatagggaacgagaattatttagactatatgacgtcgatgaaaagatttaaaaatgaaagtgacccagagggggccttgtggtga

SEQ ID NO: 21728 - RNA, 9879 nt, synthetic construct
  misc_feature 1..9879: note = derived and/or modified CDS sequence (opt6) from DENV-1__FJ898392__SS-prME
  source 1..9879: mol_type = other RNA
tcggttaccatgctattaatgttaatgcccactgcgttagcattccatctaactacaagaggaggtgaaccacacatgatcgtgactaaacaggaacgaggaaaatctttactttttaaaacatctgccggtgtaaatatgtgtactctaattgctatggacttgggtgaattatgtgaagatactatgacctataaatgcccccgaattactgaagcagaaccggacgatgtagactgttggtgtaatgcaacagatacgtgggtcacatacggaacttgttcccaaacaggagaacacagacgagacaaaagatcggtagcgctagcaccccatgtgggtttaggactcgaaactcggacagagacatggatgtcatcagaaggtgcgtggaaacaaatccaacgagtagaaacatgggcgttgagacatcctgggttcacagttattgcactgtttctagcacacgcaataggtacttcaataacacaaaaaggaattatctttattctactcatgcttgttacgccatccatggcaatgagatgtgtagggattgggtctcgagactttgttgaaggtctctctggtgcaacctgggtagacgtggttctagaacatggaagctgtgttacaacgatggcaaaagataaacctacgttagatatagaactgttaaaaaccgaagtaacgaacccagcggtcctgcgtaaactatgcatcgaagcaaaaatttctaataccacaacagactctcggtgcccgacacagggagaagcgactctaatggaagaacaagatgcaaatttcgtttgtcggcgaacttttgtggataggggatggggaaacgggtgcggactattcggcaaagggagcttgataacttgtgccaaatttaaatgcgttactaaactggagggaaaaatcgtccaatatgagaacttaaaatactcagtaatagtaactgtccataccggagatcaacatcaagtcggaaacgaatctactgaacacgggacgaccgctacaataacacctcaggcacctacctcggaaatacaactaacagactacggtgcactaacgttagattgttccccgagaactgggttagatttcaatgagatggtactactaacaatgaaagagaaaagttggttggtgcataaacagtggtttttagacctaccactgccttggacttcaggagcgtcaacaagtcaagaaacttggaatcgccaggacctgctagttacattcaaaacagctcacgctaaaaagcaggaagtagttgtgttaggatcgcaagagggtgctatgcacacagcccttacaggagccacagaaatacaaacgtcaggaactacaacaattttcgcaggacacttaaaatgtcgtcttaagatggataaattaacgttaaagggaatgtcttacgtcatgtgtacaggtagtttcaaacttgaaaaagaagtcgcagagacgcagcatgggacagtattagtgcaaataaaatatgaaggaactgacgcgccgtgcaaaatcccattctcgacacaagacgagaagggtgtgacccaaaacggtagattaataacagcaaacccaatagtaaccgataaagaaaaaccagtaaatatagaagcagaacctccattcggagaaagttacatcgtaattggagcaggagaaaaggcattaaaactgagctggttcaagaaaggaagctcaatcggtaaaatgtttgaagctacagcgcgtggcgctcgcagaatggctatcctaggggatacagcctgggacttcggaagcataggaggtgtcttcacgtcagttgggaaattagtccatcaaatattcggaactgcctacggggtgctattttccggtgtctcctggactatgaaaatcggaataggggtgttgctaacctggttagggctcaattctcgaagcacaagtttaagtatgacttgtatagcggtaggactggtaaccttataccttggcgtaatggttcaagcagattccgggtgtgtaattaattggaagggaagagagcttaagtgcggctctggaatatttgttacgaacgaagtacatacctggactgagcaatacaaatttcaagccgattcacccaaaaggttaagcgcagcgataggtaaagcgtgggaagaaggagtttgtgggattcgatcggctactaggttagaaaatattatgtggaaacaaatctctaacgaattgaatcacatcttattagaaaatggcatgaaatttacggtcgtagtcggtgatgtagtaggaattttggcacagggcaagaaaatgatcaggccacaacctatggaacataaatactcttggaaatcatggggaaaagctaaaatcataggcgcagatgtgcagaatacaaccttcattatagacggaccgaatacacccgaatgtccagacgaccaaagggcttggaatatatgggaggtagaagattatggattcgggatttttaccactaatatatggttgaaactgagagattcatatacgcaagtttgtgatcatagactaatgtctgccgcaattaaagactcaaaggccgtccacgcggatatggggtactggattgaatccgaaaagaatgaaacctggaagctagctagagcatccttcatagaagttaaaacttgtatttggcctaaatcccatacattatggtctaacggagtattagaaagtgaaatgataatacctaaaatatacggagggccgatatcccagcacaattatcgaccaggatacttcacacaaacagctggaccatggcacttaggtaaactggagctagattttgatttatgcgaaggaaccacagtggttgttgatgagcattgtggtaacagaggaccgagtctgagaactacaacagttaccggaaaaataatacatgaatggtgttgtcgctcgtgtacattaccacctttgagattcaaaggtgaagatgggtgctggtatggaatggagataaggccagtgaaagagaaggaagaaaacttggttaaaagtatggtcagtgcgggaagcggagaagtggactctttcagcttaggtttactttgcacttcaattatgatagaagaagttatgcggtcgagatggagcagaaaaatgctgatgacgggcacattggctgtcttcctcttgctaataatgggacaattgacttggaacgatttgattagactatgtataatggtaggagctaatgcttcggatagaatgggaatggggacaacatatctagcacttatggcaacctttaaaatgagacccatgttcgcagttggcttactatttagaaggttaacatcaagagaagtcttgctgttgactatagggttgtcattagtagcatccgtagaactacctaacagcctggaagaacttggtgatgggctagcaatgggtataatgattttaaagttgctcaccgacttccaatcccatcaactatgggcaacattattatcgttaactttcataaagactactttgagcttacattacgcctggaaaactatggcgatggtactatccatagtctcgctgttccccctttgcttatcaacaacctcccagaaaaccacatggctaccagttctactaggcagccttgggtgcaagccgttgacaatgttccttattgcggagaacaagatttggggccgaaaatcatggccactgaacgaagggataatggccgtaggagtcgtatcaatacttttaagttctttactcaaaaatgatgtccctctagcgggtccgttaatagctggcggcatgttaattgcctgctacgtaatatctggatcctcagctgatctttctctagagaaagcggctgaagtttcttgggaagaagaagcagaacattctggagcttcacataatatattagtagaagtgcaagacgatggcacaatgaaaataaaggatgaagagagagacgacacacttacgattttactaaaagcgaccttactcgcagtgtcgggcgtatatcccttaagcataccagcaacattattcgtttggtacttctggcagaagaagaaacagagatcaggggtgctttgggatactccaagtccgcctgaagtagaacgagctgttttagatgacggaatttacaggataatgcaacgagggctgttgggaaggagtcaagttggcgtaggagtatttcaagaaaatgtctttcacacaatgtggcatgtaactagaggcgccgtactcatgtaccaaggaaaacgacttgaaccctcttgggcatcggtaaagaaagatctaatatcatatgggggtggatggagattacaaggatcatggaatacaggtgaagaggtccaggtaattgcagtagaaccagggaaaaatcctaaaaatgtacaaaccgctccaggcacctttaagactccagaaggagaagtaggggcaatagctttagacttcaagccaggtacgtcgggaagtccaattgtcaaccgtgaggggaaaattgttggactttatggaaatggcgtagtgaccacatcaggcacgtatgttagcgcaatcgcacaagcgaaggcaagccaagaaggtcctctaccggaaatagaggatgaagtttttagaaaaagaaatctaaccattatggacctacatcctggatctggaaaaacacgacgatatctaccagcgatagttagagaagccattaaaagaaaattaagaaccctgatattagcgccgacgagagtcgtcgcttccgaaatggcagaggctcttaagggcatgccaatacgatatcaaacaactgcagttaagtcagagcatacggggaaagagatagtcgacctaatgtgtcacgcaactttcaccatgagactgttgtccccagtgagagtacctaattataacatgataataatggatgaggcacactttactgatccttcctcaattgcggcgcgagggtacataagtacaagggtcggaatgggagaggcagctgctatttttatgacagcaacaccacccggcagtgttgaggctttcccccagtccaatgcagttatacaagatgaggaaagagacatacctgagaggtcttggaatagcggttatgaatggataacggatttcccaggcaaaaccgtatggtttgtcccatccatcaaaagtggcaacgatattgccaattgcctaagaaagaatggaaagcgagttatacaattaagtagaaaaacgttcgatacagaataccaaaagacgaaaaataacgattgggactatgtcgttacgactgatatttcagaaatgggtgcgaactttcgtgctgatcgtgtaatagatccaagaagatgtttaaagccagttatattaaaagatggtcctgaaagagtgatattagcgggaccaatgccagtcaccgtagcaagcgcagcacaaagacgaggacgcataggaaggaatcataataaggagggtgatcaatacatatatatgggacaacctctcaacaatgatgaagatcacgcgcactggacggaagcaaagatgcttctagataacataaatacccctgaaggaataataccggcactattcgagcccgagcgcgagaaaagtgcagctatagatggtgaatatcgacttagaggagaagcgcgtaagacattcgtagaacttatgagacgaggagatttacccgtatggttaagctataaagtagcttcagaaggatttcagtactcggatagaagatggtgcttcgatggggaacgtaataatcaagtcctagaagagaacatggacgtggaaatatggacaaaagagggagaaaggaagaaattgaggccaaggtggttggatgcgaggacgtactctgatccactagccttgcgcgaatttaaagagttcgctgctggacgacgctcagtaagcggagatctaatacttgaaattgggaaattgcctcaacatttaacccaaagagcccaaaacgcattagataacctggttatgttacacaatagcgaacagggagggcgagcttaccgccacgccatggaagaactaccagatactattgaaacactaatgttactagcacttatcgcagtccttacaggaggtgtaacattattcttccttagcggcaggggtttaggcaaaactagcataggcttactatgcgtaatggcttcatcagttttgttatggatggctagtgtagaacctcactggattgcagcctccattatattagagttctttctaatggtcttactaatcccagaacctgatcgccaaagaacacctcaagacaaccaattagcctatgtagttataggacttttgtttatcatattgaccgtcgcggctaacgaaatgggattgttagaaacaactaagaaagatttaggaatagggcatgtggcagttgagaaccaccaccacgctaccatgttagatgttgatttgcaccctgcttctgcatggacactctacgccgttgcgacaacgataattactcctatgatgagacatactatagaaaatacaactgccaacattagcttgaccgcaatagcaaatcaggcggccatattaatgggattagacaaaggatggcctatcagcaaaatggacataggtgttcccttgttagctttaggatgttacagtcaagtaaaccctttaacattaacggcggcggtactaatgctagtagcgcactatgctattataggaccaggactacaagcaaaggcaacaagagaagctcaaaagcgtacagcggctggcataatgaagaatccaactgtagacggaatagtcgccattgatttagacccagtcgtatacgacgcaaaatttgaaaaacaactaggacaaattatgctactgatactttgcacttcgcaaattttactaatgaggacaacctgggctttgtgtgaaagtattactcttgcaacaggtccactaacaacgttgtgggagggtagtccgggcaaattttggaatactactattgcggtctcaatggcaaatatattcaggggatcttatcttgccggtgctgggctagcgttttccctaatgaagtccctaggaggaggaagacgagggaccggggcccaaggagaaactctaggtgaaaaatggaaacgacaattaaatcagctgtcaaagtcagagttcaatatatataaaagaagcggtataatggaagttgaccgttccgaagccaaagaagggctaaaacgcggcgagaccacacgacacgctgtttcaagaggaacagcaaagctccgttggtttgtagaaagaaatttagtaaaacctgaaggaaaagtgatagatttaggatgtggccgtggtggatggtcatactactgcgccggactcaagaaagtaaccgaagttaagggttatacaaaaggtggccccggacacgaggagcctataccaatggctacttacggatggaatttagttaaactccatagcggaaaagatgtgttctttacgcccccggaaaaatgtgatactcttttatgtgatattggcgagagcagccctaatccgacaattgaagaaggtagaacattgagagtgttaaaaatggttgaaccatggttacgaggtaaccagttttgcataaagatcctgaacccatacatgccgtctgtagtcgagactctagaacagatgcaaagaaaacatggtggaatgctagtacgaaacccactatccagaaacagcacgcacgaaatgtattgggtcagctgtggtacaggaaatatagttagtgccgtaaatatgacttcacgaatgttactgaacagattcacaatggcgcaccgaaaaccaacttatgaacgagacgtagatctaggagccggaacaagacacgtggcggttgagcccgaagtagcgaatctcgatattattgggcaacgcatagaaaatattaagcatgagcataaaagtacgtggcattacgacgaagataatccatacaaaacgtgggcataccacgggtcttatgaagtaaaaccttcaggatcggctagtagtatggtaaatggagttgtaaagctcctaacaaaaccgtgggacgtaatccctatggtaacacagatcgcaatgactgacaccactccattcggccaacaacgagtgttcaaggaaaaagtagacaccagaacaccaaaagctaagagaggaaccgctcaaataatggaagtaacggcaaggtggttgtggggatttttaagtcgcaataagaagcccagaatatgtaccagggaggagttcacaagaaaagtacggtctaatgctgcaattggagctgtctttgtcgatgaaaatcaatggaactcggctaaggaagctgtcgaagatgaacggttttgggatctagtccagaaagaacgtgagttacacaagcaaggtaaatgtgcgacttgtgtatataatatgatggggaaaagagagaagaaactcggagaatttggaaaagcgaagggatcaagagcaatttggtatatgtggctcggggctcgatttctggagttcgaagcactaggttttatgaacgaagatcattggttttcgcgcgaaaatagcctatctggagtagagggggaaggtctacataaactaggctatattttgagagacatatcaaaaatccctgggggcaatatgtatgcggatgataccgcgggctgggatacacgtattacagaagacgatctacaaaatgaagcgaaaataacagatataatggaacctgaacatgcactactggcaacgagtatatttaaactaacataccagaataaggttgtaagggtacaacgccccgcgaaaaatggaacagtgatggatgtaataagccggagagaccaaaggggcagcggccaggtgggtacatatggattaaatacattcaccaatatggaagcgcaacttattagacaaatggaatcagaagggatatttctaccgtcggaactagaaactccaaatttagcagaaagagtgctggactggttagaaaaatatggggttgaaagacttaaacgcatggctatcagcggagacgattgcgtagttaaacctatagatgatcgttttgctacagcattaacagcactgaatgacatggggaaagtacgaaaggatatcccccaatgggaacctagcaaaggatggaacgattggcaacaggtccccttctgttcgcatcattttcatcagctaatcatgaaagatggccgagaaattgtagtaccttgcagaaaccaagacgaacttgtaggccgcgccagagtaagccaaggggcaggttggtctctaagagaaactgcttgcttagggaaaagttatgcgcagatgtggcaattgatgtatttccatcgccgagatcttcgtctcgctgctaacgcaatatgtagcgcagtaccagtagactgggttccaactagccgcaccacatggagcatacatgcccaccaccagtggatgacaaccgaagatatgttaagtgtgtggaaccgagtttggattgaggagaacccgtggatggaagataaaactcatgtttcgtcgtggggagacgtgccatatctcggtaaaagagaggaccagtggtgtggatctttgataggcctaactgctagagccacgtgggcaagcaacatacaagtagccattaatcaagtgagacgactgataggcaatgagaattacttggactacatgacttctatgaaaagatttaaaaatgaaggggatccagagggggctttatggtaa

SEQ ID NO: 21729 - RNA, 9879 nt, synthetic construct
  misc_feature 1..9879: note = derived and/or modified CDS sequence (opt6) from DENV-1__FJ898393__SS-prME
  source 1..9879: mol_type = other RNA
agcgttacaatgctcctcatgttaatgccgaccgctttagcattccacttaaccacccgcggaggagagccccatatgatagtaactaaacaagaaagaggtaaatctcttttatttaaaacatcggcaggggttaatatgtgtacgttaatagcaatggatctgggggaactatgtgaagacacaatgacttataaatgccccagaataactgaggccgaacccgacgatgtagactgttggtgtaatgcgacagatacatgggtaacatatggaacatgttctcagaccggggaacaccgcagagacaaaagatcagtcgccctcgcacctcacgttggactaggtcttgaaacccggacggaaacatggatgtctagcgagggagcatggaaacaaatccaaagagttgaaacttgggcgcttcgacatccaggattcactgtaatagctctattcttagcgcacgctataggaacctcaatcacacaaaaaggtataatatttattcttctgatgttagtaacaccatcgatggcaatgagatgtgtcggaatcgggagcagagactttgtagaaggcttgagcggagccacatgggtagatgtagtgttggaacatggctcttgtgtaacgaccatggccaaagataaaccaactctagacatcgaattattgaaaacggaagtcacaaacccagcagtacttcgtaaactgtgtatcgaagcgaaaatatctaacactacaacagacagcagatgtccgactcagggagaagcaacgttaatggaagaacaagatgcgaactttgtatgtagacgcaccttcgtcgacagaggatggggtaatggatgcggattattcggaaaaggtagcctcatcacatgcgcaaaatttaaatgtgtgacaaaactagaaggaaaaattgtacaatatgaaaacttaaaatattcggttatcgtcactgtacatacaggtgaccaacatcaagtaggcaatgaatctacagaacatggtacaactgcaactataacgccacaagccccaacaagcgaaatacagttgacagattacggcgcattaactctagattgttctcctcgaacagggttggatttcaatgagatggtgttattaacgatgaaagagaaatcatggttggttcataaacaatggttcctcgacctacctttaccgtggacttctggagcatcaacatcacaagaaacatggaacagacaagaccttttagtcacgtttaaaaccgcccatgcaaagaagcaagaagtagttgttcttggatctcaagaaggggcaatgcacacagcattaactggtgcaaccgaaatacaaacatcagggaccacaacaatatttgcaggtcatttaaagtgtcgcttgaaaatggataaattgacacttaaaggcatgagctatgtgatgtgtaccgggtcctttaagttggagaaagaggtagcagaaacacaacacggtactgtattagtccagataaagtacgagggcactgacgcaccatgtaaaatcccgttttcgactcaagacgagaaaggggtaacacaaaatggacggttgataacagcgaatcctattgtaacggataaagaaaaaccagtaaacatcgaagctgaaccacctttcggagaatcatatatagtgataggagctggagagaaagcgctcaaactcagttggtttaaaaaggggtccagtataggcaaaatgttcgaagcaacagcccgaggagcgcgaagaatggcaattttaggggacacggcatgggacttcggtagtgtcggtggagtatttacgtcagtagggaaacttgttcaccaaattttcggaacagcctacggtgtattattctcaggggtttcatggaccatgaaaataggtattggagtactcctaacatggctcggtttaaacagcaggagcaccagtctaagtatgacctgcatcgcagtagggctggtaacattatacttaggtgtcatggtccaggcagatagtggttgcgtcataaactggaaaggccgcgaattaaaatgtggaagtggaatttttgtcacgaacgaagtgcatacttggactgagcaatataaattccaggcagactcaccaaagcggctcagcgcagcaataggacgagcctgggaagaaggagtatgtggtattagaagtgcaacacgtcttgaaaacattatgtggaagcaaatttcgaacgaattgaatcatatacttcttgaaaacgatatgaaatttaccgttgtagtgggtgatgtagtagggatattagcgcaaggaaagaaaatgatccgaccacaacccatggaacataagtattcctggaaaagttggggaaaggcgaagataattggagcagatgtccaaaatacaacattcattattgatggtcccaatacccccgaatgtcccgacgatcagcgcgcatggaacatttgggaagttgaagactacggatttgggatcttcactactaacatatggttgaagctacgagactcatatactcaagtatgcgatcatagactcatgtccgcagcaattaaagatagtaaagcggtacatgcagacatggggtactggattgaatcggagaaaaatgaaacgtggaaattggccagagcaagttttatagaagtcaaaacatgtatatggccgaaatcacacacattgtggtcaaatggagttctcgaatcagagatgataattccgaaaatctatggaggtcctatatcgcaacacaactatagaccgggctacttcacacaaacagcaggaccatggcatttaggtaagttagagcttgatttcgacttatgcgaaggaactacagtcgttgttgacgaacattgtggaaataggggtccgagtttgagaactaccacggtaacaggcaaaataatacatgaatggtgctgtagatcatgcacacttccacccttaaggtttaagggtgaggacggatgctggtatggtatggagatcaggccagtgaaagaaaaagaagaaaatctagtaaaatcaatggtgtccgcgggatcgggcgaagtggattccttttctctcggtttattatgtatatcaattatgatcgaggaagtcatgagatcaagatggagtcggaaaatgttaatgacgggtacattagcggtatttctattattaataatgggacagttgacgtggaatgacctaataagattatgtataatggtaggtgctaacgcaagtgaccgtatgggcatgggtaccacatatctcgcattaatggccacatttaagatgcgaccaatgtttgcagttggattgctgtttaggcgtctgacttcaagagaagtattattgctaacgataggactatcattagtggcaagtgtagaactaccgaatagtctagaggaacttggtgatggattggctatgggaataatgatattaaagttgttaaccgacttccaatcacatcaattatgggccacattactgtccttgacatttataaagactaccctctcattacattatgcgtggaaaactatggcaatggtcttgtcaatagcgagtttattccctctatgcttgtcaaccacctctcagaaaactacttggttacctgtgctgttagggagtctcgggtgtaagccgctgacgatgtttttgatcaccgagacaaaaatatggggaaggaaatcatggccgttaaatgaaggaatcatggcagtgggtgttgtaagtattttactttcatctttattgaaaaatgacgtacccctagcgggtccactaatagccggcgggatgctaattgcatgttatgtaattagtggaagttctgctgaccttagtcttgagaaagcagcagaagtatcgtgggaggaagaagcggagcactctggagcaagtcataatattctcgttgtggttcaagatgatggtactatgaaaataaaagatgaagaaagggatgatacattaacaatattgctaaaggcaacactgttggctgtttcaggggtatacccattgtctatcccagctacattattcgtctggtacttctggcagaaaaagaaacagagatctggagtcctttgggatacgccaagtcctccagaagtcgaaagagcggtcctagacgatggtatttataggatcatgcagaggggactattaggacgttctcaagtaggggtaggagtctttcaagaaaacgtgtttcatacgatgtggcacgtgacaaggggtgctgttttgatgtatcagggcaaacgattagaacccagttgggcatccgtcaagaaagacttaatatcatatggtggtgggtggcgattacaaggttcttggaataccggggaggaggtgcaagtaatcgccgttgaaccggggaaaaatcctaaaaatgtccaaacagcaccaggaactttcaaaacaccggaaggagaagtaggggccatagcattagattttaaacctgggacttcaggctccccaatcgtaaacagagaagggaaaatagtgggactctatggtaatggggtagttactacaagtggaacctatgtttcagctattgcacaagctaaggctagccaagagggtcctttgccagagatagaagacgaagtctttagaaagaggaacttaacgattatggacttacacccagggagtggcaaaacgaggcgttatctaccagcgattgttagagaggccatcaaacgcaaattacgaacgttaatcctggctccaacccgggtagttgcttccgaaatggcagaggcactaaaaggaatgccaatcagatatcaaactacggcggtaaagagcgaacataccggtaaagaaatagtggatctaatgtgtcatgctacatttactatgaggctattatctcctgtgagagtgcctaattacaacatgatcataatggatgaagcacattttactgatccaagcagtattgctgctagaggatatatatcaacacgagtaggaatgggagaagcagcagccattttcatgacagcgacacctccaggatcagtagaggcattcccgcaaagcaatgcagtgatacaagacgaagaacgagacataccagaacgttcatggaatagcggatatgaatggataactgacttcccagggaaaacggtatggttcgtgccctcaattaaatctggaaacgatatagcgaattgcttaaggaaaaatgggaagagggtaatccaattgagtaggaaaacatttgatactgaataccagaaaactaagaataatgactgggattacgttgtgacaacggatataagcgaaatgggtgcaaactttagagcagatagagtcattgatccgcgaagatgcctcaaaccggtgattcttaaagacggacctgaacgagtaatactagccggaccaatgcctgtcacagttgcatccgcggcgcaacggcgaggacgaataggccggaatcataacaaagaaggagaccaatacatatacatgggacaaccgctaaacaatgacgaagatcatgctcattggacggaagctaaaatgctattagataatattaacacacccgagggaattatcccagcgttgttcgaacccgagcgtgagaaatctgcggctatagatggggaatataggttgagaggtgaagcacgcaaaactttcgtcgagttaatgaggaggggcgatttgccagtatggctctcttataaagttgccagcgaaggctttcaatactcagatcgaaggtggtgttttgatggagaacgaaataaccaagtcttagaagagaacatggacgtagaaatatggacaaaagaaggagagaggaagaaactaagaccaagatggctagacgcaaggacctatagcgatccgcttgcactcagggagtttaaagaatttgctgcaggcaggagatcagtgtctggcgacctaatattagaaattgggaagttaccccagcatctaactcagagagctcaaaacgctctagataatttagtgatgctacataacagtgaacaaggtgggcgtgcgtatagacatgcaatggaagaacttccggatacaattgaaaccttgatgctattagcactgatagcggttctaactgggggtgtcacactatttttcctgagcggccgtggattaggtaaaacgtcaattgggttgctctgtgtaatggcaagctcggtactactctggatggcttcagtcgaaccccactggattgccgcaagtattatactggagttctttcttatggtactattgattcctgaacctgatagacaaagaaccccgcaggataatcaacttgcatacgtagtaattggtttattgttcatgatacttactgtcgcagcaaatgaaatgggtctgctcgaaacaaccaagaaagatctaggtatcgggcatgtggctgtagaaaaccaccaccacgcgactatgcttgatgtggacctacatccggcgtccgcatggacactatatgcagtcgccacaactataataacccctatgatgagacatacgatcgaaaacacgacagccaacatatcgttaacagcaattgcaaatcaagcggcaattttaatggggttagataagggttggccaattagtaagatggacattggcgtacctctattagcactcggctgttactcacaagtaaacccattaacacttacggctgcggttttaatgctcgtcgcccactatgcaattataggcccaggccttcaagccaaggccacaagggaggcacagaagagaaccgctgctggcataatgaaaaatcctacagtcgatggtatagttgctattgacttagaccctgtcgtgtatgatgcaaaattcgaaaaacaacttggacagattatgctgttaatcctatgtacctctcaaattcttctaatgcgaaccacgtgggctttatgtgagagcataacccttgccacgggaccgctcaccacactatgggaaggaagccctggaaagttctggaacacaacaattgcagtatctatggcgaatatattccgtgggagctacctggccggtgcaggattagcgttctcgcttatgaaatccttaggtggagggcggaggggtacaggtgcgcagggggaaacgctaggtgagaagtggaagagacaactcaaccagttgagcaaaagcgaatttaacatatacaagagatctggtatcatggaagtagataggagtgaagccaaagagggattaaaaagaggggagactactagacacgcagtcagtcgaggtaccgcaaaattacgatggttcgttgagagaaatttagtcaaaccagaaggaaaagtaatagatttaggttgcgggcgtgggggatggagctattattgcgcggggctaaagaaagttacggaagtaaagggttatacaaaaggagggcctggacatgaggagcctataccaatggccacttatggttggaacctcgttaaactacacagtggtaaagatgttttctttacccctcctgaaaaatgtgatacacttctttgtgacataggggagtcatcacccaatcccacaattgaggaaggtagaacattacgagtcctaaaaatggtagagccatggctccgtgggaaccaattttgcatcaaaatattaaacccatatatgccgtccgttgttgaaaccctcgaacaaatgcaacgcaagcatggtggaatgttagtaagaaacccactctctaggaacagcacacacgaaatgtactgggtatcctgtggtacaggtaatatcgtctctgctgtgaatatgacaagtagaatgttactcaatcggtttacgatggcgcatcgaaaaccaacatacgagagggatgtagatctgggcgctgggactaggcacgttgctgttgaaccagaggtagcaaacttagatataatcggtcaaagaattgagaatataaagcacgaacataaatctacttggcattatgatgaagacaatccctacaagacctgggcttaccacggttcatacgaggtcaaacctagtggatctgcaagttccatggtcaacggagtcgtgaaacttttaactaaaccgtgggatgtcattccaatggtaacacagatagcaatgaccgataccactccatttggacaacaacgagtatttaaggaaaaagtggatactcgtactcctaaagctaaaagaggaactgcgcagataatggaggtgactgcccgatggttgtggggattcttatcaagaaataagaagccaagaatctgtacccgagaagaatttacaaggaaagtacgtagtaatgctgctataggtgctgtttttgtagacgaaaatcaatggaactcagccaaagaagcagttgaagatgaaagattttgggatttggttcaaaaggaacgggaattgcataagcaaggcaaatgcgctacatgtgtatataacatgatgggcaagagggagaagaaactgggagaatttggaaaagcaaagggtagccgagcgatatggtacatgtggctgggggccagattcttggagttcgaagcattaggatttatgaacgaagaccattggttttctagagaaaacagcctttccggtgtagaaggtgaaggattgcacaaactaggatatatcctaagagacattagtaaaatacctggcgggaacatgtatgctgatgacactgcgggttgggacacgaggataaccgaggatgacctacaaaatgaggcaaaaataacagatataatggagccagaacacgccttacttgcaacttctatatttaaactaacctatcagaacaaagtagtgcgggttcaaagacccgcgaaaaatggaacagttatggatgttatctctcgtcgagatcagagggggtctggtcaagtcggaacttacggtttgaatacgtttacaaacatggaagcacagttaattagacaaatggaatctgaaggcatatttttgccatccgaactcgagacgcctaatttagcagagcgcgttctagactggcttgagaagtacggggtagaaagattaaagcggatggcaatctcaggagatgactgtgtggtcaaaccaattgatgatagatttgcgacagcactaacagccttgaatgatatgggtaaggttcgtaaagatatacctcaatgggaacctagtaaaggatggaatgactggcaacaagttccgttttgcagtcaccatttccaccagctcatcatgaaagatgggcgagaaattgttgtcccatgcagaaaccaggacgaactcgtagggagagcgcgagtgtctcaaggtgcgggctggagtttaagagaaactgcatgcttagggaaatcttacgcacagatgtggcaacttatgtactttcatcgccgagatttacgacttgccgcaaacgccatttgtagcgcggtacctgttgattgggtaccaacaagtcgcacaacttggtctatacacgctcaccatcaatggatgacgacagaagatatgctatctgtctggaatagagtgtggattgaggaaaacccatggatggaggacaaaacacacgtaagttcatggggagacgtgccatacctcgggaaaagagaggatcagtggtgtggctcgcttataggcttgacggcacgcgcaacatgggcaagcaacatacaggttgcaataaatcaagtacgtagattaataggaaacgaaaattatctcgactatatgacatcaatgaaacgatttaagaatgagggtgacccggaaggggcactttggtag

SEQ ID NO: 21730 - RNA, 9879 nt, synthetic construct
  misc_feature 1..9879: note = derived and/or modified CDS sequence (opt6) from DENV-1__FJ898394__SS-prME
  source 1..9879: mol_type = other RNA
tcagtaacgatgctactaatgttaatgcctactgcattggcctttcatctcaccacgagaggtggagaaccccatatgattgtaacaaaacaagaaaggggaaagagcttactatttaaaacatcagcaggcgtaaatatgtgtaccttaattgccatggacctcggcgagttatgtgaagacacaatgacttacaaatgccctagaatcacggaagccgaacccgatgatgtggactgctggtgtaatgccactgatacctgggtgacgtacgggacttgttcgcaaacaggtgaacatagaagagacaaacggagtgtagcactagcaccacatgtgggacttggccttgaaacgaggacagaaacatggatgtcaagtgaaggggcatggaaacaaatacaaagagtcgaaacatgggctttaagacatcccggatttaccgtcatagctctgtttctagcacacgctataggcacttcaataacacaaaaaggaataatcttcatactcctaatgttggtcacaccaagtatggcgatgaggtgtgttggtattggatctagagacttcgtcgagggccttagtggggcaacttgggtcgacgtagtattagagcatggttcatgtgtaacaacaatggctaaagataaacctacattagatatcgaattattgaaaacagaagtaacaaatccagcagtgctcagaaaattgtgtatcgaagcaaaaatttcgaatacaacaacagactccagatgtccaacccaaggcgaggcgactctaatggaagaacaggacgccaattttgtatgtaggaggacattcgtcgaccgcggatggggcaatggttgcggattatttggaaaaggatctttgattacatgtgctaaatttaaatgtgtgacaaagttggagggcaaaatcgtacagtatgaaaacctaaaatacagcgtgatagtaacagtacacactggcgaccaacaccaagtaggaaatgaaagtactgaacacggaacaactgcgacaataactccgcaggcacccacgagtgaaatacaactgacagattatggagcattaacactagattgcagtccacgcacaggactggactttaatgaaatggtacttctgactatgaaggaaaaatcatggctagtgcataagcaatggtttttagacttaccgctaccttggaccagtggtgcaagtactccccaggagacatggaatagacaagatttgcttgttacatttaagacagcacacgctaagaagcaggaagttgtagtactaggaagccaagagggggctatgcatacggcgttaacaggcgcgacagagatacaaacaagcggcactacaacaatatttgcaggtcacttaaaatgtaggctcaaaatggacaaactgactttaaaaggcatgagctacgtaatgtgtactggatcatttaaacttgaaaaagaagtggcggaaacacaacacgggacagttctagtacagataaagtatgagggaacagatgcaccgtgcaaaataccgttttcgacacaagatgagaaaggggtaacacaaaatggaaggcttataacagccaacccgatagtaacagacaaagaaaaaccggtaaacattgaagcggaaccacccttcggggaaagttatattgtaatcggtgcaggagaaaaagctcttaagttaagctggttcaaaaagggttcgtcaataggaaaaatgtttgaagcaaccgcacgtggggcacgacgaatggcaatcctaggagatacagcatgggatttcgggagtataggtggagtttttacttccgtcggaaagctagtgcatcaaatatttggcaccgcatatggagtattatttagcggggtttcctggacaatgaagataggtattggagtattgttaacgtggcttggtttaaatagtagaagcacgagtctctccatgacgtgtattgcagtcggccttgtgaccttatatttgggtgtgatggtgcaggccgattccggatgcgtcataaattggaaaggaagagaactcaaatgtgggtcaggaatttttgtaactaatgaagttcacacatggacagagcaatacaaatttcaagccgattcaccaaaaaggttaagcgcagctattgggaaagcctgggaagaaggagtatgtggaatacgaagtgcaacaagattagaaaatattatgtggaaacaaatttctaacgagttaaaccacattttactagaaaatgatatgaaatttaccgtggtagtaggagatgtggttggaattttagcacagggcaaaaagatgattaggccacagcccatggaacacaaatattcttggaaatcatgggggaaagctaagattattggagcagatgtccaaaacactactttcataatagacggacccaacacacctgaatgtcccgacgaccaacgggcttggaatatatgggaggtagaagactacgggttcggaatttttaccaccaatatttggttaaaacttcgcgacagttatacacaggtgtgtgatcatcgtctaatgagcgcggctataaaagacagcaaggctgtacatgcagacatggggtactggatagaaagtgagaaaaatgagacctggaaattagctcgagcgagcttcatagaagtaaaaacatgcatctggcctaaaagccatactctatggagtaacggagtacttgaaagtgaaatgataattcctaagatttatggtggaccaatatctcaacacaattatagacccggatactttacacaaacagctggaccttggcatttgggaaagctagagctggactttgacctgtgtgaaggtacgactgttgttgtagatgaacattgcggaaaccgagggccaagcctacgaactacgactgttacgggtaagataattcacgaatggtgctgcagaagttgcaccctcccaccattacgctttaagggagaagatggttgctggtacggaatggaaatacgaccggtaaaagaaaaggaagagaacttagtaaaatctatggtttcagccgggagtggggaagttgatagttttagcctgggattactttgtatatcgattatgattgaagaagttatgcggagtagatggtcgagaaaaatgttgatgacgggtacattggccgtattcctacttctgatcatggggcaattgacatggaacgatctaatccggctctgtataatggttggagctaacgtctccgatcgaatgggaatgggaacaacctacctcgctttaatggcgaccttcaaaatgcgaccgatgttcgctgtcggactcctattccgaagactaacgagccgcgaggtattgttgttaacgataggattgtcactcgttgcatcagtagaattacctaattctctagaagaacttggggatggattagcaatgggaattatgattcttaaattacttacagattttcagagccatcagctgtgggcaacactacttagtttaacattcatcaaaaccactctgtcactacattacgcatggaaaaccatggccatggtcctctcgatcgtatcactttttccattatgtttatcaactacatcacagaaaacgacttggctaccggtgttattaggctctttaggatgcaaacccttaacaatgtttttgatagcagaaaacaaaatatggggtcgaaaatcatggccccttaatgaaggaattatggctgttggcgtagtctctatcctattatcctcattgctaaagaatgacgtccctttggcaggtccacttatagctggaggaatgctaatagcatgttatgtgattagcggttcaagtgccgacttgagtttggaaaaggcagcggaagtcagctgggaagaggaagctgaacatagtggagctagccataacatcttagttgaagtacaagacgacggaaccatgaagataaaggatgaagagagggatgacacactaacaatactattaaaggcaactttactagctgtctccggagtgtatcctctaagtatacctgcaactctattcgtttggtatttctggcagaagaagaaacaaagatcaggagtattatgggatactccaagtcccccggaagttgaaagggcagttttagatgacggtatatacagaatcatgcaaagaggacttttaggtcgatcgcaagtaggagtgggtgtttttcaagaaaacgtctttcacactatgtggcatgttacacgaggagcggtactaatgtatcaggggaaaagattggaaccaagttgggcatctgtcaagaaagatctcatatcatacggtggagggtggagactccaagggtcatggaataccggggaagaagttcaagtaatagcggtcgagccaggcaaaaatcccaaaaacgtacaaaccgcaccgggaacatttaaaaccccagaaggcgaagttggggccattgcgttggattttaaacctggcacaagcggatcacctatcgttaacagagaaggaaaaatcgtgggactatatggcaatggagttgtaactacatctgggacatacgtcagtgctatcgcgcaagcaaaggcttctcaagaaggtccactgccggaaattgaagatgaagtatttagaaagaggaaccttacaattatggatttgcacccgggctccggaaaaacacggcgttacctaccagcaatagttagagaagctattaagagaaaactccgaaccttaatactagctccaactcgcgtagtagcttctgagatggcagaggcgttgaaaggtatgccaatacggtatcaaacaacggcagtaaaatctgagcatacaggaaaagagatcgtcgatttgatgtgccacgctaccttcaccatgcgtctactctcgccggttagagtccctaactataacatgatcataatggacgaggcgcattttacagacccaagctccattgcggcgagaggatacatatcgactcgagttggtatgggtgaagcagcagcaatattcatgactgcaacgccaccaggatcagtggaggcattccctcagtccaacgcggtgatacaggacgaagaacgcgacatacctgaaaggtcgtggaactcaggttatgaatggattactgattttccaggaaagactgtatggtttgtaccaagtattaagtccggtaatgatattgccaactgtttaagaaagaacggtaagcgcgtcatacaattatcaagaaagacatttgacacagagtatcagaaaactaagaataatgattgggattacgtagtgactacggacatctccgaaatgggagcgaactttcgagcggatcgagttattgacccaagacgctgtttaaaaccagtaatccttaaagatggaccggaaagagtcattcttgccggacccatgcccgttacggtagctagtgcagcacaacgaagaggcagaattggccgcaatcacaacaaagaaggagatcaatacatttacatgggacagccattaaataacgacgaagatcacgcgcattggaccgaggctaagatgttgcttgacaacattaacactccggagggtataataccagctctatttgagccggaacgagagaaatcagcagcaatagacggagaatatcgattaagaggggaagcaagaaagacattcgtcgagctaatgcgaagaggtgacctacctgtttggctgtcatataaagttgcgagtgaaggttttcaatattccgatagaaggtggtgcttcgatggagaaagaaacaaccaagtactagaggagaacatggacgtcgagatatggactaaggaaggtgagcgaaagaaattgaggccccgttggctcgacgctagaacgtattcagatcctttagcgctaagagaatttaaagaatttgcagcgggacgacgatcggtctctggggacttaatacttgaaattggaaaactgccacaacatttgacacaacgggcacaaaacgctttagataatttagtaatgttacataattctgagcaaggtgggagagcttaccgacatgcgatggaagaactacctgatacgatagaaactttgatgttgctggcactaattgcagtgttaacaggaggagtgacgctctttttcctaagcgggaggggcttaggaaaaacatctataggacttctatgtgtgatggcatcttctgtccttctatggatggcttctgtcgaaccccactggattgccgcttcaatcatattggagttctttcttatggtgttgttgatacctgaaccagacaggcaacgaacaccacaagataatcagctagcttatgtagttatagggcttctatttatgatactaacagtggcagctaatgaaatgggattgctggaaaccactaagaaagatcttggaattggccacgttgctgtggaaaatcatcatcatgctactatgttagatgtggacctacatccagcaagtgcctggacattgtacgccgtggccactacaatcataacgcctatgatgagacataccattgaaaatacgacagcaaatatatctttaacagccatagcgaatcaagcggcgattttgatgggtttagataaagggtggcctatctcgaaaatggatataggagtccctttattagccctaggctgctacagtcaagttaatccattaacattaactgccgcggtactaatgttagtcgcacattatgctataattggtcccgggttacaagcaaaggctacacgagaagcccagaaaaggacagcagcaggtataatgaagaacccaacggttgatggaatcgtggctattgatctagatcctgttgtttacgatgcaaagtttgaaaaacaactcgggcaaatcatgttattaatattgtgtacatcacaaattttactaatgcgaaccacctgggcgttatgtgagtcaataacgctcgcaactggaccattgaccacactctgggaaggttcaccagggaaattttggaacacaactatagctgtctcaatggcaaacatttttaggggtagttatttagccggggccggcctggcttttagtcttatgaagagtctcggtggagggagacgtggtaccggtgcacagggcgagactcttggtgagaaatggaaacgacagttaaaccagctatcgaagtcagaatttaatatatacaaaaggagtggcatcatggaagttgacagatcagaagcgaaagaagggctaaagcgtggagagactacacgtcatgctgtaagtagaggaaccgcgaaactccgatggtttgtagagcgaaatctcgttaaacccgaaggaaaagtcatagacctgggctgtggtagaggcggctggtcatattattgcgctggcctgaagaaagtaacagaagttaaagggtatacaaaagggggtcctggtcatgaagaaccgattcctatggcaacatatggatggaacctagtaaaactccacagcggcaaggacgtcttctttacaccacccgaaaagtgtgatacattactctgtgatataggcgaaagtagtcccaacccgaccatcgaagaaggaagaaccttacgtgtcttaaaaatggtcgaaccatggttaaggggaaaccaattttgtataaaaatactaaacccctatatgccgagtgttgtagaaacattagaacaaatgcagcgcaaacatggcggtatgttggtgcgaaatccactctcacgaaattccacgcacgaaatgtattgggtttcctgcggaacaggcaacatagtatctgcagtcaacatgacgagccgaatgctcttaaacagattcacgatgactcacaggaaaccaacatatgaacgtgatgtggacttaggagctgggacacgtcacgttgcggtagaacctgaagttgctaatttggatataataggtcaaagaatagagaatattaagcatgaacataaatcaacatggcattacgacgaagacaatccttataaaacgtgggcttatcatggtagctacgaagtaaaacctagtggaagcgcaagtagtatggtgaacggtgtcgtaaaattactgacgaagccgtgggacgtaattccaatggtaacccaaattgctatgacagacactacaccctttggacaacaaagggtgttcaaagagaaagttgacaccagaacaccaaaggcaaagaggggaacggcacaaataatggaagtcactgctcggtggctatggggattcttatcaagaaacaagaaaccacgcatttgtactagagaagagtttaccagaaaagtacgaagcaatgcagcaatcggagcggtctttgtcgatgaaaaccaatggaactcggcaaaggaagcagttgaagatgaacgattttgggacttagttcagaaagaaagggagttacataaacaaggaaaatgtgcgacgtgtgtctacaacatgatggggaaaagagagaagaaactcggtgaatttggaaaggcaaaggggtcacgagcaatctggtacatgtggttaggtgccaggtttctagaatttgaagcattgggatttatgaatgaagatcactggttcagccgagagaactccttaagcggggtcgaaggagaaggtctgcacaaacttgggtacattctgagggatattagcaaaattccaggaggaaacatgtacgctgatgatacagcaggttgggacacaaggataacagaagacgatctccaaaatgaagcgaaaataacagatataatggaaccagaacatgcactgctcgcaacctcaatatttaagctaacgtatcaaaacaaggtcgtaagagtacagaggcccgcgaaaaacgggaccgtaatggatgtaatatcgagacgtgatcaaagagggagcggccaagttggaacgtatggattgaatacatttacaaatatggaggcacaactaataagacaaatggagagtgaaggaatctttctacccagtgaattagaaactcccaaccttgcagaacgagtcttagattggctagagaaacatggggtagagagattgaagcgaatggcaattagcggtgatgattgtgtggttaagccaattgacgatagattcgccacggcgctcactgcattaaatgatatggggaaagtcaggaaggatatacctcaatgggaaccatcgaaagggtggaacgactggcaacaggtaccattttgcagtcaccacttccatcagctaatcatgaaagatggtcgcgaaattgtcgtcccttgcagaaaccaggacgaactcgtcggtagggcgagagtttcacaaggcgcaggctggtcactaagggaaacggcatgccttggaaaatcatatgcacaaatgtggcagcttatgtacttccatagaagagaccttagacttgctgcgaatgctatctgtagtgccgtaccagtagattgggtcccgacttctaggactacatggtctatacatgcccaccaccaatggatgacaaccgaagacatgctctcagtatggaaccgtgtttggatagaagaaaatccatggatggaagacaaaacgcatgtaagttcatggggtgacgtcccatatctggggaaaagagaagatcagtggtgtggctcattgattggactcactgccagagctacatgggcctcaaatatacaagtagcgattaaccaagtaaggcgactgataggaaacgaaaactacctggattatatgacgagcatgaaaagatttaaaaatgaaggcgaccctgaaggtgcgctatggtag

SEQ ID NO: 21731 - RNA, 9879 nt, synthetic construct
  misc_feature 1..9879: note = derived and/or modified CDS sequence (opt6) from DENV-1__GQ199838__SS-prME
  source 1..9879: mol_type = other RNA
tcagttacgatgttgctcatgttaatgccaactgcattagcatttcatcttacaacacgcggcggtgaacctcatatgatagtaaccaagcaagaacggggtaagtcacttctatttaagacttcagcgggcgtaaatatgtgcacattaattgcaatggacctaggagaactttgtgaagatacgatgacatataaatgtcccagaattacggaagcggagcccgacgacgtggactgttggtgtaacgcaacggatacgtgggtcacatacggcacatgctcccaaactggtgagcaccgaagagataaacgcagtgttgctttagcaccgcacgtgggcctggggctggagacgagaactgagacctggatgtccagtgaaggcgcttggaagcagatacaacgtgtagaaacgtgggcgctacgtcatccagggttcactgtgatagcgttatttttagcacatgcaataggaacttcgattacacaaaaggggattattttcatattattaatgttagtgacaccctctatggcaatgcgatgtgtaggaatcggcagccgagactttgttgaaggtctgtcaggggcaacatgggtcgacgtggttcttgaacacggttcctgtgttacaactatggccaaggataagccaacgctagatatagagttactaaagacagaggtgacaaaccccgccgttctaaggaagttatgcatagaagccaaaatttcaaatacgaccactgattctaggtgccctacccaaggtgaagcaactctaatggaagaacaagatgcgaatttcgtatgcaggcgaactctagtagaccgagggtggggtaatggatgcggactctttggaaagggaagtttgattacatgcgccaaattcaaatgtgttaccaaactggaaggaaaaattgtacagtacgaaaatttaaaatattcagttatcgtaacagtacatactggagaccaacatcaagtgggaaatgagtcgacggagcacggaaccacggcaacgattacgcctcaagcgccaacctcggaaatacaacttaccgattacggcgccctcactctagattgtagtccccgaactggactagatttcaatgaaatggtcttattaactatgaaggagaagagttggttagtacataagcaatggttcctggatttaccactcccatggacgagcggtgcatctacttcacaggagacatggaatagacaagatttgctagttacatttaagacggctcacgccaagaaacaagaagtagttgtactaggatctcaagaaggggcaatgcatactgcgcttacaggtgcaacggaaatacaaacttcaggaactacaacgattttcgcaggacaccttaagtgcagattaaaaatggataaactaacattaaaaggaatgtcatatgttatgtgtacaggatcatttaagctagaaaaagaagtggcggaaacgcagcatgggacggtccttgtccagataaaatacgaaggtacagatgctccttgtaaaatacctttctcaactcaagacgaaaagggtgtgacacaaaatggtagattaattactgcaaatccaatcgtgacggataaggaaaaacccgttaacatagaggcagagccaccatttggggaaagttacattgtaataggtgctggagaaaaagctcttaagttaagctggtttaagaaaggatcttctattggcaaaatgttcgaagccacggcacgcggtgctcgaaggatggcgatattaggtgacacggcgtgggattttggatcaatagggggagtatttacgtcggtaggtaaattagtccatcagatatttggaacagcgtacggcgtgttattttccggtgtatcatggacaatgaaaataggaattggggtattactaacttggttgggtctaaatagccgcagcacctcattgagtatgacttgtatagccgtaggtttggtcactttatatttgggcgttatggtacaagcggattctggatgtgtcataaattggaagggaagggaactgaagtgtggcagcgggatatttgtgacaaatgaggttcacacttggacagaacaatacaaatttcaagcagatagccctaaacgtctatcggccgcaattggaaaagcctgggaagaaggcgtatgcggaatccgcagtgccactagacttgaaaacatcatgtggaaacaaattagcaacgagcttaatcatattctattagaaaacggtatgaaattcacagtagttgtgggggatgtagtaggcattctggctcaagggaagaaaatgatacggccacaaccgatggagcacaaatacagctggaaaagctggggaaaagcaaaaatcataggagcagatgtacaaaatactacatttataatcgatggtccgaatactcccgaatgtccagatgatcaaagagcgtggaacatttgggaggtcgaagattacggttttggaatattcacaacgaacatatggttaaaactccgagacagttacacccaagtttgtgaccataggctcatgagtgcagcaattaaagactcaaaagcggttcatgctgacatgggatactggatagaaagtgagaaaaacgaaacctggaaacttgcacgagccagttttatagaagtaaaaacttgcatatggccgaaaagccataccttatggtcaaatggtgttcttgagtcagaaatgattatcccaaaaatttatggtggtccgatttcacaacataattatagacccggatatttcacacaaacagctggaccatggcacttaggcaaacttgaattagattttgatctctgcgaaggaacaacagtagttgtagacgaacactgcgggaatcgagggccgagtctgagaacaaccacagtaaccggtaagattatacacgaatggtgctgccgttcatgtacgttaccgcccctacgtttcaagggagaggacggctgttggtatggaatggaaatcagacctgttaaggaaaaagaggagaatctagtaaagtctatggtgagcgcagggagtggtgaagtagacagcttttcgcttggcctgctttgcacatctataatgatagaggaagttatgagaagtaggtggtcgagaaaaatgttaatgactgggaccttagcggtgttcttattacttattatgggccaactaacttggaatgatttaatacgactgtgtatcatggttggagccaatgcttccgaccgcatggggatgggaaccacgtacttagcattaatggcgacgtttaaaatgagacccatgtttgccgtcggcctattgtttagacgtttgacatcacgagaggtattactactgaccattggactctctctggtggcatcagtcgaattgcctaacagtctcgaggaacttggagatggcctagctatgggtataatgatattaaaactactaactgattttcagtcgcaccaattgtgggcgacattactctctctcacgttcattaaaacaacacttagtctccattatgcatggaaaacgatggccatggtcttgtcaatagtatccctttttccactgtgtctatctacgacatcgcagaaaacaacatggctaccagtattattaggctctctaggatgcaaacccctgacgatgtttctaatagccgaaaataagatctggggtcgtaagagttggcctctcaacgaaggaataatggcagttggcgttgtatcaatactcttatcttcattacttaaaaatgacgtgccactcgcgggtccgctgattgctggtggaatgttaatagcatgttacgtaatttcaggctcatcagcggatttatccttggaaaaagctgccgaagtatcctgggaggaggaagctgaacattctggagcaagtcacaacatcttagtagaggtccaagatgacggaacgatgaaaattaaggacgaagaacgagacgatactctgacaatactattgaaagccaccttattggcagtatctggcgtatacccattatcaatcccggcgacactctttgtatggtatttttggcagaaaaagaaacaaagatcaggagtcttatgggatactccatcacccccagaagtagaaagagcagtattagatgatggtatatatcgaatcatgcaaagaggtctcctcggcagaagtcaagtgggggttggcgttttccaagaaaatgttttccatacaatgtggcatgtaactcgtggtgcagttcttatgtaccaaggtaaacgactagaaccctcgtgggcctcagtcaaaaaggatctgattagttatggtgggggatggcgtttacagggatcgtggaacacaggggaagaagttcaagtaattgccgttgagcctgggaaaaatccaaagaacgtacaaactgcaccaggaaccttcaagacgcctgaaggggaagtcggagctatagctttagactttaaaccaggtacgtcgggcagtccaatcgtcaaccgggaagggaagattgtgggcctttatgggaatggtgtggtgactacgtctggaacgtatgtctcagcaattgcacaagctaaagcaagtcaagaggggccattaccggaaatagaggatgaagttttcaggaaaagaaacctaactataatggatctacatccagggagtggaaaaacaaggagatatttaccggcaatagtacgtgaagcaataaaacgtaaacttagaaccctaatattggcaccaacccgagttgtggcgagcgaaatggcagaagccttaaaggggatgccaataagataccaaacgaccgcggttaaaagtgaacataccggtaaagaaatagtggatctcatgtgtcatgcaacattcaccatgcggctgttgtctcccgtacgcgtaccaaactataatatgataataatggacgaagcacactttacggatccaagctcgattgcggcacgaggatacatatcgaccagggtcgggatgggggaagcggctgctatattcatgacggctacgccaccgggtagcgtggaggcttttcctcagagtaatgcagtgatacaagacgaagaaagagatattcccgaaagaagctggaactcgggctatgaatggataactgacttcccaggtaagacagtttggttcgtaccatcaataaaaagtggaaatgacatcgccaattgtctaaggaaaaatggtaaaagagtgatacaactaagcagaaaaacatttgatacagaatatcagaaaaccaaaaacaacgactgggactatgtagttacgacagacatatcagaaatgggagcgaatttccgagcggacagagtgattgatccgagaagatgcttgaaaccggtaatactaaaggatggtcctgaaagagtaattctagccggaccaatgcccgtaacggtagcatcagcagcgcagagacgtggacgcataggtagaaatcataataaagaaggcgaccaatatatttacatgggacaacccctgaataacgacgaggaccatgcacattggaccgaagctaaaatgcttttagataatatcaacacgccggaaggaataatacctgctttatttgaaccagaacgagagaaatcagcagcgatagacggcgaatataggttgcggggagaagctcggaaaacttttgttgagctgatgaggagaggtgacctaccagtctggttatcttataaagtcgcttcggaaggctttcaatacagtgacagaagatggtgtttcgatggagagaggaacaatcaagtcctagaagagaacatggacgttgaaatttggacgaaagaaggagaacgcaaaaagttacgaccgcgctggctagatgccagaacatactcagatcccttggcgctaagagagttcaaagaatttgctgcgggaagacgaagcgtgtcaggggacttaatccttgaaattggaaaattaccacaacatctaacacaaagggctcagaacgctttagataatttagtaatgcttcataacagtgaacagggaggtagagcttaccggcacgccatggaagaactaccagatacaatcgaaacattaatgttactagccctgattgcagtactaacaggaggtgtaaccctatttttcctatcaggcagagggctaggaaagacatcgataggattgttatgtgtaatggcatcgtctgtcctactttggatggcatctgtcgaaccccattggattgcggcttctataatacttgagttctttctaatggtattattaattccagaaccggaccgacagagaacgccacaagataatcaattagcgtatgtcgttataggcttgttgtttattattttaacagtagcagcaaacgaaatgggacttcttgaaactaccaagaaagacctaggaattggacatgtagctgtagagaatcaccatcatgctacaatgctagatgttgatttgcaccccgctagtgcatggaccctgtacgcagttgccacgactataataaccccaatgatgcggcacactatagaaaatacgacagccaatattagcttaactgctatagcaaaccaagctgcaattctaatgggattagataaaggatggccaattagtaaaatggatattggagtgccgctattagcactcggttgttactctcaagtaaatccccttacactcacagcagcagtcctaatgctagttgcacattatgctattatcggacctggtctccaagccaaggctacacgtgaagcacaaaaacggaccgctgcaggaataatgaaaaatccgacagtcgatggaatagtcgctattgatctagatcctgtggtatatgacgcgaagtttgaaaaacaacttgggcaaattatgctcttaatattgtgcacaagtcaaatactgctaatgcgcacgacgtgggccctctgtgaaagtatcacccttgctactggaccactaactacattgtgggaaggatccccaggtaaattttggaataccacaattgcagttagtatggcaaacattttcagagggtcatatttagcaggagcaggacttgcattctctttaatgaaatcacttggaggcgggagaagagggacaggtgcacagggagaaacattgggtgaaaagtggaaaagacaactgaaccaactaagcaaaagcgagttcaacatctataagcgcagcggaattatggaagttgatcggtcagaagcgaaagaaggattaaaacgaggtgaaactacgaggcacgctgtatctaggggtaccgcaaaattaaggtggtttgttgaaaggaacttagtaaaacctgaaggcaaagtgattgacctaggatgtggtcgaggaggttggagttactattgtgccggactaaagaaagtaacggaggtgaagggttatacaaaagggggtcccggtcacgaagaaccaattcctatggcaacctacggatggaacttagtcaagctacattccggaaaggatgtctttttcacaccacctgaaaagtgtgatacccttctatgcgacataggcgaaagctctccaaaccctactatagaagagggacggacattgcgagtactcaagatggtagagccatggttacggggaaatcaattctgtataaaaattctgaatccatatatgccatctgtcgtagaaacgctagaacaaatgcagcgaaaacatggagggatgctggtaagaaaccccttatcacggaatagcacacacgaaatgtattgggtgtcttgtgggaccggaaacatagtatcggcagtgaatatgacatcaagaatgttgttaaatcgtttcacaatggctcacagaaaacccacctatgagagagatgtggacctcggagctggtactagacacgttgccgtggagcccgaggtcgctaatttggatataataggacaacgaatagaaaacatcaaacacgaacacaaatcaacttggcattatgatgaagacaatccatataaaacatgggcctaccacgggtcttatgaagtaaagccttcgggaagcgcaagctctatggttaacggcgttgtaaaactattaactaagccctgggatgtaatccctatggtcactcaaatagccatgacagatacaacaccctttggccagcagcgcgttttcaaagaaaaagtcgataccagaactccaaaagccaaaaggggcaccgctcaaattatggaagtaaccgcaaggtggctgtggggatttctatcgagaaacaagaagccacgaatttgtacccgtgaagaatttaccagaaaagttagatcaaatgctgctataggtgccgtatttgttgacgaaaaccaatggaatagcgcgaaagaagcggttgaagatgaaaggttctgggatttagtacagaaagagcgggagctgcataaacagggaaaatgcgcaacatgcgtgtacaatatgatgggcaagagagagaagaagctaggggagtttggcaaagctaaaggaagtagagctatctggtatatgtggttgggtgcaaggtttttggagttcgaggctttaggctttatgaatgaagatcactggttcagtagagaaaatagtttgagtggagtagaaggtgaagggctccacaaattgggttatatcctacgggacatatcgaaaataccaggaggaaacatgtacgcggacgatacagcaggatgggatacaaggataacggaagacgacttacaaaacgaagctaaaataacagatataatggagcccgagcatgctttgctcgcaacatctatatttaaattaacttatcaaaataaagtggtgcgggttcagcgtcccgccaaaaatggtacggtcatggatgtaatatcgagaagagaccaaagaggtagtggacaggttggtacatacggacttaacaccttcacaaatatggaggctcaactaattcgacagatggaaagtgaagggatttttcttccaagtgaactcgaaacaccaaacttggctgaacgtgtattagactggctggaaaaatacggcgttgaacgcctgaaaagaatggctattagtggggatgactgtgttgtgaaaccaatagatgacagatttgctacagcactgacggcactcaatgatatggggaaagttagaaaggatatcccccaatgggaaccaagtaaagggtggaatgattggcaacaagtaccattttgctcccaccattttcatcagcttataatgaaagatgggcgagaaatcgtagtgccgtgtagaaaccaggatgaactggtagggagagcacgagtttctcagggagcgggttggtctctgcgagaaaccgcatgtctcggcaaaagttacgcgcagatgtggcaacttatgtattttcatagaagagatctaagattagccgcaaatgccatctgttcagcggtcccagttgactgggtgccaacaagtagaacaacatggagtattcatgcgcatcatcagtggatgacgaccgaggacatgcttagtgtatggaatagagtatggatagaagaaaatccatggatggaggacaagactcatgtttcttcatggggagatgtaccatatctaggcaaaagagaagaccaatggtgtgggagcctgattgggcttacagcacgtgcaacgtgggcgtctaacatacaagtagccataaatcaagtccgacgactaatcggcaacgaaaattatctagattatatgaccagtatgaaacgattcaaaaacgagggtgatccggaaggagcgctatggtga

SEQ ID NO: 21732 - RNA, 9879 nt, synthetic construct
  misc_feature 1..9879: note = derived and/or modified CDS sequence (opt6) from DENV-1__FJ898396__SS-prME
  source 1..9879: mol_type = other RNA
tctgtaactatgctgttgatgttaatgccaacagcgcttgcatttcatctcacaacaaggggaggcgaaccacacatgatagtaacaaaacaagaacgaggcaagagcttactttttaaaacatcagcgggtgtgaacatgtgcacactcatcgcaatggatctaggagaactatgtgaagatactatgacgtataaatgtcctagaattacagaagcggaacccgatgatgttgactgctggtgcaatgcaaccgatacgtgggtcacatatggaacatgtagtcaaacaggagaacatagaagagacaaacgttccgtggctttagcacctcatgttggattaggattggaaacaagaactgaaacatggatgagttcagaaggagcctggaaacaaatacagcgagtggaaacatgggccctaagacatcctggattcacagttatagcactatttctagcccacgccataggaactagcataactcaaaaaggtataatatttattttgctcatgttagtaactccatcaatggcaatgcgatgcgtagggattggatcaagagattttgtcgaaggccttagcggcgctacatgggtagatgtagtactagaacatggctcctgtgtaacaactatggcgaaagacaaaccaacacttgacatagaattgctaaaaacagaggtgacaaacccagctgttttgcggaaactctgtatagaagccaaaatctcaaacacaacaacggattccagatgtccaactcaaggggaagcaaccttgatggaagaacaagacgcaaattttgtgtgtcgcaggacatttgttgatagaggttggggcaatggttgtggcttattcggaaaaggaagtctcataacctgcgcgaaattcaaatgtgtaacgaaactagaaggtaaaattgttcaatatgaaaatttaaaatacagtgtaattgttacagtacatacaggcgaccaacaccaagttggaaacgaatccacggaacatggaaccaccgcgacgattacacctcaagcgccgacatcggagatacaactcaccgattatggcgcgttaacgttggactgctctccgagaaccggtctcgattttaacgaaatggtactactaacgatgaaagagaaaagctggttggttcacaaacagtggtttttagacttacctttgccatggacaagtggagcaagtacatcacaagaaacttggaatcgacaggatctcctagtaacattcaaaactgcgcatgccaagaaacaagaagtagtcgttctaggaagtcaagaaggggctatgcacacagctttaacaggcgctaccgagatccaaaccagtggaactactactatctttgcggggcatctgaaatgtcgtctaaaaatggataaattgacactaaaaggtatgagttatgtcatgtgtaccggatcatttaaattagaaaaagaagtagcagaaacacaacatggaacggtattagtacaaattaaatatgaaggaactgacgctccttgtaaaattccgttttccacgcaagacgaaaaaggggtaacacaaaacggacgattaattacagcaaacccaatagtaactgacaaagagaaacccgtaaacatagaagctgagcctccattcggagaaagttatattgttattggagccggtgaaaaagccttaaaactaagttggtttaagaaaggtagttcgattggtaaaatgtttgaagccacagcacgaggagcacgtaggatggccatactgggcgacactgcttgggatttcggaagcgtaggaggagtctttacaagtgtaggtaaattagtccatcaaatattcggaacggcttacggcgtactattttcaggagtctcttggaccatgaaaataggcatcggagtgctcctcacatggttgggcctcaatagccgatcaacttccttatccatgacatgtatagctgttgggctagtaactttatacctcggagtcatggtacaagcagatagtggatgtgtaattaactggaaaggaagagaattaaaatgtgggtctggaatatttgtaacaaatgaagtacacacttggacggaacagtacaaattccaagcagatagtcctaaaagactgagcgctgcaatcggtaaagcctgggaagaaggagtttgtggcatacgctctgcaacaaggcttgaaaacatcatgtggaaacagatctcaaacgaactaaaccatattttactagagaacgacatgaaatttacagtcgttgtcggagatgtagtcggaatcttagctcaagggaagaaaatgattagaccacaaccaatggaacataaatattcttggaagtcttggggtaaagcaaagataatcggcgctgatgtccagaatacaacgtttattatcgacggaccaaacacgccagagtgtcctgatgatcaaagggcttggaatatatgggaagtagaagattatgggtttgggatttttacaacgaacatatggctaaaactaagagactcatatactcaagtatgtgatcataggcttatgagtgcagcgattaaagattctaaggctgtacatgcggacatgggatactggatagaatctgagaaaaatgaaacatggaaactcgctcgtgcatcgttcatcgaggtcaagacctgtatttggccaaagtcccataccctatggtcaaatggcgttctagaatcagagatgataataccaaagatatatggtggaccaatatcgcaacacaattatagaccaggatacttcactcaaaccgcggggccttggcatctaggaaaacttgagcttgacttcgacctatgcgaggggacaacagtagtggtagatgaacattgtgggaaccgtggaccaagtcttcggaccacaacggtaaccgggaagattatccacgagtggtgctgcagaagttgcacgctaccgcccttgcggttcaaaggagaagacggatgttggtatggcatggagattagaccggttaaggaaaaagaggaaaacttagtgaagagtatggtatcggcgggcagtggggaagtagattcatttagcctgggtttattgtgtataagtatcatgattgaggaagtgatgagaagcagatggtcacgaaaaatgcttatgacaggtacactggctgttttcctattattaataatgggacaactaacatggaacgacctcattcggttatgcataatggtaggggccaatgcaagtgatagaatgggaatgggtacaacctatctcgcattgatggccacatttaagatgagaccaatgttcgctgtggggcttcttttcagaagattaacatccagggaagtcttgctattgactataggactatcacttgtagctagtgtcgagctacccaatagtctcgaagaactgggcgatgggttagcaatgggaataatgatactcaaactactaacagattttcaatcccatcaactttgggcaacactgttgagtttaacttttataaaaacaacactgtcactacattatgcatggaaaacgatggcaatggtgttatcaatcgccagtctctttccattatgcttaagcacaacgagccagaagactacatggctccctgttttactcgggtcgttaggatgcaaaccgttaacaatgtttctcataaccgaaacgaaaatctggggacgaaagagttggccactgaatgaaggcataatggctgtgggagtcgttagtattcttttgtcatccctattaaagaatgatgttcctctagcaggcccgctaattgcaggagggatgcttatcgcatgctacgttataagcggatcaagtgcagatctgtcattggaaaaagcggcagaagtcagctgggaggaagaagcggagcattcaggggcatcacataatattttggtagttgtacaagacgacggtacaatgaagataaaagatgaagaacgagatgataccttaactatactactaaaagctactttacttgcagttagtggggtttatccattatctataccggcaacattattcgtatggtatttctggcagaagaagaaacaacgaagtggcgtactttgggatacaccaagccctccagaggttgaacgtgcagttttagacgatggaatctatcgaattatgcagagaggattattaggacgtagtcaagtaggagtaggtgtatttcaggaaaatgtgtttcatacaatgtggcacgtgacacgcggggcggtactaatgtatcaaggaaaaagattagagccatcctgggccagcgtaaagaaggatctaattagctatggaggtggatggagactacagggttcgtggaatactggtgaagaagtacaagtaatagcagtcgaacccgggaaaaacccgaaaaacgtccaaaccgcaccgggtacattcaaaacgccggagggtgaggttggtgctattgcattggatttcaagcccggtacaagtggtagtcctatagtaaatcgggaaggaaagatagttggattgtatggaaacggcgtagtgactacatcaggtacttatgtttcagctattgctcaagcaaaagcatcccaagagggccctctaccagaaatagaggacgaagtattccgtaagcgaaacctgacaattatggacctccacccgggttctggaaagacgagaagatacttgcctgctatagtcagggaggcaatcaagaggaaactcaggaccctcatcctagcaccaacacgtgtagtcgcgtcagagatggccgaggcacttaaggggatgccgatcagatatcaaacaacagcggtcaaatctgaacacactggcaaagaaatagttgatttaatgtgccatgcaacttttaccatgcgccttcttagtccagtccgtgttccaaattataacatgattataatggatgaggcgcacttcactgatcctagttctattgcagcacgtggatatatatctactcgtgtaggtatgggagaggctgctgccatttttatgaccgcaacaccgcctggaagcgttgaggcatttcctcaatcaaatgcagtcatacaagatgaagaacgggatatacctgagcgttcttggaatagtggatatgagtggataacagactttccaggaaagactgtatggtttgtcccatcaataaagagtggaaacgatatcgcaaattgcttaaggaaaaatggaaaaagagtgatacaactatccagaaaaacttttgacacagaataccagaaaactaaaaataacgactgggactacgtagtaactactgacataagtgaaatgggcgccaatttcagggctgaccgagtaatagatccaagaaggtgcctcaaacctgtcatacttaaagatggtcctgagagagtaatactcgctggtcctatgccagttaccgtagcgtcagccgcacaacgacggggacgcatcggaagaaaccataacaaagaaggagaccaatacatttacatgggccaacctctaaacaacgacgaggatcatgctcattggactgaagcgaaaatgttgctagataatatcaacactccagagggcataatccctgcattatttgaacccgaaagagaaaagagtgcagcgatagacggggaatatagactaagaggtgaggcaagaaaaacctttgtagaattaatgagacgaggtgatcttcccgtatggctatcatacaaagtagcgagtgaaggcttccaatattccgatagaaggtggtgttttgatggggaacgtaacaatcaagtgctcgaagaaaacatggatgtagaaatatggaccaaagaaggtgagaggaagaaattacgaccacgatggctggacgcacggacctactcagatcctctggctttgcgcgaatttaaagagttcgctgcaggtagacggtcagtatcgggtgatctaattctcgagattggcaaattaccacagcatctaacacagagagcccaaaacgctcttgataatttggtaatgctacacaattcagaacaagggggacgagcatacagacacgccatggaagaattaccggatactatagaaacgctaatgttattagccctcatagctgtgcttacaggcggcgttaccttgttcttcctgtcaggtcgaggactaggcaaaacttctatagggctattatgtgttatggcatctagcgtccttctatggatggcatcagttgagccacattggatagcggcttcaatcacattagagttctttctaatggttctattgattccagaacccgatagacaaagaacgccgcaagataaccagttagcttacgtggttattggcttattgtttatgatccttaccgttgccgcaaatgaaatgggcctgttagaaacaaccaagaaagacttagggataggtcacgtagccgtggagaatcatcatcatgctacaatgttagatgtagacttacatccagcctcggcatggaccctgtacgccgttgcgacaacgataatcactcctatgatgagacacacaattgaaaatactactgcaaacataagtttgactgcaatcgctaatcaagctgccatacttatgggattagacaagggatggccgatatctaaaatggatattggagtgccgttactagctctcgggtgctactcacaagtcaacccacttaccctgaccgcagctgtattgatgttggtagcacattacgccatcatcggacccggcttgcaggctaaagcaacaagggaagcacaaaaacgaaccgcagcaggaattatgaaaaatcctactgtcgacggaatagtagcaattgacttagatcccgttgtatacgacgcgaaatttgaaaagcagttagggcaaatcatgcttttaatattgtgcacaagtcaaatccttctcatgagaactacttgggcattgtgtgaatctatcacgcttgctactggtccacttactactttatgggaagggagcccaggcaagttttggaacacaactatcgcggtctccatggccaacatttttcgtggaagttacttagccggggctgggctagcgttctcattaatgaaatcattagggggaggccgccggggtaccggtgcgcaaggcgaaacactaggcgaaaaatggaaacgacaactcaaccagttatcaaaatcggagttcaatatttacaagaggtcaggtataatggaagttgaccgctcagaagcaaaggagggcctgaagaggggagagacaacaagacacgcagtaagtagagggactgcgaagctaagatggtttgtcgaaaggaatttggttaaaccggaagggaaagtgattgacttagggtgcggtagaggtggctggtcatattattgcgccggtcttaagaaagtaacggaagtaaagggctatacaaaaggagggcccggacatgaggaaccaattcctatggcaacttacggatggaatctcgtcaaattacattcgggaaaagacgttttctttacacctccagaaaaatgcgatacacttctctgtgatattggagagagctcgccaaaccctactatagaagaaggtcgcacactgagggtgttaaagatggtcgaaccttggctacgaggaaatcagttttgtataaaaatcctaaatccttacatgccgtcagttgtagaaactctggaacaaatgcaacgcaaacacggtggtatgctcgtaagaaacccgttgagtagaaatagtactcatgagatgtattgggtctcttgtggaacaggaaatatcgttagcgctgttaatatgacttcacgaatgctgttaaatagattcaccatggcgcacaggaaacctacctatgaacgagatgttgaccttggtgcaggcaccagacatgtcgctgtagaaccagaagtagcaaatttagacattataggacagagaatagaaaatataaagcatgaacacaaatcaacttggcactatgacgaagataatccttataaaacttgggcatatcatggctcttacgaagtgaagccatccggaagcgctagttcaatggttaacggggtggtgaaattattaaccaaaccttgggacgtgataccgatggtaacacaaatcgctatgactgatacgaccccgtttggccaacaaagagtatttaaggaaaaagttgatacgagaacacctaaagcaaaacgtgggacagcacagatcatggaagtaacagcacgctggctttggggatttttaagtagaaataagaaaccacgtatatgtacgagggaggagttcactcgcaaggtgagaagcaacgcagcgataggcgcagtctttgtagatgaaaatcaatggaatagcgctaaagaagccgtagaggatgagaggttttgggaccttgtacagaaagaacgcgaactacacaaacaaggtaaatgtgccacttgtgtatacaatatgatggggaaacgcgaaaagaaattaggcgaatttggaaaagcgaaaggaagtcgagctatatggtatatgtggcttggcgcacgctttctagagttcgaagcattaggatttatgaacgaggaccattggttctcaagagaaaatagtctaagtggagtcgagggggaaggattgcacaaactaggatacatacttcgagacataagtaagataccaggcggcaatatgtacgcagatgacacggcagggtgggatactagaatcacagaagacgatctgcaaaacgaagcaaaaattacggatattatggaaccggaacacgcattactggcaacatcgatttttaagctcacgtaccaaaacaaagttgtaagggtacaacggcctgctaaaaacggaacagttatggacgtcatcagtcgaagagatcaacgaggatctggtcaagtcgggacatacggtttaaacaccttcactaacatggaagcacaactaatacgacaaatggaatcggaaggaatatttctaccatctgaactagaaacacccaaccttgccgaaagagtcctggattggttagagaaatatggcgtagaaagattaaaacgcatggctatatcaggtgacgattgtgtggtaaaacccatagacgatagattcgcaactgccttaacagctttaaacgatatgggaaaggtaagaaaagacattccgcaatgggaaccaagtaaaggatggaatgactggcaacaagtaccgttttgcagtcaccattttcatcaattgattatgaaagacggaagggaaatagtagtaccatgcaggaatcaggatgagcttgttggtcgagccagagttagccagggcgcagggtggtccttaagagaaacagcctgtctaggcaaatcttacgctcaaatgtggcaactcatgtattttcacagaagagacctaagactagcagcaaatgctatttgttcagctgtaccagttgattgggttccgacatcaaggaccacatggtcaatacacgctcatcatcaatggatgactactgaagacatgttatctgtatggaatagggtatggatagaagaaaatccctggatggaagataaaacacatgtatcatcttggggtgatgtcccttatttagggaaaagagaagaccaatggtgcggcagcttgattggacttacagcacgagcaacatgggcctctaacatacaagtagccatcaaccaagtgagaagactaattggaaacgagaattacttagactacatgacgtcaatgaaacgattcaaaaatgaaggagacccagagggagcgttatggtaa

SEQ ID NO: 21733 - RNA, 9879 nt, synthetic construct
  misc_feature 1..9879: note = derived and/or modified CDS sequence (opt6) from DENV-1__GQ199839__SS-prME
  source 1..9879: mol_type = other RNA
agtgtgacaatgttattgatgcttatgccaacagcacttgcgttccacttgacaactcgcggtggagaaccacatatgattgtaacaaaacaagaacgtggcaaatcattactgttcaaaacaagtgctggggtaaacatgtgcacgttaatagctatggatctgggtgagctatgtgaagacacaatgacttataaatgtccgcgaattactgaagcggaaccagatgatgttgactgctggtgtaatgcgacagatacatgggtaacctatggaacatgtagcagaacaggagagcaccgacgcgataaaagatcagttgctctggcgccacacgtagggttgggcctagaaacaagaacggaaacctggatgtcaagcgagggagcatggaaacaaattcaaagagtagagacctgggcgttgagacaccctggctttacagtcatcgcgttgttcttagcacatgctataggaacaagtataacacaaaaaggtatcatattcatacttctgatgttggtcacgccaagtatggcgatgagatgcgtaggcataggatcacgggacttcgttgaaggactatcaggagctacgtgggtagatgtagtactagagcacggttcttgcgttactaccatggcaaaagacaaaccgacattagatattgaattactaaaaaccgaagtcaccaatcccgcggtactaagaaaattatgcatagaagcgaaaattagtaatactactacagactcaagatgtccgactcaaggagaagcaacattaatggaggaacaagatgcaaactttgtatgcagaaggacatttgttgacagaggatggggaaatggctgtggcttgtttggtaaaggtagcctaataacatgtgctaaatttaaatgtgtgacaaaattagaagggaaaatcgttcaatacgaaaaccttaaatatagcgtgatagtaaccgtccatacgggcgatcaacatcaagtcgggaacgaatcaacagaacatggcaccacagccactataactcctcaagcgccgactagcgaaatacaacttacagactacggcgccttaactttggactgcagcccgagaacaggtctagatttcaatgaaatggtgttgctaactatgaaagaaaaatcatggcttgtacataaacaatggttcctagacttaccattgccgtggacttcgggagcgtcaacttcccaagaaacgtggaaccgacaggacctactcgtgactttcaaaactgcccacgccaagaaacaggaggtagtagttcttggttcccaagagggcgcaatgcacacagcacttaccggcgccaccgaaattcaaacaagtggaacgactacgatctttgcaggtcatctgaaatgcagattaaaaatggataaattgactttaaaaggtatgtcctatgtgatgtgtacggggtcgtttaaacttgaaaaagaagttgcagaaacccaacatggaactgtattggtgcaaattaaatatgagggaacagacgcaccatgtaaaatccctttctcaacgcaagatgaaaaaggtgtgacccaaaatggaaggctgattacagcaaacccgatagtaaccgataaagaaaaaccagtcaacatagaagctgaaccaccttttggtgagtcttatatagtgataggggccggagagaaggctttgaaactttcatggttcaagaaaggatcatcaatagggaagatgttcgaagcgaccgcccgcggagcgcggagaatggcgatacttggagacacagcgtgggactttggatcgatagggggcgttttcaccagcgtgggcaagctagtacatcaaattttcggaactgcttatggagttctctttagcggtgtaagttggacgatgaagataggaataggagtcttattaacatggttaggcctaaattcccgcagcacatcattgtctatgacttgcatcgctgttgggctagtcacactatatctgggcgtaatggtgcaggccgattccggatgtgtaatcaattggaaaggccgagagcttaaatgtggtagcggtatcttcgtaacaaacgaagttcacacatggaccgaacagtataaatttcaagctgatagcccgaaaaggctctcagcagcaatcggaaaagcgtgggaagagggtgtatgtggaattagaagcgctacacgattagaaaatatcatgtggaaacaaattagtaatgaactgaatcatattttgcttgaaaacgggcttaaatttactgttgtggttggtgatgttgttggaatcctggcacaaggaaagaaaatgataagaccacaaccgatggagcacaaatatagctggaaatcttggggaaaagcgaaaatcataggggccgacgtccaaaacacaacttttattatagacggacctaacacacccgaatgccccgatgatcaacgagcatggaacatttgggaggtggaggattacggtttcggcatctttaccactaacatatggcttaaattaagagacagttatacccaagtctgcgatcatcgactaatgagtgcagctattaaagatagtaaagcagtgcatgctgacatgggttattggatagaatcggagaaaaatgaaacatggaaactagcaagagcttcatttatagaagttaaaacttgcatatggccaaagagtcacaccctgtggagcaacggagtattagaaagcgaaatgattattccaaaaatatacggcggtccaatcagccaacacaattataggccaggctatttcactcaaacagcaggcccgtggcatcttggtaaactcgaattagattttgatttgtgcgaagggacaacggtagttgtagacgaacactgtggaaatcgaggaccatccctcagaacaacgactgtaacggggaagattatacacgagtggtgttgtagatcatgcacattgcccccattaagatttaaaggtgaggatggatgctggtacggaatggaaatccgacccgtaaaagaaaaagaagaaaatctagtaaagagtatggtcagcgccggaagcggggaagtagattcctttagtctcggattactatgcaccagcatcatgatcgaagaggtcatgagatcaaggtggtcgagaaaaatgttaatgacaggaacactagctgtatttttactactgattatgggccaattaacatggaatgatctcattaggttatgcataatggtaggtgccaatgcatccgataggatgggaatgggaacaacttacttggcactcatggctacctttaagatgagaccaatgttcgctgtaggacttttatttcgtagattaacgtctagagaagtgctccttctcactattggactctcgcttgtcgctagtgtagaactaccaaattctctcgaagaattaggagacggactcgcaatgggcataatgatcttaaagctacttaccgatttccagtcacatcaactttgggcgacgctcttaagtctaacgttcatcaagacaactttaagcctacactatgcatggaaaacaatggcaatggtgcttagtattgttagtctttttccactttgcttgagcaccactagccagaaaacaacgtggttacccgtattgttaggaagtctcggttgtaaaccgcttacaatgtttctcattgcagagaataaaatatggggccgtaagtcctggcctttaaatgaaggcataatggccgtcggtgtggtcagcatattactctccagtttattaaagaatgacgttcccctcgcaggaccactaatagctgggggaatgctgattgcttgttatgtcattagtggctcaagcgccgatctctcgcttgaaaaagccgcagaagttagctgggaggaggaagcagaacatagtggcgccagccacaatatatttgttgaagtacaagatgatggtacaatgaaaattaaagatgaagaaagagacgacacactaaccatcctactgaaagcgactctactcgcggtcagcggagtctaccccctctcaataccggctaccctattcgtctggtacttttggcaaaagaagaagcaacgctcaggtgtattgtgggacactccttcaccgccggaggtggaacgggcagccctagacgatggcatctaccgtatcatgcagagggggcttctaggaagaagtcaagtaggggtaggagtatttcaggaaaacgtatttcataccatgtggcacgtaacacgtggtgcagttttgatgtaccaaggaaagcgactggagccttcctgggcatcggtcaagaaagatcttatttcctatggaggtggctggcgattacagggtagttggaacaccggtgaagaggttcaagtaattgctgtagagccgggaaagaatcctaaaaatgtacaaacagcgcctggcacattcaagacaccagagggagaagtgggggccatagcacttgatttcaaacctgggacttcaggctcgccaatagtaaatcgcgaagggaaaattgtaggtctttacggaaacggagttgttactaccagtggaacgtatgtgagtgcaatagcacaaaccaaagcatctcaagaggggcccctaccagaaatagaggatgaagtattccgaaaaagaaacctaacaataatggatttgcacccaggtagtggcaaaacacgcagatacttaccagccatagtacgggaagctatcaaaaggaagctaagaacgttaatactggcaccgacccgagtcgttgcatcagaaatggccgaagcacttaaagggatgccaataaggtatcagacaacagctgtaaagagtgaacataccggaaaagaaatagtcgatctcatgtgtcacgctacatttaccatgaggcttttatcgccagtcagagttccaaattataacatgataattatggatgaagctcatttcactgatccgagcagtatagctgcgcgcgggtatatatctactagagttggcatgggagaagctgcagccatatttatgacagcgacccctccaggatcagttgaagcatttcctcaaagtaatgctgtcatacaggacgaagaacgagacataccagaaaggtcatggaactcgggatatgaatggataacggactttcccggcaagactgtatggtttgtaccgtccataaaaagtggcaatgatattgcgaattgtctaaggaaaaatgggaagagagtaattcaactcagtcgcaaaaccttcgacacagaatatcaaaagaccaaaaataatgattgggattatgttgtcacaactgatattagtgagatgggagcaaactttagagcggaccgcgttatagatcctagaaggtgcctcaagcctgtaatactaaaagacggaccggaacgagttatcttagccgggccaatgccagttaccgttgcaagcgcggctcagcgtcgaggtagaattgggagaaatcacaataaggagggcgatcaatatatatatatgggtcagccattaaacaatgacgaagatcatgcacattggacggaagcgaagatgctgttagacaacataaacaccccagaaggcatcattccggctctgtttgaaccagaaagagaaaaatccgccgctattgatggagaatacagactccgtggagaagcacgaaaaacttttgtagaattaatgagacgtggggatctgcctgtgtggctatcgtacaaagtagcgtcagaagggttccaatactcagatagacgttggtgcttcgacggagagaggaataaccaagtgttagaagagaatatggatgtagaaatctggacaaaagaaggagaaaggaagaaacttcgaccgagatggctagacgcgcgaacatattcagatccactcgctctacgtgaatttaaggaatttgcagcaggacgtcgatcagtgtccggagatctcatccttgagattggaaagctccctcaacatttgacacagagggcgcagaacgcattagacaacttggtaatgcttcacaattcagagcaaggaggcagagcgtatagacatgctatggaagaactccctgatacaatagaaaccctaatgttattagcactcatcgctgtcctaacaggaggcgtcaccttattctttctgagtggtcgaggattaggcaaaacatcaatcggactcctatgtgtaatggcgtcctccgttttattatggatggcctcagtagaaccgcactggattgcggctagtataattttggaatttttcctaatggtgctattaataccagagccagatcgtcaaagaactccgcaagataatcagttagcatacgtagtgataggtcttctgtttataattctcactgtcgctgctaacgaaatgggtctactagagactactaagaaagatttaggtattggacatgtagccgttgaaaatcatcaccacgcgacaatgttagacgtcgacctgcatcctgcctcagcctggacactctacgccgtagctactactataataacgccaatgatgagacatacaattgaaaacacaacggcgaatattagcttgactgcgatagcgaatcaagcagcgatacttatggggttagataaaggttggccaataagtaaaatggacataggagtacccctacttgcgctaggctgctattcacaagtaaacccacttacattgactgccgcggtgttgatgctggtagcgcactacgcgataataggcccaggcttacaagctaaagcaactagagaagctcagaaaaggactgcggcaggaattatgaagaatcccacagtcgatggtattgttgctattgatctggacccggttgtatatgatgcgaaatttgagaaacaactcggtcaaataatgctccttatactttgcacaagccaaatcttgttaatgcgaacaacctgggcattatgcgagtcaataacccttgcgacagggccactaactactttatgggaaggttcaccgggtaagttctggaataccacaatagcggtatctatggcgaatatctttaggggtagctatttagcaggcgccggattagctttctcacttatgaagtcgctagggggaggaagaaggggtacaggtgcacaaggtgaaacattgggtgaaaaatggaaacgacaattaaaccaactaagtaaaagcgagttcaacatatacaaacgatccgggataatggaagtggacagaagcgaggctaaagaaggtttaaagcgaggagaaactacaagacatgccgtaagtagaggtactgccaaattacggtggtttgtcgagcgcaatctagtcaaaccagaaggaaaagtcatcgatctcggatgtggccgaggaggatggtcttactactgtgctggactaaagaaagtaacagaagtaaagggttatacaaaaggaggtccaggccatgaagaaccaataccgatggcaacatatggctggaatctcgtcaaactccactctggtaaagatgtgttctttacaccaccagagaaatgtgacacactattatgcgatatcggtgagagttcaccaaatcctactattgaggagggtaggaccttacgagtcctaaagatggttgagccatggctgcgtggtaatcaattttgcataaaaatactaaatccttacatgccatcagttgtagaaacactagaacagatgcagagaaagcatggcggaatgctagtccgtaatccactttcacgtaacagtacccacgaaatgtattgggtgagttgtggaacgggtaacatagtatcagctgtaaatatgacgtctcgaatgttattaaatcgcttcactatggcacataggaagccaacatatgagagggacgtcgatttaggagcaggcacacgtcacgtagcagtagaaccggaagtcgcaaatttagacataattggccaaagaatagaaaacattaaacacgagcataaatcaacatggcactatgatgaagataacccttacaagacatgggcatatcatggatcatatgaggtaaagccaagcggcagtgcaagtagtatggttaatggtgtagtaaaacttttaacaaaaccttgggacgtgattccgatggtaactcaaattgctatgaccgataccacacctttcggacaacaacgggtttttaaagaaaaagtcgatactcgcacaccgaaggcaaagagaggaactgcgcaaatcatggaagtaacggctaggtggctctggggatttctttcaagaaataagaaaccgaggatatgtacgagagaagaatttacaagaaaagttagatcaaacgcagcaataggagcagttttcgttgacgaaaatcaatggaatagtgcgaaagaagctgtagaggatgagaggttctgggatctagtacaaaaagagagggagttacataaacaaggcaaatgtgcgacttgtgtgtacaatatgatgggaaagcgagagaagaaactaggtgagttcggtaaagcaaaaggaagtcgagctatatggtacatgtggttaggagcaagattcttagagtttgaagcattaggctttatgaacgaagatcattggttttcgagagaaaattctttgtcaggcgtagaaggtgaaggccttcacaaacttgggtacatattacgtgacatatccaaaatacctggtggaaatatgtatgccgatgatacagcaggttgggataccaggataacagaagatgatctccaaaacgaagcaaaaataactgacataatggaaccagaacatgcattgttagcgacttcgatattcaaattaacataccaaaacaaagtagttagggtacaaagacccgccaaaaatggcaccgtgatggacgtgataagccgaagagatcaacggggttcgggacaggttggtacttacggattaaataccttcacaaatatggaggcccaactgataagacagatggagtcagaaggtatattcctgccgtccgaacttgagacaccaaatttggctgagcgagtattagattggctagaaaaatatggggtggaaaggctaaaaagaatggcaatctcgggggacgactgcgtcgtcaaacctatagatgatcgatttgctactgcactaacggcgctcaatgatatggggaaagtaagaaaagatatcccccaatgggaaccgagcaaaggatggaacgattggcaacaggtcccattctgttcccaccattttcaccagttaataatgaaggatggaagagagatcgtagttccgtgtcgtaaccaagatgaactggtcggacgagctagggtttctcagggtgctggttggagtctacgggaaactgcatgtttaggcaagagctatgcgcaaatgtggcaactaatgtacttccatagaagggaccttagactggcggcaaacgcaatatgcagtgcagttccagtagattgggtacctacaagtaggaccacatggtcaatacacgctcatcatcaatggatgaccacagaagacatgttaagtgtttggaatagagtttggattgaagaaaacccatggatggaagacaaaacccacgtttccagctggggcgatgtaccatatcttggaaaaagagaagaccaatggtgcggcagccttataggactaacagcacgtgctacatgggcgagcaacattcaagtagcgattaaccaagtacgaagactaatcggtaacgagaattacctagattacatgacgtccatgaagagatttaagaacgagggagatcctgaaggtgctctatggtaa

SEQ ID NO: 21734 - RNA, 9879 nt, synthetic construct
  misc_feature 1..9879: note = derived and/or modified CDS sequence (opt6) from DENV-1__FJ898397__SS-prME
  source 1..9879: mol_type = other RNA
tctgtaacaatgttgctaatgttaatgccaacagccctggcattccatttaaccataagaggaggagaaccacatatgatagtttctaaacaagaaagagggaaatctttgttatttaaaacaagtgcaggagtgaacatgtgtactttaatagcaatggatctaggagaattttgcgaagatacaatgacatataaatgtccaagaatcactgaagctgagcccgatgacgtcgactgttggtgtaatgcaactgatacatgggtcacctatggaacttgcagccaaacgggtgaacatagaagagataaacgttctgttgcgctggcaccacatgtaggtttaggattggaaaccagaacagaaacttggatgagctcagaaggggcatggaaacaaattcaaagagtcgagacttgggctctaagacatcccggatttacagtaatcgcactatttctagcacacgctatcggaacatcaattacacaaaaaggtattattttcatactattaatgcttgttactcccagtatggccatgcgatgcgtaggtattggtagtagagattttgtcgaaggactaagtggtgcgacatgggtggacgtagtacttgaacatggtagttgcgtcaccactatggcaaaagataaaccgaccttagacatcgaattactaaaaactgaagtcactaatccagccgtactgagaaaattatgcatagaagcgaaaataagtaatacgacgacagattcaagatgtcctactcaaggggaagccacattagtggaagaacaagatgcaaactttgtttgtcgtagaacatttgtggatagaggttggggaaatggttgtggacttttcggtaaaggatcactaataacgtgtgctaaattcaaatgcgtcacgaaactggaaggaaaaatagtacaatacgaaaaccttaaatacagcgtaatcgtaactgttcatacaggggaccagcatcaagtaggtaatgaaagtactgaacatggaactacagccacaattacaccacaggcaccatctacggagatccaattaaccgattacggggctcttactctggattgctccccacgaacagggttagatttcaatgaaatggtcttattaacaatgaaagagaaaagttggctagttcataagcaatggttcttagacctaccactcccctggacatcgggagctagcaccagccaagaaacatggaatcgtaaagatcttttagtcacatttaagacggcgcacgcgaagaaacaagaagtagttgtcttagggtcacaagaaggagctatgcacacggctctcactggtgcaactgaaatacaaacaagtggaactacaactatctttgcaggtcacttaaaatgcagactaaaaatggacaaattgacgctcaagggaatgtcatatgtaatgtgtacggggtcatttaaactagagaaagaagtggcggagacacagcacggaactgtccttgtacaaataaaatatgagggtacagatgctccgtgtaaaataccgttctccacacaggacgaaaagggcgttacacagaatgggcgactcattacagcaaatcccatagttacggacaaagaaaaacctgttaacatagaagcagaaccgccgtttggggagtcatatatagtgataggagccggagagaaagccctgaaactgtcatggtttaagaaaggatcaagcattggaaaaatgttcgaagcgacggcgagaggagctcgccgaatggcaattctaggtgatactgcatgggactttggctcaattggtggagtgtttactagcgttggtaaattagtacatcaaatattcggtacagcttacggtgtcctattctcaggcgtaagttggacaatgaaaatcgggatcggtgttttactaacgtggttgggactaaatagtagatcaacctcactatccatgacatgcatagccgtaggactcgtaacgctttatttgggggtaatggttcaagcagactcaggatgcgtaataaattggaaaggacgtgagttaaaatgtggaagtggtatattcgtaactaatgaagtacacacatggacagaacaatacaagttccaggcagattcaccaaaaaggctttcagcagctatagggaaggcttgggaggaaggtgtgtgcggaattaggagtgcaactagattggagaatataatgtggaaacaaatctcaaacgaactcaaccacatcctactagaaaacgacatgaaatttacagtcgttgtaggggacgtagccgggattttagctcagggcaagaaaatgataagacctcaaccgatggagtataaatatagttggaaatcgtggggtaaagctaaaataatcggagcggacgtacagaacaccacgttcatcatagacggacctaatacgccagaatgcccagacgaccagagggcatggaacatctgggaagtcgaagactacggttttggaatctttactacaaatatttggttaaaacttagagattcatacacgcaagtgtgcgatcaccgtctcatgtccgctgctataaaagattcgaaagctgtccacgcagacatgggttactggatagaatcagagaaaaatgaaacatggaaacttgcaagagcgagtttcatagaggtaaaaacgtgcatctggccaaagagtcacacactatggtcaaatggcgtgctagaatcagaaatgattatcccaaagatatatggtggtccaatttctcaacacaattatcgaccaggttatttcacgcaaacagcaggaccatggcatttagggaagctcgaactagattttgatctatgtgaaggaacaacagtagtggtcgacgaacattgtggaaatagagggcccagcttacggacgacaacggtcacaggcaagattattcatgaatggtgttgtcgaagttgtacattaccacccttaagatttaaaggagaggatggatgttggtacggtatggaaatcagaccagtcaaggaaaaagaagaaaacctagtaaaaagtatggtcagcgctggatcaggcgaggtggacagtttttctttggggctcctatgcatatctattatgatcgaagaggtgatgagatctagatggtcaaggaagatgcttatgacagggactttagcagtatttttcttgctgataatgggacaactaacttggaatgatcttataagactttgtataatggtgggtgctaatgcgagcgatagaatgggaatgggaactacttatttagctctaatggctacttttaagatgagaccaatgtttgctgtaggtcttctattccggcgattaaccagtagggaagtcctactcttaacaataggtttatcacttgtggcaagtgtagagttaccaaattccctcgaggagctaggagacggattggccatgggaatcatgatactgaaactattaacagatttccaatcccatcaactttgggcgactttattaagtctaacgttcataaaaaccacgttttctcttcactacgcatggaaaaccatggcaatggttttatcaatcgtgtcactttttcctttatgtctatctacgaccagtcagaaaacaacatggctgcctgtattgctcggtagtttaggttgcaaaccactcacgatgttcttaatcgcggagaataaaatatggggccgaaaatcttggcctttaaacgaagggatcatggcggtcggaatagtgtctatattattgtctagcctactcaaaaacgacgtcccattggcgggccctctgattgctgggggaatgttaatagcctgttatgtaatatctggtagctctgcagacctatcattagaaaaagcagcagaagtgtcttgggaagaagaagcagaacattctggtgcttcgcataatatcttggttgaagttcaagatgatggaacaatgaaaataaaggacgaggagagagatgacacattaacaatactactcaaagcgactctattggccgtaagtggcgtatatcccctatcaattccagcgacgttatttgtgtggtatttctggcaaaagaagaaacaaagaagcggcgttctttgggatactccatcgccgccagaagttgaaagggcagtactggatgacggcatctacaggatcatgcaaagaggtctattgggtaggtcgcaagtgggcgtcggcgtttttcaggaaaatgtttttcacactatgtggcacgtaacgcgtggcgcagttttaatgtatcaaggcaaaaggctagagccaagctgggcatcagtaaagaaggatctaatttcttacgggggaggctggcgtttgcaaggaagttggaatactggtgaagaggtacaagttattgcagtcgaaccaggcaaaaatccgaaaaacgttcaaacagccccgggtacgtttaaaacgtcggaaggagaggtcggagcaatagctctagactttaaaccagggacatccggaagcccgattgtaaacagagaggggaaaatagtagggctatatggaaacggtgttgttacaactagcggcacttatgtaagtgcaattgcccaggcaaaagcctcacaagaaggtccactgccagaaatcgaggacgaagtatttcgtaagcgaaatttgacgataatggacctacatcccggctcaggaaaaaccagaagatatttgcccgcaatcgttagggaagcgataaaacgaaaactaagaacgctaatattagcgccaacaagagtagtcgccagcgaaatggccgaagctctaaaaggtatgccgataagatatcagacaaccgcggtaaagagtgaacataccggtaaggaaatagttgacctaatgtgtcatgcaacgtttactatgaggttattatcaccagtgcgagtacccaactacaacatgattattatggacgaggcacacttcaccgacccgtcttcgatagcggccaggggctacatcagtaccagagttggcatgggcgaagcggcagcaatatttatgacagcgacccctccaggctccgtggaagcattccctcaatccaatgcagtaatccaagatgaagaaagggatattcctgaacgttcttggaatagcggttatgaatggataactgactttccaggaaaaacagtatggtttgtaccctcaataaagtctggtaatgacatcgcaaattgtttgaggaaaaacggaaaaagagtaatacaactatcgagaaaaacctttgatacagagtaccagaaaacgaaaaacaatgattgggactacgtcgttacaacagatatttcagagatgggagccaattttagagcagatcgagtcatcgatccgagacgctgtctaaaaccagtaattttaaaagacggtcccgaaagagtcatcttggcgggaccaatgccagtaactgttgcctcggcggcccaaaggagaggcaggataggtagaaatcataataaagagggagaccaatacatatatatggggcaacctttgaataatgacgaggaccatgcccactggacagaagctaaaatgcttcttgataatattaacacacctgagggaattatcccagccttatttgaacccgagagagagaaaagcgctgcaatagacggcgaatacagactacgtggcgaagcgagaaaaactttcgttgaactaatgaggcgcggggacctacccgtttggctatcttacaaggtagcgagtgagggctttcagtacagtgatcgaaggtggtgctttgatggcgagaggaataaccaagtgctggaagaaaacatggatgtggagatctggacgaaagaaggggaacgcaagaaactgagaccgagatggctagatgcaagaacgtatagtgatccgttggccttaagagaatttaaagagtttgcagcggggcgaagatctgttagtggtgatttaattctagaaataggaaaacttccacaacacttaacacaacgcgctcaaaatgctttagataatctagtaatgctacataatagtgaacagggtggaagggcctatcgacatgccatggaagaacttcccgatactattgaaacattaatgttattggctcttattgcagtgttaacaggtggagttacgcttttctttttgtctggaagggggttgggaaagacatcaataggactgttgtgtgttatggccagctcggttcttctatggatggcgtctgttgaaccacactggatagctgcatcaataatactcgagttctttttaatggtgttacttattccggaaccggacagacaaagaactcctcaagataatcaactcgcgtatgtagtaattggacttttatttatgattttgacagtggccgctaatgaaatggggttactcgaaaccacaaagaaagatttagggatcggacacgttgcagttgagaatcatcatcatgcagcgatgctagacgttgacctacaccctgcaagtgcatggactctatatgcagtagctacaacgatcataacacccatgatgaggcatactattgaaaatactacagcaaatatcagtttaacggctatagcaaatcaagcagcaattctgatgggtcttgacaaaggatggcctatctccaaaatggatataggagtaccgctcttggcactaggttgttatagccaagtcaatccattaacactcactgctgcggttctaatgttggtagcacactacgccataataggacccggccttcaagctaaagctactcgtgaagcacagaaaagaactgccgctgggataatgaaaaatccaactgtagacggaattgtagctatagatcttgaccccgtggtatatgacgcgaagtttgagaaacaactaggccaaataatgcttttaattttgtgcacctcacagatacttctcatgaggacaacatgggccctttgtgaatcaataacactggcaacaggaccgcttactaccctatgggaagggtcaccaggtaaattttggaatacaactatagcggtctcaatggcaaatatattccgggggtcatatttagctggggcaggcttagcattctctttaatgaaaagcctcggagggggccgaagaggaacgggagcacaaggagaaacactaggagaaaaatggaaaagacagctaaaccaactttcgaaaagtgaatttaatacatataagcgaagcgggattatggaggtagacaggtcagaagcgaaagaaggactaaaacggggtgaaacgaccaaacacgcagtcagtagggggaccgcaaaactcagatggtttgtagagcgcaatctagtgaagccagaagggaaggtaatagatctaggttgcggacgcggtggttggagttactattgcgctgggctcaagaaagtgactgaagtaaaaggatatacaaaagggggtccgggtcatgaagaaccaattcccatggccacgtacgggtggaatcttgtaaaacttcattctggaaaggatgtattcttcataccgccagaaaaatgcgatactttgctctgcgatataggcgaatcaagcccaaatcctacaatcgaggaaggaagaaccttacgtgtcttgaagatggtagaaccttggctacgaggtaatcaattttgtataaaaatactaaatccgtatatgcctagcgtagtagaaacactcgaacaaatgcaaagaaagcatggcggcatgcttgttcgaaatccgttatctagaaacagtacccatgaaatgtattgggtcagttgcggcacaggtaacatagtatcagccgtgaatatgacaagcagaatgctcttaaatcgttttactatggcacaccgcaaacccacttatgaaagagatgttgaccttggggcggggacaagacacgtagccgttgaacctgaagttgcaaacttagacataatcggacaacgtatagagaacataaagcatgaacataaaagcacctggcattatgacgaggacaacccatataaaacctgggcatatcacggtagctatgaagttaaaccaagcggttcagcatcaagtatggttaacggagttgtcaaacttttaaccaagccgtgggatgttataccaatggtaacacaaattgcaatgacagatacaactccatttggacaacaaagagtatttaaggaaaaagtggacaccaggacacccaaggcgaaacgcggcactgcccaaatcatggaagttacagcaaagtggctgtggggatttctatcacgtaataaaaagccacggatttgtacgcgggaggagtttacaaggaaagtaaggtcgaatgcagcgattggggctgttttcgtagatgaaaaccaatggaatagtgcgaaagaagcggtggaagatgaaagattctgggatctggtacatcgtgaaagagaactacacaagcaaggaaagtgcgcaacgtgtgtgtacaacatgatgggtaaacgagagaagaaactcggtgagtttgggaaagcaaagggatcaagagccatctggtacatgtggttaggtgccaggtttcttgagttcgaagctcttggatttatgaacgaagatcactggttttcccgggaaaactctttatctggagttgagggtgaaggactacataagctaggatatatattacgagacatttctaaaataccgggtggaaacatgtatgcagatgatacggctgggtgggatacacgaataaccgaagacgacctacagaatgaagcgaaaataactgatattatggaaccagagcacgccttattggctacaagcatttttaaacttacatatcaaaataaagtggtaagagtacaacggccagcgaaaaatggtacagtgatggacgtaattagccggcgagaccagagaggtagtgggcaggttggaacatacgggttgaatacattcactaacatggaagcgcaattaattcgccaaatggagtcagagggtatatttagtccctcagaactcgagacgcccaaccttgcaggaagagttttggattggcttgaaaaacatggggtagagaggctcaaaagaatggcaatatcgggtgacgattgtgtagtgaaaccaatcgacgaccgatttgcaaccgcactcaccgcactaaacgacatgggcaaagttaggaaggatattccgcaatgggaaccgtcaaaaggatggaatgactggcagcaagttccgttctgttcccatcactttcaccaactgataatgaaggatggaagagaaatagtcgtaccatgccgaaatcaggatgagttagtaggtagagcaagggtatcccaaggagcaggttggagtctgagagaaactgcttgcctagggaaaagctatgctcaaatgtggcaattaatgtattttcatagacgcgacctcagacttgctgcaaacgccatctgtagtgcggtgccagtggattgggttccaacgtcacgaacgacgtggagtatacatgcacatcatcaatggatgaccactgaagatatgttgagtgtatggaaccgagtttggattgaagaaaatccatggatggaagacaaaacgcatataagtagttggggagatgtaccgtacctgggtaagcgtgaagaccaatggtgtggtagtttgataggactaacggcgagagcgacatgggcaacaaatatccaagtggccataaaccaagtacgtagattaattggaaacgagaattacttagattatatgacaagtatgaagaggtttaagaatgaaagcgaccctgagggtgcattgtggtag

SEQ ID NO: 21735 - RNA, 9879 nt, synthetic construct
  misc_feature 1..9879: note = derived and/or modified CDS sequence (opt6) from DENV-1__FJ898398__SS-prME
  source 1..9879: mol_type = other RNA
tcagttactatgctacttatgctaatgcccactgcattagcgtttcatctaacaacgagaggcggggagccacacatgatagtctcaaaacaagaaaggggcaaatccctattatttaaaacaagtgcgggagttaacatgtgcactttaatagctatggacttgggcgaattttgcgaagacacaatgacatacaaatgtccgaggataacagaagcggaacctgacgacgtagattgttggtgcaatgcaactgacacgtgggttacatacggcacttgcagccaaacgggggagcatcgtcgtgacaaacgtagtgttgcattagctccacatgtcggattgggattagaaacaagaaccgaaacatggatgtcttcagaaggtgcatggaaacaaatacaaagagtagaaacatgggctcttaggcatccaggatttactgtaatcgcgctattcctcgcacatgcaatcggaacaagcattacgcaaaaggggataatatttatattactaatgctcgttacgccatccatggctatgcgttgtgttggcattggatcacgtgattttgtcgaaggtcttagtggagcaacatgggtagatgtagtgttggagcatgggagctgcgtaacaactatggcaaaagataaaccaacgcttgacattgagctattaaaaacggaagttaccaatcctgctgtgttgaggaaattatgtatagaagcaaaaataagtaatacaaccacagattcacgatgccccacccagggagaagctacattagttgaagaacaagacgctaattttgtatgcagaaggacattcgttgaccgtggatggggtaacggatgtggcttatttggtaagggtagtttaatcacctgtgccaaatttaaatgcgtcactaaactagaaggaaaaatagtccaatatgaaaacttaaaatacagcgtcattgtcactgtccacactggcgaccaacatcaggtgggtaacgaaagtacagagcacgggactacagcgaccataacaccacaggcaccgagcactgaaatccaactaacagattatggtgccctaacacttgactgcagtccacgaacaggtctagatttcaacgaaatggtcctcttaacaatgaaagaaaaatcgtggcttgttcacaaacaatggtttcttgacttacctctaccctggaccagtggggcatcaacatcacaagaaacgtggaacagacaggacttgttggttacatttaaaaccgcacacgccaagaaacaggaagtcgtggtcttaggatcacaagaaggcgcaatgcacactgccttaacaggagcaactgaaatccaaacttcaggtactacgaccatctttgcgggacacctcaaatgtagattaaaaatggataaattaacattaaaaggaatgtcatatgtaatgtgcactggtagctttaaacttgaaaaagaagtagccgaaacgcagcatggcacagtattagtccaaattaaatacgaggggacggacgcgccctgcaaaataccgtttagtacgcaagacgagaagggagtaacccaaaacggtagattaataacggccaatccaattgtaacggacaaagaaaaaccagtaaatatagaggctgaaccaccctttggcgaatcatacatagtgatcggcgcaggcgaaaaagcgttgaaattatcctggtttaagaaaggttcatctattggaaaaatgtttgaagctacagcaaggggtgcccgaaggatggccattctaggagatacagcatgggactttggctccattggcggagtgttcacaagcgttggtaaattggttcaccaaatctttggtactgcctatggcgtactctttagtggcgtcagctggacaatgaagatcggtattggcgttctgctcacctggttgggactaaattcacgatctacatccttaagtatgacttgcatagccgttggcttagtgaccctctacttgggggtcatggtgcaagcagattcgggatgcgtaattaactggaaaggtcgcgaattaaagtgcgggtcaggaatatttgtcacaaacgaggtacacacctggaccgaacaatataagtttcaagcagattcacctaaaagattaagtgctgcaataggaaaagcatgggaagaaggagtatgtggcataagaagtgcaactaggctagaaaatattatgtggaaacagatctcgaatgagctcaatcacatcttgcttgaaaatgatatgaaattaacagtagtcgtcggagacgtagccggtatcctagcacaaggtaaaaagatgattcggcctcagcccatggaatacaagtatagctggaaaatctggggaaaagccaaaataattggtgcagacgttcagaatacgacatttattatagatggacctaatacacctgagtgtccagacgaccaaagagcttggaatatatgggaagtagaagattatggatttggaattttcacaacaaacatctggctaaagttgcgagattcttatacacaggtttgcgatcatcgactgatgtctgctgcgatcaaagattctaaagcagtccatgccgatatgggctattggatagaatccgagaaaaatgaaacctggaaattggctagagcctcatttatagaagtcaagacgtgcatttggcccaaaagtcatacactttggtcaaatggagtattagaatcggagatgataattccaaaaatatatggcggacctatcagtcagcacaattaccgtcctggatactttactcaaactgctggaccttggcatcttggcaaattagaattagactttgatctctgtgaaggtactacagtagtggtagatgaacattgtggtaatagggggccaagtctgagaacgacgaccgtaacagggaaaataatacacgagtggtgctgccgatcatgtacattaccgcctttaagattcaaaggagaagatgggtgttggtacgggatggaaattaggccagttaaagaaaaagaggaaaacctagtcaagtcaatggtcagtgcgggcagcggggaagtcgattcgttctcacttgggttactatgcatatcaattatgatagaagaagttatgagatcaagatggtcaagaaaaatgctcatgactggcacgttggcagtcttctttctgcttatcatgggacaactcacatggaatgatcttattagattatgtataatggtcggagccaatgcatcagatcgcatgggcatggggaccacctatctagccctaatggctacctttaaaatgagaccaatgttcgctgtaggattactattccgacgactcacaagccgtgaagtgttactgttaacaataggacttagtttagttgcatccgttgaacttcctaactctctagaagaactcggcgacggtctagcgatgggtatcatgatcttaaaattattaacagatttccagtcacaccaattgtgggcaacgttattatctttgacctttatcaggactactttttcattacattatgcatggaaaacaatggctatggtactatcgatagtctctttatttcccttatgtctttctacaacctcccaaaagacaacttggttaccagtcttattaggatccttaggttgcaagcctcttacaatgttcttaattgcagagaacaagatatggggtcgtaaatcttggcctctcaatgaaggaataatggcggtgggtatcgtgtctattcttttatcaagcctcctcaaaaacgacgtaccactagccggacccctaatagcgggtggaatgctaatagcttgctatgtaataagtggatccagtgcagacctatcattggaaaaagcagctgaagtcagttgggaagaagaagcagaacactccggcgcgagtcataacattctagtagaagtacaagacgatggtaccatgaaaattaaagacgaagaacgggatgatactctaacaattctattaaaagcgactttacttgccgtctcaggagtctatcctttatcaatcccagccacgctattcgtgtggtacttctggcagaagaagaaacaacggagcggagtgttatgggatactccatctccaccggaagttgagagagcagttctagacgacggtatatatagaataatgcaacgaggattattagggagatctcaagttggagtcggagttttccaagagaatgtatttcatactatgtggcatgtaactcgcggagcagtactgatgtatcaaggaaagcgactagagccgtcgtgggcaagtgtaaagaaagacctcatctcttacggcggcggctggcgacttcaagggtcatggaatacgggtgaagaagtacaggtaatagctgtagaaccagggaaaaaccctaaaaacgttcagacagctccaggaacttttaaaacaagtgagggtgaggtgggtgcaatcgctttggattttaaaccaggcacatctggctccccaatagtaaatcgagaaggaaaaatagtaggactatacggtaatggagtggtaacaacatcaggaacttatgtatccgcaattgcacaggctaaagcatctcaagaagggccgctaccagagatagaagatgaagtcttccgaaaacggaatctaactataatggacttacatccaggaagtggaaagacacgacgatatcttcctgcaatagttagagaagcaataaaacgacggttgcggactcttatcttagccccaacgagagtagttgcttctgaaatggctgaggcattaaaaggaatgccgatacgttaccagacaacagcagttaaatcagaacatactggaaaggagatagtggacttaatgtgccacgctacattcacaatgcgactattaagtcccgtgagagtacctaattataacatgataataatggatgaggcacacttcacggacccttcaagtatagcggcaagaggctatataagtacacgagtcggaatgggtgaggcggcggcaatatttatgacggcaacaccgccaggaagtgtggaagcgtttccacaatcaaacgcagtaattcaggacgaagagagagacatacccgaaagatcatggaacagtggttatgaatggataaccgactttccgggtaagacagtttggttcgttcctagtattaaaagtggaaacgacatagcgaattgtctaagaaagaatgggaaaagagttatacaattatcaagaaaaacatttgatacagaataccaaaagaccaagaataacgactgggactatgtagtaacgactgatatatcagaaatgggtgcaaactttcgtgctgatagagtcattgatccgcgccggtgtttaaaacctgttatactaaaggacggaccagagagagtaatcttggcaggccccatgcctgtaacggttgcttcggctgcccaaagaagaggtcgtatagggaggaaccacaacaaagagggagatcaatacatatatatgggacaacccctaaataatgacgaggaccacgcgcactggacagaagcaaagatgctattggataatatcaacacacctgaaggtataatccccgccctattcgaaccagaaagagaaaaatcagcggctatagacggcgagtaccgtttaagaggagaggcaagaaaaacgtttgtagaacttatgcgaagaggggatttgccagtttggttaagctacaaggtggcgtctgaagggtttcaatactctgataggagatggtgttttgatggcgaaagaaataatcaagttctagaagaatcaatggacgtagaaatctggactaaagagggagaaaggaagaaattaagaccacgttggctagatgcacgaacgtacagtgatccgttagcactgagagaatttaaagaatttgccgccggcagaagatctgtttcaggagatttaatcctggaaattggtaaattaccacaacatttgacccaaagagcacagaatgcgttggacaacctcgtaatgttacacaactcggagcaaggagggagagcgtatagacatgctatggaagaactccccgatactattgaaacattaatgttactagcgctaattgctgtattaacgggtggcgttactctattctttttaagcggccgtggccttggaaaaacatcgataggtttactatgtgtcatggcctcatccgttttactatggatggcctcagttgaaccacactggatagccgcgagcattattttagagttctttttaatggtcctactcataccggaaccggataggcagagaacaccacaggataatcagctagcgtatgtggtcataggtctattattcatgattctaaccgttgcagcaaacgagatggggctactggaaaccaccaaaaaggatttaggtatcgggcatgtagcggtggagaatcaccaccacgcagcaatgcttgacgtcgacttacatccagcctcagcgtggactctttacgccgtagcaactactataataacaccaatgatgcgccacacaatagaaaatacaacggctaatattagcctaacagctatagctaaccaggcagcgatacttatggggctagacaaaggatggcctataagtaaaatggatatcggagtccctttgttagcacttgggtgttacagtcaggtgaaccccttaacattaacagcagcagttcttatgttagtagcacattatgctattatcggaccaggattacaagctaaggcaactcgcgaagcccaaaagaggacggcggccggaataatgaaaaacccaacagtggatggcatagtagccatagacttagatcccgttgtatatgatgcgaaattcgaaaagcagctgggccagataatgttgcttatactatgtacgtcacagatcctgcttatgagaactacgtgggccctctgtgaatccataacactagcgaccggaccgttaacaacgttgtgggaaggcagcccaggaaaattttggaacacaacgatagcagtatcgatggcaaatatatttagaggatcgtacctagctggtgctggcttggccttcagtctaatgaaatcactcggaggtggaaggcgaggtacaggcgcccaaggggaaaccctgggtgaaaaatggaaacggcagcttaatcaactaagcaaaagtgagttcaatacctacaaaagatcaggaattatggaagtagatcgtagtgaagcaaaggaaggtttaaagaggggagaaaccacaaaacacgctgtctctagaggtaccgctaaactaagatggtttgtagaaagaaaccttgttaaacctgaaggaaaggtcatagacctaggatgcggacggggaggctggtcatattattgtgcgggactcaagaaagttacagaagtcaaaggttatacgaagggcggacctggccatgaagaaccaataccgatggctacctatggatggaacttagtaaaattacactcaggaaaagatgtattctttattcccccagagaaatgtgacacacttctatgtgatataggagagtcttcaccgaatccaaccatagaggaaggtcggacgctacgagtattgaaaatggtagaaccatggttgagaggtaatcaattctgtataaagattctaaatccttatatgccatctgtggtggaaacattggaacaaatgcaaaggaagcatgggggaatgttagtcagaaatccacttagtagaaattcaacccacgagatgtactgggtaagttgtggaaccggaaatatcgtttcagcagtgaatatgacatcaagaatgttgttgaaccgattcacaatggcacacaggaaaccaacatatgaacgcgatgttgacttgggagccggtactaggcacgttgctgtagaaccggaggtagccaatctcgatataataggtcagaggatagaaaatatcaagcacgaacacaaaagcacctggcactatgatgaagataatccttataaaacctgggcttatcatgggagttacgaagttaaaccttcagggagcgcgtcaagcatggtaaatggtgtagtaaaactattgacaaagccatgggatgttattcccatggtaacacagatagccatgacggatactactccattcggtcaacaaagggtattcaaggagaaagttgacacgagaactcccaaagcaaagcgagggacggctcagattatggaggtcaccgctaaatggttatggggatttctcagtcgaaacaagaaaccacgtatatgcaccagagaggagtttacaaggaaagtccgttcgaacgctgcaatcggtgccgtattcgtggatgaaaaccaatggaactcggccaaagaagcagtcgaagatgaacgattttgggatcttgtacatcgcgaacgagagttacacaaacaaggaaaatgcgcgacctgcgtttataacatgatgggaaaaagggagaaaaagttaggtgaatttgggaaagccaaaggttcgagagcaatttggtatatgtggttaggtgcgagatttctagagttcgaggccctgggatttatgaacgaggaccattggttttcaagagaaaacagcttatcaggtgtagaaggagaaggattgcataaactaggttatattctacgagacatatcaaaaattccgggagggaacatgtatgctgatgataccgcagggtgggacacccgaatcactgaagatgacctgcagaacgaagccaaaatcacagacatcatggaaccagaacatgcacttctggcgaaatcgatattcaaattgacataccaaaataaggtagtacgagtacaaagacctgccaaaaatggaaccgtaatggatgtcatatccaggcgagaccaacggggatcaggtcaggtcgggacgtacggtctaaatacattcactaatatggaagctcaactcataagacaaatggaatcagagggtatcttctccccgtccgaactcgaaacacccaatttggcaggaagagttttaaactggctagaaaagcacggtgtcgaaagattaaaaaggatggcaatctccggtgacgattgtgtggtaaaaccaatagatgaccgttttgcaacagccctcacagcgttaaatgatatgggaaaagtccgcaaggatataccacaatgggaaccttctaaaggatggaatgattggcaacaggtcccattttgttcccatcattttcatcaattaattatgaaagatgggagagaaattgtagtaccatgcagaaaccaagacgagttggtaggtagggcacgagtatctcagggtgccggatggtctttaagagagacagcttgcttaggaaaatcctacgcgcaaatgtggcaattaatgtattttcacagacgggaccttcgactagctgcgaatgcaatttgtagcgctgtgcctgttgattgggtcccaacaagtagaactacgtggtcaatacatgcacatcaccaatggatgaccactgaagacatgttatccgtttggaatcgggtatggatcgaagaaaacccttggatggaagacaaaactcacgtttcgagttggggagacgtcccatatcttggaaagagagaagaccaatggtgtggctcgcttattggcctaacggcacgggcaacttgggcgacgaatatacaagtagcgatcaaccaagtgcggcgattattagggaatgagaactatcttgactacatgacaagcatgaaaagatttaaaaatgaaagcgatccggaaggggcgctatggtag

SEQ ID NO: 21736 - RNA, 9879 nt, synthetic construct
  misc_feature 1..9879: note = derived and/or modified CDS sequence (opt6) from DENV-1__FJ898399__SS-prME
  source 1..9879: mol_type = other RNA
tcggtaacaatgttgttgatgcttatgccaacggctcttgcttttcatctcaccaccagagggggtgaacctcatatgatcgtatcaaaacaagaacgagggaaatcattactgtttaaaacctccgccggtgtaaatatgtgcactttaattgcaatggacttaggcgaattttgtgaagacacaatgacctataaatgcccaagaataactgaagcagagccagatgatgtagattgctggtgcaacgcaacagatacctgggtaacatacggtacatgtagtcaaacaggagaacatcggagggataaacgttcggtagcgctcgcgccgcatgtaggactcggactggaaaccagaacagaaacttggatgagttctgaaggagcttggaaacaaatacaacgcgttgaaacttgggcacttcgacaccctggttttaccgttatcgcccttttcttagcacatgccataggaacttcaatcactcaaaaaggaattattttcatattgttaatgctagtaacaccctcaatggcaatgcgttgcgtaggaatcggatcaagagacttcgttgaaggactatcaggggcgacttgggtagatgtagtactcgaacacggatcctgtgttacaaccatggcaaaagataaaccaacgttggacattgaattgttaaaaacagaagtgactaacccagcagtactaagaaaattatgcatagaagcgaaaatttctaataccacaacagattcaaggtgccccactcaaggtgaagccacattggtcgaagaacaagacgccaatttcgtctgccggagaacctttgtcgatcgagggtggggcaacggctgtggattattcggaaaaggctcacttattacatgcgctaaattcaaatgtgtaacaaaattagaaggtaaaattgtgcaatatgaaaatctaaaatactcagtaatagtaacggtacatacaggagaccaacatcaagtgggcaatgaatcaacggaacacggcacaacggcgactattaccccacaagcaccttctactgagatccaactaactgactatggtgcattaactttagattgctcgccgagaaccggcttagattttaacgagatggtcttgttaacgatgaaggagaaaagttggctcgtacataaacaatggtttttggacctgccgctaccatggacgtcaggagcgagtacatcacaggaaacttggaatcgaaaggacttgctcgtgacatttaaaactgcacacgcgaagaaacaggaggtagtagtcctaggctcacaggagggcgctatgcatactgcgctcacaggtgcaacagagatacaaactagcggtacaaccactatctttgcaggccacctcaaatgtagactcaaaatggataaattaacattaaagggaatgtcatacgtaatgtgtaccgggtctttcaaattagaaaaagaagtcgccgagactcagcacgggaccgttttagtacagattaagtatgagggaacggatgctccgtgcaaaatacctttttcaacccaagacgagaaaggtgtaacacaaaatggacgtctaataactgctaaccccattgtaacagataaagaaaagcccgtgaatatagaggccgaacccccattcggcgaatcatatattgttatcggcgccggggaaaaggcccttaaattatcgtggtttaagaaaggatcatccataggtaaaatgtttgaagcaacagcgagaggcgcgcgaagaatggcgattttaggagacacagcgtgggacttcggcagtatagggggagtatttacctcagtcggaaaactcgtgcaccaaattttcggaactgcatacggagtcctattttctggagtgtcatggacgatgaagatcgggataggtgtgttgctaacatggctagggttgaactcacgcagtacgagcctatccatgacatgtatagcggtaggtttggtaactctatatctcggggtaatggtacaagccgattctggatgtgtgataaactggaaaggaagagaacttaaatgcggaagcggaatttttgtcactaatgaagtacacacttggacagagcaatacaaattccaggcagacagtcccaaacgcttgtctgccgctatagggaaggcttgggaggaaggtgtttgtgggatacgtagcgcgaccagattggaaaatatcatgtggaaacaaattagcaatgaactcaaccatattctactcgaaaatgacatgaaactaaccgtcgtagtcggggacgtcgcaggtatcctagggcaaggtaagaaaatgatacggccacaacctatggagtataaatatagctggaaaagttggggcaaagctaaaataataggagctgatgctcaaaacacaacttttataatagatggaccaaatacacccgaatgtccagatgaccagagagcttggaacatatgggaggtcgaagattatggatttggcatctttaccacaaatatctggcttaagctaagagatagttacactcaggtctgcgatcacagacttatgtctgcagcaatcaaggattccaaagctgttcatgccgatatgggatactggatagagagtgagaaaaacgagacatggaaattggctagagccagctttattgaagtaaaaacctgtatctggcctaaaagccacacgttgtggtctaatggagtcttggaaagcgaaatgataattcctaagatatacggaggaccaataagccaacacaattatcggccaggctacttcacacaaacagcaggcccttggcatcttggaaaacttgaacttgattttgatctctgtgaaggaaccacagtagtggttgatgaacactgtggaaatcgaggtccatcactgcgaacaactacggtaacaggtaaaataatacatgagtggtgctgtcgatcttgtacactgccgccactaagattcaaaggtgaagacggatgctggtacggaatggaaatacggcccgtaaaagagaaagaagagaatctagtaaagtcaatggtctcagctggaagcggcgaagtagattcattttcattaggactactatgcatatccattatgatagaggaagtaatgagaagtagatggtcaaggaaaatgctcatgactggaaccttggcagtgttctttttactgatcatgggacagttaacatggaacgatctcattcgtttgtgtatcatggtaggagctaatgcttcggatagaatgggtatgggcactacgtacttagcactaatggcgacatttaagatgagaccaatgtttgctgtaggattactattcagaaggctaacgtcgagagaagtgttacttctcacgataggactatctctagtagcgtcggtcgagctgccaaattcgcttgaagaactgggtgatgggttagcaatgggaataatgatactgaaacttctcacagactttcaatcccaccaattatgggcgacattgttatcattgacttttataaaaaccacattttcactgcattacgcctggaaaacgatggcaatggtattatcaattgtctcattattccctttatgtctatcaacaacttcacagaaaaccacttggttacccgtactactcggatcgctaggttgcaaaccactcacgatgttcttaatagcagaaaataagatatggggtcgaaagtcttggccccttaacgaggggatcatggctgtcggtattgtctctatactcctttcttcgctcttgaagaatgacgtaccactggccggccctttgatagccggtggtatgttgattgcatgttatgttatttctggatcgtctgccgacttatctttagagaaggctgcagaagtatcatgggaagaagaagcagaacattcaggagcctctcacaatatactggttgaagtccaggacgatgggacaatgaaaatcaaagacgaagagagagacgacacattaacaatattattaaaggcaacgttgttggcagtgtcgggcgtctatccattaagtattcctgcgacacttttcgtatggtacttctggcagaaaaagaaacaaaggtctggagttctctgggatactccatcaccgcctgaagtcgaacgggcagtgttagatgatgggatatataggataatgcaaaggggtctactgggcagatcacaggtgggagtgggggtgttccaagaaaacgtctttcataccatgtggcacgtcaccaggggtgcagttcttatgtaccaaggcaaaagactcgagccaagttgggcaagcgtcaagaaagatctcatttcctatggtggtgggtggcgactgcaagggagctggaataccggagaggaagttcaagtaatagcagtagagccaggcaaaaaccccaaaaatgttcaaactgcgcctggcactttcaaaacatcggaaggagaggtaggtgcaatagcactggattttaaacctggaacaagtggatcaccaatcgttaaccgtgaaggtaaaatcgtcgggctttacggaaatggagttgttacaacatcaggtacatacgtgtcagcaattgctcaggcaaaggcgtcgcaagagggaccccttccagaaatagaggatgaagtattccgcaaaagaaaccttaccataatggatttacacccagggagtggtaagacccgcagatatttacctgcgatagtcagagaagctataaaacgaaaattaagaactttaattctagctccaacaagagtagtggcatcggaaatggctgaggctttgaaaggaatgccgataagatatcagactacagctgtaaaatcagagcatacaggtaaagaaatcgtagatttgatgtgccatgcaactttcaccatgcgactcctaagcccagtacgcgtaccaaattacaatatgataataatggatgaggctcacttcactgacccatcctcaattgcggcaagggggtacatatctacgcgtgttggtatgggagaagcagcggccatttttatgacagcgactcctcctgggagcgtagaggcatttccacaaagtaacgcagtgatacaagacgaggagcgcgacataccagagcgcagttggaatagtggctacgaatggatcaccgatttccccggaaaaacagtttggttcgttccttctattaagtctggcaacgatatcgctaactgcctcaggaaaaatggaaaaagagtcatccagttaagtcggaaaacatttgatacagaatatcagaaaacaaagaataatgattgggactatgtcgtaacaactgatatatcagaaatgggtgcgaattttagagctgatagggtcattgatcccaggagatgccttaaacctgtcatattaaaagatggaccagaaagagtaatactggcaggacccatgccagttactgtggcgagcgcagctcaacggagagggagaatcgggagaaatcataataaggagggcgaccaatatatttatatgggtcaaccgttgaataatgatgaagaccacgcgcactggactgaagccaaaatgttacttgacaatattaacacgccagaaggaattattcctgcattgttcgaaccagaaagggaaaaatcagctgccatagacggtgaatacagattacgaggtgaagcaaggaaaacctttgttgaattaatgagacggggagatttaccagtatggttgagctacaaagtcgcgtcagaagggttccaatactccgatagaagatggtgtttcgacggagaaagaaacaatcaggttctggaagagaatatggatgtagaaatttggacaaaagaaggtgaaaggaagaaactcagaccaagatggctagacgcccggacctactcggatccattagcattacgagaatttaaagagtttgctgcaggaagacgaagtgtctcaggagatttaatactcgaaattggcaagctgccacaacacttaacacagagagctcagaatgcacttgacaaccttgtcatgttgcataactccgaacaaggtggtcgtgcttatagacacgctatggaagaactaccagacactattgagacattaatgctgttagcactaatagcagtgttaaccgggggagtaaccttattctttttaagtgggcgtggacttggaaaaacttcgataggattattatgtgtaatggcctcatcagtattactgtggatggcatcggtagaaccgcactggattgccgctagcattattcttgagttctttcttatggtcctccttataccagagcccgaccggcaacgtacaccgcaagacaatcaacttgcttacgttgtgatcggactactttttatgatactgactgtagcagcgaacgagatggggcttttagaaaccacaaagaaagacctcgggattggtcatgttgctgtagagaatcaccatcatgcagctatgttagacgtagatctacaccctgcttcagcttggactctatatgcagtggcgactactataataactccaatgatgagacacactattgaaaatacaactgcaaacatatcacttactgccattgccaaccaggctgcaatcctaatgggtctagataaggggtggccaatatcaaaaatggacattggagttccgctactagcccttggttgttatagtcaggtgaatcccctaacgttaacagctgcagtactcatgctggttgctcactacgctataataggtccaggtttacaagcgaaagcaacgcgagaagcacaaaaacgtacggccgctggaattatgaaaaaccctacagtagacggcattgtagccatagatcttgacccggtcgtatacgacgcgaaatttgaaaaacagctcggacaaattatgttattaatactatgcacatcccagattttgttaatgcggacaacgtgggcgttgtgtgaatcaattactctcgctactggtcctttgactacgttgtgggaaggatcgccgggcaaattctggaatactaccatcgccgtaagtatggcaaatatattcagagggtcctacttggcaggagccggactagcatttagtttaatgaagagtctaggcggaggtagaagaggaacaggagcacaaggtgaaacgctaggggagaaatggaaacgtcaacttaaccaactaagtaaaagtgaatttaatacatataaaagatctggaattatggaagtggaccgttccgaggcaaaagaagggctaaaaagaggcgaaactacgaaacacgcagttagccgaggaacagctaaactacgatggttcgtcgagcgaaaccttgtaaaaccggaaggcaaagttattgatttaggatgtggaaggggaggatggtcatattattgcgcaggtctgaaaaaggtaacggaggttaaaggctacactaaagggggacccgggcatgaagaaccaattcctatggcaacatatgggtggaatttggttaaattacattccgggaaagatgtgttctttatacctcctgaaaagtgcgacactcttttgtgcgatatcggggagagtagccctaatcctacaatagaagagggaaggacactaagggtattaaaaatggtagaaccttggttaagaggaaatcaattttgtatcaaaattttgaatccatatatgccttcagtagttgaaactttagagcaaatgcaaaggcgacatggaggaatgctagtgagaaacccattaagtagaaattctacacacgagatgtattgggtttcatgcggaacaggaaatatagtcagtgcggtaaacatgacttctagaatgttattaaatcgatttaccatggcgcataggaaaccgacctacgaaagagatgtagacctaggtgctggcacacgacatgtcgcagtagaacctgaagtagcgaatctcgatataattggccagcgaattgaaaacatcaagcacgaacacaaatctacttggcattatgacgaagataatccgtataaaacgtgggcctatcatggatcatatgaggtaaaacctagcggatcagcaagtagtatggttaatggagtggtgaaattattaactaaaccatgggatgttatcccaatggttacccaaattgctatgacagatactactccttttggtcagcaaagagtttttaaggagaaggtcgacactagaacgcctaaagctaaacgaggaacggctcaaataatggaagtcacagcgaaatggctatggggatttctctcaagaaataagaaaccccgaatatgtacgcgagaggagtttacccgaaaggtccggtcaaacgcagctataggagctgtatttgtagacgaaaatcaatggaactcagcgaaggaagcggtagaagacgaaagattctgggatttggtgcacagagaaagagaacttcacaaacagggaaaatgcgccacctgtgtgtacaatatgatgggaaaacgtgagaagaaattaggggaatttggtaaggcaaaaggaagccgtgccatttggtatatgtggctcggcgcaagatttctagagttcgaagcgttaggattcatgaacgaagaccattggtttagtcgagaaaacagtttgagcggcgtcgagggagaaggattacataagttaggatatattctgagggatatttctaagattcccggtgggaacatgtatgcggatgatacagctggatgggacacaaggataactgaagatgatctacaaaacgaagcaaaaatcacagacataatggaaccagaacacgcactattggcaaaatcgatttttaaattaacataccaaaataaagtggtacgagtacaacgtccggccaaaaatggtacagtaatggacgtcatcagtcggcgcgatcagagaggtagtggtcaagtgggaacctacgggttaaatactttcactaatatggaggcacaactaataaggcaaatggagtcggagggtattttcagtcctagtgagctggagacaccaaacttagcaggcagagtactagactggctagagaaacacggtgtagaaaggctaaagagaatggcgatttcaggggacgactgcgtagtaaaaccaattgatgatcgtttcgcaacagcactcactgcgttaaacgatatgggaaaagtaagaaaagatattccacaatgggagccgtcaaaagggtggaatgattggcaacaagtaccattctgttcgcaccatttccatcagctaataatgaaagacggacgggaaatagtagtgccatgccgaaatcaggacgaactcgtgggtagagcaagggtgagtcaaggagcgggttggagtctgcgcgaaactgcatgtttaggtaaaagctatgcacaaatgtggcagctaatgtatttccacagacgagatctaaggttggctgccaatgctatatgtagcgccgtacccgtcgattgggttcccacaagcaggactacatggtcaatacacgcacatcatcaatggatgactacagaagatatgctatctgtgtggaatagagtatggatcgaagaaaacccttggatggaggataaaacccacatatcctcatggggagatgttccatatctagggaaacgcgaagatcaatggtgcggaagccttattggactgacagctagagccacatgggcgacgaatattcaggtggcaattaaccaagtgcggagactaataggaaacgagaactacttagactatatgacaagcatgaaaagattcaaaaatgagagtgatccagagggtgctctatggtaa

SEQ ID NO: 21737 - RNA, 9879 nt, synthetic construct
  misc_feature 1..9879: note = derived and/or modified CDS sequence (opt6) from DENV-1__FJ898401__SS-prME
  source 1..9879: mol_type = other RNA
tcagtaacaatgctcctaatgctaatgcctactgcgttggcattccacttaactacaagaggaggtgaaccacatatgatagtgagcaaacaggaaagaggtaaaagtttactttttaaaacttcagccggagtaaatatgtgtactttaattgcaatggatttaggtgagttttgcgaagacactatgacgtacaaatgtcctcgaatcacagaagcggagccggacgatgtagactgctggtgtaacgcgacagatacatgggtcacttacggcacttgttcacagacaggtgaacacagaagggacaagagaagcgtagcgcttgcacctcacgttggccttgggttagagacacgcactgagacctggatgtcatccgaaggcgcttggaagcagattcaacgcgtagagacatgggcgctaagacatcctggattcacggtaatcgccttgttcctcgctcacgcgataggcacctccatcacccagaaaggaataatatttatactactaatgctcgtaaccccatcaatggcgatgcgatgcgtgggtattggttctagagacttcgttgaggggctctctggcgcaacgtgggtggacgtagttctagaacatggatcatgtgtaacgaccatggcaaaggacaaaccgacactagatatagaattattaaaaacggaagtaacaaatcccgcagttctcagaaaattgtgtatcgaagcaaaaatatctaataccacgacagacagtcgatgtcccacacaaggcgaagcaaccctagtcgaggagcaagacgcaaattttgtatgtcgaaggacgttcgtcgatagaggttggggaaatggctgtggtctctttgggaaaggatcactcataacgtgtgcaaaatttaaatgtgtcacgaagctagaaggtaaaatagtacaatatgaaaatcttaaatactcagtgatagtgacggtacacactggggatcaacatcaagtgggaaatgagagcaccgaacatggaactacagccactattactcctcaagcgccatcgaccgaaattcaattaacagactatggtgccctaacccttgactgttcacctcgaacaggactcgactttaacgaaatggtactgttaaccatgaaagaaaaatcttggctagtacacaaacaatggtttctagacctaccgctgccctggacgtcaggagcaagcacatcacaagagacgtggaaccgtaaggaccttttagttacatttaaaactgcacacgcgaagaagcaagaggttgtagttttaggatcccaggagggcgccatgcacactgcacttaccggtgcaacagagattcaaacaagtggaactaccacaatttttgcaggacacttaaaatgtagactcaagatggataaactcacgttaaaaggaatgtcgtacgtaatgtgtactggaagtttcaaactagaaaaagaggtcgctgaaacgcaacacgggacagtattagtacaaataaaatacgaggggaccgacgcaccgtgtaagataccttttagtacccaagatgaaaaaggcgtgacacaaaatggcagactgataacagcgaatccgatcgttacagacaaggagaaaccagttaatattgaagcagaaccgccttttggtgaatcttatatagttattggtgccggagagaaagctctaaaactatcttggtttaaaaagggatccagtataggtaaaatgtttgaagccacagcgagaggggcaaggcgaatggcaatattaggagacacagcctgggacttcggtagcataggcggagtatttacctctgttggtaagttggtccatcagatattcggaaccgcgtacggagtcctgtttagcggcgtgtcatggactatgaaaataggcataggagtactcctgacatggttagggctaaactcacgatcaaccagcctcagtatgacatgtattgctgtaggattagtgaccttatacttaggagttatggttcaagcagattcaggatgtgtgattaactggaaaggcagggagttaaaatgcggctcaggaatatttgtaacaaacgaagtacacacatggactgaacagtacaaattccaggccgactctcccaaaagactatcagcggctattggcaaggcatgggaagaaggagtctgtgggattcgaagtgcaacacgcttagagaacattatgtggaaacaaatatctaatgaacttaatcatatattattagaaaatgacatgaaatttacagttgtagttggagatgttgccggtattctagctcaaggaaagaaaatgataaggccacaaccaatggagtataagtacagttggaagagctggggaaaagcaaagatcataggtgctgatgtacaaaatacaacgttcattattgatggaccgaacactcctgaatgcccagatgaccaaagggcatggaatatttgggaagtagaagactatggatttggcatttttaccaccaacatatggttgaagttgagagatagctacacccaagtttgcgatcaccgcctaatgtctgcagctatcaaagattcgaaagcggttcatgcagatatgggttactggatagaaagcgaaaaaaatgaaacctggaaactagcgcgcgcttcattcattgaagtgaaaacatgtatttggccaaagtcacataccctgtggagcaatggtgttctagagagcgaaatgataataccaaagatatacggtggccccatatcacaacataactataggcccggctattttacacaaaccgcaggaccatggcacctaggtaaattagaacttgatttcgacctttgcgaaggcactactgtggttgtagacggacactgtggaaaccgaggcccatccctaagaaccacgactgttaccggcaaaataatacatgaatggtgctgccgttcgtgcacactaccgccattaagatttaaaggcgaagatggttgctggtatggaatggagatcagacccgtaaaagaaaaagaggaaaatttagtaaaatcgatggtttcagcgggatcaggagaggttgactcgtttagcctagggctcttatgcataagtataatgatagaagaagtaatgagatcaaggtggtcccgaaaaatgttaatgaccggaacattagcagtcttttttttgttaatcatgggtcagctcacatggaatgatttgataagactatgcattatggtaggagcaaacgctagcgatcggatgggaatggggactacttatctagctctcatggctactttcaaaatgagacctatgttcgccgtagggttattattccgaaggcttacctcacgggaagtgctactattaactatcggactatcattagtagccagtgtagaattacctaatagtttagaagaactaggggatggtctagcaatgggaataatgattttgaagttattgacagattttcaatcgcatcagttatgggccacgctattaagtctaacattcatcaaaactacatttagtttacattacgcatggaagactatggcaatggtattgagtattgtatcactattcccattatgcctatccactacaagccaaaaaactacttggttacctgtattattaggttcactcggatgtaaaccattaacaatgtttttaatagcagaaaataaaatttggggtaggaagagttggccattgaacgaaggaataatggccgttggtatagttagtattctactttctagcttacttaagaatgatgtacctttagcagggccattaattgcgggtggtatgctaatagcatgttatgtaattagtggatcatcggcggatctcagtctcgagaaggcggcggaagtttcatgggagaaagaggcagaacattcaggcgcatcccataatatattagtagaagtccaagatgatggaaccatgaaaataaaagatgaagaacgagatgacacattaactatattattaaaggcaactttgttagcagtgagtggagtatatcctttatctatcccagccacactctttgtgtggcacttctggcaaaaaaagaagcaacggtcgggagtgctgtgggatacaccgagccctcccgaggtggagcgtgccgtactagatgatggcatataccggatcatgcaaagaggtttgttaggacgtagtcaggtaggtgtcggagtatttcaggaaaatgtattccatacgatgtggcacgtaacaaggggggccgtattgatgtaccaaggaaaaagattagaaccgtcatgggcctcggtgaagaaagatttaatatcgtatgggggcgggtggcgtctacaaggatcatggaatacaggtgaagaggtgcaagttattgccgtcgaaccaggcaaaaacccgaaaaacgtacaaactgccccaggaacattcaaaacatctgagggtgaagttggagcgatagctctcgacttcaagccgggaacaagcggctccccgatagttaacagagaaggaaaaattgttgggttatatggtaatggagtagtaacaacttctggcacgtacgtatcagcaatagcccaagctaaagcgagtcaggaagggcctctcccagaaatcgaagacgaagtttttcgaaaaaggaatctaacgattatggatctacaccccggatctggcaaaaccaggagatatctaccggcaatcgtacgtgaagcaatcaaacgaaaattgcgtaccctgatactggcaccaactcgcgtagtagcgagcgaaatggcggaagccctgaaagggatgccgatccgttatcaaaccacagctgtaaaaagcgaacacacaggcaaagagatagtagatctaatgtgtcacgcaacatttacaatgagattgttatcgccagtacgagttccaaattataacatgatcattatggatgaggcccatttcacagatccatcctcaattgcagccaggggatatataagtacaagagtcggtatgggcgaagcagcagcaatttttatgacagcaacaccacccggaagcgttgaggctttcccgcaatcaaatgccgttatccaggatgaagaacgggacataccagagagatcatggaactcaggatatgaatggataacagatttcccgggaaaaactgtatggttcgtaccgtccattaaaagtgggaacgatattgctaactgtttacgaaaaaacggaaaaagagtaatacaactcagcagaaaaactttcgacaccgagtatcaaaagacaaaaaacaacgactgggattacgtagttactactgacatctccgaaatgggagcaaattttagagctgatagagttatagaccctcgaagatgcttgaaaccagtgatcctaaaagatggcccagaaagagttatcttagccggtccaatgcctgtaactgtcgcaagtgctgcacaaagacgtggtagaattggtagaaatcacaataaagaaggcgaccaatacatatatatgggtcagcctctaaataacgacgaggaccatgcgcattggacagaggccaagatgctacttgacaacatcaatacgccagaagggattattcctgccttatttgaaccagaaagggagaaatcagcagccatagatggagaatatcgcttgcgtggtgaggcaagaaaaacattcgttgagttaatgcgaaggggagacctgcccgtatggcttagctataaggtagccagcgaggggttccaatactctgatagaaggtggtgttttgatggggaaagaaataatcaagtcttggaagagaatatggatgtagagatttggacaaaggaaggagagagaaaaaaactaagaccaagatggctggatgcgagaacttattcagatccactagctctcagagaattcaaagaattcgcagctggtcgaagatcagtctctggagatctaatactagagataggaaagctacctcagcatttgactcaacgtgctcagaacgcattagacaatttagtaatgcttcataactcagagcaaggaggaagggcgtatcgccacgcgatggaagaattaccagacaccatagaaacactgatgcttttggctctaatagcggttttaactggaggcgtcacattattcttcttatcagggcgtggtttaggaaagacttctattggtcttctgtgcgtcatggcatcgtcagtcctactatggatggccagtgttgagccccattggatagcagcaagtataatattagaattcttcttaatggtactactaataccagaaccggataggcagaggacgccacaggacaatcaactggcgtacgtggtaattgggttattatttatgatattaaccgtagcggcaaatgaaatgggtctattagaaacgacaaaaaaagacttaggaataggacacgttgctgttgaaaatcaccaccatgcagccatgcttgacgtggatctccacccagctagtgcgtggacactatacgcagtagcgacaacaataattactccaatgatgcgacatacgatcgaaaacacaacagcaaatatcagtctaacagcaatagctaaccaagctgccatattaatgggactagacaaagggtggcccataagtaaaatggacattggcgtcccactcttagctctaggttgttatagccaggtaaaccctttgacattaacagctgcggttctcatgttagtagcacattatgccatcatcgggccaggcttgcaggccaaggccactcgagaagcacaaaaacgaacagctgcgggtataatgaaaaatccgacggtagatggcatcgtggcaatagacctagatccagttgtgtatgatgcgaagtttgaaaagcaactaggacaaataatgctgttaatattatgtacttcccaaatactattgatgaggacgacctgggccttgtgtgagtccataacgttagcgacaggacccctaacgacactttgggaagggtcccccggtaaattttggaatactaccatagcagtctccatggcaaatattttcaggggatcatatctagctggagcgggtctagcgttctcgcttatgaagagtctcggaggaggaaggagagggacaggagctcacggtgagacactcggggaaaaatggaaaagacaattaaaccaacttagtaaatcagaattcaatacctataagaggtcggggataatggaagttgatcgatccgaagcaaaagaaggcttgaaaagaggtgaaaccactaaacacgctgtaagtagggggacggcaaagctcaggtggtttgtggaacgaaacctggtaaaaccagagggaaaagtgatagatcttggttgtggacgaggtggatggtcttattattgcgctggtctaaaaaaagtcacggaagtgaaagggtatactaaagggggtccaggacatgaagaaccaatcccaatggctacttacggttggaacttggtgaaattacacagtggcaaagatgtctttttcatcccaccggaaaaatgcgatacgctattatgcgacataggtgagtcttcaccgaatccaacgatcgaggaaggacgaacactaagggttcttaagatggttgagccgtggttacgaggcaatcaattttgcataaaaatactaaacccctatatgccaagtgtagttgaaaccttggaacaaatgcaaagaaaacatggaggcatgttagtccgaaatcctttatctcgcaattcaacccacgagatgtattgggtctcatgcgggacaggaaatattgtcagcgctgtgaacatgaccagcagaatgttactgaataggtttacgatggcacacagaaagcctacatacgagagagatgtggacttaggagctggaactagacatgtggcagtggaaccagaagtcgcaaatcttgatattataggacaacgcatagagaacattaaacatgaacacaagtccacttggcattatgatgaagataacccttacaaaacatgggcctaccacggatcatatgaagtgaaaccttctggatcggcttcatccatggttaacggtgtagttaagttactaacgaaaccgtgggatgttataccaatggttacgcaaatagcaatgactgatactaccccattcggccagcaaagagtatttaaggaaaaggttgacactagaacgcctaaggcaaaaagaggaacagcgcagataatggaggtaacagctaagtggctgtggggttttttaagccgaaacaaaaaaccgagaatttgtaccagggaggagtttactcggaaagttagaagtaatgctgcgattggagctgttttcgtcgacgaaaaccagtggaatagtgccaaagaagcggttgaagacgagagattttgggaccttgttcatagagaacgcgagttgcataagcaaggtaaatgcgcgacgtgcgtctacaatatgatgggaaaacgcgaaaaaaaactaggagaatttggtaaagcaaaaggtagcagagcaatatggtatatgtggctaggagcaagatttttagagttcgaggcgctaggatttatgaacgaagatcactggttttccagagaaaatagcttatccggcgttgagggagaaggattacataaacttgggtatatactacgggatattagtaaaatacccgggggaaacatgtacgcagatgataccgccggatgggacacgagaataacagaggatgaccttcagaatgaagcgaagataactgatataatggaaccagaacacgctctattagcgaaaagcattttcaaattgacctaccaaaataaggtcgtaagagtacaaagaccagcaaagaatggaacagtgatggacgtcataagtagaagagatcaacgaggttctggccaagttggaacgtacgggttaaatacattcacaaacatggaggcacaattaatcagacagatggaatcagaaggcatattttctccttcagaactcgaaactcccaacctcgctggaagggtgctagactggttggaaaagcatggggtagaacgattgaagcgaatggcaatctcgggagacgactgcgtggttaaacccattgacgacagatttgcgacagcattaaccgcattgaatgacatggggaaggtacgtaaggacattcctcagtgggaaccatctaaaggatggaacgactggcaacaagtaccattttgttcacatcattttcatcaactcataatgaaagatggacgggaaatagtagtgccctgccgtaatcaagacgaattggtaggaagggcccgggtctcacaaggggcaggatggtcattaagggaaacagcctgcttaggaaaatcatacgcgcaaatgtggcagttaatgtattttcataggagagatttacgattagctgcaaacgccatttgctcagctgttccggtagattgggttccgacatctcgtacgacttggagtatacacgcccatcatcaatggatgaccactgaagacatgctctcggtatggaatagggtatggatagaggaaaacccatggatggaggataaaacacatatatcgtcgtggggagatgtcccttatttaggtaaacgcgaagaccaatggtgtggaagtttaataggccttactgcgcgtgcaacttgggccactaatatacaggttgcaatcaatcaagtaagaagacttataggaaatgaaaattatctggattacatgacttcaatgaaaaggtttaaaaacgagagtgacccagaaggtgctttatggtaa

SEQ ID NO: 21738 - RNA, 9879 nt, synthetic construct
  misc_feature 1..9879: note = derived and/or modified CDS sequence (opt6) from DENV-1__FJ898402__SS-prME
  source 1..9879: mol_type = other RNA
agtgtaactatgttattaatgttaatgccaacagctcttgcatttcatctgacgaccagaggaggagaaccacacatgatcgtatcgaaacaggaacgaggcaaatcacttctatttaaaacctcagcaggggtcaacatgtgcacgctaatagcaatggaccttggcgaattttgtgaagacaccatgacgtacaaatgcccaagaatcacagaagcggaacctgatgatgtagactgttggtgtaatgctacggacacgtgggtaacatacggcacttgctcccagacaggagaacatagaagggataaacgatccgtagcacttgcaccccatgtaggcctgggattagaaacaagaacagaaacctggatgtcgtcagaaggtgcatggaaacaaattcaaagggttgaaacatgggcgctacgccatcctggctttacagtaatcgcattatttttagctcatgcaattggaacatcaattacacagaaaggaataatctttatcctattgatgttggtaactcctagcatggctatgagatgtgtgggtattggctctcgggatttcgtcgaaggactatctggcgcaacatgggtagacgtagttttagaacacggttcatgtgtaacaaccatggcgaaagataaacccactctcgatattgaattactaaaaaccgaagttacgaatccagctgttttaaggaaactgtgtattgaagcgaaaataagcaacaccacaactgattcaagatgccctactcagggagaagctactctagtggaagaacaagatgcaaattttgtgtgtagacgaacgttcgtagatcggggatgggggaatggatgcggattgttcggtaaaggctctctcataacatgcgcaaaattcaaatgcgtaacaaaacttgaaggtaaaatagtgcagtatgaaaatttaaaatacagtgttatagtaaccgtacatacaggcgaccaacatcaagtcggcaatgaatctaccgaacatggtacgacagctactatcacaccgcaagctccgtcaacagaaatccaactgacagactatggagcgctcacgctagattgcagcccgcgaacaggactagatttcaatgaaatggttcttctcacaatgaaagagaaaagctggctcgtacataaacaatggtttcttgatttacccctgccatggacgtccggcgcatcgacttcacaggaaacatggaatcgaaaagatcttctagttacctttaaaactgctcatgccaagaaacaggaagttgtagtattaggctcacaggaaggcgcgatgcataccgcccttaccggagccaccgagatccagacaagtggaactacgacaatttttgcaggccacctgaaatgcagattaaaaatggacaaactaactctaaaaggaatgtcttacgtaatgtgcacagggagtttcaagttggaaaaagaggtagctgaaactcagcatgggaccgtcctagtacaaatcaaatacgaaggaacggatgctccttgtaaaatcccattctctactcaggatgaaaaaggagtaacacaaaatggcagattaataacggcgaatccaatcgtaacggataaagaaaaacccgtaaatattgaggcagaaccgccgttcggagaatcctatatagttataggagcaggagaaaaagctctaaaattgtcgtggttcaagaaaggctcatccattggaaaaatgttcgaggcaacggcaagaggtgcaaggcgaatggctatcttaggggatacagcatgggactttggctcgatagggggtgtctttaccagtgttggtaaactcgtccaccaaatttttggcaccgcatatggtgtacttttcagcggcgtatcatggacgatgaaaattggtataggagtattattgacctggctaggtctaaactcaaggtcaacttcactaagtatgacatgtatagcagtaggtttagtaacattatatttaggagtaatggtacaagcggacagtggctgcgtaatcaactggaagggaagggaactaaaatgtggaagcggtatatttgtaaccaatgaggttcacacatggacagaacaatataaattccaagcagatagcccaaagcgactttcagcagctataggaaaggcttgggaagagggggtgtgcggaatccgatcagctacaagactagaaaacattatgtggaaacaaattagtaacgaattaaattatattttgctggagaacgatatgaaattcaccgttgtcgtcggagacgtagccgggatccttgcgcaaggcaagaaaatgataagaccacaacctatggaatataaatactcgtggaagtcatggggcaaagcaaaaattatcggagccgacgttcagaacaccacatttataatagatgggcctaatacacctgaatgtccagatgaccaaagagcatggaacatttgggaagtcgaagattacggtttcggtatatttacaacaaatatttggttaaaattaagagattcctatacacaagtttgtgaccatcggctaatgtcagcagcaataaaagatagtaaagctgtacacgcggatatgggttactggatcgaatctgaaaagaatgaaacatggaagctagctagagcatcatttatagaggttaaaacttgtatctggcccaagtctcacacgctctggtcgaacggagttctagaaagcgaaatgattataccaaaaatttatggtggaccgataagccaacataactatcgacctggatattttacccagacagcaggtccctggcacctaggaaaattagagctcgacttcgatctatgtgaaggaacgacagtagttgtcgacgagcattgcggtaaccgaggaccatcactaagaacgaccacagttacaggcaaaataatacatgagtggtgttgtagatcttgtacactaccgcctttaagattcaagggtgaagatggctgttggtacggaatggaaattcggccagtaaaagagaaagaagaaaatttggtgaaaagcatggtatccgctggatcaggagaagttgacagcttctccctaggcttattatgtatatcaatcatgatcgaagaagttatgagaagtcgttggagccgtaaaatgttaatgactggaaccttagctgttttcttcttacttattatgggacagcttacttggaacgatctaattcgcttatgcatcatggtaggagccaatgcttcagacagaatgggaatgggaaccacatacctagctttgatggcgacatttaaaatgcgacccatgtttgcagtgggactattatttcggaggctgactagccgagaagtacttcttttaacgattggactatccctcgttgccagcgtggaattaccaaattccttggaagaacttggggatggactagcgatgggcattatgattcttaagttgttaaccgattttcagtctcatcaattatgggctacactgctatcattaacctttataaagactacattctcattgcattacgcctggaaaacgatggcaatggtactctcaattgtctcactattccctttatgtttatctacgacttcccagaaaacgacctggttaccggttttacttggttccttaggttgcaagcctcttacaatgtttctgatagcagaaaacaaaatctggggccggaaaagctggccgctaaacgaaggtatcatggccgtaggaatagtaagcatattacttagtagcctactgaaaaatgacgttccactagctggtcccttgatagcaggaggaatgctcatagcgtgttacgtaatctcaggatcaagtgctgatcttagcctcgaaaaggctgcagaagtcagttgggaagaagaagccgagcacagtggagctagccataacattttggtcgaagtacaagacgacggtactatgaaaattaaagacgaagaacgggacgacaccttaacaatactactaaaagcaacgctcttagcggtatcaggcgtatatccgctttccatcccagcaacgttatttgtatggtacttctggcaaaagaagaaacaaagaagtggagttttatgggataccccatcaccacccgaggtggagcgagcagttctcgatgatggaatttacagaataatgcaaagaggcctacttggaagaagtcaagtaggtgtaggcgttttccaagaaaacgtttttcatactatgtggcatgtaacacggggcgctgtattaatgtatcagggtaagagactagaaccttcctgggcgagcgttaagaaagatttaatcagctacggaggagggtggaggctacagggtagctggaacacgggagaggaagtgcaagtaattgctgtagaacctggcaagaatcctaaaaatgtacaaacagcacccggaactttcaaaacaagtgaaggcgaggtgggagcaattgcattggatttcaaacccggaactagcggcagcccaatagttaatagggaaggcaaaatagtcggactatatggaaacggagtcgttactacatcagggacatatgtgagtgcgattgcacaggcaaaagcatcccaagaaggaccgctaccagaaatagaggatgaagtattcagaaagcgaaatctaactatcatggacctgcatccaggaagcggaaaaaccagaagatatttgccagccatagttagagaagcaataaaacgaaaactacgaacactcatattagcaccaacaagggttgtagcatctgaaatggctgaagcgcttaaagggatgccaatacgctatcaaacgacggcagttaaatcagagcatacaggtaaggaaattgtggatttgatgtgccacgctaccttcacaatgcggcttctatctccagtacgcgtacccaattataacatgatcataatggatgaggcacattttacagatcctagctcaatagctgccaggggatacatatcaactcgagtcggcatgggagaagccgcagccatatttatgacggccacccctcctgggagcgtagaagcctttccccaaagcaatgccgtaatacaggacgaagaacgggacattccggaaagatcgtggaacagtggatacgaatggataaccgatttcccgggtaaaaccgtttggtttgttccatcaattaaatccggcaacgacattgccaattgtcttaggaaaaatgggaaaagggtaatccaattatcccgcaaaacattcgacacggaataccagaaaaccaagaataatgattgggactacgtagtgactactgatatatcagaaatgggggccaactttagagcagaccgcgtaatcgatcctcgcagatgcttgaaaccagtcattttaaaggacgggccagaaagagtaatcctagccggcccaatgccagtgaccgtagcatcggcggcgcaaagaagaggcagaataggccggaatcacaataaggagggtgatcaatacatatacatgggacaacccttgaacaatgacgaggatcatgcacactggacagaagcaaagatgctattagacaacattaatacgcctgagggcattataccagcgttgtttgagccagagcgagaaaaatctgctgcaattgacggtgagtatcgcttaagaggcgaagcccgtaaaacatttgtagaattaatgagacgcggtgacttaccagtctggttatcatataaagttgcgagtgaaggcttccaatattcggacagaaggtggtgctttgacggcgaacgaaataatcaagttttggaagaaaatatggatgtagaaatttggacaaaagagggtgagagaaagaaattaagacctagatggctagatgcacgaacatatagtgacccattggcgttgagagagttcaaagagttcgccgcaggtagaaggagcgtaagcggtgatcttattttggaaataggaaaacttccccagcacctcacccagagagcacaaaacgcactagataaccttgtgatgctacacaactccgagcagggtgggcgagcgtataggcatgctatggaagaactccccgacacaatagaaactttgatgttactagcattaatagcagtgttaacaggaggagttacgctattctttctcagtggacgaggactcggaaaaacgagcataggtctgctctgtgtaatggcaagttcagtactcctatggacagcatcagtggagccacactggatagcggcatctataatactcgagtttttcctcatggtgttactgataccagaaccagatcgacagaggacgcctcaagataatcagctagcgtatgtcgtcatcggtttattatttatgattctgacagtagccgcgaatgagatgggcttgctagaaactacgaagaaagatttaggaatcggtcatgtcgcagtggagaatcatcaccatgcagctatgcttgatgtggatcttcatccagctagtgcatggactttatacgcagtcgcaacaacaataataacgccaatgatgagacacacgatagaaaatacaactgccaatatttcgttaacggcgattgcaaatcaagcagctatattaatgggtctcgataaaggctggcctataagtaaaatggatattggggtgcctctattggccttgggatgttattcacaagtgaatccacttactctaacggcagctgtactaatgttagtagcacactatgcaataattggcccaggcttacaagctaaagcaaccagagaggcacagaaacgaactgcagctggcataatgaaaaatccaaccgtcgatggtatagtagcaatcgatctagacccagtagtatacgatgcaaaatttgagaagcagctcggtcagattatgctattaatactatgtacaagtcaaatcctattaatgagaactacatgggcattgtgcgaatcaattacccttgctactgggccactgacaacgttatgggagggtagccccggcaagttttggaatacgactatagcagtttccatggcaaacatttttagagggagttacctagcaggggcaggcctcgcattctcactaatgaaatcactagggggcgggagaaggggaacaggcgcccagggtgagacattaggagaaaaatggaaacgtcaattaaaccagctaagcaaaagtgagttcaatacatacaaaagaagcggcatcatggaggtagataggtcagaagctaaggaggggttaaaaaggggcgaaactacaaaacatgctgtatcccggggtaccgcaaagttaagatggtttgtagagcgaaatttggtaaaacctgaaggaaaagtaatagatctaggctgcggcagaggtggatggtcttattattgtgctgggctcaagaaagtaacagaggtcaaaggatacaccaagggaggtccgggtcatgaagaaccaatccctatggcaacttacggttggaatttagttaaactacactctggaaaagacgttttcttcatacctccagaaaaatgcgatactttactatgtgatattggtgaatcgtcccccaaccctacgattgaggagggtagaacattacgagttttaaaaatggtagaaccgtggctaaggggcaatcagttctgtataaaaattctcaatccttatatgccatcagtagttgaaacactggagcagatgcaacggaagcatggagggatgttagtaagaaatccgctctcacgcaattctacgcatgagatgtactgggtgtcatgtggtaccggtaatatcgtaagcgccgtcaatatgaccagccgaatgctcctcaaccgctttacaatggcgcatagaaaaccaacctatgagagagatgtagacttaggagcaggcactcgtcacgtcgcggtcgaacctgaggtggcgaacctagacatcattgggcagagaatcgaaaacataaaacacgaacataaatccacttggcactacgacgaggacaatccatacaaaacgtgggcctaccatggtagctatgaagtaaaaccctctgggagcgcatctagtatggtaaatggggtggtaaaactactcactaagccctgggatgttattcctatggttacacaaatagcaatgaccgacactacaccattcggccagcaaagggttttcaaagagaaagtagatactcgaactccaaaggcgaaacgaggcaccgcgcaaataatggaggttactgcaaagtggctctggggattcctgtccaggaacaagaaaccaagaatttgcacacgagaagagttcacgagaaaagtacgaagtaacgccgcaataggtgctgtatttgttgacgagaaccaatggaatagcgccaaagaagccgttgaggatgaaaggttttgggatctagttcatagagaacgtgaactacacaaacagggaaaatgtgctacttgtgtctataatatgatgggaaaaagagagaagaaactgggtgagttcggtaaagctaagggcagtagggcgatatggtacatgtggctgggagcacggtttttagaatttgaagcattagggtttatgaatgaggatcactggttttcacgggagaacagtctatcaggagttgaaggcgaaggattacacaagctgggatacatactgagagacattagtaaaataccaggtgggaatatgtacgcggacgatactgcgggatgggatacgaggataactgaagatgacctacagaacgaagcaaaaataaccgacattatggaacctgaacatgctttgttagcaaagtcaatcttcaaattaacttaccaaaacaaagtagtaagagtgcaacgaccagctaaaaatggcacggttatggatgttatctccagaagagatcaaagaggaagcggacaagttggcacttacggactaaataccttcactaatatggaagcgcaattaatccggcaaatggagtcagaagggatttttagtccctcggaactagaaacaccgaatctagcaggtagagttcttgattggctcgaaaaacatggggtagaacgactaaaacgcatggctatcagcggcgatgactgtgtagttaaacccattgatgaccgtttcgcaactgcgttaaccgcacttaatgatatggggaaggtcagaaaagatatcccgcagtgggaacctagcaaaggctggaacgactggcaacaagtgcccttctgttcacaccattttcaccaactaatcatgaaagacggacgcgaaattgttgtcccgtgtagaaaccaggacgaattagtaggcagggcgagagtttcacaaggtgcgggttggagtcttcgtgagacagcttgcctcggcaagtcatacgcgcagatgtggcaactaatgtattttcatcgccgagatttgagacttgcggcgaatgctatttgttcagcagtgccagttgactgggtaccgactagccggacaacctggtctatacatgcacaccaccagtggatgactacggaggatatgttgtcagtatggaatagagtttggattgaagaaaatccatggatggaagacaagactcacattagttcatggggtgatgttccgtatctaggtaaacgggaagaccagtggtgtggatcattaataggcttaacagcacgcgccacctgggccacaaacatccaagtcgctatcaatcaagtccgaaggctaataggaaacgaaaattatttagattatatgacatcaatgaaaagatttaaaaatgaatcagatccggaaggtgcgctgtggtaa

SEQ ID NO: 21739 - RNA, 9879 nt, synthetic construct
  misc_feature 1..9879: note = derived and/or modified CDS sequence (opt6) from DENV-1__FJ898403__SS-prME
  source 1..9879: mol_type = other RNA
tcggtaacaatgttactgatgttaatgccaacagcactcgcgttccatttaacaactcgaggtggggaaccgcatatgattgtatctaaacaggaacgaggtaaatccttgttatttaaaacaagtgcaggcgtaaatatgtgtacattaatcgcaatggatttaggggaattttgcgaagacacaatgacttataagtgcccacgtattacagaagcggaacctgatgatgtggactgttggtgcaatgctacagacacgtgggtaacttatggaacttgctcacaaacaggagaacacagacgtgacaaaagatcggttgcgttagctccacacgtaggactgggacttgaaacacggaccgaaacgtggatgtcaagtgaaggtgcctggaagcaaatccaacgtgttgaaacttgggcgttgcggcatccaggtttcaccgttatcgctctctttttagcccatgcgattggtacctcgattacacaaaaaggaattatttttattcttctcatgttggtcacaccatcgatggcaatgaggtgtgtaggaatcggaagtagagattttgtagaaggcctgtcaggagcaacttgggtagatgtggttttagaacatgggtcgtgtgttaccacgatggctaaagacaaaccaacattagatatagaattattgaaaacggaagtaactaaccctgcagttctgcgtaaactttgtatagaagcaaagatatctaacactaccacggacagtagatgcccaacgcaaggagaagcaacgctagtagaagaacaagacgcaaattttgtatgtaggcgaacttttgttgatcgtggatggggtaacggctgtggattgttcggaaaaggtagccttatcacttgcgcgaaatttaaatgtgtcacaaagttagaaggaaagatcgtccagtacgaaaatttgaaatacagtgtaatagttacagttcatacaggtgatcaacatcaagtaggcaatgaatcaaccgagcacggtactaccgcaactataacgccacaagcaccatccaccgaaatacagctaacggactacggagcattaaccttagattgtagcccgcgaactgggctagacttcaacgaaatggtacttctaactatgaaagaaaaatcgtggctagtacacaaacaatggttcttggacctacccctaccatggacttcgggagcgtccacctcacaagagacatggaatcgcaaggatctacttgtgacatttaaaacagctcatgccaagaaacaagaagttgtggtacttggttctcaagagggagctatgcacacagcgttaactggtgcgactgagatacaaacaagtggtactaccacaatcttcgctggccacttgaaatgtagactaaagatggataaacttacgcttaagggaatgagttatgtaatgtgtacaggaagtttcaaactggagaaagaagtcgctgagacacaacatggtactgtactggttcaaataaagtacgagggaactgacgctccttgtaagatacctttcagcacacaagatgagaaaggagtaacacagaacggaaggttgatcactgcaaatccaattgtaacggataaagagaagccagttaatatcgaagcagaaccacctttcggagaaagttacatagtaataggagctggtgaaaaagccttgaaactaagctggttcaagaaaggctctagcattggaaaaatgttcgaagcaacagcaagaggtgcacgtaggatggctatactaggcgacacagcatgggattttggatcaattggaggtgtgtttacctcggtaggtaaactggtgcatcaaattttcggtactgcgtacggtgtattgttttcaggtgtgtcatggacaatgaagattgggataggcgtcttacttacctggttagggttgaacagtagatccacatctctttcgatgacatgtatagccgttggcttagttaccctatacttgggagtaatggttcaagcagatagcggatgtgtaataaattggaagggaagagaattgaaatgtggcagcggaatattcgtcactaatgaagtccatacttggacagaacaatacaaatttcaagctgattccccaaaaaggttgagtgccgctataggtaaggcctgggaggaaggtgtatgtggaataagatccgccacacggctagaaaacataatgtggaaacaaattagcaacgaactaaaccacatactgttggaaaatgatatgaaattcactgtcgtagtgggagatgtagcgggtatattggcccaaggcaaaaagatgattaggccccaaccaatggaatataagtatagctggaaatcatggggcaaagctaagatcattggcgccgatgttcagaacacaaccttcatcatagacggacctaatacaccggaatgtccagatgatcaaagagcatggaacatctgggaggtagaggattatggttttggtatatttaccacaaatatatggttaaaattaagggactcatacactcaagtttgcgaccacaggttgatgtcagcagccatcaaagatagtaaggctgttcatgctgacatgggatattggatagaatcagagaaaaatgagacatggaaactagctagggcaagtttcatagaagtaaaaacctgcatatggcccaaatcgcacacactctggagtaatggcgtcttggaatccgagatgattataccgaaaatttatggcgggccgatttctcaacacaattacagaccgggatattttactcaaacagctggcccatggcatctgggaaagttagaactagatttcgacttatgtgaaggcacaaccgtagtggtggatgagcactgtgggaatagagggccctcacttcgaaccactacggtaactgggaaaattatacatgaatggtgttgcagaagctgtactctaccaccattacgattcaaaggtgaagacggatgttggtacggtatggagattagacctgtaaaagaaaaggaagaaaatttagttaaatctatggtttcggcgggaagcggtgaagtcgattctttctcactaggactattatgcatctcaataatgatagaagaagtcatgcgtagtcggtggtcaagaaagatgttgatgacaggtacattggctgtatttttcttgctgatcatgggtcaattgacgtggaacgatctgatacgtttatgtattatggtaggtgctaacgcatcagataggatgggaatgggtaccacttatctagcattaatggcaacgttcaaaatgcgaccgatgttcgcagtaggcctccttttcagaagactcacatctcgggaagttcttcttttgacaattggtttaagtctcgtcgcctctgtagaacttccaaactccctagaagaattaggtgatgggttggccatgggtatcatgattttgaaattgctaacggattttcagagccaccaattgtgggcgactttattgtcattaacttttattaagaccacgtttagcttacactacgcttggaaaacaatggcgatggtcctttcgattgtgtcgctattcccactgtgcctgagcacgacaagtcagaaaacaacatggctaccggtcctattgggatcgctcggttgtaaaccactaacgatgttcttaatagcagagaacaaaatatggggaagaaaatcatggcccttaaatgaaggaatcatggcagttggaatagttagtattctactaagtagcttactgaaaaacgatgttccattggccggtccactaatcgcaggaggcatgcttattgcatgctatgtgatatcgggcagctcagcagatctatccctcgagaaggctgcagaggtgtcttgggaggaagaagctgaacattcaggagccagccacaacattttagttgaagtacaagatgatggaacaatgaaaattaaagacgaagagagagacgacactttgacgattttgctaaaagcaactctattagcagtaagcggggtatatcctctatccatcccagcgacgctgtttgtctggtatttttggcagaaaaagaaacaacgaagcggagtactatgggacacaccatcgcccccagaagtagaacgtgccgtattagacgatggcatttatagaataatgcagaggggcctgttgggcaggtctcaagtgggtgtgggtgtcttccaagaaaacgtattccatacaatgtggcacgtaacacgcggtgctgtacttatgtaccagggaaaacgactagaaccaagttgggcctccgtgaaaaaggacctcatatcatatggaggaggatggagattacagggtagctggaatacaggagaagaagtacaagtgattgctgtagagcccggtaagaatcccaaaaacgttcaaacggctccgggaactttcaagaccagcgaaggggaagttggagcaatcgcattagatttcaaaccgggtacaagtggcagccctatagtaaacagagaaggaaaaatagtaggtctctatggtaatggtgtagttacgacgtcaggtacatacgtctctgcaatagcacaagcgaaagcctctcaagaaggacccctccctgaaatagaagatgaagtctttaggaagcgaaatttaacaataatggaccttcacccgggctcgggaaaaacacggagatatcttccagcaatagtaagagaggcgataaaaagaaaacttcggactctaattcttgcccctacaagagtcgtcgcctcagagatggctgaagctctgaaaggcatgcctatcaggtaccaaactacggcggtaaagtccgaacacacgggtaaagaaattgttgacctaatgtgtcacgctacttttaccatgagattgttgtctccggtacgcgtgcctaactataacatgataataatggatgaagctcatttcacagatccttcatcaatcgctgcgagaggatacatatccacaagagtaggaatgggcgaagccgctgcgatatttatgacggcaacacccccaggaagtgtagaggcttttcctcaaagtaacgctgtaatacaagatgaagaacgtgatatccccgagagaagttggaatagtggatatgaatggattacggacttccctggtaaaacagtatggtttgttccatcaataaaaagcggaaacgacattgcaaactgtctaaggaaaaacggtaagagggtcatccaattaagtcgaaagacatttgacactgaatatcagaaaaccaaaaataacgactgggattacgtagttacgacagacataagcgaaatgggtgcaaacttcagggcagatagagtgatcgacccgagaaggtgtcttaaacctgtaatactaaaggatggtccagaaagagtcatcctggcagggccaatgcccgtaacagttgcaagtgcagcccaacggagaggcaggattggtaggaatcataataaagaaggagaccaatatatttatatgggtcaaccgttaaataatgacgaagaccacgcacattggacggaggcgaaaatgttgcttgataacataaatacacctgaaggaatcatcccagctctctttgagcctgagagggaaaaatcagcagctattgatggagaatacaggttgcggggagaagccaggaagacgttcgtagagttaatgcgtcgaggggatttaccagtctggttatcctataaagtagcatcagaaggcttccaatactcagacagaagatggtgcttcgacggggagaggaacaatcaagtgctggaagaaaatatggatgttgagatatggacgaaagaaggagaacgtaaaaagctgcgtccgcggtggctcgatgccagaacttatagcgatccattagctttacgagagttcaaagagttcgcagcagggagacgttcagtaagtggagatttaatcttagaaataggcaagctaccccaacacctaactcaaagggcgcaaaatgcattagacaacttggttatgttacacaacagcgaacagggcggacgcgcatacagacatgccatggaagaactaccagatacaatagaaactctaatgttattggcattaatagctgtgttaacaggtggtgtaactttattctttctttcaggaagaggtttaggtaaaactagcataggcctgctctgcgttatggcatcatcagtactgttatggatggcatcagttgaaccacactggatcgctgcaagcatcatcctagagttcttcttaatggtactgttgataccagaaccagataggcaacgaactccacaagacaatcagcttgcatatgttgtcatagggctactgtttatgattctgactgttgcagcaaacgaaatgggattacttgaaactaccaagaaagacttaggaattggacacgtcgcagtggaaaatcatcatcatgcggcaatgctagatgttgatttgcacccagcttctgcgtggacattgtatgcagtagcgaccaccataatcacacctatgatgcgccatacaatagaaaacacgacagcaaatatatcgctaacagctatcgctaatcaagcagcaatattgatgggtctagacaaaggatggccgatcagcaaaatggacataggggtaccactccttgcgcttggatgttatagccaggtaaatcctctgacgttaactgcagcagtcctaatgttggttgcccattatgcaatcatcggccccggactgcaggcaaaagccacacgcgaagcccaaaaacgaaccgccgcaggtattatgaagaatcctactgtggatggcatagtagccatagacctagatcctgtcgtctacgatgccaagtttgagaagcaacttggccaaattatgttattaatactatgcacaagtcaaatattactgatgagaaccacatgggccttatgtgaaagtataacattagcgacgggtccattaaccacactttgggaaggttcgcctggtaaattctggaatactacgatcgcagtaagcatggcaaatatttttagaggttcgtacttagcgggagcgggattagctttttcactaatgaaaagcctaggaggaggacgtagaggaactggtgcccagggggaaactttgggcgaaaagtggaaacgtcaactcaatcaactctccaaaagcgaatttaatacctacaaacggagtggaataatggaagtagaccgcagcgaagcaaaggagggattaaaacgcggagaaacgactaaacatgcagtatcaagggggacagccaaactaaggtggtttgtggaaaggaacttggtaaaacctgaaggcaaggtaatagatttagggtgcggacgaggcgggtggtcctattactgcgcaggcttaaagaaagtaacggaagtgaaaggatacacgaaaggtggaccaggacacgaagaaccgattccaatggcgacttacggttggaatctcgttaaactacactccggcaaagacgtattcttcataccaccagagaaatgtgatacattactctgtgatattggggaaagtagcccgaacccaacgatagaggaaggtagaacacttagagttctaaagatggtcgaaccgtggcttaggggcaaccaattctgtataaaaatcctaaacccatatatgccaagtgtcgtagagacactagagcagatgcaacgcaaacacggaggaatgctcgtcagaaatcctcttagtagaaactcaactcatgagatgtattgggtctcatgcggaacaggtaacatagtttcagccgtaaatatgacttcgagaatgcttctaaataggttcacaatggctcatagaaaaccaacttacgagagagatgtagaccttggagcaggtactagacatgtcgcagtcgaaccagaagtggctaacctggatattatcggtcaacgcatagagaacataaaacatgaacacaaaagtacatggcattatgacgaggataacccgtataaaacttgggcctaccacggatcgtacgaagttaaaccatccggctcagcaagttctatggtaaacggtgtagtgaaactcctaacaaagccgtgggacgtaatacctatggtaacgcaaatagcaatgaccgatactaccccctttggccaacaaagagtttttaaagaaaaggtcgacacaaggacgccaaaagcaaaacgaggcaccgctcaaataatggaagttacggctaaatggttatgggggtttctaagtaggaataagaaacccagaatatgcacacgagaagagttcacgcggaaggtgagatcgaatgctgctataggtgccgtattcgtagatgagaatcaatggaactcagccaaagaggccgttgaggatgaaaggttttgggatctcgtacacagagaaagagaacttcataagcagggaaaatgtgcaacctgcgtttacaacatgatgggcaagcgagaaaagaaattaggagaatttggtaaagctaaaggaagtcgtgctatctggtatatgtggctgggtgcccgctttcttgagttcgaagcactaggattcatgaacgaagatcattggttctctcgagaaaattcactatctggtgttgaaggtgaggggctccataaattgggatatatattgcgcgacatatcaaaaattccaggagggaatatgtatgcggatgacactgctggatgggatactcgtatcacggaggatgatcttcaaaatgaggcgaaaatcacggatattatggaaccagagcatgctcttttggcaaaatctatcttcaaactaacatatcaaaacaaagttgtacgggtacagagaccagcgaaaaatggcacagttatggacgttatcagcagacgtgatcaacgggggagtgggcaagtgggcacatacggactaaacacctttacaaatatggaagcacagcttattagacaaatggaatcagaaggaatattttcccctagcgaattggagactcccaatctcgcagggagagttttagattggttagaaaagcacggagttgagcgcttgaaacgcatggcaatctcgggggatgactgcgtcgtaaagcccatagacgacaggtttgccacggcactgacagctcttaacgatatgggaaaagtgaggaaagatgtgcctcaatgggaaccaagtaaaggatggaatgattggcaacaagtaccattctgtagccatcatttccatcaacttataatgaaggatggtcgtgaaatcgtagttccgtgccgtaaccaagacgagttagtcggcagggctagagttagtcaaggagctggttggtcactcagagaaacagcatgcctaggaaaatcctatgctcagatgtggcaattaatgtattttcacagaagagatctcaggctggctgcaaacgctatatgtagcgcagtaccagtagattgggtacctacatctcgaacaacctggtccatacacgctcatcatcaatggatgaccacagaagacatgctttcagtttggaatagagtgtggatcgaagagaatccttggatggaagataaaacgcatataagttcttggggcgatgtaccctatttaggcaaacgggaagatcaatggtgcggaagtttgatagggctaacagcccgagcgacatgggccacgaatatacaggtggctatcaatcaagtaagaagactcataggaaatgaaaattatctagactacatgacctctatgaaacgtttcaaaaatgagtcggatcctgaaggagctttgtggtaa

SEQ ID NO: 21740 - RNA, 9879 nt, synthetic construct
  misc_feature 1..9879: note = derived and/or modified CDS sequence (opt6) from DENV-1__FJ898404__SS-prME
  source 1..9879: mol_type = other RNA
tcggtcactatgttgctaatgctgatgccgaccgctctagcgtttcatttaactactagaggaggggaacctcatatgattgtaactaaacaagaaagaggtaaatcccttttattcaaaacgtccgcaggagttaacatgtgtactctaattgcaatggatctaggggaattgtgtgaggatactatgacatacaaatgtcctagaatcacagaagcagagccggatgacgtcgattgttggtgtaatgcaacagatacttgggttacttatggtacgtgcagtcaaaccggcgaacatagacgagacaaacgaagcgtcgcgttagctccacatgtaggtttgggcttggagacaagaacagaaacttggatgtcaagtgaaggagcttggaaacaaatccaacgtgtcgaaacatgggctcttagacatcccggtttcacggtaattgcattatttttagcacatgcaattggtacttctatcacacaaaaagggataatatttatcctattaatgttagtcacaccatctatggctatgcgatgcgtgggcataggaagcagagatttcgtagaaggcttatccggagcaacttgggtagatgtagttttagaacacgggagctgtgttacaacaatggcaaaagataaacctacccttgacatagaactcttgaaaacagaagttacgaaccctgcagtcttacgaaaactatgtatagaggcaaagataagcaacacgaccactgatagccgatgccccacacaaggagaagcaacacttatggaagaacaagacgctaactttgtctgccgacggacatttgtggacagaggatggggaaatggatgtgggctctttggaaaaggatctttaataacctgcgcaaaatttaagtgtgtcacgaagttagaaggcaaaattgttcagtacgaaaacctaaagtactcagtgattgtaactgtacatacaggggatcaacatcaagtcgggaacgaaagtacagaacatggaaccacagcaacaataacgccgcaagcacctacaagcgagatacaattaaccgactacggagcactgacactagactgtagcccccgaactggcttggatttcaatgagatggtcttacttacaatgaaagagaaatcttggttagttcacaaacaatggttcctagatctcccattgccctggacctcaggggcttcgacaagtcaggaaacttggaatagacaagacctccttgtaacattcaagacagcgcacgcaaagaaacaagaggtagtagtcttaggaagccaagaaggcgctatgcacacggcattaactggggctactgaaatacaaaccagcggaactacaacaatattcgcaggacaccttaagtgccgattgaagatggataaattaacgcttaaaggaatgagctatgtaatgtgcacaggttcttttaaattggagaaggaggtcgctgaaacacaacatggaactgtgcttgttcagataaagtacgaaggaaccgacgcaccttgcaaaataccgtttagtactcaggacgaaaaaggagtaacccaaaatggtcgactcatcacggcaaatcctatagttaccgataaagaaaaacctgttaacattgaggctgaaccgcctttcggggagtcttatatagtcataggagccggtgaaaaagccttaaaacttagctggtttaagaaagggtcttccataggaaagatgtttgaagcaacggctagaggtgctcgaagaatggcaatattgggagacactgcatgggatttcggttcggtgggaggtgtttttacttcggtaggaaagctagtccaccaaatattcggcacagcgtacggagtacttttctctggcgtatcatggacgatgaaaataggtataggagtactcttaacctggctcggtctcaacagcagatccacgagtctatcgatgacctgtatagccgtagggttagtcactttatacctaggggtgatggtgcaagcagactccggatgtgtcatcaactggaagggcagagaattgaagtgtggaagcggtatattcgttacgaacgaggtgcacacttggacggagcaatataagtttcaggctgatagtccaaaaagactaagtgcggccatcgggaaagcgtgggaagaaggcgtgtgcggaattagaagcgccaccagattagaaaatataatgtggaaacaaatatcaaacgagttaaatcatattttattagaaaatgacatgaagttcacagttgttgtcggcgatgttgttggtatccttgctcagggaaagaagatgataagaccgcagccaatggaacataaatattcgtggaaatcatggggaaaagcaaaaataataggggcagatgtacaaaacactacatttatcatcgacggtccgaacacaccagaatgtccagacgatcaacgggcatggaatatatgggaagttgaggactacggattcggtatctttacgaccaatatatggctcaagttaagggatagttatacccaagtatgcgatcacaggttaatgagcgcggccataaaagatagcaaggcggtacatgcagatatgggatactggatcgagtcggagaaaaatgaaacatggaaattggctagagcatcattcattgaagtaaaaacttgtatatggccaaaatctcatacattatggagcaacggagtattagaaagcgaaatgataataccaaaaatttatggtggacctataagtcaacacaattatcgaccaggatatttcactcaaacagcaggaccttggcacctagggaaattggaactagatttcgatttatgtgaagggacaactgttgtcgttgacgaacattgtgggaatcgtgggccatctctacgaacgaccacagtgacaggcaaaataatacatgagtggtgttgtcgtagctgtacgctgccaccactaagattcaagggtgaagacggttgttggtatggaatggaaattcgaccagtaaaggaaaaagaagaaaacctagtaaagtcaatggtaagcgctgggagtggagaagtggattcattcagtcttggacttctatgcatctcaataatgatagaagaagtcatgaggagtagatggagtagaaaaatgttaatgactggtactctagccgtattcctactcttaattatgggccaattaacttggaatgacttaatacgtctgtgtatcatggtaggggcaaacgcttcggaccgtatggggatgggaacaacttacctcgcgctcatggcaacctttaagatgaggccgatgtttgcagttggacttttgtttagaagacttacttcaagggaagtcttactattaacaataggcctctctttagtcgcatcggtcgaacttccaaacagtttggaagaattgggtgatggccttgcaatgggcataatgatactaaaattattgacagacttccagtctcaccaattgtgggcaaccttactcagtttgactttcattaaaaccacgttatctctacattatgcgtggaagacaatggccatggtcttatctatagctagtttattccccctatgcttatctaccacatcacagaaaactacttggcttcccgtactacttggatctctgggatgtaaacccctgacaatgttcctaataacagaaactaagatatggggacgtaaatcttggcctctgaatgaaggaataatggccgtaggagtagtatctatattattatcctcattactcaaaaacgatgtccccctcgccggtcccctaattgcaggaggaatgctaatagcatgctatgtaatcagtgggtcatccgccgatctcagtttagaaaaagcagctgaagtcagttgggaggaggaagcggaacactctggcgccagccacaatatacttgttgtagttcaagatgatggaacaatgaagataaaagatgaagaacgagatgacactctcactatattgcttaaagcgacgctattagccgtgtcaggcgtctatcctctaagtattccagccaccctgtttgtatggtatttttggcagaagaagaaacaacgtagcggtgttttgtgggacacgccttccccaccggaagttgagagagctgtacttgatgatggcatttatagaataatgcagcgtggcttactaggaaggagtcaagtcggcgtaggtgtctttcaagaaaatgtcttccatactatgtggcacgttactcgcggggctgtattaatgtatcagggtaaacgattagagcctagctgggccagcgtaaagaaagaccttatatcatacggcgggggctggagattacaaggttcatggaacaccggagaagaggttcaggttattgcagtggaacccggcaaaaatcccaaaaatgttcagacagctccaggaacatttaaaactccagaaggtgaagtaggagcaatagccctagattttaaaccaggtacgagtggatcacccatcgtaaatcgtgaagggaaaattgttggcttatacggcaacggtgtagttacgacaagtggtacatatgtaagtgctatagcacaggcgaaagcgtcccaagagggaccgttacctgaaatagaagacgaggtatttcgaaaaagaaatttaactatcatggatctgcatcccggatcaggtaagacacgtcgatatctgcctgcgatagttagagaggcaattaagagaaaattaagaactctaatactcgcgcccacccgcgtcgtcgccagcgaaatggcagaggcccttaaaggtatgccaatcagataccaaactacggctgtaaagtccgaacacacgggtaaagaaatagtagaccttatgtgtcacgccacattcacgatgcgactgctctcgccagtaagagttcccaattataatatgattattatggatgaggctcacttcaccgatccgtcttccatagcagcaagagggtacatctctaccagagtaggtatgggggaagcggctgcgatttttatgactgcaacgccccctgggagcgttgaggcttttcctcaatccaacgcagttatccaagacgaagaaagagatatacccgaaagaagctggaactccggatacgaatggattacggattttccaggtaaaaccgtatggtttgttccgtcaatcaaatcaggaaatgatatagcaaattgtcttcggaaaaatggtaaaagagtgatacagcttagtaggaaaacgttcgatactgaataccagaaaaccaaaaataatgactgggattacgtagtaacaaccgatatatcggaaatgggcgccaatttccgagcagatcgagtcattgatcctagaaggtgcttaaaacctgtcattctcaaggatggtccagagagagttatactagccgggcctatgccagtaactgtagcaagcgccgcacaaagaaggggaagaatcggaagaaaccataacaaagagggagaccaatatatctatatgggccaacctcttaacaatgatgaagatcacgcacattggacagaagccaaaatgttactagataacattaatacacccgaaggaataattcctgctctgtttgaaccagaaagggagaaatccgctgcaattgacggagaataccggctacgaggagaagctaggaaaacctttgtagaattaatgagacgcggcgatctacccgtgtggctttcctataaagttgcgagcgaagggttccagtattccgacaggcggtggtgttttgatggagaacgaaataatcaggtactagaagaaaatatggatgtggaaatatggacaaaagagggagaacgcaagaaactacgaccacgatggctagatgcacgaacttactctgatcctctagccttaagagaatttaaggaatttgccgcagggcgtaggagtgtatcaggcgacctcatcttagaaataggtaaattaccgcaacatttaacacaaagagctcaaaacgcacttgataacttagtaatgttacataatagtgaacaaggaggcagagcttatcgtcacgcaatggaggaattaccagacacaattgaaacacttatgttattggccctaattgcggtactcaccggaggagttacattattctttctaagcggaaggggtcttggaaaaacatcaataggattgctctgtgtgatggcgtcaagtgtactactatggatggcatctgttgagccacattggatagcagcaagcatcattttggagttctttctaatggtccttctaataccagaacccgatcggcaaaggactccacaagataatcagttggcatatgttgtaattggactcttattcatgatattaactgttgccgcaaatgaaatgggcctactggaaacaactaagaaagacctagggatcggtcatgtagccgttgaaaaccaccatcacgcgactatgttggatgtggatctccaccccgcgtccgcgtggacgctctatgcagtagctactacaataatcacgcccatgatgcgacacacaatagaaaacacaacagctaacattagccttactgcgatagcaaatcaagctgcgatcctaatgggtttggataaaggatggccaatatcaaagatggatataggtgtacctctgttggcattaggctgctattcccaagttaatcctctgacattaactgctgcagttctaatgttagtagcccattatgcaataatagggcccgggttgcaagctaaagcaacgcgcgaagcacaaaagagaacggctgcaggcataatgaaaaatcctacagttgacggcattgtcgcaatcgatttagatccagttgtctatgacgcaaaatttgaaaaacaactcggacaaataatgctactaatactatgtacgagtcagattcttcttatgcgtacgacctgggcattatgcgaatcaataaccttagctactgggccactaacgactttgtgggagggttcacctggaaagttctggaatacgacgatcgcagtttcaatggccaatatattcagaggttcctacctagcaggagcgggactagcgttcagtctaatgaaatctttaggtggaggaagacgcggtacaggtgcacagggtgaaacactcggcgaaaaatggaaacgacaactaaaccaattgagcaaaagtgagttcaatatatataaacgctccggaatcatggaagttgatcgtagtgaagccaaggaaggccttaaacgaggggaaactacaagacacgcggttagtcgaggaacagctaagctccgctggtttgttgaaagaaatctagtcaaaccagaaggaaaagtaatcgacctcggatgcgggagaggagggtggtcatattattgcgcggggttgaagaaagtgacggaagtaaaaggttataccaaaggtgggcctggtcatgaggaacctataccaatggcgacctacggatggaatctcgtcaagctccactcggggaaggacgtcttctttacaccacccgaaaaatgcgatacacttttatgcgacataggcgaatcgtccccaaacccaaccatagaagaaggcagaacattaagagtattaaagatggtagaaccatggttgagaggaaatcagttttgcattaagatcttaaacccgtacatgccttcagtagtagaaacactagaacaaatgcaaagaaaacatggaggaatgttggtaaggaacccgctctcacgcaattcaacacatgaaatgtattgggtaagttgtggcacgggtaacattgtgagtgccgttaatatgacaagtagaatgttattaaatagatttacaatggctcatcgaaaaccaacatacgaacgtgacgttgatttgggtgcaggtacaaggcacgtggccgttgagcctgaggtcgctaacctagacattatcggtcaaaggatagaaaatattaaacatgaacataagagtacctggcactacgacgaagataatccgtataaaacctgggcttaccatggttcatatgaagtaaaacccagcgggagcgcaagtagtatggtaaacggagtagtcaaactgctaacaaaaccttgggatgtcattcccatggtgacgcaaattgccatgacggacacaacccctttcggccaacagagagtttttaaggaaaaagtagatacacggacgccgaaagcaaagagaggaacggcacaaattatggaggtgacggcccgatggttatggggctttttatcccgaaacaagaaacccaggatatgtactcgagaagagttcacaagaaaggtaaggtcaaacgctgctataggagcagtatttgttgatgaaaaccaatggaacagtgcaaaagaagcagtcgaagacgaaagattttgggatttagtccaaaaagaacgggaattgcataagcaagggaaatgcgcaacatgtgtttataacatgatgggcaaacgagagaagaaactgggggaatttggaaaggcgaaaggatctagagcgatatggtatatgtggctaggggcgagatttctcgagtttgaggcattaggattcatgaacgaagaccactggtttagccgtgaaaatagcttatctggagtagaaggtgagggtctccataaattaggatacattctacgcgacatttcaaaaattccaggaggaaatatgtatgccgatgacactgcggggtgggatacaagaataactgaagacgacttacaaaatgaagcaaaaattaccgatattatggagcccgaacacgcactgcttgcaacaagtatatttaaactaacttatcaaaataaggtggttcgagttcaaaggccagccaaaaatggtacagttatggatgtgataagcagacgggaccaaagaggaagtggccaggttggcacatatggtttaaatacgtttacaaatatggaagcacaattaataagacaaatggaatcggaaggaatatttttgccatcagagcttgaaaccccgaacctagcagaaagagttttagactggcttgaaaaatatggcgtggaaaggctaaaacgaatggcaatcagtggtgacgattgcgttgttaaaccaatagacgatagattcgctacagctcttacagcactaaatgacatgggaaaagtccgtaaggatatcccacaatgggaaccaagtaaagggtggaatgactggcaacaagtccccttttgcagccatcattttcaccaattaataatgaaagatggtagagagatcgtagtcccctgcagaaatcaagacgagctagtcggtcgagcaagggtgtcccaaggtgccggctggagtctcagagaaacagcctgtttaggaaagtcgtatgctcaaatgtggcaattaatgtactttcataggagagatttacgcttagcagcaaacgcaatttgtagtgccgttcctgtagattgggttcccacaagtagaactacatggtcgattcacgcccaccaccaatggatgactactgaagacatgttaagtgtttggaacagagtatggatagaggagaatccctggatggaagacaagacccatgtttcaagttggggtgacgtaccttatctaggtaaacgagaagatcaatggtgcggcagcttaataggcttaaccgcccgggcaacgtgggccagtaatattcaagtggctatcaaccaagtaaggaggctaataggtaatgaaaattatctagattatatgacaagtatgaaaaggtttaaaaacgaaggagatcctgaaggagctttatggtga

SEQ ID NO: 21741 - RNA, 9879 nt, synthetic construct
  misc_feature 1..9879: note = derived and/or modified CDS sequence (opt6) from DENV-1__GQ199840__SS-prME
  source 1..9879: mol_type = other RNA
tcagttacgatgctgctaatgttaatgccgacagccttggcatttcatttaaccactagagggggtgaaccacatatgatagtttctaaacaagaaaggggaaagagcttattattcaaaacatcagcaggagtaaatatgtgcactctcatcgctatggacctgggggaattttgtgaagatacgatgacatataaatgtccgcggataacagaggcggaacctgacgacgtagattgttggtgtaatgccacagatacttgggtcacctacggaacatgcagccaaactggtgaacacagacgcgataaacgttccgtcgcattggctccacacgtcggactaggattagaaaccagaacagagacatggatgagtagcgaaggggcttggaaacaaatccaaagagttgaaacatgggcattgcggcacccaggttttactgtaatagctttattcttagctcatgcgattggaacgagtataactcaaaaaggaattatctttatactactgatgttggtaacaccgtctatggcaatgagatgcgtcggcataggttctagagatttcgtagagggactctccggagcgacctgggtagatgtagtcctagaacacggttcatgtgtgaccacgatggcaaaagacaaaccaactttagatatcgagctcctcaaaacggaggtaacgaatcctgcggtactaagaaaactatgcatcgaagcgaaaatctcaaatactactactgattccaggtgtcccacacaaggagaagcaactttggtggaagaacaagatgctaactttgtctgtagacgaacctttgtagaccgtgggtggggcaatggatgtggactatttgggaaaggatcactcattacctgtgcgaaattcaaatgtgtaacaaaattggaaggtaaaatagttcaatatgaaaatttaaaatacagtgtaattgtgactgtacacactggggatcagcaccaagtaggaaacgaatccactgagcatggaacaacggctaccattacgccacaagccccatccacagaaatacagttgacagactatggcgcattaactttagactgttcaccgagaactggcctagactttaatgaaatggtcttactaactatgaaagaaaaatcatggttagtccacaaacaatggtttctggacctaccattaccatggacttctggggcgagcacttctcaagaaacctggaatcgacaagacctcttagttacctttaaaacagcgcatgcaaagaaacaagaagttgtagtgctaggatcacaagagggcgcaatgcatacagcactaaccggggcaacagaaattcaaacgtcggggaccacaacaatctttgctgggcaccttaaatgtcgattaaaaatggacaaattaacattaaaagggatgtcatatgttatgtgtactggttcctttaaattggagaaagaagtagcggagacccaacatggtacagtgctagtccaaattaaatacgaagggaccgacgctccatgcaaaataccttttagtactcaagatgaaaaaggagtaactcaaaatggtcgactaatcaccgcgaatccgattgttacagataaggaaaagcctgtaaacatagaagctgaaccaccgtttggagagtcttacatagtaattggtgccggagaaaaggctttaaaactaagttggttcaaaaagggatcaagtattggaaaaatgtttgaagctacagcccgcggagcacgccgaatggccattctgggggataccgcttgggattttggatccataggaggtgtattcacttcggtcggaaaactcgtacatcaaatatttgggactgcatatggggttttattctcaggggtctcttggactatgaaaataggaataggtgttctacttacgtggctggggctaaacagtaggagtacgtcactaagcatgacatgtatagcagtaggcttagttaccctctatttaggagttatggtacaggccgactctggttgtgtaataaattggaaagggcgcgaattaaaatgcggaagtggcatatttgtaacaaacgaagtccatacatggacagagcaatacaaattccaggcggacagcccaaaacgtttatcggcggcaatcggaaaagcatgggaggagggagtttgtggaataagatccgcgacgagactagaaaacattatgtggaagcaaatttcaaatgagctgaatcacatattattagagaatgatatgaaatttacagttgtcgtcggcgatgtagcaggaatattagctcaaggcaagaaaatgatcagaccccagcccatggagtataaatacagttggaaatcgtggggcaaagcgaaaataatcggagcagacgtgcaaaatacaacttttataatagatggtcccaatacacctgaatgtcctgatgatcaacgtgcgtggaatatatgggaagtggaagattatggttttgggatatttacaacaaatatatggttaaaacttcgagacagttatacccaggtttgtgatcataggctcatgtctgcagcgataaaagacagtaaagccgttcacgctgacatgggatactggatcgaatcagagaagaatgaaacctggaaattagcacgagctagctttattgaagttaaaacttgcatctggccaaaaagtcatacactttggagtaatggagtgctggagagcgaaatgattataccaaaaatctacggaggcccaatttcccaacacaattacagaccaggatattttactcaaacggcagggccatggcacttagggaaattagaattggatttcgatctttgtgaaggaaccactgttgtagttgacgagcattgtggaaatagaggtcctagcctaagaacaacaaccgtcacaggtaaaattatccatgaatggtgctgtcgttcgtgcactctaccaccgttacgcttcaaaggtgaagacggttgttggtacggaatggaaatcaggccagtaaaagagaaagaagaaaatctcgttaagtctatggtgtcagctggaagtggagaggttgatagcttttcccttggattattgtgtatttctattatgatcgaagaagtaatgcgtagcagatggtcaagaaaaatgttgatgacaggtactctagctgtctttttcctactaattaccggacaactcacatggaatgatcttatccgattatgcataatggttggagcaaacgcttctgatagaatgggaatgggaacaacgtatttagcactaatggcaacgtttaaaatgcgcccaatgttcgcggtgggactcttattcaggaggttgacttctagagaggtacttttattgacaattgggttaagtcttgtggcttctgtggaattacctaatagcctagaagaactaggtgatggcctagccatgggtatcatgattttaaaactcctaaccgatttccaatcacaccaactctgggcaacacttctctctttaacctttataaaaaccacattttctttacactatgcatggaagacaatggccatggtattatccattgtatcattatttccactttgtttatcaaccacaagtcagaaaactacctggctacctgtgctattaggatcgctaggatgtaaaccattaactatgtttcttatcgctgaaaataaaatttggggcagaaaatcctggccccttaatgaaggtatcatggctgttggaatagtatcaatactattatcatcattattgaaaaatgacgtccccttagcaggaccccttattgcgggtgggatgttaattgcatgttatgttatttcaggaagctcagctgatttatctctagaaaaagccgcagaagtatcatgggaagaagaggcagaacatagtggtgccagtcataacattttggtggaagtacaggacgatggaacaatgaaaataaaggatgaggaacgggatgatacattaaccatactacttaaagccactttactcgcagtttctggggtctacccactttcgattccagcgacgctattcgtatggtacttttggcaaaagaagaaacaaagatctggggtattatgggacattccctcaccccctgaggtagaaagagccgtactggacgatgggatatatcggataatgcaaagagggttacttggaaggagtcaagtgggggttggcgttttccaagaaaacgttttccacacaatgtggcatgtgacccgtggggccgtgttaatgtatcagggaaaacgacttgagccatcatgggcctccgtaaagaaagacttaatttcatatggaggcggctggcgactacaaggaagttggaatacgggcgaagaagttcaagttatcgcagtcgaaccaggcaaaaatccgaaaaatgttcagacggcacccgggacttttaaaaccagcgaaggtgaggtaggggctatagcgctcgattttaaacctggaacaagcggttcccccattgtaaacagggagggaaaaatcgtgggactctatggtaacggtgtcgtgacaacatcgggcacatatgtctcagctatcgctcaagcaaaggcttcgcaagagggtccacttcccgaaatagaagatgaggtatttcggaaacgaaacctaacaatcatggaccttcatccaggtagtggaaaaacaagaagatatttaccggctatagtaagagaagccataaaacgaaaacttcggacattaatccttgcaccgactcgggtggtcgcatctgaaatggctgaagcactaaaagggatgccaattcgttatcagaccactgccgttaaaagtgaacacaccggcaaagaaatagtcgacttaatgtgtcatgccacttttactatgcgacttttatcgcccgtcagagtgccaaattataatatgataatcatggatgaggctcatttcactgatcctagtagtattgctgcacgtgggtatatatcaacgcgtgttggaatgggcgaagcagcagcaatttttatgacagctacacccccaggatcagtcgaggctttcccacaaagcaatgcagtcatacaagacgaggaacgcgacattccggaacgaagctggaactcgggttacgagtggattacggacttccctggcaaaactgtatggttcgtcccatcgataaaatcgggcaacgatatagcaaactgtctcaggaaaaatggcaaaagggtaatacaattatcgcgtaaaacatttgatacagaataccagaaaaccaagaacaatgattgggattatgtagttactacagacatatctgagatgggagctaatttcagagcggatcgtgtaatagaccctaggcgatgtcttaaacccgtaatactaaaggatgggccagaaagggtaatattagctggtcccatgcctgtcaccgtcgcgtcagcagcgcaaagaagaggacgcatagggcgaaatcataacaaagaaggcgatcaatacatttatatgggtcaaccgttgaataacgacgaagaccacgcgcactggaccgaagctaaaatgctccttgacaacatcaacacgcccgaaggaattatcccggccctgttcgaacctgaacgtgaaaagtcggcagcgattgacggagagtacagattacgcggagaagctcggaagacattcgtagaactaatgaggaggggtgatttacctgtatggctttcttacaaagtcgcatcagagggtttccaatattccgacagaagatggtgcttcgacggtgagcggaacaaccaggtattagaagagaacatggatgtcgaaatttggacaaaggaaggtgagaggaagaaattaaggcctaggtggctcgatgcacgaacatattcagatccattagcactaagggaatttaaggaatttgcagcagggaggagatccgtaagtggagatctcattctagaaataggaaaattaccccaacacttgacacaacgagctcagaacgccttagataatctagttatgctccacaattcagagcaaggaggtcgagcttacaggcatgcaatggaagaactccccgatactatagaaactttaatgttattagcgcttatagccgtcttgacaggaggagtcaccctctttttcttgtctggacgtggattaggcaagacctcaatcggcttactatgtgtgatggcaagcagtgtattattatggatggcatccgtcgaaccacattggatagctgctagcataattttggagttctttctgatggtgctactaattccagagcccgaccgtcaaagaacgccgcaggataaccaattagcttacgtagtgataggacttttatttatgattttgactgtagcggcgaatgagatggggctattagagaccaccaaaaaggacctaggaatcggacatgttgcagcagaaaatcatcatcacgctgccatgcttgatgttgatctacaccccgcgtccgcttggacactatacgctgtagcgaccacaataattactcctatgatgcgacacacaattgaaaacacaacagctaatatatcactaacagctatagccaatcaagcagcgatcctaatggggctagataagggatggccaatctcgaaaatggatatcggggttccactcttagctcttggttgttactcacaggtgaatccattaacattgactgcagcggtactaatgctagtagctcattacgctatcataggaccaggacttcaggccaaagcaacaagagaagcacaaaagcgaactgccgccggtattatgaagaatcctactgtagatggaatcgttgcaatcgacctagatcctgttgtctatgatgcaaaattcgagaaacaactcggccaaattatgttactaatactctgcacgtctcaaatattgttaatgcgaacgacgtgggcactgtgcgaatcaattacccttgcaacggggccactaactactctgtgggaaggttcaccaggaaagttttggaacacaacgatagcggtcagtatggctaacatatttaggggaagctacttagcaggggcaggcctagcattttcgctcatgaaatcgctaggtggaggacgtagaggaactggggcacaaggggagacactcggtgaaaaatggaaaaggcagctaaaccaactctcaaagagcgaatttaacacttataagcggagtggaataatggaagtcgatcggagtgaagcaaaggaaggtctcaaaaggggagagacaacaaaacatgccgttagtagaggcacagcgaaattacgctggttcgttgaacgcaatttagtaaagccagaggggaaggttatcgaccttgggtgcggtcgcggaggttggagttattattgtgccggtctcaagaaagtaacagaggttaaaggatacactaaaggagggcccggacatgaagaaccgatacctatggcaacatacggatggaatttagtaaaattacactcaggaaaagatgtatttttcatccctcccgaaaaatgtgatacattattgtgtgatataggtgaaagcagccccaatcctacaatagaggaaggacgtacattacgcgtgctgaagatggtagaaccatggttacgcggcaatcaattctgtattaagattttgaacccttacatgccgtcagtggtggagacactagaacaaatgcaacgaaaacacggaggcatgttagtgagaaatccgctctctcgtaactctacacacgagatgtactgggtctcatgtggaactggtaacattgtgtctgcggtcaatatgacctcaagaatgcttctgaatagattcacgatggcacaccgaaaaccaacgtacgaaagagatgtggatttaggtgctggcactcgccatgtcgccgtggagcccgaagtcgcgaatttagacataatcggccaacgcatagaaaatattaaacacgaacataaatctacttggcactacgatgaagataatccctacaagacatgggcgtatcatggatcatatgaggtaaagccgagtggcagcgcaagctctatggtcaacggagtggtcaaattactgaccaaaccttgggatgtaatcccaatggtgacccagattgcaatgactgatacaacaccattcggccaacaaagggtatttaaagaaaaagtagatacgcgtactcctaaagcgaaacggggcacagcacagattatggaggtgaccgctaagtggttatggggatttttaagtagaaacaagaaaccaagaatatgtacaagagaagaatttactagaaaagtaaggtcaaacgccgctatcggtgctgtatttgtagatgaaaatcaatggaatagtgccaaggaagcagtggaagatgagagattttgggacttggttcaccgagaaagggaactacacaagcaaggcaagtgcgcaacgtgtgtatacaacatgatgggcaaacgagagaagaaactgggggagttcggtaaggcgaaaggaagcagggctatatggtatatgtggttaggagcccgatttttggagttcgaggctttagggttcatgaatgaagatcattggtttagtcgcgaaaactcattaagcggagtagaaggagaaggcctccataagctaggatacatactaagagatataagcaaaattcctggtggaaatatgtacgcagatgacacggccggatgggacaccaggataacagaggatgacttacagaacgaagcaaaaataacagatattatggagccggaacatgctttattagcaaagtcgatttttaaactaacctaccaaaataaggtagtgcgagtccaaagaccagccaagaatggtacggttatggatgtgataagcagacgtgatcaaagaggctcaggacaagtcgggacatatggattaaacactttcactaacatggaggcacaattaattagacaaatggaaagtgagggaatattcagcccaagcgagttggaaacaccgaatctagcagggcgggttttagactggttagaaaaatacggggttgagagattgaagaggatggcaataagtggagacgattgcgtagtgaaaccaatagatgaccgcttcgcgacggcgcttacagcactaaatgatatgggcaaggtgcgaaaagatattccacaatgggaaccatcgaaagggtggaatgattggcaacaagttcccttttgttcacatcatttccaccaactaatcatgaaagacggaagagaaatcgtagtaccttgcaggaatcaagacgagctagtaggaagggcgagagtcagccaaggagcaggatggtcacttagagaaactgcatgtctaggaaaatcatacgcacaaatgtggcaattaatgtattttcacagaagggatctacgtttagctgcaaatgcaatatgtagcgcagtccccgttgattgggtacctacatcacgaacaacatggtccattcacgcgcatcatcaatggatgactactgaagatatgctatctgtatggaatcgcgtttggatagaagagaacccttggatggaagataaaacacatatctcatcatggggagatgtaccatatttaggcaaacgggaagaccaatggtgtggatcgttaataggactaacagcacgtgcaacttgggcaacgaatatccaagttgctataaaccaagtaaggagactgataggcaatgaaaattatctagattatatgacgagcatgaagaggttcaagaacgagtcggatcctgaaggggcactatggtga

SEQ ID NO: 21742 - RNA, 9879 nt, synthetic construct
  misc_feature 1..9879: note = derived and/or modified CDS sequence (opt6) from DENV-1__FJ898405__SS-prME
  source 1..9879: mol_type = other RNA
tctgtgaccatgctgttgatgctcatgccaactgcgctggctttccatctcactacccgaggaggggaaccccatatgatagttacgaaacaagaaagagggaaatccttactatttaagacaagtgcaggggttaatatgtgtaccttaatagcaatggacttgggcgaactatgtgaagacactatgacttacaaatgtcctcggataactgaagcagaacctgatgacgtagactgttggtgtaatgctactgatacatgggtgacctacggaacatgtagccaaacaggagaacatcgaagagataaaagaagtgtagcattagccccgcatgtaggccttggacttgaaacgagaacagaaacctggatgagttcagaaggagcctggaaacaaatacaacgcgtagagacatgggctttaaggcatccgggatttaccgtaatagccttatttctcgcacacgcaatagggacatcaataacccaaaaaggaattatatttatactacttatgttggtaactccttccatggctatgagatgcgtaggaatcggatcaagagattttgtagaagggctttccggtgcaacatgggtcgacgtagtcttggaacacggaagctgtgtgacaaccatggcaaaagataaaccaaccctagacatagagttgttaaaaacagaagtaacaaatccggctgttttacgtaagctatgcattgaagcgaaaatcagtaatacgaccacggatagcagatgtcctactcaaggtgaagcgacacttatggaagaacaagatgctaattttgtgtgtcgccggacgttcgtggacagggggtggggaaatggatgcggattatttggcaagggttcactaataacttgtgcaaaattcaaatgtgtaactaaacttgaaggaaagatcgttcaatacgaaaatcttaagtattctgtcatagtcaccgtacacacgggcgaccaacatcaggtcggtaacgaaagtacagaacatggtaccacggcaacgattactcctcaggcaccgacatccgaaatccaattaacagattacggcgcattgacattggactgctcacccaggacaggtctagatttcaacgagatggtcttattgaccatgaaagaaaaatcctggttggttcataaacaatggttcttagatttacctctaccctggacaagtggggcttccacatctcaggaaacctggaacagacaggatctattagtaacttttaaaacagcccatgctaagaaacaagaagtcgttgtactaggatcacaagaaggcgccatgcataccgctttgacaggcgcaacagaaattcagacatcagggacaacaacgatctttgccggtcacctcaaatgccggcttaaaatggataaactaacgctaaaaggaatgtcctatgttatgtgtacaggctcctttaaactggaaaaagaagtggcggaaacccagcatggaactgtcttagtacagattaagtacgaaggaaccgacgctccttgtaaaatcccattttcaacacaagatgaaaagggcgtgacacaaaacggcagactaatcactgcgaatcctattgttactgacaaagaaaaacccgtaaatatagaagctgaaccgccctttggagagtcgtatatcgtgataggagcaggagaaaaggctcttaaattaagttggtttaagaaaggaagtaacataggaaaaatgttcgaagctacggcaaggggtgcaagaaggatggcaatattaggggacaccgcttgggactttggatcaataggaggcgtcttcacaagtgtaggaaagttggttcatcaaatattcgggacagcatatggcgtcctattttccggagtctcttggacgatgaaaatcggaataggcgttctattaacttggctcggactaaattcaagatctacgagtttatccatgacctgtattgcggtaggcctagtaaccctgtatttaggagtcatggttcaagcagatagcgggtgtgtaattaattggaaaggacgagaactaaaatgtggttcggggatctttgtgacaaatgaagtgcatacatggacagaacaatacaaatttcaagccgactcacctaaaagactttcagccgctatcggtaaagcatgggaagaaggtgtgtgcggcataagaagtgctacgcgtcttgaaaacattatgtggaagcagatcagcaatgaactaaatcatatacttttagaaaatgatatgaaattcactgtagtggtaggagatgtagtgggtattcttgcacaagggaaaaagatgataagaccgcagcccatggaacataagtatagttggaaaagttggggcaaagcaaaaataataggggctgacgtacaaaatacaactttcataatcgacggaccaaatacaccagaatgtccagacgatcaacgagcttggaacatatgggaagtagaagattacggatttgggatctttactaccaacatatggctaaaactacgggactcatatactcaagtatgcgatcatagattaatgagcgcagcaattaaagactctaaagcggtacacgccgacatgggatactggatagaaagtgagaaaaatgagacttggaaattagcacgagccagctttatagaagttaaaacttgtatttggccaaaaagtcacacactatggagcaacggagtattggaatctgaaatgataataccgaagatatatgggggacccatatcgcaacacaattataggccgggttatttcacccaaacagcaggaccatggcacttaggaaagttggaattggattttgatttatgcgaaggaaccaccgtcgtagtagacgaacattgcgggaacagaggcccgtctctcagaactaccacagtaactggaaaaataatccatgaatggtgttgtcgtagttgtactctccctcctttaagattcaaaggagaagatggttgttggtatggaatggaaattagacctgtgaaagaaaaagaagaaaacctggtaaagtcaatggtatctgcaggttcaggagaggtcgattccttttcattgggcttactatgcataagtatcatgattgaagaggtgatgcgttcaagatggtccagaaaaatgctcatgacgggaacgcttgccgtcttcctcttattaatcatgggacaattaacttggaacgatcttattaggctctgtattatggtaggggctaatgcatctgatagaatgggaatgggtacgacatatttggcgttaatggctacatttaaaatgcgaccgatgtttgcagtgggtctgttgtttagaagactcacgagccgtgaagttttgttattaactattggattgtcattagttgcctcagtcgagctacccaattcattagaagaattaggggatggactcgcaatgggcataatgatactcaaattattaacagatttccagtcacaccagctatgggcaacactcctatcactaaccttcattaaaaccacgctaagtctacactacgcatggaaaactatggcaatggttctaagcatcgtaagcctctttcccttatgtctttcaacgacaagccagaaaacgacatggttacctgtattattaggatcgctaggctgcaaaccacttactatgttcctaatagcagaaaataaaatttggggtcgaaaaagttggcccctaaatgaagggataatggctgtgggtgttgtaagcatcttactgtcgagcttactgaaaaatgatgtcccactagcaggccctctaatagctggtggaatgcttatcgcatgctatgtaataagcggatcaagcgccgatctatctttagaaaaagctgctgaggtatcctgggaagaagaagcagaacattcaggtgcgagtcataacatattagtggaagtccaggacgatggtactatgaaaataaaagatgaagaacgagatgacacgcttacaatacttctgaaagcaacactcttagctgtctcaggggtataccctttaagtatccctgctacattattcgtgtggtatttttggcaaaagaagaaacaacggtccggagtgctatgggacacacctagcccacctgaagtagaaagagccgtattagatgacggcatttaccgcataatgcaacgtgggttactaggaagaagtcaagtgggtgtcggcgtcttccaggaaaatgtgttccacactatgtggcatgttacgagaggggcagtcctaatgtatcaaggaaaacgcttagaaccaagctgggctagcgtcaagaaagatttaattagctatggaggtgggtggcgcctacaaggatcttggaatactggagaagaagtccaagttatcgcagttgaacctggcaaaaatcccaaaaatgtccaaactgcaccaggtactttcaaaactccagaaggagaagtcggtgctattgcgttagactttaaaccaggaacctctggtagcccaattgtgaatagagagggaaagatcgttggcctgtacggcaatggggttgtaacaacatctggaacatacgtatctgcaatagcacaagcaaaagcatctcaggaaggacccctacctgaaatagaagatgaagtttttagaaaaaggaatctgacgattatggacctacatccaggatcaggaaagaccagaaggtaccttccggccatcgtccgcgaagccatcaaaagaaaacttagaaccctaattctagctccgaccagagtcgttgcatcagaaatggcggaggctctcaagggaatgcctataagataccaaactactgccgtaaaatcagagcacacaggaaaggagatagtggatttaatgtgccacgcaacctttacaatgcggctactgtcaccagttcgtgtcccgaactataacatgatcataatggatgaggctcattttacagatccaagtagcatagcggcgagaggttatatatcaacgagagtaggcatgggagaagctgccgcaatattcatgacagcgaccccaccaggttcagtagaagcgtttccccaatcaaatgctgtaattcaagatgaggaaagagatattccagagcgttcttggaacagcgggtatgaatggattacagattttcccggtaaaaccgtatggttcgttccgtcgatcaagtccggaaacgatattgctaactgtttacgtaaaaatgggaaaagagttatccaactcagcagaaaaacattcgatactgaataccagaaaacgaaaaataacgattgggattatgtcgtaacaacagatattagtgaaatgggagcaaactttcgcgcagatcgtgtaatagatccaagaagatgcttaaaaccagttattctgaaagatggcccggagagagtcatccttgccggaccaatgccagtgacagtagcgagtgcagctcaacggagaggtcgaattggccggaatcacaacaaagaaggagatcaatacatatacatgggacaacctctaaacaatgacgaagatcatgctcattggacagaggcaaaaatgttactagataatataaatacacctgaaggaattattccggcattatttgagcccgagcgagaaaaatcagctgcaatcgatggcgaatatcgtctacgcggggaagctcgaaaaactttcgttgagttaatgcgacgaggcgatctaccagtctggttaagttataaggtagcatcagaaggtttccaatactctgatcggcgatggtgctttgacggcgaaagaaataatcaggttttggaggaaaatatggatgtagaaatttggactaaagagggggaaagaaagaaactacggccgaggtggttagatgcaagaacatacagcgacccacttgcattacgagaatttaaagagtttgcagcgggcagacgatcagtgtccggagatttaatactcgagatcggtaaacttccacaacacctcactcagagagcccaaaatgccttggacaacctcgttatgttacataattcagaacaaggcggtagggcttataggcatgcaatggaagaattaccggacactattgaaacactgatgctattggcactaatagcagtactgactggaggtgtaacgctctttttccttagcggtcgtggtttaggaaagacgtcaataggcctactatgtgtaatggcttcatcggttctactatggatggcttcagttgaaccacactggatagcggcgagtattattttggagttcttcttaatggtcctacttattccagaaccagacagacaaagaaccccacaagacaatcaattagcatacgttgtcataggtcttctgttcatgattctgacggtagccgcaaatgaaatgggactattggaaacaactaagaaagacttagggatcggtcacgtggctgtcgagaatcatcatcatgctactatgctagacgtagatctacatcctgctagtgcatggacgttatatgcggtagcaaccacgatcattacaccaatgatgagacataccatagagaacacgactgctaatatctctctaacggctatagctaatcaagcagctatcttgatgggattagacaaaggttggccaatatcaaaaatggatattggagtacctctattagctttaggttgctatagtcaagttaacccattgacattaacagccgcggtacttatgctagttgctcactatgcgataattggcccgggattacaagcaaaggcgacacgcgaggcacaaaaacgaactgccgctggaataatgaaaaacccaacggttgatggcatcgtcgccatcgaccttgatcccgtcgtttatgacgcaaagttcgaaaaacagctggggcaaattatgctactaatattatgtacttctcaaattcttttaatgcggacgacatgggcgttgtgcgaatcaattaccttagcaactggtcctctaaccacattatgggagggttcgccaggtaaattctggaataccacaatagctgtaagcatggcaaacattttcagaggatcttatctggcaggagcgggcttagctttttccttaatgaagagtttaggtggagggcggagaggaactggggcgcaaggagagacccttggtgaaaaatggaaacgtcagctaaaccagttatcaaagtcagagttcaacatttacaagcggtctggaataatggaggtagacagaagcgaagcaaaagaaggtttgaaaaggggtgaaacgactaggcacgctgtttcccgtggaaccgcaaagttaagatggtttgttgaaagaaacctagtgaaacctgaggggaaagtgatagatcttggatgcggaagaggaggatggagttactactgcgctggactgaaaaaggttacggaagttaaaggctatactaaaggtgggccgggacacgaagaaccaataccaatggcaacgtacggttggaatctcgtcaaacttcattcggggaaggatgtgttctttactcccccagagaaatgtgatacactactatgtgatataggggaatcatcgccaaatccaaccatcgaagaaggaaggaccttgagagtcttaaaaatggttgaaccatggttaaggggaaatcagttctgtataaaaatactcaatccatatatgccctccgtagttgagacactggaacaaatgcaacgtaagcatggaggcatgctagtacggaacccccttagccgtaacagcactcatgaaatgtactgggtctcgtgcggtacaggtaatatagtcagtgcggtcaacatgacttccagaatgcttctaaataggtttacgatggcacatagaaaaccgacttatgaaagagatgtagatctaggtgcaggaaccagacacgtcgccgtagagccagaggtagcaaatttggacataataggacaaagaatagagaatattaaacatgaacacaaatctacctggcattatgacgaagacaacccgtataagacttgggcataccatggaagttacgaagttaaaccatccggatccgcgagtagtatggtgaacggtgtagtaaaactcctgactaaaccttgggatgtaatccctatggttactcaaattgctatgacggatacgactccatttggacagcaacgcgtatttaaagagaaggtagatacaagaacacccaaagccaaacgaggaactgctcaaattatggaggtcactgcaagatggctatggggatttctctccagaaacaaaaagccaaggatatgtacccgagaggagttcaccaggaaagtacgatcgaacgcagcaatcggggcagtatttgtagatgaaaatcaatggaactctgcaaaagaagcagtagaagacgaaagattctgggatctcgtacaaaaggaacgagaactccacaaacaaggaaaatgtgctacgtgtgtgtataacatgatgggaaaaagagagaagaaattgggagaatttggtaaagcgaaagggtcacgagctatatggtatatgtggttaggtgctcggtttttagaatttgaagcgttaggtttcatgaatgaagaccactggttttcacgtgaaaatagtctttctggggttgaaggagaaggtcttcacaagttgggctacatattaagagatatctctaagataccaggaggtaacatgtatgcagatgacactgcagggtgggatacaaggataaccgaagatgacctccaaaatgaggctaaaattacggatataatggagcccgaacacgcgttattggcaacatcgatattcaaactgacatatcaaaataaagtcgttagagttcaaaggccagccaaaaatggcacagtaatggatgttatctctcgtagagatcaaaggggtagtggacaagttggaacttatggattaaacacatttactaacatggaagcacaactaatccgtcaaatggaatccgaaggaatattctccccttcagaacttgaaatacccaatttagcagaacgcgtgctcgactggctagaaaaatacggggttgagaggcttaaacgaatggcaatatcgggtgacgattgtgtcgtgaagccaatagacgatcggtttgccaccgcattaacggcccttaacgatatgggaaaagttagaaaggatgtcccacaatgggaaccatcgaaaggttggaatgattggcaacaagtccctttttgttctcatcacttccaccaactaatcatgaaagatggacgtgagatcgtagtcccttgtcgcaatcaggatgagttggttggacgggcccgagtctcgcaaggcgcgggatggagccttagggagacagcgtgccttggaaaatcctatgcacagatgtggcaactaatgtacttccacaggagagaccttaggcttgcagcaaacgcaatctgtagtgcagttcctgtagactgggtacctacatcgaggacaacatggtcgatacacgcacatcatcaatggatgacaacagaagacatgttgagtgtttggaacagagtctggatagaagagaatccatggatggaggacaaaactcacgtatcatcatggggcgatgtaccttacttaggtaaaagagaagatcaatggtgcggtagcctaataggtttaacagcaagggccacgtgggcatcgaatattcaggtagcgattaatcaagtaaggcgactgattggaaatgaaaactacttagactacatgacgtccatgaagaggttcaaaaacgaaggagatccagaaggggctttgtggtaa

SEQ ID NO: 21743 - RNA, 9879 nt, synthetic construct
  misc_feature 1..9879: note = derived and/or modified CDS sequence (opt6) from DENV-1__FJ898406__SS-prME
  source 1..9879: mol_type = other RNA
agcgttacaatgttacttatgttaatgcccacggcattagcatttcatctcacaactcggggaggagaaccgcatatgatagtcacaaaacaagaaagagggaaatcattactctttaaaacctcagccggagttaatatgtgtaccttgatagcaatggacttgggtgaattatgcgaagatacaatgacgtacaaatgcccaagaattacggaagcagaaccagatgatgtagattgttggtgcaatgctaccgatacatgggtaacatacgggacttgttcccaaactggagagcacagacgagataaacgctcagtggcgctggcacctcatgtcgggctaggattagaaactcgtacggaaacatggatgagctcagaaggagcatggaaacaaatacaaagagtggaaacgtgggcactcagacacccagggtttacagttatagctctgtttttagctcacgctatcgggacgtctataacgcaaaaaggtatcatctttatactcttaatgctagtcaccccctcaatggcgatgagatgtgtagggatcggatcccgtgacttcgtggagggtttgtctggtgcgacttgggttgatgtagtgctggaacacggatcatgcgttacgacgatggccaaagataaacccactttagatatagaacttttaaaaacagaagtaactaatccggctgttctacgcaaactatgtatcgaagctaaaatatcgaacacaaccaccgacagtaggtgcccaacgcaaggtgaagccacccttatggaagaacaagatgctaattttgtatgcagacgaacttttgtagacagaggttggggtaatggatgcggactttttggaaaaggatctttgataacatgcgctaaattcaaatgcgttaccaaattggagggtaaaattgtacaatacgaaaacctgaaatactctgttattgtaacagtgcataccggagatcagcatcaagtaggtaatgaatcgacagaacatggtacaacggcaactattacaccccaagctccaacgtcggagatccaattaaccgattacggagccttgactctcgactgttcaccaaggactggtcttgatttcaatgagatggttctgttaacaatgaaagagaaaagctggttagtacacaagcaatggtttttagaccttccactcccatggacgtcaggtgcatcaacaagccaagaaacttggaatagacaggacctgcttgttacttttaaaacggctcatgcgaagaaacaggaggtagtagtattaggtagccaagagggtgccatgcacacagccttgaccggggccacggaaatacagacgtcaggtaccactaccatatttgctggacatttaaaatgtagactaaaaatggacaaactaacactaaaaggtatgagctatgttatgtgtacaggttcgttcaaattagaaaaagaagtagcagaaacacaacatggaactgtgctagtacaaattaaatatgagggaacggatgcaccatgcaaaatcccttttagcacccaagacgagaaaggagtaactcaaaatggtcgcttgatcacagcaaaccccatcgtcacggacaaggaaaaaccagtaaatatagaagccgaaccgccttttggggaaagctacatcgtaataggtgctggtgaaaaggctctaaaactctcttggtttaaaaagggaagcaatataggtaaaatgttcgaagcaacagcgagaggtgccaggcgcatggcaattctaggtgatacagcgtgggattttggaagtatcggaggagtattcacgtcagtgggtaagttagttcaccagatttttggaactgcttacggggttttattctctggagtatcttggacaatgaaaataggaataggagtactacttacgtggttaggactcaatagcagaagtaccagcctgtctatgacgtgcattgcggtaggcctagtcacgttatacctcggcgtaatggtacaagcagatagtggttgcgttataaattggaaaggcagagaattaaaatgtggctcgggaatttttgtaacaaatgaagtacatacatggactgaacaatataaatttcaggctgacagtcctaaaagattaagtgccgcaattgggaaagcctgggaagagggggtgtgcggcatacgatcagctacgagattagaaaatatcatgtggaagcaaatatcgaatgaacttaatcatatattattagaaaatgatatgaaattcaccgtagttgtaggtgatgtggtcgggattctagcccaaggaaagaaaatgatacgaccacagcctatggaacacaagtatagttggaaatcctggggcaaggcaaaaataattggggcagacgtccaaaacactacttttataatagatggtcccaatacacccgagtgcccagacgaccagcgagcatggaatatctgggaagttgaggattacggatttggaatatttacgactaatatttggctcaaactaagagacagttacacgcaggtatgcgatcatcgactgatgtcggcggctatcaaggactcaaaagcagtgcatgcagatatgggttattggatagagagtgagaaaaatgaaacctggaaactagctagggcatcattcatagaagttaaaacatgtatctggcccaaatctcacacactatggtcaaatggagtattggaatctgaaatgatcataccgaagatctatggaggacctattagccagcacaattataggccaggttatttcactcaaactgcagggccctggcacttaggaaagttagagctagattttgacttatgtgagggaacgactgtagtagtggacgaacattgtggaaatcgcggcccatccctgcgaacaactacagtcaccggtaagataattcatgaatggtgttgcagatcatgcacacttccaccactacgtttcaagggtgaagacggctgttggtatggcatggagatcaggcctgtcaaagagaaagaggaaaatctcgtcaaatcgatggtaagtgcaggaagtggcgaggtagactcatttagcttaggactcctatgtataagtataatgattgaagaagtaatgagatcaagatggagcaggaagatgttaatgaccggcaccctggctgtatttctcctacttataatgggacaattaacgtggaatgatcttattcgactgtgcatcatggtcggagcgaatgcttctgacagaatgggtatgggaacaacgtatctagccttaatggcaacgttcaagatgcgaccaatgttcgcggtaggcttactttttcggcgcctaacatcccgagaggtcctattgttaactatcggattatcgctagtagcgtcagtcgagctcccaaactcattagaagaacttggtgacggattagctatgggaattatgatacttaaattactaaccgactttcagtcacaccagttatgggcgacacttctgtcactaacatttattaaaacaacgttaagcctacattatgcctggaaaacaatggccatggtactgagtatagtttcactctttcctttatgcttatcaactacgtcacagaaaactacgtggttgccagtattgttagggtcattaggttgcaagccacttactatgtttctgatagcagagaataaaatatggggaagaaaaagctggcccttgaatgaagggatcatggccgttggggtagtaagcatattattgtcatcattacttaaaaatgatgtgcctttagcgggtccgttgatcgctggcggaatgcttatcgcctgttatgtcatttcgggaagctccgcagatttatcactagaaaaagccgcagaagtttcatgggaagaggaagcggagcacagcggagcgagccataatatactcgtagaggtacaagatgacggtacaatgaaaattaaagacgaagaacgtgacgatactttaaccatattattaaaagccactctacttgcggtttctggcgtctaccctctatcaatcccagctactctgtttgtatggtatttttggcagaagaagaaacagcggagcggggttctgtgggataccccaagtcccccagaggtggagagagccgttttagacgatgggatatacagaataatgcagagaggacttcttgggagaagtcaagtaggagtaggcgtcttccaagaaaacgtatttcatacaatgtggcacgttaccaggggtgctgtcctgatgtatcagggcaaacgcttggaacccagctgggcaagtgtgaagaaagatttaatctcttacggaggtgggtggcggcttcaaggatcttggaatacaggtgaagaagtccaagtcatcgccgtagaaccaggtaaaaaccccaaaaacgttcaaacagcccccggaacttttaaaaccccagaaggtgaagtgggcgcaatagccctagattttaaacctggcacgtcaggatctccaattgttaatagggagggtaagatagtgggcttatatgggaatggcgtggttaccacatcaggaacatatgtaagcgcgatcgctcaggccaaagcctcgcaagagggaccactcccagagatcgaggacgaagtattcagaaaaaggaatctgaccattatggatctacatccaggatccggtaagacccgaagatatcttcccgcaattgtacgagaagctattaaacgtaaattaagaacattaattttagcgccgactcgggtggtagcgagcgagatggcggaggcacttaaggggatgccaatacggtaccagacaacggcagtcaaatcagaacataccggtaaagaaattgtcgacttaatgtgtcacgctacctttactatgaggttgttatcacctgtaagagtgcccaactacaacatgataataatggatgaagcacattttactgatcctagctctatagcagcgcggggttatataagtacgagagttggaatgggagaggcggctgcaatatttatgacagcgacacctcccgggtcagtcgaagcatttccacaaagtaatgccgtaatccaagacgaggaacgagatatacctgaacgatcatggaatagcggttatgagtggattacagactttcctggcaagacagtttggttcgtcccaagcatcaaatcaggcaatgatatcgccaattgcttgaggaaaaacgggaagcgtgttattcagttatcaagaaaaacatttgataccgaatatcagaaaacaaagaacaacgattgggattatgtagtcacaactgatattagtgaaatgggcgccaactttcgcgccgacagggtaatcgaccccaggcgatgtttaaaacccgtaatattaaaagatggaccggagagagtaatccttgcaggtcctatgccagtaacagtagcatcggcagcacagcgacgaggaagaataggtcgtaaccacaataaagaaggcgaccaatatatatatatgggacaacccctaaataatgatgaagatcatgcccactggacagaagctaagatgctattagacaacattaatacaccggaagggataatacctgcattgtttgagccagaaagagaaaaatccgctgctatagacggtgagtacagactaaggggtgaagcacggaaaacctttgtagagctcatgagaagaggggatttgccggtatggctaagctacaaagtagcaagtgaggggtttcaatattcggacaggagatggtgcttcgacggagaacgtaataatcaagtattagaagagaacatggatgtagaaatatggactaaagaaggtgaaagaaagaaactacgacctcgctggttagacgcgcgcacatatagtgacccactggcattgcgagagttcaaagaatttgcagccggtcgcagaagtgtatcaggggaccttatattagaaattggaaaactaccgcaacatctaacacaaagagcacaaaatgcacttgataatttagtcatgttgcataattccgaacaaggagggagagcatatagacatgcaatggaagaactgcccgatacaattgagacattgatgctgttagctttaatagctgtcttaacaggaggggttaccttgttctttctctcggggcgtggtctaggaaaaacttctataggcttactctgtgttatggctagctccgttttattatggatggctagtgtcgaacctcactggattgcagcaagtattattttagagttctttctaatggtgctgttaatcccagaacccgatagacagaggactccgcaggataatcaactcgcatacgtagtaattgggttactttttatgattttaactgtcgccgctaatgaaatgggacttctagaaaccaccaagaaagatcttggcataggtcatgtagcagtagaaaaccatcatcatgcaacaatgttagacgtggatttgcacccggcatcagcttggacactatatgcagtagctaccacaattataacaccaatgatgagacacactatagaaaatacgacggctaatatcagcttaactgccatcgccaatcaagcggcgatattaatgggtctagacaaagggtggccgatctccaaaatggacattggcgttcctctgttagcactcggttgttattcccaagtaaaccccttgacgctcacagcagcagtattaatgttagtggcacattatgcgataattggtcctggtctccaggcaaaagcaactagagaagcacagaaaaggacggcagcgggaataatgaaaaatccgaccgtagatggaatcgtagctatcgatttggatccagttgtatacgatgccaaatttgaaaaacaacttggccaaataatgttgctaattctatgtacctcacaaatactgctaatgcgtacaacatgggcactttgtgaatccatcacattggcaactggaccattgacaaccttatgggaaggatcaccaggtaaattctggaatactacaatcgctgtttccatggcaaacatttttaggggatcatatctagcgggagccggacttgctttctcccttatgaaaagcctcgggggaggtaggcgtggtactggtgcccagggtgagaccttgggggagaagtggaagcgccagttgaatcaactatcaaaaagcgagttcaacatttacaaacgatcagggataatggaagttgaccgttccgaagccaaagaaggtctaaaacgcggcgaaacgaccagacacgcagttagccgaggaaccgccaaactacgatggttcgtagaacgcaacctcgtaaagcccgagggaaaagttattgatctggggtgtgggagagggggttggtcctattactgtgccggccttaagaaagtcaccgaggtgaaaggatacacaaaaggcggtccaggccatgaagaaccgattcccatggccacctatgggtggaacctagtaaaactacatagtgggaaggatgtatttttcacaccaccagaaaaatgtgatacattattgtgcgacataggggaatccagcccgaatccaaccatagaagaaggtcgcacactgagagtccttaaaatggtagaaccatggttgagaggaaaccagttttgtataaaaatacttaacccttatatgccttccgttgttgaaacattagaacagatgcagagaaagcacggaggaatgttagtacgtaatcctctttcccgaaattcaacccatgaaatgtactgggtaagctgtgggacaggtaacatagtaagcgcagtgaacatgacttcaagaatgttgctaaaccggtttactatggctcacagaaagccaacttatgaaagagacgtagatttaggagctggaactagacatgtagcagtggaaccagaggtagctaacctagacatcattggacagcggatagaaaatattaaacatgagcacaagtctacatggcattacgatgaagataatccttacaaaacttgggcgtaccatggtagttacgaagtcaaaccgagtggaagcgcatcaagcatggtgaatggtgttgtcaagctgcttacaaaaccttgggatgtgatccccatggtaacacaaatagctatgacagacacaacgccatttggacaacaacgggtctttaaagaaaaagtagacacccgtactcctaaagcgaaacgaggcactgctcaaataatggaagtaaccgctagatggttatggggattcttatcgagaaacaaaaagccacgaatatgtacaagagaagaatttaccagaaaagtcagatcaaatgctgcgataggcgcggtatttgttgatgaaaatcagtggaatagcgctaaagaagccgttgaagatgaaaggttttgggatttagtccaaaaggagagggagctacataagcaaggtaaatgtgcgacgtgtgtgtacaatatgatgggtaaaagggagaagaaacttggtgagtttggaaaagcaaaaggctcgcgggctatatggtatatgtggcttggagcccggtttttagaatttgaagctctaggatttatgaatgaggatcattggttttcaagagaaaactccctaagtggagtcgaaggagaaggcctacataaactaggatatatcttaagagatatatccaaaatacctggagggaatatgtatgctgatgacactgccggatgggatacaagaataaccgaagatgaccttcaaaacgaagcaaaaatcactgatattatggaaccagaacatgcactgctggctacaagcatattcaaacttacatatcagaataaagttgtaagggtacagagaccagccaaaaatggtacagtaatggacgtcatatcaaggcgcgaccagcgaggctcgggacaagtgggaacctatggcctcaacacctttacaaatatggaagcgcagttaatacgacaaatggaatcagaaggcatttttagtccatctgagctagaaattccaaatttagcagagagggtgctcgactggctagaaaaatatggcgttgagagactaaaacgcatggcaatatccggagatgattgcgttgtcaaacctattgatgatcgatttgcaacagcattgactgctttaaatgatatgggcaaagtgcgtaaagacgttccccaatgggaaccatccaaaggctggaatgactggcaacaggttcctttctgctcacatcattttcatcaactaattatgaaagacggacgagaaatcgtagtgccatgtcgtaaccaagacgagctagtaggcagagcgagagtaagtcagggagcaggatggtcattacgcgaaacagcatgtttgggtaaatcctacgctcaaatgtggcaattaatgtattttcataggcgagaccttagactcgccgctaatgcaatatgttcagcagttcccgttgattgggtgccaacttcaagaacgacgtggtccatacatgcgcaccaccaatggatgactactgaggatatgttaagtgtttggaaccgagtttggatagaagaaaacccttggatggaagataaaacgcacgtatccagctggggagacgttccttatctcggtaaaagagaagaccaatggtgcggtagcctaataggtttgacagcaagggcaacctgggcatcaaacatacaagtagccattaaccaggtaagacgattaataggtaatgaaaactacttggattacatggcctcgatgaagagattcaagaacgaaggggatcctgaaggcgccctttggtaa

SEQ ID NO: 21744 - RNA, 9879 nt, synthetic construct
  misc_feature 1..9879: note = derived and/or modified CDS sequence (opt6) from DENV-1__GQ199841__SS-prME
  source 1..9879: mol_type = other RNA
agtgtgacgatgttactgatgctgatgccgaccgcgttagcatttcatctaacgactcgaggaggagaaccacacatgatagtttcaaaacaggaacgtggaaagagcttgttatttaaaacttcagctggagttaatatgtgcacactaatagctatggacttgggagaattttgtgaagacacgatgacttacaaatgtccaagaataactgaggcagagcccgatgatgtagactgttggtgcaacgccacagatacttgggttacctacggaacttgctcacaaacaggagaacaccgtcgggataaaaggagcgtggccctagcgccccacgttggtctcgggctagaaacaaggactgaaacatggatgagttcggaaggagcgtggaaacaaatacaaagggtcgagacttgggccctacgacatccgggttttacagttatagcgttgtttctagcacatgcgatcgggacctctataacgcaaaagggaattatattcatcttactgatgctggtcacacctagtatggctatgagatgtgtcggaattggtagtcgtgactttgttgaaggattaagcggtgctacgtgggttgatgtagtactggaacatggatcctgtgttacaacaatggctaaagacaaaccgacacttgatattgaactgctaaaaacagaagttacgaacccagcagtcctcaggaaactatgtatagaagctaaaattagcaatactacaacagactcgaggtgcccaacgcaaggagaagccacgttggtagaagaacaagacgcgaactttgtatgtcggaggacatttgttgaccgaggatggggaaacggatgcggactctttgggaaaggaagccttatcacgtgcgcaaaattcaaatgtgtgaccaaattagaaggtaaaacggtgcagtatgaaaatctaaaatacagtgtcatcgtaacagtgcacactggagatcaacatcaggtaggtaacgaatcgactgaacatggtacgaccgccactataacacctcaagcacctagcactgagatacaactgacggattacggagccctaacattggactgcagccctcggacaggactagattttaatgaaatggtgctcctaacaatgaaagagaaaagttggctagtacacaaacaatggtttcttgatctaccactaccgtggacaagtggagcttccaccagccaggaaacttggaatagaaaagacttacttgtcacctttaaaacagcgcacgctaagaaacaagaagttgtggtcttgggatctcaagaaggagcaatgcacacagcacttaccggtgctactgaaatacagaccagcggaacaactacaatttttgcaggacatttaaaatgcaggctgaaaatggataaactaacattaaaagggatgagctacgttatgtgtactggatcatttaaacttgaaaaagaggtggcggaaactcaacacggcactgttcttgtccaaatcaaatatgaaggcactgatgcgccctgtaaaatacctttttcaacacaggacgaaaaaggggtcacacaaaatgggcggctaataaccgcgaatcccatagtcacagataaagaaaaacctgttaatattgaagcagaaccgccatttggagagtcatacatagtaatcggggccggagaaaaagcactaaaattatcatggttcaagaaagggtcatcaattggtaaaatgtttgaagccacggccaggggagcacgcagaatggctatccttggcgatacagcctgggacttcggaagtataggcggagtatttacatctgtaggaaaattggttcatcaaatatttggtacagcttacggagtactattttcgggtgtctcctggactatgaaaataggaatcggagtattgttaacttggttagggctaaattcccgaagtacatcattgagtatgacgtgcatagccgtaggcttagtcaccctttatctcggagtaatggtgcaagcagacagcggttgcgtaataaattggaaaggacgagaactaaaatgcgggtcaggtatctttgtaacgaatgaggtccacacatggacggagcaatataaattccaagccgacagtccaaaaagactgtcagcagctattggaaaggcttgggaagaaggagtgtgcggaatacgatcagctacaagacttgaaaatataatgtggaaacagatatctaatgagttaaaccatattttattagaaaatgatatgaaattcacggtagttgtaggtgacgtagctggtatattagcccaaggtaagaaaatgatcaggcctcaaccgatggaatataagtatagctggaaatcttgggggaaagccaaaatcataggtgctgacgtacaaaacaccacatttatcatagacggaccgaacaccccggaatgtcctgacgatcagagagcatggaacatatgggaagttgaagattacggttttggcatttttacgacgaatatatggctcaagttacgagattcttatactcaagtatgtgatcacagactcatgagtgccgcgattaaggattcgaaagcagtacatgccgatatgggatattggattgaaagtgaaaagaatgaaacatggaaacttgctagggccagctttattgaagttaaaacatgcatatggccaaagagtcacacactatggagtaacggagttttagaatccgaaatgataataccgaaaatttatggaggcccgatcagccaacataattataggcctggttattttacgcagacagctgggccttggcatctaggcaaactagaactagatttcgatctctgtgaagggacaacagtagtcgtggatgaacattgtggtaatagaggtccaagtttacgaaccactacagtcacaggtaaaattatacacgagtggtgttgcagaagttgcacgttaccaccccttagattcaaaggagaggatggctgctggtatgggatggaaataaggccagttaaagaaaaagaggaaaacttagtaaaaagcatggtcagcgctgggtcgggtgaggtagactctttttctctaggcctgctatgcatctccatcatgatagaagaagtgatgcgatcaagatggtcgcgaaaaatgttgatgacaggaacccttgcagtattctttcttctcataatgggacagttaacatggaacgatcttattagactatgcataatggtaggagcaaacgctagcgacaggatgggaatgggcactacatacctggccctgatggctacgtttaaaatgcgcccaatgtttgcagtcggcctcctattcaggcgtttaacctctagggaagttctattgttaactatcggtttatctctggtagcatcagtagagttaccaaattcattagaagaactaggagacggtttagcaatgggcataatgatactgaaactactcacagactttcaatctcaccaattgtgggcaacactcttgagcttaacatttattaagactacattcagtttacattacgcttggaaaacaatggccatggtactcagcatagttagcttatttcctttgtgtttatctacaacaagtcagaaaacaacatggctaccagtgttactaggttccctaggatgcaagcctttaacgatgtttctcatagcagaaaataagatatggggtcgtaagtcttggccactcaacgaaggaattatggcggtcggtatagtaagcatactattaagtagcctcttaaagaatgatgtacccctagctggcccattaatcgctggcggaatgctgattgcctgttacgtcataagtggctcatccgcggatttgtcattagaaaaggctgcggaagtaagctgggaggaggaagcagaacacagtggcgcatctcataatattcttgtagaggtacaagatgatggaacaatgaaaatcaaggacgaagaaagagatgatacgctgacgattttattgaaagcaacattattagccgttagcggagtatatcccctctcaatacccgcaactctattcgtatggtacttttggcagaagaagaaacaaagatcaggagtactttgggacactccaagtccacccgaagtagaacgagcagttttagatgacggaatataccgcattatgcagcggggtctactaggtcgttctcaagtgggagtgggagtttttcaagagaacgtttttcacacaatgtggcacgtcactcgaggggcagttctcatgtaccaaggaaaacgtctagaaccctcatgggcgtctgttaagaaagatttaataagctacggtggaggttggcgactccagggaagctggaataccggagaagaagtacaggtgatagctgtagagccaggcaaaaatcccaaaaacgtacaaacggccccaggaacttttaagacaagcgagggagaagtaggggctatagccctagacttcaagcctggaacaagcgggagtcccatagtgaacagagaaggaaaaattgtaggtttatatggtaatggagtagtaactacatccggtacatatgtcagcgcaatcgcccaggcgaaggcttcgcaagaaggtcctcttccagaaatcgaagatgaagtgtttagaaaacgaaatcttacaataatggacttacacccaggttctggtaaaacacgacgatacttgcctgctattgtacgagaagccattaaacgtaaattgcgcacgttaatattagctcctactagagtagtagcgagcgaaatggcagaagccttaaaaggaatgcctatacgataccaaaccactgcagtcaaaagcgagcatacagggaaagaaatagttgatctaatgtgtcatgccacgtttacaatgaggttgctatctccagtaagggttcccaactataatatgataatcatggatgaagcgcactttacagacccaagtagcatcgcagcaagaggatatatatcgaccagagttggaatgggggaagcggcagcaatatttatgactgccactccaccggggtcagtagaagcattcccccaaagcaatgcagtgattcaagacgaagaacgagatataccagaacgttcgtggaactcgggttacgaatggataacagacttcccaggtaagacagtttggtttgtaccatcaataaaatcaggaaatgatatagcaaattgtttacgtaaaaatggaaaaagggttatacagctctctagaaaaacatttgacaccgaataccagaaaactaaaaataatgattgggattatgtagtaactacagatatttcagagatgggcgctaactttagagctgaccgtgttattgatcctagacgatgtcttaaaccagtaatcctgaaggatggacccgagcgagtgatactagctgggccgatgccggtaactgtagcatcagcggcgcaaagacgcggcagaattggacgaaatcataacaaagagggagatcagtacatatacatgggtcaacctctaaacaacgatgaagaccatgcacactggacagaagctaagatgctcctagataacataaatacacctgaagggataatacccgctctatttgaacccgaaagagaaaagtcagcggcaatcgatggcgaatatagactaagaggtgaagctaggaagaccttcgtagaactgatgaggagaggagacctgccagtttggctttcatataaggtcgcatcagaaggttttcagtactcagacagaagatggtgcttcgatggcgaaagaaataatcaagttttggaagaaaacatggatgtagaaatatggacgaaagagggcgaaagaaagaaattacgaccgagatggctggacgcacgaacctacagcgatccattagctctgagagaatttaaggagtttgctgcaggaagaagatccgtatcaggagacttaatattagagataggtaaactacctcaacacctcacacaacgcgctcaaaatgctctagataacctagtgatgctacataactcggaacaaggtggccgagcatatagacacgcgatggaggaacttccagataccatagaaactctaatgctattagcgttaatagcagttttgacaggtggcgtaacacttttctttctatccggacgggggttaggaaagacaagtataggtttactctgcgtaatggcttcgtcagcacttctgtggatggcaagtgtcgaacctcactggattgctgcaagtatcatattggagttctttttgatggtattattaatcccagaacccgaccgacagagaacaccacaagataatcaacttgcatacgtagtaatcggtttattatttatgatactcacagtagcagcaaatgaaatgggcttattagaaactaccaagaaagatctaggaatcggtcacgtagcggttgaaaaccaccatcatgcggctatgctagatgttgatctacatccagcatccgcttggaccctttatgccgtggccacgacaataataactcctatgatgcgacacaccatagagaacacgactgcgaatattagtttaactgctatcgcaaatcaagcagctattctcatgggcttggacaaaggttggcctatatccaaaatggacataggggtaccattacttgcattgggatgctacagccaggtaaaccccttaactctaacagcagctgttcttatgctggtggctcattacgcgattataggaccgggcttacaggcgaaagcaactcgggaggcacaaaagagaacagctgcagggatcatgaaaaatccgacagtcgatggaatagtagcaatagacctagacccagtagtgtatgacgcaaagttcgagaaacagttgggacagattatgttgttaattctttgtacctcacaaattctacttatgagaacgacgtgggcactatgtgagtctataactctggcaactggtccgcttactacattgtgggaaggtagtcccggaaaattctggaatactactatagcagtgtcgatggcaaatatttttagaggatcgtacctcgcaggagcgggtcttgctttctcactaatgaaatcactaggtggtgggcgcagaggaacaggagcacaaggagaaacactaggagaaaagtggaaaagacaacttaaccaactaagtaaatctgagttcaatacctataaaagatcgggcataatggaagtagatcgctctgaagcaaaagaaggactaaagagaggagagacaacgaaacatgctgtctctcgaggaaccgccaaattacgttggttcgttgaacgaaatctggtcaagcctgagggcaaagttatcgacttaggttgcggcagaggtggttggtcgtactattgtgcaggtcttaagaaagtaacggaagtgaaaggctacactaaaggaggacccggccatgaagaaccgataccaatggcaacatacggttggaacttagtgaaattacacagtggaaaggatgtattctttattccccctgaaaaatgtgatacactgctctgcgacataggcgaaagctccccaaatcctaccatagaagagggtaggaccttacgtgtattaaaaatggtagaaccgtggttgaggggcaaccaattctgtatcaaaatactaaacccctacatgccatctgtagtggaaacgcttgagcaaatgcaacgcaaacatggaggcatgttggtaagaaacccactttccaggaactctacgcatgaaatgtactgggtgagctgtggaacaggcaacatcgtttcagccgtaaacatgacaagtaggatgttattaaatagatttactatggcacacagaaaacccacatacgaacgagatgtcgacttaggtgcagggacacgccacgtagcagttgaaccagaggttgcaaatctcgatattataggtcaaagaatagaaaatataaagcacgaacataaatcgacatggcactatgatgaagataatccatacaaaacatgggcataccacggatcgtatgaggttaaaccgtctgggtcggcgagtagcatggtaaatggagttgttaaattgttgacaaaaccttgggacgtcatccccatggtaacccagatcgcaatgacagacacaacaccttttggtcaacagcgcgtctttaaagagaaagtagatacaaggacacccaaagctaaacgaggaactgcccagatcatggaagttacagcaaaatggttatgggggttcttaagtagaaataagaaaccccgcatatgcacacgggaagaatttaccagaaaagtaagaagcaatgccgcgattggggcagtttttgttgacgagaatcaatggaactctgcgaaagaagcggtcgaagatgaacggttttgggatctagtacatagagagagagaactacataaacaaggaaaatgtgcgacgtgcgtttataacatgatgggtaaacgtgagaagaaattaggggaatttggaaaagcaaaagggtctcgagccatatggtatatgtggctaggtgcaaggtttctggaatttgaagctctaggatttatgaatgaggaccattggttctcccgggaaaattcactttcgggtgtcgagggggaaggacttcacaaattaggttacattttacgagatatatcaaaaataccaggaggaaatatgtatgctgatgacaccgcaggttgggacacaaggataacggaagatgaccttcaaaatgaggccaaaattacagatataatggagccggaacatgcattactggcgaaatcaatctttaaacttacgtatcagaataaagttgtcagggtccagaggcccgctaaaaacggaactgttatggacgtaatctcacgacgcgatcagcgtgggtccggccaggtagggacgtatggtttaaacaccttcaccaatatggaagctcaattaatacgtcaaatggagtccgaaggtattttctcaccctcagaattagaaactccgaaccttgccgggagagttttggattggttagaaaaacacggtgtagaaaggctcaaaaggatggcaatatcaggcgatgattgtgtggtaaaaccgatagacgacaggtttgcaaccgctctaactgcgcttaacgacatgggaaaagttagaaaagacattccgcagtgggaacctagtaaaggttggaatgattggcaacaagtcccattttgctctcatcatttccatcagctcataatgaaagatggaagggaaatagtagtaccatgcagaaaccaagacgaattggtagggagggcgagagttagtcaaggagccggctggagtttacgggagacagcatgtctaggcaagagctatgcacaaatgtggcaactcatgtacttccataggcgagatttgaggttagcagccaatgcaatatgctcagctgtaccagtcgattgggttccgacttcaagaacaacatggagtatacacgcgcatcaccagtggatgacaacagaggatatgctctcagtttggaaccgggtttggatagaggaaaatccatggatggaggataaaactcatatatctagttggggcgacgtaccatacttgggtaagcgcgaagatcagtggtgtgggagcctaataggattaacagcaagagcgacctgggctacaaacatacaagtagctataaatcaagtccgtcgtttgatcggtaacgaaaattaccttgattatatgacaagtatgaaaaggttcaaaaatgaatcagaccccgaaggagctctatggtaa

SEQ ID NO: 21745 - RNA, 9879 nt, synthetic construct
  misc_feature 1..9879: note = derived and/or modified CDS sequence (opt6) from DENV-1__FJ898407__SS-prME
  source 1..9879: mol_type = other RNA
agtgtaactatgttattgatgctaatgccaactgccttagcctttcacctaacaactcggggaggggaaccacatatgattgtgtctaaacaagaaagaggaaaatcgctactctttaaaacttcggcaggggtcaatatgtgtaccctaatagccatggaccttggagaattgtgtgaagatactatgacttataaatgtccacgcataacagaagtagaacctgatgatgtagattgttggtgtaatacgacagatacatgggtgacttatggaacatgttcacaaactggagaacatagacgagataaacgaagtgtggccttagcgccgcatgtgggtttaggattggaaacacgcgctgaaacgtggatgtcaagtgaaggagcatggaaacaaatccaaaaagtagaaacctgggcactaaggcatccaggttttacagtaatagcgctgttcttagctcacgcaataggaacaagtataactcaaaaaggtataattttcatattattaatgctggtgacccctagtatggcaatgcgttgcgttggtataggctctcgagatttcgtagaaggtctttccggcgcaacgtgggttgatgttgtattggaacatggaagttgtgtaacaacaatggcaaaagacaaaccaacactcgatatcgaactattaaaaacagaagttactaatcccgccgtactgagaaaactttgtatcgaagccaaaatttctaatacaacaactgacagccgatgtcctacacaaggtgaagctacacttgtagaagaacaagatgcaaattttgtatgtagacgaacattcgtcgaccgagggtggggcaacggatgtggtctcttcggaaaaggttcactcataacttgcgcaaaatttaaatgtgtaaccaaactcgaaggtaaaattgtccaatatgagaacttgaaatatagtgtgattgtcaccgtacacaccggagatcaacatcaagtagggaatgaatctactgaacatggaactacagcgactattactccacaagccccaacttccgaaattcagctaactgactacggagcactaacattagattgctcacctaggaccggcctggacttcaatgaaatggtccttttaactatgaaagaaaaatcatggttagtacataaacagtggtttctggaccttcctttaccatggacatcgggagcttcgacatcacaagagacatggaataggcaagacctattagtcacattcaaaactgcacacgcgaagaaacaggaagtagttgttctaggatcgcaagaaggtgccatgcatacagcgttaacgggtgctacggaaatacagacgagcggaaccacgacgatatttgcggggcacctcaaatgccgactaaaaatggataagctcaccctcaaaggaatgagctatgttatgtgtacaggctcatttaaactagaaaaagaagtggcggaaacccaacacggcactgttttagttcaaataaaatacgagggcacagatgcaccatgtaaaataccattttctacgcaggacgaaaaaggagttacccaaaacgggaggcttataacagccaacccaatagtcacagataaagaaaaaccagtgaatattgaagctgaacctcccttcggagagtcttatatagtaatcggagcaggcgaaaaagcactaaaactctcctggtttaagaaaggtagtagcataggcaaaatgttcgaggccaccgcaagaggggctcgtaggatggctattctaggtgatacagcttgggattttggaagtatagggggagtcttcacgagtgtaggtaaacttgtacatcaaatattcggtacagcttacggcgtcttatttagtggagtgagttggaccatgaaaatcggaatcggtgtcttattgacgtggcttgggttaaatagtcgtagcacttccttatccatgacatgtatagctgttggtttggtcacattatatctaggcgttatggttcaggcagactcaggctgtgtcataaactggaaagggagagaacttaaatgcgggagcggcatttttgtaactaacgaggtgcatacttggaccgaacagtataaatttcaagcggacagtccaaagagattaagtgcggcgattggaaaagcatgggaagagggagtatgtggaatacgaagtgcaaccagactagaaaatatcatgtggagacagataagcaatgaattgaaccatatactattagagaatgatatgaaatttactgttgttgtaggcgatgtcgtgggtattttggcccaaggcaagaaaatgatcagaccccaaccaatggaacataaatattcttggaaatcttggggaaaggcaaaaattattggggcagacgtacaaaacactacttttattatcgatggtcctaatacaccagaatgcccggatgaccaaagagcgtggaacatctgggaagtcgaagactatggttttggcatatttacgaccaacatatggttgaaattacgagactcatatacacaagtatgtgaccaccgtttgatgtccgcagcaattaaggatagtaaggccgtacatgccgatatgggatactggatcgaatcggagaaaaatgaaacttggaagttagcacgtgccagtttcattgaagtaaaaacctgtatatggccaaaatcacatactctatggtcaaacggtgtactcgaatccgaaatgatcataccaaaaatatacggaggtccaatttcgcaacataattatcgaccaggatactttacgcaaaccgccggcccgtggcacttaggaaaactagaattagatttcgatctctgcgaaggaacaacagtcgtagtcgatgagcattgtggaaatcggggtcccagtttgcggacaacaactgtaacaggaaaaataatacacgagtggtgctgccggtcatgtaccttgcccccactacgatttaaaggggaagatggttgctggtacggaatggaaataaggcctgttaaagaaaaagaagagaatttagtaaaatccatggtgtccgctggaagtggagaggtagactcattcagtttgggtctactctgtatttcgataatgattgaagaagtaatgcgatcccggtggagcagaaaaatgttaatgacaggaacattagcggtctttttcctactaattatgggtcaacttacatggaatgatttaataaggtcatgcattatggtaggagctaacgcttcagaccgtatgggaatgggaacgacttacctcgcgctcatggcaacctttaaaatgagaccaatgtttgcagtaggtttactttttaggagactcacaagtagagaagtgttgttattaactataggtctaagtttggtagcttccgtcgagctgcctaatagtctagaggaactgggcgatggacttgccatgggcataatgatattaaaacttttaacagacttccaaagttaccagctgtgggcaaccttattaagtctaacctttattaaaaccacgttcagtctacactacgcatggaaaactatggcgatggtcttgagcatagtctcactgctgccactatgcctttccactaccagccagaaaactacttggttaccagtgctactcggatcactagggtgcaagcctcttacaatgtttttgatagccgaaaataagatatggggacgaaaaagctggcctcttaacgaaggaattatggcagtaggaatagttagtattctcctaagcagtttgttaaagaatgatgtaccattagcaggaccacttatagcaggcgggatgctaattgcttgctacgttatatccggtagctctgctgatctcagcttagagaaagcagccgaagtatcgtgggaagaggaagccgagcatagtggtgcaagtcataatattctagttgaagtgcaagatgatggaaccatgaaaatcaaagacgaagaaagagatgacactcttactattttattgaaggctaccttactcgctgtaagcggagtgtaccctttgtcaattcccgccacactattcgtttggtacttttggcaaaagaagaaacaaagaagcggcgttctatgggacacaccctcgccacctgaagttgaacgtgctgtattagatgatggcatatacagaatcatgcaaaggggcctacttggacgaagccaagtcggagttggagtttttcaggaaaatgtgttccatactatgtggcatgtaactaggggcgcagtattgatgtatcaaggcaaacgactagaaccatcttgggcgagtgtcaagaaagatttaatatcttatggaggaggatggcgactacaggggtcttggaatactggagaggaagtacaggtaatagcagtagaaccaggcaaaaatcctaaaaatgtacaaacagcgccagggacattcaaaacaccagagggcgaagtcggcgccatcgctctagacttcaaaccgggtacaagtgggtcccctattgtaaatagagaaggaaaaatcgtaggattatatggcaacggggtggtaactacatccggaacttatgtgtcggccatagcacaaacaaaagctagtcaggaaggtccactgcctgagatagaggatgaagtatttcgtaaaaggaacttgaccatcatggacctacatccgggctctgggaaaactcgacgatacctccccgcaatagtcagggaggctattaaacgaaaattaaggactctaatcctagcaccaacgcgagttgtagcgtccgaaatggcagaggcccttaaaggcatgccgataagataccaaacaactgcagtcaaaagcgagcatacaggacgtgaaattgtagaccttatgtgtcacgcaacatttactatgagattattaagtccagtacgagtacccaattataatatgataataatggatgaggcacattttaccgatccatcctccatagctgctcgtggttatatttcaactcgagtagggatgggtgaagcagcagcaatctttatgacagcaaccccgcctgggtcagttgaagcgtttccacaatcaaacgctgtgatacaagatgaggaacgtgacatacctgaaagatcttggaactctggctacgaatggatcactgattttccaggaaaaacggtatggtttgttccaagcattaaaagtgggaatgacatagcaaattgtttgagaaagaacggcaaaagagtaatccaactcagcagaaaaacgtttgatactgaataccagaaaaccaaaaataatgattgggactatgtcgtgacgaccgacatatctgagatgggagcaaactttagggcagatagagtaattgacccacgaagatgcttaaagccagtaatcttaaaagacggaccagaacgggtgattctggctggcccaatgccagtaaccgttgcttcagccgcgcaaagaagaggacgtattggtagaaaccataataaggagggtgaccaatacatctacatgggccaacccttgaacaacgatgaagaccatgctcactggaccgaagccaaaatgctattagataatataaatacgcccgaaggaataattccagctttgtttgaacctgaacgtgaaaaatccgctgccatcgatggtgaatatagattacgcggagaagcccgtaaaacatttgtagagctaatgagaagaggggacttgcccgtctggttgtcctataaagttgcgtcagaaggctttcaatattcagacagacgatggtgcttcgacggcgaaagaaataatcaagtgttagaagaaaacatggacgttgagatttggacaaaagagggggaaagaaagaaattacgaccacgatggctggatgccagaacatattctgaccctttagctctccgtgaatttaaagagttcgctgctggtagaagaagcgtgagcggagatttgattctggagattggaaaattgccacaacacctgactcagagagcccaaaacgcactagacaacttggtaatgctacacaactcagaacaaggtggacgagcatatcgtcacgcaatggaagaacttccagatactattgaaacccttatgttattggccctgatcgctgtcttaacaggaggagtaactctattcttcttgtctggaaggggcttaggaaaaacgtcaataggtttattatgtgtcatggcttcatcagcattactctggatggcgagtgtggagcctcactggatagcggctagcataatcttagagtttttcctaatggttctactgattccagaacccgatagacagcggactcctcaagataatcaattggcgtatgttgttataggattgttatttatgattcttactgttgctgcaaacgaaatgggactattagagactacgaagaaagatcttggtataggacacgttgcagtagaaaaccaccaccacgctaccatgctcgatgtagatttacatcccgcgagcgcgtggacactgtacgcggtagctacaacgataataactcctatgatgcgacatacaattgagaatactacggctaatatctcattaaccgcaatagctaaccaggccgcaatactaatgggcctcgacaagggctggcctatatccaaaatggatattggagtaccactacttgctttaggatgttactcgcaagttaacccattgacactaactgcagccgtgttgatgctggttgcacattacgctataattggacctggattacaagccaaggctacccgtgaggctcaaaagagaactgcagcgggcataatgaaaaatccaacggttgatggaatcgtcgcaatagatcttgaccccgttgtgtacgacgcaaagttcgaaaaacaattaggacaaatcatgctgctcatactatgtacctctcaaatactgttgatgcgaacaacgtgggctctatgcgaatccattacccttgctacaggtccattaactaccttatgggaaggttctcccggaaaattttggaatacaactatagcggtgtccatggcaaatatattcagggggagctatctggcaggagccggactcgccttttctttaatgaaaagtctaggtggtggcaggaggggtactggcgcacaaggggaaacacttggagaaaaatggaaaaggcaactgaatcaactatcaaagagtgagttcaatacctataagaggtccggcataatggaagtagacagaagtgaagccaaggagggcttgagaagaggagaaactacaaaacatgctgtttcaagggggactgccaaattaaggtggttcgtggagcgaaacctggttaagccagaaggaaaggtcatagacctcggttgtggtcgaggagggtggagttattattgtgcagggcttaagaaagtgacagaagtcaaaggatatactaaaggagggccgggccatgaagaaccaatccctatggcaacttacggatggaacttagtaaagctgcatagtggcaaagatgtattcttcataccaccagagaagtgtgatactcttttatgtgatattggagaatcttcaccaaatcctacaatcgaagaaggaagaacgctcagagttctcaaaatggtagaaccatggctcagaggtaatcaattctgtatcaagattctcaacccttatatgccatctgtagtcgaaacattggaacaaatgcaaagaaagcatggtggcatgctagtaaggaatccactctctagaaattctactcacgaaatgtactgggtttcgtgtggaacagggaacatagtgtcggctgttaatatgacaagtaggatgttattaaatcgtttcacaatggcacatcgtaagccgacttatgaacgcgatgttgatcttggcgcggggacccgacatgtagccgtagaaccagaagtagctaatcttgacataatcggacaacgaattgaaaacattaaacatgaacacaagtctacatggcactatgatgaagataatccatataaaacatgggcttaccacggctcatacgaagtgaaaccgagtggatctgcaagtagtatggtaaacggtgttgttaagttactcacaaaaccctgggatgtaatacctatggtgactcagatagcaatgactgatactactccatttgggcagcagagagttttcaaagaaaaggttgatacaaggacaccgaaggctaaaagaggaacagcacaaattatggaggtaactgctcgatggctttggggatttttatctcgcaacaagaaaccaaggatatgtacacgggaagagttcacccgaaaagttcgctcgaatgccgcgattggagcagttttcgtggatgaaaaccaatggaactccgcaaaagaggcggtagaggacgaacgcttttgggacttggtacacagagaacgagagctacacaaacagggtaaatgtgccacgtgtgtgtataatatgatggggaaacgcgagaagaaactaggggaatttggtaaagctaaaggatcccgagcgatttggtatatgtggttaggagctagattcctggaatttgaagccttaggattcatgaacgaagatcactggttctcaagagagaatagtctaagtggcgttgaaggagaagggctacataaattaggttacatcctcagagacatttcaaagatacccggtggaaatatgtacgctgacgatactgcgggatgggacacgcgaataaccgaagacgacttacaaaatgaagccaagatcactgatataatggaaccagaacacgctctactcgccacgtcgatctttaaattgacctatcaaaataaagtagttagggtccaaagacccgcccgaaacggcacggtaatggacgtaatctccaggagagaccaaaggggctcgggacaggttggcacatatggtctaaacacttttacaaacatggaagcacaactaatacgacagatggaatcagaagggatattcagccctagcgagctcgaaacgccaaatcttgctgaaagagttcttgattggctagaaaagcatggtgtagaaagacttaaaagaatggctatcagtggtgatgattgcgttgtcaaacccatagatgatagatttgccacggctctatccgcgctaaatgatatgggtaaggttagaaaagatattccgcaatgggagccatcgaaaggatggaatgattggcaacaggtcccattttgttcccatcatttccatcaactaatcatgaaagatggacgagaaatagttgttccatgtcggaatcaagacgagctagttggacgggcgagggtcagccagggagctggatggtcactaagagaaactgcgtgtcttggaaaaagttatgcgcaaatgtggcagctaatgtattttcatagacgtgacctgaggcttgctgctaacgcaatctgtagcgctgttcccgtggactgggtcccaacatcacggacaacttggtctatccacgcacaccatcaatggatgactacagaagatatgttatccgtatggaatagggtatggatcgaagaaaacccctggatggaggataaaacgcacataagttcatggggagacgtaccttacttaggaaaaagagaggaccaatggtgtggcagccttattggtctcacggcaagagcaacttgggcaacaaatatacaggtagcaataaatcaagtaaggagactaatagggaacgagaattatcttgactatatgacaagtatgaaaagattcaaaaacgaatcggatcctgaaggagcattatggtga

SEQ ID NO: 21746 - RNA, 9879 nt, synthetic construct
  misc_feature 1..9879: note = derived and/or modified CDS sequence (opt6) from DENV-1__FJ898408__SS-prME
  source 1..9879: mol_type = other RNA
tcagtaacaatgttacttatgttaatgccaactgcactcgcatttcatttaacaacaagaggaggagaaccgcatatgatagtaactaaacaagaacgtggaaagagcttacttttcaaaacgtcggcaggagtcaatatgtgcaccttaatagcaatggatttgggagaactatgcgaagacaccatgacatataaatgcccacgcataaccgaagctgaaccggacgacgttgattgttggtgcaacgctacggatacatgggtcacttatggaacgtgtagccaaacgggggaacatcgcagggataaacgatccgtggcattagcaccacatgtcggattagggttggagacaagaaccgaaacctggatgtcttcagaaggcgcatggaaacaaattcaacgagtagaaacatgggctctacgtcacccaggttttactgtcatagcactattcttagcacacgcaataggaacaagcataacacagaaagggattatattcatcctattgatgctcgtaaccccttccatggcgatgagatgtgttggaatcgggtcacgagattttgtcgaaggactttcaggggcaacatgggtagatgttgttcttgaacatggcagttgtgtaacaactatggctaaagataaaccaacattggatatagaattattaaaaacagaagtcacaaaccctgcggtactgagaaaattatgtatcgaagcaaaaatatcaaacacaaccacagactcaaggtgtcctacacaaggggaagcgacgttgatggaagaacaagatgcaaactttgtatgtcgaagaacatttgtagatagaggctggggtaatgggtgtggtctgttcggaaaaggaagtttaattacatgcgccaaattcaaatgcgtaacaaaattagaaggtaaaatagtccagtatgaaaatcttaaatacagtgttatagtgacagtccacactggagaccaacatcaagttggaaacgaatccaccgaacatgggacaaccgcaacgataacgccccaagctccaacatcggagatacagttaacagattacggcgccttaacgctcgactgttcgccccgcactggactcgattttaatgaaatggtattgttaactatgaaagaaaaatcgtggttagtgcataaacaatggtttttagacttgcccttgccctggacatcaggcgcctctacatcccaagaaacgtggaatcgacaagatctattagttacatttaaaacagcacatgccaagaaacaagaagtcgtagttctaggtagtcaagaaggggcgatgcataccgcccttaccggggccactgaaatccagacctcgggaacgacaacaatctttgctggtcatctgaaatgtaggttaaaaatggacaaactcacattgaaaggaatgtcatacgtgatgtgtacaggatcgttcaaactggagaaagaagtagccgaaactcaacacggcactgtcctagtccagattaaatacgagggtacagacgcaccatgcaaaataccgttttctactcaagacgaaaaaggtgttacacaaaatggtcgactgatcacagcaaatccgatagtgaccgacaaggagaaacctgtaaacatagaagcagagcccccgtttggagaaagttatattgtgattggagcaggagagaaggctttaaagttatcttggtttaagaaaggatccagtattggcaaaatgttcgaagcaacggctagaggcgctagacgcatggctatattgggggacacagcatgggacttcggtagcataggcggagtgtttacaagcgtagggaaacttgtccaccaaatattcggaaccgcatacggagtattattctcaggggtaagctggacaatgaaaattggaattggagttctacttacgtggctgggcctaaattcaagatcaacatctctatccatgacatgtatagcggtggggttagtgacactgtatttgggtgtaatggttcaagctgacagtggctgtgtaattaattggaagggacgagaacttaagtgtggcagcggaatttttgtaacaaatgaggttcatacttggacagagcaatacaaattccaagctgattcacctaagcgattatctgcagccataggaaaggcttgggaagagggagtctgtggcattcggtcagctactcgtcttgaaaatataatgtggaaacaaatatctaacgaattaaatcatatactcctcgagaatggaatgaaatttacagtggtagtcggagatgttgttggaatactcgcgcaaggcaagaaaatgatccgtccccaacctatggagcataaatacagttggaaatcttggggtaaagcaaaaattatcggagctgacgttcagaatacaacatttataattgatggtccaaatacaccagaatgtccagacgatcaaagagcctggaatatttgggaggtagaggactatggttttggtatatttacaacgaatatctggctaaaactccgtgattcttatacgcaagtgtgtgatcatcgacttatgtccgcagcgattaaggattcaaaagctgtacacgctgatatggggtattggatcgagagcgagaagaacgaaacttggaaattagcccgtgcctccttcatagaggttaaaacatgtatctggccaaagtcgcacacattatggagcaacggcgtattagagagcgaaatgatcatacctaaaatttatggaggacctataagtcagcacaactacaggcccggttattttactcagacagccggcccctggcacttgggaaaactagaattagatttcgatctatgtgaaggtacaaccgtcgtagttgacgagcattgcggaaatagaggcccgtcattgcgaacaacaaccgtaaccggaaaaataatacatgaatggtgctgcagatcgtgcacattaccacctttgcgatttaaaggagaagatggctgctggtatggtatggagattaggccagtaaaagaaaaagaagagaacctagttaaatcgatggtaagcgcgggatctggagaagttgactccttttcgttgggactattgtgcacaagtataatgattgaagaagtaatgaggtctaggtggagtcgtaaaatgttgatgacaggaaccctggccgtttttctcctcttaataatgggccaactcacctggaacgacttgattcgactatgtattatggtaggcgcgaatgcaagtgacagaatgggcatggggacaacctaccttgcattaatggccacatttaaaatgaggcccatgtttgcagttggtttactatttagaagacttacaagtcgtgaggttttactactaacaataggattgtcccttgttgctagtgttgaactacctaacagtcttgaggaactaggagacggcctagctatgggtataatgatcttaaaactattaacagactttcaatcgcatcaattatgggctacattgctttctcttactttcataaaaacgacactatccttacattatgcttggaagacaatggccatggtgctaagcatagtttctttattcccattatgtttatcaacgacctcacagaaaactacctggttgccagtactccttggctcattaggttgtaaaccgctaacaatgtttctaatagccgagaacaagatttggggtagaaaatcctggcctttaaacgaaggtataatggctgtaggggtagttagcatattgctcagtagtttacttaaaaatgacgtaccattagcgggtcctctaattgccggtggtatgctaattgcttgttatgtaatttcaggctcatccgcagacttgagcctagagaaagcagcggaagtgtcatgggaggaggaagctgaacacagcggcgctagtcataatatcttagtagaggtgcaggacgatggtaccatgaaaattaaagacgaggagagagatgatacactaacaatacttctaaaggctactttacttgcagtatctggagtgtatccactaagtatacccgctaccttgtttgtttggtatttttggcagaaaaagaaacaacgtagtggagtgttatgggacacaccaagtcccccagaagtagagagggcagtattagatgatggtatatatagaataatgcaacgtgggctactagggcgatcacaggttggagttggcgtatttcaagaaaacgtctttcataccatgtggcacgtaacaagaggcgcagtactaatgtatcaaggaaaaaggctagaaccgtcctgggcatcggtcaagaaagaccttatttcttatggaggaggatggagactacaaggaagctggaacacgggagaagaagttcaagtaattgcagtcgagccagggaaaaatcctaaaaatgtacagaccgccccggggacatttaaaaccccagagggagaagtaggagcaatagccttggacttcaaaccgggtacgagcggatcccctatagtaaaccgggaaggtaaaatagtaggtttatatggaaatggtgtcgtaactacaagtggtacatatgtcagtgcgattgcccaagcaaaggcgtctcaagagggaccgttacccgaaatcgaagacgaagtattcagaaaaagaaacctcacgattatggatttacatccgggttctggcaaaacaagaagatatcttcctgcgatagtgcgagaagctataaaacgaaagctacgaactttaatattggcacctactagagtagtcgcaagcgaaatggccgaggcactaaaaggtatgccgataagataccaaaccactgccgtcaaaagcgaacacacggggaaagaaatagttgatctaatgtgccacgctacattcacaatgcgattgctttcaccagtgagagtacctaattataatatgataatcatggatgaggcccatttcaccgatccttcaagcatagctgcgcgggggtatataagcaccagagtcggcatgggcgaagctgccgcaatcttcatgaccgcgacaccaccaggaagtgtagaagcatttcctcaaagcaacgcagttattcaagatgaagaacgtgatattccagaacgaagctggaactcaggatatgaatggataacggattttcctggaaagactgtctggttcgtcccatcaataaagagtgggaacgatatagctaattgcttacgcaaaaacggaaaaagggtaattcagttatcaaggaagacattcgatacggaatatcagaagactaaaaataacgactgggattatgtagtaacaactgatataagcgaaatgggggctaactttcgagcagatagagtaatcgacccacgaagatgtttaaaacctgttattctaaaagatggaccagagcgagttatacttgccggcccaatgccagtcacggtggcaagtgcagcgcagaggagaggaaggataggtagaaaccataataaagaaggagatcaatatatatatatgggtcaaccactcaataatgatgaagaccatgcccattggacggaagctaaaatgttgttagacaacataaatacgcccgaaggaattattccggctttgtttgagccagaaagagagaaaagtgctgcaatagacggggagtatcgcttacggggagaggccagaaaaacgtttgtcgaattaatgagaaggggagatctacccgtttggcttagctataaagtagcaagcgaggggttccagtattctgatcgaaggtggtgcttcgatggagaaaggaacaaccaagtcctcgaggaaaatatggacgtagaaatatggacaaaggaaggggaaaggaagaaactgagaccaagatggttggatgcgaggacatattcagatccactagccttaagagaatttaaagaatttgcagctgggcgcaggtctgtaagcggggatttaatattggagataggaaaacttccccaacatttaactcaacgagcacaaaatgcattagacaacttagttatgttacataatagcgaacaaggtggcagagcgtaccgccatgccatggaagaactcccggatactatagaaactttaatgcttctagcactcatcgccgtactaacaggtggcgtaactctctttttcctatcaggaaggggactgggaaaaacttcaatcggcttattgtgtgtaatggccagttcagtattattatggatggcatcggtggaaccacactggatagccgcatcgattatactagagtttttcctaatggtcctactgataccggaacccgaccgacaaagaacaccacaagataatcaattagcatacgtagtcataggactacttttcatcatacttaccgttgctgcgaacgaaatgggtcttctagagacaacaaagaaagatctcgggataggccatgtagcggtagaaaatcatcatcatgcgacaatgctagacgtcgacttacatcctgctagcgcttggacattgtacgccgtcgcgactacaattataacaccaatgatgcggcacacgatagaaaacactacagctaacataagtttaacagctatagcaaatcaagcggcaatccttatgggtctggataaaggctggcctattagcaaaatggatataggagttcctctcttagcactaggatgctattctcaggttaacccacttacattaacggctgcagtcttaatgttggttgcacactacgctattataggacctggacttcaagctaaagctacccgagaggcacaaaaacgaaccgcagccggcattatgaaaaacccaacggtagatggtattgtggcgattgatttagatccagttgtgtacgatgctaagtttgagaaacagctcggacagattatgctattaatattatgtacatcacagatacttctcatgcgtactacatgggcactttgtgaatcaatcacgttagcaacgggtcccttaaccacgctatgggagggttcaccaggtaaattttggaatactactatagccgtatcaatggctaatatattccgaggaagctaccttgccggtgcgggactagcgttttccctgatgaagtcgctaggcggagggcgaagaggcaccggagctcaaggggaaacattaggagagaagtggaagaggcaacttaatcagctgagtaagagcgaatttaatatatataaaagatcaggaattatggaggttgatcgctccgaggcaaaagaaggccttaaaagaggggagactaccagacatgccgtgagcagaggaactgcaaaactgcggtggtttgttgagagaaatttagtaaaacccgaaggtaaggtgatagacctaggctgcggtcgtggaggatggagttattattgtgcaggcctaaagaaagtaaccgaagtaaaaggatatactaaaggcgggccaggacacgaagaaccaatacctatggccacgtacggatggaatcttgtaaaacttcactcaggtaaagacgtattctttacgcctccagaaaaatgcgacactctgctgtgtgatataggtgagagttcacccaacccgacaatagaggaaggaaggactctacgtgtgcttaaaatggtcgaaccttggctccgaggtaatcagttttgtatcaagattttaaacccatatatgcccagtgttgtagaaacattagaacaaatgcagaggaaacacggtggaatgcttgtccgaaatcctctctctcgcaatagcacccatgaaatgtattgggtatcatgcggtacaggtaacatcgtgagtgctgtcaacatgacatctcgaatgctgttaaaccggttcacaatggcacatcgtaaaccaacctacgagagggatgtcgatttgggggctggaacaagacatgtcgcagtagaaccagaggttgccaaccttgacatcattggacagaggatcgaaaacataaaacacgagcataagtctacctggcactatgatgaagacaacccttacaaaacttgggcgtatcacggaagttacgaagtaaagccaagtggaagtgcgtcatcaatggttaatggagtagtgaagttactgacaaaaccatgggacgtcataccaatggtaacccagatagcgatgacagatacaaccccctttggtcaacagagagttttcaaagagaaagtggacacaaggacaccaaaagcgaaaagaggcactgcacaaatcatggaagtcacggcacgttggctatggggcttcttatccagaaataagaaacctcgtatctgtacaagagaggaatttactcgaaaagtaagatctaacgccgcaataggcgcagtgttcgttgacgagaatcaatggaacagtgcaaaagaggcagtggaagacgagagattttgggatttagttcaaaaggaaagggaactgcacaaacagggaaaatgcgctacatgtgtatataatatgatggggaaaagagagaagaaattaggagaatttggtaaagcgaaaggaagccgagccatatggtacatgtggttaggagcaagattcttagagtttgaggcacttgggttcatgaatgaagatcattggttttcaagggaaaatagcctatcaggagtggagggtgaaggcctgcataaattaggatatatccttagagacatatcgaaaatccccggagggaatatgtatgctgacgacacagcgggatgggatactcgcatcactgaagatgatctacaaaatgaagcaaagataacagacataatggaacctgaacatgcgctattggcgacatcaattttcaagttaacttatcagaacaaagttgttagagtacaaagaccagcaaagaatggcacagtaatggatgtaatatcccggcgagaccagagaggaagtggccaagtaggcacatacggtctgaatacatttacaaatatggaagcacaactaataagacagatggaaagcgaaggtatttttctaccctcggaattggaaactccaaatctggcggagagagttctggactggcttgaaaagtatggagtcgaaagactaaaaagaatggcaatctcaggcgacgactgcgtagtgaaacccatagacgatcgctttgcaacagctttaacagctcttaacgatatgggaaaagtacgaaaagatataccgcagtgggaaccatccaaaggatggaatgattggcaacaggtaccattttgtagccatcattttcatcaacttataatgaaagatggtagagaaatagtagtaccttgtcggaatcaagacgaattagtaggtagagcgagggtcagtcagggcgcagggtggtcactacgtgaaacagcatgcctaggcaaatcatacgctcaaatgtggcaactaatgtattttcacagaagagatcttagacttgcggcaaatgctatatgtagcgccgatcccggagactgggtgccaacgtcgagaacgacatggtcaatccacgcacaccaccaatggatgacgacagaggatatgttgtcagtatggaacagggtgtggatcgaagagaacccctggatggaggataaaactcacgtctccagttggggcgacgtcccttatttaggaaagagagaggatcaatggtgtggttcattgatagggttgactgctagagcaacttgggcaagcaatatacaagttgcaatcaatcaagttcgaagacttataggcaatgaaaattatctcgattacatgacgagcatgaaaaggtttaagaatgaaggagatccagaaggggccctatggtag

SEQ ID NO: 21747 - RNA, 9879 nt, synthetic construct
  misc_feature 1..9879: note = derived and/or modified CDS sequence (opt6) from DENV-1__GQ199843__SS-prME
  source 1..9879: mol_type = other RNA
tctgtgacaatgttacttatgttaatgcccacagctcttgccttccacttaacgacacgtggaggagagccacacatgatcgtttcaaaacaagaaaggggaaaatctttgttattcaaaacatctgcgggggtaaatatgtgtacgttaatagctatggatcttggagaattatgtgaagatacaatgacatataaatgtccgcgtataacggaggttgaacctgacgatgtggattgttggtgtaataccactgatacatgggtgacttatggtacatgctcgcagacaggggaacataggcgcgataaacgaagtgtagcattagcaccacatgtaggtttaggtttagaaacaagggcagagacgtggatgagttcggagggtgcatggaaacagatacaaaaagtcgaaacatgggcattgcgtcatccaggatttacggtaatagcattattcttagcacatgctatcggaacttccataacccaaaaaggtataatatttatacttttaatgttagttacaccctcgatggcaatgagatgtgtgggaatcggctctagagacttcgtcgagggcctttcaggagcgacttgggtagatgtggtacttgaacatgggagttgtgtaaccaccatggcgaaagataaacctaccttagacatagaactacttaaaacagaagttactaaccctgctgttctgaggaaactttgtatagaagcaaagataagtaacactacaacggattctagatgcccgacacaaggagaagccactcttgtagaagaacaagacgctaatttcgtgtgcagacgcacctttgttgatcgcggatgggggaacggttgtggcctattcggaaaaggcagtctcataacatgcgccaaatttaagtgtgtgacaaaattagaaggtaaaatagtacaatacgagaatttaaaatatagtgttattgttaccgtccatacaggagatcaacatcaagtaggaaacgaaagtacagaacacggaacaacggcaacaattacgccacaggcacccacttcagaaattcagcttacagactatggagccctaacattagattgctcccctcggacgggcttggattttaatgagatggtacttcttacaatgaaagagaaaagttggctagtacataaacaatggttcttagaccttcccttaccttggacatctggtgcctctactagccaggagacatggaatcggcaagacctcttagtaacattcaagactgcacatgctaagaagcaggaagtggttgttcttggatcgcaggaaggagccatgcatacagcgctcacaggtgccacagaaattcagacatccggaacaactacgatctttgctggacatttgaagtgtagattaaagatggataaactaactttaaagggaatgagttatgttatgtgtaccggaagtttcaaactagaaaaagaagtagcagaaacacaacatggcactgttttagttcaaataaaatacgaaggtacagacgcaccctgtaaaatcccctttagtacacaagacgagaaaggcgtgacgcaaaatgggaggctaattaccgctaatcccatcgtaactgataaggaaaaaccggtcaatattgaggctgaaccgccctttggggaatcatatattgtaatcggtgcaggagaaaaagcattaaaactttcatggttcaagaaaggctcctctatcggaaagatgtttgaggctacagcaagaggcgcaagacggatggcaatacttggcgatacagcttgggattttggttcaatcggaggagtctttacctctgtaggaaagttagtccatcagatatttggcacggcctatggcgttctattttcaggggttagctggactatgaaaattgggatcggagtacttctaacatggctgggattgaactcaagaagtacatccctaagtatgacttgcattgccgttgggcttgttactttgtatctcggtgttatggttcaggctgattcaggctgcgtgataaattggaagggacgtgaactaaaatgtggttctggtatattcgtgactaatgaagttcatacatggacggaacaatacaaattccaagcagactcacctaaaaggttgtcagctgctattggtaaagcgtgggaagaaggagtatgcgggattcgaagtgccacgagactagagaatataatgtggagacaaatatctaacgaattgaatcacattctactggaaaacgacatgaaatttaccgttgtggtcggcgatgtcgtaggtattttagcacagggcaagaaaatgattagaccacaacctatggaacataaatactcctggaaatcgtggggcaaggcaaaaatcataggagccgatgtccaaaacacaacattcatcattgacggtcctaatacacccgagtgtccagacgatcaaagagcttggaatatttgggaagtcgaagactacgggttcggaatttttacaacgaacatatggctcaagctaagggatagctacacacaggtatgcgaccatcggcttatgtctgccgcgattaaagactctaaggcagtacacgcggatatgggatactggatagagtcagagaaaaatgaaacctggaaattggctcgtgcaagttttatagaagtaaagacttgcatatggcctaaatcacatacattatggtcgaacggcgttttagaaagcgaaatgataataccaaagatatatggaggaccaatttcacaacataactacagaccaggttattttactcagactgccggaccgtggcacctaggaaaattagaactagattttgatctatgtgaaggtacaacagttgtcgtagacgaacactgcggcaatcgaggacctagtttaagaacaactacagtaactggaaaaattatccatgaatggtgttgtaggtcgtgtacactccctcctttgaggtttaaaggtgaagatgggtgctggtatgggatggaaataagaccagtaaaagaaaaggaggagaacctagtaaagagcatggtgtctgctggttccggagaagtagattctttctcactcggactcctatgtatttcaattatgattgaagaagttatgagatccaggtggtccagaaagatgttaatgaccgggaccttggctgtgttctttctgctaattatggggcaattaacatggaacgatctgatcagaagttgtataatggtaggtgcaaatgcaagtgaccgtatgggcatgggaacaacatacttagcattgatggctacttttaaaatgagaccaatgttcgctgttgggctgttatttagaaggctgacgtccagagaggtattgctacttactataggtttaagcctcgtggccagcgttgagctaccaaactcgttggaggagctaggtgatggtctagccatggggatcatgatattaaagctgttaacagactttcagtcttatcaattatgggccactctattatcactaacgttcattaaaacgacgtttagtctacactatgcctggaaaactatggctatggttttgtcaatcgtgagtctgctcccgttatgtctcagtacgacaagtcagaaaaccacatggctaccagttctattaggcagtttgggttgcaaaccattaaccatgttcctaatcgcagaaaacaagatatggggacggaaatcctggccattaaatgaaggaattatggcggtaggaatagtctctattttactatcatcattactaaagaatgacgttcctttagcagggcccttaatagcaggcggaatgctcattgcgtgctacgtaatcagcggctcctctgccgacctgtctttagaaaaagctgcagaggtaagctgggaagaggaagcagaacattcgggtgctagtcacaatattctcgtagaagtacaagatgatgggacaatgaaaattaaagacgaggagcgcgatgacacccttacaatattactaaaagcaacactcctagcagtatctggcgtatatcccctatcgatacctgcaacactttttgtttggtatttttggcagaagaagaaacaacgatcaggagtactttgggatactccaagtccccctgaagttgaacgtgccgtacttgatgacggcatttataggataatgcagcgcggattattaggccgaagccaagtaggagtaggcgtttttcaagaaaatgtatttcacacgatgtggcacgtcacgagaggagctgtactaatgtatcagggaaagagattggaaccatcatgggcaagtgtcaagaaagatcttatatcatacgggggaggctggagattgcaagggagttggaatactggcgaagaagtacaagtgatcgcagtcgaaccaggcaaaaatcccaaaaacgttcaaacagccccaggaacatttaaaacgccggaaggagaagtcggagccatagccctggactttaaaccaggtactagcggaagtccgatagtaaacagagagggaaagattgtaggattatatggaaatggagttgtcacgacaagtggtacttatgtcagtgcaatagcacaggctaaggctagccaagagggtccattgcctgaaatagaggacgaagtgttcagaaaaagaaacctgaccataatggatcttcatccaggcagtggaaaaacaagaagataccttccggcaatagtacgtgaagccattaaaaggaagctaagaacattgattctcgctcctaccagggtcgtggcatccgaaatggcagaagcattaaaaggtatgccaatacgatatcagacaaccgcggtaaaatcagaacatacaggacgagaaattgtagatttaatgtgccacgcaacctttacaatgagactgctatcgccagtgagagtaccgaactataacatgataatcatggatgaagcacactttacagatccatctagcatcgcagcaagaggctacatatctacccgtgtgggcatgggagaggcagcagctatttttatgacagccaccccacccggaagcgttgaagcgttcccacagtcaaacgcagtgatacaagatgaagaaagggatatacccgaacgaagctggaactcaggatatgaatggataactgattttcctggaaagactgtctggtttgtaccatctataaagtcaggaaacgatatagctaattgtctccgtaaaaacggcaaacgggttattcagttaagtaggaaaacattcgatactgagtatcagaaaaccaaaaataatgactgggattatgtagtgacaacagatatttcagaaatgggtgcaaattttcgtgctgatcgcgtgatcgaccctagaaggtgtctgaaacccgtcattctaaaagatggaccggaacgtgttatattggcaggaccgatgcccgtgacagtagcatctgcagcacaacgacgaggcaggatcggtagaaatcataataaagaaggtgatcagtatatatatatgggacaacctcttaacaatgatgaagatcatgcgcactggacagaagcaaaaatgttactagataatataaacacacccgaaggcataattccagcattattcgagccagaaagggagaaaagtgcggccatagatggcgagtaccgcctacgtggagaagccagaaaaactttcgttgaactgatgaggcgcggagatctgccagtatggctatcctacaaggttgccagtgaagggttccaatatagtgacagacggtggtgttttgacggtgaacgtaacaaccaagtactcgaagagaatatggatgtagaaatatggaccaaagaaggcgaaagaaagaaactccgacctcgctggctagacgcacgaacttatagcgacccccttgctttacgtgaatttaaagaatttgctgctggccgaagaagtgtttcgggtgatttgatattggaaataggcaaattacctcaacacttaacccaaagggcacagaatgctctagacaacctagtaatgctacacaacagtgaacaaggaggacgagcttacagacatgctatggaggaactccctgatactatagagacgctaatgttgttggcgttaatagctgtcctaacaggaggcgttacactattctttttatccggccgaggattgggcaagacgtcaattggcttgctttgtgtcatggcttcatcagctctactatggatggcatcagtcgaaccacattggattgcagcaagcataatcctcgagttctttttgatggtactattaattcctgaacctgacagacaaagaacaccacaagacaatcaacttgcttacgtagtcataggattgctattcatgattcttaccgtagcagcaaatgaaatggggttactagagacaactaagaaagatttgggaataggacatgcagcagtagaaaaccatcaccacgctacaatgctagatgttgatttacacccagcatcagcatggaccttatacgcagtagcaactactattataactccaatgatgagacatactattgaaaatactacagcaaatattagcttaaccgcaatcgctaatcaagcagcaatattaatgggattggataagggttggcccatatccaaaatggacatcggagtaccattactagcactagggtgttatagccaagttaatcctctcactttaacggcagcagtactgatgctcgtcgcacattacgcaataataggacccgggttacaagctaaagccacccgtgaagcacagaaacgaactgcagccggtataatgaagaatcccactgtcgatggtatcgttgcaattgaccttgaccccgtagtatacgacgctaagttcgagaaacaattgggtcaaataatgctcctcatcctttgcacatctcaaatactactaatgaggactacgtgggcactatgtgaatccataaccttagcaacaggcccactaacaactctgtgggaaggaagccctggaaaattctggaataccacgatagcagtatcgatggctaatattttccgaggatcatatttagcaggggcgggattagctttttcgctcatgaaatctcttggtggagggagacgcgggacaggtgcccagggtgaaacccttggggaaaaatggaaaagacagctaaatcaactatcaaaaagtgaatttaacacttacaaaagatctggtataatggaagtcgacagaagtgaggcaaaagaaggattgcgacggggtgaaacgacaaaacacgcagtatcaagggggacggcaaaacttagatggtttgtagaaaggaatttagttaaacctgagggtaaagtcattgacctgggatgtggcaggggaggatggagttattattgtgctggactcaagaaagtgacagaagtgaagggatatactaaagggggtccaggtcacgaagaacccataccaatggctacatacggctggaacttagtaaaactacactcaggaaaggacgttttctttattccaccggaaaaatgtgacaccctgctatgtgatatcggcgaatcgtctcccaacccgacaatagaagaaggtagaacgcttcgtgtattaaaaatggtagaaccctggctgcgagggaaccaattttgcatcaaaattctgaacccatacatgccatcggtagtcgaaacattagaacagatgcaaagaaaacacggcggtatgctagttcgaaacccactaagtaggaatagtacacacgaaatgtattgggtatcgtgtggaacgggcaatattgtttccgcggtcaatatgacatcacgaatgttgttaaatcgatttacgatggctcacagaaaaccaacatacgaacgcgatgtcgatctaggcgcaggaacaagacacgtagccgtagagcctgaagtcgccaatttagatataattggacagcgaatagaaaacataaagcatgaacataaatctacatggcattacgacgaagacaatccatataagacatgggcttaccatggtagttatgaggttaaacctagtggtagcgcttctagcatggtaaatggagttgttaaacttctaactaagccatgggatgttataccaatggtaactcaaatcgctatgacagatactaccccgtttggacaacagagagtattcaaagaaaaggtcgatactagaacccccaaggcaaagagaggaactgcccagattatggaagtcacggcacgttggttatggggctttttgtcccggaataagaaacctcgcatatgtacaagagaagagttcacccgaaaagtcagaagtaatgcagctattggagcagtgtttgtcgatgaaaatcagtggaactctgcaaaagaagcagtcgaagatgagagattttgggatttagtacatcgggagcgcgagctacacaagcaaggcaagtgtgccacatgtgtgtacaacatgatgggtaaacgcgagaagaaacttggagagtttggcaaggccaaaggaagtcgagcaatttggtatatgtggcttggcgctagatttcttgagtttgaagcgttgggttttatgaatgaggaccattggttctctagggagaacagtttgtcaggtgttgaaggtgagggtttacataaattaggttacatcttaagggatatatctaaaatacctggcggaaatatgtatgcagacgatacagcaggttgggacacccgaataactgaagacgatctgcagaatgaagccaaaatcactgatatcatggagccagaacacgctctactagcaacaagtatcttcaaattgacttaccaaaataaggttgtgagggtacaaagaccagcacgtaatggcaccgtcatggatgtcatatccagaagggatcaaaggggctcaggccaggtaggtacctatggattaaatacatttacgaacatggaagcacaactaataagacaaatggaaagcgagggcatatttagtccgagtgaattagaaaccccaaatctagccgaaagagtgttggactggctcgaaaagcacggagtagaaagattaaaaagaatggcaatttccggcgatgattgtgtcgtgaaaccaattgatgatcggttcgcaactgcgttgtcagcattaaacgatatgggaaaagtccgtaaagatattccccaatgggaaccatcaaaaggttggaatgactggcaacaagtccccttttgttcacatcatttccatcaactaataatgaaagatggcagagaaatcgtagttccttgccgtaaccaggacgaattagtaggcagagcaagggtttctcaaggagccggatggagtttaagagaaacagcatgcttaggaaaatcctatgcgcaaatgtggcagctcatgtatttccatagaagagacctacgtctggcagcaaatgccatatgttcggcggttcctgtcgactgggtccccacttcaagaactacgtggtccatacatgcacatcaccagtggatgactacagaggacatgctcagtgtttggaatagagtgtggatagaagaaaatccctggatggaagacaaaactcatatatcttcttggggagacgtaccgtatttaggcaaaagagaagatcaatggtgcggctcactgataggactaactgcacgggccacatgggctaccaatatacaggtagccattaatcaggttcgaagactaataggaaacgagaactatctagattatatgacttctatgaagagattcaaaaatgaatcagacccggagggcgctttatggtag

SEQ ID NO: 21748 - RNA, 9879 nt, synthetic construct
  misc_feature 1..9879: note = derived and/or modified CDS sequence (opt6) from DENV-1__GQ199844__SS-prME
  source 1..9879: mol_type = other RNA
agcgtaactatgttgcttatgctaatgccgacggcgctagctttccacttaacaacaaggggcggagaaccacatatgattgtcacgaaacaagaacgaggcaaatcattactcttcaaaaccagtgcgggagtaaatatgtgtactctcattgcgatggatttaggagaactttgtgaagatacaatgacatataaatgtcccaggataacagaagcagaacccgacgacgtagattgttggtgcaatgcaacagacacttgggtgacttatggcacatgttctcagacaggtgaacaccggcgggataaacgcagcgtagcacttgcacctcatgtaggtctaggtcttgaaacaagaaccgaaacatggatgtcttcagaaggggcatggaaacaaattcaacgggtagaaacgtgggcattaaggcaccctggatttacagttattgctttgttcttagcccatgccataggaaccagtatcacacaaaaagggataatattcatactactaatgttggtcacgccgagcatggcaatgagatgtgtaggtataggatcaagggacttcgtggaggggttgtcaggagcaacatgggtggacgtagtgctcgaacacggaagttgcgttactacgatggctaaagataaaccgacactagatatagaactactcaaaaccgaagtcacaaatccagcagtattacgaaaattgtgcatagaggcgaaaatatcaaatacgacaactgattcaagatgcccaacacagggagaggccacattgatggaagaacaggatgctaatttcgtatgccgaagaacgttcgtagatcgaggatggggcaatggatgtgggttattcggcaaaggatccctcattacgtgtgcgaaatttaaatgtgtaacgaaactagagggcaagattgtacaatatgaaaacctaaaatattcagtaattgttactgttcatacaggtgatcaacaccaagtaggtaatgaaagcaccgaacacggaacgatagcaacaatcacaccacaagcgcccacatccgaaatacaattaacggactatggtgctctcacattagattgttcaccaagaaccggactagatttcaacgaaatggtgttgctaacgatgaaagaaaagtcttggcttgtacacaagcagtggttccttgacctcccacttccgtggacgtcaggagcctctacctcccaagaaacttggaatagacaagatctgctcgttactttcaagaccgctcatgccaaaaagcaggaggtggttgtactaggctcacaagagggtgcgatgcatactgcactcacaggtgcaacagaaatacaaacatctggaactactaccatatttgcgggacatttaaaatgtcgtttaaaaatggacaaactgaccttgaaagggatgtcgtatgtgatgtgtacaggaagttttaagttagaaaaagaggtagctgagactcaacacggaacagtattagtacagataaagtacgaaggtactgatgctccttgcaaaatacccttttcaacccaggatgaaaaaggagtaactcagaacggaagactgataaccgcaaatccgatagttacagacaaagaaaagccagtcaatatagaggcagaaccgccgttcggagagtcatatattgtaataggagcgggtgagaaggcattgaagttatcatggtttaagaagggaagttccattggaaaaatgttcgaagcaactgccagaggagctagaagaatggcaattctcggtgatacagcttgggattttggaagtgtaggcggagttttcacatctgttggaaaattagttcatcagatcttcggaacagcgtatggcgtactattttcaggcgttagttggacaatgaaaatagggatcggtgtactactaacatggctaggattaaattcacgtagcacaagtttaagtatgacatgtatagccgttggattagttaccctatatctgggagtgatggtgcaagcagactccggatgcgtcattaattggaaagggagggaactcaaatgtggcagcggaattttcgtaacgaatgaagttcatacatggacagaacaatacaaatttcaagcagatagtcccaaacgcttatctgcagcgattggaaaagcctgggaggagggagtttgtggcatcaggtcggctactcgacttgagaacattatgtggaaacaaatatctaacgaacttaaccatatattacttgaaaatgacatgaaatttacagtagtggttggagatgtagttggaatactagcacaaggcaagaaaatgataagaccacagccaatggaacacaaatattcttggaagagttggggaaaagcaaaaatcataggagcagatgttcaaaacacaacgttcataattgatggaccgaatacgccagagtgccccgatgatcaaagagcatggaatatatgggaagttgaggattacggcttcggtatattcaccactaatatatggttaaaactacgagactcctatacgcaggtctgtgatcatagactgatgtcggctgcgataaaagactctaaagccgtacatgcagatatggggtactggatcgaatctgagaaaaacgagacttggaagctagctcgagcgagtttcattgaggtcaaaacttgtatttggcctaagagccacactttatggtcaaatggagtattagagagcgaaatgatcatcccaaaaatctatgggggaccaatctcccaacacaattatcgtccagggtactttacacaaacagcaggtccgtggcatttagggaagttagaattagacttcgatctgtgtgaaggaactacagtagtagttgatgaacattgtggaaatcgaggaccatctctcagaactactactgtcacagggaaaatcatacatgaatggtgttgcagaagttgtacattaccgcccctaagatttaaaggtgaagatggatgttggtatggtatggaaatacgaccagtaaaagaaaaagaagagaacttagtcaaaagtatggtctctgctggttctggagaagtcgattcattttctctgggcctactttgtatatcaatcatgatagaagaggttatgcggtctaggtggtcgaggaagatgcttatgactgggactttggctgtatttttgctattaataatgggtcaactgacctggaatgatcttattcgattatgcataatggtgggtgctaacgcgtctgaccggatgggcatgggcaccacctatttagccctaatggctacttttaaaatgagacctatgtttgctgtaggacttcttttcaggcgccttacttcaagggaggtactattactaaccattggtttatctttggtagctagtgtagagcttcctaattcattagaagaacttggcgatggcctagcgatgggaattatgatattaaaacttcttacggattttcaaagtcatcaactatgggctacactattgagcctgacatttataaagactacactttcgctacactatgcttggaaaacaatggcaatggtattgtcaattgcttcactttttcccctatgcttgagcacaacctcccaaaagaccacctggctaccagtacttctaggatcactggggtgtaagccgctaacaatgttcttaataacagaaacgaaaatatggggccgaaaatcatggccactaaatgaaggaattatggcggtaggcgtagtctcaattttactttccagcctgctgaaaaacgatgtcccattagcagggccgcttatagcaggaggaatgcttattgcgtgttatgtgatctcaggatcgagtgcagacctatcattggagaaagcggcagaagtgtcgtgggaagaagaagccgaacattcaggagcgagccataatattctagtggttgtgcaagatgatggtacgatgaaaattaaggacgaggaaagggatgatacattgacgattctactaaaagctacactattggcggttagtggagtgtatcccttgtctatacccgcaaccctgttcgtttggtatttctggcaaaagaagaaacaacgtagtggagtcctgtgggacactccaagtccaccggaagttgagagagcagtcctggatgacggaatataccgaattatgcagcgtggtttgttaggccgaagccaagtaggggttggtgtgtttcaagaaaatgtcttccatactatgtggcacgtaactagaggggcagttttaatgtaccaaggcaaaagactcgaaccttcctgggctagtgtcaagaaagatcttataagttatggtggcggatggaggctacaaggatcctggaatacaggagaagaggtgcaggtaatagcggttgaacccggaaagaatcccaaaaatgtacaaacggcaccgggcacttttaaaactccagaaggggaagtgggtgcaatcgcgctggactttaaacccggaacaagtggatctccgatagtaaatagggaaggaaaaattgtcgggttatacggtaatggggtagtaaccacaagtggtacatacgtatcagcgattgcacaggcaaaagcatctcaagaaggaccactacccgaaattgaagacgaagtatttcgaaagagaaatttaaccatcatggacctgcatccaggaagtggtaaaacaagacgttacctccctgcaatagtccgcgaggcaattaaacgaaaactccgcacgctcatactcgcacctacaagagtagtagcatctgaaatggctgaagctcttaaaggtatgccaattagatatcaaaccacagcggtaaaaagcgagcacacaggtaaagagatcgtcgatttgatgtgtcatgcaacgttcactatgagactcttaagccccgttcgagttcctaattataatatgattatcatggatgaagcacatttcacagacccatccagcatagccgcaagaggctacataagtacacgcgttgggatgggggaagctgctgcaatatttatgaccgctacacctccgggttctgtagaagcatttcctcaaagtaacgccgtgatacaggacgaagagagagacatccctgaacgaagctggaatagtggttatgaatggataactgactttcccggaaaaaccgtatggttcgtaccgtcaataaaatccggcaatgatatagcaaattgtctgcgtaaaaacgggaaaagagtaatacaattatcacgcaaaacatttgacaccgaataccagaaaacaaagaataatgactgggattacgtagtcacaactgacatatctgagatgggtgcaaacttcagagctgatagagtaattgatcctcgccgttgtctaaagccagttatactaaaagacgggcctgaaagagtaatactagcagggccaatgccagtaacagttgcttcagcagcacaacgtcgagggcggattggccgtaatcataacaaagaaggtgatcaatacatctatatggggcaaccactaaataacgacgaagaccatgctcactggacagaggcaaaaatgttattagacaacataaacacaccagaaggaatcatacccgcgctgttcgagccagagcgagaaaaatccgcggcaattgatggagaatatagattaagaggtgaagcaagaaagacttttgttgaattaatgagaaggggtgacctaccggtatggctaagttataaggtagcatcagaaggattccaatattctgatcgaagatggtgctttgatggagaaaggaacaatcaggtcttggaggaaaatatggacgtcgaaatctggacgaaagaaggggagaggaagaaattacgccctcgttggttagatgctcggacgtactcagacccattggccctaagggagtttaaagagttcgccgcaggaagaaggtccgtttcaggagatctaatactagagataggaaaactgcctcaacatcttacccaaagagcacaaaatgcattagacaatttagtaatgttgcacaattctgaacaaggcggtagagcttataggcacgctatggaggaactgccggatacaatagagacattgatgcttctggctctaatcgcagtactaacaggcggtgtgacattatttttcctaagcggaaggggacttggaaaaacatctataggcctcctatgtgttatggcatcatctgttttattatggatggcaagcgtggaaccccattggatagccgcatcgataattttagagtttttcttgatggtattacttattcctgagcctgatcgacagagaacaccacaagacaaccaattagcctacgtcgtaataggactattattcatgatcctcacagtagcagccaacgagatgggattgttggaaaccactaagaaagatctcggaattgggcacgtcgcagtggaaaatcatcatcatgcaactatgttggatgtggaccttcacccagcttcagcctggactctgtatgcagtagcaacaacaatcatcaccccaatgatgcgacacaccatagaaaatacaacagcaaacatatctctaaccgccatcgcaaatcaggctgccatccttatgggtcttgacaaaggctggccaatatcgaaaatggacataggcgtccctctactggccctaggatgctacagccaagtaaatccattaacgttgacggcggcagtgctaatgctagttgcgcattatgctattatcggacctggattacaggctaaagctacccgagaagctcagaaaagaacggcagctgggatcatgaaaaatccaacagtagacgggattgtcgctatcgatttggatcccgttgtgtacgacgctaaatttgaaaagcaactcggtcaaattatgctattaattttatgcacgtctcagatccttctgatgcgaaccacatgggctttatgcgaatcaattactttagcaactggaccgttgaccacactatgggagggaagccccggaaaattctggaacacgacaatagctgtatcaatggctaatatttttagaggaagttatctagcaggagcagggcttgcattttcactgatgaagtcattaggaggcggacgcagaggcacaggcgcccaaggcgaaactctcggagagaaatggaaacggcaactaaatcaactgagcaaatcagagttcaatatctataaaagatcgggtatcatggaggtggatcgaagtgaggccaaggaagggctgaaaagaggagagacaacgagacacgctgttagtcgaggaactgctaaattacgttggtttgtggaaaggaacctggtcaaaccagaaggaaaagtcattgacttaggatgcgggagaggcggttggagctactactgcgcgggtctcaaaaaggttacagaagtaaagggctataccaaagggggccccggacacgaggaaccaatcccaatggctacatacggctggaatctagtaaagctacattccggtaaagacgttttctttacaccaccagagaaatgtgataccctcttatgcgatataggcgagtcttccccaaatcctacaatagaggaaggacgtactctaagagtactaaaaatggttgaaccgtggctacgaggtaaccaattctgcatcaaaatattgaacccctacatgccaagtgtagtcgaaaccttggaacaaatgcaaagaaaacacggtggaatgcttgtccgaaaccccttatctcgtaacagtacacacgaaatgtattgggtaagctgtggaaccggaaacatagtttctgccgtaaacatgacatcgcgaatgttattaaaccgcttcacaatggcacaccgtaaaccaacttatgaaagagatgtcgacctgggagcaggtacgagacacgtagctgtagaaccggaagtcgcaaacttggatataattggtcagcgcatagagaatataaaacacgaacataaaagtacttggcactatgacgaagacaatccttacaaaacttgggcatatcacggatcctatgaagtaaaacctagtggctcggcaagttctatggtgaatggtgtggtaaaattattgacaaaaccgtgggacgtaattccaatggtaacacaaatagctatgaccgatacaacaccatttgggcaacaacgtgtatttaaagaaaaagttgacacgagaactccgaaagctaaacgaggaactgcacaaataatggaagtaacagctagatggctttggggattcctatcacgcaacaaaaagccaagaatatgcacccgtgaagagttcactcgaaaagtaagaagcaatgctgcaataggtgcggtatttgtagacgaaaaccagtggaatagtgccaaagaagccgttgaagatgagaggttctgggatctcgtacaaaaagaaagagagttacataaacaaggaaaatgtgcaacgtgtgtatacaatatgatgggtaagagagagaagaaacttggtgagttcggtaaagcaaagggatcaagagctatttggtacatgtggttaggagcaaggttccttgaatttgaagcccttggatttatgaacgaagaccactggttttcacgtgaaaattcgttgtcaggcgtggaaggagaagggcttcacaaacttggatacatattaagagatataagtaaaattccaggtgggaatatgtatgccgacgatactgcaggatgggatacccgaataaccgaagacgatctgcaaaatgaagcaaaaataactgatatcatggaaccggagcatgccttactcgcaacaagcatcttcaagttgacataccaaaataaggttgtaagagtccaacgaccggctaaaaacggcacggtaatggacgtcatctcaagaagggatcaacggggttctggtcaagtaggtacatatggactgaacacttttaccaatatggaggcccaattaattcgacaaatggagtcagaaggtatatttttgccgtcagaactcgaaacccctaatctagcagaacgtgtactagattggttagaaaaatacggagtagaaagactaaaaaggatggcgattagtggcgacgattgcgtcgttaaacccatcgacgacagatttgcaacagcacttacagctttaaacgatatgggcaaagtcagaaaggacattcctcaatgggaaccatcaaaaggatggaacgactggcaacaagtacctttctgtagtcatcacttccatcaattaataatgaaagatgggcgtgaaatagtagttccgtgtcgtaatcaagatgaattagtcgggcgagcacgagtgtcacagggggctgggtggtcactgcgagaaacagcctgcttgggtaagagttacgcacagatgtggcagctcatgtactttcatcgtcgcgatttaagacttgcggcaaatgcaatatgtagcgctgttccagtagattgggtaccaacaagtaggaccacttggagtattcacgcacaccaccaatggatgaccaccgaagatatgttaagtgtgtggaatagagtatggatagaggaaaatccctggatggaagataaaacacacgtctcatcatggggagatgttccctatttgggcaagagagaggatcaatggtgcggtagtctaatagggttaaccgcccgagcaacctgggcttcgaacatacaggtcgcaatcaaccaggtaaggagattgataggaaatgagaactatctggattatatgacttctatgaaaagatttaaaaatgagggagaccctgaaggtgcactatggtga

SEQ ID NO: 21749 - RNA, 9879 nt, synthetic construct
  misc_feature 1..9879: note = derived and/or modified CDS sequence (opt6) from DENV-1__GQ199845__SS-prME
  source 1..9879: mol_type = other RNA
agcgtcactatgttattgatgttaatgcctactgctctagcttttcatttaactacccgtggaggagaaccacatatgatagttagtaaacaagaacgaggtaaatcactgctgtttaaaacttctgccggagtaaatatgtgtacccttattgctatggatcttggggaattttgcgaagatactatgacatacaaatgtccgagaataacagaggcggaacccgatgatgtagattgctggtgtaacgcaactgatacttgggtaacttacggaacatgttcgcaaacaggagaacaccgaagagacaaaagatctgtggccctggcgcctcacgtaggattaggactagagacaagaacagaaacatggatgagtagcgaaggagcttggaaacagatccaacgagtagaaacgtgggccttaaggcatccagggttcacggtcattgcgctttttcttgcacatgctatcgggacgagcataacacaaaaaggaattatattcattcttttaatgttagtaacaccgagtatggccatgcgatgcgtcggcatagggagtcgcgattttgtagaaggactatctggagctacctgggtagatgtagttctagaacatgggtcttgtgtaaccactatggcgaaagataaaccgacattagatatagaactgttaaaaacggaggtcactaatccagctgtattaagaaaattatgtatcgaggctaaaatatctaatactactacggatagccgatgtcctactcaaggtgaagcgaccctagtagaagaacaagacgccaacttcgtatgtagaagaacgtttgtagatcgcggatggggtaatggatgcgggttattcgggaagggcagcctaattacatgcgcgaaatttaagtgtgtaacaaaacttgaaggaaagatagttcagtatgaaaacttaaagtattccgtaatcgtcacggttcacactggagaccaacaccaggttggaaacgaatcaactgaacacggaaccactgctactattacgcctcaagcaccctctacagaaatacaattaacagactatggagcacttactttggattgttctcctagaacagggttagacttcaatgaaatggtattactaacaatgaaagagaaaagttggcttgtacataagcagtggttcctcgacctaccactaccatggacatcgggcgcttcaacttcacaagagacatggaacagacaggacttattagtaacatttaaaacagcacatgcgaagaaacaggaagtggtagtgctaggatcccaggaaggggcaatgcataccgcgttaacaggagcgactgaaatacagacatccgggacaacgacaatcttcgctggccacttgaagtgtcgattaaagatggataaactaactttaaaaggaatgagttatgttatgtgcactgggtcatttaagctagaaaaagaagtcgctgaaacccaacacggaactgttttagtgcaaataaaatacgaaggaactgatgcaccgtgtaagattccattttcgacacaagatgagaagggtgtaactcaaaacggaagattaataacggcaaatccgatagtgactgataaagaaaaacccgttaatatcgaggcagaaccgcccttcggtgaatcttatatagttattggtgctggtgaaaaggcactaaagttaagttggttcaagaaaggatcatcaataggaaagatgtttgaagcgacagcacgtggagctcggcgtatggcaatattaggagatactgcgtgggatttcggctctattggaggtatgttcacaagcgtggggaaattggtccatcaaattttcggaacggcatatggggtattgtttagcggagtcagctggacgatgaaaatcggaataggtgttttacttacctggcttggactcaatagtcgtagtacttccttgagtatgacatgcattgcggtaggccttgtaactctttacttgggagttatggtacaagcagatagcggttgtgtcattaattggaaaggaagagaactcaaatgtggatccggtattttcgtaacgaatgaggtacatacgtggaccgaacagtataaattccaggcggacagcccaaaaagattatctgcagcaatcgggaaggcttgggaagaaggtgtatgcggtataagatctgcaacacgactcgaaaacataatgtggaaacaaatcagcaatgagctaaaccacatactcttagaaaacgatatgaagctaacagtggtagtaggcgacgtggccggtattttggcacaaggcaagaaaatgattaggccacagccaatggaatataaatatagctggaaaatatgggggaaggctaagataataggtgctgacgtacagaatacgacatttattatcgatggtccgaacactccagagtgccccgatgatcagagagcttggaatatttgggaagtagaagactatggtttcggaatattcactactaatatctggcttaaattaagagactcatacacccaagtatgcgatcatagactcatgtctgctgccatcaaagatagtaaagccgtacatgcagatatgggatattggatcgaatcagagaaaaatgaaacatggaaattggcaagggccagcttcatcgaggtaaaaacgtgcatttggccgaaaagccatactctgtggtccaatggagttctcgaaagtgaaatgataattccaaaaatatatggaggtcctattagccaacataattatcggccaggatactttactcaaacagctgggccatggcatcttggaaaacttgaattagactttgatctatgtgaaggtacaacagtggttgtagacgagcattgcggcaaccgaggaccctccttacgaacaactacagtaacgggtaaaattatacatgagtggtgctgcagatcatgcacactacctccactaagatttaagggcgaagatggatgctggtacggtatggagatcaggccggtaaaagagaaggaagagaacttagtaaagtctatggtatcagccggatctggggaagtagatagtttttcactaggtttattatgtatatcaataatgatagaagaagtgatgcgaagtcggtggtcaaggaagatgttaatgacgggaacattggccgttttctttctccttataatggggcagctcacatggaatgacttaattcgactatgtattatggttggagcaaacgcgtcagatcggatgggaatgggaacaacttacctggcgctaatggccacttttaaaatgcgtccaatgtttgcagttggtttgttatttagacgtctcacatcaagggaagtattactattaacaattggtctatctctggtagcctcggtggaactaccaaattctctggaggagttaggggatggattagcaatgggtataatgattctaaaattacttacagattttcaaagtcatcaattatgggcaacattactcagcttaacttttatccgaacaactttctccctgcactatgcgtggaagacaatggccatggtattaagtatcgtatcattattccccttatgcctaagcaccacatctcaaaagactacatggctaccggtgttattagggtcactcggatgtaaacccctgactatgtttctcattgctgagaataaaatatggggtcgcaaatcttggccattaaatgagggaatcatggcagtgggaatagtttccattttattgagttcgttactcaaaaatgacgttcctttggcaggccccctgatagctggagggatgctaattgcatgttatgttatttccggatcttcggcagacctcagcttggaaaaagccgccgaagtgtcatgggaggaagaggcggaacacagcggcgcaagtcacaacatcttagttgaagtccaggacgacggaactatgaaaatcaaagatgaagaaagagatgacacgctcacaatattattaaaagcaactttactcgcagtctcaggagtctaccccttatcaatcccagccacattatttgtgtggtatttctggcagaagaagaaacaacgaagtggggttttatgggatactccaagccctccggaagtagaacgtgcagtgctggatgatggcatatataggataatgcaacgtggacttctaggtcggtctcaagttggggtcggtgttttccaagagaacgttttccacaccatgtggcatgtgacacgtggagctgttctgatgtatcaaggtaaaagattagaaccatcatgggcttcagtcaagaaggatttaatctcatatggagggggatggaggttgcaaggaagctggaataccggggaagaggtgcaagtgattgctgttgagcctggcaaaaacccgaaaaatgtacaaacagcacctggtacattcaagacaagtgaaggtgaagtaggtgcaatagcccttgatttcaagccaggaacaagcggcagtccaatagtaaacagagaagggaaaatagtagggttatatggaaatggagttgttaccacttcaggcacttatgttagcgcgatcgcccaagctaaggcttcacaagagggacctttaccggaaatagaggatgaagtattcagaaaaaggaatttaacaataatggaccttcacccagggtctggaaaaacacgtcgatatttaccggcaatagttcgagaggcaacaaaaagacgtttaagaactttgatattggcaccaacaagagtagttgcaagtgagatggcagaggccttgaagggaatgccgatacgttatcagactacagcggtaaaatctgagcatacagggaaagagatcgttgaccttatgtgtcatgctacatttacgatgagattactgtcaccagtccgagtaccaaattataacatgatcataatggatgaagcacattttacagatccatctagcatagcggcacgaggctacatatcaacccgggtaggtatgggcgaagctgccgcaatatttatgacggcgacgcccccgggttcagtcgaagccttcccccaatcaaacgctgtcattcaagatgaagagagagatatccctgaaagaagttggaactcgggttatgaatggataacagacttcccgggaaaaactgtatggtttgtaccatcaatcaagagtggaaatgatattgcaaactgcctccgcaaaaatggtaaaagagtaatacaacttagcaggaagacatttgatactgagtatcagaaaaccaaaaataatgactgggattacgttgtaaccaccgacatctctgagatgggcgcgaactttcgggcggatcgtgttattgatccaaggagatgtttaaaacctgtcatacttaaggacggcccggaacgcgtaatactcgcaggtcccatgccagttacggtagctagtgcggctcaaagacgggggagaataggtagaaatcacaacaaagaaggtgatcaatatatctatatgggtcaaccactaaacaacgacgaagatcatgcgcactggacagaagctaaaatgttattagataacataaatacaccagaaggcatcattcctgctttgttcgagccagagagagaaaaatcagcagcaatagacggagaatatcgattaaggggtgaagcgagaaagacttttgtagagctaatgagacgtggggacttgccagtatggttatcctataaagtagcgtcagaaggatttcaatattcagaccgaaggtggtgtttcgatggagagaggaataatcaagttttagaagaaaacatggatgtagaaatttggacaaaggagggagagagaaagaaattacgccccaggtggctagacgcgaggacttatagcgatccattagcgctgcgggaatttaaggaatttgctgccggtagaaggtcagtaagtggagacctaatactagaaataggaaaacttcctcaacacttgacccaacgagcacagaacgcccttgacaacctagtaatgctccataattcagagcagggtggacgagcctacagacatgctatggaagaacttcctgacactatagaaaccttaatgctgctggcgttaatagcagtactaacgggaggagttactctgtttttcttgtcgggtcggggcttagggaaaacatccatcggcctactatgcgttatggcctcctctgtattactatggatggcaagcgtagaaccccattggatagcggcgagtataatcctggagttctttttaatggtattactaatacccgaacctgatagacaaagaaccccacaagacaaccaattggcctacgttgtaataggcctgttgttcatgatactcaccgtggcagctaatgaaatgggtcttctagaaacaaccaaaaaggatttagggataggtcatgttgcagtagagaatcatcatcacgcagcaatgttggatgtagatttacacccggcaagcgcttggacattatatgctgttgccacaactataatcacaccaatgatgagacacacaatcgaaaatacaaccgcaaatatatcattgacagcgatagcaaatcaagctgctatattaatggggttagacaagggttggccaatatcaaaaatggacatcggcgttccattactagctttgggatgctatagtcaagtcaatccattaacactgactgctgctgtattgatgctcgtagcgcattatgctattataggtccaggtctccaagcaaaagctacgagagaagcccaaaagaggactgcggcgggcatcatgaaaaacccaacagttgacggtatagtcgcaattgaccttgacccagtagtctacgatgctaaattcgaaaagcagctaggacaaatcatgttactgatactctgtacgtcacagattctattaatgaggaccacctgggcattgtgtgagtcaatcacgctggccacgggtccactcacaacgctttgggaaggttctccaggaaagttctggaacactacaatcgcagtgtcaatggcgaatatattcagaggttcgtatttggctggggctggattggcctttagtctaatgaaatcattaggagggggccgtaggggtacgggcgcacaaggggagactctcggagaaaaatggaaacgacaactcaaccaattgagtaagtctgaatttaatacatataaaaggagcggaattatggaagtggaccggagcgaagctaaagagggtctaaaaagaggtgaaacgacgaaacatgcagtcagccggggaacggcgaaactccggtggttcgtcgaaagaaatctggtaaaaccggaaggcaaagtaatagatcttggctgtggaaggggaggatggagctattattgcgcaggcctcaagaaagtgacggaagttaaaggatatacgaaaggagggccggggcatgaagaaccgatacctatggctacatatggatggaatctcgttaaattgcattcagggaaagatgtatttttcataccacccgaaaagtgtgacacactattatgtgatatcggggaatcctctccgaaccctacaattgaagaagggcgaactttgcgagtactaaaaatggttgaaccttggctaagaggcaaccagttctgtatcaaaatattaaatccctacatgccaagtgtagtcgaaacgctggagcaaatgcaacgtaaacatggaggaatgcttgtaagaaaccccttatcacgcaactcaacacatgaaatgtattgggtgagttgcggaaccggtaacatagtctcagccgtgaacatgacaagtcgtatgttattaaatcgctttactatggcgcatcgaaaacctacttatgagcgagacgtagatttaggagctggaacaagacacgtcgcggtggaaccggaagtagcgaacttagacataataggacaacgaattgaaaacattaaacatgaacataaatctacatggcattatgacgaggataacccgtataaaacttgggcgtaccatgggtcatatgaagtgaagccgtcaggatccgcttctagcatggttaatggcgtcgttaaattattgactaagccttgggatgtaatcccaatggtgacacaaatagccatgacggatactacaccattcggacaacaacgggtatttaaagagaaagtagatactagaacgccaaaggcaaaacgtggcaccgctcagataatggaggtaactgcaaaatggctttggggatttcttagccggaataagaagcccagaatatgtacgcgggaagagttcactagaaaagttcgctctaacgcagctattggtgctgtttttgtcgatgaaaatcaatggaactctgcgaaagaagcagtagaggatgagagattttgggatctggtacatagggagcgcgaacttcataaacaggggaagtgcgcaacatgtgtgtataacatgatgggaaagagagagaagaaactaggcgagttcgggaaagccaaaggatcccgggctatatggtatatgtggttaggtgccagatttcttgaatttgaggctttaggctttatgaatgaagaccattggtttagccgagaaaactcgctatcaggagtagaaggtgaaggtttacacaaattaggttatatactgcgcgatatatcaaaaatcccaggagggaatatgtacgcagatgacacggcgggatgggataccagaattacagaggatgatctacaaaatgaagcaaagatcactgacatcatggaaccagaacacgcgttgttagcaaaatcaatattcaaattaacataccaaaataaagttgttagagtacaacgacccgctaaaaatggaacggtgatggacgtaatctcaaggagagatcagcgaggtagtggtcaggtcggaacctatggtctaaacacatttacgaacatggaagcacaacttatacgccaaatggaatcggagggaattttctcaccgtcagaacttgagacgccaaatttagcaggacgtgtgctggactggttagagaaacacggtgtggaacgtctaaaacgaatggctatttcaggtgatgattgtgttgtaaaaccaatagatgatagatttgccacagcattaacggcacttaatgacatgggaaaagtccggaaagatataccccagtgggaaccgtcgaaaggatggaatgattggcaacaagttccattctgttcacaccactttcaccagttaatcatgaaagatggacgtgagatagtcgtaccgtgtagaaatcaagatgagttggtcggacgagcgcgcgtctcacagggagcaggatggagtttacgggaaacagcctgcttaggtaaaagttatgctcaaatgtggcaactcatgtactttcacaggagggacttaaggttagcagcaaacgcgatatgttccgcggtccctgtcgactgggtaccaacgtcaagaaccacttggtcgattcatgcgcaccatcagtggatgactacggaagatatgctgagcgtgtggaatcgggtgtggattgaagaaaacccatggatggaagacaagacgcatgtatcgagttggggagacgtaccgtacttggggaagagggaggatcaatggtgtggtagcttaatcggattaactgctcgagcaacgtgggcaacgaacatacaagtagcaataaaccaagtgcgacgtttattaggcaatgaaaactatctagactacatgacaagcatgaagcggtttaagaacgaatcagaccccgagggagcactatggtaa

SEQ ID NO: 21750 - RNA, 9879 nt, synthetic construct
  misc_feature 1..9879: note = derived and/or modified CDS sequence (opt6) from DENV-1__GQ199846__SS-prME
  source 1..9879: mol_type = other RNA
tcagtaaccatgctgttaatgttaatgccgactgctttggcgtttcatcttaccactcgaggaggagaaccgcacatgattgtaactaaacaagaaagagggaaaagtctactattcaaaacgtctgcaggagtcaatatgtgtactcttatagccatggatctaggcgaactctgtgaagatactatgacttataaatgcccaagaatcactgaagcagaaccggacgacgtagactgttggtgtaatgcaaccgacacttgggtgacatatggaacttgcagtcaaaccggagaacaccggcgcgataaaagatccgtagcattagcaccacatgttggcctaggactcgaaactcgaactgaaacttggatgagttcagaaggagcatggaaacaaattcaaagagtagaaacatgggctctaagacatccagggtttaccgtaatcgcactcttcttagcacacgcaatcggaacgagcattactcagaaaggaattatatttatcttactcatgttggtaacaccttccatggcgatgagatgcgtagggataggttcaagagactttgtagaaggtctgtctggtgccacatgggtggatgtagtcttagaacacggatcgtgtgttacaattatggcacgcgataaacccacactagatattgaactactaaaaactgaagtcacaaatcctgctgtcttacgaaaattatgtatagaagccaaaatttcaaatactactactgactcaagatgccctacgcaaggagaagcaactcttatggaagaacaagacgccaatttcgtttgcaggagaacatttgttgacagaggctggggaaacggctgcgggctctttggcaaaggatctctaataacatgtgcaaaatttaaatgtgtcactaaacttgaaggaaaaattgtgcaatatgaaaacctgaaatattcggtaatagtaaccgttcacacaggagaccaacatcaggtaggtaatgaatcaacggaacacggtacaacagctaccatcacaccccaagctcctacctcagaaatccaattaacggactatggtgcactaacactcgactgcagcccaagaaccggtcttgattttaacgaaatggtattattgacaatgaaagaaaaatcctggctagtccataaacagtggtttttagatttgcccctaccctggacttccggggcctcgacaagccaggaaacgtggaatagacaagatctgctagtcaccttcaagactgcacatgccaagaaacaggaagttgttgtacttgggtcgcaagaaggggcgatgcacaccgccctaaccggagccaccgaaatacaaaccagtggtaccactaccatatttgcaggccacttaaaatgtaggctcaaaatggacaaactgaccttaaaaggaatgagttacgtaatgtgcacagggagctttaagttagaaaaggaagttgccgaaacgcaacacggaacagtattggtccaaatcaaatatgaaggtactgatgctccctgcaaaatacctttttctacacaggatgaaaagggggttactcaaaatggaagattaataactgcaaaccctatagttacagacaaggagaaaccagtaaacatagaagcagaacctccatttggtgaaagttatatagttataggagcgggtgaaaaagccttaaagttatcttggtttaaaaagggaagttccataggaaagatgtttgaagctacagcacgtggagcacgaaggatggccattttaggtgatactgcttgggatttcggtagcgtaggaggagtttttacatctgtaggtaagttggtacatcaaatcttcggtacggcatatggcgtactttttagtggcgttagttggactatgaaaataggtattggagtattattaacgtggctagggttgaatagcagaagcacttcgctctcaatgacatgtatagctgtagggttagtaaccttatatttaggagtaatggtgcaggccgacagtggctgcgtcattaattggaaaggtcgcgagttaaaatgcggatcaggtatatttgtcactaatgaggtccacacatggacagaacaatataaattccaggcagattctccgaaaagattaagtgccgctatcggtaaagcctgggaagaaggcgtatgtggcatcagaagtgcaacacgattagagaacattatgtggaagcaaataagcaacgaacttaatcacattcttttggaaaacgatatgaaattcacggtagtcgtgggtgatgttgtaggaatactagctcaaggaaagaaaatgattcgcccacagccgatggaacataagtatagctggaagtcatggggaaaagcaaaaataattggcgcagatgtgcaaaatacgacttttatcatagatggcccaaatacaccagaatgccccgacgaccaaagggcctggaacatatgggaagtcgaggactatgggttcggcatttttactactaatatatggttaaaattaagggactcatatacgcaagtttgtgaccacagactcatgtcggcggctatcaaagattcaaaagcagtgcatgcagacatgggctactggattgaaagtgagaaaaatgaaacctggaaacttgccagagcatcatttatagaagtaaaaacatgcatatggcccaaatcacacactctatggtcgaatggagtgcttgaaagtgaaatgataattccaaaaatatatggaggtcctatatcacagcacaattatagaccaggttattttacgcagactgcggggccctggcacctagggaaattggaattggactttgatctctgcgaaggaacgacggtagttgtagacgaacactgtggaaacaggggaccttccctaaggacaaccacagtaactggtaaaataatacatgaatggtgctgtcgctcatgtacgttacccccactacgattcaaaggtgaagatggttgctggtatggtatggagatcagaccggttaaagaaaaagaagagaatttagtaaagtctatggtctcagccggaagtggcgaagtagactcgttctctttaggactgttatgtataagtataatgatcgaagaggtaatgcgcagtagatggtcaaggaaaatgcttatgactggaacacttgcagtatttctcttacttatcatgggacaactaacttggaacgacttaatccggttgtgtataatggtcggtgcaaatgcgagtgatcgcatgggcatgggcacaacgtatttagcattaatggcaacctttaaaatgagaccaatgttcgctgtaggactccttttcagaaggctaaccagtagggaagttctgttgttaactatcggcctttctctagtcgcaagcgtagaattgcctaatagcttagaggaattgggtgatggcctggctatgggtataatgatactaaaattactaacagatttccaatctcatcaattatgggccactctgctctcacttacgttcatcaaaacgactctatcgctccattatgcttggaaaacaatggccatggtacttagcattgcctcactattcccgttatgtttgtctactacctcacagaagactacttggttacccgtacttctaggcagtcttggatgtaagcctctcacaatgtttctaataacagaaactaaaatatggggaagaaaaagttggccattgaatgaggggattatggcggtgggtgtagttagcattctattaagcagcttattgaagaatgacgtgccgctcgctggacctttgatagcgggaggtatgctcatcgcatgttacgttatatcggggagctccgcggacctatcattagaaaaagcagcggaggtttcatgggaagaggaagccgaacatagcggtgcttctcataatattttggtagtagtacaggacgatgggaccatgaaaataaaggacgaagaacgagacgacacattaacgatattactaaaagcaaccctacttgcagtatcaggcgtgtatccgctcagcataccagccacgttatttgtatggtatttttggcaaaagaagaaacagagatccggggtattatgggacacacctagccctccagaagtggaaagagccgttctcgatgacggaatttatagaattatgcaacggggactattagggcgaagtcaggtaggagtgggtgtttttcaggaaaatgtctttcatacaatgtggcatgtaacaagaggtgctgtcctgatgtatcaaggaaaaagacttgaacctagttgggcgtccgtcaagaaagatctcataagctatggaggaggatggcgactccagggttcctggaacacaggggaagaagtccaagtgatagctgtggaacctggtaaaaaccccaaaaatgtacaaaccgccccgggtacttttaaaaccccagagggggaagttggggcaatcgcattagattttaaaccaggaacatcaggctcacctatagtgaatagggaagggaaaatagtgggtctatatggcaatggagtagtaacaacaagcgggacatacgtcagtgcaattgcacaagcaaaagcctcacaagagggaccattaccagaaatcgaggatgaagtgtttagaaaaagaaacctaactatcatggacttacaccctggaagcggaaaaactagacggtatctccctgcgattgttagagaagcgataaaacgaaagttgcgtacactaattttagcaccaacgcgagtagtcgcgagcgagatggcagaggcgctaaaagggatgcccattaggtatcaaactacagctgtaaagtcagaacatactggaaaagagatagttgaccttatgtgtcatgccactttcacaatgcgtcttctctcaccagtccgagtaccgaattacaatatgattataatggacgaggcccattttacggatccctcgtcaatagcagcaagagggtacatatcgactagagtaggaatgggggaagctgctgccatattcatgacggccactccaccaggaagtgttgaggctttccctcaatcaaatgccgtcatacaggatgaagagagggacattcccgaacgaagctggaactcaggatacgagtggataactgacttcccgggaaaaacagtgtggttcgtcccgagtataaaaagtggcaatgacattgcgaattgtctacggaaaaacggtaaaagagttatacaactttcgcgaaagaccttcgatactgagtatcagaaaactaaaaataacgattgggactatgttgtgacaactgatataagcgaaatgggagctaatttcagggcagatagagtcatcgatcctagaagatgtttaaagccagtgattctaaaagatggacctgagcgagttattcttgcaggcccgatgccggtaacagtggcatcagcagcacagaggcgaggtaggatagggaggaaccataataaagaaggagaccaatatatttatatgggtcaaccactaaacaatgacgaagaccacgcacactggacagaggcaaaaatgttgttagacaacataaatacacccgaaggcattattccagcattgtttgaaccagagagagagaaaagtgccgcaattgatggtgaatatcgcttacgcggagaggcaaggaaaacatttgtcgaactcatgaggagaggcgatctcccggtatggcttagttataaagtcgcatcagagggatttcaatacagtgatagacgatggtgttttgatggggaacgcaataatcaagtattagaggaaaatatggatgtagagatttggacaaaggaaggtgaaaggaagaaattacgtccaagatggctagacgccagaacgtacagtgatccacttgcccttagagagttcaaggaatttgctgccggccgtcgaagtgtaagtggagatctgatattagaaattggtaaattgccgcaacatctaacccaacgtgcacagaacgctctggacaacctagtgatgctgcataattcggaacagggagggagagcatatagacatgccatggaggagttaccggacacaatagaaactttgatgctattagctttgatagccgtcctaaccggaggtgttactcttttctttcttagcggaagaggtctcggcaaaacttcgattggccttctatgtgtcatggccagttctgtattattgtggatggcatcggttgaaccccactggattgctgcgagtattattctagagttcttcctgatggtactcttaattcccgaaccggatagacaacgaaccccacaagataaccaactagcgtatgtggttatcggattactattcatgatcctaacggtagcagcaaatgaaatgggtttactagaaaccaccaagaaagacttaggtattggtcatgtagcagtagaaaatcatcatcacgcgactatgctagacgttgacttacaccccgcctcagcatggactttatatgcagttgcgacaaccattataactcctatgatgagacatacaatcgaaaataccacagcaaatatttcactaacagccatagcaaaccaagcagctatattgatgggtctagacaaaggctggccgatctcaaaaatggacataggtgtaccgcttttggccttaggttgttattcccaagtgaatcccttgactttaacagcggccgtactaatgcttgtcgcacactacgcaatcataggacctggtctgcaagcaaaagcaacacgtgaagcacagaaaagaactgctgctggaataatgaagaatcccaccgtcgatgggatagtagccatcgacttagacccggtggtctatgatgcaaaatttgaaaaacaattaggtcaaataatgctacttattctgtgcacatcgcaaatcttgttgatgagaactacatgggcactgtgtgaatcgatcacactagccacaggacctctgacgacactgtgggaaggatcacctggaaagttttggaatactactatagcagttagtatggctaacatatttagagggtcttatctggccggcgcgggactcgcatttagtctgatgaaatcactaggaggaggacgtaggggtacgggcgcccaaggagagactctgggcgaaaaatggaaacgccaattaaatcaactctcaaaatcagaatttaacatctataaaagatcaggaatcatggaggtagatagatccgaggcaaaagagggattaaaacgcggggaaaccacacgtcacgcagtatcaaggggcacagcaaaactgcggtggtttgtagaacggaatttagtaaaacctgaaggaaaagtaatcgacttggggtgtgggcgtgggggatggtcttattattgtgcaggtctaaagaaagtaacagaagtgaaaggatataccaaaggtggtcccgggcacgaagaacctatccctatggcgacatacggatggaacctagtcaaactgcacagcggcaaagacgtctttttcacacccccggagaaatgtgacactttactttgtgatattggagaaagctccccgaacccaacaatcgaagaaggaaggactctgcgcgttcttaagatggtcgaaccttggttaaggggaaatcaattttgtataaagatattaaatccgtacatgcctagcgtagtggagacattagaacaaatgcaaaggaaacacggtggcatgttagtccgtaatccccttagtaggaatagcacacacgaaatgtattgggtgtcgtgtggtaccggtaatatagtaagcgctgtgaatatgacaagtcgaatgctattgaacagattcacaatggcccacaggaaacctacttatgaacgcgatgtcgatttgggcgcagggacaagacatgtcgcagtagaaccagaagtagcaaacctggacattataggacaaagaatagagaacattaagcacgagcataaatcaacttggcattatgacgaagacaatccatataagacttgggcatatcacggcagctatgaagtgaagccaagtggtagcgcatcctcgatggttaatggtgtagtaaagttactaaccaaaccttgggatgtaataccaatggtcactcagatagcgatgactgatactacaccgtttggccagcagagggtgtttaaagaaaaggttgatacaagaacaccaaaggcgaaacgtggtacggcacaaatcatggaagttacggctaggtggttatggggatttcttagtaggaataagaaaccaagaatatgcacacgagaagagttcacgaggaaagttcgctcaaatgcagccataggcgcagtctttgtagatgaaaatcaatggaactcggctaaagaggcagttgaagacgagcgattctgggatttagtgcaaaaagagcgtgaattacataaacaaggaaaatgcgctacatgtgtatacaacatgatgggaaaaagggagaagaaacttggcgagttcggaaaagctaaaggttccagagccatatggtacatgtggttgggagcccgctttttagagttcgaagcacttggtttcatgaacgaagatcactggttttcgagagaaaactctttgtcaggtgttgagggtgaaggtcttcataagctcggatacatactaagagatataagcaagattccaggagggaacatgtatgcagatgatacagctggatgggatacgcggattaccgaagatgatcttcaaaacgaagcaaaaataactgacataatggagccagaacatgcgttactagcgacaagtatatttaaattgacctatcaaaataaagtagtcagggtacagcggcctgccaaaaacggaacggttatggatgtaatatctagacgggaccaacgagggagtggtcaagtcggtacgtacggtctaaacacttttactaacatggaagcacaattaatacgacagatggaatctgaaggaatatttcttcccagtgaattagagacacccaatctcgcggaaagagtactcgactggctggaaaagtacggggtagaaaggttaaagcggatggcaatttctggtgatgattgtgtcgtaaaacctatcgatgataggttcgctactgcattaactgcattaaatgatatgggaaaagtgaggaaggacataccacaatgggaaccgagtaagggttggaatgactggcaacaagtcccattttgctcacatcattttcaccaacttattatgaaagacggacgtgaaatagtagtaccatgcagaaatcaagatgaacttgtaggacgagcgagagtgtcccagggcgccggatggtcccttcgagagacagcgtgtctaggtaagtcttatgctcaaatgtggcaactcatgtattttcataggcgagatctacgacttgccgcgaatgcgatttgttcagctgtaccagtggattgggtgccgacaagtcgtacaacttggagcattcatgcacatcatcagtggatgacaaccgaagatatgttgtctgtttggaatcgagtgtggatagaggaaaacccctggatggaagacaagactcatgtatcatcctggggagatgtaccttacctgggtaaaagagaagatcaatggtgtgggagcctgataggattaacggccagagcaacttgggccagcaacattcaagtagcaataaatcaagtgcgtagactaataggaaatgagaattacctagattatatgacatcaatgaagaggtttaaaaatgaaggggatccagaaggggccttatggtaa

SEQ ID NO: 21751 - RNA, 9879 nt, synthetic construct
  misc_feature 1..9879: note = derived and/or modified CDS sequence (opt6) from DENV-1__GQ199847__SS-prME
  source 1..9879: mol_type = other RNA
agtgtcacaatgttgcttatgttaatgccaacagcacttgcttttcacctaacaaccagaggtggggaaccacatatgattgttagtaaacaagaacgagggaaatcactgctgtttaaaacctctgcgggggtgaacatgtgcacactaattgctatggacctgggggaattttgcgaagataccatgacgtataaatgtcctcgaataaccgaagcagaaccagacgatgtcgattgctggtgtaatgcgacagatacatgggtaacttacggaacttgctctcaaactggagaacatagaagagataaaagatctgtagcactggctccccatgtggggttggggctagaaacacgaactgaaacatggatgtctagtgaaggagcttggaaacaaatacagcgcgtagaaacttgggcattaagacatcctggatttaccgtgatcgctctttttctagcacatgcgataggaacatccataacgcaaaaaggtattatatttatattgctaatgctggtaacaccatcaatggctatgcggtgtgtaggcataggctctagagatttcgttgagggcttgagtggtgcaacatgggtagatgttgttctagagcatggaagttgtgtgacaacaatggctaaagataaaccgactctagacattgaacttttaaaaacggaggtcaccaacccagctgtattacgaaaactatgcatcgaagctaaaatatcaaataccacaaccgatagtcgatgtccaacacagggtgaggcgacgctagtagaggagcaggatgctaatttcgtatgccgcaggacattcgtcgatcgtggatggggcaatggttgtggtttatttggcaagggatcactcataacttgcgctaagtttaaatgcgtaacaaaacttgaaggtaagatagtacaatacgaaaatttgaaatacagtgtaatcgtcacggtacatacaggggatcaacaccaagtagggaatgaatcaactgaacatggtacaacagcaaccatcacgcctcaggcaccgagtaccgaaatacaactcacagactatggagccttaactctggattgttcgccgcgtacgggactagacttcaatgaaatggtacttttaaccatgaaggagaaaagttggctcgtacacaagcagtggtttctagatttgccgcttccatggacttcaggagcaagcacaagtcaagagacctggaatagaaaagatctattagtaaccttcaaaactgctcatgcgaaaaagcaagaagtagtagtacttggttcgcaagaaggtgcaatgcacaccgctctaaccggtgctacagagatacaaacaagcggcaccactacaatttttgccggtcatttaaaatgtaggttaaaaatggataaactgacgctaaagggtatgtcatacgtgatgtgtacagggagtttcaaactcgaaaaagaagtagctgaaacgcaacatggtaccgtattggtacaaataaaatatgagggtacagatgcaccttgcaaaataccgtttagtacacaggacgaaaagggtgtcactcagaatggtagactcattactgcaaatcctatagttacagataaggaaaaacctgttaacatcgaagcagaacctccgttcggtgaatcatatattgtcataggggcaggagaaaaagctcttaagctaagctggttcaagaaaggatcatctattggaaaaatgtttgaagccactgcacgaggtgctcggcgaatggcaatattaggcgatactgcatgggacttcggatccatcggcggcgtatttacttcagtaggaaaactggtgcatcaaattttcggtacggcgtacggagtattattttcgggcgtgtcgtggacgatgaaaataggtattggtgtcttacttacatggttaggactaaattcccgaagtacatctctctcaatgacatgtatcgcagtaggactggtaaccttatatttaggagtaatggtccaggccgactctggatgcgtaatcaattggaaaggccgtgaattaaagtgtggtagcggtatattcgtaactaacgaggtacatacatggaccgaacagtacaaatttcaggcagactcccctaaacgtttgagcgctgccattgggaaggcctgggaagaaggagtttgtggaatacggagcgctactagactagagaatattatgtggaaacaaatatcgaatgagttaaatcacatattgcttgagaatgatatgaaatttactgtggtagttggagacgttgcaggaatattagcacaagggaagaagatgatacgaccccagcctatggaatacaaatacagttggaaatcttggggtaaggcaaaaattataggagctgatgtgcagaatacaacctttattatagatggtccgaatacacctgagtgcccagatgatcaaagggcttggaacatatgggaggttgaagattatgggttcggaatcttcaccacaaatatatggctaaaactaagagatagttatacacaggtatgcgatcatagacttatgtccgccgccattaaagattcaaaagccgtacatgctgatatgggctattggatagaatcagagaagaacgaaacctggaagctagcaagagcttcattcatagaagtaaagacgtgcatatggcccaaatcccacactttatggtcgaatggtgttttggaatcggaaatgataattcctaagatttacggaggaccaatcagccaacataactatcgtcctggctacttcacgcagacagcaggtccctggcacctaggcaaacttgaattagatttcgatttatgcgaaggaaccacggtagtagtagacgaacattgcggaaaccgcggcccgtcgctacgcacgacgacagtaacaggaaaaataatacatgagtggtgttgcagatcctgcaccttgccgcctttaagattcaaaggggaagatggctgctggtatggaatggagataagaccggtgaaagaaaaagaagaaaatctcgttaaatcaatggtttcggcagggtcaggagaggtagatagtttcagtctaggcttgctatgtatatcaatcatgatcgaagaggtaatgcggagtagatggtcaaggaaaatgctaatgactggcacgctagcggtcttctttttactcataatgggtcaacttacgtggaacgatttaattcggttatgcattatggtcggagcaaacgcatcagaccgtatgggaatgggaactacataccttgctttaatggctacttttaaaatgcgacctatgttcgcggttggtcttctttttagaagattaacctctagagaagtattactcctgactattggtcttagcctagtcgcatcagtagaattacctaactcactagaagaattaggggacggcctagccatggggataatgattctcaagctcttaactgactttcaatcacatcaattatgggcaactctgctttccctcactttcataaaaaccacgttctcccttcattatgcctggaagacgatggccatggtattaagtatagtatctttatttcctctttgtttatcaactacatcacagaaaactacatggttacccgttttactaggctccctgggatgtaaaccccttacaatgtttttaatagcagaaaataaaatatggggcagaaagtcttggcccttaaatgaaggaattatggctgtggggattgtttctattctgttatcagctttgctcaaaaacgatgtgccattagctggcccactaatagcaggaggaatgttgattgcatgttacgtaatttctggaagtagcgccgacctaagtctggaaaaagctgccgaagtatcatgggaagaggaggctgaacattcaggggccagccacaatatattagttgaggtacaagacgatggtacaatgaaaataaaagatgaagaaagagacgatactttaaccatcctactaaaggcaaccctactcgcggttagcggggtgtaccccttatcaatcccagcgacattatttgtatggtacttttggcaaaagaagaaacagagaagtggcgtcttgtgggacacgccgagtccacccgaagttgagcgtgcagtattagacgatgggatatacagaattatgcaaaggggtctattaggtagaagtcaagtgggcgtcggagttttccaagagaatgtattccacaccatgtggcacgtaacaaggggagcagtcctgatgtaccagggaaaaaggttagaaccgagctgggcatcagtaaagaaagacttgatttcgtacggtggaggctggagattgcaaggatcatggaataccggcgaagaagtccaagttatcgcagtagagccgggcaaaaatcccaaaaatgtacaaaccgcacccggaacattcaaaacaagtgagggcgaagtaggcgcaatagcactcgacttcaaaccaggaacatcaggttcgccgattgtaaatagagaaggaaaaattgttggtctatatggcaacggtgtagtaaccacctcaggcacgtatgtaagtgctatcgcccaggcaaaagcatcgcaagaaggtcctttaccggaaattgaggatgaggtcttcagaaaaagaaatcttacgatcatggatttgcatccgggatccggaaaaacaagaagatatctgccagccatagttcgtgaagccataaaaaggaagctacgaactttgatattagctcccacacgagtagtggccagtgaaatggccgaagctcttaaaggaatgcctataagatatcagactacagccgttaaaagcgaacacacaggaaaagaaatagtagatctaatgtgccacgccaccttcaccatgagattactgagtccggtacgtgttccaaattacaacatgattattatggatgaagcacatttcacagacccttcatccattgcagctcggggatatatatcaacaagagtcggaatgggggaagcagctgctatatttatgacagcaaccccaccgggaagcgttgaggcatttccacagtcaaatgccgtgattcaagatgaagaacgggatataccggaaaggtcttggaacagcggatatgaatggatcactgatttccctggaaaaactgtctggttcgttccgagtattaaatccggtaacgacattgccaattgtctcaggaaaaatggtaaaagagtgatccaattaagtcgcaaaacttttgatactgaatatcagaaaactaaaaataacgactgggattacgttgtaacaacagatatcagtgaaatgggagccaacttcagggcagatcgagtgatagatcctagaagatgcctaaagccggtgatacttaaagacgggccggaacgagtcatcttggccgggcccatgccagtaactgtggccagtgctgctcaaagaaggggacgaataggaagaaatcacaacaaagaaggcgatcaatacatctatatgggtcaacctttgaacaatgatgaggaccatgcacattggacagaggcgaaaatgcttctagataatatcaatactccggagggcataatccccgcattatttgaaccagaaagagagaaatctgcagcaatagatggcgagtacagactaagaggagaggcacgaaaaacctttgtggaattaatgagaagaggagatctaccagtatggttatcctataaagtagctagtgagggattccaatattcagataggagatggtgctttgatggtgaacgaaataatcaagttttggaagaaaatatggatgtggaaatctggactaaagagggggagcgtaagaaacttcgacctaggtggttggacgctcgtacctattccgatccactggcattacgtgaatttaaagaatttgctgcgggtagacggtcggtttcaggagatctaatcttggaaattggaaaattgccacaacacttgacacaaagagctcaaaacgccttagacaatttggttatgctacacaactcagagcaaggtggccgagcatacagacatgccatggaggaacttcctgatacaatagaaacgctcatgctattagcattaattgcggtactgacgggtggtgttactctattctttcttagcgggcgtggtttaggaaagacaagcataggactattgtgcgtaatggcgtcatcggttctactatggatggctagcgtggaaccccattggatagctgcttccataatcttagagttctttttaatggtattgttaattccggaacctgataggcagagaactcctcaagataatcaactagcctatgtagtaattggattgctttttatgattttaacggtagctgccaacgaaatgggacttttggaaaccactaagaaagacttgggaataggacacgtggccgtggaaaaccatcaccacgccgcaatgctggatgttgatttgcatccagcttcagcttggactttatatgcagtggctactacaatcataacacctatgatgcgtcataccatagagaacactaccgcgaatatttctctcacagcgatagccaaccaagctgccatcctgatgggtctggacaaaggatggccaattagtaagatggatattggcgttccgctacttgcgctaggatgttattctcaagtaaatcctttaaccctcacagcagcggtgttaatgctagtggcccattacgcaataataggaccgggtctccaagctaaagctactagagaagcgcagaaacgaacagccgcgggtatcatgaagaatcctacagttgacggaatagttgccatagacttagacccggtcgtctacgacgcgaaatttgaaaaacaattaggacaaataatgctactcatactttgtacatcacaaatcctgttaatgcgtacgacgtgggcgctatgcgaaagcataacgctggcgacaggaccgctgactaccttatgggaaggatccccaggaaaattttggaacacaactattgcagtatctatggcaaacatttttagaggaagctacctagcgggcgcaggattagcattctctctaatgaaatcgctgggtggagggagacgaggtacgggtgcacaaggagagactctgggggaaaaatggaaacgacaattaaaccaactatcaaagagtgaatttaacacttataaacgttctggaatcatggaagttgataggtctgaggcaaaggaaggtttaaaaagaggagaaaccacaaaacacgcagtatcacgagggacagctaagctcagatggttcgtagaaagaaatttggtgaaaccagaaggtaaagtcatcgatctagggtgtggacgtggtgggtggtcatactattgtgctgggttaaagaaagtaacagaagttaaagggtacaccaaaggagggccaggacatgaagaaccgatacccatggcaacctatggctggaatttggtaaaattgcattctggaaaagatgtattctttattccgccggaaaagtgtgacactttactatgcgacataggagaatcatcacctaatccaactattgaagagggacggactttacgcgtattgaagatggtagaaccgtggcttagaggcaatcaattctgcattaaaattctcaacccatatatgccatctgtagtagagaccttggaacaaatgcagaggaaacatggagggatgctagtacggaatccattgtcaagaaactcgacccatgagatgtattgggtttcatgtggaactggtaatatagtttcggccgtaaacatgacaagtaggatgttgttgaataggtttaccatggctcaccgaaaaccgacttacgaaagagacgtcgatctaggggctggcacgagacatgtagccgttgaacctgaagttgcgaacctggacatcataggtcagcgaatcgagaatataaagcatgaacacaaatcgacttggcattacgacgaggataatccgtataaaacatgggcataccacggttcttacgaggtaaaaccaagcggcagcgcatccagtatggtaaacggtgtggtaaaacttcttacaaaaccatgggatgttatacccatggtaactcagatcgcaatgacagatactacaccttttggacaacagagggtttttaaagagaaagttgatacccgtacaccaaaagctaaacggggaactgcgcaaattatggaagtaactgctaaatggctatggggatttctttcaagaaacaagaaacccagaatatgtacccgagaagagtttacacggaaggtgcgaagcaacgccgcgatcggtgctgtattcgttgatgaaaatcaatggaatagcgctaaggaagcagtagaagatgagaggttttgggacctagtccatagggagcgtgaattacacaaacaaggcaaatgtgcgacttgcgtttataatatgatgggaaaaagagagaagaaactcggtgagtttggaaaagcaaaaggatcacgtgcaatctggtacatgtggctcggggctcgtttcttagagtttgaagcactaggttttatgaacgaggatcattggttttcacgggaaaattcattaagtggtgtagaaggagaaggactacataagttaggttacatactacgggatatatcaaaaataccgggtggaaacatgtacgccgatgacacggctggttgggacacacgcataacagaagatgacctgcaaaacgaagccaaaataacggacataatggagccagagcacgccctattagccaagtccatatttaaattaacatatcagaataaggtagttcgggtacaaagaccagccaaaaatggtacagtgatggatgttatttcacggagggatcagcggggctcgggccaagttggaacatatggactaaatactttcacaaatatggaagctcaactaatcagacaaatggagtcggaaggaatattttctccctccgaactcgaaactcctaatctagctggaagagttttggattggctggagaaacatggagttgaaagattaaaacgaatggcaatatccggagatgactgcgtagtgaagccaatagatgacagatttgcaacagcactaactgcattaaatgatatgggaaaagttagaaaagatataccccaatgggaacctagcaagggatggaacgactggcagcaagtaccattctgctcacaccacttccatcagttaataatgaaggatggcagggaaatcgtcgttccttgtagaaatcaagatgaattagttgggcgggcacgtgttagccaaggcgctggatggtcactcagggaaaccgcatgtctcggtaaaagctatgcccaaatgtggcagctaatgtatttccaccgaagagatttaaggctggctgctaatgctatctgttcggctgatcccgatgactgggttccaacaagtaggacaacgtggtcaatacatgcacatcatcaatggatgacgaccgaggacatgctttcggtttggaatcgggtatggattgaagagaacccctggatggaagacaagactcacatctcttcctggggagatgtcccatatctaggaaagcgagaagaccaatggtgtggttctctaatcgggctaacagctagggctacctgggccactaacatacaggttgcaattaatcaagtaagacgactaattggaaacgaaaattacttggattacatgacaagcatgaagcgattcaaaaacgaatctgatccagaaggcgcgctctggtga

SEQ ID NO: 21752 - RNA, 9879 nt, synthetic construct
  misc_feature 1..9879: note = derived and/or modified CDS sequence (opt6) from DENV-1__GQ199849__SS-prME
  source 1..9879: mol_type = other RNA
tctgtaactatgctgcttatgcttatgccgactgcattagcatttcatttaacaactcgcggaggtgaaccccatatgatagtaacaaagcaagaaagaggaaaatcacttctttttaagacatctgccggtgtaaatatgtgcactttgatagctatggatttgggagaactctgtgaagacacaatgacatataagtgcccgagaattacagaagcagaaccagatgatgtcgactgttggtgtaacgctactgatacatgggtcacatatggaacctgctcacgcacaggagaacataggagagacaagcgttccgtggcattagctccccacgtgggattgggactcgaaacaaggacggaaacatggatgagctcagaaggtgcatggaaacagatacaaagagtcgaaacgtgggctttacgtcacccaggttttacagttatagcgttatttttagctcatgctattggaacctctattacgcaaaagggaatcatttttatcctattaatgcttgtaacaccatccatggctatgagatgcgtcgggataggatcaagagacttcgtggaaggactaagtggggcgacctgggttgatgtcgtattagaacacgggtcgtgtgttactaccatggccaaagataagcctacgctagacattgaactactgaagacagaagtgacgaaccctgcagtacttagaaaattgtgcattgaagccaaaatatccaacactactacagactcaagatgtccgacacagggagaagcgacacttatggaagaacaagatgcaaattttgtctgccggagaaccttcgttgatcgaggttgggggaatggatgcggtttatttggtaaaggttcccttatcacgtgtgctaagtttaaatgcgtaacgaaattagagggaaagattgttcaatatgagaatttaaaatatagcgtgatagtaacggtacacacaggtgatcaacatcaagttggtaatgaaagcactgaacacggaacaactgcaaccatcacgccacaagccccgacttctgagatacaactaacagattatggtgcccttacactcgactgttcaccaaggacaggactagatttcaatgaaatggtactcctaacaatgaaagagaagtcgtggttagtccacaaacaatggttcctcgatcttccgctaccttggacatcaggtgcttctacgagtcaagaaacctggaacaggcaagacctattagtaacctttaaaactgctcatgcgaagaaacaagaagtcgttgtcctaggttcacaagaaggagcgatgcatactgcgttaacaggtgcaacagagattcagacctctggtacaaccacaatatttgctgggcaccttaaatgcagattaaaaatggacaagctcgccctaaagggaatgtcgtacgtaatgtgcaccggtagttttaaactagaaaaagaagtggcggagacacaacacggaaccgtactcgtccaaataaaatatgaaggtaccgatgctccatgcaaaatacctttttccactcaggacgaaaagggagtaacacaaaatggacgacttataacggccaatccgattgttacagataaagaaaaacccgtaaacatagaagcagaaccaccctttggagagagttatatagtcattggtgcaggagaaaaagcgcttaagttgtcttggttcaagaaagggtccagtataggaaaaatgttcgaagcaactgccagaggggcacgacgtatggcaatcttaggtgatactgcatgggattttggctccattggcggcgttttcacgtctgttggaaagttagttcatcagatcttcggaactgcatatggagtgctattctcaggagtcagttggacaatgaaaataggtattggggtcctcttgacgtggttgggattgaactcacggagtacaagtttaagtatgacatgtattgcagttgggctagttacgttatatttaggagtgatggtccaagcagacagcggatgcgtaatcaactggaagggaagagagctgaaatgcggatcaggaattttcgtcacaaatgaagtccacacatggactgaacagtacaaatttcaagccgacagcccaaaaagactcagtgcagctattggtaaagcgtgggaggagggtgtatgtgggattagaagtgcaactagattggaaaacataatgtggaaacaaatatctaacgagttgaatcatatcttactcgaaaatggtcttaaattcacagtggtagtcggtgatgtagtcggaatattagcacagggcaagaaaatgatacgcccacaaccgatggaacacaaatacagttggaagtcttggggtaaagccaagataataggtgctgacgtacagaataccacctttatcatcgacggaccaaatacgccagaatgtccagatgatcaaagagcgtggaacatatgggaagtcgaggactatgggtttgggatatttactacaaacatatggctgaaattacgcgattcatatacgcaggtctgtgatcaccggttaatgtctgcggctatcaaagattcaaaagcagtacacgctgatatgggatactggattgagagtgaaagaaacgaaacttggaaacttgccagggcgtctttcattgaggtcaaaacgtgtatatggcctaaaagccatacgctttggtcaaatggcgttttggagtcagaaatgatcattcccaaaatttacgggggaccgattagtcaacataactataggccaggatatttcacgcaaaccgcgggaccctggcatttaggcaaacttgaactagatttcgatttgtgcgaaggaacaactgtggtagtagatgaacactgtggcaatagaggaccatcgctacggacgacgacggttacaggtaaaataattcatgaatggtgttgcagatcgtgtacactacccccattaagatttaaaggagaggatgggtgctggtatggtatggagatccgtcccgtcaaggaaaaagaagaaaatttggtaaaatcgatggtatcagcaggatcgggagaagtagactcattctcacttggactcctatgcacgtcaatcatgattgaagaggttatgcggagtagatggagtagaaaaatgcttatgactggaacattagcagtatttctattactaataatgggacagttgacatggaacgatctgatacgcctctgtattatggtgggtgcgaacgctagtgatagaatgggtatgggcaccacctatttagccttaatggctacatttaagatgagaccaatgttcgcagtaggtttgctatttagaagactaaccagtagagaggtcctattacttacgatcggtctatccctagtagcatcagtagaactcccaaattccctagaagaacttggggatggacttgcaatgggaataatgatactaaaattactaacagacttccaatcccaccagttatgggcgacgttactgagtctaactttcataaaaaccacactaagccttcactacgcatggaaaaccatggctatggtcttatctatagtaagcctgttcccattatgcctatcgacaacatcgcagaaaactacttggctgcccgttctattaggctcattgggatgcaaacccctaactatgttcctgattgcggaaaataagatatgggggagaaaatcctggcccctaaatgaaggtataatggccgtgggtgtagtgagtatactactatctagtctgctaaagaacgacgtgccgttagctgggccattaattgcaggcggcatgttaatagcctgttacgtaatttccggtagcagtgcagacttatcactcgaaaaagctgctgaagtaagctgggaagaagaagctgagcatagtggtgcatcacataatatatttgttgaggttcaagatgatggtactatgaaaataaaagatgaagaacgagatgacacattaacaatactgttaaaagccacattactcgcagttagtggagtatatccactttcaattcccgcgacattattcgtgtggtacttttggcaaaagaagaagcagagaagtggcgtattatgggatactccaagcccaccggaagttgaacgagccgcgctagacgatgggatctatagaatcatgcaaagaggtttattgggacgatctcaagttggggttggagtattccaggaaaatgtgtttcacacgatgtggcatgtaactcgtggagcagtgctaatgtatcagggtaaacgactagagccatcctgggcatccgtaaagaaagatctgatcagttatggaggtggttggagactacaaggtagctggaataccggggaggaagtacaagttatcgccgtcgaaccagggaaaaatccgaaaaacgttcagacggcaccaggaacattcaaaacaccagaaggtgaagttggcgcgatagcattggacttcaaaccgggaacaagtgggagcccaattgttaatagagaaggtaaaatagtaggtttatatggtaatggagtagttacaacaagcgggacttacgtatccgcgatagcccaaacaaaagcctcacaggaaggaccactaccagaaattgaagacgaagtatttaggaaaagaaatttaactattatggatttacatccaggctctggaaaaacgagaaggtacctacctgctatagtaagggaggctattaaacgaaaactccgaacactcatactagctcctacaagagtggtagcaagtgagatggcagaagcgctaaaaggaatgcctatccggtatcaaacaacagctgtgaaatctgaacatacaggaaaagaaattgtggatctgatgtgtcacgctacattcaccatgcgattactaagcccagtgcgtgtcccaaactacaacatgataatcatggatgaagcacattttacagaccccagtagtatcgcagcacgaggatatatttctactcgtgtcggaatgggcgaagccgcagccatttttatgactgcaacgccaccgggttcagttgaggcttttccgcaatccaatgctgttatacaagatgaagaacgagatattcccgagcgtagctggaactccggatacgaatggatcactgacttcccagggaagacagtgtggttcgttccgagtataaaaagtggaaacgatatagcaaattgtttaagaaagaatggtaaacgcgtaatacaactttcaagaaaaacatttgatacggaatatcaaaagactaaaaataacgattgggactacgtcgttacaacagacatatccgaaatgggggcaaactttagggccgatagagttatagatccccgccgctgcttgaaaccggtaattttaaaagacggtcctgaaagagtgatcctggctggaccaatgcctgtaacagttgcaagcgctgcacagcgtagaggccgaataggtaggaatcataataaagagggggatcaatatatatacatgggccagcctttaaataacgatgaagatcatgcacactggactgaagctaagatgcttctggacaatataaatactcctgaaggtataataccagccctattcgaaccagaaagagagaaaagtgcagcaattgatggagagtatagattaagaggggaagcacgaaaaacatttgtggaacttatgaggagaggagatttgccggtgtggttgagttacaaggtagcgtccgagggatttcagtattccgatagacgatggtgtttcgatggtgaacgaaataatcaagtgttggaagagaatatggatgttgaaatatggactaaagaaggagaaagaaagaaattgcgcccccggtggctcgacgctcgaacatatagcgatccgttagctctccgagagttcaaagaatttgcggcgggtcgaagatcagtgtccggggacctcattttagaaatcggaaagttgccacaacatcttacgcaacgagcccaaaacgcactcgacaatcttgttatgctacacaactccgagcaagggggacgagcatacagacatgctatggaagagttgcccgacaccatagagacactcatgttactcgcattgatagcagtattaacgggaggagttacacttttcttcctgtcaggtcgcggactaggaaaaacaagtataggattgctatgcgtcatggcttcctcagtgcttctttggatggccagtgttgaaccacattggatagcggctagtattatccttgagttctttttaatggtcctcttaattcctgaaccggatagacagagaacccctcaggacaatcaactagcatacgtcgtcatcggactactatttattatacttactgtagcagctaatgaaatgggtttgctcgaaaccaccaagaaagaccttggaattggacacgtcgcagtggaaaatcatcaccatgctacgatgctagatgtagatttacatccggcaagcgcctggaccctatacgcagtggctacaactataattacgcctatgatgcgtcatacaatagagaatactacggccaatatctcattaactgcgatcgcgaatcaagcggcgattttaatgggactagacaaaggctggccgatatcgaaaatggatataggggtacctctgttggcactaggatgctattcccaagttaatccgctgacgttaaccgccgcagtcctaatgttagtggctcactatgctattatcggacccggtctacaggcaaaagcgacgagagaggctcaaaaacgtacagctgcaggaataatgaaaaatcctacagttgacggaattgtagccatagacttagatcctgtagtctatgacgctaaatttgagaaacaattaggccaaatcatgctattgattttatgtacttctcaaatattacttatgcggactacatgggcattatgcgaatctataacattggcaactggtcccttaaccaccctttgggaaggtagtccaggaaaattttggaacacaacgatagcggtatcaatggctaacatctttagaggctcatacctggctggtgctggactagcgttcagtctaatgaaatcattaggaggaggaagaagaggcacgggagcacaaggcgagaccttgggggaaaagtggaaaagacaacttaatcaactatctaaatcggaatttaatatatataaaagatctggtataatggaggttgatcgtagtgaagcaaaagaaggattaaagcgtggagaaacaaccagacatgcagtatcgcgcggtaccgcaaaattaagatggtttgtagaaaggaacctcgttaaaccagaaggaaaagtaatagacctgggctgtggtcgaggaggctggtcttattattgtgcagggttaaagaaagtgaccgaagtaaaaggatatacgaaaggaggacccggacacgaagaacctataccaatggcaacctacgggtggaacttagtcaaactgcactcaggcaaagatgtattctttacgccgccagaaaaatgtgatactttattatgcgatataggggaatcctcacctaatccaacaatagaagaaggtcggaccctacgggtacttaaaatggtagagccatggctccgtggtaatcaattctgtataaaaattttaaacccctacatgccgtcagtagtggaaacgttagagcaaatgcaacggaaacatggaggaatgctcgttagaaacccactaagtcgaaatagtacccatgaaatgtattgggtgtcatgcggtactggaaatattgtatcagcagtcaatatgacatccaggatgctgctgaaccgatttactatggcccatagaaaacccacatatgaacgggatgtagatctcggtgctgggaccagacacgtcgcagtcgaacccgaagtagcaaatctagatatcatcggacagaggatagagaatataaaacatgaacacaaatcgacatggcactacgacgaagataatccgtataaaacgtgggcctatcacggttcttatgaggttaaaccgagtggctcagctagttctatggtcaatggggtcgttaaactactgacaaagccatgggatgtaataccgatggttacacaaattgcaatgactgatacaacgccctttggccaacagcgagtgtttaaagaaaaagtagatacaagaacccctaaggctaaaagaggcaccgctcaaatcatggaagtaacggcaagatggctctggggattcctatcgagaaacaagaaacctagaatatgcactagagaagagtttacccgtaaagtgaggtccaatgcagctatcggcgctgtatttgtcgatgagaatcagtggaatagtgcaaaggaggctgtagaggatgaacgtttctgggatttagtacaaaaagagagagaactacacaagcagggaaagtgtgcaacctgtgtctataatatgatgggaaaaagagaaaagaaattgggagagttcggcaaggcaaagggaagcagagcaatttggtatatgtggcttggagcacgatttctggagttcgaagccctaggcttcatgaatgaagatcattggttcagtcgagaaaacagtctatctggagtagaaggagagggactccacaagttaggatacatcttgagggacatatcaaaaattccaggcgggaatatgtatgctgatgacacagcaggatgggacacaagaataacagaagatgatttgcagaatgaggcaaaaataacagacattatggaaccagaacacgcactacttgcaacaagtatatttaaacttacgtaccaaaataaagtagtaagagtccaaaggcccgcgaaaaatggaacggtcatggatgttatatctagaagagatcaacggggttcagggcaagtaggaacctacggtttaaatacctttacaaatatggaagcacaattaatcaggcagatggaatctgaaggaatatttctcccttctgagttagaaacacctaatctggctgagagagtactagattggttagaaaagtacggagtagaaagacttaagcgcatggctatttccggagatgattgtgtagtaaagcctatcgatgatagattcgcaacagcgcttacagcgttaaacgacatgggaaaagttagaaaggacataccgcaatgggaaccatcaaaggggtggaacgactggcaacaggtcccattttgctcccaccattttcaccaactaatcatgaaagatggacgtgaaatagtagtcccatgtcgtaatcaggacgaattagttggacgggcacgagtttcacagggggccgggtggtctctacgagaaacagcatgtctcggtaaaagttacgcacagatgtggcaattaatgtactttcacagacgtgacctccggttagctgcgaacgctatatgtagcgccgtaccggttgattgggtccccacatcacgtacaacatggagcattcatgcccaccatcaatggatgacaacagaagacatgctaagcgtatggaacagagtatggattgaagaaaacccctggatggaagacaaaacccacgtgagttcctggggagacgtgccatatttggggaagcgagaggatcagtggtgcggaagtctaataggactaacagcaagggctacatgggcatcaaatattcaagtagctataaatcaagtccgacgactaattggtaatgaaaactaccttgattacatgacaagcatgaaaagattcaaaaatgaaggagatcctgaaggtgctctctggtag

SEQ ID NO: 21753 - RNA, 9879 nt, synthetic construct
  misc_feature 1..9879: note = derived and/or modified CDS sequence (opt6) from DENV-1__FJ898410__SS-prME
  source 1..9879: mol_type = other RNA
tccgttaccatgctactcatgctgaccccaactgcccttgcatttcatttaacgacgagaggaggagaacctcacatgattgtaagtaaacaagaaagaggcaaatcgcttctatttaaaacctccgctggagtaaatatgtgtacactaatagccatggatctaggagaattttgcgaagacactatgacgtataaatgtccgagaatcacggaagcagaaccagacgatgtagattgttggtgcaatgctactgatacctgggtaacgtatggtacgtgttctcaaactggtgaacatcgacgggataaaagatcagttgctctcgctccacacgtcggcttaggattagaaactagaactgaaacctggatgtcgtctgaaggtgcatggaaacaaatacaaagagttgagacttgggcgctacgtcatcccggatttactgttatagctctatttctagcacatgctattgggacatctatcacacagaaaggtatcatttttatactattaatgctcgtaactcccagtatggccatgaggtgtgtaggtattggaagcagggatttcgtggaaggtcttagtggtgctacgtgggtagacgttgtacttgaacacggcagttgtgtaacaactatggcaaaagataaaccaacactagatattgaattattaaaaacagaagtaacaaatccagctgtcctaagaaaactatgcatagaggcgaaaataagcaacacgacgacagacagccgatgtcctacccagggagaggcaacattggtagaagaacaagatgcaaacttcgtctgtagaagaacatttgtagacaggggctgggggaatggatgtggattatttggaaagggatctctcatcacttgcgcaaaattcaaatgtgtaacaaaactcgaaggcaaaatagtacagtacgagaacctgaaatatagcgttatagttacagtccatacaggtgatcagcaccaagtaggtaatgaaagcacggagcacggaaccactgcgacaattacgccacaggcaccatcaacagaaatacagttaacggactacggcgcactaacactagactgtagcccacgtacgggcctagatttcaatgaaatggtattactcaccatgaaagagaagagttggttagtgcacaaacaatggttccttgatcttccgctaccctggacctctggggcaagtacaagtcaagaaacttggaacaggcaagacctattagtaacgtttaaaactgcgcacgctaagaaacaagaagttgtcgttttgggtagtcaggaaggagctatgcacactgcattgacaggcgcaactgaaatacaaacaagcggaacaacaactatattcgcaggacacctaaaatgcaggctcaagatggataaactgacgcttaaaggtatgtcgtatgtaatgtgcactggctcattcaaattagaaaaagaagtagctgagacacagcatgggactgtgctcgtgcaaattaagtacgaaggaactgacgccccttgcaaaatacccttttccacacaggatgaaaagggcgtaactcagaacggacggttgataactgcaaaccctatcgtcacagataaagaaaaacccgtaaacatagaagctgagccaccgtttggcgaatcttatatagtcatcggagcaggagaaaaggccttaaaactaagttggtttaagaaaggctccagtataggtaagatgtttgaggctactgctaggggagctagaagaatggcgatactaggagatactgcttgggattttggctcaataggaggagtctttacttcagtgggaaaacttgtacatcaaatttttggaacagcgtatggagtattgttttctggagttagctggaccatgaaaattgggattggagtattgctgacatggctgggattaaattcacgaagtacatcactctcaatgacatgtatcgctgtcggtctggtaaccctatatctaggcgtaatggttcaagcagactccggctgcgtaattaactggaaaggaagagagttaaagtgtggttctggaatttttgtcacgaatgaagtgcatacatggaccgaacagtataaatttcaagcagattcaccgaagagattaagtgcggccatagggaaggcttgggaagaaggagtgtgtggaatacgatcagcaactcgcttagaaaatattatgtggaaacaaatcagcaatgaactaaaccatatactactcgagaatgacatgaaactgacagtggttgtaggcgatgttgcgggcatccttgctcaaggaaagaaaatgatccgccctcagccgatggaatataaatattcatggaaaatatgggggaaagctaaaataatcggcgctgatgtccaaaacaccaccttcatcatagatggaccaaatacacccgaatgtcccgatgaccaaagagcatggaacatatgggaggtcgaggattacggcttcgggatttttacaactaatatatggttaaaactaagagattcatatacccaagtctgtgatcacagattaatgtcagcggcaataaaagatagtaaagcagtacatgcggatatggggtattggatcgagtcggagaaaaatgagacatggaagctcgctcgggcatcattcattgaagtgaaaacatgtatatggcccaagagccatacgctatggtccaacggggtcttggaatcagaaatgatcatcccaaagatatatggcggtccaataagtcaacataactaccgtccaggatactttacgcaaaccgcaggtccatggcatttaggtaagctggaactagacttcgatctatgtgaaggaaccactgtcgtagttgacgaacactgcggaaaccgcgggccatctttaagaactacgactgtcaccgggaaaataatacatgagtggtgttgcagatcgtgcacacttcctccacttcggttcaagggggaagacggatgctggtatggtatggaaattagacctgttaaggaaaaggaagagaatcttgtaaaatctatggtcagtgcgggttcaggagaagtagattccttctcgcttgggttactatgcattagcataatgatagaagaagttatgagatctcgttggtcacgtaaaatgttaatgactggaaccttagccgtattcttcttactaataatgggacaactcacttggaatgatctaataagactttgtattatggtgggagcgaatgcctcagatcggatgggtatgggaacaacatatctagctttgatggctacgtttaaaatgagaccaatgttcgctgtaggcctactctttcgtaggttaacctccagagaagttttgctgttgaccatcggactatcattagttgcctctgtagagcttcccaactcacttgaagaactgggagatggtttagccatgggcattatgattttaaaactactaacagattttcaatcccaccagctttgggcaacccttctttctttaactttcataaggacgaccttcagccttcactatgcctggaagaccatggctatggttctaagtatagtctcattgtttccattatgtctcagtacaacatcacaaaagacaacgtggcttccggtactattgggttccttaggatgtaaacccttaaccatgtttctaatcgcggagaacaaaatatggggcagaaagtcatggcccctaaacgaaggaatcatggctgttggtatagtaagcatattgctaagcagtctactcaaaaacgacgtacctcttgcgggaccattaatagctggtggcatgctaatagcatgctatgttatatcaggcagttcagcggacctatccttagagaaagctgccgaagtttcctgggaggaagaagccgagcattcgggtgcatcacataatatcctagtagaggtacaagatgacggtaccatgaagattaaagatgaagaacgcgatgatacactcacaatactcttgaaggccacactactagcagtttctggcgtatatccattaagtattccggcaacactatttgtatggtatttttggcagaaaaagaaacaaagaagcggagtgttatgggatacacccagcccgcccgaagtagagcgggctgttttggatgacggtatatataggataatgcagcgcggcctcctcggtagaagccaagtaggtgtgggcgtgttccaggaaaatgtctttcacacgatgtggcatgtcacaagaggggcagtattaatgtatcaaggcaaaagattggaaccaagttgggcttcggtcaagaaagacttaatatcgtacggaggaggttggagattgcaaggaagctggaacacaggagaagaggtacaagtaatcgcagtcgaacctggcaaaaatcccaaaaacgttcaaacagcaccgggcacattcaaaacttccgaaggagaggtgggagcgatcgctctggactttaaaccaggcacaagtggatcgcctattgttaatcgggaaggaaaaatcgtaggattgtatggcaatggagtcgttaccacatcaggtacatacgtatcagccatagcacaagcaaaagcgagtcaggaaggcccactgccggagatagaagatgaagtattccggaaacgaaacctaacaataatggatttacatcctgggagtgggaaaaccagacgatatctaccggctatagtacgagaagcgatcaaaagacgacttaggactttgattcttgcaccaactagagtagtggcgagcgaaatggccgaagctctaaaaggcatgcctattcgctatcaaactactgcagttaaatccgaacataccggaaaagaaatagttgatttaatgtgccacgcaacatttactatgagactactctcgcctgtacgcgtaccaaattataatatgatcatcatggatgaagctcattttacagatccttctagtatcgctgcacggggttacattagtactagggtcggtatgggcgaagcagcagctatatttatgactgcaacgccaccaggcagtgtcgaggcatttccacaatcaaatgcagtaattcaggacgaagaaagagacattccagaaagatcttggaatagtgggtacgagtggattactgactttccaggcaaaacggtatggtttgtcccttcaatcaagtcgggaaacgacatcgctaattgtctcaggaaaaatgggaaaagagtaatccaattgagtcgtaaaacttttgatacagaatatcaaaagacgaaaaataacgactgggactatgttgtaacgaccgatatttcggaaatgggagcaaattttagagcagatagagtcatcgatccacggcgatgtttaaaaccagtcattcttaaagatggtcctgaaagagtcattctcgccggtcctatgccagtcacagttgcatctgcggcacagcgtcgcggtagaataggaaggaaccacaacaaagaaggagatcaatacatttacatgggccaaccactgaacaatgacgaagaccacgcacactggaccgaagcgaaaatgcttttggacaatattaatacgcccgaaggcataatacctgcactctttgaacccgaaagagaaaagtcagctgcaattgatggcgagtataggcttagaggagaagcacgtaaaacttttgtcgaactaatgagacgtggtgaccttccagtctggctgtcctataaagtcgcaagcgaaggcttccaatatagtgatcgtagatggtgttttgacggtgaaaggaacaatcaagtgttagaagaaaatatggatgtagagatctggacgaaggagggtgaaagaaagaaacttcgaccacgttggttagatgcacgtacttactcagaccctcttgcattaagggaatttaaggagtttgccgccggcaggagaagcgtcagcggggatctaatcttagaaataggtaaattaccacaacatttgacccagcgagcacaaaacgcactagataacctagttatgttacataacagcgaacaaggcgggagagcataccgacacgctatggaggagttgcctgacacaatagaaacgttaatgctgttagcgctaatagctgtattaactggaggggtaacactcttctttctttcaggaaggggtcttggtaaaacatcgattggactcctatgtgtaatggcatcatctgtacttttgtggatggcgagtgtagaacctcattggatagcggccagcataatcttagagttctttttgatggtgttactcataccagaacccgataggcagaggacccctcaagacaaccaattagcctacgtagtcatcggactactctttatgatattaaccgtagcagcaaatgaaatgggcctccttgaaacaactaagaaagaccttggtataggacatgttgccgtcgaaaatcaccatcacgccgccatgcttgacgttgatctacacccggcctcagcatggaccttgtatgccgttgctactacaataattacaccaatgatgaggcacactattgaaaacacaactgcaaatataagcctaaccgccatagccaatcaggcggccatattaatggggctagacaaaggctggcccatatccaaaatggatataggagttcccctattagcacttggctgttactcgcaagtaaatcctcttacactgacggctgccgtgctcatgttggtggcacattatgccattattggaccaggacttcaggctaaggcgacacgggaggctcaaaagcgaactgcggctggcataatgaaaaacccgactgtagacggtatagtagcgattgacttggacccggtagtctacgatgccaaattcgaaaaacaactaggacaaataatgctattaatactctgtaccagtcaaattctattaatgagaaccacatgggctctatgcgaatcaatcacactagcgactggcccacttaccacgctatgggaaggaagtccagggaaattttggaatactactatcgcagtaagtatggccaatattttccgtggtagttacttagcgggagcgggtttagcgttctcattaatgaagtctttgggtggaggacgcagagggactggagcccagggagaaacgttaggcgaaaaatggaaaagacaacttaaccaactgagcaagcctgagtttaacacctacaaacgtagcggaataatggaagtagatcgtagcgaagccaaggaaggactaaaacgaggcgaaactaccaaacatgcagttagcaggggaaccgcaaaattacgctggtttgtagaaaggaacctggttaagcctgaaggtaaagttatcgacctaggatgtggtcgaggagggtggagctattactgtgccggattgaagaaagtaactgaagttaaaggctatactaaaggaggtccaggacacgaagaaccaataccaatggcaacttacggctggaatcttgttaaactccatagtgggaaggatgtcttcttcattcccccagaaaaatgtgatacactcttatgcgatataggtgaatcgtctccaaatcccactatcgaggaaggaaggacacttcgagtactaaaaatggtagagccttggctcaggggtaatcaattttgcataaaaattttaaatccttatatgccatcagtcgtagaaacgttagaacaaatgcaacgtaagcacggtgggatgctagtgcgtaatccactttcgcgcaatagtacacatgaaatgtattgggtaagctgtggaacaggtaacatagtatcagctgttaatatgactagcaggatgctgttaaatagattcactatggcgcatcgaaagccaacctatgaacgagacgtcgacctaggggctggaacgagacatgtagctgtagaaccagaagtagcaaatctcgacattattggtcaaaggatcgaaaatataaaacatgagcacaagagcacatggcattacgacgaagacaacccatacaagacgtgggcataccatggaagctatgaagtaaaaccatctggatccgctagttcaatggtaaatggagtagtcaaattattaacaaaaccctgggatgtgattccaatggtcacccagatagctatgaccgacacaaccccctttggtcaacaaagggtttttaaagaaaaagtcgatactagaactccaaaagccaaaagaggcacagcacaaataatggaagtaacagccaaatggctttggggcttcctttcgagaaacaagaaaccccgcatatgcacgagggaggaatttacaagaaaagtccgatcgaatgccgctataggggcagttttcgtagatgaaaaccaatggaacagtgcaaaagaagctgtggaagacgaaagattttgggatctagtacatagggagcgtgagctacataaacaaggtaagtgtgcaacatgtgtttacaatatgatggggaaaagggagaagaaattaggagagtttgggaaagccaagggctcccgcgcaatttggtatatgtggttaggcgctcgatttttggaatttgaagcactaggatttatgaatgaagaccattggttctcgcgagaaaattccctaagcggtgtcgaaggcgaaggtctacataaattaggatatatcttaagagatatcagtaaaataccaggaggaaacatgtacgcggacgacactgccggatgggacactcgcataaccgaagatgatctacaaaatgaagccaaaattactgacattatggaacccgaacacgctctgttagcaaagtctatatttaaacttacttatcagaataaagttgtacgagtacaacgtcctgctaaaaatggtacagttatggacgtaatttccagaagagatcaacgaggctcagggcaagtgggaacgtacggtttaaatacgttcacaaatatggaggcacagttaatcagacaaatggaaagtgaaggaatctttagcccctcggaattggagacgcctaacttagctggtagggttctcgactggttagaaaagcatggagtcgaaagactaaaaagaatggctatctccggtgatgactgtgttgtgaagccaatcgatgatcgttttgctactgctttgacagcgttaaatgatatgggtaaagttagaaaagatataccgcaatgggaaccaagcaagggatggaatgattggcagcaagtacctttttgtagccatcacttccatcagttaattatgaaggacggaagagaaatagtggtaccatgtagaaatcaagatgaattagttggccgagcgagggtttcacaaggtgcgggatggagtttgagagagactgcatgcctaggaaaatcctatgcacaaatgtggcaacttatgtactttcatcgacgtgacctacgacttgctgcaaacgctatatgcagtgcggtaccagtagactgggtcccgacctccaggacaacatggtctatacatgcacaccaccagtggatgacaacagaggatatgcttagtgtatggaacagagtgtggatagaagaaaatccatggatggaagataagactcacgtgagttcatggggagacgtcccgtacttaggaaagcgcgaagatcagtggtgtggttcactcattggattgacagcacgagccacctgggcaacaaatatacaggttgcaatcaatcaagttcgacgacttctcggcaatgaaaactatctagattatatgacaagtatgaagcgattcaaaaacgaatccgatcccgaaggtgcattatggtaa

SEQ ID NO: 21754 - RNA, 9879 nt, synthetic construct
  misc_feature 1..9879: note = derived and/or modified CDS sequence (opt6) from DENV-1__FJ898411__SS-prME
  source 1..9879: mol_type = other RNA
tcagtaacaatgttacttatgcttatgcccacagcactagcattccacctaacaactagaggaggtgaaccacatatgattgtgtcaaaacaagaaagaggaaagagcttactctttaaaacaagtgccggtgttaatatgtgcactttgatagctatggaccttggagaattttgcgaagatacgatgacctataaatgtccaaggatcacagaagcagaaccagatgacgtcgattgttggtgcaacgcaactgacacctgggtaacatacggaacatgtagccaaacaggtgaacatagaagggataaacgttcagtggcccttgcaccacacgtaggtttaggattagaaaccagaacagagacttggatgagttctgaaggggcttggaaacaaattcaaagagttgaaacgtgggctctacgacaccctgggtttaccgttatagcactatttttagcacatgcaataggaacatcaattacgcaaaaagggatcatattcatactattaatgctcgtaactccttccatggctatgcggtgtgttggtatagggagcagagattttgtggagggtctatctggtgctacatgggtagatgtagtgttagaacacggctcatgtgtgacaacgatggcgaaagacaaaccgactcttgatatagaattattgaaaacagaagtcacgaatcccgctgtactaagaaaactatgcattgaggcaaaaatttcaaacacaactacagatagcagatgcccaactcaaggggaagctacacttgtggaagaacaggatgccaactttgtatgtagaaggacgttcgtagacagaggatggggcaacgggtgtggacttttcggaaaaggatctctgattacatgcgcgaaattcaaatgtgtgactaaactagaaggcaaaattgtgcaatacgaaaacctcaaatatagtgtcatagttaccgtacatacaggtgaccaacaccaagtaggcaacgagtctacggaacacggcacaacagcaacaataacaccacaggccccatcaactgaaatacagttaacggattatggagcattgacgcttgactgctccccaagaacaggtctagattttaacgaaatggttttattaactatgaaagagaaaagttggctagtccataaacagtggttcttggatttgccgttgccgtggacttcgggtgcatcgacaagccaagagacctggaatcgaaaagacctactggtaacatttaaaacggcccatgcgaagaaacaagaagtagtagtactgggatctcaagaaggagcaatgcacactgcattaaccggggccacagaaattcaaacaagtggcaccactacaatcttcgctggccatttaaaatgtcgtcttaaaatggacaaactcacacttaaaggtatgtcgtatgtcatgtgcactggctcattcaaattggagaaagaagtagctgaaacacaacacgggactgtattagtgcaaatcaaatacgaaggaacagatgcaccttgtaaaatacctttctcaacgcaagacgaaaaaggagtcacgcaaaatgggcgattgattacagcaaatcctatcgtaactgacaaggaaaaaccagtaaatatcgaagcggaaccaccctttggcgaatcatatattgtcataggcgcaggggaaaaagcactgaagttgtcgtggttcaagaagggatcctcgataggaaagatgtttgaagcaactgccaggggagccagacgtatggcgatacttggagatacagcatgggattttggctcaattggcggtgtattcacttcagtaggtaaactcgtgcaccagatctttggcaccgcctatggtgttttattctcgggagtgtcatggacaatgaagataggaatcggagtactattaacatggctaggactcaattcaagatctacgagtctctcaatgacgtgtatcgcagtaggattagtgacactgtatttaggagttatggtgcaagcagattctggttgtgtaataaattggaaaggaagagaactaaaatgtgggtctggaatcttcgtaaccaatgaagtccacacttggacggaacagtacaagtttcaagctgattcaccaaagagacttagcgcagcaataggcaaggcatgggaagaaggagtttgtgggattcgatcagcgacgcgtctggaaaacattatgtggaaacaaataagtaatgagttgaatcacatacttctggagaatgatatgaaattcacagtcgtagtaggcgatgtcgcaggaatactggcacagggaaagaaaatgatacgccctcagcccatggaatataaatattcatggaaatcttggggtaaagctaaaataataggtgcagatgttcaaaatactacattcattatcgacgggccaaatacaccagaatgtccggatgatcaaagagcatggaacatatgggaagtcgaagactacgggtttggcatatttactactaacatttggctaaagctccgtgacagttatacacaagtatgtgatcatcgacttatgagtgcggcgatcaaagattccaaagctgttcatgctgatatgggatactggatagaaagtgagaaaaatgagacttggaagttagctcgtgccagcttcatagaagtgaaaacttgcatttggccgaaaagtcatacgttgtggagtaacggtgtattggaatctgaaatgattatcccaaaaatttacggaggtccaatctcacaacataattatcgaccaggttacttcacacaaactgctggaccatggcacttggggaaattggaattagatttcgacctctgtgaaggtacgaccgtcgttgttgatgaacactgcggaaataggggaccaagtctacgtacgacgacagttacgggtaagataatacacgaatggtgctgtcgctcatgtacgctgcccccattaagatttaaaggcgaagatggctgttggtacggtatggaaataagacctgttaaggagaaggaagagaacctcgtgaaaagcatggtatctgcaggatctggggaagtagactcttttagcttaggtctattgtgtatctcaatcatgatagaagaagtaatgagaagcagatggagcagaaaaatgcttatgactggtacgctagctgtattctttctactcattatggggcagctaacatggaacgacctcatcagactatgcataatggtaggagcaaacgcatcagatagaatggggatgggtaccacgtatctagcgctcatggctacttttaagatgagaccaatgtttgcagttggattgctgtttagaagacttacatctagagaggttcttttactgaccataggactttctctggttgcaagtgtggaattaccaaattccttggaagaacttggtgatgggttagcgatgggaataatgattttaaagctgttaactgacttccagagtcaccagctgtgggctacgttattatctttaacctttataaaaacaacattctctctacattatgcatggaaaactatggccatggttttatcaatagtcagtctctttccgctatgtttgtctacaacgagtcaaaagactacctggcttcctgtcctcctaggctccctgggatgtaagccattaacaatgtttttaattgcggagaataaaatctggggaaggaaaagctggccccttaacgaaggcataatggcagtgggtatagtaagtatactactatctgcattgttgaagaatgatgtccctttagcgggaccactaattgcaggcggaatgcttattgcttgttacgttatttcaggatcttcagcggatttaagtttagaaaaggccgcggaagtttcttgggaagaggaagccgaacactctggtgcaagccataatatacttgttgaggtccaagatgatggaacaatgaagataaaggacgaagaacgagatgacactctaactattttgttgaaagcaacactactagctgtatccggagtatatccattatcaataccagctacgttgttcgtctggtatttttggcagaagaagaaacagcgatctggagttttatgggacacaccatcgccaccagaagtcgaaagggcagtgctagatgatggtatatataggatcatgcagagaggactcttagggcgaagtcaagtcggggtgggtgtatttcaagaaaatgtttttcacacaatgtggcacgtgacaagaggagctgtgctcatgtatcaaggtaagcgattagaaccaagttgggcgtcggtcaagaaagacttaatatcttacggcgggggttggaggcttcaaggatcttggaatacaggagaagaggtccaagtaatagcagttgagcccgggaaaaatcctaagaacgtacagactgcaccaggcacatttaaaacgtctgagggtgaagtaggggctatagcattagattttaaacccggaacctccggctcgcctatcgtaaatagagagggtaaaatagttggactttatggaaacggagtagttacaacatcaggtacttatgtctcagctatcgcacaagctaaagcatctcaagagggaccattaccggagattgaagatgaagtcttcagaaaacgcaatctgacaataatggacctacaccctgggagcggaaagaccagaagatacttacctgcgattgttcgagaagctataaaaagaaaacttcgcacacttatactcgcccctactagagtggtagctagcgaaatggcggaagctctgaaaggaatgcctatacgctatcaaacaacagctgtcaaatctgaacatactggaaaagaaattgtagatttaatgtgtcatgctacttttacaatgagattattaagtccagttagagtacctaattataacatgataatcatggatgaagcacatttcactgatcccagctctatcgcagcaagaggttatatttctacacgggttggaatgggagaggccgcggcaatcttcatgaccgccactcctccaggcagcgtggaagcctttccacaaagcaacgcagtaattcaagatgaggaacgtgatatacctgagaggagctggaacagtgggtatgagtggataactgactttccgggtaaaactgtatggttcgtacctagcatcaaatcgggcaacgacatcgcaaattgtttaaggaaaaacggtaaaagagtaatccaactatcaagaaaaacttttgatactgaataccagaaaaccaaaaataatgattgggattatgtcgtaacaacagacataagcgaaatgggagctaactttagggctgatcgcgtgatcgatccccgacgctgtttaaagcccgttatactaaaagacggaccggagagagttatattggctggccccatgccagtaacagttgctagcgcagcacaaagaaggggacggataggaaggaatcataacaaggaaggagaccagtatatttatatgggacaacctctgaataacgatgaggatcatgctcactggacagaagcaaaaatgttactagataatattaatacgccggaagggataatcccagcgctttttgaacccgaacgagaaaaatcagccgcaattgacggcgagtataggttacgaggtgaggctaggaagacgtttgttgaacttatgaggcggggtgatctgccagtctggctgagctacaaagtcgcctcagaaggatttcaatattcggatcgacggtggtgttttgacggggagcgaaataaccaagtcttggaagaaaacatggacgttgagatatggaccaaagaaggagaaaggaagaaacttaggcccagatggcttgatgcccgaacctattcagacccattggctcttagggaatttaaagaatttgcagcaggaagacgctcggtctccggcgatctgatattggagattggaaagttaccccaacacttgacccaacgcgcccagaacgcgttagataatcttgtgatgttgcataactcagaacaagggggtagggcgtaccgacatgctatggaagagttgccggatacaatagagaccttgatgctgctcgcgttgattgcagtcctcactggaggagtaactttgttctttctatcagggcgaggcttaggaaaaacgagcataggactgttatgcgtaatggcttcttcagttcttttatggatggccagcgtcgagccacattggatcgcagcgtcaatcatattagaatttttcctcatggttctacttatacctgaacccgatagacagaggaccccacaagacaatcaacttgcatatgtcgtgatcggtctactatttatgatacttactgtggcagcaaatgagatgggactattagagacaacaaagaaagatcttggcataggacatgtagcggttgaaaatcaccatcatgcagcgatgttggatgttgatttacatcctgcttcagcatggacactttatgctgtggcaaccacaattataacaccgatgatgcgccacaccatagaaaatacaacagctaacatatcactcacagccatagccaatcaagcagccatattaatggggttagacaagggctggcccatatcaaaaatggacatcggcgttccattacttgcattaggatgctacagtcaagttaatccactcacattgacagctgcagtattaatgcttgtggcacactatgcaattataggccccggcttacaggccaaagccacacgagaggcgcagaagagaactgcggcaggtatcatgaaaaacccaactgtggacggaatagttgcaattgatttagatccagtggtatatgatgctaagtttgaaaagcaactaggtcaaataatgttattaatattatgtacttcccaaatattacttatgaggactacttgggcattatgtgagtctattacattagcaacaggccctttaactaccctatgggaagggagcccgggtaaattctggaatacaacgatagccgtatcgatggccaacatatttagaggtagttatctagcgggtgcgggacttgcgttcagtctcatgaagtcattagggggtggacgaaggggaacaggcgcccaaggagaaacactgggcgaaaaatggaaaagacaactcaatcaactctccaaatcagagttcaatacatacaaaaggtcaggcataatggaagtagatcgttccgaagccaaagaagggctgaaacgaggagaaacaacgaagcatgctgtttcgagaggcaccgccaagttgcgttggttcgtggagcggaacttggttaaacctgagggcaaagttatagacttaggatgtggcagaggtggttggtcttactattgtgctggtcttaagaaagtaacagaagtgaaaggatatacaaaagggggacccggacatgaagaacctattccaatggcgacgtacggatggaatttagtgaagttacactccggcaaagatgtatttttcattccacccgaaaaatgcgacactttactctgcgacatcggagaatcatcacccaatcctaccatagaagaaggacgaacacttagggttctaaaaatggtagaaccttggcttagaggcaatcagttctgtataaagattcttaatccttatatgccgtctgtcgtggagacattggaacagatgcagaggaaacacggaggaatgttagttagaaatcccctaagtagaaacagcactcacgaaatgtattgggtgtcttgcggtacaggtaatatcgtctcagcggttaatatgacaagtaggatgttgctaaaccgatttaccatggcccacagaaaaccaacatatgagcgggacgtagacttaggtgccggtactcgacatgttgccgtagaaccagaagttgctaatctagacataataggacagaggattgaaaatattaaacatgaacataagtcgacgtggcattatgatgaagacaatccttacaaaacatgggcgtatcacggaagttacgaggtcaaacccagtggttcagcctctagtatggtcaacggggtggttaaattattgacaaaaccttgggacgtaataccaatggtgacccagattgcgatgacagatacgacaccctttggacaacaacgcgtattcaaagaaaaagttgatacacgaacacccaaagcaaagagaggaaccgctcaaataatggaagtcacagcaaaatggctatggggattcttatctagaaataagaaacctagaatttgcactcgagaagaatttacaagaaaggtaagatcgaacgcagccatcggggctgtctttgttgatgagaatcaatggaactccgcaaaagaggcagtcgaagacgaacgattctgggacttagttcaccgagagcgagaattgcataaacaagggaaatgcgccacatgtgtgtacaatatgatgggcaaacgagagaagaaattaggagagttcgggaaagctaaaggctcaagagctatctggtacatgtggcttggagcgcggtttttagaatttgaagctctaggattcatgaatgaagaccattggttttcacgagaaaattcacttagtggcgtggaaggtgaagggctacacaagttaggctacattctaagagatatatcaaagattccgggaggaaatatgtatgcagacgatacggccggatgggacacgagaattaccgaagacgatctacagaatgaagcaaaaattacagatataatggagccagaacacgcattgttagcaaagtccatcttcaaattgacatatcaaaacaaagtggtcagagtacaacgcccggcaaagaacggaaccgtgatggatgtaataagcaggagagatcagagaggaagcgggcaagttggcacatatggccttaataccttcacgaacatggaagctcaattaattcgacaaatggaaagtgaaggtattttcagcccatccgaactggaaacaccaaatcttgctggaagagttttggattggcttgaaaaacatggtgttgaacgattaaaaagaatggctatctctggcgatgactgtgttgttaaaccaatcgatgacagatttgctactgcactaactgccttgaatgatatgggcaaagttcgaaaagatattccacagtgggaacccagtaaagggtggaatgattggcaacaagtgccgttctgctcccatcactttcatcaattaataatgaaagatggacgagaaattgtcgtaccatgcagaaatcaagatgaattagtagggagggccagagtatcacaaggtgcaggctggagcctacgagagactgcatgtttaggaaaaagttacgcccaaatgtggcaattaatgtactttcacaggagggatttaaggctcgccgcaaacgctatttgctcggctgttcccgttgattgggttccaacgtcgcgaactacctggtcaattcatgctcatcatcaatggatgactacggaagatatgttatcagtatggaatagagtgtggatcgaggaaaatccatggatggaagataagacacacatttcctcatggggtgatgtcccctatctcggaaaaagagaggatcaatggtgcggttcgcttattggattgactgcaagagcgacgtgggccactaatattcaggtggcgattaaccaagtaagacgactaattgggaatgaaaactatttagactatatgacatcaatgaagcggtttaaaaatgaatcagatccagaaggggcattatggtaa

SEQ ID NO: 21755 - RNA, 9879 nt, synthetic construct
  misc_feature 1..9879: note = derived and/or modified CDS sequence (opt6) from DENV-1__FJ898412__SS-prME
  source 1..9879: mol_type = other RNA
tcagttacgatgctactaatgctgatgccgacggcattagcatttcacttaacgacaagaggcggggaaccacacatgatagtcacaaaacaagaaagaggaaaatcattactatttaaaacatcagcaggagtaaatatgtgcacgttgatagctatggatctaggcgaattatgtgaagacacgatgacatataaatgtcccagaataacggaagcggaaccagacgatgttgactgctggtgtaatgcaacagacacatgggttacctatggaacatgttcacaaacaggagaacacaggcgcgataaaagaagtgtcgcattagcgccacatgttggcctgggactagaaacaagaacagaaacatggatgtcatcagaaggtgcctggaaacaaatacaaagagtagagacgtgggcccttcgtcatcctggatttacagtaatcgccttgtttttggcacatgccataggaacaagtataacacaaaaagggataatattcatcttgctcatgctcgtgacaccaagcatggcgatgaggtgcgttggaataggttcgcgagatttcgtcgaaggtctatcgggtgctacatgggtagatgtagtacttgagcacggaagctgtgttacaactatggcgaaagataaacccacattagatatagaactattgaaaaccgaagtaaccaatccagcagtgcttcggaaattatgcatagaggcgaaaatcagtaatactactacagactcacgatgccccacacaaggtgaggcgactcttatggaggagcaagacgcaaattttgtatgtagacgtacatttgtcgatagaggatggggaaatggatgtggattgtttggtaaaggaagtttaataacttgcgcgaaatttaaatgcgtaacaaaactagaaggaaagatagttcaatatgaaaacctgaaatattctgttatcgtaacagttcacacaggagaccaacatcaagtaggtaatgaaagtaccgaacacggaactacagcaaccattaccccacaagctcctacgtccgagatacagttaaccgactacggagccctcacccttgattgttcgccccgaacaggactggattttaacgaaatggtgttactaacgatgaaggagaaaagctggctggtacataagcagtggtttctagatttaccattaccatggacgtctggcgccagtacatcacaagagacatggaacagacaggatctgttagtgacgttcaagacagctcacgccaagaaacaagaagtagtagttttaggctcacaagagggagcaatgcatacggctttaactggagctaccgaaatacagacatctggaaccacaactatattcgctggccatttaaagtgccgtctaaaaatggataaactaacactaaaaggtatgagctacgttatgtgtacaggatcatttaaacttgaaaaagaagttgctgaaacacaacacggaacagtattagttcagatcaagtatgaaggaactgatgcaccctgtaaaattccattcagcacgcaagatgaaaaaggtgtaacacagaatggtcgcctcattactgcaaacccaatcgtaaccgataaagaaaagccagtaaatatagaagctgagcctccttttggtgagtcatatatagtaataggagctggtgagaaggccttgaagctgtcttggtttaagaaaggctccagtattggtaaaatgttcgaggcgacagctcgtggagcaagacgaatggcaatcctaggggacacagcatgggatttcggctcaatcgggggtgtctttacatccgtcggtaagttagtgcatcaaatctttggaacagcatacggagtactcttcagtggagtttcatggacgatgaaaattggtattggtgttcttctaacatggttaggcctaaatagcaggtcaacatcactatctatgacatgtattgcagtgggattggtaacgttatacttaggagtaatggttcaagcagacagcggctgtgttataaattggaaaggcagagaactgaaatgtggtagtggaatattcgtaacaaatgaagttcacacgtggactgagcaatacaaatttcaagctgattcacccaaaaggcttagcgcggcaatcggtaaggcttgggaagaaggagtttgcgggattcgatctgccactagactggagaatattatgtggaaacagattagcaatgaactgaaccacatattactagaaaacgatatgaaattcactgtagtcgtcggtgatgtagtcggaatcctagcacaaggtaaaaagatgattagaccacaaccgatggaacataagtattcttggaaaagctggggaaaagccaagataataggcgcggatgtacagaatacaacctttatcatagatgggccaaacacacctgagtgtccagatgatcaacgagcatggaatatatgggaggttgaagactacggatttggtatatttacaacaaatatatggctcaagttacgtgactcatatacacaagtgtgtgatcacagattaatgtcagcggcaataaaagatagcaaagcagtgcatgcagatatgggttactggattgaatctgagaaaaatgaaacatggaagctagcccgagccagcttcattgaagttaaaacctgtatatggccaaaaagccatacgctatggtcaaacggagtccttgaatcggaaatgatcatccctaaaatatatggaggccctattagtcagcataattaccgacccggatattttacacaaacagctggaccctggcaccttggtaaactagaacttgactttgatttgtgtgaaggaacaacagtagttgtcgatgagcactgcggaaacagagggccaagtcttagaacaacaacagtaacaggaaagattatacatgaatggtgctgtcgctcatgtacgctacccccactgcgttttaagggagaagatggctgttggtatggaatggaaatacgacctgtcaaggagaaggaagagaatttagtcaaatctatggttagtgctggttcaggggaggtagatagttttagtttgggactattatgtatcagtattatgatagaggaagtaatgcggtcacggtggagtagaaagatgctgatgacaggtacacttgctgtttttctgctgttaataatgggacaattaacgtggaatgaccttattagattatgcataatggttggagcgaacgctagtgacagaatgggaatgggtacgacgtatttagcattaatggcaacatttaaaatgaggcccatgttcgcggtaggacttttatttaggaggctaacaagtcgtgaagttctactacttacgattggtctgagtttagtagcaagtgtggaacttccaaattcacttgaggaattgggagatggtctggcgatgggtataatgatacttaaactactaacagattttcaaagtcatcaattatgggcaacacttttgagccttactttcataaagacaacattgagtcttcattacgcgtggaaaaccatggcaatggtcctctcgatcgttagcctttttccactatgtttaagtacaaccagtcaaaagaccacttggctgccagtacttttaggtagcctagggtgcaaacctctaacgatgtttctaattgccgaaaacaagatatggggccgaaaatcatggcctctaaatgaggggataatggccgttggtgttgtatctatattactctcaagtttacttaaaaatgacgtaccactcgctggacctcttatcgcagggggcatgttaattgcatgttatgtcatttcagggagctctgcagatttgtcattagaaaaagctgcggaagtatcctgggaggaagaagcggaacatagtggggcgtcacataatatcttagttgaggtccaagacgatggcaccatgaagataaaagatgaggagcgggatgatacactaacaatattactaaaggctactttattagcggtaagtggagtatatccattatcgatacctgcgacgcttttcgtctggtatttttggcagaaaaagaaacaacgatcgggagttctgtgggataccccgagccctccagaagtagaacgggccgttctagatgacggtatatatcgtataatgcaaagaggtctactaggtcgatcgcaggttggggtaggtgttttccaagaaaatgtttttcacacgatgtggcacgtaacaagaggggcagttttaatgtaccaaggaaaacgcttggagccatcgtgggcctcagtgaaaaaggacctaatcagttacggaggtggatggaggctacagggctcttggaacacaggagaagaagtacaagtcatcgctgtagagccagggaaaaaccctaaaaacgttcaaactgcacccggtacgttcaagactccggaaggggaagttggcgcaatcgcactggatttcaaacccgggacaagcggctcacccattgtcaatcgggagggcaagattgtgggtctatacggaaacggggtcgtaacaacatctggcacttacgtaagtgcaatagcccaagcaaaggcttcacaagaaggcccattaccagagatagaagatgaagtgtttagaaagagaaatctaaccataatggaccttcatccaggcagtggaaaaacgagacgctatctcccagcaattgtacgtgaagcaataaaaaggaaattgagaaccttgattcttgcaccgacccgggtggtagcatccgaaatggcagaagcactaaaaggaatgcctataagatatcaaacgacagccgtgaagtccgagcacacaggtaaggaaatagtagatttgatgtgccatgctacttttactatgcggttgctatctccagttcgtgtgccgaactataacatgataatcatggatgaggcacacttcacagatcccagtagtatcgcggcgagaggatatatttctacaagggttggcatgggcgaggcagctgcgatatttatgacggctacgccacctggtagtgtggaagcatttccgcaaagcaacgccgtgatacaagacgaagaaagagacatacccgagagaagctggaactcaggatatgaatggataactgatttcccgggtaaaacagtgtggtttgtcccatcaatcaaatcggggaatgacattgcaaattgtttaagaaagaatggaaaaagagtgatacaactatctcgtaaaaccttcgatactgagtaccagaaaaccaaaaataacgactgggattatgtagtaacgactgacatttctgaaatgggtgcgaactttagagcggaccgggtaatagatcctagacgatgtttgaagccagtaatattaaaagatggaccagagagagttatccttgcaggaccaatgcctgtcaccgtagcaagtgcagcacaacgccgtgggcgcattggaagaaatcataacaaagaaggtgaccaatacatttatatgggacaaccactcaataatgacgaggatcatgctcattggactgaagcaaagatgctactggataatataaacacgcccgaagggattatacccgccttgtttgagccggaaagagaaaaatcggcagctatcgatggtgagtaccgactgcggggcgaagcgcggaaaacctttgtagaattgatgagaaggggcgaccttcctgtttggctctcctataaagttgcatcagagggttttcaatactctgacagacgttggtgctttgatggtgaaaggaataatcaagtgctcgaagaaaacatggatgtggaaatatggactaaggagggtgaacgtaagaagctccggccccgatggctggacgctcgaacatatagcgacccgctggcattacgagaatttaaggagttcgccgcagggcgaaggtctgtctcaggcgatctcatcttagaaatcggtaagctgccacaacaccttacccaaagagctcaaaacgcgctggacaacctagttatgttacacaattcggaacaaggtggtcgggcttacagacacgctatggaagaactcccggatactatcgaaactttaatgcttttagctctcatcgcagttctaacagggggtgtaactttatttttcttgtcaggaaggggattgggaaaaacgtctataggtttgctgtgtgttatggcaagttcagtattattgtggatggcctcggtggaaccccactggatagcagcttcgataatattagaatttttcttgatggtgctactcatacccgaacccgacagacaaagaacaccacaggataatcaattagcatatgttgtaattgggttactttttatgatattgactgtagcagcgaatgaaatgggcctgttagagacaactaagaaagatttgggaattggccatgttgcagtagaaaatcatcaccatgttacaatgcttgacgtagacctccatcccgcgagcgcatggacactttatgcagtagccacaactataataactccaatgatgagacacacaatagagaacacgacagcaaatatttcccttactgccatcgctaatcaagcagcaatactgatgggacttgacaaagggtggcctattagtaaaatggatataggagtaccgttattagcattaggatgctattctcaagttaatccgctaacactgacagctgcagtcttaatgcttgtagcccattatgcaataattgggccaggcttgcaagcaaaagcgacaagggaggcgcagaaaaggacagccgcgggaataatgaagaatccaaccgtagacggaatcgtagcgatcgatctagacccagttgtctacgatgcaaaatttgaaaaacaactagggcaaattatgttactcattctatgtacttcacaaatactgcttatgcgtaccacttgggcgctttgcgaatcaataacactcgctaccggtcctttgacaaccctatgggaaggttctcccggcaaattctggaatacaactatagctgtaagcatggccaacatatttagaggatcgtacttagccggagcaggtctagcattttctttaatgaaaagtttaggaggaggtcgtagaggcacaggcgctcagggggagaccttgggagaaaaatggaagagacaattgaaccagctaagcaaaagtgagtttaatatatataagaggtcaggtattatggaggtagacaggagcgaagctaaagaaggcttaaaacgtggcgagacgactagacacgcggtaagtcgaggtacagctaaattgagatggttcgttgaacgcaacctcgttaaaccagaaggtaaagtcattgatttgggatgtggaaggggaggatggtcctattattgcgccggactaaagaaagtgacagaagttaaaggatacacaaaaggtggacctggccacgaggaacctattccaatggcaacatacggttggaacctagtaaagctacactcgggaaaggatgtatttttcacacccccagaaaagtgtgatacattattatgcgacataggggaatcatctcctaatccaacaatagaggaaggtagaacccttcgagtactaaagatggtagaaccttggttacgaggtaaccagttctgcattaaaattttaaacccgtatatgccgtcggtggtggaaactttagaacaaatgcaacggaaacatggaggtatgctagtgagaaaccctctttctagaaactcgacccatgaaatgtattgggtttcgtgtggtaccggaaacatcgtaagtgctgtaaatatgacttcccgtatgttacttaacagatttaccatggcacacagaaaaccgacgtatgaacgtgatgtggatttgggtgcaggaaccagacatgtagcagtagaaccagaggtagccaatttagacattattggccagagaatcgaaaatataaaacatgaacacaaatcgacgtggcattatgatgaagacaatccatataaaacgtgggcatatcatggctcctatgaagtcaaaccatctggttcagctagctccatggtgaatggagtagttaaacttctaactaaaccctgggatgtgattcccatggtaacccaaattgctatgacagatacaacgccgtttggtcagcaacgggtgtttaaagaaaaagttgacactagaacgcccaaagcaaagagagggacagcccagatcatggaggtgactgcaagatggttgtggggctttctgagtaggaacaagaaacctaggatctgtaccagagaggaatttacaagaaaggttagatcaaatgctgccatcggagctgtattcgtagatgaaaaccaatggaactccgcaaaagaagcagtagaggatgaacggttttgggaccttgtccaaaaagaaagagaattacataaacaggggaaatgtgctacttgtgtatacaatatgatgggaaaaagagagaagaaactcggtgaatttggcaaagcaaagggctctagagccatatggtatatgtggctaggcgccaggtttttagaatttgaagcactaggattcatgaatgaagaccattggttttcaagagaaaactcacttagtggcgttgaaggagaagggcttcacaaattaggatatatattgcgagacatttcgaaaattcccggcggtaatatgtacgcagatgatacagcaggttgggacacgagaattacagaagatgacttacaaaacgaagctaaaataactgatattatggaacctgaacacgcgttattggcaacatcaatatttaaattaacataccaaaataaagtcgtgagggtacaacgaccagctaagaatggcacagttatggacgtgatatcaagaagggatcagagaggttcaggacaagtggggacatacggattaaatacatttacgaacatggaggctcaactaattagacaaatggagtccgaaggcatattcctcccctcagagctagaaacaccaaatcttgcagaacgtgttctcgactggctagaaaaatacggagtggaaagacttaaaaggatggcaatttcaggagatgactgtgtggtaaaacccattgacgacagatttgcaacagcacttaccgctctgaatgatatgggaaaggtcagaaaagacatcccccaatgggaaccttcgaaagggtggaatgattggcaacaagtgcctttttgttctcatcattttcatcaattaattatgaaggatgggcgtgagatagtagttccttgtaggaaccaagacgaactggttgggcgcgcaagagtaagtcaaggggcggggtggtctttaagagaaacggcctgtttgggaaaaagttatgcgcagatgtggcaactcatgtattttcacaggagagacttgagacttgccgcgaacgcaatatgcagtgcagtaccggttgactgggtcccaacttctagaactacatggagtatccatgcacaccatcaatggatgacgactgaggatatgttatcagtttggaatagagtctggatagaagaaaacccctggatggaagacaaaacacatgtcagctcatggggagacgttccatacctaggcaagagagaagatcaatggtgcggctcactgatagggttaacagcaagagctacttgggctagtaacatccaggtggcgatcaatcaagtccgaaggcttataggtaatgaaaactatttagattatatgacaagcatgaagaggttcaaaaatgaaggggatccagagggagcactatggtag

SEQ ID NO: 21756 - RNA, 9879 nt, synthetic construct
  misc_feature 1..9879: note = derived and/or modified CDS sequence (opt6) from DENV-1__GQ199852__SS-prME
  source 1..9879: mol_type = other RNA
tctgttactatgttattaatgttaatgcctactgcgttagcgttccatctaactacaagagggggtgaaccgcatatgatcgtcacaaaacaagaacgcggcaaatctctattattcaaaacttctgctggtgtgaatatgtgtactctcatagctatggacctgggagaactctgcgaagacaccatgacatacaaatgccctagaatcactgaagcagaaccggacgacgttgattgctggtgtaatgcgactgacacttgggtaacttatggtacctgtagccaaactggtgaacacagaagagataaaaggagtgtggcgctggcaccccatgtaggcctaggcttagagactcgaacagaaacgtggatgtcatctgaaggagcgtggaaacaaatccaaagagttgaaacctgggctctgagacacccaggctttacggtcattgcattgttccttgctcacgcaattggtacctctataacccaaaaaggcataatattcatacttttgatgttggtgaccccatccatggcaatgagatgtgtaggtataggcagccgggatttcgtagagggattatccggtgcaacctgggtggatgtcgtattagaacatgggagctgcgtcacaacaatggcgaaagataaaccaactctggacattgaactgttaaaaacggaagtaactaatcctgcagttcttcggaaactctgcattgaagcaaaaatcagtaatactacaactgattctagatgtcctacgcaaggggaggcaaccttaatggaagaacaagatgctaactttgtatgtagaaggacatttgtcgatagaggttggggcaatggatgcggtttatttgggaaaggtagtttgataacctgcgctaaatttaaatgtgttactaaattggaagggaaaatagtccagtatgaaaatctcaaatattcagtaatagttactgttcacaccggtgatcagcatcaagtaggtaacgagtcaaccgaacatggaacaacggctacaatcacaccgcaagcaccgacgtcagaaatccaactaaccgactatggggcattaacacttgattgctctccaagaacaggacttgactttaatgagatggtacttttaacaatgaaagagaaatcttggctagtgcacaaacaatggttcttagatctcccattaccgtggacatcgggggcttcaacaagccaagagacatggaatagacaggatttgctggttacttttaaaactgcacacgccaagaaacaagaagtcgttgtactagggtcgcaagaaggtgcgatgcacacggcccttacaggtgcaaccgaaatccagacgtcaggcacaaccacgattttcgcgggacacttaaaatgtcgtctaaaaatggacaaactgaccctaaaaggaatgtcttatgttatgtgcacgggttcattcaaactagaaaaagaagtcgcagagacgcagcatggaactgtattagttcagataaaatacgaaggaaccgacgcaccatgcaaaattcctttcagtactcaagacgagaaaggtgtcactcaaaatgggagactgattacggctaatccaatagtaaccgataaagaaaagcccgttaatatagaagccgaacctccatttggggaatcttatatagttataggagccggtgaaaaggcattaaaattatcctggttcaagaaagggagcagcataggaaagatgtttgaagcaaccgcaagaggtgctcgaaggatggcgatcttaggggacactgcatgggatttcgggtccgtagggggagttttcacctctgtcggcaaactggtacatcaaatttttggaacagcatacggagtgttattctcaggtgtgagttggacaatgaaaataggtatcggggtattgctaacatggctcggactcaactcaaggtcgacatcattgagtatgacttgcattgcggtcggtctagtaacgctttatttaggggtaatggttcaagccgacagcggatgtgtaattaattggaaaggtagagaactgaaatgtggatcgggaatatttgttacaaacgaggtccatacctggacggaacagtataagttccaagcagattcgccaaagcgattaagtgccgcaatagggaaggcctgggaagaaggcgtgtgtggaataaggtcagcaacacgactagaaaacataatgtggaaacaaatcagtaatgaacttaatcacatattactcgaaaatgatatgaaatttacagtagtagtaggagatgtggtagggattttggcacaaggtaagaaaatgatacgcccgcaacctatggaacacaaatacagttggaaatcgtggggaaaagcgaaaataattggcgcagacgttcaaaatacaacattcataattgatggcccaaacacgccagagtgtccagatgatcaacgagcttggaatatatgggaagtagaagattacggctttggaatatttacaactaacatatggttaaaattaagagattcatatactcaagtctgtgaccacagattaatgtcagcagccataaaggattctaaggctgtgcacgccgacatgggatattggatagaaagtgaaaagaatgaaacttggaaattagcacgcgcatctttcatagaagtgaaaacatgtatatggcctaagtcgcacacattatggagtaatggtgttttggaaagtgaaatgataatcccaaaaatctatggaggtcccataagccagcataactacagaccaggatactttactcaaacagctggcccttggcatcttggaaaactcgaactcgactttgatttatgtgaaggaacgactgttgtagtagatgagcattgtggcaatcgtggccctagcctaagaacaaccacagtaacggggaagatcatccatgaatggtgctgtagatcttgtacattacctcctttgcgttttaaaggagaggatggctgctggtatggaatggaaatacgtccggtaaaggagaaagaggaaaatctagttaaaagcatggtgagtgcgggaagtggagaagtagattcattttcattgggtctactatgcatatccataatgatcgaagaggtgatgagatcacggtggtccagaaaaatgttaaccaccggtacattggctgtattcttgttgcttataatgggccaattaacttggaacgacctcatacgactatgcatcatggttggtgcaaacgctagcgatagaatgggaatgggcactacctacttagcattgatggcgacctttaaaatgagacctatgttcgcggtaggtttgctatttagacgtttaacttcgcgggaagtactcttactaaccattggattatcattagtcgccagtgtagaattgcccaatagtttagaagaattaggagatggacttgcaatgggtatcatgatactcaaactactaactgatttccagagtcaccagctttgggcaacactcctctccctcacttttattaaaacaaccttacctctgcactgtgcttggaaaacgatggccatggttctaagcattgcatcattgtttccattatgtttgagtactacaagtcagaagacgacttggttaccggttttattgggttcacttgggtgtaagcctttaacgatgtttttaataaccgaaaccaaaatatggggaaggaaaagttggcccttaaacgagggcattatggctgtgggagtagtgtccatattacttagttctctgctaaagaacgatgtaccactagccgggcctttaatagctggagggatgttgatcgcgtgctacgttatatcaggcagttctgccgatttaagtttggaaaaagcggcagaagtatcttgggaggaagaggccgaacactccggggctagccacaatatactcgttgtagtccaagacgatggaacgatgaaaataaaagacgaagaacgagacgatactctgacgattctcctcaaagcaacattactggcagtaagtggagtttatccactatcaatcccagctactctttttgtgtggtatttttggcagaagaagaaacagcgcagcggtgtactttgggacacaccatccccaccggaggtagagagagcagtgctggacgacggtatatacagaataatgcagagagggctattaggtcgttctcaagttggtgtgggggtttttcaggaaaatgtcttccatactatgtggcacgttactcgaggcgcagtgttaatgtatcaaggaaaacgcttagaaccttcatgggccagtgttaagaaagatctgatcagttatggagggggatggaggctacagggttcatggaatacgggtgaagaggttcaagttattgctgtagaacctggcaaaaacccaaagaacgtacaaacagcgcctggaaccttcaaaactccagaaggtgaagtgggggctatcgccttggactttaaaccaggtacatctgggtcacctattgttaaccgggagggtaaaatagtagggctgtatggtaacggagtagtcaccacatcaggaacatacgtaagcgcaattgcccaagcaaaagcaagtcaagaaggtcctttacccgaaatcgaagatgaagtctttcgaaagcgtaatttaacgatcatggacctgcacccaggctcgggaaaaacgcggcgatatctcccagcgatcgtgagggaagcaattaaaagaaagttaagaacattaatactagcacctacaagggttgtggcatcagagatggctgaagcactcaaaggtatgcccattaggtatcaaacgaccgccgttaaatctgaacacacgggaaaggaaatcgtggatttaatgtgtcatgcgacatttacaatgagactattgagcccagtacgtgtaccaaattacaatatgataataatggatgaagcacactttacagatccctcttccatagcagcacgaggatatatcagtacgagagtaggcatgggagaggcggctgcaatcttcatgacagctacgccacctggatcagtcgaagcgtttccacaatcgaatgctgttattcaagacgaagagagagatatacctgaaaggtcttggaactctggatacgaatggattactgatttccctggtaaaacagtctggttcgttccgagcataaaatcgggcaatgatatagcgaattgccttcggaaaaatggtaagcgcgtcatacaactcagtcgcaagacgtttgatactgaataccagaaaactaaaaacaatgactgggattacgtagtaacaactgatatctcagaaatgggagcaaactttcgggcagatagagtcattgatccgagacggtgcttaaaaccagttattttgaaagacggaccagaaagggtcatcctagctggaccaatgcctgtaacagtcgcaagcgcagctcaacggagagggagaattggaagaaatcacaacaaagaaggagaccagtatatatatatgggccaaccactaaataacgacgaagaccatgcacattggacggaagctaaaatgttattagacaatataaacactcctgaaggaattataccagccttgtttgagcctgagcgagagaaaagcgccgcaatcgacggcgaatatagactgaggggtgaagcaaggaaaacttttgttgagctaatgcggagaggtgatctaccagtatggttatcttacaaggtagccagcgagggtttccaatacagcgacagaagatggtgcttcgacggagaaaggaataatcaggttctcgaagaaaatatggacgtcgaaatatggacaaaagaaggggagaggaagaagttgagacctcgttggctagatgcgcgaacctactcagacccactggctttacgtgagttcaaggagttcgctgccggaaggaggtccgtatcgggtgatttgatactagaaattggcaaactcccgcaacacctaactcaaagagcacagaacgcgctggacaatctggtaatgctacataatagtgaacaaggaggcagagcgtatcgccatgccatggaagaacttccagacacaatcgaaacacttatgcttttggcacttatcgcagtcctcactggaggagtgaccctattctttttgagcggaaggggattagggaaaacgagtattggccttctatgcgtcatggcatcgagtgttctactatggatggcgtcagtagaaccgcactggatagctgcatcgataatactagagttctttcttatggtattactaatcccggaacctgacaggcaacggactccccaagataatcaattagcgtatgtagtgatcggactcttatttatgatactgactgtagcggccaacgaaatgggtctcttagaaaccacgaagaaagaccttggtataggacatgttgcggtcgaaaaccatcatcatgcaacaatgctagatgttgacctacatcctgcaagtgcttggactctgtatgcagtagccacaaccattataacaccaatgatgcgtcatacaattgaaaacactactgctaacattagtctcacagcaattgccaatcaggctgcaatcttaatggggctggataaaggatggccgattagcaagatggatattggagtaccattacttgcattaggatgttatagccaagttaacccactcacacttacagctgcggttctaatgctagtcgcccattacgcaatcataggacctggcctacaagcaaaagctacaagggaggcacagaaaagaactgctgcaggtataatgaaaaatccaacagtggatggtatagttgctattgacctagacccggtagtatatgatgcaaaatttgaaaaacagttaggccaaataatgcttctaattctttgtacgtcccaaattttattgatgaggaccacctgggcactatgcgaaagtatcactttagcaaccggtccgttaaccacactttgggaaggttcacccggaaaattttggaacaccactatagcagtcagtatggcgaatattttccgcggctcttatttagccggtgcaggacttgcattttcgttgatgaaatcattgggaggaggtcggcggggcacaggtgctcaaggtgaaaccttaggggagaaatggaaaagacagttaaatcaattatccaagtcagagtttaatatatataaacggtcaggaataatggaagttgatagaagtgaagctaaggaaggattaaaacggggagaaacaactcgacacgcggtatcaagaggtacagcgaaacttcgttggttcgtagaaagaaacctcgttaaaccagaaggtaaagtgatcgatttgggatgtgggagaggagggtggtcatattattgtgctggtctaaagaaagtaacagaagtaaagggctacactaaaggaggtccaggtcacgaggaacccataccgatggcaacgtatggatggaacctcgttaaactgcatagcgggaaagacgtattctttacccctcccgaaaaatgtgacacactcctctgtgatataggagaatcgtcgcccaacccgactattgaagagggtagaacgctaagagtattaaaaatggttgaaccttggctaagaggaaatcaattctgtattaaaatattgaacccatacatgccatctgtcgtagaaacattggagcagatgcaacgaaaacacggaggaatgttggtcagaaacccgttaagtcgtaactcaacacacgaaatgtattgggtatcttgtggaacaggaaatatagtaagtgctgtaaacatgacaagtcgtatgttattaaatcgctttaccatggcgcaccgtaaacccacttatgagcgtgatgtcgatttaggtgccggtactcgacacgtagcagtggaacccgaagtagcaaatctagatataattggacaaagaatagaaaacataaaacacgaacataaatcaacctggcattatgacgaagacaatccctacaaaacatgggcatatcacggtagttatgaagtcaaaccctctggctctgcttcaagcatggtgaatggtgtagtcaaactactgaccaagccatgggacgtcatacccatggtcacacagatagcaatgactgatactacccctttcggtcaacaaagagtgttcaaggagaaagtagacacgcgcacccctaaagctaaaagaggtactgcgcagattatggaagtgaccgcacgatggttgtggggattcctttcgaggaataagaaacctaggatatgcacccgagaggaatttacaaggaaagttcgctcaaacgctgcaattggggccgtttttgttgatgaaaatcaatggaactcggctaaagaggctgtggaggatgagcgattctgggatcttgtacagaaagagagagaactacataaacagggaaaatgcgcaacttgtgtctataatatgatgggcaaaagagagaagaaattaggtgaatttggtaaagcaaaaggctctagggctatatggtatatgtggctaggcgccagattccttgagttcgaagcgctaggattcatgaatgaagaccactggttttcgcgagaaaattcgctatcaggagtagaaggagagggattacataaactcggctacattctacgtgatatatccaaaattcctggcggtaatatgtatgcagatgatacagctggttgggacaccaggattacggaagacgatcttcaaaacgaagccaaaatcactgacatcatggaacctgaacatgccttactggctaccagtattttcaaactaacatatcaaaataaagttgttagggtccaaagacctgctaaaaacggaaccgtcatggatgtaatttcacgtcgggatcagcgtggctcaggtcaagtcggaacctatggacttaatacttttacgaacatggaagcacaattaatacggcaaatggagtcggaaggaatctttttgccgtcggagttagagaccccaaacctcgccgaaagagtcttggattggctagagaaatatggtgtagagcggttaaagcgtatggcaatttccggggatgattgtgtggtaaaaccaatagacgaccgatttgctacagcattgacagccttaaatgacatgggaaaggtacgaaaagacatcccccaatgggaaccaagcaaaggttggaacgactggcagcaagtaccattctgttctcatcacttccaccaactgataatgaaggacgggcgagaaatagtagtaccgtgtcgaaatcaagacgagttagttggtcgagcacgcgtttcacaaggtgccggatggtctttaagggaaacagcatgtttaggcaaatcatatgctcaaatgtggcaattaatgtatttccataggcgggacttgcgacttgccgccaacgcgatttgctccgccgttccagtggactgggttcctacaagccgtacaacatggagcattcacgcacatcatcaatggatgactacagaagatatgctatcggtatggaacagagtttggatcgaagagaatccatggatggaggataaaacgcatgttagcagctggggtgatgttccatatttgggaaaacgagaggatcaatggtgcgggagtttaatcggtttaaccgcacgtgcgacctgggcttctaatattcaggttgcaatcaatcaagtcaggcgtttgattgggaacgaaaattatctagattatatgacgtcaatgaagcgtttcaaaaatgaaggtgatcccgaaggtgcactttggtaa

SEQ ID NO: 21757 - RNA, 9879 nt, synthetic construct
  misc_feature 1..9879: note = derived and/or modified CDS sequence (opt6) from DENV-1__FJ898415__SS-prME
  source 1..9879: mol_type = other RNA
agcgtaacaatgcttctgatgctaatgccaactgcgctggcatttcatctaacgacaagaggtggagaaccacatatgattgtaacaaaacaagaaagaggaaaaagcctattgtttaaaacttctgcaggagtcaatatgtgtacactaattgctatggatctaggagaattatgtgaagacacaatgacgtataaatgtccccggataacggaagcagaaccagatgacgtggactgttggtgtaatgcaacagatacatgggtcacatatggtacttgtagccaaacaggtgaacatcgaagggataaaagatccgtcgcactagcaccacatgtaggattagggttagaaacacggaccgagacttggatgtctagtgagggagcttggaaacaaatacaaagggtcgaaacatgggctctccggcatccagggtttacagtgatagcattatttctagcacacgcgataggaacatctattacacaaaaaggaatcatcttcatccttctaatgcttgtgaccccctctatggcaatgaggtgcgtagggataggttcaagggattttgtagaaggactatcgggggccacatgggtggatgtcgtacttgagcatggtagctgcgtaacgactatggcaaaagataaaccgacattagatattgaattactcaaaacggaggtaacgaacccggcagtactgagaaaactttgcatagaagcaaaaataagtaatacaacaacagatagtcgttgcccgacacaaggtgaggcaacactgatggaggaacaagatgcaaacttcgtgtgtcgtcgaacatttgtagaccgtgggtggggaaatggttgcgggctattcggtaaaggttcgttgataacttgtgctaaatttaaatgcgttacaaaattagaaggaaaaattgtgcaatatgaaaacttaaaatactctgtcatagtcacagtacatacaggagaccaacatcaagttggtaatgagtccacagagcacggtacaacggctacaataacccctcaagctccgacctcggaaatccaattaacagattacggtgctttaacgcttgattgctcgccaaggacaggtttagattttaatgaaatggttttactcactatgaaagagaaaagttggttagtacacaaacagtggttcctggaccttccattaccgtggacgagtggagcgtcaacaagtcaagaaacatggaacagacaagatttattagttacatttaaaactgcacatgccaagaaacaagaagttgttgtattaggatcacaagaaggggcaatgcatactgcattgactggagcaacggaaatccaaacgtctggaactacaaccatctttgccggacacttgaaatgtagacttaaaatggacaaactaacactgaaaggcatgtcttacgtgatgtgtactggcagctttaaactagaaaaagaagttgcagaaacccaacatggaacagttttagtacagataaaatacgaaggaacagacgcgccgtgtaaaatcccgttcttaactcaggatgaaaaaggtgtcacacaaaacggccggctaatcacagcaaatccgatcgtgacagataaagaaaaacccgtcaatatagaagccgaacctcccttcggagagagctatattgtaatcggggcgggagagaaagccttgaaacttagctggtttaagaaaggaagcaatatcggaaaaatgttcgaagcaaccgctaggggtgcaagacgaatggctatattaggagacactgcatgggattttgggtctatcggcggagtttttacttctgtaggcaaacttgtccatcagattttcggaacagcttacggtgtattattctcgggagtttcgtggaccatgaaaattggtatcggagtcttattaacttggttagggcttaatagtagaagtacatcgctatcaatgacatgtatagcggtcggactggtcacactttatctcggagttatggtccaagcagatagcggatgtgttattaactggaaagggagagagctaaaatgtggatcaggtatctttgtaacaaacgaagtacatacctggacagaacaatataagtttcaagccgacagtccgaaaaggctctctgcagccattggaaaagcctgggaagaaggcgtttgcggtatcagaagtgctactaggcttgagaacataatgtggaaacaaataagtaacgagctgaaccacattctccttgaaaacgatatgaaattcactgtagttgtaggagatgtagttgggatcttggcacaggggaagaaaatgattcggccccagcctatggaacacaaatattcatggaagtcgtggggaaaagcaaagataattggagcagatgtacagaatacgacctttatcatagatggacctaacaccccagaatgcccagatgaccaaagagcgtggaacatttgggaggtagaagattatggctttggcatttttacaacaaatatctggttaaagttgcgagattcttatactcaagtttgtgatcatcgacttatgtcagcagcaattaaagattcaaaagcagtccatgcagatatgggatattggattgaatctgaaaagaacgaaacatggaaactagcaagagcgagtttcatagaagtaaagacttgcatttggccaaagtcccacacactctggtcgaatggagtattagagagtgaaatgatcattccaaaaatttatggaggccctatatctcaacacaattataggccagggtactttacccagaccgcaggcccttggcatctagggaaattggaacttgacttcgatttatgcgaagggacaacggtcgtagtggatgaacactgtggtaatcgcggtccatcattgagaacaactactgtaactggaaaaactatacatgaatggtgttgtagatcttgcacactcccgccattaagatttaagggagaagatggctgttggtatggtatggaaattcgaccagtaaaagagaaagaagaaaatctcgtcaagagtatggtatcggcaggctcgggagaggttgactcctttagcttaggattactatgtatctcgatcatgatagaagaagttatgcgatcgcgctggtcaaggaagatgctaatgacaggaacactggccgtattcttattattaattatgggtcaattgacctggaacgatctaattagactttgcattatggtcggagccaacgcatctgatagaatgggtatgggtacaacgtacttagcattaatggctacgtttaaaatgcgaccaatgttcgcagtaggactattattccgccgattgaccagccgcgaggtgttgctactcactatagggttatcgttggttgcctcagtagaattaccaaattcattagaagaactaggtgacggacttgcaatgggcataatgattttaaagttacttacagattttcaaagccaccagctctgggcaacgttactatcattaacttttataaagacaacactttcactacattatgcatggaagactatggcaatggttttgtctatagtcagcctattccctttatgtctgagtaccactagccagaaaactacctggcttcccgtactattagggtcattgggttgtaaaccactcacgatgttcttaattgctgagaataagatatgggggaggaaatcctggccattaaatgaaggcataatggcagttggcgttgtatctatcctattgtcctctttgctaaagaacgatgtcccattagcaggaccactgatcgcagggggaatgttaatagcttgctacgtaattagcggatcgagtgccgatcttagcctagagaaagcagccgaagtgtcgtgggaagaagaagcagagcactcaggtgcaagtcataacatattggtcgaggtccaagacgacgggacaatgaaaataaaagacgaagaaagagacgacacgttgacgattttattaaaagcgacattactcgccgtatccggagtataccctctgtcaattcccgctacgttatttgtttggtatttctggcagaagaagaaacagcgaagtggggtactatgggacacaccatcaccacctgaggttgaaagagcagtacttgatgatggaatctatagaataatgcagagaggcttattaggacggtcgcaggttggcgtgggtgtgtttcaggaaaacgtttttcataccatgtggcacgtaacaagaggggcagtgctaatgtatcaaggaaaacgcctagaacctagttgggcaagtgttaaaaaggaccttatctcttatggaggaggatggcgtttgcagggatcttggaatacaggtgaggaggtacaggtaatagctgtagaaccaggtaaaaatcctaaaaacgtccagaccgcgccaggaacatttaaaacaccagagggtgaagttggtgctatagctctagacttcaaacctggtaccagtggttcccccatagtaaatagagaaggtaaaatagtagggctgtatggaaatggcgtggtaacgacatcgggtacatatgtatcagctatagcacaagcgaaggcatctcaagaaggcccactgcctgaaatcgaggatgaagttttccggaaaagaaacttaaccattatggatcttcacccaggatctgggaagacacgacgctatttaccagcaatagtgagggaggccattaagagaaaacttaggacgctgatattggcccctacaagagtagttgcctccgaaatggcagaagcactaaaaggaatgccaatacgttaccaaacgactgccgtcaaaagcgaacacactggaaaagagatagtcgacttaatgtgtcatgctacgtttacaatgagattattatcaccagtaagagtacccaattataatatgataataatggatgaggcccactttacagatccatcttcgatagcagcaagagggtatataagcacacgggtaggtatgggtgaagccgccgctatatttatgactgcgactccacctggatccgtggaagcatttccccaatcgaacgcggtaatacaagacgaagaacgcgatatccctgaaaggagttggaactcaggctatgaatggataaccgattttccgggcaaaaccgtttggttcgtacctagtattaaatccgggaacgacatagctaactgtctgaggaaaaatggtaaaagggtaatacagctcagcaggaaaacattcgatacagaatatcagaaaaccaaaaataatgattgggactacgtggtgacaactgacataagtgaaatgggagcgaattttagagcagatagagtaattgaccctcgacgatgcttgaagccagtaatattaaaggatggtcctgaacgtgtgatactagctggaccgatgcctgtaacagtagctagtgctgcacaaaggcggggtagaattggacggaatcataacaaggaaggagatcagtatatctatatggggcaaccattaaacaacgatgaagaccacgcacactggactgaagctaaaatgttattagataacatcaatactcctgaaggaataatacccgctttattcgaaccagaacgtgagaaatctgctgcaatcgacggggaataccgtcttagaggcgaggctcgtaaaacttttgtggaacttatgagaaggggagatctaccagtatggctatcatacaaagtggcctcagaagggtttcaatattctgatcgacgatggtgcttcgacggcgaacgcaacaatcaagtattagaagaaaatatggacgttgaaatttggacaaaagaaggagagagaaagaaattacgtcctcgatggcttgatgcgaggacatatagcgatccgttagcattacgtgagttcaaagaatttgcggcagggagaagatcagtctcgggggatcttatattagaaattggcaaacttcctcaacatctaactcaacgggcgcaaaacgcattagataacttggtgatgctacataacagcgagcaaggaggacgagcgtataggcatgccatggaagaactgcccgatacaatcgaaaccttaatgctgctagccttaatagcagttttaactggcggcgtcaccttattctttttgtctggaaggggactgggcaaaacttccatcggactactatgtgtaatggccagcagcgtacttttatggatggcctccgtcgaaccgcattggatagctgcgtctataatcttagaatttttcttaatggtcctcctaataccagaacctgatcgacaaagaacaccgcaagacaaccaacttgcctatgtggttataggtctcttatttatgatcctaaccgttgctgccaatgagatgggacttctggagactacaaagaaagacttaggcatcggtcatgtggcagtcgaaaaccatcatcatgctaccatgttagacgtagacctgcatccggcttcagcttggacactatacgcggtagctaccactatcattactcctatgatgcgacacacaattgaaaacacaacagcaaatatttctcttacagccattgcaaatcaagcagctatacttatgggactagacaaaggttggccgatatcgaaaatggatattggagtaccccttttggctttaggatgctactctcaagtgaaccccctaacactaactgcggcggttttaatgcttgtagcccactatgccataatcggccctggtctacaagcaaaagctactagagaagctcaaaaacgaactgcggcgggaattatgaaaaaccccacggttgacggaattgtagctatcgatttagaccccgtagtatacgatgcaaaattcgaaaaacaactcggacagataatgctacttatactgtgcacaagtcagatcttgctaatgcgtacaacttgggctctttgcgagtctataaccctagcaacaggtccattaacaaccctgtgggaaggctcacccggaaagttttggaatacgacaatagcagtatctatggccaatatctttagagggtcataccttgcaggggcaggccttgccttttcgttaatgaagtctttgggaggcggaagaagagggaccggagcacagggtgaaacactcggtgaaaaatggaagagacaactaaatcaattaagcaagtcagagttcaacatttataaacgatctggtatcatggaagttgaccgttcagaagctaaagaaggattaaaaagaggagagacaaccaggcacgcggttagtagaggaacggcaaaattgagatggtttgtcgaaagaaacctggttaaacctgaaggcaaagttatagaccttggatgtggacgaggagggtggagttactactgtgcagggctgaagaaagttacagaggttaaaggttacacaaaaggcggcccaggacatgaagaacccattcctatggctacatatgggtggaatcttgtaaagctgcacagcggaaaagacgtgtttttcacaccacctgaaaagtgcgatactttactatgtgacataggagagagttctccgaatcccacaattgaggaagggaggacactcagagtgctaaagatggtagaaccatggctgcgaggaaatcaattttgtataaaaatacttaacccatatatgcccagcgtagtcgaaactcttgaacaaatgcaacgtaaacacggtggtatgttagttcgaaatccattgtcaagaaactccacccacgagatgtattgggtatcatgtggaactggtaatatagtaagtgcagttaacatgacatcgaggatgttactgaatcgtttcacaatggctcatcgcaaaccaacttatgaacgggatgtagatctgggagcaggtactaggcatgttgcagtagaacccgaagttgcaaatcttgacataatcggacaacggatagaaaacatcaaacatgaacataaatcgacgtggcattacgatgaagacaatccatacaaaacgtgggcgtaccacggatcatacgaagtaaagccctcaggttctgctagttctatggtgaacggtgtagtaaaattactaactaaaccctgggacgtgattcccatggtaacacaaatagcaatgacagataccactcccttcgggcaacaacgagtcttcaaagaaaaagttgatactaggacaccaaaagcgaaacgtggaaccgcacaaataatggaagtgacagctcgatggctttggggattcctttcacggaataagaaacccagaatatgtacccgggaagagttcacaagaaaagtaagatcgaacgcagctattggtgcagtattcgttgatgaaaatcaatggaactccgctaaagaagcagttgaagatgaaaggttttgggacctcgtacaaaaggagcgcgagctacacaaacaaggtaaatgtgccacttgtgtctataacatgatgggaaagagagagaagaaacttggggagttcgggaaagcaaaaggctcaagagccatatggtatatgtggctcggtgcacgattcctcgaatttgaagcattaggattcatgaacgaggaccattggttttcacgcgaaaactccctttcaggagtcgaaggggaaggactacataaactaggttatatattaagagacatatctaaaataccgggaggcaatatgtatgcagacgatacagcaggatgggacacgcgtataacagaagatgatttacaaaatgaggccaagataacggatattatggaacctgaacacgcactgttagcaacaagtatattcaaattaacgtatcaaaacaaggtggtcagggttcaacgaccggctaaaaatggaaccgttatggacgttatatctagaagagatcaaaggggctcaggacaggtgggtacttatggtctaaacacctttacaaacatggaagctcaattgatccgccaaatggaaagtgaaggtatattttcgccatctgaattggaaatacctaacctagcggaaagagtacttgattggctcgaaaagtatggggtcgaaagactaaaaagaatggcaatctctggcgatgattgtgtagtaaaaccgatcgatgacagattcgcaacagctctgacagcattaaacgatatgggtaaagtgagaaaagacgtacctcagtgggagccaagtaaaggatggaatgactggcagcaagtaccgttttgtagtcatcatttccaccaattaataatgaaagacggacgtgagatagtcgttccatgtaggaaccaagatgagctcgttggcagagcgagagtctcacaaggggccggatggtctttacgagagaccgcttgtttaggaaaatcatatgcacagatgtggcaacttatgtattttcatagaagagacctaagacttgctgcaaacgcaatatgtagtgcagttcccgtggattgggtacccacgagcagaactacatggtcaatccatgctcatcatcagtggatgacaacagaggatatgttaagtgtatggaacagagtatggattgaagaaaatccgtggatggaggacaagacgcacgtaagtagctggggcgatgtcccttatttgggtaaaagagaagatcaatggtgtggttctctgattggtttgacagctcgagccacttgggcctctaacatacaagtagcaataaaccaagttcgaaggctaattggaaatgaaaactatctcgattatatgacgtcaatgaaacggtttaaaaatgagggtgatccagaaggagccctgtggtaa

SEQ ID NO: 21758 - RNA, 9879 nt, synthetic construct
  misc_feature 1..9879: note = derived and/or modified CDS sequence (opt6) from DENV-1__FJ898416__SS-prME
  source 1..9879: mol_type = other RNA
tcagtaactatgttgttgatgttaatgccaaccgccctagcgtttcacttaactacacggggaggggaaccacatatgatcgttaccaaacaagaaaggggtaaatctttgctttttaaaaccagcgccggcgtaaacatgtgtacgcttatagccatggacttaggcgaactatgtgaagatacaatgacatacaaatgtccgaggatcaccgaagcagaacctgacgatgtggattgttggtgtaacgcaacagatacatgggtcacttatggaacttgcagtcaaacaggggaacatcggcgagacaaaaggtcggtagccttagcgccacatgttggtctgggattagaaacacgtaccgaaacgtggatgagttcagaaggcgcctggaaacaaatacaaagagttgaaacgtgggccctaagacatccaggatttacagttattgcactatttttagcacacgcaattggtacaagtattacccaaaaaggtatcattttcatacttcttatgttggttacgccttccatggctatgaggtgtgttgggatagggagccgagatttcgtggaggggttatcaggggcaacatgggtagacgtcgtattagagcatggatcctgtgtaacgacgatggcaaaagataaaccgactttagacattgaattactaaaaactgaggttacaaaccctgcggtattacgaaaactctgcattgaagcaaaaatctctaacacgacaacggactcacggtgcccaactcagggagaagccacgttaatggaagaacaggacgcaaatttcgtttgcaggcggactttcgtagaccgggggtggggcaacgggtgtgggttgtttggtaaaggctcattaataacctgcgcgaaattcaaatgtgtaacaaaattggaaggaaaaattgtgcagtacgaaaacttaaaatacagtgtgattgtcactgttcatacaggcgaccaacatcaagtgggaaacgaatcaactgagcacgggaccactgcaactataacgccacaggcacctacaagtgaaatacaactaaccgactatggagcactcacactagactgctcacctagaacggggttagattttaatgaaatggtgctattaactatgaaagaaaaatcatggctagtgcacaaacaatggtttttagatctaccattgccatggacaagcggagcttcaacatcccaagaaacatggaatagacaggatctgctggtcacttttaaaacagctcacgcaaagaagcaggaagtagtagtcctgggctcgcaagaaggagcaatgcatacagcactaacaggggccacagaaatacaaaccagcggcacaacgacaatctttgcaggacaccttaagtgcaggttgaaaatggataaattaacattgaaaggcatgtcatatgtcatgtgtactgggtcgtttaaactagagaaagaggtagcggaaacccaacatggaacggtgctggttcaaattaagtatgagggaacagacgctccttgtaagattccatttagtacgcaagatgagaaaggtgtaactcagaacggaagacttatcactgctaatccaatcgtgacggacaaagaaaaacctgttaacatcgaggctgaaccaccattcggagaaagttacattgtaattggggcgggggaaaaggctttaaaacttagctggtttaagaaaggatcctccattggaaagatgtttgaagcaaccgcaagaggcgcaagacgaatggcaatcctgggtgataccgcgtgggatttcggcagtgttggtggggtattcacaagcgtcggaaagctagttcatcagatttttggaacggcctatggtgtgctatttagtggtgtaagctggaccatgaagattggtataggtgtattattgacatggttagggttaaacagtagatctacaagtctttcaatgacgtgcatagccgtcgggttagtcacactgtacttaggagtcatggtacaggctgactctggatgtgtaataaattggaaagggagggagctaaaatgcggtagcggtatattcgtcaccaatgaggttcacacttggacagagcagtacaagtttcaagcagatagtcccaaacgtctctcggcagccataggaaaagcatgggaggaaggggtgtgcgggattcgatcagcaactagactcgaaaacataatgtggaaacaaataagcaacgaactaaatcatatattattggaaaacgatatgaagtttacagttgtagtgggggacgtagtaggaattttggcccaaggtaagaagatgattagaccccagccaatggaacataagtatagctggaaaagttggggtaaggcaaaaattattggtgctgacgtccaaaatacaacctttattatagacggccccaacacacctgaatgtccagatgaccaaagagcatggaacatttgggaagtagaggactatggattcggaatctttaccactaatatatggcttaaacttcgggatagttatacacaagtatgcgatcatagactcatgagcgcagcaataaaagactctaaagcagtacatgccgatatgggatattggatagagagtgagaaaaatgaaacatggaaactagcaagagcaagttttatcgaagtaaaaacatgcatctggccaaaatctcatacactctggagtaatggagtcctcgaatccgaaatgataatacctaagatttatggaggacctataagtcaacacaattacaggccagggtatttcacgcagacagcgggaccgtggcacctcgggaaattagaattggattttgatttgtgtgaaggcacaaccgtagtagtggacgaacattgtggaaatcgaggcccaagtcttaggacaacaacagtcacaggtaaaataattcatgaatggtgctgtagatcatgtacgctcccgccactaagattcaaaggcgaagatgggtgttggtacgggatggaaatccgaccagtcaaagaaaaagaggaaaatcttgtaaaatcaatggtttcagcaggatcaggtgaagtagattcctttagtctggggctcctatgtatctctataatgatcgaagaagtgatgagatcgagatggtctagaaaaatgctaatgactggaaccctagcggtattcctccttctcataatgggacaactgacatggaatgatttaatcagattatgcatcatggtcggtgctaacgcttccgaccggatgggaatgggaacaacatatttggctctcatggcaacatttaaaatgcgtccaatgtttgcagtcggtctcctcttcagacgactgacttcgagagaagtcttattacttacaataggactttcccttgtagcatcagtagagttaccaaatagtttagaagaattaggagacggattagcaatgggaataatgattctcaaactattaacagactttcagtcgcaccagctatgggctactctactaagccttacatttattaaaacaacgctaagtttgcattatgcttggaaaacaatggctatggtgttatctatcgcaagtctatttcctctttgcttgtcaacaacaagtcaaaagaccacttggttacctgtcttgttaggttcacttggatgtaagccactaaccatgtttttgattaccgagaccaaaatatggggtcgaaaaagctggcctttgaatgaagggataatggcagtgggtgtggtgagtatattattgagttcgttgctcaaaaatgatgtccccttggccgggccactgatagcaggaggaatgcttattgcatgttacgtaatctcaggaagttcagcagatttaagcctagaaaaggcagctgaggtaagttgggaggaagaagcagaacacagtggggcatcccacaatattttggtagtggtacaagacgatggcactatgaaaataaaagatgaagaaagagacgatactttaaccattcttctaaaagcaacgctattagcagtatcgggagtgtacccactgtcaataccagcgacgctctttgtatggtacttttggcagaagaagaaacagagaagcggagttttgtgggatactccgtcacctccagaggtggaacgtgctgtattggatgacggcatctatcgcataatgcaaagaggattattaggtcgcagccaagtgggtgtaggagtgtttcaggaaaatgtattccatacaatgtggcatgtcacacgaggtgcagtactcatgtaccaaggtaaaagactagaaccttcttgggcttcagtcaagaaagatttaataagctacgggggcggttggcgcttgcaaggaagctggaatacgggagaagaggtacaagttattgcagtagaacccggtaaaaatcccaagaatgtgcaaaccgcaccgggcacgtttaaaactcccgagggcgaagtcggtgcaatcgcacttgattttaaaccgggaacgagcggttcacctattgtaaatcgggagggaaagattgtaggtctatacggtaatggagtggtgacaacgtccgggacttacgtcagcgcaatagctcaggcgaaaaccagtcaagaaggacccttaccagaaatagaggacgaagtatttagaaagaggaatttgacaatcatggatctacaccctggtagtgggaaaactaggagatacctacccgccatcgttcgtgaggcaatcaaaagaaaattaagaacattaatattggcgccaactagggttgtggcgagcgaaatggccgaagcgttgaaaggtatgccaataagataccaaacaacagcagtaaaatccgaacataccggcaaagagatagtagacctgatgtgccatgcaaccttcacaatgagactactctcacctgtaagagtaccaaactacaatatgataatcatggacgaagcacatttcacagacccctcatcaatagcagcacgtgggtacatttccactcgagttggtatgggtgaagccgcagcgatctttatgacagccacgccccctggaagcgttgaggcttttcctcaaagtaatgccgtaatacaggatgaagaaagagatatacctgaaagatcatggaactcaggatatgaatggataacagatttccccggaaaaacggtttggtttgtaccatcaataaagagtgggaatgatatagcaaactgtttgcgtaaaaatggtaagagggttattcaactgtctcggaaaacattcgatacggaatatcaaaagactaaaaacaatgattgggactacgtcgtaactacagatatatcggaaatgggcgcaaactttcgagcagacagagtgatagatccgaggcgatgcttaaaacctgtaatattaaaagacggtccagaacgcgtcatactagctggtccaatgcctgtcacagtcgccagcgcagcacaaagacgaggcagaattggacgaaatcataataaagagggggatcagtacatatatatgggtcaacccctgaacaacgatgaagaccacgctcactggaccgaagcaaaaatgctgcttgataatattaacacacctgaagggattattccagctctatttgaacctgaaagggaaaaatcagcggcaatagatggagaatatcgactacgaggagaggccagaaaaacattcgttgagttaatgaggagaggggacctaccagtatggctgagttacaaagtagcgtctgaaggattccagtatagtgataggcgatggtgctttgatggtgaacgaaataaccaagttttggaggagaatatggacgtcgagatttggacaaaagaaggggaaaggaagaaattgcgtccgagatggttagatgcaagaacctattcagatcctctagccctaagagagtttaaagaatttgcagcaggacggcgttcggtgagcggtgatttgattttagaaataggaaaattaccccaacatttgacacaaagagctcaaaatgcgctggacaatttagtaatgctacataacagtgaacaaggtggaagggcttatagacacgctatggaagaactcccggatacaattgaaacattaatgcttttggctctgatagcagttcttacaggaggagtgacactgttcttcctaagcggtagaggcctgggaaagacttctattggcctcttatgtgttatggcttcatcagtgcttttgtggatggcaagtgttgaacctcactggattgctgcatccataattttagaatttttcctaatggtactattaatacccgagcctgatagacaacgaactccacaggataaccagttagcttacgtagttattggattactatttatgatactcactgtcgcagcaaatgaaatgggattattagaaacgacgaagaaagatctgggcataggtcatgtagcagtagagaatcatcatcatgcaacaatgttagacgtcgacctgcacccagccagtgcttggactctctatgcagtagctactacgataataactccgatgatgagacatacaatcgaaaacacaacagctaacatttctctgacggcaatcgcaaaccaagctgcaatcctaatgggacttgacaaaggttggccaatttctaaaatggacattggagtcccattattagcgctgggatgctacagtcaagtcaacccactcacactgacagcggcagtactaatgttagtagcccactatgcaattatagggccgggactacaagcaaaggcaacacgcgaggcacaaaaacgaacggctgcgggtatcatgaaaaatccgacagtcgacggcatagtagcgattgacctggatcctgttgtttatgatgctaaattcgaaaaacaactaggtcaaataatgttattaatactctgtaccagccaaattttactaatgagaacaacttgggctctctgtgagtcaattacattagcaactggaccgttgactactctttgggaaggcagtcctggaaagttctggaatacaacaattgccgtaagcatggccaatatattccgaggttcttacctcgctggtgctggcctggcgtttagtttaatgaaaagcctcggtggtggacgacgcgggactggcgcccaaggagagacacttggcgaaaagtggaaacggcaactaaatcaactttctaagtcagagttcaatatatataagcgtagtggtattatggaagttgacaggagtgaagccaaagaaggtctaaagaggggcgaaacaactagacacgcagtgtcgagaggcacagccaaactacgttggttcgttgagagaaatttggtaaaaccagaaggtaaagtcattgaccttggctgtggaagaggtggttggtcatactactgtgcagggctcaagaaagtcacggaagtgaagggctatactaagggtggtcccggacatgaagaaccaatacctatggcgacatacggttggaatttggtcaaactacattctggcaaggatgtcttctttaccccgccagagaagtgtgatacacttctgtgtgatattggcgaatcatcgccaaaccccacgatagaagaaggaaggacattaagagtattaaaaatggtcgaaccatggctaagaggaaatcagttctgtataaaaattcttaatccttacatgccgagtgtagtagaaacactagaacagatgcaaagaaaacacggcggaatgcttgttagaaatcctttatcaagaaattcaacacacgaaatgtattgggtatcatgtggtaccggaaatatagtctcagctgttaatatgacctcgcgaatgctgcttaatcgatttaccatggcgcacaggaagccgacatatgaacgagatgttgatttaggtgcaggaacaaggcatgtggcggttgaacctgaggttgcaaacctagacataataggacaacgaatagaaaacataaagcatgaacataaatcaacatggcattacgacgaagataatccatacaagacatgggcgtatcatggaagttacgaggtaaagccaagtggttctgcaagttcgatggtaaatggtgtagtaaaactacttacaaaaccctgggatgtaatacctatggtgacacagatagctatgacggatacaactccttttggccaacagagagtgtttaaagaaaaagttgacacaaggacaccaaaagcaaaaagaggaacagcccaaataatggaagtgacggcaagatggctgtgggggttcttgtcccgaaataagaaacccagaatttgtacaagagaggagttcacaagaaaagtaagatctaatgccgcgataggtgctgtcttcgttgatgaaaaccagtggaacagtgcaaaagaagccgtagaagatgaaaggttctgggacttagtacagaaagaaagagaattacataagcaaggtaagtgcgccacatgtgtatacaacatgatgggaaaacgtgagaagaaactcggagagttcggaaaagcgaaaggctctcgggcaatatggtacatgtggcttggagctcgattcctggagtttgaggcactgggatttatgaacgaagatcactggttttcacgagagaacagtctatcaggcgtagaaggtgaaggattacataaattaggatatatattacgggatatatcaaaaattcccggtggaaacatgtacgccgatgacactgcggggtgggatacaagaataaccgaagacgatttacaaaacgaagccaagataactgacatcatggagccggaacatgcgttgttagctacatcaatatttaagttaacctatcaaaacaaagttgtacgagtacagagaccagccaagaacggaacggtaatggacgtaatcagcagacgtgatcagaggggttcagggcaagttggaacttatggacttaacacatttacaaatatggaagcacaactgattagacaaatggagtcagaaggcatattcttgccctcagaattagaaacccctaacttagcagaacgagtattagattggctggaaaaatacggagtagagagattaaaaaggatggcgatctcaggcgacgattgtgtcgtaaaaccaatcgacgatagattcgcaacggccctgaccgctcttaatgacatgggaaaggttcgtaaggatataccccaatgggaaccttcgaaaggatggaacgactggcagcaagtaccattctgctcacaccactttcatcaactcattatgaaagatggccgtgaaatagtcgtaccgtgtagaaatcaagacgaacttgtcggtagggcacgcgtgagtcaaggagccggttggtcacttagggagactgcatgccttggtaaaagctacgcgcaaatgtggcaattaatgtattttcatcggagagaccttaggcttgcagcaaatgcgatctgcagtgcagtgccggtggattgggttccaacaagtcgcactacatggtctatacatgcgcatcaccaatggatgacaaccgaagacatgctaagcgtgtggaatcgagtatggattgaagagaatccatggatggaagacaaaacacatgtctcttcctggggagacgtaccatatcttggaaaacgagaagatcaatggtgcggtagcctaatagggttaacggcaagagcaacatgggcttcaaatatacaagtagccatcaaccaagtaagaagattaattggtaatgaaaattacctcgattacatgacaagtatgaagaggtttaaaaatgaaggtgaccctgaaggggttctatggtaa

SEQ ID NO: 21759 - RNA, 9879 nt, synthetic construct
  misc_feature 1..9879: note = derived and/or modified CDS sequence (opt6) from DENV-1__FJ898417__SS-prME
  source 1..9879: mol_type = other RNA
tccgtgaccatgcttctcatgttaatgcctactgcgctggcatttcatctcactaccaggggtggtgaaccgcacatgatagtctcgaaacaagaacgtggaaaatctttacttttcaaaacaagtgcgggtgttaatatgtgcacattaatagcaatggatttaggcgaattttgcgaagacactatgacgtataaatgtccaaggattaccgaagccgaaccagatgatgtcgattgctggtgcaatgccacagacacatgggtcacctatggaacgtgttcacaaacgggagagcatcgacgtgataaaaggagtgttgctcttgcgccacacgtaggattaggcttggaaacgaggacggagacgtggatgtcatccgagggagcttggaaacaaatccaaagggttgaaacttgggcattgcggcatccaggtttcactgttatagccctcttcctagctcacgcaattgggactagcataacacaaaaaggaattatttttatattattgatgttagttacgcccagtatggcgatgagatgtgtaggcatcggttctagagacttcgtagaaggactgtcaggggcaacatgggttgacgtggttttagagcacggctcttgtgtcacaaccatggcaaaagacaaaccaaccttagacatagaacttcttaaaacggaagtcaccaacccggcagtgttgagaaaactgtgcatagaagcgaaaataagcaacacaactaccgattctagatgtcccactcaaggagaagcaacattagtagaggaacaggacgctaattttgtttgtcgcagaacatttgtggatcgtggatggggaaatggttgtggactttttggaaaaggttcactaattacttgcgccaaatttaaatgtgtaactaaactggaaggcaaaatagtgcagtacgagaatttgaaatattcagtgatcgtaacagttcacactggcgatcaacatcaagtaggaaacgaaagtactgagcacggaaccacagcaactattacgccacaggcacctagtacagaaatacagttaacagattatggcgcactaactttagactgctctcctcgaacaggcttagattttaatgagatggtactactaactatgaaagaaaaatcatggctagtacataaacagtggttcctagatctccctcttccatggacttcgggagcctcaacaagtcaagaaacttggaatagaaaagatctactggttacatttaaaaccgcacacgcaaagaaacaagaagttgtagtcctcggctcccaagaaggagcaatgcataccgcactcacgggcgccacggaaattcaaacaagtggcaccactactatattcgctggccatctgaaatgcagattaaaaatggataaattaacgcttaaaggcatgtcttatgttatgtgtactggatcctttaaattggagaaagaagttgctgaaacacaacatgggaccgtacttgtacaaatcaaatatgagggaacggatgcaccatgtaaaattccattcagtacacaggatgaaaagggagtcacccaaaatggtaggcttattaccgccaatccaatagtcacagataaagaaaagcccgtaaacattgaagcagaaccgccatttggtgaaagctacatagtaataggtgcaggagaaaaagctctcaaattatcatggtttaagaaaggaagctcaatagggaaaatgtttgaagccaccgcaagaggggcccgaagaatggcgattcttggagatacagcttgggatttcggaagcatagggggtgtttttacctcagtggggaaattagtgcaccaaatttttggaacagcatacggagtattatttagtggtgtctcgtggactatgaagattgggatcggagttctgctgacatggcttggattaaactcacgaagtacatcactgagcatgacatgcatagctgtgggtttggtaacattatatctgggagttatggtgcaagccgattcaggttgtgtcataaactggaaggggagagagttgaaatgtggatcaggaatatttgtaacaaacgaggtgcacacctggacagaacagtataaattccaagcggattccccaaaaagacttagtgccgctattggaaaagcgtgggaggagggcgtatgtggaataagatccgcaacgcgccttgaaaacataatgtggaaacaaatatctaatgaattaaaccatattcttctagaaaatgatatgaaattcactgttgtagtaggcgatgtcgctggtattctagcgcagggaaagaaaatgataagaccgcaacctatggagtacaaatattcttggaaaagctggggaaaagcaaaaataatcggagctgatgtccagaataccacattcataatagacggtcccaacactccagaatgtcctgatgatcaaagagcctggaatatttgggaggttgaagattatggatttggtatattcacaacaaatatatggctgaaattgcgagactcatacactcaagtttgcgaccacagattaatgagcgctgctataaaagactcaaaggctgtacatgcagacatgggttactggatagaaagtgagaaaaatgagacttggaaactagcacgtgcttctttcatagaggtgaaaacctgtatatggccaaagtcacatacactttggagtaatggtgtactagagtccgagatgataataccaaaaatttatggaggacctatttcacaacataactatcgaccgggatatttcacacagacggctgggccctggcatttaggtaaactagagcttgacttcgacctatgcgaaggaacaacggtagtcgttgatgaacattgcggaaatagaggcccatccttaagaacaacaacagtcaccgggaaaataatacatgaatggtgctgcaggtcatgtactctaccgcccctcagatttaaaggtgaagacggatgctggtatggcatggagataagaccagtgaaagaaaaagaagaaaacctagtaaaatcgatggtctctgcagggagtggggaagtagacagcttctcactcggattactgtgcatcagtataatgattgaagaagtaatgagatctcgatggagtaggaaaatgctcatgacagggacgttagcagtgttctttttacttataatgggtcagctaacgtggaatgacctaattcggttatgtataatggttggagcaaatgcgtctgaccgtatgggaatgggaaccacgtacttagcactaatggctaccttcaaaatgaggccaatgtttgcagtcggtctattattccgcagactcaccagcagggaagtcctgttactaacgataggcctgagcttagttgccagtgttgagcttcctaacagcctagaggaactaggcgatggattagcaatgggtatcatgatactaaagttattaacggactttcagagtcatcagttatgggcaacactcctttcattaacttttatcaagacaaccttttcgcttcattatgcatggaagaccatggcaatggtcctttctatagtttcactctttcccttatgtctttccacaacaagtcagaaaaccacatggttacccgtacttttgggatcattaggatgtaaaccactaacaatgttcttgatagctgaaaacaaaatatggggacgcaaatcatggccattaaacgaaggaataatggcggtggggatagtgagcatattactttctgcactattgaaaaacgatgtaccgttggcaggaccgctgatagctgggggaatgctaattgcgtgctatgtaatatccgggtcttccgctgatttgtccctcgaaaaagccgccgaagtatcgtgggaggaagaagctgagcatagcggtgcatcacacaatatacttgtagaagttcaagatgatgggacaatgaaaatcaaagatgaagaacgggatgatacacttacgatactgttaaaagccacgctcctcgctgtctcgggcgtataccctctatctataccagccacattattcgtctggtacttctggcagaagaagaaacaacgttcaggagtgttgtgggatacgcctagcccgccggaggtagaacgtgcagttctagatgatggaatttacaggatcatgcagcgagggctgctgggaaggagtcaggtgggagtaggggtatttcaagaaaatgttttccatactatgtggcacgttacaagaggggccgtcctaatgtatcagggaaaacgattagaaccctcttgggcatctgtcaaaaaggacttaatctcgtacggaggaggatggcgtctacaaggatcctggaacactggagaagaggtacaggtaatagcagttgagccgggcaaaaatcccaaaaatgtacagaccgctcccggaactttcaaaacatcagaaggtgaagtcggagcaattgccctagactttaaaccaggtacatctgggagtcctatagtaaatagagaaggaaagatagtcggattatacggaaacggcgtggtcaccacttcgggtacctacgtttcagctattgcgcaagcaaaagctagtcaggaaggaccactccctgagatcgaagacgaagtattccgtaaaaggaaccttaccatcatggacttacatcctggctcggggaagacaagaagatatcttccagcgattgtaagagaagcaataaagcgcaaattgagaacattaattttagcaccaacccgagtagtagcatcagaaatggctgaagcattgaaggggatgccaataaggtatcaaacaactgccgttaaatcagaacataccggaaaagaaatagtggaccttatgtgtcatgccaccttcaccatgcgattattatcaccggtccgggttcccaattataatatgattatcatggacgaggcacactttacagacccctcaagtatagctgcacggggatatatatcaacacgagtcggtatgggggaagccgcggccatattcatgacggccacaccacctggtagtgtagaagcgttcccacaatctaacgctgtaattcaagatgaagaacgtgatataccggaaagatcatggaatagcggttatgaatggatcacagacttcccaggtaaaacagtatggtttgtaccaagcataaaatcaggtaatgatatagcaaactgcctaaggaaaaatggaaaacgagttattcaattgtcaaggaaaacattcgacactgaataccagaaaaccaaaaacaacgactgggattatgtagtaaccactgatatatcggagatgggtgcaaatttcagagccgacagagtgatagacccaagacgttgtcttaaacctgtaatcctgaaagacgggccagagcgtgtgattcttgcaggaccaatgccagtaacagttgccagtgcggcacaaagacgtggtagaatagggagaaaccataataaagaaggagatcagtacatttacatgggacaaccgctgaacaacgatgaagatcacgcgcactggaccgaagcaaagatgttacttgataacataaatacgccggaaggtataattcctgcactattcgaaccagagcgagagaagagtgcagctattgatggtgaatatagactacggggagaggcgcgtaaaacattcgtagaactgatgcgtcgaggagatctcccagtatggttgtcttataaagtggcgagtgaggggttccaatatagcgatagacgatggtgttttgatggagaaagaaacaatcaagttttagaagaaaatatggatgttgaaatatggactaaggaaggagaaaggaaaaagctccgacctaggtggttagacgcaagaacatatagtgatcctttggccttgcgagaatttaaagagtttgcggcgggccgacgatcggtttcgggtgatttgatactggaaataggaaaattaccgcagcacctcacgcaacgggctcaaaacgcattggacaacctagtaatgttacacaactctgaacagggcggccgagcatatcggcatgctatggaagaactacccgatactatagagacattaatgctattagcccttatcgccgtgcttacaggaggagtaacattattcttcttaagtggtaggggcttaggaaaaacaagtataggcttgttgtgcgtaatggcaagcagcgtgcttctgtggatggcgtcagttgaaccacattggatagctgcgtcaattatactagaatttttcctaatggttttactcataccagaaccagatagacaaagaacacctcaagataaccaactagcatatgtagttataggtttgttatttatgatattaacggttgcggcaaatgagatgggattacttgagactaccaagaaagatctaggaataggacacgttgcggttgaaaatcatcaccacgcagctatgttggacgtagacctgcatcctgcttcagcatggacattatatgcagtggcgactactattattacacccatgatgagacacaccattgaaaataccacagcgaatatatcgttaacggcaatcgccaaccaggctgcaatattaatgggattagacaaaggctggccaataagcaagatggacatcggtgtaccgcttctagccctcggatgctactcacaggtgaacccattaacactcacagcagcggtactaatgctggtcgcccactatgcaataataggccctggtctacaagccaaagcgacaagagaagcccagaaacgaactgccgcaggaataatgaagaaccctacagtggatgggatagtcgcaatagatttggatccggtggtttacgacgcgaaattcgaaaaacagctaggccaaataatgttattgatactatgtacctcccagattctattgatgagaaccacatgggcattatgtgaaagcattacattagctacaggacccctaacaacgttatgggaaggatccccgggcaaattttggaataccacaatcgccgtatcgatggctaacatattcagagggtcctatcttgcaggagctggactcgcttttagtttgatgaagtcattgggaggagggcgcaggggaactggagcgcaaggagaaactttgggtgagaaatggaaacgtcaactaaatcaattatctaaaagcgagtttaacacatacaaaaggtcaggtattatggaagtagatcgatcagaagcgaaagaaggactaaaaagaggggaaacaacaaaacacgcagtgagcagaggtacggcaaaactaaggtggttcgtggaaagaaatttagtaaagccagaaggaaaggtaatagatttgggttgcggtagagggggatggagctattattgtgcaggtctaaagaaagtcacggaagtaaagggatacacaaagggcggacctggccacgaggaaccgattcctatggctacatacggttggaatctagtgaaattgcacagtggaaaggacgtatttttcatcccgcctgaaaaatgtgacactcttctatgtgacatcggagaatcaagtcccaatcctactatagaggaaggaagaacattgcgtgtcctaaagatggtggaaccatggttaagaggaaatcaattttgcataaaaatattaaacccttacatgccctcagtggtggagacattagagcagatgcaacgcaaacacggaggaatgctagtgcgaaacccactgtctcgaaactctactcacgagatgtattgggtgtcctgcggaacaggaaatatcgtatcagcagtcaatatgacttctcgtatgctgttgaaccggttcactatggcacatcgaaaaccaacatacgaacgcgacgttgatctcggagccggaacgaggcatgttgctgtagaaccagaagtcgcaaacttggatataataggacagcgaattgaaaacataaaacatgaacacaaaagtacgtggcattatgacgaggataatccttataaaacgtgggcatatcacggcagttacgaagtaaaacccagcggatcagcatcatcaatggtaaatggtgtagtaaaattacttacaaagccctgggatgtcataccaatggttacacaaatagcaatgacagatactaccccattcggacagcaacgtgtgtttaaagaaaaagtagatactcgtacgccaaaagcaaaaagaggaacggctcaaattatggaagtaacagccaaatggttatggggttttctcagccgaaataagaaaccacgaatttgtacacgtgaagagttcaccagaaaagtgagaagtaacgcagccataggggccgtttttgttgatgaaaatcaatggaactcagctaaggaggcagtagaggatgagagattctgggacctggtgcatcgagaacgagagctacacaagcaaggaaaatgtgcaacttgtgtctataatatgatggggaaacgtgagaagaaactcggagagttcggcaaggcaaaagggagcagagcaatttggtatatgtggctgggtgcaagatttttagagtttgaggcattaggatttatgaacgaagaccactggttcagcagagaaaacagtctaagtggggttgaaggggaggggttacacaagctaggctacatcctacgagacataagcaaaataccgggaggtaatatgtacgccgacgacacagcaggttgggatacgagaatcacagaggacgacctccaaaacgaagcaaaaataacagatataatggaaccagaacatgcgttgctagcgaaaagtattttcaaattaacgtatcaaaataaagtggttagagtacaaaggccagccaaaaacggtactgtaatggacgttattagtcgtcgtgatcaaagaggatcgggacaagtaggtacttatggactaaacacttttactaatatggaggcacagcttatacgacaaatggagtccgaaggcattttctctccatcagaacttgagacccccaacctagccggtcgtgtactcgattggctagaaaagcatggggtagaacgattaaaacgaatggcaatatcgggagatgattgtgtagtaaaaccgatcgacgaccggtttgcaaccgctctcactgctctgaacgatatgggaaaagttagaaaagacatacctcaatgggaacctagcaaaggatggaatgattggcaacaagtacctttctgttcacatcactttcaccaattaataatgaaagacggacgagagatagtagttccgtgcagaaatcaagacgaacttgtaggccgagctagggtgagtcaaggggctgggtggagtctaagagaaactgcatgcttaggaaaatcttatgcccaaatgtggcaactaatgtatttccacagacgagatttgcgcttagccgcgaacgccatttgctccgcagatccggtagattgggtgcctacatcgaggactacatggagtatccatgcacatcaccagtggatgactacagaagacatgctaagtgtgtggaatagggtctggatagaagagaatccttggatggaggataaaacacatatcagcagctggggagatgtgccctatctggggaaaagggaagatcagtggtgcggtagtctgattggtttgacagcacgcgcaacatgggcaacaaacatccaagttgcaattaatcaagtacgaagattaatcggtaatgaaaactatctggattatatgacaagtatgaagcgattcaaaaatgaatctgatccggaaggtgccttatggtaa

SEQ ID NO: 21760 - RNA, 9879 nt, synthetic construct
  misc_feature 1..9879: note = derived and/or modified CDS sequence (opt6) from DENV-1__GQ868612__SS-prME
  source 1..9879: mol_type = other RNA
tcagtaacgatgctgctaatgctaatgcctacggccttagcatttcatttaactactcgtggtggagaaccacatatgattgtttccaaacaagaacgaggaaagagcttattattcaaaacttctgcaggagtaaatatgtgcactcttatagcgatggatctcggtgaactatgtgaagatacaatgacttacaaatgtcctagaattacggaagcggaaccggatgacgtagactgctggtgtaatgcaacggatacctgggtaacctacggaacttgcagccaaaccggggaacacaggcgagacaaacgaagcgtggctctcgctcctcacgtcggattaggactcgaaacaagaactgaaacctggatgtcgtccgaaggggcttggaaacaaatacaaagagtagaaacctgggctttacggcatccaggttttacagtaatagccttgtttttagcgcatgcaattggaacgtcgatcactcaaaaaggaataattttcatattactaatgttggtaactccgtcaatggctatgaggtgtgtaggtatcggaagtagagactttgtcgaaggattaagcggagcaacatgggtagatgttgtactcgaacacgggagctgtgtgacgactatggcaaaagacaaaccaactctagatattgaattgttaaaaactgaagtaacaaatcctgcggtactacgtaaactatgcattgaagcaaaaattagcaataccactacagattctagatgtccaacacaaggagaagctacgttagttgaagaacaggacgcaaattttgtttgtagaagaacgttcgttgaccgtggatggggtaatggatgtggactttttggcaaaggatcacttattacatgcgcaaaatttaaatgcgttaccaaactagaagggaaaatagttcaatatgaaaatcttaaatacagtgtgatcgtcacagtgcacacgggagatcaacaccaagttggaaatgaatctactgaacatggcacaaccgccacgatcacaccccaagcacctacaacagaaattcagcttactgactatggggccctgacactagattgttctcctcggacgggtctagactttaacgaaatggtcttgttgacaatgaaagaaaaatcatggttggtccacaaacaatggttcctagatctgccccttccttggacaagtggagcgagtacgtcacaagaaacgtggaatcgacaggacttattagttactttcaaaacagcccacgcaaagaaacaggaggttgtagtactaggaagtcaagaaggggcaatgcatacggcattaacaggggcaacggagatacaaacatccgggacaaccactatttttgcaggacatctaaaatgccgtttgaaaatggacaaactgacactaaaaggaatgtcttacgtaatgtgtaccggctccttcaaattggaaaaagaagttgcagaaacacaacatggcacggtcctagtacaaataaaatacgaggggacggacgcaccctgcaaaattcctttcagtacacaagacgaaaaaggtgtaacacagaatggtagactgataacagcaaaccctattgtaactgataaagaaaaaccagttaacattgaagccgaaccaccgtttggtgaatcatatatcgttataggggctggtgaaaaagcactaaaactcagctggtttaagaaaggttcgtcaataggtaaaatgtttgaggcaactgcgcgaggggctagaaggatggctattttaggcgatacagcttgggactttggctccattggaggagtattcactagcgtcgggaaacttgtacaccaaatatttggtactgcttacggtgtattgtttagcggcgtcagctggacaatgaagatcggtattggagtacttttaacatggttaggactaaactcaagatcaacatcgctcagcatgacctgtattgctgtgggcctagtaaccctctacttgggtgctatggtgcaagccgactcgggatgcgtgatcaactggaaagggagggagttaaaatgtggcagtggaattttcgtaaccaatgaagtacatacctggactgaacaatataaatttcaagcggactcaccaaaaagactatcagctgctataggaaaagcatgggaagaaggagtatgtggaataaggagtgcaacacgattagaaaatattatgtggaaacaaatctcaaacgaactaaaccatattctcttagaaaatgatatgaaattaacagtagtcgttggcgacgtggcaggtatcttaggccaggggaagaaaatgatacgccctcaacctatggaatacaaatattcatggaaatcctgggggaaagcaaaaatcatcggagcagatgcgcaaaatacaacatttataatagatggaccgaatacgcctgaatgcccagatgatcaaagagcatggaacatatgggaagtagaagactacggctttggtatatttacgacaaatatctggttgaaactcagagactcctatactcaagtctgcgaccatcgactgatgtcagcagcaattaaagactcgaaagcagtccatgcagatatgggatattggattgagtcggagaaaaatgagacctggaaactagcccgtgcgagtctaattgaagtcaaaacctgcatatggccaaaaagccacacactttggtccaatggtgtacttgaatcggaaatgataataccaaaaatctatgggggtccgatttcacaacacaattatcgtccaggttactttactcaaaccgctggcccatggcatctaggcaaactcgaattagacttcgatctatgtgaaggaacaacggtggtcgtcgatgagcattgtggaaatcgcggcccttcattgagaacaacaacagttacaggaaagataatccatgaatggtgttgtcgctcatgcacgctaccaccccttaggtttcggggagaagatgggtgctggtacggaatggagattagaccagttaaagaaaaagaagaaaatttagttaaaagtatggtaagcgcaggaagcggtgaagtagattcattcagtctgggactactgtgtataagcattatgatagaagaggtaatgcgatcaaggtggtccagaaaaatgttaatgacgggtactctagctgtgttctttttactaataatgggccagcttacttggaatgacctaattagactctgcataatggttggcgcaaacgctagtgaccgtatgggaatgggtacaacgtatctagctctcatggctacatttaaaatgcggccaatgttcgcggtaggcttactatttcggagactgacttcacgagaagtcctacttttaactataggattaagtcttgtagctagtgtagaattgccgaatagcctagaagaattaggagatggtcttgcaatgggtattatgatattaaagttactaacggactttcagtcacaccaactgtgggctacattactaagccttactttcattaaaacaaccttcagtctgcattacgcatggaaaacaatggctatggtactgtcaatagtcagcttgtttcctttgtgtttatcaacaacgtcacagaagactacctggctacctgtacttctaggatcattaggttgcaagcctttaacgatgttcctcatagcagaaaacaaaatatggggtaggaaatcgtggccactaaatgaaggtattatggcagtaggaatagtgagcatccttctctctagccttctgaaaaatgatgtccctcttgcaggaccccttatagcaggaggaatgctaattgcatgctatgtgatttcaggatcatcggcggatctaagtctcgaaaaagctgccgaagtgagctgggaagaagaagcggaacactcaggtgctagtcataatatattagtagaagtacaagatgatggtactatgaaaataaaggatgaagaaagggacgatacacttacaatcctcctgaaggcaactttgctagccgttagtggcgtatacccattatctataccagcaacattgttcgtctggtatttttggcagaagaagaaacaaaggtcaggagttctgtgggacacaccaagtccgccggaggtagaacgggcagttctggatgatggtatctacagaattatgcaaagggggctattaggaagaagtcaagtaggtgtgggagtctttcaagaaaacgtatttcacactatgtggcacgtgactagaggtgccgttcttatgtaccagggaaaaagattagagccaagttgggcaagtgtcaagaaagatctgatcagttacgggggcggttggcggttgcgtggaagttggaatactggggaagaggttcaggtgatagccgttgaaccgggcaaaaatcccaaaaatgtacaaacagctccgggcacctttaaaacaccagaaggggaagttggagctatagctcttgacttcaaaccaggtacaagtggatcgccaatagttaatcgtgaaggcaagattgttggcctatacgggaatggagtagtcactacatcagggacgtatgtttcagctatagcacaagcaaaggctagtcaggaaggaccattgccagagattgaagacgaagtattccgaaaaagaaaccttaccattatggacctgcatccagggtcaggcaaaacaagaaggtatttaccagccatagtacgcgaagcaatcaaacggaaactaagaacgctaatcttggctccaacgcgagtcgttgcttctgaaatggcagaagcgctaaaagggatgcctatccgatatcaaaccacagcagtaaaatcagaacacacagggaaagaaatagtagatttaatgtgtcatgcaacatttacaatgagattattatcaccggtaagagtgccaaactataatatgatcatcatggacgaagcgcactttaccgacccctcttcaattgcggctagaggatatatttcaacgcgagtaggaatgggcgaagctgctgcaattttcatgaccgccaccccgcctggttcagtcgaagcattccctcagtcaaatgcagtgattcaagatgaagagagagacattcctgaaagatcttggaatagtggatacgagtggataacagatttccctggaaaaactgtctggtttgtcccttcaataaagtcaggaaacgacattgcgaattgccttcgtaaaaacggcaaaagagtgattcaactgtctagaaaaaccttcgacactgaatatcagaaaaccaaaaataacgattgggactacgtagtcaccactgacatatcagaaatgggcgcaaattttagggcagatcgtgtaatcgacccacgccgatgtttgaaacctgtaatactaaaggatggacccgagagagtaatcttggcaggtcctatgccggtaacagtagcgtctgcggcgcaaagaaggggtagaataggccgaaatcataacaaagagggggatcagtatatatatatgggccaacccttgaataacgatgaagatcacgcacattggacagaagcgaaaatgttgttggataacataaatacaccagaagggattattcccgcattatttgaacccgaaagagagaaaagcgcagctgtagatggagaatatcgactacgaggtgaagcaaggaaaacttttgtagaattaatgcgaagaggggacctaccagtttggctaagctataaagttgcctccgaaggtttccaatacagtgatcggcgttggtgctttgacggtgaaagaaacaatcaggttttagaagaaaatatggatgtagaaatatggacaaaagagggagagaggaagaaactaagaccgaggtggcttgacgcgagaacttattcggacccacttgctttaagagaatttaaggagttcgccgcagggcgaagatcagtcagcggtgacttgatactggagataggtaaattgccgcaacatctcacccagcgtgctcaaaatgcgctggacaatttggttatgcttcacaattccgaacaagggggtagagcataccggcacgccatggaggagctacccgatactatagaaacattaatgttactggccttaatagcagttttaactggaggcgttacattgttcttcttaagcggtcggggtctaggaaaaacaagtataggcctgctttgtgtcatggcctcaagcgtgttattgtggatggcaagtgtagaaccacattggatcgccgcgtcaattatattagagttctttcttatggtattattgataccagaaccagataggcaacgaacaccgcaggataatcaattagcttatgtagtcatagggcttctattcatgatcttaacagtggcagctaacgaaatgggattgcttgaaacaactaagaaagatttaggtataggacatgtagcggtagaaaatcaccatcacgccgcaatgcttgatgtagatttacacccagcaagtgcgtggacgctatacgctgtggccaccactatcataacaccgatgatgaggcataccatagagaatacaaccgctaatatctccttgacggcaatagcaaaccaggcagccattttaatgggacttgataaagggtggccaatatccaagatggatatcggagtgcccctactagcgctgggttgttattcgcaagtgaaccctttaaccttaacggcagcagtcctgatgttagtagctcactacgcaatcataggtccaggattacaagccaaagcaacgagggaggcgcagaaaagaactgccgccggcataatgaaaaaccctacagtagacggaatcgtagcaattgatctggaccccgttgtatacgatgctaaatttgagaaacaattggggcaaatcatgttacttatattatgtacaagtcaaatactattaatgcgaactacttgggctttatgtgaatcaattactttggctactggacctttaacaacgttgtgggaagggtcccctggcaaattttggaatacgacgattgcagtgtctatggcaaacatatttcggggatcctatctggccggggcgggacttgcatttagcctaatgaagagtctcggcggcggacgtcgtggaacaggagcacaaggggaaactttaggtgaaaaatggaaaaggcagttaaatcaacttagtaaaagcgaatttaacacatacaagagatccggcataatggaggttgacagatcagaagcaaaagaaggcttaaaaagaggggaaacaaccaagcacgcggtttcaagaggaactgcaaaacttcgatggtttgtggaacgtaatctagtcaaacctgagggtaaagtgattgatctaggatgcggccgagggggctggtcgtattattgtgcaggcttaaagaaagtaacagaagttaaaggctatactaaaggaggtccaggacacgaagaaccaataccaatggcgacatacggatggaacctagtaaaattacactcaggaaaagatgtcttcttcattccaccagaaaagtgcgatacactattgtgcgatataggggagagtagccctaatcctacaattgaagagggtcgtacattacgagtcctgaaaatggtggaaccctggctacgcggaaatcagttctgcataaaaatactgaatccatacatgccatcagtagtcgagacccttgaacaaatgcagagaaagcatgggggaatgctcgtaagaaatcctttaagccgaaattcaactcatgagatgtattgggtaagttgcggaaccggaaacatagtaagcgccgtcaacatgacatcccggatgttattaaaccggttcaccatggcgcacagaaaaccaacttacgaacgggatgtcgatttaggtaccgggactcgacacgtagctgtagaacctgaagttgccaacctcgacataattggccaacgtattgaaaatataaaacacgaacataaatcaacttggcattatgatgaagataatccatataaaacttgggcgtaccacggtagctacgaagtgaagccttccggatcagcatcatctatggtaaacggagtcgtcaagttgctcactaaaccatgggacgtgataccaatggttactcaaatcgccatgacagacaccactccgtttggtcaacaacgagttttcaaagaaaaggttgatactcgaacacccaaagcaaaacgcggaacagctcaaatcatggaagtcactgccagatggctgtggggatttcttagcaggaacaagaaacctagaatatgtacaagagaagagtttacaagaaaagtaaggtctaacgctgcgataggggccgtttttgtcgacgagaaccaatggaactctgcgaaagaagctgtagaggatgaaagattttgggatctagtacatagagagcgggagctgcataaacaggggaaatgtgcaacatgtgtttacaacatgatgggaaaacgagagaagaaattaggagaatttggcaaagcaaaaggatcaagagctatatggtatatgtggttaggagctagatttctggaatttgaggccctaggcttcatgaatgaggatcactggtttagtagggaaaattctttgtctggcgtagaaggagagggattacataaattaggatacattctacgagatatttcgaagatacccgggggaaacatgtacgctgacgacacagcaggatgggacacgcgtattacagaagacgatttacaaaatgaggccaaaattactgacataatggagcccgaacatgctctattggctaaggctattttcaagttaacttaccaaaataaggtagttcgagttcaaagaccagccaaaaatggaacggtcatggatgtcatttcaaggcgtgaccagaggggttcggggcaagtaggtacttacggattaaatacattcacaaacatggaagcacaattaatccgacaaatggagagcgaaggaattttcagtccctcggagctagaaacgcctaacttagctgaacgggcattggattggctagaaaaatatggcgtggagaggctgaaaagaatggcaatatccggggatgattgtgttgtgaaaccaatagatgataggttcgccacagctttgaccgccctgaatgatatggggaaggtgcgcaaggatataccccagtgggaaccatcaaaaggttggaacgattggcaacaagtgccattctgcagtcaccactttcaccaactaataatgaaagatggaagagagatagttgttccgtgccggaatcaagatgagctagtaggaagggcacgagtatcgcaaggcgctggatggtcattgagagagacagcatgtttgggaaagagctacgcccaaatgtggcaacttatgtacttccatagaagagacctacgtctcgcagcaaatgcaatatgtagtgctgtgccggtggactgggtccctacaagtcgaacaacatggagtattcacgcccaccatcagtggatgactacagaagacatgctctcagtatggaatcgtgtttggatagaagaaaatccgtggatggaagacaaaacgcacatcagttcttgggaagatgtgccatacttggggaaacgggaggatcaatggtgtggtagtcttatcggactaacagctcgcgcaacatgggcaacaaatattcaggtagccataaaccaggtgcgacggttaattgggaatgaaaactacctagactatatgacatcaatgaaaagatttaagaacgaatctgatcccgaaggggcgttgtggtaa

SEQ ID NO: 21761 - RNA, 9879 nt, synthetic construct
  misc_feature 1..9879: note = derived and/or modified CDS sequence (opt6) from DENV-1__FJ898419__SS-prME
  source 1..9879: mol_type = other RNA
agtgtaacaatgctactgatgttaatgccaacagcactcgcatttcacttgacgacacgtgggggagaacctcatatgattgtttctaaacaagagagagggaaatcattgctatttaaaacaagcgctggagtgaacatgtgcacactaatagctatggatctaggagaattttgcgaagacacaatgacttacaaatgtcctagaataacagaagctgaaccggacgacgtagattgctggtgtaatgcaacagacacttgggttacttatggaacatgtagtcaaactggagaacatcgtagagacaaacgatcagtagctttagcaccacatgtaggtttgggactggaaacgagaacagaaacctggatgtcatcagaaggggcatggaaacagatacaaagggttgaaacttgggcacttcgtcatcctggattcacagtgattgctttgttcctagcacacgcgataggtacatcgataacacaaaagggtataatatttattttgctaatgctagttacaccatctatggccatgagatgtgttggaatagggtcgcgcgactttgtggagggtttgagtggagcaacttgggtcgatgtagtactagaacatggatcttgtgtaactactatggcaaaagataaaccaacccttgatatagaattattaaaaaccgaagtaacaaacccagcggtacttcgaaaactgtgcatagaagccaaaattagtaataccacgactgactcaagatgtcctacgcaaggtgaagcaactttagttgaagaacaggacgcaaactttgtgtgtcgacggacattcgtagatcgaggctgggggaatggctgcggactctttggtaaaggttctcttataacgtgtgcgaaattcaaatgtgtaactaaattagagggtaaaattgtccaatacgaaaatttgaaatatagtgtaatagtcactgtacacacaggagatcaacaccaagtaggaaacgaatcaacagaacatggaacaacagcaactataacccctcaagctccatcaacagaaattcaattaactgactatggggcgctaactctggactgtagtccaagaaccggattagacttcaacgagatggttcttctaactatgaaagaaaaatcctggcttgttcacaaacaatggtttcttgaccttccactcccctggacatcaggcgcatcaaccagccaggaaacctggaaccgaaaagatttacttgtaacgttcaaaacagcgcacgctaagaaacaggaagtcgtcgtattgggatcacaggaaggggccatgcacacagctttaactggagccacagagatacaaacatccggaacaactacgatatttgcaggacacctaaaatgcagactcaaaatggacaagttgacactaaaaggaatgagctatgtcatgtgtaccggtagttttaaactggaaaaggaagtagctgaaacacaacacggaaccgttctagtccaaattaaatatgaaggaacagacgcaccctgtaaaataccattttctacgcaagatgaaaaaggagtaactcagaacggccgcctgattacggccaacccaatagtcacagacaaagaaaagccagtaaatattgaggcagaaccgccttttggagaaagctacatagtgatcggagctggggaaaaagccttgaagctgtcttggttcaagaaagggagtagtattggcaaaatgtttgaggcgactgcccgtggagcacgtaggatggcgatcttgggcgacacggcttgggatttcggttcgatcggaggtgtattcacaagtgtagggaaattagtgcaccagatatttggtacagcatatggggttttattctcgggagtctcgtggacaatgaaaataggaataggagtactattgacatggttgggcttaaacagtaggtctacttccttaagcatgacgtgtatagcggttggattagtgacgttatatcttggtgtcatggtgcaagccgatagtggatgcgtcatcaactggaaaggtcgagaactaaaatgcggaagcggaatcttcgtaactaatgaagtacatacctggaccgaacagtacaaattccaagctgattcccctaaaagattatccgctgccatcggaaaagcatgggaagaaggtgtatgtggaataagatcagcaacacgtctagagaatattatgtggaaacaaatttccaatgagttaaatcatatactgctagagaatgatatgaaattcacagtggtagtaggagacgtagcaggcatcctcgctcagggcaagaaaatgatccgccctcaaccgatggaatataaatatagctggaaatcatggggtaaagctaaaataattggcgcagatgttcaaaatactactttcataattgatggtccaaacacgcctgaatgcccagatgatcagcgagcttggaatatttgggaagtcgaagactacgggtttggaatctttacgactaatatctggctaaaattacgggatagttatactcaagtttgtgaccaccggctaatgagcgcagccataaaggatagtaaagcagtgcacgcagatatgggctactggatagagagtgaaaagaacgagacctggaaacttgcacgagcctcatttatagaagtaaaaacatgcatatggcccaagtctcacacactatggagcaacggagtattggaatcagaaatgataatccccaaaatctacggagggcccatatcacagcataactatagacctggctactttacacaaacagccggcccttggcacctcggcaaattagaacttgattttgacctctgcgaagggactacagtagtggttgatgaacattgcggaaacagaggaccttcattaagaactacaaccgttacaggaaagataatacacgagtggtgttgtagatcttgtacactaccgccactaagattcaaaggtgaagatggttgttggtacggaatggagattagacctgtcaaagaaaaagaagaaaatctagttaaatcaatggtctctgcaggttcaggagaagtggactccttttccttaggtctactttgcataagtattatgattgaagaagtgatgagaagtcgatggtcacgcaagatgttaatgacaggaacactagcagtcttctttcttctcataatgggccaattgacctggaacgacttgatcagactatgcattatggttggtgctaatgcatctgatcgaatgggcatgggtaccacatacctagcactgatggccacctttaaaatgagacctatgttcgcggtcggcctgttgttccgtcgattgacttcacgagaagttttattgttaactattggcctctctttggtagctagtgtcgagctaccaaatagcctagaagaactaggagatggattagcaatgggtataatgattctaaaattgctcacagatttccaatctcaccaattgtgggctacgttactatcattaacattcataaaaacaacgtttagtctacattatgcatggaaaactatggctatggtacttagtatcgtatccctttttcctttatgtctttcgacaactagccagaagactacatggctcccagtactgttaggcagcttaggatgtaaaccacttacaatgttcttaatagcagaaaacaagatttgggggcgaaagtcctggcccttaaacgaaggtatcatggcagtagggattgtttcaattctgctgtcagcacttctcaaaaatgacgtcccacttgcgggcccccttattgccggcgggatgttaattgcgtgttatgtcataagtggatcttccgccgatctctctctagagaaagcagcagaggtctcatgggaagaagaagcagagcattcaggagccagtcataacatcctagtagaggtgcaagacgatgggacgatgaaaataaaagatgaagaacgtgatgatactcttacaatattactgaaagcgactctacttgcagttagcggtgtttatcctttaagtatacctgctacattatttgtctggtacttctggcaaaagaagaaacaacggtctggagtcctatgggatacaccgagtccgcccgaagttgagcgagcggttttagacgacggaatttacagaattatgcaaagaggcctattaggaagaagtcaagtaggcgtaggagtatttcaagaaaatgtattccacactatgtggcatgtaacacgaggagccgtgttgatgtatcaaggaaaaagattagaaccctcctgggcgtcagtaaagaaagatctgataagttatggaggtggctggagactacaaggaagctggaataccggggaagaggtgcaggtaatagctgttgaaccggggaaaaatcccaaaaatgtccagacggcccccggcacgttcaagacatcagaaggcgaagtaggggctattgccttagattttaaaccagggacgtcaggcagccctatagtaaatagagaaggtaaaatagtaggcttatacggaaatggcgtagtaacgacatcaggaacatacgtgtcagcaatagcacaagcaaaggcgtcacaggaagggcctttacctgaaattgaagacgaagtttttagaaaaagaaacctaacaatcatggatctacaccctggctcaggtaagacccgtcgatatttaccagctattgttagggaggcaattaagagaaagctccgaactctaattttagctccgacaagagtagtagctagtgagatggcggaggccctgaagggtatgcctatcagatatcaaacaactgctgtcaaatccgagcatacaggaaaagaaattgttgacttaatgtgtcacgcaacatttacaatgagacttctttcgcccgttcgagtaccaaactacaatatgattatcatggatgaggcacacttcacggacccgagctcaatagcagcaagaggctatataagtacaagagttggaatgggcgaagcagccgcgatctttatgaccgcgacgccaccgggatccgtggaggctttcccacaaagtaacgccgttatccaggatgaagaacgagatattccagaaagatcatggaatagcgggtatgaatggataacagatttcccgggaaagacagtgtggtttgttccaagtataaagtccggaaacgatattgcaaattgcctacgtaaaaatggaaaacgtgtgatccaactgtccaggaagacgtttgatacagaatatcagaaaactaagaataacgattgggattacgtagttacaacagacatatcagaaatgggtgcgaactttcgagcagacagagtgatagatccaaggagatgcttaaaacccgttatactaaaagatggaccggaacgtgtaattctggctgggcctatgccagttacagtagcctcagctgcacagcgtcgaggacgaatcgggcgaaatcacaataaagaaggcgatcaatatatttacatgggtcaacctttaaataacgacgaagaccacgcgcattggacagaagcgaagatgctattagataatataaatacaccagagggaatcatcccagcgctttttgagcctgaaagagaaaaatcggcagctattgacggtgaatatagactgcggggagaggcaagaaaaacctttgtagagcttatgaggagaggggacctaccggtatggctgagctataaagtcgcgtcggaagggttccaatactctgaccgcagatggtgctttgatggagaacgtaacaaccaggtattagaagagaacatggatgtggaaatttggactaaggaaggcgaaagaaagaaattgagacccagatggctagacgcacgaacatacagtgacccactagctctccgtgagtttaaggagttcgcagctgggcgaagaagtgttagcggagacttgatactcgaaataggtaaactaccacaacatttaacacagcgtgcgcagaacgcgcttgataatttagtaatgctccacaatagcgagcaaggaggacgagcctaccgacatgctatggaagagttaccagacacaatagaaacgttaatgctgctagcattgatagcggtattaactggcggttggacattattctttttgtcgggacgtgggttgggcaagacctccatcggattattgtgcgtaatggcatcatctgtgctactctggatggcaagcgtcgaaccccactggatagctgccagcatcatattggagtttttcttaatggttttgttaataccggaaccagatcgacagagaacacctcaagacaatcaattagcctatgtagtaataggattattatttatgattcttacagtagccgcaaacgagatgggattattagaaacaaccaagaaagacttaggaataggtcatgttgcagtcgaaaatcaccaccatgccgctatgttagacgtggacttacatccagctagtgcttggacactatatgcggttgcaacaactattataacaccaatgatgagacacactatagaaaatacaacagcaaacatatcactaacagcaatagccaaccaagcagcaatactaatgggtttagataaagggtggccgatatcaaagatggatataggtgttccactcttagccttaggatgctattcacaggttaatcctttaacgctcactgcagcggttttaatgctggtagcccattatgcgatcataggacctggcctacaagctaaagcgactagagaagcccaaaaacgaactgcggccgggataatgaaaaaccccaccgttgatggcatagttgctattgacctcgatccagtagtatacgacgcaaagttcgagaaacaacttggtcagattatgctattgatactgtgtacttcacaaatactactgatgagaacaacatgggcattgtgtgagagtataacattagcaacagggccgttaacgacgctatgggaagggtcaccgggtaagttctggaatacaaccattgcggtaagtatggcaaacatattcaggggaagttatttagccggcgcaggactcgcattctcactaatgaaatcactagggggcggtagacgaggaacaggggcacagggcgagacgcttggcgagaaatggaaaaggcaattaaatcaactatctaagagtgaatttaacacttacaagaggtcaggcataatggaggtcgacaggtcggaagcaaaagaaggtcttaagagaggtgaaacgaccaaacacgccgtaagtagaggtacagcgaagttacgctggtttgtagaaaggaacttagtaaaaccagaaggcaaagtcatcgacctgggatgtggccgaggcggatggagctattactgtgctgggcttaagaaagtcacggaagtgaaaggatatacaaaaggaggaccaggacacgaagaacccatacccatggccacatatgggtggaacctcgtgaaactacattctggaaaagacgtctttttcatacctccagaaaaatgtgatactcttctatgtgatattggagaatcatctccaaatccaactatagaagaaggtagaacacttcgagtactaaagatggttgagccatggctaaggggtaaccaattttgcataaaaattttaaatccctatatgccttcagtagttgagacattggaacagatgcaacgtaagcacggtggaatgttggtaagaaaccctttgtctagaaatagtacgcacgaaatgtattgggttagctgtggaactggaaatatagtgagcgccgttaacatgacgtctagaatgctgctaaatcgattcacaatggcacatcgcaagcctacatatgaaagagatgtagacctaggcgctggaacacgacacgttgcggttgaaccggaggtagcaaatctagacataatcggccaaaggatagagaacattaaacacgagcataaaagcacttggcactatgatgaagataatccatataaaacatgggcgtatcatggatcctacgaagtcaaacctagcgggtcagcatcaagtatggtaaacggggttgtaaaactactgaccaagccgtgggatgtaattccgatggtcacccaaatcgcgatgacagacacaacaccatttggccaacaacgagtcttcaaagaaaaggtagatacgagaacgcctaaggccaaacgcggcacagcgcaaataatggaagtaacagcgaaatggctatggggatttttgtcgagaaacaaaaagcctcgaatatgtacacgggaggaatttacacgcaaagttaggtcaaatgcagccataggcgcagtctttgtagatgagaaccagtggaatagcgccaaagaagctgtagaggatgaaagattttgggaccttgtacatcgggaacgagaactccataagcaaggtaaatgtgcaacttgtgtctataacatgatgggtaagcgagagaagaaactaggagaatttggaaaagcaaaaggatctcgggcaatatggtatatgtggttgggtgcgagattcttagaatttgaagcattaggtttcatgaatgaggatcattggttttcgagggagaatagcttatcgggtgttgaaggcgaaggcctacataaactcggttatattttacgcgacatttctaaaattccagggggaaatatgtatgcagatgatacagcgggttgggatacaaggattaccgaagatgatttacaaaacgaagccaagataactgacatcatggagccagaacatgcccttttagcaaaatctatatttaaattaacatatcaaaataaagtagtacgagtccaaagacctgctaagaacgggacggtcatggacgttattagcagaagagaccaaagggggtccggtcaagtaggtacatacgggttaaatacatttactaacatggaagcacaacttatacgacagatggagagcgagggaatttttagtccgtcagaactggaaacaccgaacttagctggaagagtcttagactggttggaaaaacatggtgttgagagactaaaacggatggccatatcaggagatgactgtgtagttaaacctatagatgataggtttgcaacagcacttacggcacttaatgatatggggaaagtcaggaaagatataccacaatgggagccttcgaagggttggaatgattggcaacaagtgccattctgctcacatcacttccatcagctaataatgaaggatggacgggaaatagtcgtgccctgcagaaatcaagatgagctagtaggccgagcaagagtctctcagggtgccgggtggtcacttagagaaacagcctgtcttggtaaatcttatgcgcagatgtggcaattaatgtacttccaccgtcgagacttgcgtcttgcagcaaacgccatttgttcagcagttcctgtagattgggtaccaacatctcgcaccacatggagtattcacgctcatcaccaatggatgaccacagaagatatgttgtcagtatggaaccgcgtatggattgaggaaaacccctggatggaagacaaaacccatatctcctcatggggagatgttccttatttaggtaaacgcgaagaccagtggtgtgggagtcttattggattaacggcacgtgcaacatgggctaccaatatacaagtcgccatcaatcaggtaagacgccttatcggtaatgagaattatctagattatatgaccagtatgaaacgattcaagaacgaatcggacccagagggcgcgctatggtag

SEQ ID NO: 21762 - RNA, 9879 nt, synthetic construct
  misc_feature 1..9879: note = derived and/or modified CDS sequence (opt6) from DENV-1__FJ898420__SS-prME
  source 1..9879: mol_type = other RNA
agtgttacaatgttacttatgttaatgccgaccgccctagccttccatctgactacacggggaggagagccccacatgatagtttcaaaacaagagcgcggcaagtcactcctatttaaaacttcagccggcgtcaacatgtgcaccctcatagcaatggacttaggagagttgtgcgaagatacaatgacttataaatgtccacgaatcacggaagctgaacccgacgacgttgactgctggtgcaacgccactgatacctgggtaacatacggaacatgttcacagacaggtgaacacagacgagataaacgctcagtagcgttagcaccccatgtgggactaggtctagagacgcggacagagacctggatgtcatcagaaggagcctggaaacaaatacaacgggtagaaacttgggcgctacgacacccaggtttcacagttatcgcactgtttttagcgcacgcgatcggaaccagcataactcagaagggaataatatttatcttgctaatgttagtgacaccaagtatggctatgaggtgtgtgggcatcggttcacgagattttgttgaaggtttatcaggtgcgacatgggtagacgtagtcttagaacatggctcctgtgtaactacaatggcgaaagataaacccacacttgatattgagctactgaaaactgaagtaacgaatcctgcggttttaagaaaattatgcatagaagcaaaaatatcgaataccacaactgactcaaggtgcccaactcaaggcgaagcaacattagttgaggagcaagacgcgaattttgtgtgcagaagaacatttgtagataggggctgggggaatggatgcggtctgttcggaaagggatcgctcattacatgtgcgaaatttaagtgcgtgacaaagcttgaagggaaaatcgtgcaatacgagaatctaaaatattcagtgatagtcaccgtccacaccggtgatcaacaccaagtagggaatgaatcgactgaacacggaactacagctaccataacgcctcaagcaccgactactgaaatccaattaacagactatggtgcactaacattagactgctcaccccgaacaggactcgatttcaatgaaatggtcctcttaacaatgaaggagaagtcatggctagtacacaaacaatggtttctagacttgccattaccatggacaagtggtgcatcaacatcccaagaaacctggaacagacaagacttacttgtaacatttaaaacagctcacgcaaagaaacaagaagtagtagtactgggatcgcaggaaggcgcaatgcatacggccctaacgggggccacggaaatacagacatctggcactaccactatttttgcgggtcatctcaaatgtaggcttaaaatggataaacttactttgaaagggatgtcctatgtaatgtgcactggaagtttcaaactagaaaaagaagtcgcagaaacccaacacggcaccgttctagtccaaataaaatacgagggcacagacgcgccttgcaaaattccgttttcaacccaagatgaaaaaggcgtgacacaaaatggtagacttatcacggcgaatccaatagtcacagacaaagaaaagcccgtgaatattgaagctgaaccgccgtttggagaaagttacatcgtaattggggcgggtgaaaaagctttgaaactttcatggtttaaaaagggctcctcaatcggtaagatgtttgaagccactgcacgcggtgcgaggagaatggcgatattaggagacacagcctgggactttggaagtataggaggcgtcttcactagcgtgggaaagctagtacatcagatattcggaaccgcatatggcgtcctgttttccggagtcagctggacaatgaaaattggaataggtgtcttattaacatggttaggattgaattcgaggtcgacttccttgagtatgacttgtatagctgtcggtctagtaactctatatcttggagcgatggtacaagcggattcgggatgcgttattaactggaaaggccgagaactaaaatgcggatccggtatttttgtaacaaatgaggtccacacatggactgaacaatacaaattccaggcagactcacccaaaagattatcagcagcaataggtaaagcatgggaagagggagtttgcggaattagatcagcaacgaggctggaaaacataatgtggaaacaaattagcaatgaattgaatcatatactactagaaaatgacatgaaactcacagtagttgtcggcgatgttgcaggtatactaggacaaggaaaaaagatgatcagacctcagcctatggaatataaatatagctggaaatcatggggaaaagccaagataataggtgcagatgcacagaacaccacgttcattatagacggcccaaatactccagaatgtcctgatgaccaaagggcgtggaacatatgggaagtggaagattacgggtttgggatattcacaacgaatatttggttgaaattacgtgatagctatacacaagtatgtgatcatcgcttgatgagcgccgcgatcaaagacagtaaagccgtgcatgccgatatgggatattggatagagagcgaaaagaacgaaacgtggaagctcgctagagcatcattcattgaagtcaaaacatgtatatggcccaaaagtcacactctttggagcaatggcgttttagagtctgagatgattattcctaaaatctacggaggtcccatcagtcaacacaactacagacctggttactttacacaaactgcgggtccttggcatctgggtagattagaactggatttcgatttatgtgaaggaacaactgtagtagtggacgaacattgcggcaaccgtggaccctccttaagaactacgaccgtcaccggtaagatcatccatgaatggtgctgtcggtcttgtacgctccctcccttaaggttccggggggaagacggttgctggtacgggatggaaatacggccagtaaaagaaaaagaagagaatttagtgaaaagtatggtcagtgcagggagtggagaagtagatagtttctccttaggtctactctgtatcagcataatgattgaagaagtaatgagaagtcgttggtcacgaaaaatgctgatgacaggcacccttgctgtatttttcctcctaataatgggacaactaacatggaatgacttgataagactgtgtatcatggtaggagcaaacgcaagcgatcgcatgggtatgggaacaacgtatttggccctaatggctacattcaaaatgcgtccaatgttcgctgtgggattacttttcagaagactaacgtcaagagaagtcttattacttactattggattgagccttgtagcttctgttgaacttccgaatagtttagaggaactgggtgatggactcgcaatgggcataatgatacttaagcttctaacggatttccagtcacatcagttgtgggccacccttcttagtctaacttttataaaaacaacattttcactacactacgcatggaaaacaatggcaatggtgttatccatagtatcgttgttccccctctgtttgtctactactagtcagaaaacaacctggctgccagtcttattaggttcactaggttgcaaaccactgaccatgtttttaatcgcagaaaataagatatggggaagaaaaagctggccgcttaatgaaggaattatggcagtcggaattgttagtatattactgtcgtcattattaaaaaatgatgtccctttagcaggcccattaatcgctgggggtatgttaatagcatgctatgttattagtggatcatccgcagacctttcactagaaaaagctgccgaagtgagttgggaagaagaagctgaacattcaggtgccagtcataatattctggtagaagttcaagatgatgggactatgaaaataaaagacgaagaaagagacgatacactgactatactgttaaaagctactctcctagcagtatcaggcgtatacccactgagtataccggcaactctctttgtttggtatttctggcaaaagaaaaaacaacgttctggagtattatgggatacaccaagtcccccagaagtcgaaagagccgtattagacgatggtatatatcggataatgcaacgtggcttattaggtaggtcacaagtgggagtaggtgtatttcaagagaacgtatttcacacgatgtggcatgttacaaggggagcagttttaatgtatcaaggaaagagacttgaacccagttgggcatcagtaaaaaaagatctaatttcatatggaggaggttggcgacttcgaggaagttggaatacaggagaagaggttcaagttatagctgtagaacctggcaagaatccaaaaaatgtacaaacagcgcccggtactttcaagacaccagaaggcgaagtaggggcaatcgctctcgatttcaaaccaggaacgtctgggagtccaattgtgaatcgcgaaggaaaaatcgttgggctatatggtaatggtgttgtaacaacaagtggcacatatgtaagtgcaatagcccaggcaaaagcttcacaggagggaccacttccagaaatagaggacgaagttttcagaaaacgaaacctaacaataatggaccttcatcctgggagtggaaaaacacgtaggtatcttccggcaatagtacgggaagcgatcaaaagaaaacttcgaaccttaatactagcacccacccgggtcgtagccagcgaaatggctgaggctttgaaaggcatgcctatccgctatcaaacaaccgcggttaaaagtgagcatacgggcaaggaaatagttgacttaatgtgccacgcgacatttacaatgagactactttcaccagtcagagtccccaattataatatgataatcatggatgaggcacactttacagatccgtcttccatagcagcaagaggatatataagtactagggtgggaatgggagaagctgcagctatatttatgacggcaaccccaccaggctccgtagaagcttttccacagtctaatgcagtaatccaggacgaagaacgggacatacctgaaaggtcttggaactccggctatgaatggattacagactttcctgggaaaacagtgtggttcgtacccagtataaagagtggtaatgatattgctaattgtttacgcaaaaatggcaagcgtgtaatccagctaagtaggaaaacatttgatacagaataccaaaaaacgaaaaacaacgattgggactatgtagttactacagatataagtgaaatgggggcaaactttcgcgctgatcgagtcatcgaccctaggcgatgtctgaaaccggtcatattaaaagatggacccgaaagagtgatattagccggaccaatgcctgtaaccgtagcatctgcggctcagcgccgagggcgaataggaagaaatcacaataaagaaggtgatcaatacatctatatgggacagccccttaacaacgatgaggatcacgcacattggactgaggcaaaaatgcttttagacaatatcaacacgccagaagggataatcccagcactttttgaacccgagcgggaaaaatctgcagctgtagatggggaatacagactaagaggagaagcacgaaagacatttgtcgagcttatgcggaggggagatcttccagtgtggttaagctataaagtggcgtcggagggtttccaatactcagacagaagatggtgtttcgatggcgaaagaaataaccaagtacttgaagagaacatggatgtggagatatggaccaaggaaggtgagagaaaaaagctcagacccagatggttagatgctagaacctattctgatcccttggctttaagagaatttaaggaatttgccgcggggcgcagatcagtaagcggtgacctgatactagaaatcggaaaactcccacaacatctaacacaacgcgcacagaatgccctagataatttagttatgctacacaatagtgaacaaggcggtcgggcgtatcgccacgctatggaggaattgcctgatacaatcgaaactcttatgctactggcattaatagcagtattgactgggggagttacgctgtttttcctatctggtcgaggtctaggcaaaacatcgattggactgctatgcgttatggcatccagcgtacttctatggatggcctcagttgaaccccattggatagctgcgagcatcatacttgagtttttcctcatggtacttttaattccggaacctgaccgacaacgtactccgcaagataaccagctggcgtatgtagtcattggcttacttttcatgattcttacagtcgcagcaaatgaaatgggacttttagaaactacgaaaaaagatctaggaataggccacgttgccgtagaaaatcatcaccatgcagcaatgctcgatgttgatttgcatcctgcatctgcatggacactatacgcagttgctactacaattattacgcccatgatgagacatacaatagaaaacacaactgcaaacatatcattaaccgctatagccaatcaagcagccatactaatgggtttggacaaaggttggcccatctcgaagatggacattggggttccactgctagcactcggctgttacagccaagttaaccccctcacgcttacagccgctgttctaatgttagtcgcacactacgcgatcattgggccaggattacaagcaaaagcaacacgtgaagcccagaagagaacggccgcaggaataatgaaaaaccctacagtagatggtatcgtagccatcgacctagatccagtcgtttatgatgcgaaattcgagaagcaactaggacaaattatgttattaatcctctgcactagccagatccttttaatgcgaactacgtgggcgttatgtgaaagtataactttagcaacaggaccattaacaaccctgtgggaaggcagtccaggaaaattctggaacactacaatcgcggtttccatggcaaatatatttcgagggtcatatctagctggagcgggtctcgctttcagcttaatgaaatctcttgggggtggtagaagagggacaggtgcccaaggggagactctcggagaaaaatggaaacgtcagttaaatcaattgtcaaagtcagaatttaatacgtacaagagaagtggaataatggaggtggaccgaagcgaggcgaaagaaggactaaaacgtggggaaacgacgaaacatgctgttagtagaggaacggctaaattaagatggttcgtggaacgaaacctagttaagccagagggcaaagtaatagacctcggatgtggtcggggaggatggtcatattactgtgcgggactaaagaaagttacagaggtaaaaggttatacaaaaggaggacctggtcatgaagaaccaattcctatggcaacatatggctggaacttagtaaaactccatagtggaaaggacgtattctttatcccacccgaaaaatgtgataccctactgtgcgatattggggagtcctcgcccaatccgactatagaagaaggccgaaccttgcgtgttctaaagatggtagagccctggcttcgtggcaatcaattttgcataaaaatactaaatccttacatgccttcggttgtggaaacacttgaacaaatgcagcgcaaacacggaggaatgctcgttcgaaatcctctaagtagaaatagcacgcatgaaatgtattgggtatcttgcggcacaggaaacatagtgagcgctgttaatatgacttcccgaatgttgttaaatagattcaccatggcgcataggaaacctacctatgaacgggacgtggatctaggaaccggcacaaggcacgtcgcagttgaaccagaggtcgccaatttagatataataggacagcggattgagaacataaaacacgagcataaatctacctggcattacgacgaagataatccttataaaacatgggcgtatcatggttcttatgaggtcaaaccctctggttcagcatcttcaatggtaaacggagtagtaaaattactaacaaagccgtgggacgttattccaatggtaacacaaattgcaatgacggatactactccgtttggacaacagcgagtattcaaggagaaagtagataccagaacccctaaagcaaagcgtggcactgcacagattatggaagttacagcacgctggctatgggggtttttgtcaaggaacaaaaaaccccgaatttgtacgagagaggaattcacaagaaaagtgcggagcaacgcagcgataggagccgtgtttgtcgatgaaaaccagtggaactcagccaaagaagccgttgaagatgaacgattttgggatctcgttcatagggagcgagaactccataagcaagggaaatgtgctacgtgtgtatacaatatgatgggcaaaagagagaaaaaattaggtgaatttggaaaagcaaaaggatccagagccatctggtacatgtggttgggtgcaaggttcctggaatttgaggctttaggattcatgaatgaagatcactggttctcaagggagaattcactatcaggtgtcgaaggagagggtttacacaaattagggtatatactacgagatattagtaaaataccagggggaaatatgtatgcagacgacacggccggttgggatacgagaataaccgaagatgatttacaaaatgaggcaaagataacagatattatggaaccagaacatgccttgttagcaaaggcaatctttaaattgacctatcaaaataaagtagtaagagttcagcgtccggcaaagaatggtaccgtaatggatgttatatcaagaagagatcaaaggggctcggggcaagtcggaacttacgggttaaatacattcaccaacatggaagcacaactgataaggcaaatggagagtgaaggaatcttctcacctagtgaactggagactcccaacctagcggagagggcgctggattggctagaaaaatacggagtagaacgtttgaagagaatggcaattagtggagatgattgtgtagtcaaaccaatcgatgacaggtttgcaactgccctgacggccctcaacgatatgggtaaagtgaggaaagacataccacaatgggagccatccaaaggctggaacgactggcagcaggtcccgttttgcagccaccacttccatcaactaataatgaaagacggaagagaaatcgttgttccatgtcgaaatcaagatgagctcgttggaagggcaagagtgtcgcaaggagcaggttggagtcttagagaaaccgcgtgtttgggaaaatcgtacgcacaaatgtggcaattaatgtatttccataaacgcgacttacgacttgccgccaatgcaatctgttcggcagtccccgtggattgggtgcccacttcaagaacaacttggtctatacatgcacatcatcaatggatgaccacggaagacatgctctctgtttggaatcgagtttggattgaagaaaacccttggatggaggataaaacccacatttctagctgggaagatgtgccgtacttaggaaagagagaagaccaatggtgcggatcacttataggtttaacggcaagagctacttgggcaacgaacattcaagtggcgataaaccaggtaaggagattaataggtaatgaaaactacttagactatatgacgagcatgaaacgatttaaaaacgaatcagacccagaaggggcactctggtaa

SEQ ID NO: 21763 - RNA, 9879 nt, synthetic construct
  misc_feature 1..9879: note = derived and/or modified CDS sequence (opt6) from DENV-1__FJ898421__SS-prME
  source 1..9879: mol_type = other RNA
tcagtaacaatgctgctgatgcttatgcctacagcactagcattccacttaaccacacgtgggggagaacctcacatgatagtgtctaaacaagaaagaggaaagagcttactgttcaaaacatcagcaggggtcaatatgtgtacccttattgctatggacctgggagaactatgtgaagataccatgacgtacaaatgtccgagaataactgaagcagaaccagatgacgtagattgctggtgtaacgcaaccgatacatgggtaacttacggaacgtgttcgcagacaggagaacatcgacgagacaaacgtagtgttgctttggcaccacacgtgggcttgggtttagaaacacgtacagaaacatggatgtcatcagaaggcgcatggaaacaaatacaaagagtcgaaacttgggcattaaggcatccagggtttacagtaatagctctttttctagcacatgcaataggaacatcaattacacaaaaaggaattatattcatattactaatgcttgtaacaccctcaatggctatgcgatgcgttgggataggtagccgggactttgtggaaggtctaagtggcgcaacgtgggtagatgttgtactggaacacgggtcatgtgtgacgaccatggcaaaagataaaccaaccttagacattgaactattgaaaacagaagtaacgaaccctgctgtgctcagaaagctgtgcattgaagctaaaattagcaatacgacaactgacagtcggtgtccaacacaaggtgaagcaacattagttgaagaacaagatgcaaactttgtatgtaggcgtacatttgtcgataggggctggggaaacggttgtggtttatttggaaaaggttccttgattacgtgtgcaaaattcaaatgtgtcacaaagctagaaggaaagatagtgcaatatgaaaatttaaaatattctgtaatcgtgacagttcatactggtgaccaacaccaagtaggaaatgaatcgacagaacatggtactacagcgaccataactccacaagcaccgactacggaaatacaactaactgactatggagcactcacattagattgttctcctaggactggcctagattttaacgaaatggttctcttgacaatgaaagaaaaatcatggttagtccacaaacaatggttccttgacctaccactaccatggacatcaggcgcttcgacatcccaggaaacatggaatagacaggacctcctagtgacatttaaaacggcccacgccaagaaacaagaagtagtggtgttagggagccaggaaggtgccatgcatacagctcttactggcgcaacggaaatacaaacaagtggaacaacaacaatttttgcgggacacctaaaatgtaggttaaaaatggacaaattgactctaaaagggatgtcatacgtgatgtgtaccgggtcattcaaactagaaaaagaggtagccgagacacagcacgggacagtcttggttcaaataaagtatgagggcacagatgcaccctgtaaaataccattttcgacgcaggatgaaaagggggtaactcaaaatggaaggctgattacggccaatccgatagttacggataaagaaaaacctgtcaatatagaagcggaaccaccatttggagaatcctacatagtaataggcgctggagaaaaagccttaaaactgtcatggtttaagaaaggctcatccataggcaagatgtttgaagcgacagcccgcggtgcgagacgaatggcgattttaggagacactgcgtgggactttggctcaataggaggagtatttacatcagtaggaaagctggtccaccagatatttggcacagcctacggtgtcttattctcgggtgtttcttggacgatgaagataggtattggtgtattgctaacatggttaggattaaacagcagatctacaagtctgagtatgacttgtattgcagtaggattggtgacactttatttaggagtaatggttcaagcagattcaggctgcgtaataaactggaaaggtcgggaattaaaatgtggaagcggaatatttgtgacaaacgaagtacacacatggaccgaacaatacaaatttcaggcggattcacccaaaagattgtcagcagctataggtaaggcctgggaagaaggagtttgcggaatacggagtgcgacccgattagagaatatcatgtggaaacagataagcaacgagttaaaccatatcctgttagagaatgacatgaaactgactgtagtcgtcggagatgtcgcaggaatactaggccaaggtaagaaaatgatacgacctcaaccaatggagtataaatacagctggaagtcatggggaaaagcgaagataatcggagccgatgctcagaatacaacctttataatagacggcccaaacacgcccgaatgtccagatgatcaacgcgcatggaacatttgggaagtggaagactatggatttggaatattcaccacaaatatttggctcaagctaagagattcttacacccaggtctgcgatcacagattaatgagcgccgcaattaaagattcaaaggccgtgcatgcggatatgggctattggatagaaagcgagaaaaatgaaacatggaagctagctagagccagctttatagaagtcaaaacttgtatatggccgaaaagccataccctatggtccaacggagttcttgaatcagaaatgataattccaaaaatatatggaggccctatatctcaacataattataggccaggctactttacccaaactgcggggccctggcacctagggaaactagagctcgattttgacttatgtgaaggaacaacagtcgtcgtggatgaacattgcggaaatcgtggaccatctttaagaaccaccacagtaacaggcaaaataatacacgaatggtgctgtcgatcctgtacattacctcctttgagatttagaggcgaagatggctgttggtatggaatggaaatacgacctgtgaaagaaaaagaagaaaatttagtaaagtccatggtatctgcgggatcaggtgaagtagatagcttctctttaggacttctcagtatatccatcatgatagaagaggtaatgagatctaggtggagccgtaagatgctaatgactgggacacttgctgttttctttcttctgattatgggtcaattaacgtggaacgatttaatacgactttgcataatggtcggagcaaacgcttcagatcgaatggggatgggtacgacatatctcgccctaatggcaacctttaaaatgagaccaatgttcgctgtcggcctactttttagaaggttgacaagtcgagaagtattattattaactatcgggttatcactcgtggcgtcagttgaacttccaaacagtctcgaagaattgggagatggattagcaatgggaatcatgatcctcaaactgttgacagatttccaatcccaccaactatgggcaacactattgagtttaacttttataaaaactacgttttcgctacactatgcttggaaaacaatggctatggtattaagcatagtatccctattccctctctgtctatcaaccaccagccagaaaactacatggctcccagtactcttaggtagtcttggttgtaaaccattaacgatgtttctaatagcagaaaataaaatctgggggagaaaaagctggccattaaacgaaggtattatggccgtagggatcgtatcaatactgttatctagtctgcttaaaaacgacgtcccgttggctgggccactcattgcgggtggaatgttaatcgcatgttatgttatttccgggagcagcgcagatctatcattagaaaaagcagctgaagtctcctgggaagaagaggctgaacacagtggtgcttcccataatattttggtagaagttcaagatgacggcacgatgaaaatcaaagacgaggaaagggatgatactctcaccatattactcaaggcaaccctcttagcggtcagcggagtttaccccctaagtattcccgctacgttgttcgtttggtacttttggcagaagaagaaacagcgcagtggtgttctatgggacaccccaagccctccagaagtagaacgtgcagtactagatgatggaatttatagaataatgcaaagagggttactcggccgcagtcaagtaggagtcggcgtatttcaagaaaatgtctttcacactatgtggcatgtaactagaggtgctgttttaatgtaccaagggaaacgcctagagccttcatgggctagtgttaagaaagatctaatatcatacggtggcggatggagacttagaggatcatggaatacaggcgaagaggtgcaagtcatcgccgtagaacctggcaaaaatcccaaaaatgtacaaaccgccccagggacatttaaaacaccagaaggtgaagtcggagcgatagctttagatttcaaaccaggtacatccggatcccccatagtcaaccgagaaggcaagatcgtaggattgtatggtaatggtgttgttaccacaagcgggacctatgtgagtgctatagctcaagccaaagctagccaagaaggccctttaccggagatagaagacgaagtgtttagaaaaaggaatttgacaataatggaccttcatccggggtccggcaagactagaagatatctacctgcaatagtcagagaggcgataaaacgcaaactccgaacattgattctagcccctacaagagtagtagccagcgaaatggctgaagcgctcaaaggaatgcccattagatatcaaacaaccgcagtgaagtcggaacacactggaaaagagatagtggatttaatgtgtcacgcaacattcaccatgagattactaagcccagtaagagtacccaactacaatatgatcataatggatgaagctcatttcaccgatccaagttctatagcagcgcgaggatacatctctaccagagtaggaatgggagaagctgccgctatttttatgactgctacacctcccgggtcggtagaagcatttccgcaatccaatgcagtgatacaggatgaagaaagagacataccagaacggagctggaatagcggctacgaatggatcactgacttcccaggtaaaacagtatggtttgttccgtctattaaatcgggaaacgatattgccaattgtttaaggaaaaatggaaaacgagtaatacaattatcacgaaagacatttgacacagagtatcagaagacaaagaacaacgactgggattatgtcgttactacagatatttccgaaatgggggcaaactttagagcagatagagtgattgaccctagaaggtgcttgaagccagtcatactgaaagacggacctgaaagagtcatactcgcaggaccaatgccagtaaccgttgcaagtgcagcacaaagaagaggccgcataggaagaaaccacaataaagaaggcgatcaatacatttatatgggtcagcctttgaataatgacgaagatcacgcacattggaccgaggccaagatgcttttagacaacatcaatacaccagaaggaataataccagcattattcgaacctgaacgagagaaaagcgccgcagttgacggagaatatagattacggggagaggcaagaaaaacattcgttgagttaatgagacgaggtgacttgccagtgtggctatcctacaaggtggccagcgaaggatttcaatattctgacagacgctggtgttttgacggcgaaagaaataatcaagtattagaagaaaatatggacgtcgagatatggacaaaggaaggcgaaagaaagaaacttcgaccacgatggttagatgcaagaacttattccgatccactagccttgcgggaatttaaagaatttgcagctggacgacgttccgtttctggagatctcattctcgagatcggcaagctacctcagcacctaacgcaaagggctcagaatgcgctggataatttagtcatgctacataattcagagcaaggaggtcgtgcgtatcgtcatgcaatggaggaattacctgataccatagagaccttaatgttattagcgttaatagcagttttaactgggggagttacattattctttctctcgggtagggggttaggaaaaacttcgatcggtttgttatgcgtgatggcatcctctgtacttttatggatggcttcagtcgagccacactggatagcagctagtataatcttggagttctttttgatggttttacttataccggaacctgatcgacaacgaaccccgcaagataaccaattagcctatgtagttattgggttactcttcatgatactaacagtggccgccaatgaaatggggctattagaaaccaccaaaaaggatctgggaattggtcacgttgccgtagagaaccaccatcatgccgcgatgcttgatgtagacttacatcctgccagtgcgtggacattatacgcagtcgcaacaactattatcacgccgatgatgaggcacacgattgaaaatacgaccgccaatatttcactaaccgctatagctaaccaagcagctattttaatgggactagataaagggtggccaataagtaaaatggacatcggggtaccattactggccttaggctgctatagtcaagtcaatccgttgactttaacagcagcagtattgatgctagttgcacactatgcgataattgggccaggactacaagctaaagctacaagggaagcacagaaacgcactgccgccggtatcatgaaaaatcccacagtagatggaattgtagcaatcgacttagacccagttgtttatgacgctaagttcgaaaagcagttagggcaaattatgctcttgatactttgtacgagccagattttactaatgcgaacaacatgggcactctgtgaaagtataacgttggcaacaggcccattaactacgttgtgggagggatcacccgggaagttctggaatactacaatagcggtatcaatggcaaacatatttagaggatcgtaccttgctggtgccggactagctttttccctgatgaaatcgcttggaggcggcagaagaggtacaggtgcccaaggtgaaactcttggcgaaaaatggaagagacaattaaatcaactatctaaatcagaatttaatacgtataaacggtctggtattatggaagtagaccgatctgaagccaaggaaggactaaaacgaggggaaacaacgaaacacgctgtatcccgaggtacggcaaaattaagatggtttgttgagagaaacctcgtcaaaccggaaggcaaagtcatagatttaggatgtggacgcggaggatggtcctattactgcgcgggactaaagaaagttacagaagttaagggttatacaaaaggcggaccaggacatgaggagcctatacctatggccacatatggctggaatctagtaaaactacatagtggtaaagatgtattctttattcccccagaaaagtgtgatacattactttgcgatattggtgaatcatcgccgaaccccaccatcgaagaaggaaggactttgagggtgttaaaaatggtggagccgtggttaagaggaaaccaattttgtataaagatcctaaacccatacatgccatcagtagtagaaactctcgaacagatgcaacgcaaacatggtgggatgctggtcagaaatccgttaagtagaaattcgacccacgagatgtattgggtgtcttgtggaacgggcaacatagtctcagcagtcaacatgacgagccgaatgctattaaatcgattcacaatggcgcatcgcaaacctacatacgaacgtgacgtggacctaggtacgggaacccgacatgtggccgtggaaccagaggtcgcgaaccttgatataattggtcaacgtattgaaaatattaaacacgaacataagtcaacttggcactacgatgaagataacccttataaaacatgggcatatcacggatcatacgaggtaaagccctccggatcagcctcatctatggtaaatggcgtcgttaaattacttacaaagccctgggatgttatcccaatggtcacacaaatcgccatgactgatactacaccgtttgggcagcaaagagtattcaaagaaaaagtagatactaggacaccaaaagccaaaagaggtactgcacaaataatggaagtgaccgcccgatggctatggggattcctatccagaaataagaaacctcgtatatgcactcgagaggagtttactagaaaagttaggagtaatgctgctataggtgccgtatttgtggacgagaatcaatggaatagtgcaaaggaggcagtcgaagacgagcgattctgggacctagttcacagagaacgtgaactacacaagcaggggaaatgcgcgacgtgtgtttacaatatgatgggcaaaagggagaagaaattaggagaatttgggaaagccaagggcagcagggcgatatggtatatgtggttgggcgcgcgattcctcgagttcgaagcacttggattcatgaatgaagaccattggtttagccgggaaaatagtttatctggagttgaaggagagggcttacacaaactagggtatatactaagagacatcagcaagatacctggaggaaacatgtacgctgatgacacagctggctgggacacccgaattacagaagatgacttacaaaacgaagctaagattacagatattatggagccagagcatgcattattagccaaagcgatctttaaattaacatatcaaaataaagtagtgcgggtacaaagacctgccaaaaacggaacagtaatggatgtaatatcacggcgggatcaaagaggtagcggacaagttgggacatacggtttaaatacatttactaatatggaagcgcagctgattcgacaaatggaatcagaaggtattttcagtccgtcagagttagaaacaccgaatctagcggaacgagctttagattggttagaaaagtatggagtagaaagattaaaacggatggcaatatctggcgatgattgtgtggtcaaaccaatagacgaccgattcgcgactgcattaacggcgttaaatgatatgggaaaagtacggaaggatatacctcagtgggagcccagcaaaggctggaacgactggcaacaagtaccgttttgtagccatcacttccaccaactaataatgaaggatgggcgagaaattgtcgttccatgccgaaaccaggatgaattggttggccgtgcaagggtttcccagggagcaggttggagtcttagagaaacagcctgcctaggcaaatcgtatgcacaaatgtggcaattaatgtactttcaccgtcgtgatttacgtctagctgcgaatgccatttgctcagccgtaccagttgattgggtacccacctcaaggactacctggtccatacatgcgcatcaccaatggatgacaacagaagatatgttatccgtatggaacagggtatggattgaagagaatccatggatggaggataaaacccatatttctagttgggaagacgtgccatacctaggaaaacgagaagaccagtggtgcgggagcttaatcgggctaacagcacgtgcaacatgggcaacaaacatacaagtagctattaaccaagttcgtcgtcttataggaaacgaaaattatttagattatatgacaagcatgaaaagatttaagaatgaaagtggtcccgaaggtgctctttggtag

SEQ ID NO: 21764 - RNA, 9879 nt, synthetic construct
  misc_feature 1..9879: note = derived and/or modified CDS sequence (opt6) from DENV-1__FJ898423__SS-prME
  source 1..9879: mol_type = other RNA
agcgtaacaatgctgttaatgttaatgcccacagcgttagctttccatctcacaactagaggaggagagccgcacatgatagtgagtaagcaagaaagagggaaaagtcttctattcaagacctccgcaggtgtcaacatgtgtactttaatagcaatggacctaggagaattgtgtgaagacacaatgacctataaatgtccaaggataacagaggtagaaccagatgatgtcgattgttggtgtaatacaacggacacctgggtcacatatggaacatgcagtcaaacgggggaacacagacgcgataaacgttctgtcgctctcgccccacacgtgggccttggtctcgaaaccagagccgaaacctggatgtcatctgaaggggcatggaaacagatacaaaaagtagaaacgtgggccctaagacatcccggattcactgttatagcgctttttctggcccatgctataggaacatcgatcacccaaaaaggtattatctttatccttctaatgttggtgacaccatccatggccatgcggtgcgtgggaatagggagcagagacttcgtagagggcctttcaggtgctacatgggtagatgtagttttagaacatgggtcatgcgtaacaaccatggctaaagataaacctacattagacattgaacttctaaaaacagaggtaacgaatccagcagtcctgagaaaattatgtattgaagcaaaaatcagtaataccacaacagactcgagatgtcctacacaaggagaagctacgctagtcgaagagcaagatgcgaatttcgtatgtagacggacgtttgtagatcggggatggggaaatggttgcggtttattcggaaagggctccctcattacatgtgcaaaatttaaatgtgttacaaaactcgagggaaaaataatacaatatgaaaatttaaaatattcagttatagttactgtccatacaggtgatcaacaccaagttgggaacgaatcaaccgagcatggaactatagccacgattactccgcaagcgcctacttcagaaatccagcttaccgattacggagctctaacacttgattgctcgcctcgaacaggattagattttaacgaaatggtactattaacgatgaaggagaaatcatggcttgtacacaagcaatggtttctcgatttgccgcttccatggacgagcggtgccagtacatcacaagaaacttggaatcgccaggatttgttagttacatttaaaacggcccacgcaaaaaaacaagaggtggtagtgctagggagtcaagaaggtgctatgcatacagcgctaacaggtgctaccgaaattcagactacaggaacaactacaatctttgcaggccacctaaaatgcaggctgaaaatggacaaactaacacttaaagggatgtcttatgtaatgtgtacgggatctttcaagttagaaaaagaagttgctgaaactcaacacggaacagttttagtccagattaaatatgaaggaactgatgcaccatgtaaaattccattttccacacaagatgaaaagggagtaacacaaaatggaagactgataacggccaatccaattgtaactgataaagaaaagccagtgaacatagaagccgagcctccattcggcgagagctacatcgtgataggggcaggtgagaaagcactaaaattatcatggttcaagaaaggaagtagcattgggaaaatgtttgaagcgacagccagaggtgctcgaagaatggccatattaggagatacagcttgggatttcggaagtatcggtggcgtattcacttcagtaggaaagttagtgcaccaaatattcggaacagcttacggtgtcttattttcaggggtatcctggacaatgaaaattggaattggtgttttattaacctggctaggtttaaatagccggagtacatcattaagtatgacatgtatagcggtgggacttataaccctttaccttggagtaatggtacaagcagactccggatgtgtaataaattggaaaggacgtgaacttaaatgtggaagtggaatatttgtgacaaatgaggttcacacatggactgaacagtataaatttcaggcggattccccaaaaagattatctgcggctataggcaaggcttgggaagaaggcgtatgtgggataagatcagccacaagactggaaaacattatgtggagacagataagtaatgaactaaatcatatattactggaaaatgatatgaagtttacagtagtagtgggggatgtggttgggattttggcgcaaggaaaaaaaatggtcagaccacaaccaatggaacacaaatatagctggaaatcctggggaaaagctaaaatcatcggagccgatgtacaaaatacgacatttataattgatggtccgaacacgccagaatgtcctgatgaccaaagagcatggaatatatgggaagtagaggattacggtttcggaatattcaccactaatatttggctaaagcttcgtgacagctatacacaggtatgtgaccaccgattaatgtcggcggcgataaaggactcaaaagcagttcatgctgacatgggatattggattgaaagtgaaaaaaatgagacttggaagcttgcacgagcatcatttatagaggtcaaaacttgcatttggcccaagagtcatacgctatggtcaaacggagtactagagagcgaaatgataatccccaaaatttatggaggcccaatttctcaacacaattatcgaccaggctacttcactcagacggcgggcccgtggcacctaggtaaattggaattagacttcgatctttgtgaaggaacaaccgtggtcgttgatgaacattgtgggaacaggggtccgtcattaagaacgaccacagtaacggggaaaatcatacatgaatggtgctgtcgttcttgcactcttcctcccctacgctttaaaggcgaggacggttgttggtatggaatggaaatacgtcccgtcaaagagaaggaagaaaatctagtaaagtccatggtaagtgcgggaagcggagaagttgactcgttcagcttagggttgttatgcatatcaataatgatagaagaggtaatgcgttcacggtggagccgaaaaatgctcatgacaggaacattagctgtttttttcttactaataatgggccagttaacttggaatgatctaataaggtcttgcattatggttggagctaacgctagtgataggatggggatgggcacaacatatctagcactaatggcaacgttcaaaatgagacccatgttcgccgttggtctcctattccgtcgccttacgtctcgcgaagtattactcctgactattgggttaagtctagttgcatctgttgaattaccgaacagcttagaggaacttggagacgggctcgctatgggtattatgattttaaaattattaacagacttccaaagctaccagttgtgggcgacgttattatccttaacctttatcaaaacaacattttcccttcactacgcatggaaaacgatggcgatggtcctctcgatcgtatcactgctgccactttgtctctctactacttcacaaaaaaccacgtggcttcctgtcttactgggcagcctagggtgtaagcccctgacaatgtttttaattgcggagaataaaatttgggggcgaaagtcttggccattaaatgagggtatcatggccgtgggaattgtctcaattcttctaagtagcttgttaaaaaacgatgtaccattagcaggtccattaattgctggaggtatgctaatcgcttgctacgtaatatccggatcatcagcagatttaagtttagaaaaagcagcagaggtttcgtgggaagaggaagcggaacactcaggggcgagtcataatattttagtggaggtacaggatgatggtacgatgaaaattaaagatgaagaaagagatgacacactaactatattgttaaaagctaccctcttagccgtctctggagtgtatcctctaagcattccagctacattattcgtatggtacttctggcagaagaaaaagcaaagatccggtgtgctctgggacacaccgtctccgcctgaagtagaaagagcggtccttgacgacggtatttataggatcatgcaacgtggtctactaggaagatcccaagtaggcgtaggagtgtttcaagaaaacgtgtttcataccatgtggcacgtaaccaggggcgcggtcttaatgtatcagggaaagaggttggagccaagctgggcatccgttaaaaaagacttaatttcatatggcggaggttggagactccaaggtagctggaacactggagaggaagtacaagtgatcgctgttgagccaggaaagaacccaaaaaacgtgcaaacagctcccgggacatttaaaacacccgagggcgaggtaggagctattgccttagattttaaaccagggacatccggatcgccaatcgtcaaccgagagggaaagatagttggattatatggaaacggggtagtaactacgagcggtacgtacgtctcagcaattgcacaagcaaaggcatctcaagagggcccactcccggaaattgaggatgaagttttccggaaacgaaatcttactataatggacttacatcctggttctggaaagactagaagatatttacctgctatcgttcgagaagcaattaaacgcaagctcaggactttaatcttagcaccgacacgagttgtagctagtgaaatggcggaagccttaaaaggtatgcccatacgttaccagaccacagctgttaagtctgaacataccggtcgagaaatagtggatctaatgtgccacgcgacattcacaatgagactcttgtctccagtgagggtgcctaattacaatatgataataatggacgaagcgcattttacagatccgtcctcaatagcagcacgaggatatatctccacccgtgttggaatgggggaagccgcagccatttttatgacagccacgcccccagggagtgtcgaagcgtttccccaatctaacgccgtaattcaggatgaggaacgtgatatacctgaaagaagctggaacagtggctatgagtggattacagatttcccagggaaaacagtttggtttgttccaagcataaagtctggcaatgatatagcgaattgtttgcgcaaaaacggtaaacgtgtcatacaattaagtagaaaaacatttgacacagagtatcaaaaaacaaaaaataacgattgggattatgtagtcactacggacatttccgagatgggagcaaatttccgagccgaccgagtcattgatccacgtcgttgtctaaagccagtaattctaaaagatgggcctgagcgggtgatactggcaggacccatgcctgtaactgtagcgagcgctgcacaacgaaggggtaggatcggtaggaatcacaataaagaaggagatcaatacatatacatgggacagccattgaacaatgatgaagatcatgcacactggactgaagcaaaaatgttattagataacattaacactccagaaggcataatacccgcactatttgaacctgaacgagaaaaatcagccgctatagacggagaatatagactgaggggtgaagctagaaaaacctttgtcgagttaatgcgtcgcggcgatctaccagtgtggctgagctataaggtcgcatcagagggttttcaatatagtgatagacgttggtgctttgatggcgaacgcaacaatcaagtcctagaagaaaatatggatgttgaaatatggacaaaagaaggtgagcgtaagaaactaagaccccgatggttagacgcgaggacatatagtgatcctcttgctctaagggaatttaaggaattcgcagcgggcaggagatcagtgagcggagatttaatattggaaatcggtaaactacctcaacacctaacccaaagggcacagaacgccttagacaatttagtaatgctacataatagtgaacaagggggacgagcttatagacacgcaatggaagagttaccagatactatagaaacacttatgttactagctttgatagctgtacttacaggtggggtcacgttattttttttatcaggtagaggcttaggaaaaactagtataggtctcttgtgcgtaatggcttcaagcgcactcttgtggatggcctccgtagagccacactggatagctgcatcaattattctagaatttttcctaatggtactattaatacctgaaccagatcgacaaagaactccccaagacaaccaactcgcctatgtagtcataggattattatttatgattctgactgttgcagctaacgaaatgggactattagaaacaacaaagaaggacctaggaattgggcatgtagcagtagaaaatcatcaccatgcaacgatgcttgatgttgatttgcaccctgcatcagcctggacattatatgctgtagctactacaataattacaccaatgatgagacatactatagaaaacacaaccgcaaacataagcttgacagctatagccaatcaagcagcgattctaatgggactagacaaaggttggcctatttccaaaatggatataggggtaccactattagccttaggctgctactcacaagtaaatccattaacattgacagcagcagttttaatgcttgtcgcacattatgcaataataggaccagggctgcaagcgaaagccacaagagaagcacaaaaaagaaccgcagcggggatcatgaaaaacccaacagtagatgggatagttgcgatagatttagacccggtagtctatgatgccaaattcgaaaagcaactaggccaaataatgctactaatcctctgtacgagccagattttactaatgaggacaacgtgggctctttgtgaaagtataacactagcaacaggccctctaactacgctatgggaaggatcacctggtaaattttggaatactactatagccgtttcaatggccaacattttcaggggaagttatcttgcaggagcagggctagctttcagcctcatgaaatcacttggaggaggtaggaggggcactggtgctcagggggaaacattaggagagaaatggaaacggcagctaaatcaattatctaaatctgaatttaatacatataaaagatccggtataatggaagtggatagatctgaagcaaaggaaggacttaggcgaggtgaaacaactaagcatgccgtgtctagaggaactgccaaattaagatggtttgttgagagaaatttggtcaaacctgaaggtaaagtcatagaccttggatgtggtcgaggtggttggtcgtactattgtgctggtttaaaaaaagttacagaagtgaaaggatatacaaaaggaggtccgggtcatgaagaaccaattccgatggctacgtatggatggaaccttgtcaaactacacagtggaaaagatgtattctttataccaccagaaaagtgcgacacattgttatgtgacattggggagagttctcctaatcccactattgaagaaggaagaacgttgagagtactgaaaatggttgaaccatggctaagggggaatcaattctgtatcaaaattcttaacccttacatgccatccgtcgttgagacattagaacacatgcagagaaaacatggagggatgctggtgcgcaacccattgagccgaaactctacccatgaaatgtactgggtaagctgcggaacaggtaatatagttagcgccgtaaatatgacgtcccgaatgctgcttaatagattcacaatggctcatagaaaacccacatacgaacgcgacgtcgatctaggggcaggaacacgacacgtcgctgttgagcctgaggtcgccaatcttgatataataggtcagaggattgaaaacattaaacacgaacacaaatctacatggcactacgatgaagacaacccgtataaaacctgggcataccacggctcatacgaagttaaaccttcaggatctgcttcatcgatggtaaacggagtagtaaaacttttaactaaaccctgggacgtaatccccatggttactcagatagcaatgaccgacacaacgccgtttggacagcaacgagtattcaaagaaaaagtagatacaagaacaccaaaagcaaaaagaggcacagcacagatcatggaagttaccgctcgttggctctggggatttttaagtcggaataaaaaaccgaggatatgtactcgcgaggaattcacaagaaaagtccgatcaaatgctgccataggggcagtattcgtggacgagaatcaatggaattcagcaaaagaagccgttgaagatgaaagattttgggatcttgttcacagagaacgagagttacacaaacaaggaaaatgtgctacgtgtgtatataatatgatggggaaaagagaaaaaaagttaggagaattcggaaaggcaaagggatcacgggctatttggtatatgtggctcggagctaggttcttagaatttgaagccttagggtttatgaatgaagatcactggttctcacgtgagaatagcctatccggtgttgaaggcgaaggtctacataagttgggatacattctaagagatataagtaaaatcccaggaggaaatatgtacgctgatgacacagcaggatgggatacacggataacggaagatgacttacaaaacgaggcaaaaatcacagatataatggagcccgaacacgccctattagccacgtcgatttttaagttgacatatcaaaacaaggtcgttagggttcaaaggccagccaaaaatggaacggtgatggatgtgatcagcaggagagaccaaaggggatcaggtcaggtagggacttacggattaaacacattcactaatatggaagcgcaattaatcagacagatggaaagtgaaggaatattcagtccgagtgagttagagacaccaaatctcgcggaacgcgttttggactggttagagaagtacggtgtagagcgtctaaagagaatggccatttctggagacgactgtgttgttaaaccaatcgacgacaggttcgccactgccttaactgcgctaaatgatatggggaaggttagaaaagatattccacaatgggaaccttcaaaaggatggaatgactggcaacaagtacctttctgctcccatcattttcatcaattaattatgaaggacggtcgagaaatagttgtcccatgtaggaaccaggacgagctggttggaagagctagggttagccaaggagcagggtggtccctgcgggaaactgcttgtttgggtaaaagttatgctcaaatgtggcaactaatgtattttcatcgccgtgatcttcgtcttgcagctaatgcgatttgctccgcagttccagtagattgggtacccaccagtcggacaacatggtcgatccacgcccatcaccaatggatgaccacagaggatatgctgagtgtttggaatagagtatggatagaagagaatccttggatggaagataagacacacatttccagttggggagatgtaccgtatctaggaaaacgtgaagatcagtggtgtggatcattgataggcctaacggcacgggcgacatgggccaccaatatacaagtcgcaatcaatcaggtgcgaagactaataggaaacgagaactatctggattatatgacgagtatgaaacgattcaaaaacgaatcggacccagaaggtgccttgtggtaa

SEQ ID NO: 21765 - RNA, 9879 nt, synthetic construct
  misc_feature 1..9879: note = derived and/or modified CDS sequence (opt6) from DENV-1__FJ898424__SS-prME
  source 1..9879: mol_type = other RNA
tcagtgactatgcttcttatgctaatgccaactgcactagcttttcacttgacaactcgtgggggagaaccccatatgattgtcagtaaacaagaacggggtaaatcccttttatttaaaactagcaccggagtcaatatgtgtacactcatagcgatggatctcggagaactttgtgaagatacgatgacctataaatgccctagaataacggaagtcgaacccgacgatgtagactgctggtgtaataccacggatacgtgggttacttatggtacatgttctcaaacaggagaacataggcgagacaaacgctcagtcgccctggcaccacacgtaggtctcggccttgaaacgcgcgccgaaacttggatgtcatccgaaggcgcttggaaacaaatacaaaaagtagaaacatgggcgttacgacacccaggttttacagtaattgctttgtttttagcacacgccataggaacaagcatcactcaaaaagggattatctttatacttctaatgctagtaactccgagtatggccatgcgttgtgtcggaatagggtcgcgggacttcgttgagggcttgagtggcgcaacatgggttgatgtcgtgctagaacacggatcgtgtgttacgacgatggctaaagacaaacctactctagatatagagctgctcaaaacagaagttaccaatccagcggtcctacgaaaactatgtatcgaagcaaaaatcagcaacacaaccacagatagtaggtgtcctactcaaggagaagccactttagttgaggaacaagatgctaattttgtgtgtagacggacttttgtcgatcgaggctggggtaatggatgtggattatttggcaagggttccctaattacctgtgcaaaatttaagtgcgtcacaaaactagaaggaaaaattgttcaatacgaaaatctaaaatactcagttatagttacggttcacacaggagatcaacatcaagttggaaacgaaagcactgagcatggtacaacagcgaccataacaccgcaagctcctacatcagagattcagctcaccgattacggcgctttgacgttagactgttctcccagaactggcttagattttaacgaaatggtattactcaccatgaaagaaaaatcatggttagtccacaaacaatggtttctagatttgccattaccatggacatcaggggctagtacaagccaagaaacatggaataggcaagacctactcgttacctttaagactgcccacgccaagaaacaggaagtagtagttttagggtcacaagagggtgccatgcacaccgcgctcactggagctactgaaattcagacttcgggcacgactactatatttgccggccacttaaaatgtagactaaaaatggacaaactaactctaaaaggtatgtcatatgttatgtgcaccggatcttttaaattagaaaaagaagtagcggaaactcaacacggaacagttttggtccaaataaagtatgagggtactgacgccccatgcaaaattcctttttcaacccaggatgaaaagggtgttactcaaaatggtagactcataactgcaaatccaatcgtaacagataaggaaaaacctgtaaatattgaagcagaaccaccattcggggagtcgtatatagtaattggagccggagaaaaagcattgaaattaagttggttcaaaaagggaagctctatcggtaaaatgtttgaggctacagcgagaggtgcacgaaggatggcgatattaggtgatactgcatgggactttggttctatcggaggcgttttcacaagtgtgggtaagttggtacatcaaattttcggcactgcatacggagttttatttagtggcgtctcgtggactatgaagataggtataggtgtacttctcacttggttagggctaaattcacgttctacgtcactatctatgacttgcatagccgtaggattagtgacattatatctgggagttatggtacaagcagactctggatgtgtaataaactggaagggacgtgaactaaaatgtgggtcgggtatttttgtaacaaacgaagttcatacatggacagagcaatacaaatttcaagcagatagtccaaaacgattgagtgcagctataggcaaagcgtgggaagaaggcgtttgcggaatccggtcggcaacgagacttgagaacataatgtggagacaaatctcaaacgaattaaatcacatcttgttggaaaacgatatgaagtttacagtcgttgtaggtgatgtagtaggaatattggcacaagggaaaaagatgataagaccacaaccaatggaacacaagtacagttggaaatcatggggtaaggcaaaaataataggcgcggatgtacaaaacaccacatttataattgacggtcctaacacacctgaatgcccagatgatcaaagagcatggaacatatgggaagtcgaagactatggatttggaatttttacaacaaatatctggttaaagctacgagattcctatacacaagtatgtgatcaccgtttgatgagtgccgcaatcaaagattccaaagcggttcacgcagatatgggatattggattgaatctgagaaaaatgaaacctggaagctcgcccgtgcatcctttatcgaagtgaaaacctgcatatggcccaaaagccatacactatggtcaaatggggttttagagtcagagatgattattcccaagatatatgggggaccgatctctcaacataactacagaccaggctattttactcagacagctggtccgtggcacttagggaaactggaactagacttcgatttatgtgaaggcaccacagtggtagtagacgaacattgcggcaatcgaggaccatccctacgtaccaccaccgttactgggaagattatccatgagtggtgttgtaggagctgtacattgccgccgttacgctttaaaggggaagatggctgctggtatggaatggaaataagacctgtcaaggagaaagaagaaaatctcgtaaagagcatggttagcgcaggatcaggtgaagtagactcattttcactgggtttattgtgtatctcgataatgatcgaggaagtgatgaggtccaggtggtcaaggaaaatgttaatgacaggaacacttgcggtattctttctattaataatgggccaattaacatggaatgacttaatacgaagttgcataatggttggcgcgaacgcctctgatcgaatgggtatgggaacaacgtatttagcactgatggcgacttttaagatgcgtccgatgttcgcggtcggtctccttttcagacgattaacgtcaagggaagttctactactcacaataggtctcagtttagtcgcctcagtagaattgcctaatagtttagaagaattaggagacggattggccatgggaataatgattcttaaactattaacagactttcaatcctatcagttgtgggcaactttgttaagtcttacattcatcaaaacaacgtttagtttacattatgcctggaagacaatggcgatggttttatcaatagtctcgttgctgcccctctgcctctctaccacctctcagaaaaccacatggttaccagttctattaggaagtttaggatgtaagccattgaccatgtttctaattgcggagaataaaatctggggtagaaaaagttggcccttaaatgaagggattatggctgttggtattgtctctatattactttcaagtttgctcaaaaatgacgttccattggcaggtccactaattgcaggagggatgttaatcgcatgctatgtaatcagtgggtcatccgctgatctcagtttagaaaaagcggcagaagttagctgggaagaagaagctgaacattcaggtgcctcacataatatcctagtcgaggtccaagacgacggaacaatgaaaattaaagatgaggaacgggatgataccctcacaatattgttgaaggcaacattgctggcagtctctggcgtttacccattatctatacccgcaactctatttgtttggtacttttggcagaagaagaaacaaagatctggggtactatgggacactccgagtccacctgaggtcgagcgggcagtcctcgacgacggaatctatagaataatgcaacgtggcttactaggtcgtagccaagtaggagttggggtgtttcaagaaaatgtatttcacacaatgtggcacgtaactagaggcgcagtattaatgtatcaagggaagcgtctggaacctagttgggcttcggtaaagaaagacttaatttcatatggaggcggttggcgccttcaaggatcttggaacacaggagaagaggttcaagtaatcgcagtggagccaggaaagaatccaaagaacgttcaaacggctccagggacattcaagacacctgaaggagaagtaggggctatcgcattagatttcaaaccagggactagcggaagtcctattgtaaatagggagggaaaaatagtaggtctgtacggtaatggagtagtgacaacatcaggaacttacgtcagtgctatagcacaagctaaggcgtcacaagaaggcccattgccagaaatagaagacgaagtatttaggaaaagaaatcttacaataatggaccttcaccctggttcaggtaaaaccagacgctatttaccagccatagtacgggaggcgatcaaaagaaaattgagaactttaatactagcacctacaagagtcgttgcatccgaaatggcagaagcattaaaaggaatgccaatacgttatcaaactaccgccgttaaaagcgaacatactggacgagaaatcgtggatttaatgtgtcacgcaacatttaccatgcgcctcttatcccctgttcgagttccgaattacaatatgataattatggacgaagctcatttcactgatccatcaagcatagcagctagaggatacatatctacgcgggtgggaatgggtgaagcagcagctatattcatgactgcaactccaccaggtagtgtcgaggcttttcctcaaagtaacgccgttattcaagacgaggaaagggacatacctgaaagatcctggaactcaggctatgaatggattacagattttcctggtaaaacggtatggtttgtaccaagtataaagagcgggaacgatattgcaaattgtctgagaaagaatggcaaacgagtcattcaactatcacgcaaaacatttgatactgaatatcagaaaacgaagaacaatgactgggactacgttgtgacgacagacatatcggaaatgggagctaactttagggcggaccgagtcatagatcccagaagatgtttaaaacctgttattctgaaagatggtcccgaaagagtgatactagcgggcccaatgcccgtcactgtagccagtgctgcccaaaggagaggccgcataggaagaaatcataacaaggaaggtgaccaatatatatatatgggccaacccctaaacaacgatgaagaccatgctcattggacagaagcaaagatgctgttggataatatcaacacgcccgaaggaatcataccagctctattcgaaccagaaagagagaaaagtgcagccattgatggcgaatatcgcttgcggggagaggcaagaaaaacatttgtcgaacttatgcgaagaggggatttacctgtctggttatcctataaagttgcctccgaaggattccaatatagcgataggagatggtgttttgacggtgaacgaaataatcaagtattagaagagaatatggatgtcgagatctggacaaaggagggtgaacgaaagaaattgagacctaggtggctagacgcacgtacctatagtgatcctttggccttgcgagagttcaaagaatttgcggcaggtcgaagatcagttagcggcgatttaattcttgaaattggaaaactgccacaacatttaacccagagagctcagaacgcattagataatttggtaatgctacataattctgagcaaggagggagagcatacagacatgctatggaagaactgccagacacaatagaaacattgatgctccttgcgctaatcgctgttttaacaggtggagtcacactattctttctgagtggtagaggattaggaaaaacttccatcggtctgttatgtgtcatggccagctccgctctattatggatggcctcagtagaaccccactggattgccgcttccataattttggagttctttctaatggtattgctaatacccgaacccgacagacaaagaacaccacaagacaatcaactagcttacgtcgtaattggtttactatttatgatattaactgttgctgcaaacgaaatggggttgctagaaactacgaaaaaggacttagggatcggacacgtagcagtagaaaaccaccatcatgcaactatgttagacgtagatcttcatcctgcttcagcatggaccctgtatgctgtcgccacaactattattacgccaatgatgagacatactattgaaaacaccaccgcgaatatatcccttacagccattgcgaatcaagcagcgatactcatgggcctggataaagggtggcctatatctaaaatggatataggggttccgctattagcattaggatgttacagccaagtcaatccactcacactaacagcagctgtactaatgttagtagctcactatgcaataattggccccggactgcaagcgaaagcaacgagagaagctcaaaaacgaacagcggcgggaataatgaaaaacccaaccgtcgacggaatagtagctatagacttagatccagttgtctacgatgccaaatttgagaaacaattagggcaaataatgctattaatactctgtacaagtcaaatcttgctaatgcgaactacttgggctctatgtgagagtattacattggccactggacctttgacgactttatgggaaggtagtcccggcaaattttggaatacgacaatcgccgtgagtatggctaatatctttcgcggctcctatttggcgggtgccggcctagcgttttcacttatgaaatcattaggtggaggtcgccgaggcaccggagcgcaaggtgaaacacttggagagaagtggaaacgccagctaaatcaattatcaaaatctgagtttaatacctacaaaagatccggcataatggaggtagaccgatctgaagccaaagaaggtcttagacgaggagaaactactaaacatgccgtctcccgcggaacggctaaactaagatggttcgttgaacgtaatctcgtaaaaccagaaggcaaagtgatagatctagggtgcggaaggggcggctggtcttactattgtgctggattgaagaaagttacggaagtaaaaggttacacaaaaggagggccgggacatgaggaaccaataccaatggcaacctacggatggaatttagtgaaattacatagtgggaaagacgtgtttttcatcccgccagaaaagtgtgatactcttctatgtgatataggagaatcatccccgaaccctactatagaagaaggcagaactcttagggtactaaagatggttgaaccttggctccggggaaatcaattttgtatcaaaatattgaacccttatatgccatctgttgttgaaacattagaacaaatgcagcggaaacatggcggtatgttagtgaggaatccattgagcagaaatagtacacatgaaatgtattgggtgtcgtgtggaacaggcaatattgtctctgcagtaaatatgacaagtagaatgttgctaaatagatttacaatggcacatagaaagcccacatacgaacgggatgtggacttaggcgctggaactagacatgttgcagtggaacccgaagtggcaaatttggatataattggacaaagaatagaaaacataaaacatgaacacaaaagcacatggcactatgacgaagataatccctacaaaacttgggcataccacggaagttacgaggtcaaaccgtcaggatctgcgagttctatggtcaatggagttgttaaattgctcactaaaccctgggatgtaattccgatggttacgcaaatagctatgacggatacgactccttttgggcaacaaagagtattcaaagaaaaagtggacacaagaacgcccaaagcgaagagaggcacagcacaaataatggaagtcacggccagatggttatgggggtttctaagtagaaacaagaaaccaagaatctgtacaagggaagaatttacgcgcaaggtaagatcgaacgccgccattggcgctgtctttgtagatgaaaatcaatggaacagcgcaaaggaagcggtagaagatgagcgcttttgggacttagttcatcgagaacgtgaactccataaacaaggaaaatgcgcgacttgtgtgtataacatgatgggaaaaagggaaaagaagctcggagaatttggcaaagcaaaaggaagcagggcgatttggtatatgtggctaggcgccaggttcctcgagttcgaggcattgggattcatgaatgaagatcactggttctcaagagagaacagcttatctggagtcgaaggcgaaggacttcataagctcggatacatacttcgcgatatatctaaaataccaggtggaaatatgtatgcggatgacaccgcaggttgggatactaggatcacagaagatgatttgcaaaacgaagcaaagataacagacataatggagccagaacacgcattgcttgcaacttctatatttaaattaacctatcaaaacaaagttgttagagtccaaaggccagcacggaacgggactgtcatggacgtaattagtagaagagatcaaagaggatccggtcaagtgggtacatacggactaaatacatttacaaatatggaagctcaattgataagacagatggaaagtgaaggtattttcagcccttcagaactagaaactcccaacctcgctgaacgagtcctggactggttagagaaacatggagtggaacgtttaaaacgcatggccatatcaggcgatgactgcgtagtgaaaccaatagatgatagattcgcgacggcgttaagtgctcttaacgacatgggcaaggttcgcaaagatataccacaatgggaaccatcaaaaggatggaatgattggcagcaggttcctttctgctcacatcattttcaccaattaattatgaaggatggtcgtgaaatagtagtaccttgcagaaatcaagatgaacttgtggggagagcccgggtttctcaaggagcgggatggagtctccgagaaacagcttgtctaggtaaatcatatgcccaaatgtggcaattaatgtatttccatagaagagacctccgtctagctgctaatgccatatgcagcgccgtcccagtagactgggtgcccacttcaaggacaacgtggtctatacatgcgcatcatcaatggatgacaacagaagacatgttatcagtatggaatcgcgtctggatagaagaaaatccatggatggaagataaaacacacatctcctcatggggagacgtcccatacttaggaaaaagagaagaccaatggtgcggaagtcttatcgggttaactgctagggcgacatgggcaactaatatacaagtcgccatcaaccaagtacgtcgcctcataggcaatgaaaattatttggattacatgacctctatgaaacgttttaaaaacgagagtgatcccgagggagcattgtggtaa

SEQ ID NO: 21766 - RNA, 9879 nt, synthetic construct
  misc_feature 1..9879: note = derived and/or modified CDS sequence (opt6) from DENV-1__FJ898425__SS-prME
  source 1..9879: mol_type = other RNA
agcgtaactatgcttttaatgcttatgcccactgcattggcattccatctaacaacccgaggtggggaaccgcacatgattgtaacaaaacaagaacgtggtaaatcactgctgtttaaaacaagtgcaggagtaaacatgtgcacactaatagctatggatctaggagaactatgcgaagacacaatgacttataaatgcccgcgaataacagaagcagaaccagacgatgttgattgctggtgtaatgctacagatacctgggtaacatatggtacttgctcgcaaaccggagaacaccgtagggataaaaggtcggttgcactcgcgccacacgtgggacttggactcgaaacgagaaccgaaacgtggatgagttctgaaggtgcgtggaaacaaatacagagagtagaaacatgggctctaagacacccaggcttcacagtgatcgcgttatttcttgcacatgcaatcggcacaagcattacccaaaaaggtatcatcttcatactactaatgttagttactccatccatggcaatgcgttgtgttggaattgggagtagggatttcgtagaaggcttgtctggggcaacctgggtggatgttgtgttagaacatgggtcatgtgtaactactatggctaaagataaaccgacgttggatatagaactcctaaaaaccgaagttacaaacccagctgtattaagaaaactttgtatagaagcgaaaatatcaaatacaaccactgacagccgatgtcccactcagggtgaagcgacactaatggaagaacaagacgctaactttgtttgccgacgcacatttgtagatcgaggttggggcaacggctgtggactattcgggaaaggaagtctaataacctgcgccaaatttaaatgcgtgacaaaactggaaggaaaaatagtacaatatgaaaatctgaaatattctgtgattgtaacagtacataccggcgaccaacatcaggttggtaacgaaagcacagaacatggcactacagcaacgataacacctcaagcaccgacaagtgaaatacagctaacagactatggagcgctaactctagattgctcaccgcgaaccggattagacttcaatgagatggtattactaactatgaaagaaaaatcttggttagtccataaacaatggttcttagacttaccactaccgtggacatcaggtgccagtaccagccaagagacatggaatcgacaagatttgctcgtaacattcaaaacagctcacgctaagaaacaagaggtagttgtgttgggatcacaagaaggagcaatgcacactgctctcactggggcaacggaaattcaaaccagtggcactacaacgatctttgcaggacatctaaaatgccgattaaaaatggacaagctgacactgaaaggcatgtcatatgtaatgtgtacaggatcattcaagctggaaaaggaagtagcagaaactcaacatggaactgtcttagtacaaataaaatatgaaggcacagacgcaccatgtaaaataccatttagcacacaagatgaaaaaggggtcacacaaaacgggagattgatcactgcgaatccgatagtaacggataaagaaaaaccagtcaacatagaggcagagccacctttcggtgaatcatatatagtgatcggagcaggagaaaaagcactcaaattatcatggttcaagaaaggcagctcgattgggaaaatgtttgaggcaacagctcgcggtgccagacgtatggccatccttggagacacagcttgggatttcggttccataggaggggtgttcacatccataggcaaattagttcatcaaatatttggtacagcttatggtgtcctcttttctggtgtcagttggacaatgaaaatcggaataggtgtgttgctcacttggcttggactgaactcaaggagtacatcgctatcaatgacttgtatagcagtcggattggtaactctttatttgggagtaatggttcaagcagactcaggctgtgttatcaactggaaaggccgtgaattaaaatgtgggtctggaattttcgtgacaaatgaagtacatacatggactgaacaatataaatttcaagctgattcaccaaaacgtctatcagctgccataggcaaggcctgggaagaaggggtttgcgggatacgaagtgcaacccgcttagaaaatataatgtggaaacagatatctaatgagttaaatcacatactcctagagaatgatatgaaatttacagtagtcgtaggagatgtagtcggaatcctagcacagggtaagaaaatgattagaccgcaaccaatggaacataaatatagttggaagtcgtggggtaaagcaaaaattataggagcagatgtacaaaacacaacctttataatagatgggccaaatacaccggaatgccccgatgatcaaagggcatggaatatttgggaggttgaagactatggatttggaatatttactacgaatatctggttaaaaatgcgggattcatatacacaagtatgtgaccaccggctaatgtcggctgcgatcaaagacagtaaagcagtccatgctgatatgggatactggatagaatccgagaaaaatgaaacatggaaattggcgcgtgcatctttcatcgaagtgaagacgtgcatatggccgaaatcccatactctctggagcaacggtgttctagaaagtgaaatgattattcctaaaatttatgggggccctatttcccaacacaattataggcctggttattttacacaaacggcaggaccctggcatcttggaaaactagagttagactttgatttgtgcgaaggaaccactgtagtagtcgacgaacattgtggtaacagagggccatctttacgtacaacaacggtgactggcaaaataatccatgaatggtgttgtagatcttgtactttacctccgttaagattcaaaggagaggatggttgctggtacgggatggaaataagaccggtaaaggaaaaagaagaaaatctcgtcaaatctatggtatccgcaggaagcggtgaggtagattctttcagtttaggattattatgcatttcgattatgatagaagaggttatgcgctctagatggtcaagaaaaatgctaatgaccggtacgctagccgtgtttcttttacttatcatgggccaattgacttggaatgacttgataagactctgcataatggttggtgcaaacgcaagtgatcgtatgggtatgggaacgacctatttggcacttatggcaacgtttaaaatgcgacctatgttcgctgtgggattactattcagacgactaacaagcagagaggtgctactcttaactataggtttaagtctggtggcaagtgtagaacttcctaatagtctggaagaattaggtgatggcttggccatgggcatcatgatattaaagttactcactgatttccaatcccatcaactatgggctactttgttaagtctaacttttattaaaacaacccttagcttgcactatgcatggaaaactatggcaatggtgctatccatagtatcactaatacccctgtgcttatcaactacctcacaaaagacaacatggctgccagtcttgttgggaagtctcgggtgtaagcctctaaccatgttccttattgctgaaaataaaatttggggtagaaagagttggccactcaatgaagggattatggccgtcggggtcgttagtatactcctaagtagtttgctgaaaaacgatgtgccgttggctggtccattgatagcaggcgggatgctgatcgcatgttatgttataagcgggtcgtcggcggatttaagtcttgaaaaagcggctgaagttagctgggaggaggaggccgagcactcgggggcttcccataatattctagtagaagttcaagacgatggtacaatgaaaatcaaagatgaggaacgagatgatacattgactatccttctaaaagcaacgctattagcggtctcgggagtataccccctatcaataccagcaactctcttcgtctggtacttctggcagaaaaagaaacaaagaagcggtgtgctttgggatactccgtcccctcctgaagtagaaagagctgtcttagatgacggtatatacagaataatgcagagaggattgctaggacgttcgcaagttggagtaggcgtattccaagaaaatgtctttcatacaatgtggcatgtaacgagaggagcagttcttatgtatcaaggaaaaagacttgagccctcatgggcatccgtcaagaaagatttaatatcgtatggtggtggttggagacttcaaggatcatggaatactggagaagaggtccaagtaatcgcggtcgaaccaggcaaaaatcctaagaacgttcaaactgcaccgggtacatttaaaacaccagagggggaagttggtgccatagcactagacttcaaaccaggtacgagcggttctccaattgtaaatagagagggcaaaatcgttggcttgtacggtaacggcgttgtcacaacatcgggtacttacgtaagcgcaatagctcaagcaaaggctagtcaagaaggacctctacccgaaatagaagatgaagtattcagaaaacgaaaccttacgataatggacttacatccaggatctggaaaaacaaggagatacttaccagccatcgttcgagaagctataaaacgaaaactacgtacgttaatccttgcgcctacacgagtggtagccagcgaaatggcagaagcattaaaaggcatgccgatcagatatcaaacgactgcagtaaagtcagaacacaccggtaaggaaatagtagacctaatgtgccatgctacgttcacgatgagactactcagcccagtaagagtgccaaattataatatgataattatggatgaagcacattttactgatcctagttcaatagctgccaggggatatatatcaacaagggtcggtatgggcgaggctgctgcaatctttatgactgccactcctcccggtagcgttgaagcgttccctcaatcgaacgccgtaatacaagacgaagaacgagacatccctgaaagaagctggaatagcgggtatgaatggattactgattttcctggtaaaacggtatggttcgtgccttcaattaaaagcggaaacgatattgcaaattgcttaagaaagaatgggaaacgtgtaatacaactatcaaggaagacatttgacaccgaatatcaaaagactaaaaataatgattgggattacgttgtaacaactgatatatccgaaatgggagctaacttccgagccgatcgggttattgatcccaggagatgtttaaaaccagtcatattaaaggatggtccagagagagtaattctagcaggaccaatgccagttacggtggcatccgccgcacaacggagaggcagaatcggtcggaatcataataaggagggcgatcagtatatatatatgggacaacctctcaataacgatgaagaccacgcccactggacggaagcaaagatgctcctagacaacattaacacaccagaaggaataataccagcactattcgaaccagaacgagagaaaagtgcagctatagatggtgaatatagactcagaggtgaagcgagaaagacattcgttgagctcatgcgcagaggtgatcttcctgtgtggctatcatataaagttgcatcagaaggattccaatattcagacaggagatggtgttttgatggtgaaagaaacaatcaagtcctagaagaaaatatggatgtagagatctggaccaaagagggtgaacgcaagaaattacgacccagatggcttgatgctcgaacgtattcagacccattggcactaagagagtttaaagagttcgctgctgggagaagaagtgtttctggcgatctaattttggaaataggaaaattaccgcaacatctgactcaaagagcacaaaacgcgctggataatttagttatgttgcacaattcggagcagggaggaagggcatatagacatgctatggaagaacttccggatactatcgaaaccctcatgttactcgcattaattgcggtgttaaccggcggagttaccctatttttcctaagtggaagaggtcttggaaaaacctcaattggcttactatgcgtcatggcatccagtgtattattgtggatggctagtgtcgaaccacattggatcgccgcgtcaatcattttagagttcttcctaatggtactccttatcccagaacccgacagacaaaggaccccacaagataatcaactagcgtatgtagtaatagggctactcttcatgatacttacagtagcggccaatgaaatggggttgttagagactactaagaaagatttaggtataggacacgtagctgtagaaaaccaccatcacgcaacgatgctagacgtcgaccttcaccctgcatcagcttggacattgtatgcagtagccacaactattataacccctatgatgagacatacaatcgagaacaccactgctaatatatcacttaccgctatcgcaaatcaggcagccatactcatgggtctagataagggttggccgatctcaaaaatggacataggtgtaccattactggcgttagggtgctactcacaggtaaacccactgaccctcacagcggcagtattaatgttagttgcccactatgcaataattggacctggcttacaagctaaggctacaagagaagcgcagaagagaacagcggctggtattatgaaaaatccgactgtagatgggattgtggctatagatttagatcctgtagtatatgatgctaagttcgagaaacagttaggacaaataatgttactgattctgtgcacttcgcaaatcctactaatgaggacaacatgggccctctgcgagtctattacacttgcaacaggaccgttgacaaccttgtgggaaggtagtcctgggaagttctggaacacgaccattgcagtttctatggcaaatatattccgaggttcttatttggcaggcgcaggtttagcattttccttaatgaagtctttaggcggtggtcgcagaggtacgggggctcagggagaaaccttaggcgaaaaatggaaacgccaattaaatcaactttctaaaagcgaatttaacatatacaagagatcgggaattatggaagtagaccgatcagaagcaaaagaagggttaaaaaggggtgaaacaacccgtcacgctgtatccaggggaactgctaaactaaggtggtttgtcgaaaggaatttggttaagccagaaggtaaagtcatagatttaggttgcggaagaggagggtggtcatattactgcgctgggctaaagaaagtcacagaagtgaaaggatatactaaaggaggcccaggccatgaagaacccataccaatggctacctatgggtggaatcttgtaaaattgcattcaggaaaagacgtattctttacgcccccagagaaatgcgacaccctgttatgcgatataggcgaaagcagtccaaacccaacaatagaagaaggaaggactttacgggtcctcaaaatggttgagccgtggttgagagggaatcaattttgtattaagatactaaacccctatatgccatcggtggtcgagacattggaacaaatgcagcggaaacatggaggtatgttagtaaggaacccattaagcaggaactctacacatgaaatgtactgggtctcatgcgggaccggaaatatagtaagtgctgttaatatgacttcccggatgttattgaatcgatttacgatggctcatcgaaagccgacatatgagaaggatgtcgatttaggggcgggaacgcgacacgttgcggtcgaaccagaagttgcgaatttagatatcattggtcaaagaatagagaacataaaacatgaacacaaatcgacttggcattatgacgaagataatccttataagacgtgggcttatcatggtagttatgaagtaaagcccagcggctcagcttcttccatggtaaatggagtcgtaaaattattgactaagccatgggatgttatacctatggtaactcagatagcgatgacggatacaactccattcggacaacaacgagttttcaaagaaaaagtagacacgagaacgccaaaagcaaaaagaggtactgtacagattatggaagtaaccgcacgatggctgtggggcttcttaagtaggaataagaaaccaagaatttgtacaagagaagaatttactaggaaagtaagaagcaatgcagctattggagccgtttttgttgatgaaaaccaatggaactccgcaaaggaggctgtagaggacgaacgtttttgggacttagtacaaaaggagcgagagcttcacaaacaaggaaaatgtgcaacttgtgtatacaatatgatgggaaagcgggagaagaaattaggagagttcggtaaagcgaaaggatccagagctatttggtatatgtggttgggagctagatttttggaatttgaggccttagggttcatgaacgaagatcactggtttagccgagaaaattctcttagtggagtcgagggtgagggcctacacaaactaggatacatacttagagatattagtaaaattcctggaggcaacatgtatgctgatgacacagcaggctgggatacccgtataacggaagatgatttgcaaaacgaagccaaaatcaccgatataatggaaccagaacatgcactactagcaacaagtatctttaaattaacatatcaaaataaagtagtaagggtgcagcggcctgccaaaaacggaacggtgatggatgtaattagtcggagagatcagcggggaagtggtcaagtagggacttatgggttgaacacgtttactaatatggaagcacaattaattagacaaatggagtctgagggcatatttctgccatccgagttagagacgccgaatttagcagaaagggtactggattggttagaaaaatacggggtggagcgacttaagagaatggctatatcaggggacgactgtgtagtaaagcctatcgatgaccgttttgctactgctttaactgcgttaaatgatatggggaaagtacgaaaagatatacctcaatgggagccctcaaaagggtggaacgactggcaacaggtaccgttttgcagccaccatttccaccagttaatcatgaaagatgggagagaaatagtagtaccatgccgaaatcaggatgagttggtagggagagcaagagtatctcagggagctggttggtctttaagggagacggcttgtttggggaaaagttatgcgcaaatgtggcagttaatgtattttcatcgaagagacttaaggcttgccgccaatgcgatatgctctgccgttccagttgattgggtgccgacttctaggacgacatggagcatacatgcacatcatcaatggatgacaacagaagatatgttatcggtatggaaccgagtgtggatcgaagaaaacccttggatggaagacaaaacgcatgtatcgtcttggggagatgtaccatatttaggaaaaagagaagaccaatggtgcggatcactaataggattgaccgcgcgtgcaacatgggcctccaatatacaggtagccataaaccaagtacggcggttgataggtaatgagaattatttagattacatgacctcaatgaagcgattcaagaatgaaggagacccggagggagcgttgtggtga

SEQ ID NO: 21767 - RNA, 9879 nt, synthetic construct
  misc_feature 1..9879: note = derived and/or modified CDS sequence (opt6) from DENV-1__FJ898426__SS-prME
  source 1..9879: mol_type = other RNA
agcgtgacaatgttattaatgttaatgccgacagctctagcgtttcatttaactacaagaggaggagaacctcatatgatagtctcaaaacaagaacgagggaaatccttactgtttaaaacatcagccggtgttaacatgtgcactttaatagcaatggatctgggggaattttgtgaagatactatgacatacaaatgtcctcggataactgaagctgaacccgacgatgtagattgctggtgcaatgcaactgacacttgggtcacttatgggacatgcagtcaaacaggagaacatagaagagacaaacgctcagtagcgttggcgccgcatgttggtttaggactagaaactagaaccgaaacctggatgagcagtgagggagcctggaaacagatacaaagggtcgaaacttgggcattgagacacccggggtttaccgtaatagcgttatttctagcacatgcaattgggacatcaataacccaaaaaggtattatttttatcttacttatgcttgttacaccttctatggcaatgcgttgcgtgggaatcggatctcgagactttgtggaagggttgtccggggcgacatgggtagatgtagtgttagaacatggatcttgtgttactactatggccaaagataaaccaactctagacattgaattattaaaaaccgaagttgcaaacccagccgtattacgcaaattatgtattgaagcaaaaatatccaatacaacaacggattccagatgtccaacacaaggtgaggccaccctagtagaagaacaagacgcaaattttgtgtgccgtcgaacatttgtagacaggggatggggaaacgggtgcggcctgtttggaaaaggtagcctgattacatgtgctaaattcaaatgcgtaacgaaactagaaggaaaaatcgtgcaatatgaaaacctaaaatattctgtaatagtcaccgtccacacaggcgaccaacatcaagttggaaatgaaagtacagaacacggaacaactgcaacaattacgcctcaagctccctcaactgaaatacaactaactgattatggcgctctaaccttggactgctcacctcgaacaggattagattttaatgaaatggtgctacttacaatgaaagaaaaatcatggttggtgcacaaacaatggtttttagaccttcccttgccttggacatcgggggcaagtacatcacaagaaacatggaataggaaagacttattagtgaccttcaaaacagcacatgcgaaaaagcaagaagtagtagtactgggtagtcaagagggtgctatgcacactgccttgactggagccactgagatacaaacttccgggaccacaacaatttttgcgggtcatttaaaatgcaggctaaagatggacaaacttactctaaaaggtatgtcatacgtaatgtgtaccgggagttttaaattagagaaagaagtagcggaaactcaacatggaacagtacttgtgcaaattaaatacgaaggaacagacgcaccctgtaaaataccattcagcacacaagatgagaaaggggtcacacagaatggccgtttaattacagctaatccaatcgtaacggacaaagaaaaaccagtaaatatcgaagcagaacccccatttggagaaagctatatcgtaataggcgccggagaaaaggccttaaaattgtcttggtttaagaaaggatcctcaattgggaaaatgtttgaggcaactgccagaggagctcgacgaatggccattcttggagatacagcatgggatttcgggagcataggtggagttttcacaagtgtgggaaaacttgtgcatcaaatatttggaaccgcttatggagtattgttctccggggtttcatggacaatgaagattggtattggagtattattaacttggttaggcctaaactcaagatcaacgagccttagcatgacttgtatagctgttggactggtaacgctttaccttggagtaatggtccaagctgactcgggttgtgtcataaattggaagggacgagagctgaagtgcgggagtggcattttcgttactaacgaggtacacacctggacagaacaatacaagtttcaagctgattctccaaaacgacttagcgcagctattggtaaagcgtgggaggaaggtgtatgtggaattaggagtgcaacccgactcgagaatattatgtggaaacaaataagtaatgaacttaatcacatactgttagaaaatgacatgaaattcaccgttgtcgtcggcgatgttgccgggatcctggcccagggaaagaaaatgattagacctcaaccaatggagtataaatactcttggaaatcgtggggtaaagccaaaataataggagccgatgtacaaaacacaacttttattatcgacggtcccaatacgccagaatgccccgatgatcagcgagcctggaatatctgggaagtagaggattacgggtttggtatctttaccacaaacatatggttgaaattgagggacagctacactcaagtgtgcgatcatcgcttaatgtctgccgccataaaagactcaaaagccgtgcatgcagatatggggtattggatagaatctgagaaaaacgaaacatggaaattggccagggcctcgttcatcgaagttaagacatgcatttggcctaaatcacatacgttatggtccaatggagtgttagagagcgaaatgataatacctaaaatatatggaggtccaataagtcaacacaattacagacccggatattttacccaaacagccgggccctggcacctaggcaaactagagctagattttgatttatgtgagggaactacggtagttgttgacgaacattgcggtaacaggggaccatcactcaggactaccaccgtcaccggaaaaattatccatgaatggtgttgtcgatcttgcacacttcctccgctaagattcaagggagaagacggttgctggtatggaatggaaatacgaccagtaaaagaaaaagaggaaaatttagtaaaatcaatggtaagtgcaggctcaggcgaagttgactcattttccttaggattactatgtatttcgataatgattgaggaagtaatgagaagtaggtggtctaggaaaatgttgatgacaggtactcttgcggtattctttttactaataatgggtcaactgacctggaatgacctaatacgtctgtgcataatggtaggagcgaacgcgtccgatcgaatgggtatggggacaacatatctagcccttatggcgacattcaaaatgcggccaatgttcgcagtgggtctgttatttagacgcctgaccagcagagaagtgctattattaactattggcttgagtctcgtcgcctcagttgaattgccgaacagtctcgaagaattaggtgacgggttagcaatgggtattatgatattaaagttattaacggactttcaaagtcaccaattatgggccacccttctaagtttaacattcataaagaccacctttagcctacattatgcttggaaaactatggccatggtcctgtctatagtcagtctttttcccttatgtttatcgacaacttcgcagaaaacgacctggcttccagtcctattaggcagcctaggatgtaaacccctgacaatgtttttgattgcagagaacaaaatatggggccgaaaatcatggcctttgaatgaagggataatggcagtgggaatagtatcaatcctactaagttctctactaaagaatgacgtaccgcttgctgggcccttaatagccggtgggatgctcatcgcatgttatgtcatatctggaagtagcgctgacctatcacttgaaaaggcagctgaagtcagttgggaagaggaggcggagcacagtggagcaagtcataatatacttgtcgaagtacaagatgacgggacaatgaaaatcaaagatgaggaaagagatgacacactaaccatccttttaaaggcgacgctattggcggtgagtggagtatatccacttagtatacctgcaacattatttgtatggtacttttggcagaagaagaaacagcggtctggtgtattgtgggatacacccagcccaccggaggtggaacgggcggtcctagacgatggaatatacaggataatgcaaaggggacttcttggtcgatcgcaagtaggtgtcggtgtatttcaagaaaacgtcttccacaccatgtggcatgtcaccagaggtgcagttctaatgtatcaagggaaaagattagaaccatcgtgggctagcgtgaagaaagacctaatttcatatggaggtgggtggagattgcagggatcatggaatacaggggaagaagttcaagtaatagcagtggaacctggcaaaaatcctaaaaatgtgcagacagcaccagggacatttaaaacttcagaaggagaagtgggtgcaatagctctagattttaaaccgggaacaagcggtagtcctattgttaaccgtgaaggaaaaatagttggactttatgggaatggagtggttacaacttcaggtacatatgtatctgcgatagcacaggcaaaagcgtcgcaggaaggacctctgcctgaaattgaagatgaggtatttaggaaaagaaatctaaccataatggaccttcaccccggaagtggcaagacaaggagatatctccccgccattgtacgagaggcaatcaaaagaaagttgcgcacactaattttagcacccacacgtgtggtagcttcagaaatggcagaggcgttaaaaggtatgcctatacgataccagacaaccgcagtgaagtctgaacatactggaaaagaaatcgtagacttaatgtgtcatgcgacgttcaccatgaggctcctttctccagttcgagtacccaattataacatgataataatggatgaggctcatttcacagatccaagttcaattgctgcaagaggatacatctctactagggtgggaatgggtgaagcagcggcaattttcatgactgctactccaccaggaagcgttgaagcctttccgcagtctaacgctgtgatccaagatgaagaaagagacataccagaacgcagttggaatagcggttatgaatggatcacggattttccagggaaaacagtctggtttgtaccctcgattaaaagtggcaatgacattgcaaattgccttagaaagaatggcaaacgcgtaatacaacttagcaggaaaacattcgatacagaataccagaaaactaagaataatgattgggattatgtagtaacgaccgatatatcagagatgggcgccaattttagagctgacagagtcattgacccaagaagatgcttaaaacctgtaatactaaaagatgggccagaaagagtgatacttgctggaccgatgcctgtgaccgtagcaagtgctgcgcagaggcgaggaaggataggtcgaaatcataacaaagaaggggaccagtatatatatatgggacaaccccttaataatgacgaagaccatgcgcactggactgaagcaaagatgctcttagacaatataaacacgccagaaggtataatacccgccttatttgaaccagaacgggagaaaagcgcagcaatagacggggagtataggttgagaggagaagcacgaaaaacctttgtagagttgatgcgacgaggtgacctgcctgtttggttgagttataaagtggctagtgaaggatttcaatattcagaccgcagatggtgttttgacggagaacgcaataatcaggtcttagaagaaaatatggacgtcgaaatatggactaaagaaggagagcgtaagaaattaaggccgcgatggctggacgcaagaacctatagcgacccgctagctctcagagaatttaaagaatttgctgcaggacgtcgttcagtttctggggaccttattttggaaattggtaaactccctcaacatttaacgcagcgagcacaaaatgctctagacaaccttgtaatgcttcataatagtgaacaaggaggtcgcgcttatcgacacgcaatggaagaactacctgataccatcgagacgttaatgcttctagctttgatagcggttttaaccggcggcgtcaccctgttctttctatccggaagaggtctcggaaaaacttcaataggtttactctgcgtcatggcaagcagtgtcttgctgtggatggcttcggtggaaccccactggatagcagcctctataatattagagttctttttaatggtcctcttgataccagaaccggaccgacaacggacccctcaagataaccagctagcttacgtagtaataggattgctgttcatgatactcacggtagcagctaacgaaatgggcttactggaaactacgaagaaagatctcggaataggtcacgttgctgtagaaaaccaccaccacgcagcgatgctggacgtcgatttacatccagctagcgcctggacactttacgcggtagcaacaacaattataacgccgatgatgcgacacaccattgagaatactacagcaaacatcagcttaactgccattgcaaatcaagctgctattttaatgggattagataagggatggcccatatccaaaatggatattggagtaccattgctagctctaggttgttattcacaagttaatcccctcacattaaccgcagccgtattaatgctagtagcgcactacgccataattgggcctgggctacaggcaaaggcaacacgagaggcccagaaaagaaccgcggcgggaataatgaagaacccaactgtggacgggatagttgcaatagatttggatccagtggtttatgacgcgaagttcgagaagcaattaggtcaaatcatgttgctaatactttgtacctctcaaatattattaatgagaactacgtgggcattgtgtgaatcgataacactagccactggaccgttaacgaccttatgggagggttcacccgggaagttttggaacactaccattgcagtctccatggcgaatatatttagaggatcatatctggcaggagctggtcttgctttcagtttgatgaagtcactaggtggaggtagaagaggaactggggcacaaggagagacactgggcgaaaagtggaaaagacaactgaatcaacttagtaaaagtgaatttaatacttataaaaggtcaggaatcatggaagttgataggtcagaggccaaagaagggttaaaacgaggtgagaccaccaaacacgcagtaagtaggggaacggccaagctacgctggttcgttgagaggaacctagttaagccagaaggaaaagtaatagatttaggatgtggtcgcggaggatggagctactattgtgcaggactcaagaaagtgactgaagtgaaaggatatacaaaagggggacctgggcacgaagaacccataccaatggctacttatggctggaatttagttaagctgcatagcggtaaggacgtattctttatacctccagaaaaatgcgacacactactttgtgacattggggaatctagtccaaacccgacaatcgaagaagggagaaccttaagggtactgaaaatggttgaaccctggttacgtggtaaccagttttgtattaaaattttaaatccttatatgccttctgttgttgaaactttagagcaaatgcaaaggcggcacggcggcatgcttgtgagaaatcccctaagtagaaactctactcatgaaatgtactgggtgagctgcggcacaggaaatattgttagcgcagtaaacatgacatctagaatgttattgaatcgatttacaatggctcacagaaagccgacatatgaacgagacgtggatttgggcgcgggcactcggcatgtcgccgtagaaccggaggttgcgaatttagatataattggccaaagaattgagaacataaaacacgaacacaaaagtacttggcattacgatgaagataatccttataaaacatgggcttaccatggttcatatgaggtaaaacccagtgggagcgcatcatcgatggtgaacggcgttgtaaaattattaacaaagccgtgggatgttatcccgatggttacacaaattgccatgacagatacgacccctttcggacaacagcgagtgttcaaagaaaaagtagatacccgaacacctaaagcgaagcggggaacggcacagataatggaggttacagccaaatggctatggggattcttgtcacgaaacaaaaagcctagaatctgtacacgagaagaatttacacgaaaagtccgatctaatgcagccataggagctgtgttcgtggatgaaaaccaatggaacagcgctaaagaagctgttgaagatgagagattctgggatctagtacatagggaaagagaactgcataagcaaggaaagtgtgcaacttgtgtgtataacatgatgggaaagcgtgaaaagaaactaggtgagtttggtaaggccaagggatcgcgagcgatttggtatatgtggttaggggctagattcttggaatttgaagccttggggtttatgaacgaagaccattggttctcgagggaaaattccctaagtggagttgaaggggaaggtctacataaattaggttacatattaagagatatctctaaaatacccggaggaaatatgtacgcagatgatacagctggttgggacacaagaattacagaagatgatttacaaaatgaagcgaaaatcactgatataatggaaccggaacatgcactacttgcaaaatcaatttttaaattaacatatcaaaacaaagtagtgagggttcaaaggccagccaaaaatggaacagttatggatgtaataagtcgaagagatcaaagggggagcgggcaagtaggaacttatgggctcaatacattcactaacatggaagcgcagctaatacgacagatggaatctgaaggaatattcagtccaagcgaattagagacaccaaaccttgccggaagagtcttggactggttagagaagcatggggtagaaagactaaagagaatggcaatttcaggagatgattgcgtggtaaagccaatcgacgaccgattcgcaacagctctgacagcattgaatgatatgggtaaggtaagaaaagatataccccaatgggaaccatccaaaggctggaacgattggcaacaagtaccgttttgttcacatcactttcaccagctaattatgaaggatggtagagagattgtcgttccatgccgaaatcaagatgaattagtggggagagcacgggtgagtcaaggagcaggttggtctttaagagaaactgcatgtcttggaaagtcttacgcacagatgtggcaactaatgtacttccatagacgagatctgagacttgccgctaatgctatttgcagtgcagtcccagtcgattgggtgcctacttctcgtactacatggagtatacacgctcaccatcaatggatgactacagaagatatgctaagtgtatggaaccgagtatggatagaagaaaacccgtggatggaagacaaaacccatattagttcatggggcgacgtaccatatctaggaaagcgggaggatcagtggtgtggcagcttaatcggtttaacagctagggccacgtgggcgacaaatatacaagtagctatcaaccaagtaagaagactaatcgggaacgaaaactatctagattacatgacgtccatgaaacgatttaaaaacgaaagtgacccagaaggagcattgtggtga

SEQ ID NO: 21768 - RNA, 9879 nt, synthetic construct
  misc_feature 1..9879: note = derived and/or modified CDS sequence (opt6) from DENV-1__GQ199856__SS-prME
  source 1..9879: mol_type = other RNA
tcagtgacaatgttactgatgctaatgccaactgcactagcattccatttaactacaaggggaggcgaaccccatatgatagttagcaaacaagaaagaggaaaatcacttctttttaaaacaagtgcaggagtaaatatgtgcacattggtggcgatggacttaggtgaattttgcgaagataccatgacgtataaatgcccgagaataaccgaagcagaaccagatgatgttgattgttggtgtaatgcaacagatacgtgggtaacatacggtacttgcagccaaacgggtgaacataggcgagacaaaagaagtgtggcattagcacctcatgtaggtttgggtctagaaacaaggacagaaacatggatgtcttccgaaggcgcttggaaacaaatacaaagagttgaaacctgggcactcagacacccaggattcacggtaatagccctatttttggcccacgcaataggaacatcgattacacaaaaaggcataatttttatactactgatgctggtaactcctagtatggcaatgcgatgcgtcgggattggatctagagacttcgtagaaggattatcgggagcaacctgggtcgacgtcgtcttagaacatggaagttgtgtaacaacaatggcaaaagataaacctacgcttgacatagaattactaaaaacagaagtgaccaacccggcagtcctaaggaaactgtgtattgaagccaaaatttccaatacaactacagatagtaggtgcccaacccaaggagaagcaactctcgtagaagaacaagatgcaaatttcgtgtgccgcagaacgttcgttgatagaggttggggtaatggctgcggattattcggaaaaggctcgttaataacctgcgccaaattcaaatgtgtaaccaaactagaaggaaaaacggtacaatatgaaaacttgaaatactcggtaattgtaaccgtacacacaggcgatcaacaccaagtcggaaacgaatcgacagaacacggcacaacagcgacaattacgccacaagcaccctcgacggagatacaattaaccgattatggagccctaactttagattgttcaccaagaaccggccttgatttcaacgaaatggtattactaaccatgaaagaaaaatcctggttggtacacaaacaatggtttctagatctgcctttaccgtggacctcaggtgcgagcacatcgcaagaaacttggaataggaaagatctcctagtaacatttaaaaccgcccacgccaagaaacaagaagtagtagtattagggtcccaagagggggcaatgcataccgcactcacaggagctacggaaatacaaacctctggcactactacgatatttgcaggtcatcttaaatgcagactaaaaatggacaaattgacactaaaaggaatgagctacgtcatgtgcacgggcagttttaaactagaaaaagaggtagcagaaacacagcatggtaccgtcttagtgcagattaaatatgaaggaacggacgcaccatgcaaaattcccttctccacgcaggatgaaaaaggtgtaacccaaaacggtaggctgatcacagcaaacccgatagtaacagataaagaaaaacccgtcaatattgaagcggaaccccctttcggtgaatcatatattgttattggcgcgggagaaaaagcattaaaattatcatggttcaagaaaggaagctcaatagggaaaatgtttgaagcaaccgccagaggagcacgacgcatggcaattcttggagatacagcttgggactttggatcaattggcggtgtctttacctcggtaggcaagctagttcaccagatatttggcactgcttacggagtattattctccggagtttcctggacaatgaaaattggaataggagtattattaacttggctaggattaaattcaaggtctacatctttatcaatgacatgtatagcggtaggcctagtaacattgtacttaggagtaatggtacaagctgacagcggatgtgtcatcaattggaaaggtcgagagcttaaatgtggttcaggaatattcgttactaacgaagtacacacatggaccgaacaatataaatttcaagcggatagcccaaaaagactttccgcagccataggaaaagcctgggaagaaggagtctgtggtattagaagtgcaacgcgactagagaacatcatgtggaaacaaataagtaacgaactaaaccacattcttctggagaatgatatgaaattcacggtagtagtcggcgatgttgcaggaatcctcgcacaagggaagaaaatgattagacctcaaccgatggagtataaatacagctggaaatcatggggaaaagcaaagatcataggtgcagacgtgcaaaatacaacatttattatcgatggtccaaacacaccggagtgccctgatgaccagagagcatggaacatatgggaggtagaagattatggattcggaatatttaccactaacatatggttaaaacttagagattcatatactcaagtatgcgaccatcgtcttatgtcagcggcgattaaagattcgaaggcggtccatgcagacatggggtattggatagaatcggagaagaatgagacgtggaaacttgcaagggccagcttcatagaagtaaagacttgtatatggccgaaaagtcatacgttgtggtcaaatggtgtacttgaaagtgaaatgatcataccaaagatatatggaggacctatttcacaacataactacagacccggatactttacacagaccgcaggaccctggcacttaggaaaattagaattagatttcgatttatgtgaaggcacaactgtagtcgtagatgagcattgtgggaacagaggtcctagtttgagaactacaacagtaacgggaaaaatcatacacgaatggtgttgcagaagctgtacgctacccccactcagattcaaaggcgaggatggatgttggtacggcatggaaattcggcctgttaaggaaaaggaagagaatcttgtaaaaagtatggtatcagcgggtagtggggaagttgattctttttccctaggattattatgcatttccataatgatagaagaagtaatgcgatccagatggtctagaaaaatgctgatgacggggacattggcagtattctttttactgatcatagggcaattgacgtggaatgacctaatacgcctgtgcataatggtgggcgcaaacgcaagtgatagaatggggatgggtactacttatctagccttaatggcgacgtttaagatgagacccatgtttgctgtcggtttattatttcgaagattgacgagtcgtgaagtattacttttgactatcgggctgagcttagtagcttcagtcgaattaccgaacagtttagaagaactaggggacgggttggcaatgggaataatgatactaaagttgttgacggacttccaatcacatcaattgtgggctaccttactttctcttacgttcatcaagaccacatttagcctacattacgcctggaaaacaatggcgatggtgttatcaatagtaagcctattcccattatgcctcagtactacgagtcagaaaactacctggttgcctgttctgctcggatccttaggctgcaaaccacttacgatgttcctaatagcagagaacaaaatatggggacgaagaagctggcctctaaatgagggaattatggcggttggaatagtatctatattattatcaagtctactcaaaaatgatgtgcccttagcgggtccattaatagcaggagggatgttaatcgcatgttacgtaataagtggtagtagcgcagacctctctctagaaaaggcagctgaagtgtcatgggaagaagaagcagagcattccggagcttcccataacattcttgttgaagtacaagacgacggaaccatgaaaatcaaagacgaagaaagagacgatacattaacgatactattgaaagccactttattagcagtaagcggagtttatccgctctccatccccgcaaccctatttgtttggtatttttggcaaaagaaaaagcaacgaagtggggtcctatgggatacgccatcaccgcctgaagttgaacgtgcagttttggatgatggaatatatagaataatgcaaagaggactactaggaaggtctcaggtcggagtaggggtttttcaagaaaatgtatttcataccatgtggcatgttacaagaggggcggttctaatgtaccaggggaagcgtctagaacccagctgggcgagcgtcaagaaagatttgataagttacggaggcggatggagactgcagggatcatggaatacaggtgaggaagttcaagtaattgcggtcgagccgggcaaaaatcctaaaaatgtacaaacagcacctggtactttcaaaacatccgaaggagaagtaggagctatagcattagattttaaacccggcacgtcaggatcgccgatagttaatagggaaggtaaaatagtcggtctttatggaaatggagtagtaactactagcggtacctatgtatcggccattgctcaggcaaaggcatcacaggagggtcccctacctgaaattgaggatgaagtatttagaaaaagaaatctaaccattatggacttacatccgggcagtggcaaaacacgcagatatttacctgctatagttcgtgaagcaataaaacggaaacttcgaactttaattttagcacccacgagagttgtagcatctgaaatggctgaggcattaaaaggtatgcctattaggtaccaaactacggctgtaaagtcagaacatactggtaaagaaattgtggatttaatgtgtcacgcaacgtttacgatgcgtttgttatcaccagtacgagtcccaaactataatatgattattatggacgaagcacacttcacagatcctagcagtatagccgctagaggatatatctctacaagagtaggtatgggcgaagctgcagctatctttatgacggcaaccccgccaggaagtgtcgaagccttcccgcaaagtaatgcggtaattcaagatgaagaaagagatatcccagagcgttcttggaactcaggctacgaatggataacagattttccagggaaaacagtttggtttgtaccttccattaaaagcggtaatgacatagctaattgcttacgtaaaaatggaaagagggttatacaattaagtcgaaaaacctttgacaccgagtaccagaaaactaaaaataatgattgggactacgtagttacaacagacatcagtgagatgggggcaaattttagagcggaccgcgtaatagatcccagaagatgtctgaagcccgtaatattaaaggatggtcccgaacgtgtaattttagcaggacccatgccggtcactgtagcttcagccgcgcagcgacgaggtagaataggccgcaaccataacaaagaaggggatcagtatatctacatgggtcaaccgttaaataacgatgaagatcacgcccactggactgaggcaaaaatgttattggataacattaatactcccgaaggcataattccagcccttttcgaacccgaaagagaaaaatcggctgcaatagatggagaatacagattgagaggggaagccagaaagacgtttgtagagctgatgcgacgaggcgatttgcctgtgtggctatcctacaaagtagctagtgagggcttccaatacagtgacagaaggtggtgttttgatggggaaagaaataatcaagtgttggaagaaaacatggatgtagaaatttggactaaagaaggagaaaggaagaaattgagaccacgatggttagatgccagaacgtatagtgatccattagcactaagagagttcaaagaatttgctgctggaagaagaagcgttagtggcgatctgattctagaaatcggaaagctgccacagcacctaacgcaaagagcacaaaatgcacttgataacttggtaatgttacataatagcgagcaaggaggtagagcatacagacatgccatggaagaattacccgacaccattgagactctgatgctattagcattaatagcagtgttaacgggtggagtcacgttattctttttatcagggagaggcttaggcaagaccagtattggtttgttatgtgtaatggcatcaagcgtcttattatggatggcaagcgttgagccgcactggatagcagcatcgataatattagagttcttcttaatggtcttactcattccagagcctgatcgacaacggactccacaagacaaccaattagcttatgtagtgataggtctattgttcatgattctgacagtggcagcaaacgaaatggggctgttagagacaaccaagaaagaccttggtataggacatgtagcagtagagaaccaccatcacgccgcaatgcttgatgtagatctgcatccagcctcggcatggacattatacgccgtcgccaccacaattattactccaatgatgagacatactattgaaaacaccacagctaacatttctctaacagctattgcgaatcaagcagcaatactaatgggtctagacaagggttggcccattagtaaaatggatattggggtacctctattagcactgggatgttattctcaagtcaacccgctaactcttacagcagcagtgttaatgctagttgcacattatgctatcattggaccaggcttgcaggcgaaagcgacaagggaagcacagaaaaggacggctgcaggtattatgaaaaatcctaccgtagatggtatagtggccatagacttggaccctgtagtgtacgatgcaaagtttgaaaaacagcttggtcagataatgctgctaatcttatgtacgtcgcaaattctcctcatgcgaacgacgtgggctttatgtgaatcaataacgctagctactggccctttaactactctatgggaaggatcaccagggaaattttggaatacgaccatcgcggtatcaatggcaaatatcttcagaggttcttatttggccggcgctgggttggcatttagcctcatgaagtcacttggagggggaaggagggggacaggcgcacaaggcgaaacccttggcgaaaaatggaaacggcaattaaatcaactttcaaagagcgagttcaacacgtacaagcgttctggtataatggaggtcgacagaagtgaggctaaggaaggattaaagcgcggagaaaccactaagcacgccgtatctagagggacggctaaattacgctggttcgtagagcgtaacttcgtaaagcccgaaggtaaagtaattgacctaggctgtggacgtgggggatggagttattactgtgctgggttgaagaaagtaacagaagttaaaggatatacgaaaggtgggcctggacacgaagaaccaattcccatggcaacatatggctggaatctagttaaattacacagcggcaaagacgtattctttataccgccagaaaaatgtgatacattattatgcgatattggagaatcttctcctaatccaacaattgaagagggcagaactttaagagtactcaaaatggtagaaccatggcttcgaggaaaccaattctgtataaaaattctaaacccatacatgccaagcgtagttgaaacattagagaggatgcaacgtaaacacggcggaatgctcgtgaggaatcctctatcccgtaacagtacccacgaaatgtattgggtaagctgcggtacgggtaatatcgtaagtgctgtcaacatgacttcgaggatgcttttgaatcggttcacgatggcccatagaaagccaacatatgaaagagatgttgacttaggagcagggacaagacatgtagcagtggagccagaggttgcaaatttagacatcataggccaaagaattgaaaacattaaacatgaacataaactaacgtggcactatgacgaagataacccttacaaaacttgggcgtaccatggttcttacgaggtgaaaccatctggatcagcatcatcgatggtcaacggcgttgttaaattacttaccaaaccatgggacgttatacctatggtgacacaaattgcaatgacagatacaacacccttcggtcaacaaagggtcttcaaagaaaaggtagatacaagaacaccaaaagcaaaacgaggcaccgcacagataatggaagtaacggctaaatggttatgggggtttttgagtaggaacaaaaagccccgtatctgcactagagaagaatttactagaaaagtaaggtctaacgcggcaatcggcgcagtattcgtcgacgagaatcagtggaacagtgccaaagaagccgtagaagatgagagattctgggaccttgttcacagagagagggaactgcacaaacagggcaaatgcgctacgtgcgtctacaacatgatggggaaaagagagaagaaacttggagagttcgggaaagcgaaagggtctagagcaatctggtacatgtggttaggggccagatttctagagttcgaggctttggggtttatgaatgaagaccactggttttcccgcgaaaattcgttgtcaggggtggaaggggaaggccttcataagttagggtacatattgagggacattagcaagattccagggggcaatatgtatgcggatgacacagcaggttgggatactaggatcaccgaagacgatctccagaacgaggcaaagatcaccgacattatggaaccagaacatgctcttttagccaaatcgatattcaagctcacatatcaaaacaaggtggtaagagtgcaaagaccggctaaaaacggaaccgtaatggacgtcatctcacgacgtgaccaacgaggaagtggacaggtaggaacttatggacttaacacctttaccaacatggaagctcagttaattagacagatggaaagtgaagggatcttcagcccttcagaactagaaacgccaaacttggccggacgcgtccttgactggcttgaaaagcacggtgttgaaagattaaaaaggatggcaataagcggtgatgactgtgtagttaaaccaatcgatgatcgatttgcaacggctcttactgcacttaacgatatgggtaaagtcagaaaagacatccctcaatgggaaccgtctaagggttggaacgactggcaacaagttcccttttgcagccaccattttcatcaacttatcatgaaggacggcagagaaatagtagtcccatgcaggaatcaagacgagttggtcggaagggctagggtttctcaaggcgcgggatggtcattaagagaaacagcttgtctaggtaagtcatacgcacagatgtggcaactaatgtactttcacagaagagatttaaggctagcagccaatgctatatgttcagccgtaccggtagattgggtcccaacgtcacgtactacctggtcaatacatgcccaccaccaatggatgaccacggaagatatgttaagcgtatggaatcgggtttggatagaggagaacccctggatggaagataagacgcacatatcctcatggggagacgttccatacttggggaagagggaagaccaatggtgtggctctttgattggattaacagctagagcgacttgggcgacgaatattcaagtagcgattaaccaagtacgacgtttaattggcaacgaaaactacctagactacatgacttcgatgaaacgcttcaaaaacgaatctgatcctgaaggagcgttgtggtag

SEQ ID NO: 21769 - RNA, 9879 nt, synthetic construct
  misc_feature 1..9879: note = derived and/or modified CDS sequence (opt6) from DENV-1__FJ898427__SS-prME
  source 1..9879: mol_type = other RNA
tcggttacaatgcttttgatgttaatgccgactgccctggctttccacctaacaactagaggaggagaacctcacatgattgtcacgaaacaagaaagaggtaaaagcctgttgttcaaaacttctgcaggagtgaatatgtgcacactaatagcgatggacctcggggaactttgtgaagacactatgacatacaaatgtcccagaatcacagaagcagagccagacgacgtcgactgctggtgtaatgcaacagatacttgggtcacctacggaacttgttcccaaaccggtgaacaccgcagagacaaaagatcagttgcattggcacctcatgtgggtcttggattggaaacaagaactgaaacatggatgtcgtccgagggagcatggaagcaaatacaaagagtggagacatgggcactcagacatcccggatttacagtgatagcgctgtttctggcgcatgccataggaaccagtattactcaaaaaggaataatatttatattgttgatgttggttacgccttctatggccatgagatgcgttggaatcggttcgcgagacttcgtggaaggattatccggagcaacttgggttgacgtagtcttggaacatggttcatgtgttactacaatggcaaaagacaagccaactctggatattgagttactaaaaacggaagtaacaaatccggcggttttgagaaagctatgtatagaggcgaaaatatcaaacacaaccactgactctagatgtccgactcaaggtgaagctacactcatggaagaacaagacgcaaacttcgtatgtcgacgaacttttgtggaccgcggatggggaaatggatgtggactatttggtaaaggaagtctcataacatgtgcaaaatttaagtgtgtaactaagttagaaggtaaaatagtacaatatgagaatttgaagtactcagtgatcgttactgtacatacaggggatcaacatcaagttggtaacgaatcaactgaacacggaactacagctactattacgccacaagccccgacaagcgagatacaactcacagattacggtgcgttaaccctagactgtagccccagaacaggtcttgatttcaacgaaatggttttattaacaatgaaagaaaaatcttggttggtacataaacaatggttcttagacttgccattaccatggacctcaggcgcctctacctcacaagaaacttggaatcgacaagacctattagtaactttcaagacggcacatgcaaagaaacaagaagtggttgtcttgggctcacaagagggagcgatgcataccgctcttacgggcgccacagagattcaaacatcgggaacgactactattttcgctgggcacctgaaatgccgacttaaaatggataaactaacgcttaaaggcatgagttatgttatgtgtactgggtcgtttaaattagaaaaagaagtggctgaaacacagcatggaacagttctcgtgcaaataaaatatgaaggaaccgacgcgccatgcaaaataccgttttctacccaagacgaaaaaggggtgacacaaaatgggcgcttaataactgctaatcctatagtaactgataaagaaaaaccagtgaacatcgaagcagaaccaccgttcggcgagagctatattgtaattggtgcgggggagaaggcccttaaactaagttggttcaagaaagggtcatcaataggaaaaatgtttgaggcaacagcccgaggagcaaggagaatggcaatcctgggtgacaccgcttgggattttggaagtgtagggggagttttcacaagtgttggtaagctagtgcatcaaatctttggaacagcgtacggagtactattcagcggagtttcatggactatgaaaataggaatcggagtgttattgacatggctagggttaaatagtagatccacatccctaagcatgacatgtatcgcagtgggtttagttacactgtacttaggagtcatggtgcaagcagatagcggttgtgttattaattggaaggggagagaattaaagtgcggttcagggatattcgtaacaaatgaagtacacacatggacagagcagtacaagtttcaagcggattctccgaagaggttaagtgcggcgataggaaaggcatgggaagaaggagtgtgcggaattaggtcggcaaccagacttgagaacataatgtggaaacaaatcagtaatgaattgaaccatattttattagaaaatgatatgaaattcacagtcgtagtaggcgacgtcgtgggaatactcgcccaaggcaagaaaatgatacgtccacaacccatggaacataaatacagctggaaatcatggggcaaggcaaaaatcatcggcgcagacgtccagaatacaacttttatcattgatggccctaatactccagaatgccctgacgaccagcgagcatggaacatatgggaagtcgaagattacggatttggaatctttacgacaaacatttggttaaaattacgagactcctatacccaagtatgtgatcaccgacttatgtctgcggctataaaagacagcaaagcagtgcatgcggacatgggttattggatcgagagcgagaaaaatgaaacttggaagttggcgagggcctcttttatagaagttaaaacgtgcatatggccaaagtcacatacattatggtcgaatggagtcttagaaagcgaaatgataatacctaagatatacggcggcccaatatctcaacataactataggccagggtactttacacaaacagcagggccctggcatttaggcaaactcgaactagatttcgacctatgtgaaggcactactgtcgttgtagacgagcactgtgggaaccggggtcctagtttgaggactactacagtcacaggtaaaataatacatgaatggtgctgtagaagttgtacacttccaccacttagatttaaaggagaagacggttgctggtatggcatggaaatacgtcccgtaaaagaaaaggaagagaacctagtgaaatctatggtaagcgcaggaagcggagaagtggattcgttttcattgggtttgttgtgcatctcaataatgattgaagaagtaatgagaagtagatggagtaggaaaatgttgatgacgggaacattagccgtttttctcctactaataatgggacaattgacttggaacgacctaatcagattatgtattatggtaggagccaacgcaagtgaccgaatgggaatgggtactacctacttggctttaatggcaacctttaaaatgagacctatgtttgcggtcggattattattccgtagactaacttcacgtgaagtattattactgactatcggtctcagtttagttgcatctgttgaactcccaaattctctcgaagaattaggagacggtctagcaatgggaattatgatattaaaattactaaccgatttccaatcacatcaattatgggccacactattatccttgacatttatcaaaaccacgctatctctacactgcgcttggaagacgatggcaatggtgctttcaatagcctctctattcccgttatgtcttagcacgacctcgcagaaaactacatggcttccggttttactgggctcattaggctgcaaacccctgacaatgtttctaattactgaaacaaagatatgggggagaaaatcctggccattaaatgaaggtataatggctgttggtgtagtctcgatacttcttagtagtttgcttaaaaatgatgtccctcttgccggcccactcatagccggtgggatgttaatagcatgctatgttatatcaggaagctccgcggatctgtcactagagaaagctgctgaagtttcttgggaagaagaagctgagcactctggtgctagtcataatattcttgttgtggttcaggatgatgggacaatgaaaataaaggatgaagaaagagacgacacattaactatccttctaaaagcaacattattagcagtatcaggagtctacccactgagtataccggcaacattgttcgtctggtatttttggcagaaaaagaaacaaaggagcggcgtactgtgggatacaccaagtcctcccgaagttgagcgagccgtcctggatgatggaatttacagaataatgcaaagaggattattaggacggtcacaggtcggagtcggcgttttccaggagaacgtattccatacaatgtggcacgtgacaagaggggcggtgttgatgtatcaagggaaacggctagaacctagctgggcttcggtgaagaaagacctcattagttacgggggagggtggagattacaaggatcatggaacactggggaagaagtacaggttatagctgtggaacccggcaaaaatcctaaaaatgttcaaactgcgccaggaacctttaaaactccagaaggggaagtaggagcgatagcactggatttcaaaccaggaacatcaggaagccctatagttaatcgcgaagggaaaatagtaggtctctacggaaatggggtagtcacaacatcaggcacgtatgtgagcgcaatagctcaagcgaaagccagccaggaaggaccactaccggaaattgaggatgaggtattccgcaagcgaaatttaactataatggatttacatccaggcagcggaaagacacgcaggtatttacccgccatagttagggaggcgattaaaagaaaattacggacacttattttggcaccaacacgtgttgtggcgtcagaaatggctgaagcactgaagggaatgccaataagatatcaaacgacggcagtcaagtctgaacacacaggtaaagaaattgtagacttaatgtgccacgcaacttttaccatgcgtctactatcacccgtaagagtaccgaattacaacatgataataatggatgaagcgcattttacagacccatcgagtatagcggcaagaggctatattagtacccgagtagggatgggagaggccgcagctatctttatgacggccactccgccaggtagtgtagaggcattcccgcaatcgaatgcagtaatacaggatgaagaacgtgatatacccgaacgatcgtggaatagtggttatgagtggataacggatttccctgggaagactgtatggtttgttccaagtattaaatcaggcaatgatatcgcaaattgtctgaggaagaatggaaagcgcgttattcagctatcaagaaaaacattcgatacagaatatcagaagactaagaataatgactgggattatgttgtaacgaccgatatttccgagatgggagcaaactttcgcgctgatagagtaatagatcctagaaggtgcttgaaaccggttatactaaaggatggacccgaaagagtgatcctggctgggccgatgcctgtaactgttgcctcagccgcgcaacgaagaggaaggataggacgcaatcataataaagagggagaccaatatatatatatgggtcaacctttgaacaatgatgaggaccacgcgcattggacagaagccaaaatgcttcttgacaacatcaacactccggaaggcataatacctgcgcttttcgaaccggaaagagaaaaatcggcggctattgacggagagtatcgtttacgaggagaagcaaggaagacatttgttgaactaatgcgccgaggtgacttaccggtttggttatcctacaaagtagcttcggagggcttccaatacagtgataggcggtggtgttttgatggtgagaggaataaccaggttttagaagagaatatggacgtagaaatatggacaaaagagggtgagaggaagaaactacgacctcgatggttggatgctagaacgtatagtgacccacttgctttacgggagtttaaagaatttgcagctgggagacgaagcgtatctggggatttaattttagaaattggtaaactgccgcaacatctcactcaaagagctcaaaatgcactagataacttagtaatgttgcataactccgaacaaggagggagggcttatcggcacgctatggaagaattgcctgacacgatagaaacactcatgctactcgcgttaattgccgttttaactggcggggtgacgttattctttttatctggccgagggttagggaaaacatcgataggtctactatgtgttatggcatcctcggtcttattgtggatggcatcggtagaaccacactggatagctgccagtataatactagaatttttcctaatggtattgttgataccagaaccggatcgacaaaggaccccgcaagataatcaactcgcgtatgttgttataggacttttatttatgatattgacagttgccgcaaatgaaatggggctgctagaaaccactaagaaagacttagggataggtcacgtagcagtagaaaatcaccaccacgctacgatgctcgatgttgatctgcatccagcttctgcatggacgctatatgcagttgcaactactataataactccaatgatgaggcacacaatagagaacactaccgcgaatatatccctaactgccatcgcaaatcaagccgcaattctaatgggtctggacaaaggctggcccattagcaaaatggatataggcgtaccactattggctctaggatgctattcacaagtaaatccactaacactgactgccgccgttttaatgcttgtagcccattatgcaataataggaccaggactgcaagctaaagctaccagagaagctcagaaaagaactgcagccgggattatgaaaaatccgaccgtagatggtatagtagcaattgatctagatccagtagtatacgatgcaaagttcgagaaacaattaggacaaataatgctcttgatactatgcacaagtcagatattactaatgcgcactacatgggcactttgtgagtccattactcttgcgactgggcccttaacaacattatgggagggatcgccagggaagttctggaacactacgatagcagtaagtatggctaatattttccgaggttcctatttagcgggagcagggcttgctttctcacttatgaaatccttaggcggcgggagacgtggaactggtgctcaaggagaaacactgggtgagaaatggaagcgtcaactgaatcaactatctaaaagtgagtttaacatttacaaacgtagcggaataatggaagtagatcgatcagaggctaaagaaggtttaaaaagaggagaaactacacgacatgcagtatcgcgtggtactgctaagctaagatggtttgtcgagagaaacctagttaaacctgagggtaaagtaatagaccttggctgtggacgaggaggttggagctattattgtgcaggtcttaagaaagtaacggaagtgaaaggttatacaaagggtggtcctggtcatgaggaaccaataccaatggcaacatacggttggaacctagtgaagctacacagtggtaaagatgtattctttactcctcccgaaaaatgtgatactctgctttgtgacataggagaaagcagcccaaacccaactatcgaggagggccgaactctccgagtcttaaaaatggttgaaccatggttgcgcgggaatcaattttgtataaaaatacttaacccatacatgccgagtgtagtagagacattagagcaaatgcaaagaaagcatggaggcatgttagtacgtaatcccttaagcagaaattctacacatgagatgtattgggttagttgtggaacgggaaacattgtttcagcagtaaacatgacaagtagaatgttattgaaccgatttacaatggcacatagaaaaccaacatacgagcgagatgtagacctcggagcagggactagacatgttgcggttgaaccagaagtagcgaatctggatattataggtcaaaggattgaaaatattaaacatgaacataaaagcacctggcattatgacgaagataacccatataaaacttgggcgtatcatggttcatacgaagttaagccaagtgggagtgcctcatcaatggtgaatggcgtcgtaaaacttcttactaaaccgtgggacgtaataccaatggttacacaaattgccatgacagatacgactccgtttgggcaacaacgcgtctttaaagaaaaagttgatactagaacaccaaaagcgaagagagggaccgctcaaattatggaagtaaccgccagatggttatggggatttctatcgcggaataagaaaccgaggatatgtactagggaagagttcacacgcaaggtgagaagtaatgcagcaattggcgcagtcttcgttgacgaaaatcaatggaactcagcgaaagaagcagtagaagatgaacgattttgggatttagtacaaaaagaaagagagctccataaacagggaaaatgcgcaacttgtgtgtataatatgatgggcaaaagagagaaaaagttaggagaatttgggaaagcaaaaggctctagagcgatatggtacatgtggcttggagctcgattccttgagttcgaggctttgggcttcatgaatgaggatcattggttctcacgcgagaacagtttatcaggtgttgagggcgaagggcttcacaagttaggatatatattaagggatataagcaaaattcccggaggcaatatgtatgctgatgatacggccggatgggatacaagaatcactgaagacgacttacaaaacgaagctaagataacagatattatggaacccgagcacgcactactcgcgacgtcaatattcaaactaacataccaaaacaaagtagtcagagtccaaagaccagctaaaaacggaacagtaatggatgttataagtagacgagaccaaaggggtagtggtcaagtggggacatatggtctgaatacattcacaaacatggaggcacagttaattaggcaaatggaatctgaaggcatattcctaccaagtgaattggaaacaccaaatttagctgagagggtcttggattggttggagaaatatggagtagaaagacttaaaaggatggcgataagtggcgacgactgcgtagtaaagcctatagatgaccggttcgcaacagctcttacagcgttaaacgacatgggaaaagtgagaaaagatattcctcaatgggagccaagtaaaggatggaatgattggcagcaagttcccttttgctcacaccattttcatcaattaatcatgaaagacggcagagaaatagttgtgccgtgtcgaaaccaagatgagctagtcggcagagcaagagtgagccaaggagccggatggagtctaagggaaacagcatgtttaggaaaatcctatgctcaaatgtggcaactgatgtatttccatagaagggatcttcgactggcggcgaatgcaatatgtagtgctgtaccagtagactgggtaccaactagccggacaacctggtcgattcatgcgcatcaccaatggatgaccacagaagatatgttaagtgtatggaatagggtttggatcgaagaaaacccatggatggaagataagacccatgtatcaagctggggtgatgtaccctatctcggtaagagagaggaccaatggtgcggaagtttaattggtctaacggcccgagcaacctgggcaagtaacatacaggtagctattaatcaagtacgacgtttgataggaaatgagaattatttagactatatgacaagcatgaaaaggttcaaaaatgagggagatcccgaaggcgcattgtggtaa

SEQ ID NO: 21770 - RNA, 9879 nt, synthetic construct
  misc_feature 1..9879: note = derived and/or modified CDS sequence (opt6) from DENV-1__JF937599__SS-prME
  source 1..9879: mol_type = other RNA
agcgttaccatgttgctcatgctaatgcccactgccctggcttttcacttaacggcaagagggggtgaaccacatatgatagttagcaaacaagaaagaggaaaatcgttattattcaaaacttcggccggtgttaatatgtgtacgctgatagcaatggatttaggcgaattttgtgaagatacgatgacatataaatgccctagaattaccgaagctgaacccgacgatgtggactgctggtgcaatgcaacagatacatgggttacctatgggacatgctcgcaaacaggagaacatcgacgcgacaaacggagcgttgcgctggcaccccatgtaggattgggcttggaaaccagaactgaaacatggatgagtagcgaaggtgcatggaaacagattcaacgtgtagaaacttgggcacttcgacatcctgggttcaccgtgattgcgctctttttagcacacgccattgggacatcaataacacaaaaaggtattattttcatattactgatgttagtcactccttctatggcaatgagatgtgttgggataggaagccgtgattttgttgaaggattgagcggagcaacatgggtagacgtagtcctcgaacatggatcatgcgtaacaaccatggctaaagataaacccacacttgacatagaactgttgaaaaccgaagtcacaaatccagccgtcctccgcaaattatgtatagaagctaaaatttctaatacaacaacagactctagatgcccgactcaaggagaagcaacattagtggaggaacaggatgccaactttgtatgtcgaagaacgtttgtagataggggatggggtaatggctgtggtctttttggaaaaggtagcttaattacttgcgctaaatttaaatgcgtaacaaaactggaggggaaaatagtgcaatacgaaaacctgaaatattcagttatagtgacagtgcatacaggcgatcaacatcaggtgggtaatgaatcaacagagcatggcacaacagctacaatcacgcctcaagcaccatcgacagaaattcaacttactgactatggagcactaactcttgattgtagtccacgaaccggtttggattttaatgaaatggtccttctaacgatgaaggagaaaagttggttagtgcataagcagtggtttctagacttgccattaccatggacgtctggtgcaagcacatcgcaagaaacctggaaccgtcaagatttgctcgtaacctttaaaactgcacatgcaaagaaacaagaagtagtcgttcttggatcacaagaaggagcgatgcacactgcattaacaggagcgacggaggtgcaaacaagcggaaccactacgatatttgctgggcaccttaaatgtcgattgaaaatggacaaattgactctaaaaggtatgtcctatgtgatgtgtactggttcatttaaacttgaaaaagaagttgccgaaactcaacatggaaccgtgttggtccaaatcaagtatgaaggaaccgacgcaccatgtaaaataccttttagtacccaagacgaaaaaggtgttacccaaaacggtcggttaataacagccaatccgatagttacggacaaagaaaaacccgtaaatatagaagcagaaccgccttttggggagtcttatattgtcattggagcaggagaaaaggctttgaagttgtcttggttcaagaaagggtcttcaattggaaaaatgtttgaggccactgcgagaggggcacgaagaatggcgatcctcggtgacacggcttgggatttcggaagcattggaggcgttttcacatctgtcgggaagttagtgcaccaaatattcgggacggcatatggagtgctattttcgggagtttcctggacaatgaaaataggtattggggtgttattgacatggttgggtttaaatagtagatcaacatcactgtctatgacttgtattgcagtcggcctcgtaactctatacctaggagttatggtgcaagccgatagtggctgcgttataaattggaaaggtagggagctaaaatgtggctccggaatattcgtcacaaatgaagtgcacacttggactgaacaatataaatttcaagcggactcgccaaaaaggctatctgcagcgataggaaaagcatgggaagaaggggtttgtggaatcagaagcgctacgcgtctcgagaatataatgtggaaacagataagcaatgaactaaatcacatactgctagaaaatgacatgaagctaacagtcgttgttggagatgtagcgggcatactggcacaaggcaagaaaatgataagaccacaacctatggaatacaaatacagttggaaaagctggggcaaagcaaagattataggagctgacgtacaaaatacaactttcataatagatggtcccaatacaccagaatgcccggatgaccaacgtgcatggaatatatgggaagttgaggactatggttttgggatctttacaacaaacatttggctaaaattgagagactcatatacacaagtatgtgatcatcggctgatgtctgctgcgataaaagattcaaaggcggtccatgcagatatgggatattggattgagagcgaaaagaatgaaacatggaaactagctcgtgcatcttttatagaggtcaagacgtgcatatggcctaaatcgcacaccctctggagcaacggtgtgctagagtcagaaatgataattcctaaaatttatggaggaccaataagccaacataactacagaccaggctatttcacacagacagccggaccatggcatttgggaaaattagaactagactttgacctatgtgaaggaactactgtagtggtagatgaacactgtggtaatcgcggaccctcgttacgaactactaccgtaacaggcaaaatcatacacgaatggtgttgccggagttgcacactgcctccactaaggttcaaaggagaagacggatgttggtacggaatggaaataagacctgtcaaggaaaaggaagaaaatttagtcaaaagcatggttagcgcaggtagtggtgaagtcgacagtttcagcctagggttactttgtataagtataatgatcgaggaagtaatgcggagtcggtggagtagaaaaatgttaatgaccgggacactagctgtatttttcttgttgataatgggacaactaacctggaatgatttgatccgcttatgcataatggtgggtgcaaatgcaagtgataggatgggaatggggactacatatttagcccttatggctacattcaaaatgagacccatgtttgctgttgggttactatttagaaggttaacctcaagagaagttttactccttacgatagggctcagtctagtggcgagtgttgagttgccaaattctcttgaagaattaggtgatggacttgctatgggaatcatgatattaaagctattaactgacttccaatcacatcaactatgggcaacgcttctctcattaacattcataagaactacctttagcttacactatgcttggaaaacaatggctatggtactaagcatagtatcacttttccccttatgcctatccacgacctctcagaaaacgacatggcttccagttctcttaggaagtctgggatgtaagcctttgacaatgttcctgattgctgaaaacaaaatttgggggcgaaagagctggccattgaacgaaggaattatggcagtaggaatcgtgagtatacttttgtcttctttgttaaagaacgatgtaccccttgctggccctttaatcgcaggaggaatgctaatagcatgttatgtcattagtggttcgtctgctgacttgagcttggagaaggcggcagaagtaagttgggaggaagaggcggagcattctggtgccagtcacaacatcttagtagaggtgcaagatgacggaactatgaaaattaaagatgaagaacgcgacgatacattaactatattattaaaagcaaccctgttagcggtatcgggtgtatacccactatcaatcccagctacgttatttgtctggtacttttggcagaagaagaaacaacggagtggcgttttatgggatacaccttcacctcccgaggtggagagagcagtacttgacgacggcatttacagaattatgcaaaggggtttattaggccgaagtcaagttggtgtcggagtttttcaggagaatgtcttccatacaatgtggcacgtcaccagaggagcggtcttaatgtatcaaggaaagcgattggaaccttcatgggcttcagttaagaaagacttgataagttatggcggtggttggagattacaaggatcgtggaatacaggtgaagaagtacaagttatagcagtcgaacccggaaagaatccgaaaaatgtccaaacggcgccaggaacctttaagacaagcgaaggagaggtcggagccatcgctttggatttcaagccgggaacaagtgggagccctatagttaatcgagaagggaagatcgttggcttatacggtaatggagtagtaacgacatcaggaacttacgtcagcgcaatagcacaagcaaaagcctctcaagagggaccactacctgagatagaagatgaggttttcaggaaaagaaatcttacaattatggacctacatccgggatcgggcaaaacccgtcgctatcttccagccattgttagagaagctatcaaaagaagactcagaactcttatcttagccccaacaagagttgtcgcgtcggagatggcagaagcattgaaaggaatgccaattagataccaaacaacggcggtcaaatctgaacacacaggaaaagaaatagtcgatttaatgtgtcatgcaacctttacaatgcggttgttgtcacctgttcgggtccctaattataacatgataatcatggacgaagcgcactttactgacccgagttccatcgcagccagaggttacatttccacgagggttgggatgggcgaagcagccgctatcttcatgacagccaccccaccgggatccgtagaagcattcccacaatccaacgcagttatacaggacgaagaaagagatataccagaacgttcgtggaactctggctacgaatggataactgatttccccggaaaaactgtatggtttgtcccctcgataaagtcagggaacgatatagccaattgcttgaggaaaaacgggaaaagagttatacagttatcacgtaagacttttgacaccgagtatcaaaagacgaaaaacaacgactgggattatgttgtaaccactgacataagcgaaatgggagctaactttagagccgatagagtcatcgaccctagacgatgtcttaaacctgtaattttaaaagatggccccgagagagttattttagccggaccaatgcccgtaacagttgcaagtgctgcgcaaagaagaggaagaatcggacgtaaccacaacaaggaaggtgaccaatatatatatatgggccagccactaaacaatgacgaagatcatgcccattggacggaagctaaaatgctactggacaatatcaatactccggaaggaattataccagcactcttcgagcctgaaagggagaagagtgcagccattgatggtgaatatcgactgagaggggaagccagaaaaacctttgtcgagttaatgcgacgtggtgacctaccggtttggttgagttataaagtcgcaagtgagggatttcaatactccgaccggagatggtgttttgacggagaacgtaacaaccaagttttagaagagaacatggacgtagaaatatggactaaagaaggggaacgaaagaaactcaggccaagatggttggatgcaagaacctactcagatccattagcactccgtgaatttaaggagttcgcagctggaagacgttcagtaagtggggacttaattttagaaataggtaaattgccccagcatttaacccaaagggcacagaatgcattggataatcttgtgatgctacacaatagtgaacaaggaggtagagcatatcgccatgcaatggaagagttgccagatacaattgagacactaatgctattagcacttattgctgttctaacaggaggggtgactttatttttcttatccggaaggggattaggaaaaacatccattggtctactatgcgtcatggcaagcagtgttttattatggatggcctctgtcgagccacactggattgccgcatcgataattctcgagttctttcttatggtcctactgattccggaaccagatcgacaaaggaccccgcaagataaccaattagcctatgtagtaataggcttattgttcatgatattgacagtagcggcaaatgaaatgggacttttggaaaccaccaagaaagacttaggcatcggccacgtagcagtagaaaatcatcatcatgctgcaatgcttgacgtcgacctacaccctgcatcagcttggacactttatgctgtagctactacaatcataacgccaatgatgagacatacaattgaaaataccaccgccaatataagtcttaccgccattgcaaatcaagcggctatcttgatgggtttagataaaggctggccaatctcgaaaatggacattggcgtaccgttacttgccttgggctgttactcacaagtcaatcccctaaccttgacagcggctgtgctaatgctagtcgcacattatgcgattatagggcctggactccaagctaaggccactcgagaagctcaaaaacgaactgctgcaggaatcatgaaaaatcccacagtcgatggaattgtggctatagatttagatccagttgtatacgacgcaaaatttgaaaaacagttagggcaaatcatgttgctaatattatgtactagccagatattactaatgagaacgacatgggcactatgcgaatcaatcactttagctaccggtcctttaactactctctgggaaggctcgccggggaagttctggaatacgacaatagctgtctcaatggctaatatattcagggggtcatatttagcaggagccggattagctttttccctaatgaaaagtttaggagggggcagaagaggaacaggtgcacaaggggagactttaggtgaaaaatggaaacgacaactcaatcaattatccaaacctgagtttaacacatataaaaggagcggaataatggaagttgatcgtagtgaagccaaggaaggcttaaaacgtggtgaaacaaccaaacacgcggtatctagaggtacagctaaactgcggtggttcgtagagcggaacttggtaaagcctgagggaaaagtcatagatttgggttgcggtcggggtggctggagctattactgtgctggactaaagaaagtaacggaagttaaagggtacaccaaaggaggtcccggccacgaggaaccaattccaatggccacttatggatggaacctagtaaaactacactctggaaaagacgtatttttcataccgccagagaaatgtgatacgttgctttgtgatattggagagagcagccctaatccaacgattgaagaggggcgtactttgagggtactgaagatggtagaaccatggttaaggggtaatcaattttgtattaaaattttaaatccctacatgccatcagttgtggaaactctggaacaaatgcagagaaaacacggaggcatgctagtaagaaatccactatcacgtaactcaacacacgagatgtattgggtatcttgtggaacaggtaatatagtatccgctgtcaatatgacgagtcggatgctactaaacaggttcacaatggctcaccgcaaacccacgtatgaaagggacgttgatctaggagctggaacacgtcacgttgcagtagaacccgaagtagcaaatttagatataataggacagcgcatcgaaaatattaaacacgaacacaagtcaacttggcactacgatgaggataacccatacaaaacatgggcttatcatgggtcttatgaggttaaacctagtggaagcgcgagttctatggttaacggagtagttaaactactcacaaaaccttgggatgtaatacctatggtgactcaaatagctatgactgacacaacacctttcggacaacaaagagtattcaaagaaaaagttgacacaagaactcctaaagcaaaaaggggtacagctcagataatggaagtgacagctaaatggttatggggatttttaagtagaaacaagaaaccacgcatatgtacacgcgaagagttcacaagaaaagtacgcagcaacgcggcgataggggctgtatttgtagatgaaaaccagtggaactcagcaaaggaagcggttgaagatgaacgcttctgggacctagtacatagagaacgtgaattgcacaagcaaggaaaatgcgctacatgtgtatacaacatgatgggaaagagggagaagaaacttggggaatttgggaaagctaaaggctcaagagcgatttggtatatgtggctcggcgcaagatttttagaatttgaagctctaggctttatgaatgaagaccattggttctcccgtgaaaactcgctctccggtgtagaaggagaggggttacacaaattgggttacatcctacgtgacatctcaaaaattccaggtggaaatatgtatgccgacgacacagctgggtgggacacgaggataactgaagatgatctgcagaatgaggccaaaataactgatataatggagccagaacacgctttacttgccaagagtatattcaagttaacataccaaaataaagttgtaagagttcagcgccctgccaaaaatggaacggtaatggacgttatatcacggagggaccaaaggggatctggacaagtaggcacttatggattaaatacttttacaaatatggaagctcaactaataaggcagatggaatcagaaggaatattttcaccaagcgaattggaaacgccaaatttagcggggagagtactagattggctagaaaaacacggcgtcgaacgacttaagaggatggctataagcggcgatgattgcgtagttaagccaatagacgataggttcgcaacagcgctgacggccctgaacgacatgggcaaagtaaggaaagacataccgcaatgggaaccatcaaaaggctggaacgactggcaacaggtaccattttgttcacaccactttcatcaactgattatgaaagacggtagagaaattgttgtaccttgcaggaatcaagacgaattagtaggacgggcacgggtgtctcaaggcgcagggtggagtctacgtgagacggcgtgcttgggtaaatcatatgctcaaatgtggcaattgatgtacttccatcgtcgagatttacggctcgctgcaaatgcaatctgtagtgccgtccctgtagattgggtacctacatcaagaacaacgtggtccatccatgcacatcatcagtggatgacaactgaggatatgttatccgtatggaacagagtatggatagaagaaaatccctggatggaggacaaaactcatgtaagtagctggggcgacgtaccttatctgggaaaacgagaggatcaatggtgcggtagtcttatcggtttaactgcgcgcgcaacatgggctactaacatccaagtagctattaatcaggttcgaagattacttggaaatgaaaattatttagactatatgacttccatgaaaagatttaaaaacgaaagcgatccggaaggcgctctatggtag

SEQ ID NO: 21771 - RNA, 9879 nt, synthetic construct
  misc_feature 1..9879: note = derived and/or modified CDS sequence (opt6) from DENV-1__FJ898431__SS-prME
  source 1..9879: mol_type = other RNA
tcagtaacaatgttattaatgttaatgccaacggcattagcgttccatctaacgaccaggggaggagaacctcacatgattgtaagtaaacaagaaaggggtaaatcgctactcttcaaaacaagtgcaggcgtaaatatgtgtacattgattgccatggatctaggtgagttctgtgaagacactatgacttataaatgtcccagaataacggaagcggaaccggatgatgtagactgctggtgcaatgctacagacacatgggtgacctatggaacctgtagccaaaccggggaacacaggagagacaaacggtcagtggcgttagcacctcacgtcggcctaggattagaaacacgtacagaaacatggatgtccagtgaaggagcttggaaacaaatacaaagggtggaaacatgggccttacgccatccgggcttcacagtaatagcactatttttagctcacgcaatagggacgtcgataacccagaagggtataatctttatactattaatgttagtaaccccctcaatggctatgagatgcgtaggtattggaagtagagattttgtagaaggtctgagtggggcgacatgggtggacgtcgtgctagaacacggaagctgtgttaccaccatggcaaaagacaaaccaacattagatattgaacttttaaaaactgaagtgacaaatcccgcagtattaaggaaactttgcatagaagcaaaaatatccaataccacgacagattcaagatgtccaactcaaggagaagcgactttggtcgaagaacaagatgcgaattttgtatgccgaagaacattcgttgacaggggttggggaaatggatgcggtctctttggaaagggatctctaattacttgcgcaaaatttaaatgcgtgacaaagctggaaggaaaaacagtacaatatgagaatctaaaatatagtgtaatagttacagtgcacaccggagaccaacatcaagtggggaatgagtcaacagagcacggtactactgcgacgataacaccacaggcccccagtacagaaattcaattgactgactacggtgcgctaacactagactgttctccgcgaaccggcctggattttaacgaaatggtgttattaactatgaaggaaaaatcatggctcgtacacaaacaatggttccttgacttaccgttaccatggacttcgggagcatcaacatcacaagaaacatggaatagaaaggatcttcttgtaacattcaaaactgcacatgcgaaaaagcaagaagtcgtggttttaggttcacaagaaggggcaatgcacacagcattaacaggtgcaactgaaatacaaacttctggaactaccactatatttgcggggcatctgaaatgtagacttaaaatggacaaattaacattaaaaggaatgtcttacgtgatgtgcacgggcagttttaaattagagaaagaagtagcggagactcaacatggtaccgtgcttgtgcaaataaagtatgaaggaacggacgccccttgcaaaatacctttctccacgcaagatgaaaaaggtgtaacacaaaacgggcgattaatcacagccaaccctatagttacagataaagagaagccagttaatattgaagcggaacctccattcggcgagagttatatcgttataggagccggtgaaaaagctcttaaattgtcatggttcaagaaaggaagcagtatagggaaaatgtttgaggcaactgcaagaggagcgaggagaatggcaattttaggagacactgcatgggattttggcagcatagggggcgtgtttacctcagtaggaaaattagttcatcaaatctttggaaccgcctacggtgtgctgttctctggtgtaagttggactatgaagattggaataggggtattactaacatggttaggactaaattcgaggtcaaccagcctctccatgacatgtatagcagtcggattagtaactctgtatctaggggtgatggtacaagcagactcagggtgtgtaattaattggaaaggaagagaattaaaatgcgggtcaggaatattcgtcactaatgaggttcatacctggacagagcagtataagtttcaagcggatagtcccaaaagactatcagcagcgattggtaaggcttgggaagagggggtctgcggtatcaggtcggcgacacgcttagaaaatatcatgtggaaacaaataagcaacgagctcaatcacatattattagaaaacgatatgaaatttactgtggtcgtaggcgacgtcgctggaatattagctcaaggcaagaaaatgataaggccacaacctatggaatataagtatagctggaaaagttggggaaaagcaaaaatcattggcgcagatgtgcaaaacacaacgtttataatcgatggccctaacacgccagaatgtccagacgaccaaagggcttggaatatatgggaagtagaagattatggtttcggcatttttacgacaaatatttggttaaagctaagggattcatacacacaagtatgcgatcacaggctaatgagtgccgcaataaaagatagcaaagcagttcatgcagacatgggttactggatcgaaagtgagaaaaacgaaacttggaaactcgcaagggcgtcatttatagaggtaaagacatgcatatggccaaagagtcatactctctggtctaatggcgttttagaaagtgaaatgatcataccaaaaatttatggaggtccaatatcacaacataattacagaccaggatatttcacccaaacagcagggccatggcacttgggcaaattggaacttgatttcgatctatgcgaaggtacaactgtagtagtggacgaacattgcggaaaccgtggacccagcttgagaacgacaacagtaacaggaaaaatcattcacgaatggtgctgccgatcttgtaccttaccacctttaaggttcaagggggaggatggttgttggtatggtatggagattagacctgttaaggaaaaagaggaaaatcttgtaaaatccatggtaagtgcgggcagtggagaagtcgactctttcagcctcggtttattatgcataagtattatgatcgaagaagttatgcgatccagatggagccgcaaaatgttaatgacaggtactctagctgtcttatttctattaataatggggcagcttacgtggaacgatttaattaggctctgcattatggtcggagcgaacgcctcagaccggatgggtatggggacaacctacttagcgttaatggcaacttttaagatgaggccaatgtttgcggtggggttgctatttaggcgtctaacttcacgagaggtcttattattgacaattggcctcagtttagtggcaagtgtcgaattgcctaactcgctagaagaattgggtgatgggttagccatgggtataatgattcttaaactactcaccgatttccagtcacaccaattgtgggcaacattattatcattaacatttataaagaccacattctcactccactatgcttggaaaaccatggccatggtgctctcgatcgttagtctgtttccactctgtctatcaactacaagtcaaaagactacttggctccccgtactattaggtagtttaggatgtaaacccctaacgatgtttttaatagcagaaaataaaatctggggtcgaaaaagttggcctttaaacgaaggaataatggctgtaggcatagtatccattttactttcaagtctacttaaaaatgacgtgccattagccggaccccttatagctggtgggatgttgatagcatgctatgtaatttcagggagctcggcggacttaagtctagagaaagccgcggaagtttcctgggaagaggaagcagaacacagtggcgctagtcataacatcttggtagaagtacaagatgacggaacaatgaaaataaaagatgaagagagagatgataccttaactattctactaaaagccaccctcctggcggtaagtggagtatatccactatccatacctgccactttgttcgtgtggtatttctggcagaaaaagaaacaaagaagcggagtgttatgggatacacccagcccaccggaagttgaaagggcagtattagacgatggaatataccgcataatgcaaagaggcctactaggaagaagtcaagtgggagtaggagttttccaagaaaacgtatttcataccatgtggcacgtgactagaggagccgtcttaatgtaccagggtaagcgactagaaccgtcgtgggcaagtgtgaagaaagacttgatatcctacggtggtggatggagattacagggatcatggaacacaggagaggaagtccaagtaatagcagtcgagccaggcaagaaccctaagaatgtacagacagcccctggtacatttaaaacaagcgaaggggaagttggcgcgatcgcactcgattttaaaccgggaacaagcggatctcctatagtaaaccgtgagggtaaaattgttggattatatggaaacggcgtggtaacaacctcaggaacgtacgtaagtgcgatagcacaggccaaggcaagtcaagagggaccgttaccagaaatagaggatgaagtcttcaggaagagaaatttaaccattatggatttacaccctggtagtggcaaaacgagacgatatttacccgcaatagtaagagaagcaatcaaaagaaaattgcgaacactgatactagcaccgacgagagtcgtggcaagtgaaatggctgaagcattaaaaggaatgcctatacgataccaaacaacagccgtgaaatcagagcacacggggaaggaaatcgtagaccttatgtgtcatgccacttttaccatgcgtcttttgtcaccagtccgagtgcctaattacaatatgataataatggacgaggcacatttcacagatccttcgagtatcgctgcgcgtggttacatttctacaagagtaggcatgggagaagcagccgcaatttttatgacggcgactccacctggttctgtagaagcctttcctcagtcaaacgcggtgatacaagatgaagagagagacataccagaacgaagttggaactccggttacgaatggataactgacttcccaggcaaaacagtgtggtttgtaccaagtataaaatccggaaatgatattgccaattgcctgcgcaaaaacggtaagcgagtcatccaacttagtagaaaaacttttgacactgaataccagaaaaccaaaaataatgattgggattatgttgttacaacagatattagcgaaatgggagctaactttagagccgaccgtgtcatagaccctaggaggtgcttgaaaccagtaatcttaaaagatggaccggaaagagttatattagctgggcccatgcctgtgacagtggcaagtgcagcacaacgacgtggacgtatagggcgtaaccataacaaggaaggagatcaatacatatacatggggcaaccactgaacaatgatgaggaccacgctcattggactgaggcaaaaatgttactagataacattaatacaccagaaggtatcatacctgccttatttgaaccagagagagagaaatcagcagcaatagacggcgagtatagattaagaggggaagcacgaaaaacatttgtagaattgatgagaagaggcgatcttcctgtgtggcttagttacaaagttgcgagtgaagggtttcaatattcagacagaaggtggtgctttgacggggagaggaataaccaagtcttagaagaaaatatggatgtagaaatatggacaaaagaaggagagcgcaagaaattacggccacgttggctcgacgcaaggacatactcggatccgttagcattaagagaatttaaagaatttgcggccggaagacgaagtgttagtggtgacctaatcttggaaataggaaaacttcctcaacatctaacgcaaagggctcaaaacgcattggacaatctcgtgatgcttcataacagcgagcaaggcggcagagcttatcgccacgccatggaagagttgcctgatactatagaaacactcatgctcctagcactaatagcagtactcacagggggtgtaacactattcttccttagtggtagaggcttagggaaaacgtccattggtttactttgtgtcatggcatcatcagtactgttatggatggcatcagttgagccccattggatcgcagcaagcattattctggaatttttcttgatggttttgttaataccagaaccagataggcaaagaacgccccaagacaatcaattagcttacgtggttataggattattatttatgatattaacagtagccgcaaacgaaatggggttattagaaacaacgaagaaagacttgggcataggccatgtggcagtggagaatcatcatcatgctgcaatgttagacgtagacctccatccggcatcggcgtggacactatacgcagtagcaaccacaattataacaccaatgatgaggcataccatagagaatacgacagccaacattagtcttacggcaattgcaaatcaagcagcaatactgatgggactagacaaaggctggccaatatcgaagatggatataggagtcccacttctggcactgggatgttactcacaagtcaatccattaacacttacagcagccgttctgatgttggtcgcccactacgctataattgggccaggattacaagcaaaggcgacccgggaggctcaaaagaggacagcagcgggcatcatgaagaatccaacggttgacggaatcgtcgcaatagatttagatccagtggtatacgacgcaaaatttgaaaaacaattaggacaaattatgttgcttatcttgtgcacaagccagatcttactgatgcgtacaacatgggctttatgcgaatctatcacgttggccacaggtccccttaccacactctgggaagggtcaccgggcaaattttggaacactacaatagcagtaagtatggcaaatatatttcgaggttcttaccttgcaggagccggattagcctttagtttaatgaaatcattaggcggagggagaaggggaacaggtgctcaaggggaaaccctcggagagaagtggaagcggcaacttaatcaattgtccaaaagtgagttcaacacatataaaaggtctgggatcatggaagttgacagaagtgaagcaaaagaagggcttaaaagaggggaaacgaccaaacatgcagtcagcagagggacagctaaactgcgttggtttgtggaacgaaatttggtaaaacccgaaggaaaagtgatagatttaggttgtgggagaggagggtggagctattattgcgccggactaaagaaagtcaccgaggtcaagggatacacgaaaggtggaccgggacatgaagaaccaataccaatggctacgtacggatggaatttggttaaattacatagcggtaaggacgttttcttcataccaccggaaaagtgtgatacgttgctttgcgatataggagaatcctctcccaaccccacaatcgaagagggaagaacgttgagggtgcttaagatggtagaaccatggttacggggaaaccaattttgcataaaaatactgaacccgtacatgcctagcgttgttgaaactctagaacagatgcaacgtaagcatggtggtatgttagtcagaaatcccctgagtcgaaactccacacatgaaatgtattgggttagttgcgggacaggtaacattgtatcggcagtcaatatgacgtcgcgtatgctgcttaatagattcactatggctcatagaaaacctacttatgaaagagatgtagacttaggcgcaggaacccgtcacgtcgctgtagaaccagaggttgctaatttagatataataggacaacgcatagaaaatataaagcatgaacataaatccacgtggcactatgacgaagacaatccatacaaaacatgggcctaccatgggagctacgaagtaaaaccaagcggtagcgcctctagtatggttaacggggtagttaaactattaaccaaaccctgggacgtgattcccatggtaacacaaatcgccatgacggatacaactccatttggccagcaaagggtgtttaaagaaaaggtagatacgagaactccaaaagccaaaagaggtactgctcaaataatggaagtcacggccaaatggctatggggatttctatctaggaacaagaaacctagaatatgtactcgggaagagtttacacgaaaagtcagaagtaatgctgctattggtgctgtctttgtcgatgaaaatcaatggaatagcgctaaagaggcggtagaggatgaacggttttgggatctggtccatagggaaagggaactgcacaaacaaggaaaatgcgcgacatgcgtttacaatatgatgggcaaaagggagaagaaattgggtgagttcgggaaagcaaaaggcagtagagcaatttggtacatgtggttaggagccagatttctcgagttcgaggcacttggctttatgaacgaagatcattggttttcgcgggaaaactcgctttccggagttgaaggcgaaggtctacataaactcgggtatatattgagagacatcagcaaaataccaggcggcaacatgtacgcagacgacacagcagggtgggataccaggattacggaagacgatctccagaatgaagctaaaataacagatataatggaacctgagcatgcattactagctaaatctatttttaaactaacttatcagaataaagttgtccgtgtacaaagaccggccaaaaacggcacagtaatggacgtgatttcaagaagagatcaacgagggtctggtcaagttggtacctatggactaaatacatttactaatatggaagcgcaactgatcaggcaaatggagagcgagggtatattctctccatccgaacttgaaacgccaaatttagcaggaagagtcctcgattggttagaaaagcacggagtcgagaggcttaagagaatggcgattagtggcgatgactgcgtagtcaaaccaatagatgacagattcgccacagctctaactgctctaaatgatatgggaaaagtacggaaagacataccgcaatgggaaccgtccaaaggttggaatgattggcagcaagtgccattctgtagtcatcatttccaccaactgatcatgaaagacgggcgtgaaattgtggtaccttgtaggaatcaggatgagctagtcggccgagcacgagtgtcccaaggggcgggctggagtttaagagaaacagcgtgtcttgggaaaagctacgcgcaaatgtggcaattaatgtattttcatagaagagatctaagattggcagctaacgctatatgctcagctgttcccgtagattgggtaccaacaagtaggacaacatggtctatacatgctcaccatcaatggatgactaccgaagacatgctcagcgtgtggaatagggtttggatagaagagaatccatggatggaggacaaaacacatatcagttcgtggggagacgtaccttacctcggtaaacgagaagatcaatggtgtggtagtcttattggcctcacggcacgggctacttgggcaaccaacattcaagtcgcaataaatcaagtaagacgtcttataggtaacgagaactatctagactacatgacaagtatgaaaagattcaagaatgaatcagatcccgaaggcgcgttatggtaa

SEQ ID NO: 21772 - RNA, 9879 nt, synthetic construct
  misc_feature 1..9879: note = derived and/or modified CDS sequence (opt6) from DENV-1__GU131678__SS-prME
  source 1..9879: mol_type = other RNA
tcagtaaccatgcttctcatgcttatgccaacagcattagcatttcacttaaccactcgcggaggtgaacctcacatgatagtttccaaacaagaaagagggaaatcactgctttttaaaacgtcagcaggagtaaatatgtgcaccttgatagcgatggacctcggagaactttgtgaagatacgatgacatataaatgtcctaggattactgaagcagaaccagatgatgttgactgctggtgtaatgcaacagatacttgggttacttacggaacatgctctcaaactggcgaacatagaagggagaaaagaagcgttgctctagcgcctcatgttggattaggattagaaactagaaccgaaacatggatgagttcggaaggggcatggaaacaaatacagcgtgtagaaacgtgggccctaaggcaccccggatttacagttatcgcactttttctcgcacatgctatcgggacgtctattactcaaaaaggaatcatattcatcttattaatgcttgttacaccatctatggctatgagatgtgttggaattggttcaagagacttcgtggaagggttatccggagcaacttgggtagatgtagtccttgaacacggcagttgcgttactacaatggctaaagataagccaacactagatatagaactattaaaaaccgaagtgactaatccagcggttcttagaaaattatgtatagaagcaaaaattagcaatactactacagactctagatgtcctacgcaaggagaagcgacattggtggaagaacaggatgcaaatttcgtctgtcgaagaacttttgttgataggggatggggcaatgggtgtggtctattcggaaaaggctctctgctgacatgcgcgaaatttaagtgcatgaccaaattagaaggcaagatcgtccagtatgaaaaccttaaatactcagtaattgtaactgtacacacgggcgaccagcatcaagtcgggaatgaaagtacagaacatggcacaacagctacaattacaccccaggcgccaactacagaaattcagttgacagattatggggccttaaccctcgattgctccccaagaacgggactagactttaacgaaatggtactattaactatgaaagaaaagagttggcttgtacacaaacaatggtttctagatttacctctaccctggacaagcggcgcatcaactagccaggaaacatggaaccgccaagacttattagtcacttttaaaacagcccacgccaagaaacaggaagttgtagttctagggtcacaggaaggagctatgcataccgcgctcactggagcaacagaaatccaaacatcaggtaccactacaatttttgccggacatttaaagtgtagacttaaaatggataaactgacactcaaagggatgtcctacgttatgtgtacaggatcatttaaattggaaaaagaagtagccgaaacgcagcatggaacagttctagtacaaatcaagtacgagggcactgacgcaccatgtaaaataccgtttagtacacaagatgaaaaaggagttacccagaatggcaggttaataaccgctaaccctatagtgacagacaaagaaaaaccagtcaacatagaagccgaacctccattcggtgagagttatattgtaattggagccggtgaaaaagcgttaaaactaagctggttcaagaaaggaagttctattgggaaaatgtttaaagcaactgcccgtggggccagaaggatggcaatactaggtgatacagcttgggacttcggcagtatcgggggcgtattcacgtccgtaggtaaattggtccatcaaatattcggtacagcatatggagttctattttcgggtgtatcgtggacaatgaagattggtataggagttctacttacttggcttggcttaaattcccgatctaccagtctttcaatgacctgcattgccgtagggttagtaacactatatctaggagttatggtacaagcagattccgggtgcgtcataaactggaaaggcagagaactaaaatgcggctctggaatctttgtaacaaacgaggtgcacacttggacagaacaatacaaattccaagctgacagcccaaaacgtttaagcgcggcgataggaaaagcatgggaagagggtgtctgcgggatacgatccgcgacgaggttagaaaacatcatgtggaaacaaatctcaaacgagttgaatcacattttgttagaaaacgacatgaaattcaccgtcgtagtaggagatgttgctggcatattggtccaaggaaagaaaatgatccgacctcagccaatggagtataaatatagttggaaaagctggggaaaagctaagattattggagcagatgtacaaaatagtacctttatcatagatggtccaaacacacctgaatgtcctgatgatcaacgagcatggaacatttgggaagtcgaagattacggatttgggattttcaccactaatatatggcttaaactaagagactcgtatactcaggtttgtgatcatcgcctgatgagcgccgcgataaaggatagtaaagcagttcacgcggatatggggtactggatcgaaagtgaaaagaatgaaacatggaaattggcacgggcaagtttcatagaggttaaaacctgcatatggccaaaaagtcacacactatggtcaaatggggtgttagaatcggaaatgataattccaaagatacatgggggaccgattagtcagcataactatagacctggttattttacacaaacggcgggcccatggcatttaggaaaactagaattagattttgatctatgtgagggaactacagtagtagttgatgaacactgtgggaacaggggtccatcgctgagaaccacgactgttactgggaaaattatccatgaatggtgttgtcgttcatgcacgctaccacccctacgattcaggggtgaggacggttgctggtacgggatggaaattagaccggtcaaagaaaaagaagaaaacttagttaaatctatggtttcagctggctccggagaagtagatagttttctactcggtttgctatgcatatcaatcatgattgaagaagtaatgaggagtcgctggtcgagaaagatgctaatgacaggtacattagcggtatttttcttgctcattatggggcaattgacgtggaatgatttgattagactatgtattatggtcggtgcgaacgcgtcggatcgaatggggatgggtacgacatacttggcactcatggcaacttttaaaatgcgccccatgtttgcggttggactcctatttagacgactgacttccagagaagttttgttattgacaataggtttatcgctagttgcttctgtggaactaccaaattcactcgaggagttaggcgatggcctagctatgggaataatgattttgaaacttctgacagactttcaatcatatcaattgtgggcaacattactgtcgctgacttttatcaaaactactttctcactccactacgcatggaaaactatggcaatggtattatcaattgtaagcctttttcctttgtgcctatccactacatcgcagaaaacgacatggctaccagtattgctaggcagtcttggatgcaaaccattgacaatgttcctcattgcagagaataaaatttggggcagaaaatcttggccactaaacgaagggatcatggccgtaggaatagtctcgatattattgagctcattacttaaaaatgacgtaccattagctggccctctaatagctgggggcatgttgatagcctgttacgtaattagtggttcatcggctgacctaagcctcgaaaaagcagcggaagtaagttgggaagaagaggcggagcacagcggggcgagtcacaacattttagtcgaagtacaggacgatgggactatgaaaattaaggatgaagaaagagacgatacacttacaatactactaaaagccacattgctagcagtatctggagtataccctctttcgataccagcaactttattcgtttggcacttctggcaaaagaaaaagcaaaggagtggagtattatgggatacaccaagcccaccagaagttgagagagcagtactagatgacggcatataccggatcatgcaacgtggattgttaggtagatctcaggttggtgtaggagtatttcaagaaaatgtatttcatactatgtggcacgtaaccagaggagcagtcttgatgtatcaggggaaacggttagaaccaagctgggcaagtgtcaagaaagacctcatttcttatggtggcggttggcgatttcagggcagttggaacacaggagaggaagtacaggtaattgcggttgaaccaggcaaaaaccccaaaaatgtgcaaacggcgcccggtactttcaagaccccagaaggggaggtaggagcaatagcgctagactttaaaccaggtacttcaggctcgccaattgtaaatagagaaggaaagatagtaggattgtacggaaacggagtagtaactacctccggcacctacgtatcggcgatagcacaggccaaggcttcgcaagagggccccttgccagagattgaagatgaggttttcagaaaaaggaaccttaccattatggatttacaccccggatcaggaaaaactcgcagatacctaccggccatagttagggaagctattaaaaggaaattaagaactttaatattagcaccaacacgagtagttgcatcggaaatggctgaagccctaaaagggatgcctatacgttaccaaacaacagcagtgaagtcggaacacacaggaaaagaaatagttgacctgatgtgtcacgcgacctttactatgcggttactaagtccagtccgtgttccgaattataatatgataataatggacgaagctcacttcacagatccgagctctatagcggcgagaggatatatttctactcgggtcggaatgggggaggcagctgcgatattcatgacagccacaccgccaggctcaatggaagcattccctcaaagcaatgccgtgatccaggacgaagaaagagatattccagaaaggtcatggaatagtggatacgaatggataacggactttccagggaagacagtttggtttgtcccatccataaaagcaggaaatgacatagcaaattgtttaaggaaaaatggaaaaagagtcattcaattaagccggaaaacattcgataccgaatatcagaaaacgaaaaataacgattgggattacgtagtaacaacggatataagcgaaatgggggcgaattttagggcggacagggttatagaccctcgtagatgtctaaaaccagtaatcttaaaagatggtcccgagcgtgtgatactggctggtccaatgccggtaactgtggcctcggcagcacaacgaagagggcgaataggtcgtaatcctaataaagaaggcgatcaatatatctatatgggacaaccactaaataatgatgaagaccatgcacactggacagaagctaaaatgttactagataatataaatacaccagaaggtataataccggcattatttgaaccggaaagagagaaaagtgcagcaatagatggtgaatacaggttacgcggtgaagcacgcaagactttcgtcgaattaatgagaagaggagacttgcccgtttggttgagttacaaagttgcttcagagggattccaatatagcgacaggcgatggtgcttcgccggagaacgaaataaccaagtattagaagaaaacatggatgtagaaatatggaccaaagagggagaacgtaagaaacttctgccacgatggctagatgctagaacctactccgatccgttagcgctaagagagttcaaggagttcgcagcgggaagacgaagtgtatccggtgacttgatcctagaaataggaaagttaccacagcacctcactcaaagagcacaaaatgcgttggacaacttagtaatgctacacaattcggaacaaggcggcagagcataccggcatgcaatggaagagttaccagataccatagaaactctcatgcttttagccttaatagcagtcctgacaggaggagttaccttgttctttttatcaggtaaaggactgggcaagaccagcattggcctgttatgcgtaatggcgtcaagtgtactattgtggatggggtcagtagagccccattggatagcggcctcaataatattagagttcttcctcatggtgctgctaataccggaacccgaccgccaacgaactccgcaggacaaccaactcgcatatgtagttataggcctcttgtttatgatattaactgtcgcggcaaacgaaatgggattattagaaacaactaagaaagatttaggcataggtcatgttgcagtagaaaaccatcatcatgcagcgatgctagacgtagatctgcatcctgcttcagcttggacactatacgctgtcgcaacaacgataataactccaatgatgcgtcacacaatcgaaaataccacggctaatatcagccttactgcgatcgcgaatcaggcagctatactaatgggcctcgctaagggatggcccatatctaaaatggatataggcgtgccactattggcactcggatgctactcccaggtaaatccattgacactaacagctgctgtattaatgttagtagcccattacgcgattatcggaccaggattacaggcgaaggcaacaagagaagcacaaaagagaacagctgccggcatcatgaaaaacccgactatagacggaatagttgccattgatcttgatccagtcgtatacgacgcaaagtttgagaaacagttaggccaaattatgctactaatactttgcacatcccaaattcttcttatgaggactacatgggctttatgcgaatccataactttagccacaggtcccttaacaacactttgggaaggctcaccaggtaagttttggaacaccaccatcgcagttagcatggctaatatctttagagggtcttacttagctggagcaggattagccttttcattaatgaaatctttagggggtggtcggcggggaacgggcgcccaaggtgaaacactaggcgaaaaatggaagcgacaattgaatcagttaagtaagagcgagtttaacacatataagaggtctggaatcatggaagtggatcgaagcgaagctaaagaaggtttgaagagaggcgaaactactaaacatgcagttagtagaggcccagcaaaattacgttggttcgtagagcgaacactcgttaatccagagggcaaggtcatagcattaggttgtggtcgaggagcgtggtcctattattgcgcggggttgaagaaaggaacagaagttaaaggttatacgaaaggaggacctggacacgaagaacctataccaatggcaacctacggctgggatctggtaaaactacactcaggtaaggatgtgttctttattccgccagaaaaatgtgacacgctattatgtgacattggcgaaagttctcccaatcctacgatagaagaaggacgcacacttagagttttgaaaatggttgaaccctggttaagaggaaatcaattctgcatcaagattttaaatccgtatatgccatccgtcgtagaaacgttagaacaaatgcagagaaagcatggaggcatgctcgtccgaaaccccctatctcgcaactccacgcatgagatgtattgggtaagttgtggcaccggaaatatcgtaagtgcggtaaatatgacttctaggatgttactaaataggtttacaatggcgcatagaaaacctacatatgaaagggatgttgacttaggggcggggacaagacatgtagcagtagatcctgaagtggcaaatctcgatataatcggccaaagaatagaaaatattaagcacgaacacaaatcaacctggcattacgatgaagacaatccatataaaacttgggcttatcacggaagctacgaagttaaaccatcaggaagtgcaagcagtatggttaatggagtagtgaaattacttactaaaccatgggacgtaataccaatggtaactcaaatagctatgactgatacgactccatttgggcaacaaagagtatttaaagagaaagttgatacaagaacaccgaaagctaaaaggggaactgctcaaatcatggaggtgactgcaaggtggttatgggggtttttgtcacgcaataaaaagccaagaatttgcactagagaagagttcactagaaaggtcagatctaacgctgcgataggcgcagtcttcgtagacgaaaatcaatggaatagtgctaaagaggcagttgaagatgatcggttctgggacctagtacatagagaacgcgaactacacaagcaaggaaagtgcccaacgtgcgtgtataatatgatgggaaaacgagagaagaaattgggcgagtttggtaaagcaaaaggatcaagacccatctggtatatgtggttgggagcgcgttttctggagttcgaggctttgggttttatgaacgaggatcattggtttagtagagaaaactcattatcaggtgtagaaggtgaagctctccacaaactaggttatattcttagagatataagtaaaataccgggtgggaatatgtatgctgacgataccgcagggtgggatactaggattaccgaagacgatcttcaaaacgaaggaaaaataactgacataatggaacccgaacatgcactcctagcgaaatctatattcaaacttacttatcaaaataaagtggtgagggtgcagcggccagctaagaatggcaccgtaatggacgtcattagccgaagagatcaaagaggatcaggacaggtaggtacatatggcctaaacaccttcacaaacatggaagcccagctcatcagacaaatggaatctgaaggtatcttcctcccaaatgaattggaaacacctaacctggcaggaagagtgctagattggttagaaaaatacggcgttgaacgattaaaacgaatggcgatatcaggggatgattgcgtagtaaaaccaatcgacgacagattcgcaacagcgttaacagcactcaacgatatgggcaaagtgaggaaagacatccctcaatgggaacccagtaagggatggaatgattggcagcaagttcccttttgtagccaccactttcatcaattaataatgaaggacggtagggaaattgtcgtcccttgtcggaaccaagatgaacttgtaggaagggcccgtgtcagccaaggagcaggttggacattgcgtgaaacagcatgccttggtaaatcatatgctcaaatgtggcagctaatgtactttccacggcgtgcacttcgcttagcggccaatgccatatgtagtgcagtacctgtagattgggtccccacgagtagaacgacgtggtctattcacgcacatcatcaatggatgaccactgaagatatgctatcagtatggaacagagtctggatagaggaaaacccctggatggaggacaagacaagaatttcgagttgggaagacgtaccatatttaggaaaacgagaggatcaatggtgcggttcgttaataggtttaacacccagagcgacctggcctactaatatacaggtagcaataaatcaagtgcggaggcttattggaaatgaaaactatagcgattatatgacatctatgaagagattcaaaaacgagagtgaacctgaaggagcactttggtaa

SEQ ID NO: 21773 - RNA, 9879 nt, synthetic construct
  misc_feature 1..9879: note = derived and/or modified CDS sequence (opt6) from DENV-1__GU131679__SS-prME
  source 1..9879: mol_type = other RNA
agcgtgacaatgctgttgatgttgatgcccacagcgttggcatttcatttaacgacgaggggtggggaaccgcatatgatagttagcaaacaagaaagggggaaatctttactatttaaaacatccgcaggggttaacatgtgcactctgatagccatggacttaggagaattttgtgaagatacaatgacttataaatgtccaagaataacggaagcggaaccggacgatgtagattgctggtgtaacgcaacagatacatgggttacatatggaacatgcagtcaaactggcgaacatcgacgggacaaacgaagcgtcgcactagcgccacacgttggtctcggattagaaacgcgcacagaaacatggatgtcgtcagaaggagcatggaaacaaattcagcgggtagaaacctgggctttgcgacacccaggttttacagtaattgcattattcttagcccacgcgatcggcaccagcatcacgcaaaaaggtatcatatttatccttttaatgttggttacgccgagcatggcaatgaggtgtgttggtatagggtctcgcgacttcgtcgaaggtttatccggggctacatgggtagacgtagtgctagagcacggttcttgtgtaactacgatggcgaaagacaaaccaacattggatatagaactactcaagacagaggtaactaaccctgccgtactaagaaaactttgtatagaagcgaagatcagcaacacaacaacagatagtaggtgtcctacgcaaggtgaagccaccctagtggaagaacaagatgctaattttgtctgtagacgtactttcgtagatcgcggatggggaaatggatgtggtctgttcggaaaaggaagcctcataacatgtgcaaaattcaaatgtgttacaaaactcgaagggaaaacagtacaatatgaaaacttgaaatacagtgttattgttaccgttcatacaggagatcaacatcaagtaggtaacgaaagcaccgaacacggaactaccgcaacgataacaccacaagcacctagcacggaaatccaacttacagactatggagctttgactttagattgcagcccaaggactggattagattttaacgaaatggtcctattaacaatgaaggagaaggcttggctagttcataaacaatggttcttagatctccctctaccatggacctctggtgcaagcacatcacaagagacctggaaccgaaaagacctattagttacttttaaaacagcccatgccaagaaacaagaagtagtagtactaggcagtcaggaaggagcaatgcacacggcattaacaggagcaacagaaatacaaacatctggaacaactactatattcgcaggacatttaaaatgcagacttaagatggataaactgacattaaaaggaatgtcttacgtaatgtgcaccggcagtttcaaattagaaaaagaggtagctgaaacccaacatggcaccgtattggttcagataaagtatgaagggacggatgcaccttgcaaaataccatttagtacacaggacgagaaaggcgttacccaaaatggacgattaattacagcaaacccaatagtaacggacaaagaaaaaccagttaacatagaggccgaaccaccatttggtgaatcctatatcgtaataggggcgggcgaaaaggcactaaaattatcgtggtttaagaaaggatcgtccattggtaaaatgtttgaagctacggctagaggagcaagaagaatggcaattttaggagacacggcatgggactttggatcaattggaggtgtctttacttcagtaggcaagttggtacaccagatattcggtaccgcttacggtgttcttttctcaggtgtctcttggaccatgaagatcggaataggcgtcctactaacatggctcggccttaacagtcgttcaacatcgcttagtatgacctgcattgcagtggggttagtaacactctatcttggtgttatggttcaggcagacagtggatgtgtgataaactggaaaggaagggagttgaagtgcggaagcgggatattcgtgacaaacgaagtacacacgtggacagaacagtacaaattccaagcagattctccaaaacgcttgtccgctgcaataggaaaggcttgggaagaaggagtatgcggaatccgctcagcaactcgactcgaaaacataatgtggaaacaaatatcaaatgaattaaatcatatcctattagagaacgacatgaaatttacagtagtggttggtgatgttgcaggcatactggcccagggcaagaaaatgataagaccgcaacctatggagtataaatatagttggaaaagctggggaaaggcaaaaattataggcgcagatgtacaaaatgctacattcataattgacggaccaaatacacctgaatgtccggacgaccaaagagcatggaacatttgggaagtagaagattacggctttggaatcttcaccacaaatatatggttaaaactgagagattcatacactcaagtatgtgatcatagactaatgtcagcggctatcaaagattctaaggcagtacatgcggatatgggatattggatagaatcagagaagaatgagacctggaaattggctcgagcctcttttattgaagtaaagacttgtatatggccaaagagtcatacactctggtcgaatggagtactcgaatctgaaatgataattccaaaaatttacggcgggccaatttcacaacacaactatagaccgggttattttacacaaactgcagggccatggcacctgggtaaattagagctggattttgatttatgtgaagggacgactgtcgtcgtagatgagcattgtggcaatcgtggaccgtctttacgaacgacgacggtaactggcaaaataattcacgaatggtgctgtcggtcatgcacacttccaccgttaaggtttaagggagaggatggttgctggtatggtatggaaattaggcctgtaaaggagaaagaagaaaaccttgtaaagagtatggtctctgctggctcgggagaggtcgatagtttttcccttggattattatgtatatcaattatgattgaagaagttatgcgttcccgctggagtaggaagatgttaatgactgggacactagctgtattctttttactaataatgggacagttgacatggaacgatctaattagattatgtatcatggtcggagccaacgcctcagataggatgggcatggggacaacttacttagcattaatggcaacattcaaaatgagaccaatgtttgcagtaggcttactatttcgtagattaacttcgagagaagttctattacttacaataggactgagccttgtggcgagtgtcgaacttccaaatagtttggaagaactcggagacggtttagccatgggaataatgattttaaagttattgaccgactttcagtctcaccaattgtgggcaacattattatcgttaacattcattaaaaccacatttagccttcattatgcatggaaaacaatggctatggtacttagcatagtttcattgttcccgctctgcctgagtacgacttcacagaaaactacctggttaccagtgctactagggtcattaggttgtaaaccactaacaatgtttctaattgctgaaaataagatatggggccgaaagagctggcccttaaacgagggcataatggcagttggtatagtctctatactactgtcaagtttattgaaaaatgacgtgcccttagccggtccactcatcgcgggaggaatgctgattgcgtgttacgttatatctggttcatcagccgacctatccctagaaaaagcagcggaagtctcttgggaagaggaagcagaacactcgggagccagtcataacattttagttgaggtacaagatgatggaaccatgaaaattaaagacgaagaacgagacgacatgcttacaatactcttaaaggcaacattactagctgtcagtggagtatatccattatctataccagcgactcttttcgtttggtatttttggcagaagaagaaacaaagaagcggcgtattgtgggatacaccctcgccaccagaggtggaaagagctgtacttgacgatggaatctaccggattatgcagcgaggattgttaggaaggtctcaggtcggagtgggcgtattccaagaaaatgttttccataccatgtggcacgtaacaagaggggctgttttaatgtatcagggcaaaagactcgaaccttcgtgggcttccgtcaagaaagatctaatatcttatggtggcggttggcgtctccaaggttcttggaataccggagaagaagttcaagttatcgctgttgaaccaggcaaaaatcctaaaaatgtacagacggctcccggaacatttaaaacgtcagaaggagaagtcggagcaatagctttagattttaaaccagggacttcagggtctccgatagtaaatagagagggaaagatagtaggactatatggaaatggggtagttactacgtcaggcacctatgtatccgcaatcgcacaggctaaggccagtcaagaaggcccgcttccagaaatagaggatgaagtatttcggaaaagaaatctgacgataatggatctgcatcccgggtcgggcaaaacaaggaggtacttgccagctattgttcgggaagcaataaagcgaaaactgcgcacattaatactagcaccaacaagggtggttgcgagtgaaatggcggaagcattgaaaggtatgccaataaggtatcaaacaaccgcagttaagagcgaacacaccgggaaggaaatagtggatctcatgtgtcacgcaacatttacgatgaggctattaagcccggtaagagtaccaaactacaacatgataatcatggacgaggctcactttacagatccgagttctattgcagccaggggatacatatctacaagggtaggtatgggagaagcagcggcaatattcatgactgcgaccccaccaggcagtgtggaagccttcccccaatcaaacgcggtcatacaagatgaagaacgcgatatacccgaaagatcgtggaactcaggatacgaatggataactgatttccctggtaaaacagtttggttcgtgccgtcaataaaaagcggcaacgatatagcaaactgtctacgaaagaatggcaaacgtgttatacaactatctagaaaaaccttcgacacggaatatcaaaagaccaaaaataacgactgggactatgtagtcacaacagatatcagcgaaatgggcgcaaactttagagccgatagagtaatcgatccaagaaggtgcctaaaacctgttatattaaaagacggtccggagagggtcattctagcaggtcccatgccggtaaccgtcgcatctgcagctcaacgcaggggacgaataggaagaaatcataacaaagaaggcgaccagtatatatatatgggtcaacctctaaataatgacgaagatcatgctcattggacagaggcaaaaatgttattagacaacataaacactcctgaggggataatcccagcattatttgaaccagaaagagaaaaatcagctgcaatagatggggagtataggcttaggggtgaagcacgaaaaacatttgtggaattaatgagacggggtgatttaccagtctggttgtcatataaagttgcttcagaaggatttcagtacagcgaccgacgatggtgtttcgatggtgagaggaataaccaagtcttagaagaaaatatggacgtagaaatatggacgaaagaaggtgaacgaaagaaacttagacctaggtggttagatgcacgcacttacagtgatcctttggcattaagagaatttaaagagttcgcagcaggaaggagaagcgtgtcaggcgacttaattctggaaatagggaaacttccacagcatttaacacagagagctcaaaacgccttagataatttagtcatgcttcataactctgaacaaggcggacgagcttatagacatgcaatggaggaattaccagataccattgagactctaatgctacttgctcttatagcagttttgactgggggagtaactcttttcttccttagcggacgaggactaggaaaaacatcgataggcttactttgcgttatggcgtcttctgtactactctggatggcaagcgtagaaccacattggatagcggcttctatcatcttagagttctttctcatggtattgctaatcccagaacccgatcgacagcggactccacaggataaccaacttgcgtatgtcgtaataggcctattgttcatgatcttaacagtcgctgcaaatgaaatggggttactagaaaccacaaagaaagacttaggcattggacatgttgcggtagaaaaccaccaccatgctgcgatgctggatgtcgatttgcacccggctagtgcatggaccttatacgcagtagcaacaactataataacaccaatgatgagacatacaatagaaaacacaacagcaaacatatcactaactgccatcgcgaatcaagccgcaattttgatgggtttggacaaaggatggccaatatctaaaatggatattggagttccactactggcattagggtgctattcccaggttaacccgttaacattgacggccgcagtattaatgttagtggcacactatgctattataggaccagggctccaagctaaagcaacaagggaggcacagaaacgaacagctgctggaataatgaaaaatcccactgtagatggtatagtggccatagaattagatcctgtcgtatacgacacaaagtttgaaaaacaattaggacagataatgttgttgattttatgtaccagccaaattttattaatgaggacgacctgggctctgtgtgaaagtataacactagcgacgggaccattaactactctctgggaaggatcacccgggaagttttggaatactacaatagcagtatctatggcgaacattttccgaggtagctatcttgcgggcgcaggtttagctttctcactaatgaaaagtttaggtgggggtagaagaggcacgggagcacagggtgagacattaggagaaaaatggaagagacaactaaaccaactcagtaaatcagaatttaacacttataaaaggtcagggataatggaagtggatagatcggaagcaaaagaaggtctaaaaaggggtgaaacgacgaaacacgctgttagccggggtacggcaaaattacgatggttcgtagagagaaatttagtgaagccggaaggaaaagtaatcgatctgggctgtggtagaggcggatggtcgtattactgtgctggtttgaagaaagtaaccgaagtcaaagggtatacaaaaggagggccgggccacgaggaacctataccaatggccacatacggttggaatctggtaaaattacatagtggtaaagatgtcttcttcatacctccggaaaaatgcgataccctgctatgtgacataggagaatcgagtccaaaccctacgatagaggaaggccgaacgctgagagttctaaaaatggtagaaccatggttacggggtaaccaattttgtatcaaaatactaaacccctacatgcctagtgtggtagagacattagaacagatgcaacgcaaacatggaggaatgttagtgagaaatccgctaagcagaaacagcacgcacgagatgtactgggtatcgtgtggaactggaaatatagtcagcgctgttaatatgacttcgcgaatgctgctaaacaggtttaccatggcacaccggaaaccaacttatgagcgtgacgtagatctcggagcggggactagacacgtagctgtagaaccagaagtagctaatctagatatcatagggcagcgaattgaaaacataaaacatgaacataagtctacttggcattatgatgaagataatccttacaagacatgggcatatcatggtagttacgaagtaaaacccagcggctcagccagcagcatggtaaatggtgtagtcaagttgttaactaagccgtgggacgtgataccaatggtaacccagattgcgatgacagacacaaccccctttggccagcaaagagtattcaaagaaaaagtggataccagaacacctaaggcaaaacgtggcacagcgcaaatcatggaagtaacagcaaaatggttatggggtttcttatcaagaaacaagaaacctcgcatatgcacacgtgaggagttcaccagaaaagtgagaagcaacgcggctattggagccgtatttgtagacgagaatcaatggaatagtgcaaaggaagcggtggaggacgaaagattctgggacttagtccatagagaacgagaactgcacaaacagggaaagtgtgccacatgtgtttacaacatgatgggtaaaagagagaagaaacttggagagttcggaaaagctaaaggcagcagagctatatggtacatgtggttaggagcccgcttcctcgaatttgaagcactgggattcatgaatgaagatcattggtttagccgcgaaaactcactaagtggagtagaaggcgaaggattacataaattaggttacatattacgtgacatttccaaaattccgggtggcaatatgtatgctgatgacactgcagggtgggacacccggataactgaagacgacttacaaaatgaagcgaaaatcaccgacattatggagccagaacacgcacttctcgcaaagtcaatttttaagttaacatatcaaaataaagttgtaagggtgcagaggccagctaaaaatgggacggtgatggatgtaatatcaaggagagatcaaagaggctccggccaggtaggaacctatggtctgaacacatttacgaacatggaagcccaacttataagacagatggagtccgaaggaatcttcagtccgtcagagttggaaaccccaaatctcgccggaagagtgttagactggctcgagaaacacggggtagaacgtttgaagcggatggccatttcaggcgacgactgtgtagtcaaacctatagatgatcggttcgccacggcccttacagccctaaacgatatggggaaagtaaggaaagatattccgcaatgggaaccctcaaaaggatggaacgattggcaacaggtccctttttgtagccaccacttccatcagttaatcatgaaggacggacgcgaaattgtagtgccttgcaggaatcaagacgagctagttggacgagcacgtgtcagccaaggagctggctggtctctacgagaaaccgcgtgcctgggaaagtcgtatgcccaaatgtggcagctaatgtattttcatcgtagagacctaagactggccgcgaacgctatatgttcggcagtccccgtagattgggttccaacaagccgaactacgtggtcaatacacgcacatcatcaatggatgacaacggaagatatgctaagcgtatggaatagggtgtggatagaagaaaatccttggatggaagacaaaacacatatctcaagctggggcgatgtgccatacttagggaaaagagaagaccaatggtgtggcagtctaataggactcacagcacgggcaacatgggcaacgaatatacaagtagcaatcaatcaagtaagaagacttatcggtaatgagaactatttagactacatgacaagcatgaaaagattcaaaaatgaaatagatccagaaggagctttgtggtga

SEQ ID NO: 21774 - RNA, 9879 nt, synthetic construct
  misc_feature 1..9879: note = derived and/or modified CDS sequence (opt6) from DENV-1__GU131680__SS-prME
  source 1..9879: mol_type = other RNA
agtgttactatgctattaatgcttatgccaaccgcgctggcttttcatttaaccactagagggggagaacctcatatggtagtatccaaacaagaaagaggcaaatcattattatttaaaacttccgcaggagttaatatgtgtacgcttatagctatggatcttggtgagctatgcgaagatacgatgacctataaatgcccacgtatcacagaagccgaaccggacgacgtggattgctggtgtaatgcgacagacacatgggtaacttatggtacatgcagtcagactggagagcatagaagagagaaacgaagcgtagcattagctcctcatgtaggactgggcctagaaaccagaactgaaacttggatgagttcagagggggcctggaaacaaatacagcgtgtggaaacctgggcattaagacacccaggattcacagtcattgctctgttcctcgcgcacgcgataggtaccagtattacacaaaagggaatcatatttatactcctcatgcttgtgactccgagtatggcaatgcgatgtgtaggaataggaagcagagattttgttgaagggttaagtggagccacctgggtagacgtagtattggagcatggatcctgtgttaccacgatggctaaggataaaccaaccctagatattgaactactaaagacggaagtaactaatccagctgtcctacgaaaattatgcattgaggcaaaaatatcaaatacaacaaccgactccaggtgtcccactcagggcgaagcaaccttggtcgaagaacaagatgcaaattttgtttgtcgaagaacatttgtagataggggatgggggaatggttgcggcctcttcggcaaaggctcgctactaacctgtgcaaaattcaaatgcgttacgaaattagaaggtaaaattgtccaatacgagaacctgaagtattctgtaatcgtcacagttcataccggagatcaacatcaagtagggaatgagtctactgaacatgggacaacagccaccataaccccacaagcccctacaacagaaatacaattaacagattacggtgcacttacactagattgtagccctagaacaggtctagattttaatgaaatggtactcttgaccatgaaagaaaaatcatggttggtgcataagcagtggtttttagacctgccactaccttggacaagtggggcgtcaacaagtcaagagacatggaatagacaagatctcctagtcacttttaaaaccgcgcatgccaagaaacaagaagtcgtggtcttaggatctcaagaaggtgctatgcatactgcgttaacaggtgcaacagagattcaaacttcaggaacgacaacaattttcgctggacatttaaaatgtagactaaagatggacaaacttactctaaagggtatgagctatgttatgtgcacgggttcctttaaactagaaaaagaagtagctgaaacgcaacacggaacagtgttagttcaaattaaatatgagggaaccgatgcaccctgcaaaataccattcagcacacaagacgaaaagggagtaacgcaaaatggcaggttgataacagccaatccgatagtaactgacaaggaaaaacccgtcaacatagaagccgagcccccttttggagaatcatatatcgttataggagcgggagaaaaggcattaaaattaagttggttcaaaaagggatcctcgattggaaagatgtttgaagcaactgcacgcggtgcgagacggatggccattctcggagacacagcttgggatttcggttcaattggaggtgtatttacgagcgttggcaagttagtacaccagatattcggcacggcttacggggttttattctcaggagtgtcttggactatgaaaataggaattggtgtactattaacatggcttgggcttaatagtaggagtacatctctttcaatgacctgcatcgctgttggattggtaactctatatttaggcgtaatggtacaagcagattcgggttgcgttataaattggaaaggtcgtgagttaaaatgtggttcaggaatattcgtaactaacgaagttcatacctggacggagcaatataaattccaagcagattctcctaaaagattatcagcagccataggtaaggcatgggaagaaggagtctgcggaataaggtcggcaactcgattggaaaatattatgtggaaacagatctctaatgaattaaatcatattctgctagaaaatgacatgaaattcactgtagtagtgggcgatgtcgcgggcatcctagtacaggggaagaaaatgataagaccccagccgatggagtataaatactcctggaaatcgtggggaaaagcgaaaataattggagcagatgtacaaaattcaacttttataatagatggacccaacacaccagaatgtccagacgatcaacgcgcatggaatatttgggaagttgaagactatggattcggcatctttacgacgaatatttggttaaaacttcgagattcatatactcaggtttgtgatcatagattaatgagtgccgctataaaggattctaaagccgttcatgcagacatggggtattggattgaaagcgagaagaacgaaacttggaaactggcacgcgcatcatttattgaagtgaaaacatgtatttggccaaaatcgcacacattatggagcaatggggttcttgaatctgagatgataataccaaaaatacatgggggaccgatctctcaacataattatcgtccaggatatttcactcaaactgctgggccttggcatctagggaagctcgaattggactttgacttatgcgaaggcacaactgtggtggtcgacgaacattgtggcaaccgagggccttctttacgaaccactactgtaactggcaaaataatacacgaatggtgctgtaggtcttgtacattaccaccactacgctttagaggggaagatggttgttggtatggaatggaaattaggcctgtaaaggagaaagaagagaatctcgtaaagagtatggtatcagcgggaagtggtgaagtcgattccttttcattaggcttactgtgtatatctataatgatcgaagaggtcatgagaagtagatggtctaggaaaatgttgatgaccgggacgcttgctgtcttctttttactgatcatggggcaactaacatggaatgacctgataagattgtgtatcatggttggagcgaatgcatccgaccgcatgggaatgggcactacatatttagcactgatggctacgttcaagatgagaccgatgttcgcagtgggattattgtttcgccgactaaccagtcgagaggttctccttctaaccattggattaagcctagtagctagcgtagaattgcccaactcattggaagaactaggagatggattggcaatgggaattatgatacttaaacttctaacagattttcaatcctaccaactttgggcgacactactgtcgctgacctttataaagacgaccttttcccttcactacgcatggaaaacgatggcaatggttttaagcatagtatctttattcccattgtgtctgtcaacaacgagccagaaaactacatggttaccggtactactaggtagtttaggatgtaagccactgactatgtttttaattgctgagaataagatatggggtaggaaatcatggcctctaaatgagggaataatggcagtaggcatagtaagcatcttgctatcaagtctacttaaaaacgatgtacctctagcagggcctctaattgctggaggaatgctaatagcttgctatgtaatctccggatcatccgcagatctgagtttggaaaaagcagcagaagttagttgggaagaggaggcagaacattccggtgcatctcataatatcttagtggaagtgcaagacgatggaacaatgaagatcaaggatgaagaacgtgacgatactttaacaatattattaaaggcaacattattggcagtctcaggtgtttatccattgtcaatacctgcaactctatttgtatggcacttttggcaaaagaaaaagcaacggtcaggagttctgtgggacacaccctctcccccggaggtagaaagagcagtattagacgatggaatatatagaattatgcagcggggattacttggaagaagccaagtaggagtcggcgtattccaagaaaacgtattccatacgatgtggcatgtcacacgaggagcagtactgatgtatcaaggaaagaggctcgaaccaagttgggcatcagtcaagaaagacttgatcagctatggcggagggtggcgctttcagggctcatggaatactggagaagaagtccaagtaatcgcggttgaaccaggcaaaaatcctaaaaatgtacaaactgcacctggtacttttaaaacaccagaaggcgaagtaggcgcaatagcgttagacttcaaaccagggacatcgggtagccctattgtaaacagagaaggtaagatcgttggcctatacggtaatggcgtagttactacatcaggaacgtatgtgtcggcaatcgctcaggcgaaagcctcacaagaaggacctctccctgaaatagaagacgaagtatttaggaaacgcaatttaactataatggatctacatcctggtagtggtaagacaagacgatacctcccagcgattgttcgtgaagccataaaaagaaaattaaggacattaatcttggcgcctactagagtagtcgcttcggaaatggctgaagcattaaaaggtatgccgattagataccaaacgacagcggttaaaagtgaacacacaggaaaagaaatagtggacttaatgtgtcacgccacatttaccatgagattattaagtccagttagggtacctaattataatatgattataatggacgaagcacactttacagatccttcaagcattgctgcccgaggatatatatcaactcgcgtaggaatgggagaagccgcggctatcttcatgactgctacaccgccgggatccatggaggcttttcctcaaagcaatgccgtaatccaggatgaggaaagagatatcccagaacgaagttggaactcaggttacgaatggataacagatttccctggcaaaacagtctggtttgtcccgtcgatcaaagcaggtaacgatattgctaattgcctcagaaagaatgggaaacgagtaatccaattgtcaagaaagacattcgatactgagtaccagaaaactaaaaataacgattgggattacgtagtcaccactgatataagtgaaatgggagcgaatttcagagcagatcgcgtgattgacccacgcagatgtcttaaaccagtaatattgaaagatggacctgagagggtaatccttgctggtcctatgcccgtaaccgtggcctctgcagcacaacgcagaggtcgtataggacgtaatcataacaaagaaggagatcaatacatatatatgggacaaccgttaaataatgatgaggatcatgcacactggacggaagcgaaaatgttactcgataacattaatacaccagagggcataataccggcactctttgaacctgaaagagagaaaagtgcagccattgatggagagtatcgtcttaggggtgaagccaggaaaacgtttgttgaacttatgagaaggggagatctacccgtttggttgagttacaaggttgcttcagaaggcttccaatacagtgacaggagatggtgtttcgatggggaacgaaataaccaagtgcttgaggaaaacatggatgtagagatttggacgaaggaaggggagcgtaagaaactaagaccacggtggctcgacgcaagaacatactccgatcctctagctctgagagaatttaaagagttcgccgctggacgacgttcagtgtctggtgatttaatactagaaatagggaaacttccacaacatttaacacaaagagcacaaaatgccctagacaatcttgtaatgctacataattcagaacagggcgggagggcataccgacatgcaatggaagaattaccagacactatagagacgttgatgctgcttgcgctcatcgcagtactaactggcggtgtcacactcttctttctatccgggaaaggtttagggaaaacgagtataggattgttatgtgtgatggcaagtagcgtattactgtggatggcttcagtagagccacactggatcgctgcttcaattatattggagttctttcttatggtactattaatacccgaaccagatcgtcaacgtacaccacaagacaaccaattagcatacgtagttattggcttactatttatgattcttactgttgctgctaatgaaatgggattacttgaaacaactaagaaagatctagggataggacacgttgcagtagaaaatcaccatcacgcagcgatgctagacgtcgaccttcacccggcaagcgcatggaccctctacgcggtggctacgactatcataacacctatgatgcgtcatactatagagaacactacagcaaatatatcacttactgccatagccaaccaggcagcaattctgatgggtttagacaaagggtggcctatatcaaaaatggacattggtgtaccccttctagcgttgggctgttatagccaagtaaacccattaaccttgacagctgctgtcctaatgttggtggcacattacgctattataggaccaggattgcaggcaaaagcaactagggaagctcaaaagaggaccgccgcaggaattatgaaaaaccccacgatagacggaattgtcgcaattgaccttgatcctgtagtttatgacgcaaaatttgagaagcaactaggacagataatgctactcatattatgtacaagtcagatacttttaatgaggacaacctgggcgctttgcgagtcaataacccttgcaacaggaccactaaccactctctgggaaggtagtccgggaaagttctggaatactacaatagctgtgtccatggcaaacatatttagaggatcatatttagccggtgcaggtttggcatttagtcttatgaaatcactagggggaggcagaagaggaacaggagcacagggtgaaacattaggtgaaaagtggaagagacaattaaaccaactcagcaaaagtgagtttaacacctataaaaggtcaggaataatggaagttgataggagcgaagctaaagaaggacttaagagaggggaaacaacgaaacacgccgtctcgagaggaacagctaaattaagatggttcgtagagaggaatcttgtaaagccagaaggcaaagtaattgatctgggctgcggtagaggaggttggagttattattgtgccggactcaagaaagttactgaagttaaaggctatactaaaggagggccaggacatgaagaaccgattcccatggcgacgtacgggtggaacttggtcaagctccatagcggcaaagatgtattctttataccacccgaaaaatgtgataccttactatgcgacataggagaaagcagtccaaatccaacaatcgaagaaggacggacacttcgtgttcttaaaatggtagaaccgtggttgcgaggaaaccagttttgtattaaaatactaaatccctatatgccgagcgtagttgaaaccttggaacaaatgcaacggaaacacggcggcatgttggtgagaaatccactatcaagaaactcaactcatgagatgtattgggtaagttgcggaaccggaaacatagtttcagcagtcaatatgacaagtagaatgctcctaaaccgctttaccatggcacatagaaaaccgacttatgaaagggatgtggatttaggggcggggacaaggcacgtggcagttgaaccggaagtagcgaatttggatataatcggacaaagaatcgaaaacataaagcatgagcacaaatcaacctggcattacgacgaagacaatccttataagacatgggcatatcatgggagctatgaggtaaaaccgtctggcagcgcatctagcatggttaatggcgtagtaaaacttttgacaaagccatgggatgttatccctatggttacgcaaatcgcgatgacagacactacaccatttggacaacaaagagtctttaaagaaaaagttgacacacgtacaccaaaggcgaaaagaggtactgcacaaataatggaagttactgctcgctggctgtggggatttttgagcagaaataagaaaccgagaatttgcactagagaggaatttactcgaaaagtaagaagcaacgcagcaataggggccgtgtttgtcgatgaaaaccaatggaactctgctaaagaagcggttgaggacgaccgcttctgggacttggttcacagagaaagggaactgcataaacaggggaagtgcgcaacctgtgtgtataatatgatggggaaacgagagaagaaactgggcgagtttggtaaagctaaaggaagtagagcaatatggtacatgtggttaggtgcacgttttctcgaatttgaagccttaggtttcatgaacgaggaccactggttcagtagagaaaactccctatcaggagtcgaaggagaaggattgcataaacttggatatatcctaagagatatatctaagattccaggcggaaatatgtatgcggatgacacggctggatgggataccaggataacagaagatgatctccaaaatgaagctaaaataacagatattatggaaccagagcatgcattattggccaaatctatttttaagctaacgtatcaaaataaagttgtacgagttcaacgacctgctaagaatggaacagttatggacgtgatatcgagaagggatcaaagaggatcaggacaggttggaacatacggactaaacacatttaccaacatggaagcacaattaataaggcagatggaatcagaaggcatttttctacctaatgaactagaaactccaaacctagccggtcgagtcttagattggttagagaaatacggggtcgaaaggttaaaacgtatggcaatctccggagacgattgcgtggtaaaacccattgatgatcgattcgctactgcactcactgccttgaacgacatgggtaaagtacgaaaagacatccctcagtgggaaccttctaagggatggaatgattggcaacaagtacctttttgtagccatcattttcatcagctaatcatgaaagacggtagagaaattgttgttccctgcagaaatcaggatgagttagtgggcagagcaagagtatctcaaggcgcaggctggagcttacgggaaacagcatgtcttgggaaatcttatgctcagatgtggcaactcatgtattttcacaggagggacctgagactagctgcaaatgcaatttgtagtgccgtaccggtggattgggtcccaacctcgcggacaacgtggtccattcatgcacaccaccagtggatgaccacggaagatatgctgtctgtctggaatcgggtgtggattgaagagaatccatggatggaggacaaaacgcgcatttcatcatgggaagatgtcccatacctaggcaaacgagaggaccagtggtgtgggtctctgataggtttaacggccagagctacatgggctaccaacatacaagttgccatcaatcaagtaagacgtcttatcgggaacgaaaactatagtgactatatgacaagtatgaaaagattcaaaaatgaaagcgaaccagaaggagccttatggtaa

SEQ ID NO: 21775 - RNA, 9879 nt, synthetic construct
  misc_feature 1..9879: note = derived and/or modified CDS sequence (opt6) from DENV-1__GU131681__SS-prME
  source 1..9879: mol_type = other RNA
tcggtgacaatgttactcatgttaatgcctacagcattagcttttcaccttaccacaagagggggagaaccacacatgatagtcacaaaacaagaacgaggaaaaagtttactctttaaaaccagtgctggtgtgaatatgtgtacacttattgcaatggatctaggcgaattatgtgaagatacaatgacttacaaatgtccgagaataactgaagcagaaccagatgatgttgattgttggtgtaatgcaacagatacatgggtgacgtatggaacctgctcacaaacaggagaacatcgaagagataaaaggtcagttgcattggcacctcatgtaggattaggactagaaacacggaccgaaacgtggatgtcctcagaaggtgcatggaaacaaattcaacgagttgagacctgggctctgcgacatccgggttttacagtaatagcactatttttagcgcacgcaattggaacgtcaattactcaaaaaggcattatattcattctccttatgcttgtcactccgagcatggcgatgagatgtgttgggattggttcacgagacttcgtagaaggtcttagtggggcaacttgggtagacgtggtgttagagcatggatcttgtgtaacaactatggcaaaagacaaaccgacacttgatattgagctcctaaaaaccgaagtaacaaatcccgcggtattaagaaaactatgcatagaggctaaaatatcaaatacaacaacagattcacgttgcccaacacaaggcgaagccactctgatggaagaacaagatgcaaacttcgtgtgtagacgtacttttgttgatagaggttggggaaatggatgtggattgttcggtaaaggaagtctaataacatgcgcaaaattcaaatgtgtaaccaaattagaaggtaaaatagtacaatacgaaaacctaaaatattccgtaatcgttacagtccacactggcgatcaacaccaagttggaaatgaaagcaccgaacatggaaccactgcaacaataacgccacaggctccgacaagtgagatacaactaactgattacggtgcactaacgttagattgtagccctcgtaccgggcttgattttaatgaaatggttctgctaacaatgaaagagaaatcttggctagttcacaaacaatggtttcttgacctacctcttccgtggacatcaggcgcatccacaagtcaagaaacctggaacagacaagatctattagttacattcaaaaccgcccacgccaagaaacaggaggtcgttgttttaggatcgcaagagggtgctatgcacacagcactgaccggggcaaccgaaatacaaacatcaggaacaacaaccatatttgcaggacatttgaaatgccgattaaaaatggataaattaacacttaaaggtatgtcctacgttatgtgtactggatcgtttaaactagagaaagaagtcgctgaaacgcaacatgggactgttttagttcaaataaaatacgaaggaactgatgcgccttgcaaaataccattttcaacccaggacgagaaaggggttactcaaaatggtagactcataacagctaatcccatcgtgactgacaaagaaaaacccgtgaatatagaagcagagcctccgtttggagaaagctacattgttataggggcgggggagaaggctttaaaactatcatggttcaagaaaggaagcagtataggaaaaatgttcgaagctacagcacgtggagctagaaggatggcaatattaggtgataccgcttgggattttggctcaattgggggtgttttcacgagtgttgggaaactggtacaccagattttcggaactgcgtatggcgttctattcagtggtgtaagctggacaatgaagatagggatcggcgtactgttaacatggctagggttaaactcaagaagcactagcttaagtatgacctgtatagcagtgggacttgtcactttgtacttgggggttatggtccaagctgattccggttgtgttattaattggaaagggagagaactaaaatgtgggtctggtattttcgtaactaatgaagtacacacatggactgaacaatacaaattccaagcggattctcccaaaagattatcggcggcaattggcaaagcatgggaagaaggagtctgcggtatccgatccgctacacgactagaaaacataatgtggaaacaaatcagcaacgaactgaatcacatattattagagaacgacatgaagttcactgtagtggtaggtgatgtcgtgggtatactagcacaaggcaagaaaatgatacgacctcagcccatggaacataaatatagttggaaatcatggggaaaagccaaaataattggagctgacgttcagaacacaacatttatcatagatgggccgaatactccggaatgtccagatgatcaaagagcatggaacatatgggaagtagaagattatgggttcggtatatttactacaaacatatggctcaaactaagagatagctacactcaagtttgtgatcatagattaatgagtgcggcgataaaagatagtaaagcagttcatgccgatatgggctactggatcgaaagcgagaaaaatgaaacatggaaactcgcacgggcatcctttattgaagttaagacatgtatctggccaaaatcacacactttgtggtcaaatggagttttggagtcagagatgatcatccccaaaatctatggcggtccaatatcacaacataattatcggccaggttattttacacagactgcaggaccgtggcacttaggtaaattagaattagattttgacttgtgcgagggcacaacagtagtagtcgacgaacattgtggtaatcgcggcccatctttacgcacaacgacagtaaccggcaaaataattcacgaatggtgttgcaggagttgtactctaccacctctaagattcaaaggagaagatggatgttggtatggaatggaaattcgaccggtcaaagagaaagaagaaaacctggtaaaatcaatggtatcggcgggttccggagaagtagacagtttctcccttggtcttttatgtatctctataatgattgaagaagttatgcgatcaaggtggtctagaaaagtcctaatgaccgggacgctggcggtctttttattattaattatggggcagcttacatggaatgatctaattagattatgtatcatggtaggtgcaaacgcatctgataggatgggaatgggaactacgtatctcgcactaatggcaacgttcaaaatgaggcccatgtttgctgtgggtttgctctttaggagattaacgtctagggaagttttgctactaacaataggactaagtcttgtagcaagtgtagagcttccaaatagcttagaagaactcggtgatggtttggctatgggcataatgatactaaagctattgacagatttccagtcccaccaattatgggcaacattgttatcacttacattcataaaaactacactatcgttacactatgcatggaagacaatggccatggttctatctatagtatcattattcccactttgcttgagtaccacatctcagaaaacaacctggcttccagtcctgttgggttcactaggatgtaaaccgttgactatgtttctcattgccgaaaataaaatatggggaagaaaaagttggccacttaatgaaggaataatggccgtgggcgtagtaagtattctactaagcagtctcttgaaaaatgacgttcccttagcagggcctttaatagctggaggaatgcttatagcttgttatgtaattagtggatcatcggcggacctatcattagaaaaagccgcagaagtctcgtgggaggaagaagcagaacattctggtgctagtcacaatatacttgtcgaggtgcaagacgacggtactatgaaaatcaaagacgaagaaagagacgacactttgacgatattactaaaagcaactctgttagctgtaagcggagtttacccattaagcatcccagcaacattgttcgtttggtacttctggcagaagaagaaacagagaagtggagtgttatgggatactccatcaccgccagaagtagagcgagcggtgctagatgatggaatatatcggattatgcaacgtggtttgcttggaagatctcaagtgggcgtaggcgttttccaagaaaatgtatttcatactatgtggcatgtgactcgtggagctgttctaatgtatcaagggaaacgtctagaaccttcttgggcatcagtgaagaaagacctcatcagttatggaggcggatggcgattacagggttcttggaatacaggtgaagaagttcaggtaattgcagtagagcctggcaaaaatcccaaaaacgtccaaaccgctcctgggacatttaagacacccgaaggagaagtgggtgctatcgccttagatttcaaacccggaacgagcgggtctccaatcgtaaaccgagagggaaagatcgtaggtttatacggcaacggggtagttactacaagtggcacgtatgttagcgcaattgctcaagccaaagcatcacaagagggacctctacctgaaattgaagatgaggtttttcgaaaaagaaacctaacaataatggatctccatccagggtccggaaagacgcggcgttatctaccggccattgtacgagaagcaattaaaaggaaactccgtacactgatcctagctcccaccagagtcgtggcaagtgagatggctgaggcactgaaaggaatgccaattcgctatcaaacaaccgctgtaaaaagcgagcatacaggaaaagaaatagttgacctcatgtgccacgccacgttcacaatgagactgttgtctcctgttagagtacccaattataatatgatcataatggatgaagctcactttacagatccctctagtattgcagccagaggttacatttcgacgcgagttggaatgggagaagccgccgcgattttcatgacagctacgcccccaggaagcgtggaagccttcccacaatctaacgcagttatacaagacgaggaacgagacataccagagagaagctggaactcaggatatgaatggataacggatttccctggaaaaaccgtatggttcgtaccaagcattaaaagtggtaatgatatagctaactgcttgaggaaaaatggaaaacgcgtaatacagcttagcagaaaaacgtttgatacggaatatcagaaaactaagaataatgactgggactacgttgtgacaaccgatataagcgagatgggagcaaatttcagggccgatcgagtaatagatccgcgacggtgtttaaagccagttatccttaaagacggacctgagagagttatcttggccgggcctatgcctgtaacagtagcatcggctgcacaaagaaggggacgcataggtaggaaccataataaggagggggatcaatacatatatatggggcaaccactcaataatgatgaagatcatgcacattggacagaggcaaaaatgcttttagataacatcaatacgccagagggaattattccagcactgtttgaacccgaaagagaaaaatcagctgcaatagacggtgaatatcgtttacgaggagaagcacgtaaaacttttgtggaattaatgcgaagaggagacctacctgtatggctatcatataaggtggcaagcgaaggattccaatattccgataggcgttggtgttttgatggtgaaagaaataatcaagtgctcgaagaaaacatggacgtcgagatttggacaaaagagggagaacgtaaaaagctacggccaagatggttagatgcacgaacatactcggatccgctagcattaagagagtttaaagagtttgcagccgggagaagaagtgtgagcggagacttaatccttgagattggaaaactgccacaacatctaacacaacgagcacaaaatgcactcgataacctcgtcatgttacacaattctgagcaaggtggaagggcctaccgccatgcaatggaggaattgcctgatacaatcgagactttaatgctattagcgctcatagctgtcctaacaggcggagtaacattgtttttcctatcaggtagaggactaggcaaaacgtcaataggattattgtgtgtcatggcatcatcagtgctgttatggatggctagcgtcgaaccacattggatagctgcttcaatcatacttgagttctttctaatggtattattaattccagaaccagacaggcaaagaacaccacaagataatcaactagcatacgtggtaattggtttactatttatgatactcacagtggcagcgaacgaaatggggcttctagaaacaaccaagaaagatcttggaattggccacgtagctgtagaaaaccaccaccatgctactatgttggacgtagacttgcatccagcatccgcatggacgttgtatgccgtagcaacaaccattataactcctatgatgcgccatacaatcgagaatactacggcaaatatatcgttaactgctattgccaatcaagccgcgatactgatggggctagataaaggctggccgataagtaaaatggacataggagttccactgcttgcattaggctgttatagtcaagtaaatccactaactctcacggctgcggtccttatgttagtagctcattacgcaatcataggccctggactgcaagctaaggctaccagagaagcacagaaacggacagcagcaggaatcatgaaaaatccaacagtcgacggaatagtagccattgacttagacccagttgtatatgacgccaaatttgaaaaacaactgggtcaaataatgttacttatattgtgcacgagccaaatacttctgatgagaacaacttgggccctatgcgaatcaataacacttgcaactggaccactaactacgctttgggaaggctctccagggaaattttggaacacgacgattgcagtgagcatggcaaacatatttaggggaagctatttagccggagccggactagcattcagcctgatgaagtcacttggaggaggtcggcggggaacgggggcacaaggagagactttgggagaaaaatggaagagacaattaaatcagctaagcaagtctgaatttaatatttataagcgtagcggaattatggaagttgacaggtctgaagcaaaagagggcctcaaaagaggggaaactacaagacatgctgtctctcggggaactgcaaagctcaggtggtttgtagaaaggaatcttgtgaaaccagaaggcaaggtcatagacttaggatgtgggcgaggaggctggagctattattgcgccggccttaaaaaggtaacagaagttaaaggatatactaaaggcggacccggtcacgaagaacctatcccaatggctacatacggatggaatctagtcaaattacatagcgggaaagatgtattctttacaccaccagagaaatgtgacaccctcttatgcgatatcggcgaatcttcaccaaacccaaccatagaagaaggcaggacattaagggtcttaaaaatggtagagccatggttaagaggcaatcaattttgtatcaaaatactgaatccctacatgccaagtgttgtcgaaacactagaacaaatgcaacgtaaacacgggggtatgctagtaaggaacccgctatctcgtaactcaacacatgaaatgtattgggtaagttgcggaacaggaaacatagtgtcggccgtaaatatgacctcaagaatgctgcttaaccgcttcacgatggcacacagaaaacctacctacgaacgtgacgtcgacctgggagcaggtactagacatgttgccgtagaacctgaggtcgccaacctcgacattattggccaacgaattgaaaatataaagcatgagcacaaatcaacttggcactatgatgaagacaatccgtataaaacctgggcctaccatggaagttacgaagtaaagccttccggttccgcttcatcgatggtcaacggtgtagtaaagttgctcaccaagccatgggacgtcatacccatggtaacacaaattgctatgacggacacaacacctttcggtcaacaaagagtattcaaagaaaaggttgataccagaaccccgaaagctaagcggggaacagcgcaaatcatggaagttacagcgcgatggctatggggattcctatctcgcaataagaaaccccgtatctgtaccagagaagagttcacacgaaaagtaagaagtaacgcagcaataggagctgtcttcgtagacgaaaaccaatggaactcggctaaagaggctgtagaagatgaacgcttctgggacttagttcaaaaagaaagagagctacacaaacaagggaaatgtgcgacgtgcgtgtataacatgatgggaaaaagggagaagaaactaggtgaatttgggaaagcaaaaggctcccgggcgatttggtatatgtggttaggcgctagatttctagaatttgaagcactcggattcatgaatgaagaccattggttttctcgagaaaattcactaagtggagtcgaaggtgaaggccttcataaattagggtacatactcagagatatatccaaaatacctggcggaaacatgtatgccgacgacacggcaggatgggatacaaggataacagaggatgatcttcagaacgaagccaaaatcacagatataatggaaccagagcatgcactgttagctaccagtatatttaaattgacatatcagaataaagttgtgagggtacagcgacctgccaaaaatggaaccgtgatggacgtaatatcaaggagagaccaacgaggatcgggacaagtcggaacatatggtttaaatacttttacaaatatgggagcacaacttatacgacaaatggaatccgagggtatattcagcccttcagaactagagatcccaaatttagccgaaagagtcctggattggttggaaaaatacggcgtcgaaagactaaaacggatggccataagtggggacgattgcgtcgtgaagccaatagatgatcgatttgctacggctttaacagcactcaacgatatgggtaaggtaagaaaggatgttccgcaatgggagccatcaaaaggctggaatgattggcaacaggtcccattttgtagtcatcatttccaccaattaataatgaaggatggcagggaaatagtagtaccctgcaggaaccaagacgagctagtcggacgtgcgcgagtatcacagggagccgggtggtccttacgagagacagcatgtctagggaaatcatacgcacaaatgtggcaattaatgtacttccatagaagagacttaagactcgcggcaaatgcaatatgttcggcagttcccgtagattgggtacctacttctcgaacgacatggtcaatccatgcacaccatcaatggatgacgactgaggatatgctaagcgtttggaatagggtttggatagaagaaaacccatggatggaagataaaactcatgttagctcatggggagatgtcccatacttaggtaaacgagaagatcaatggtgcggctctttgattggattaactgcgagggcaacatgggcttctaatattcaagttgcaattaatcaagtgcgtaggttaatagggaatgaaaattatctcgattatatgacctcgatgaaacgttttaaaaacgaaggcgacccggaaggggcattatggtaa

SEQ ID NO: 21776 - RNA, 9879 nt, synthetic construct
  misc_feature 1..9879: note = derived and/or modified CDS sequence (opt6) from DENV-1__GU131682__SS-prME
  source 1..9879: mol_type = other RNA
tctgtaacaatgcttctaatgctcatgccaactgctctggcttttcatttaacaacgagaggaggagaaccacacatgattgtatcgaaacaagaacggggaaaatcattgctgtttaaaacgtctgctggcgttaacatgtgtacactcatcgcaatggatctaggagaactttgcgaagacaccatgacttataaatgccctcgtattacagaaacggaacccgacgacgtagactgttggtgcaacgctactgacacatgggttacctacggcacatgcagtcaaactggtgaacatagaagagataaacgtagtgtagcattagcaccacatgtaggtttaggcttggaaactagaacggaaacgtggatgtcctcagaaggtgcttggaaacaaattcaaagggttgaaacatgggctttaaggcacccagggtttacggtcatagcattattcttggcacatgtgatcggtacctccattactcaaaaagggataatctttattttattaatgctggtcacaccatcgatggcaatgagatgcgttggaattggttccagggattttgtggaagggctttctggagctacctgggttgatgtagtattggaacatggttcctgcgtaacaacaatggcaaaagataaaccgacacttgatattgaactcctaaaaactgaagtaactaatccagcagtcctaagaaaattgtgtattgaggcaaaaatatctaacacaacaacagattccagatgccccacacaaggggaagcgacattggttgaagaacaagacgcaaacttcgtatgccggcgaacttttgtagatagaggatggggcaatggatgtggtttgtttgggaaagggtcattaattacttgtgctaaatttaaatgtgtcactaaactagaaggaaaaatagttcaatatgagaatttaaaatattctgtgatagttaccgttcatacaggtgatcaacaccaggtcggaaatgaatcaacagaacatgggaccacagctacaataacgccgcaggcgccaacaaccgaaatccaattaacagattatggtgcattaactctggactgttcaccaaggacaggtttagactttaacgagatggtattattgacaatgaaagaaaaatcctggctagtgcataaacaatggtttttagatttaccacttccttggacaagcggagcatccaccagtcaggagacatggaatcggcaggacttattagtaactttcaaaaccgcacatgccaagaaacaagaggtcgttgttttaggtagtcaagaaggtgccatgcatactgcattaaccggagctacagaaatacagactagcggcactaccactatctttgcaggtcacttaaaatgtagattgaaaatggacaaattaacacttaaaggtatgtcatatgtcatgtgcacaggatcgtttaaactagaaaaagaagtagctgagacacaacacggtacagtccttgtgcaaataaaatatgagggaacggatgcaccctgtaaaattccattttcaacccaagacgaaaagggtgtaacccaaaatggaaggctaatcactgccaatccaattgtcacagataaagaaaaaccagttaatatagaggcagagccgccatttggtgaaagttatataatcattggagccggagaaaaagccttgaaattatcatggtttaagaaagggagctccataggaaaaatgtttgaagcaaccgccagaggggcaagaagaatggctattctaggtgacacggcatgggatttcggaagtataggcggggtcttcacatccgtaggaaaattagtacatcaaattttcggaactgcttatggggtcctattttcaggagtctcctggactatgaagataggcatcggagtcttattaacatggctaggtttaaactctagaagcacatctttatccatgacttgcatagccgttggcctagtaacattatacctgggagttatggtacaagcagactcaggttgtgttataaattggaaaggacgagaattaaaatgtggatctggaatatttgttaccaatgaagtccatacatggacggagcaatacaaatttcaagccgattccccaaaaaggttatctgctgcgataggaaaggcatgggaggagggtgtatgtggaatacggtccgctactcgcttagagaatattatgtggaagcaaatatcgaatgaattgaatcatatactacttgaaaatgatatgaaattcactgtagttgtaggagacgtcgccggcatcctcgcgcaggggaagaaaatgatacgcccacaaccaatggagcataagtactcatggaaatcgtggggtaaagctaaaataattggcgcggatgtgcaaaatacaacatttataatagatggtcctaatacacccgagtgtccagatgaccaaagggcatggaacatttgggaagtagaagattatggattcggaatatttactaccaacatatggctaaaactacgcgattcctatacacaagtatgtgatcacagattaatgtctgcagcgattaaagacagtaaagcagtacacgctgacatgggctattggatcgagtcagaaaagaacgagacatggaaactcgcaagagcgtcatttatagaagttaagacttgtatatggccaaaatctcatactctatggagtaatggcgtgttagagtcggaaatgattataccaaaaatatatggtggccctattagtcaacacaattaccggccaggttacttcacgcagaccgctggtccatggcatctaggaaaactagaattggattttgatctttgcgagggtactacggtagtagtggacgagcattgtggaaaccgggggccctctttacgcaccactacagtaacgggtaagatcattcatgaatggtgttgccgcagttgcaccttacctccattacgctttcgtggagaagatggatgctggtatggaatggaaataaggccagtaaaagagaaagaggagaatctcgtaaaaagcatggtatcagcaggctctggcgaagtagactcatttagcttgggattgctatgcatctcaattatgatagaagaagtaatgcggtcgaggtggtcccgcaaaatgttgatgacagggactctggcagtattctttttattaatcatgggccaattgacatggaatgacttaattaggttatgcattatggtgggggcaaacgccagtgacagaatgggtatgggaacaacatacttagcactaatggccacattcaaaatgaggcctatgtttgcagtaggtttgctctttaggcgactaacctcaagagaggtgctcctattaacaatcggacttagcttagtggcttctgtggagttaccaaacagcctagaagaattgggagatgggcttgcgatgggtatcatgattctaaaactacttaccgatttccaatctcaccaactctgggccacactcctgagtcttaccttcattaaaactacattttccttacattatgcctggaaaacgatggcaatggttttatccatagtgagtcttttccccttgtgtttaagtacaacaagccagaaaactacttggttaccagtcttactaggttcccttggctgcaaaccgttaactatgtttctgatagcagagaataaaatatggggtagaagaagctggccactaaatgaaggaataatggccgttggaatagtaagcattttactcagctcgttattaaagaatgacgttccactagctggtccactcattgctggtggaatgcttatagcgtgttatgtaatttcaggttcgagtgcagacctcagcttagaaaaggccgcagaagtttcatgggaggaagaagcagaacattcaggcgcatcacacaatatactcgttgaagtacaagacgacgggactatgaaaattaaagacgaggagcgagacgatacattaacaatattactgaaagcgactttattagccgtatcgggggtgtaccctctaagtattccagcaacgctctttgtatggtacttttggcaaaagaagaaacaacggagcggtgtcttatgggatacaccatcgcctccagaagtggaaagggcagtgctagatgatggaatatacaggattatgcaaagaggtttgttgggaaggtcacaagtgggagtaggggtattccaagaaaatgtattccatacaatgtggcacgttacacgaggggctgtgcttatgtatcaaggaaaaagattagaaccatcttgggcctctgtcaagaaagatttgatatcatacggtggaggatggcgcttacaggggagctggaacactggtgaggaagtccaagtaattgctgtcgagcctggcaaaaatcccaaaaatgtgcagacggcgccaggaactttcaagacacccgaaggggaggtgggcgctattgcactagattttaaacctggtacaagtgggagtccgattgttaatagggaaggaaaaatcgtgggactgtacggaaacggtgtagtaaccacctcgggaacttatgtaagtgcaattgctcaagcaaaagcaagtcaagaaggaccgctacctgaaattgaggacgaagtgtttcggaaaagaaatcttacaataatggatttacacccaggatcaggcaagactcgccgatatttaccggcaattgtacgtgaagctataaaacgtaagctgcgtacattaatcttagcgccaacaagggtagtagcgtctgaaatggcagaagccctcaaaggaatgccgatacgatatcaaacgacagccgttaaatcagagcacaccgggaaagaaatcgtagatttgatgtgccatgccacatttacaatgcgtttactatcaccagtaagggtacctaactataatatgataattatggatgaagcacacttcacagaccctagttcaatagcagcaaggggctacattagtactagagttggaatgggagaggctgccgctatcttcatgactgcaactccaccaggatcggtagaggcttttccacaaagtaatgcggttattcaagatgaggaacgtgacataccagaacgatcatggaactcaggatacgaatggataactgattttcctggaaaaacagtatggtttgttccctccatcaaatctggaaatgacattgcgaattgcttaagaaagaatgggaaacgagttattcaattatcaagaaaaacattcgacactgagtatcagaaaaccaaaaataacgattgggactatgtagtgacaactgatatttcggagatgggagctaattttagggcagatagagtgatcgatccacgaaggtgtctgaagccagtaattttgaaggatggaccagaacgagtcatattggctggccctatgcctgttaccgttgccagtgcagcacaacgaagaggaagaatcgggagaaaccacaacaaagaaggcgatcaatatatttacatgggacaacctttgaacaatgacgaagatcatgcacattggaccgaggccaagatgctattagataacattaatacgccagaaggaattatccccgccttattcgaaccagaaagagagaaaagcgctgcaatcgatggcgaatacagattacgcggtgaggctcgtaaaactttcgtcgaattaatgagacgtggggatctcccagtctggctatcttacaaggtagcttctgagggatttcaatactctgacaggagatggtgtttcgatggcgaacgcaataaccaagtgctagaggaaaacatggatgtcgaaatatggacgaaggaaggcgagcgaaagaaacttcgtcctcgatggcttgatgctagaacctatagcgatccattggcattgcgagaatttaaggagttcgcagctggtcgtcgtagtgtttcaggcgacctaatcttagagattgggaaattgccacaacacttgacgcaacgagcgcagaacgctctagataatttagtgatgctccacaactctgaacaaggagggagagcttatagacacgccatggaggaattaccagacacgattgagaccctaatgctattagcgcttattgcagtactcactggcggagttactttattctttttatcaggtagaggtttagggaagacaagtatcggacttttatgtgttatggcttcatctgttcttctgtggatggcttctgtcgaaccgcactggatcgcagcaagtattatattagaatttttccttatggtattgcttatccccgaacccgatcgacaaaggacacctcaggataatcaactcgcttatgttgtaatcgggttgctctttatgattctaaccgtggcagccaacgaaatgggattgctcgaaactacaaagaaagatttaggaatcggtcacgtcgcagtagagaaccaccatcatgcagctatgctagatgtcgacttacatccagccagtgcttggacactttacgcggtcgcaacgacaataataactccaatgatgcgtcatacgatagagaatacgaccgcgaacattagtctgaccgcaatagcaaatcaggcagctattttaatgggtttagataaaggctggccaataagtaaaatggatatcggggtcccactactcgccttgggctgttactcacaagtaaaccctttaacactgacagcagcagtactaatgctggttgcacattacgcgataattgggccaggactacaagctaaagcaacgcgtgaagcccagaaaagaacagccgcaggaatcatgaaaaatccgacagtcgatggaatagtagcaatagatttagacccggtagtatacgatgctaaattcgaaaaacaattaggacagatcatgcttctcattttgtgtacatcccagatactcttaatgagaacgacttgggctctttgcgaaagtattacccttgcaacaggtcctctaacgactctatgggaagggtctccaggtaaattctggaacactaccatagcagtgagtatggctaatatatttaggggttcttatcttgccggtgctggactagcattctctcttatgaaaagtttaggaggtggccgtagaggaaccggcgcacaaggtgaaacattaggcgaaaaatggaaaagacagctaaaccaattgagcaagagtgagtttaatacatacaaacgaagtggaattatggaggtcgatcgctcagaagccaaagaaggtttaaaaagaggagaaactacgaagcacgccgttagcagaggaacggcgaaacttagatggttcgtggagagaaacctagttaagcccgaaggcaaggttatagacttaggttgtggtcgaggcgggtggtcctactattgcgcagggttgaagaaagtaacagaagtcaaaggatacacaaaaggcggcccgggacatgaagaacctattcctatggcgacttacggatggaacctggtgaaattacatagtggaaaggatgtcttcttcataccacctgaaaaatgcgacacccttttatgtgacatcggagaaagtagccctaatccaacaatagaagaaggtcgaacgctaagagtactaaaaatggtggagccatggctacgcgggaaccaattttgtatcaagatcttgaatccttatatgccatcagtcgtggaaacgctcgaacaaatgcaacgaaaacatggaggaatgttggtacgaaatccgctgagccgtaatagcactcacgaaatgtactgggtatcatgcgggacgggcaacatagtgtctgcagtaaacatgacatcaaggatgcttttaaatagatttaccatggcacaccgaaagccaacttatgaaagggatgttgatctaggtgctggcaccaggcacgtagctgtagaaccagaagttgcaaatttagatattataggacaaagaatagaaaatattaaacatgaacacaaatctacttggcactatgatgaagataacccgtataagacatgggcatatcatggatcatatgaagttaaaccatccggtagcgcctcaagtatggtaaatggtgtagtaaaactgctaacaaaaccctgggatgtaatacctatggtgactcaaattgctatgactgacacaactccattcggccaacaacgtgtattcaaggaaaaagtggatactagaacacctaaagccaaaagaggaacagctcaaatcatggaggtgacagcgaaatggctatggggatttctatcaaggaataagaaaccaagaatatgtacacgcgaagagttcacaagaaaagtcaggagtaacgcagcaattggagccgttttcgtagacgaaaatcaatggaactctgctaaggaagccgtagaggacgaacgtttctgggacttagtccaccgtgaaagagagctacacaagcaaggaaaatgtgcaacttgtgtttataacatgatgggcaaacgggagaagaaactgggtgaatttggtaaagccaaaggcagcagggcgatatggtatatgtggctgggtgccagattcctagaatttgaagctctaggattcatgaatgaagatcattggtttagcagagaaaattcactaagtggagtcgaaggggaagggcttcataagttgggttacatactgcgagatatttcgaaaattcccggaggcaacatgtacgcggacgatacagctggttgggatacacgtatcaccgaagacgacctacagaacgaagcacgaattacagacataatggagccagaacacgcgttactcgctaaaagcatctttaagctaacataccaaaataaagtagtgagggtacaacgaccagcgaaaaacggtacagtaatggatgtaatcagcagacgcgatcaaagaggatcaggccaagtgggaacatacggtttaaatacattcaccaatatggaagcacagttaataagacaaatggaatctgagggaatatttagtccttctgaattagaaaccccaaacttagcagaacgagtcctggattggcttgaaaaatatggagttgagagacttaagcgcatggcaatatcgggagacgattgcgtggtgaaacctatagatgatagatttgccacagcgctaacagctctcaacgatatgggaaaggtaagaaaagatattccgcagtgggaaccttcaaaaggatggaatgactggcagcaagttcccttctgtagccatcactttcaccaattgatcatgaaagatggaagagaaatagtagttccctgcagaaaccaagatgagttggtgggtcgagcacgggtatctcaaggtgctggatggagtcttagagagactgcatgtttggggaaaagttatgcccagatgtggcaacttatgtattttcatcgacgtgatctccgcttagcagccaacgcaatttgctcagcagtaccagtagattggatcccaacgtcgagaaccacctggagtatacacgcgcatcaccaatggatgaccacagaagatatgttgagcgtttggaatcgagtatggatagaggagaacccctggatggaagataaaacacatataagtagctggggagatgttccctatttgggaaaacgcgaggaccaatggtgtggatcattaataggtctcaccgcgcgggcgacatgggcgaccaacatacaagttgcaataaatcaagtaagaagactaataggtaatgaaaactacttagactacatgacttcaatgaaacgattcaaaaacgagtcagatcccgaaggcgccctttggtaa

SEQ ID NO: 21777 - RNA, 9879 nt, synthetic construct
  misc_feature 1..9879: note = derived and/or modified CDS sequence (opt6) from DENV-1__GU131683__SS-prME
  source 1..9879: mol_type = other RNA
tcagtgactatgttgttgatgcttatgccgactgcactagcctttcatttaactacaagagggggtgaaccccatatgattgtgtcaaaacaagaacgtgggaaatccttactgttcaaaactcccgcgggcgtgaacatgtgtacactaattgctatggacttaggtgagctatgcgaagatactatgacatacaaatgcccaaggattaccgaaaccgaaccggatgacgttgattgctggtgtaacgcaacagacacatgggttacatatggaacctgctcacaaaccggagagcaccgacgagataaaagatccgtagcactcgccccacatgttggtcttggtcttgaaacgagaacagaaacgtggatgtctagtgaaggggcttggaaacaaatacaaagagttgagacatgggctttgagacatccaggctttactgtaattgcgttatttctcgcccacgcaatagggacgtcgataactcaaaagggaataatatttatattgctgatgctcgttactccgagtatggcgatgagatgtgtaggaatagggtcacgagattttgtcgaagggctaagtggagcgacatgggttgatgtagtcctggagcatggaagttgtgtaacaacaatggcaaaagataagcccacactcgatatcgaattacttaaaacggaagtaacaaaccctgccgttctacggaaactttgtatagaagctaaaatctccaacacaacgactgattcaagatgtcctactcaaggtgaagcaaccttggtggaagaacaagacgcaaattttgtatgcagaagaacatttgtagaccgtgggtggggaaacgggtgtggactatttggcaagggcagcctaataacttgcgcaaaatttaagtgtgtaaccaaattagaaggaaaaatagtacaatatgagaatcttaaatatagtgtcatagtaacagtacacacgggagaccaacatcaagtaggaaatgaatcaacagaacatggtacaaccgcgaccataacaccgcaagcacccaccacagaaattcaacttacagattacggtgcgctaactttagattgcagtccgcgaacaggattggactttaacgagatggtgctattaacaatgaaagaaaaatcttggttggcgcataaacaatggtttttagacttacctcttccttggacatcaggagcaagcacgtcccaagaaacgtggaacaggcaggatcttttagttaccttcaagacggctcatgctaagaagcaagaagtagtggtattaggaagtcaagaaggggctatgcatacagccctaactggtgccacagaaatccaaacttccggaacaactacaatctttgcaggtcacctgaaatgcagacttaaaatggataaattaaccctgaaaggaatgagttatgtaatgtgcacaggatcattcaaactggaaaaagaactggctgaaacacaacacggaacagtccttgtacagataaagtatgaaggaacagatgcaccttgtaaaataccctttagtacacaagatgaaaaaggagtgacacaaaacgggcggcttattaccgctaatcctatagtgacagataaagaaaaacctgtcaatattgaagccgaaccaccatttggagaatcatacatcgttataggcgccggtgaaaaagctcttaagttatcttggttcaagaaaggatcgtcaattggaaaaatgttcgaggccacagcacggggcgctaggaggatggcaatattaggagatactgcttgggattttggttctattggaggtgtgttcacttcggcaggtaaattagtacatcaaatttttggaacagcctatggggttctattctccggtgtgtcatggaccatgaaaatcggcataggagtcttattaacgtggttaggactgaactcaaggtcaacatcattatccatgacttgtatagcagttggattggttaccctttatctaggtgtcatggtccaagctgactccggatgcgtgattaactggaaaggaagggagctaaaatgcgggtctggaatcttcgttacaaatgaagttcacacttggacagaacaatataaattccaagcagatagtcccaagcgcctttcagccgcaataggaaaagcatgggaagagggtgtatgtggtatcaggtctgcaacacgtctagaaaacataatgtggaaacaaattagtaacgaattaaaccatatattacttgaaaatgacatgaaattcactgttgttgttggcgatgtagccggcattcttgctcaaggcaagaaaatgatacgaccccagccaatggaatacaaatactcgtggaaatcatggggaaaagctaaaataattggggctgacgttcaaaatacaacatttattatcgacggcccaaatactccggaatgtcctgatgaccaaagggcctggaatatctgggaagtggaagactacggatttggaatcttcacaacgaatatatggctaaagctcagagatagctacacacaagtttgtgatcacagacttatgtcggctgcaattaaagacagtaaagcagtgcacgcagatatgggatactggatcgagtcggagaaaaatgaaacttggaagttagccagggccttctttatagaagtgaaaacatgtatatggcctaaatcacatactctgtggagtaatggagttttagaatcagagatgattataccaaaaatatacggtggcccaattagccaacacaattacagaccgggttattttactcagactgccggaccgtggcatctcggaaagttagaattagatttcgatctctgtgaggggacaacagtagtagtagatgaacactgtggaaatagggggccatcattaagaactacaacagtaacaggaaaaataatacacgaatggtgctgtcggtcttgcacattaccaccattaagatttcgtggcgaagatggatgctggtatggaatggaaattcgaccagtgaaagaaaaagaagaaaacttggttaagtccatggtatcggcaggaagcggtgaggttgattctttttcattaggactcctctgcataagcataatgatcgaagaagtgatgaggtccagatggagtcgtaaaatgctaatgaccggaaccctcgcagtattctttctcttaataatggggcaactaacgtggaacgatcttatacgcttatgcattatggtaggggctaatgcatcggaccgaatggggatgggtactacatatttagccctaatggcaacttttaaaatgaggccaatgtttgctgtggggcttctattcagacgactgacgagcagggaggtcttgctattaacaataggtcttagcctagtcgcgagtgtcgagctacctaactctttggaagaactaggagacgggcttgcgatgggtattatgatacttaagttattaaccgatttccaatcacaccaactttgggcaacacttttgagcttaacatttattaaaacaacattctcgctacattacgcctggaaaactatggccatggtcctgagtatcgtctctttgtttcctttatgtttatctactacaagtcagaaaactacttggctaccagtcctattaggatcacttggatgtaagccccttacaatgtttctaattgcagagaacaaaatatggggtagaagatcatggcccctaaatgaagggatcatggccgtcggtattgtatcgatattattaagttcacttttgaaaaacgacgtcccgctggcaggccctttaatagctggaggcatgttaattgcgtgctacgtaatttctggttcatccgcagatttatcattagaaaaagcagctgaagtaagttgggaagaagaagcagagcattctggggcgtcccataacatcctcgtcgaagttcaagatgatggtaccatgaaaataaaagatgaagagagagatgataccctcacgatactattgaaagcaacattgttggcggtttccggagtttatccgttgtccattccagcaactttgttcgtttggtacttctggcaaaagaagaaacaaagatccggtgttttatgggacacccctagtccacccgaagtagagagagccgtacttgatgacgggatatacaggataatgcaaagaggacttctagggcgttcccaagtaggtgttggtgtctttcaagaaaatgtattccacactatgtggcatgttactcggggtgctgtcctaatgtaccaaggtaaacgactggaaccaagttgggcaagtgtaaagaaagatttgatttcatatggaggagggtggagattacagggatcatggaacacgggcgaagaggtgcaagtaattgcagttgaaccaggtaagaatccaaagaatgtacaaactgctccaggcacattcaaaaccccagaaggagaagtaggagctatagcgctagacttcaaacctggaacgagtggctcgcccattgttaatcgtgaaggaaaaattgtaggattgtacgggaatggagttgtaactacatcggggacatatgtgagtgccattgcgcaagcgaaagccagccaggaaggaccattaccagagatcgaagatgaagtctttagaaaaagaaacttgacaattatggatttacatccaggaagtggtaagacccgcagatatctgcctgcaatagtaagggaagccataaaaaggaaactgagaactttaatcttggctcccacccgagtagtcgcatccgaaatggcagaagccctcaaaggtatgcccatccgttaccaaactacagcagtcaaaagcgaacacactggcaaagaaattgtagatttaatgtgtcatgctacctttacgatgcggttattatctcctgtcagggtaccaaattataatatgataataatggatgaggcacattttacagatccctccagtatagctgcccgaggatacatatctacgagagtaggaatgggagaagcggctgccatatttatgacagccactcctccaggctcagttgaagcctttcctcagagcaatgcggttattcaagatgaagagagggatattcctgagcggtcatggaatagcggatatgaatggataacagattttcccggtaaaactgtatggtttgtcccaagcattaaatcaggaaacgacatagccaactgcctaagaaagaatggtaaaagggtcattcagctatcaaggaaaacatttgacactgaataccagaaaacaaagaacaatgactgggattacgtcgtcactactgatatttcggagatgggcgcgaactttagagccgatagggtaatagatccacggagatgcttaaaaccagtgatacttaaagacggtcctgaacgtgtaatattagcgggtccaatgcccgtgacggtagctagtgcagcacagcgccgaggccgaataggtagaaaccataataaagaaggcgatcagtatatctatatgggccaaccactaaataatgatgaagatcatgcccattggacagaagcgaaaatgttactagacaatataaatacacctgaaggaattattccagccctctttgaacctgaacgagagaagtcagctgcaatagacggtgaatatagactacgcggtgaagcacggaaaacttttgttgaattaatgcgacgcggagaccttccagtatggttatcatacaaagttgcatccgagggttttcaatattctgatagaagatggtgtttcgatggcgaaaggaataatcaagtactcgaagaaaacatggatgtagaaatctggacgaaagaaggcgaacgcaagaaattacgtcctagatggttggatgcaaggacctacagtgacccattagcgcttagggaatttaaagaatttgcagccggaaggcggtccgttagtggagacctaatacttgaaattggcaaactgccacaacatcttactcagcgcgctcagaatgcacttgacaatttagtcatgttacataacagtgaacaaggaggacgggcatatagacatgctatggaagaattaccagacacgattgaaactttaatgctattggctttaattgcagtattaacaggaggagtaacattattctttctttcaggtagaggcctaggtaaaacgtctattggtctactttgcgttatggcaagtagcgtccttctctggatggcttcagttgagccacattggatcgcggcaagcataatattagagttctttctaatggtactgctgatacctgaacctgacaggcaaagaaccccacaggacaaccaactagcttacgttgtcatcgggctactgtttatgatcttaacagtcgcagccaatgaaatgggcttattggaaaccacaaagaaagatttaggcattggacatgtagcggtcgaaaaccatcatcatgccgcaatgttagatgtagacttacacccagcttcagcatggacgctttatgcagttgctacgactataattacgcccatgatgagacacactatcgaaaatacgaccgccaacatatcgctcactgcaatagcaaaccaagcggcaatactcatgggtttagataaagggtggccaatatctaaaatggacattggcgtacctctattggctcttggatgttatagtcaagtaaaccctttaaccctaacagcagcggtcttaatgctcgtcgcccattatgcaataatcggtcctggattacaagccaaagcgactagggaagcacaaaaacggacagcagcggggattatgaaaaatccaactgtagatggaatagttgctatagaccttgacccagttgtatatgacgccaaattcgaaaagcaattaggccaaataatgctgttaatactgtgcacgagtcagatattgttaatgcgtacaacgtgggcactctgtgagtctataacccttgccactggtccactaactacgctctgggaaggaagtcccgggaaattttggaatactacaatagcagtcagcatggcaaatatattcagggggagttatctagcgggtgcgggtctggcatttagcttaatgaagtcattaggaggaggtaggaggggaacaggcgcacaaggtgaaacattaggagaaaaatggaaacgtcagttgaatcaactctccaagtcagaatttaatacgtataaaaggtcagggatcatggaggtagacagaagtgaagcaaaggaagggctgaaacgcggtgaaacgactaaacatgcagtgagtcgcggaacggccaaactacgatggtttgtggagcgcaatttagtaaaacctgagggcaaagttattgatttaggatgcggacgtggagggtggtcgtactattgtgcaggactgaagaaagttacagaagtgaagggatatactaagggtggcccgggtcacgaagaaccaataccaatggcaacatatggctggaaccttgttaaacttcattcgggcaaagatgtatttttcatcccaccagaaaaatgcgacactctgctatgtgatattggagaatcatctccaaatccaaccatcgaggaaggtaggacattaagggtattaaaaatggtcgaaccatggttacgaggaaatcagttttgtataaaaattctaaatccttacatgccaagtgttgtagagacccttgagcaaatgcaaaggaaacacggaggaatgcttgtaaggaacccattgtcacgtaacagcactcatgaaatgtattgggtgtcctgcggaacgggcaacatagtatctgcggttaacatgacctcgcgaatgttgctaaacaggttcacaatggctcacagaaaaccaacctatgaaagagacgtcgatctaggggctgggaccaggcatgtggcagtagaacccgaagtcgccaatttagacatcattgggcaacgtatagaaaacatcaagcacgaacataaaagtacatggcactatgacgaggataatccttataagacatgggcataccatggtagctacgaggttaaaccaagtggttcagcctcttcaatggttaatggggtagttaaattattaacaaaaccttgggacgttatacctatggtaacccaaatagcaatgactgatactacaccttttggccaacagagggtttttaaagaaaaagttgacacaagaacccccaaagcgaaacgaggtacagcccaaatcatggaggttacagctaaatggctgtggggttttctgagtagaaataagaaaccacggatctgtacaagagaggaatttacacgaaaggttagaagcaacgccgctataggagcagtgttcgtcgatgaaaaccagtggaactccgccaaggaagcagttgaagatgagaggttctgggacttagtacaccgagaaagagaactacacaaacaaggcaaatgtgccacttgtgtttacaatatgatgggaaaacgtgagaagaaattgggagagttcggtaaagcaaaaggatccagggccatatggtacatgtggcttggcgctcgctttttagaatttgaagcattagggtttatgaatgaagatcactggttctcaagggaaaattcactgtcaggtgtcgagggcgaagggctacataaacttggatacatattaagggatatttcgaaaatccctggaggcaatatgtatgccgacgatactgctggttgggatacacgaatcactgaggatgacttacaaaatgaagcaaggattacagatataatggagccagaacatgctttactagcaaagtctatttttaaacttacttaccaaaataaggtagtcagggtgcagagacccgctaaaaacggaacagtaatggacgtgatatccagacgtgatcaaaggggttccggtcaagtaggaacttatgggttaaatacttttactaatatggaagctcagttaatcagacaaatggaatccgagggtatctttagtccatctgagctagagacgccaaacttggctgaaagagttctagactggttggaaaagtatggcgtcgagagattgaaaagaatggccataagtggcgatgactgtgtcgttaaaccaattgacgacagattcgcaacggcattgactgccctcaatgatatgggaaaagtccgcaaagatatacctcagtgggaaccatctaaaggttggaacgattggcagcaagttcctttctgtagtcatcatttccatcaactaataatgaaagacggacgtgagatagtggttccgtgtagaaatcaagatgaattagttggtagagctagagtatcgcaaggcgcaggctggtctttaagagagacagcctgcctcggaaagtcatatgctcaaatgtggcaactaatgtatttccatagacgtgaccttcggctcgcagcaaacgccatatgcagcgctgtgcctgtcgactggataccgacaagccgtactacatggtcaattcatgctcatcatcaatggatgactacggaagacatgttgtcagtgtggaaccgtgtctggatcgaagaaaacccatggatggaagataaaacgcatatttcaagttggggagatgttccctatcttggaaagcgagaagatcagtggtgtggttctttaatcggattaacagctcgagcaacttgggcgaccaatatacaggttgctattaatcaagttagacggctaataggcaacgaaaactatctggactacatgacaagtatgaagagattcaagaatgaaagtgatccagagggagcattatggtaa

SEQ ID NO: 21778 - RNA, 9879 nt, synthetic construct
  misc_feature 1..9879: note = derived and/or modified CDS sequence (opt6) from DENV-1__GU131684__SS-prME
  source 1..9879: mol_type = other RNA
agtgtaactatgctattgatgctcatgcctactgctttagctttccacctaacgactcgtggaggagaaccgcacatgatagtgtctaaacaagaaagaggaaaatccttactttttaaaacgtcagctggtgtaaacatgtgtacgttaatagcaatggatctaggagagttctgtgaagacacgatgacttacaaatgtcctaggatcactgaagcagaaccagatgatgtagactgttggtgcaatgctactgacacctgggtaacctatggaacgtgctcccaaacgggcgaacacagacgcgacaaacggagtgtagcgttagcaccacatgtcggactagggctcgaaacaagaacggaaacgtggatgagctcagaaggagcttggaaacagattcaacgagtcgaaacttgggcacttcgccatccaggatttaccgtcatcgccctttttctcgctcacgcaataggaacaagcataacacagaaaggaataatttttatattactaatgctagtgacaccttcgatggctatgcggtgcgtgggaataggttctcgagattttgtcgaagggcttagtggtgcgacatgggtagacgtagtcttggaacatggaagttgtgtcacaaccatggccaaagacaaacctaccctagatatcgaactactcaaaacggaagtcacaaaccccgccgtgttaagaaaactatgtatagaagctaaaatatctaacactacgactgatagtcggtgccccacccaaggagaagctaccctagttgaagaacaggatgctaatttcgtatgtcgaagaacgtttgttgatagaggctggggcaatggatgtggtctcttcggaaaaggatcgcttataacctgcgctaaattcaaatgtgtcacaaaattggaaggaaaaatagtacagtatgaaaatctaaaatactcagtaattgttactgtacacactggggatcaacaccaagtaggtaacgaatcaacagaacacgggacgacagcaacaattacaccccaagccccgagcacagaaatacaactaacagactacggggcattaacgcttgactgtagcccacgtacgggactagactttaatgaaatggtattgttgaccatgaaggaaaaatcatggctagttcacaagcaatggttcttagatttacccctgccgtggacaagtggcgcctcaacttcacaagaaacatggaatcgtcaagatctgctggtcacatttaagactgcgcatgccaagaaacaagaagtagtcgtcctagggtcccaagaaggtgctatgcatacagccttaactggtgcgacagaaattcaaacatcaggaactacaactattttcgccggtcatctaaaatgcaggcttaaaatggacaaattaacactcaaaggaatgagttacgttatgtgcacggggtcgtttaaactagaaaaggaagtagctgaaactcaacacggaacagtcctagtacagataaaatatgaaggtacagatgcaccttgtaaaataccctttagtacacaagatgaaaaaggtgtaactcagaacggaaggttgattaccgctaaccctatagtaacggataaagaaaaaccagtaaatatagaggcagagccaccatttggtgagagttacatagtaataggagccggtgaaaaagcgttaaaattatcttggtttaagaaagggtccagtataggtaagatgtttgaagccacagctaggggagctagacgtatggcaatcttaggtgacacagcatgggacttcggtagtattggaggagttttcacaagtgtaggtaaattagtacaccaaatatttggaacagcctatggggtactattttcaggagtctcctggacaatgaaaataggtataggagttttactgacatggttgggcttaaattctaggagcacaagtctaagtatgacatgcatagcggtgggactcgttacgctttacctcggggtaatggtacaagcagatagtggctgcgttataaactggaaaggtcgagaactgaaatgtgggtcaggaatatttgtaacaaatgaggtacatacgtggacagaacaatacaaatttcaagccgactcgccgaaacgcttatcggctgcgattggtaaagcatgggaggaaggggtatgcggaataagatccgccactagactagagaacattatgtggaaacaaattagcaacgaactaaaccatatacttctagaaaatgatatgaagctgacagttgtagtaggcgacgtcgctggaatattggcccagggcaagaaaatgattcgaccgcaacctatggagtataaatatagttggaaatcgtgggggaaagccaaaattatcggtgcggatgtacaaaatacaacatttataatagacggaccgaatacacctgaatgtcctgatgatcaacgcgcctggaatatatgggaagtagaagactacggattcggtattttcacgaccaatatttggttaaagttacgcgattcttatacacaagtgtgcgatcaccgtcttatgtccgcggctataaaagactctaaagcagtgcatgcagacatgggatactggatagaatcagagaaaaatgaaacatggaaattagcccgtgcaagtttcatagaggtaaagacgtgtatatggccaaaatctcacaccttatggtctaatggggtactagaatcagaaatgataattccaaagatctacggaggaccgatctctcaacataactaccgacctggttattttacacaaaccgcaggaccgtggcatttagggaagttagagttagactttgacctttgcgaaggaacaacagtagtcgtagatgaacactgcggtaatagagggcccagtttaaggacgacgacggttacaggaaaaattatacatgagtggtgctgtcgttcctgtaccttacctccattgagattcaaaggtgaagatggatgttggtacggcatggaaattagacctgtaaaggaaaaagaagaaaatctagtaaagtcaaaagttagcgctggcagcggagaagttgactcctttagcctcggcttactttgtatatcaattatgattgaagaagtaatgagaagtagatggagtaggaaaatgctaatgacaggaactttagctgtgttcttcttgctaattatgggacaactgacctggaacgacctaatcagattatgtattatggtgggagctaacgcaagtgataggatgggcatgggaacaacttatttagcattaatggccacatttaaaatgcgtcctatgtttgcggtgggtctactatttcgtcgacttacaagtagggaagtcctcctgcttacaataggattatccctggtcgcatcggtcgagttacctaattctctagaggagctaggcgatggcttagcaatggggataatgatattaaagctcttaactgactttcaaagccatcagctttgggcaaccttattatcactgacgtttatacgaactacattctctcttcactatgcttggaaaactatggctatggtcctctcgatcgtatctctatttccattatgcttatcaactacttcacagaaaaccacatggttacctgtactattaggctcgctaggatgcaaaccgttgacaatgtttttaattgccgaaaacaaaatatggggacgaaagagttggcccctcaacgaaggcattatggccgttggtatagtgtctatattactatcatcgcttttaaagaatgatgtgcctctagcaggacctctcatagcgggtggtatgttaatagcatgttatgtaattagcgggtcaagtgcagatctaagtttagaaaaggcagcagtcgttagttgggaagaggaggctgagcacagtggagcgtctcacaacatcctagttgaggtacaagacgacgggacaatgaaaataaaagacgaagaacgagacgacacgttaactatactacttaaggctacgctactagcagttagtggagtatacccgctatcgatacccgctacgttatttgtttggtatttctggcagaagaagaaacaaagatcaggggtgctttgggacactccttcgccacctgaggtcgagagagcggttctagatgatggcatataccgaatcatgcaaagaggattactcgggagatcccaagtgggtgtgggggtttttcaggagaatgtgttccacactatgtggcatgtaacgagaggcgctgtcctgatgtaccaaggaaagaggctggaaccatcttgggctagtgtcaaaaaggatttaatcagttatggtggaggatggagactacaaggttcatggaatactggggaggaagtacaagttatcgcagtagaaccgggcaaaaaccctaaaaacgtccaaactgcgcctggaacctttaagaccagcgaaggtgaagtaggagcgattgctttagatttcaagcctggcactagcggcagccctattgttaacagagaaggtaagatcgtaggactgtatggaaatggagtcgttactacatctggaacatatgtgtcggctattgcacaggcgaaagcgagtcaagaaggcccactccctgagatagaagatgaagtattccgtaagagaaatctaaccataatggatctacacccggggagtggcaaaacaagaagatatctgccagcaatagtaagagaagctataaagagaaaattaaggacactcatcctggcccctacaagagtcgtggcttcagaaatggcggaagcgttaaaaggtatgccgatcagatatcagacaacagcagtaaaatctgaacataccgggaaagaaatcgtggatttgatgtgtcatgccacgttcacaatgaggctactatcacctgtcagagtaccaaactacaatatgataattatggacgaagcgcacttcactgatccaagctcaattgcagctagaggttacattagtacaagggtggggatgggagaagcagctgccatctttatgaccgctacaccgccaggctcagtagaggcttttccacaatcaaatgctgtaattcaagatgaagaaagagatattcccgagaggagctggaactcagggtatgagtggattacggactttcctggcaaaacagtctggttcgtacctagtataaaatccggaaatgatattgctaattgtctacgtaaaaatggcaagagagtaatacaactgtctagaaagacttttgatactgaataccaaaagactaaaaataacgattgggactacgtggtaactacagacatatcggaaatgggggctaatttccgtgcagatagagtaatagacccacgcagatgtctgaagccagtcatactgaaagacggcccagaacgagttattctggcaggtcctatgccagtcactgtagcatcagcagcacaacgaagaggtagaataggacgcaatcacaacaaagaaggcgatcaatacatttacatgggtcaaccacttaacaatgacgaagatcatgcacactggacagaggcaaagatgctactagacaacattaacacgcctgaaggtataatacctgccttattcgaacccgaacgggaaaagagcgcagccatagacggagaataccggctaagaggggaagcaagaaaaacatttgtcgaactgatgcgacggggcgacttgccagtatggttatcttataaggttgcatcagagggatttcaatattctgatcggcgatggtgtttcgacggagaaaggaacaatcaagtacttgaagagaacatggacgtggagatttggacaaaggaaggagaacgaaagaaattgagaccaagatggttagatgcacgaacatattcagacccactagcacttcgtgagttcaaagagtttgcagcggggcgaaggtcggtgagtggagacctaatattagagataggaaaattacctcaacacttaacacaacgtgcgcaaaacgctcttgacaatttggtaatgcttcataattctgaacagggaggtcgagcctaccgccatgcaatggaagaactacctgacacaatcgagacgttaatgctgctcgcattaatagcggtattgacagggggtgttacgcttttctttctaagcggaagaggactcggaaaaacttcaattggtttattatgtgtaatggcgagctctgtactcttatggatggcatcagtagaaccgcattggatagccgcttcaatcattcttgagttcttcttgatggttttactaataccagaaccggatcgtcaacgaactccgcaggataatcagctagcctatgttgtcattggactattattcatgatactaacagtcgccgcgaatgaaatgggactcttagaaactaccaagaaagacctaggaataggtcatgttgcagtagaaaaccatcaccatgctgccatgttggacgttgatttgcacccagcatcagcatggacgttgtatgcagtagctaccacaattatcactccgatgatgagacatacgattgagaacactacggcgaacatttcgttgacagctatagctaatcaagcagctatcttgatgggtctagacaaaggttggccaatcagtaaaatggacataggtgtgccgttgcttgcacttggatgttatagtcaagttaatccgttgacacttacagcagcagtcttaatgttagtcgctcattatgcgataataggacccggactgcaagcgaaggcaacgagggaagcacaaaagagaacggctgcaggaataatgaaaaacccgactgtagacggaatcgtagcaatcgatttagacccagttgtttacgatgcgaaattcgaaaaacaattaggtcaaataatgttactaatattatgcacgtcacagatattattaatgaggacaacgtgggctttatgcgaatcaataacccttgcaactggtccattaacaactctctgggaaggtagtcctggaaaattttggaacacaacaatcgccgttagcatggcaaacatatttcgcggatcttatctagcaggcgctggattggcattctcattgatgaaaagtcttggaggagggagaagaggtaccggggcacaaggagaaacacttggcgaaaaatggaaaagacaattgaatcagctgagcaagtccgagttcaatacttacaaaaggtcaggaattatggaagtagacaggtctgaggcgaaagaagggttaaaacgaggagaaactacaaaacacgcggtctctagaggaacagcaaaactaagatggtttgtagaaaggaacctagtgaagcctgaaggaaaggtaatagacttaggatgtggtagagggggatggtcctattattgtgcaggactcaagaaagtaaccgaggtaaaggggtacacaaaaggaggaccaggtcatgaggaaccgatacctatggcaacatatggctggaatctagttaaacttcattctgggaaagacgtatttttcatccctccagaaaaatgcgatacacttttatgtgatataggcgagtcatccccaaaccctaccattgaagagggaaggacactcagagtactcaaaatggtggagccatggttgaggggaaaccaattctgcatcaaaattcttaatccatatatgcccagtgttgttgaaactctagaacagatgcaaagaaaacacgggggaatgttagtcagaaacccattaagtcgaaacagcacgcatgagatgtattgggttagctgtggaacaggcaacatagtgtcagcggttaatatgacatcgagaatgctccttaacagattcactatggctcatagaaaaccaacatacgaaagagatgtagatttgggggctggtactcgacatgttgcagtcgaacctgaagtagcaaacctcgacatcataggccaaagaatagagaatataaaacatgaacataaaagcacttggcactatgatgaggacaacccctacaaaacttgggcgtaccatggatcttatgaagtcaagcccagtggctctgcatcatccatggtaaacggcgtggttaagctactcacaaagccatgggacgttattccaatggtgacccaaattgccatgactgatacaaccccatttggccagcaacgagtgttcaaagagaaagtagacactcgtaccccaaaagcaaaacgaggaaccgcgcaaattatggaagtaactgcaaaatggctatggggatttttaagcagaaacaagaaacctagaatctgcacaagagaagagtttacgcgaaaagtcagaagcaatgccgcaatcggcgccgttttcgttgatgaaaaccagtggaacagtgctaaagaagcagtagaagatgaaagattctgggatttagtacacagggagagagagctacacaaacaagggaagtgtgcaacgtgtgtctacaacatgatgggtaaaagagagaagaaattaggtgagttcggaaaagcaaaaggatcaagagctatttggtatatgtggttaggtgcgcgtttcttagaatttgaagcactagggttcatgaacgaagaccattggttcagtagagaaaattctttgagtggagttgaaggggaaggactccataaattgggatacatcttgcgtgatataagcaagatcccaggcggtaatatgtatgctgacgatacagcgggatgggacactcgaataaccgaggatgatcttcaaaacgaagctaagattactgacattatggaacctgaacatgcacttctagccaaatcaatatttaagctcacataccaaaacaaagtcgtgagggtgcaacgaccagcaaagaacggaacagtaatggacgtcataagtagacgtgatcaacgcgggtcaggtcaggtcggcacgtacggattaaataccttcaccaacatggaagcgcagctcattaggcaaatggaaagtgagggaatatttagtccatcggagctagaaacgccaaatttagcgggcagagttttagactggttagaaaaacacggggtagagagactaaaaagaatggcgataagtggggatgattgtgtagttaagccgattgatgaccgttttgctacagcgctaaccgctttaaacgatatgggtaaagtccgaaaagacatccctcagtgggaacccagcaagggctggaatgactggcaacaagtacctttttgttcccaccatttccaccaactaataatgaaagacggtagagaaatagtcgttccatgtagaaaccaagatgaactggtaggtcgcgcaagggtttcacagggggccggatggagcttaagggaaacggcatgccttggaaaatcatacgcgcaaatgtggcaactaatgtatttccatcgaagagatttacgtctggcagcaaacgcaatatgctcagcagttccagtagattgggttcctacatcaaggactacatggagtatccatgcccatcatcaatggatgacaactgaagatatgctatctgtctggaaccgtgtatggatagaggagaatccttggatggaggataagactcatatcagttcgtggggcgacgttccgtatttgggaaaacgtgaagatcaatggtgcggctcattaattgggttaactgctcgagctacctgggctacaaacatacaggtagcgattaatcaagttcgtcgtcttctcggcaacgaaaattatctagactatatgacatcaatgaaacgctttaaaaacgaaagtgaccctgaaggagctctgtggtaa

SEQ ID NO: 21779 - RNA, 9879 nt, synthetic construct
  misc_feature 1..9879: note = derived and/or modified CDS sequence (opt6) from DENV-1__GU131685__SS-prME
  source 1..9879: mol_type = other RNA
tctgtgacaatgctcttgatgctaatgccaactgcactcgctttccatttaacaacacgaggaggtgaacctcatatgatagttagtaaacaagaaagaggaaaatctctgttatttaaaacctcagcaggcgtaaacatgtgtaccttaatagctatggatctcggagaactgtgtgaagatacaatgacatacaaatgtccaagaatcacagaaacagagccagatgacgtagattgttggtgcaatgctacagacacttgggttacgtatgggacgtgctcgcaaaccggcgaacacagaagagataaaagatctgtagcactagcaccacatgtaggccttggactagagactcgaacagagacttggatgtcctcagaaggcgcgtggaaacaaattcagagagttgaaacgtgggcgttgagacaccccggattcacagtaattgcgcttttcttagcccacgctattggtacatccattacacaaaaaggtataatttttatattactaatgttggtgactccgtccatggccatgaggtgcgtaggaatcggttccagagattttgtggaaggactatcgggtgccacgtgggtagatgttgtactggaacatggatcttgcgtaacaacaatggcaaaagataaacctacacttgacatagaactattaaaaacagaggtaacaaatccagcagtgctgcgaaaattatgtattgaagcaaaaataagcaatacgacaaccgatagtagatgccctacacaaggcgaagcgactctagttgaggaacaagatgctaattttgtttgtagaaggacattcgtagatagaggttggggaaatggttgcggtcttttcgggaaagggtccctaatcacctgtgccaaatttaaatgtgtaacaaaactcgaaggtaaaatagtccagtacgagaatttaaaatatagcgtgatagtaactgtacacacaggagaccaacaccaggttggaaacgaaagcaccgaacatgggaccactgcaactattacaccacaagcacctaccacagagatccaacttaccgattatggagccttaactttggattgctctccccgcacaggtctagattttaacgaaatggtattattaaccatgaaagaaaaatcatggttagtccataaacaatggttcttggatttaccattgccgtggacctcaggcgcatcaacatcacaagaaacatggaacagacaagacttactggtcacgttcaaaacagctcacgccaagaaacaagaagttgtagttctgggttcacaagaaggagcaatgcacacagctttaaccggggctaccgaaatacagacctcgggaacaaccacaatctttgccggacatcttaaatgtcgcctcaaaatggaaaaattgacactaaaaggaatgtcttacgttatgtgcactggatcattcaaacttgaaaaagaggttgcagaaacacagcatggaacggtccttgttcaaatcaaatatgaaggaacggacgctccttgcaaaataccctttagcacccaggatgaaaaaggtgtaacacaaaacgggagattgataaccgcaaacccaatcgtaacagataaagagaaacctgtcaacattgaggcagaacctccatttggcgaaagttacatagtgataggagccggtgaaaaagcattgaaattgagttggtttaagaaaggatcgtccattggcaaaatgttcgaagctactgctcgaggagcaaggagaatggctattttaggggatactgcatgggatttcggttcaattggtggggtgttcacaagtgttggaaaacttatacaccagatattcggaaccgcgtacggagtactattttcaggggtatcttggacaatgaaaatagggatcggagttctactcacatggttggggctaaacagtaggagtacaagcctctcaatgacatgtatagcggtaggattggttaccctataccttggcgtaatggtccaagctgatagtggatgtgtaatcaattggaaaggtagagagctaaaatgcggttccggaatcttcgtaacgaatgaagtacatacttggaccgaacaatataaattccaagcagatagccctaaacgattgagcgcagctattggtaaagcgtgggaggaaggagtttgtggaataaggtccgctacacgcttagaaaatatcatgtggaagcaaataagcaacgaacttaatcatatattgttagaaaacggaatgaagttcacagtggtagtaggtgatgtagccggaatcttagcccagggcaaaaagatgataaggccacaacccatggagtataagtactcctggaaatcgtggggaaaagcaaaaattattggagcggatgtacaaaataccacctttatcatagacggacctaataccccagaatgtccagatgatcaaagggcatggaacatctgggaggtagaggactatggatttgggatatttactacaaacatctggctaaaattacgcgattcttacactcaagtgtgcgatcacaggttaatgtcagccgctattaaagattcaaaggctgtccatgccgatatgggatattggatcgaaagcgaaaagaatgaaacatggaaattagcgcgagcgagttttatagaggtaaagacatgtatttggccaaaaagtcatacactctggagcaatggcgtattggagtcagaaatgataattccaaagatctacggtggacccatcagtcaacacaattatcgccctgggtatttcacacaaacagccgggccttggcatttaggcaaattagaattagattttgacctatgtgaaggaacaacagtggtagtagatgaacattgtggtaatagaggaccatccctgagaacgactacggtaacgggtaagataatccacgaatggtgttgccggtcatgtacgttacccccattaagattcagaggagaagatggttgttggtatggaatggaaattagaccagttaaagagaaagaagaaaatcttgtaaaaagtatggtctctgcaggtagtggtgaagtagactcatttagtttaggtttgttatgcatttccattatgatagaagaagtaatgagatcgaggtggtcacgcaagatgctaatgactggtacgctagcagtctttttcctattgattatgggccaacttacctggaatgatttaattcggttgtgtatcatggtcggagcaaatgctagcgaccggatgggcatggggacaacttatttggcgctaatggccacatttaaaatgcgaccaatgttcgctgtaggactactatttagacgccttacctctagggaagtattactacttacaattggtttgagcctagtagcgagcgtagaattaccaaatagcctcgaagaattaggggatggtctggcgatgggtatcatgatattaaaattactaactgactttcaaagtcatcaactttgggctactctattaagtttgacttttataaaaacaactttcagcttacattacgcctggaagacaatggcgatggtactaagcatagtgtcactatttccactgtgcttaagtaccaccagtcaaaagaccacatggctgccggttttattaggtagtctcggctgcaaaccactgacaatgttcttaatagcagagaataaaatttggggtaggaggtcatggcctttaaatgagggaatcatggctgtcggaattgtctcaatattgttatcctctttgcttaaaaatgacgttcctttagccgggccgctcatcgccggagggatgttgattgcatgttatgttataagtggtagctcagctgacctctcgttagagaaagctgcagaagtctcatgggaggaagaagctgaacactcaggagccagccataacatacttgttgaggtacaagatgatggaactatgaaaatcaaagacgaagaacgagatgatacgcttacgatattacttaaagcaacactacttgcggtaagtggagtttatccattaagcatccctgctacacttttcgtatggtacttctggcaaaagaaaaagcaacggtcaggggtgctctgggataccccaagtccaccagaggtagaacgggcagtactggacgacggaatatatcgcataatgcaacgtggactattaggacgtagtcaagtgggagtcggggtgtttcaagaaaacgtatttcatactatgtggcatgtgacgagaggggctgttttaatgtatcaaggaaaaagactagaaccttcgtgggcaagtgttaaaaaggaccttatatcgtatggtggaggatggagactccaaggttcatggaatacaggcgaagaggtgcaggtaatagctgtggaaccgggtaaaaaccccaaaaatgttcaaacagctcctggcacgtttaaaactccggaaggggaagtaggagccatagctctagattttaaaccaggtacgagcggaagtccaattgtaaatcgtgaaggaaaaatagttggcttatatggaaacggagtcgtgacaacctcaggaacctatgtctcagcaatagcacaggctaaagcctcccaagagggcccattacccgagatcgaagatgaagtgttcaggaaacgtaacttgacaattatggatttacatcctggcagtggtaagacaaggcgatacttaccagctatcgtgagagaggccataaagagaaagctgcgtacactaatactagctccaacaagagtcgttgctagtgaaatggcagaggcactaaagggaatgccgatccgatatcaaacaacggctgtaaaatcagagcatacaggtaaagaaatagtagatctgatgtgccacgcaactttcaccatgagattactatcacctgttagagttccaaattataacatgataatcatggacgaggctcattttacggatcctagtagcatagcagctagaggttatatctcaacccgggtaggcatgggagaagcagctgccatatttatgaccgccaccccacctggcagtgttgaagcgttcccacaatctaatgctgtaattcaagatgaagaaagggatatacctgaaagatcatggaatagcggatacgagtggattacggattttccgggtaagacagtctggtttgtcccctccataaaaagcggcaatgacatagcaaattgtttgaggaaaaatggtaaaagggttatacaattaagtagaaaaacctttgatacagaatatcagaaaaccaaaaacaacgattgggactatgtagtgacaaccgacataagtgaaatgggtgcaaactttagagctgaccgcgtcatcgatccacgtagatgtttaaaaccagtaatactgaaagatgggcccgaaagagtaattttagccggaccaatgcctgtaaccgttgcgtccgctgcacaaagaaggggtagaatcggaagaaatcacaacaaagagggtgaccaatatatttatatggggcaaccactcaacaacgatgaagaccatgcacattggacagaagcaaaaatgcttctggacaacattaacaccccagaaggaattatcccagctctatttgaaccagaacgagagaaaagtgcagcaatagacggcgaatacagattgcgtggcgaggcaagaaagacctttgtggagctaatgagaagaggtgaccttccggtctggttaagctacaaggttgcaagcgaaggattccaatatagcgatagacgatggtgttttgatggagaacgaaataaccaagtcctagaagagaacatggatgtagaaatttggacaaaggaaggagagagaaagaaattaagaccgagatggctagacgcgcgaacttacagtgatccgttagctcttagagaatttaaagagttcgcggctggaaggcgatccgtatcaggagatctcatactagaaatagggaaacttccacaacatctaacgcaacgggcgcaaaatgcccttgataatcttgtcatgttacacaactctgaacaagggggacgagcataccgtcacgcaatggaagaactaccagatacaatagagactcttatgttgttagctctaatagccgtcctgactggaggagttacactgttctttttatctggcagaggattagggaagacatcaatagggttattatgtgttatggcgagttctgttttgttatggatggcctctgtagaaccacactggatagcagcaagtataatcctcgaatttttcttaatggtactattaatccccgaacccgataggcaacgtacgccgcaagacaaccaattagcgtatgtggttataggccttctgtttatgattctaacggtcgcagcaaacgaaatgggcttactcgaaacaaccaagaaagatcttggtataggccacgttgcggtcgaaaaccatcatcacgctgctatgctcgatgtagacttgcacccagcatcggcctggaccctatatgcagtagctacgacaattataacgcctatgatgcgacacactatcgaaaatacaacagcgaatatctctctcacagccatagcaaaccaggccgctattttaatgggtctagacaaaggatggccaattagcaagatggatataggagttcctttgttagctttaggatgttatagccaggtgaacccacttacacttactgcggctgtattaatgttggtcgctcactacgcaattatcggcccaggtttacaagctaaagcgactcgagaagcccagaagagaaccgccgccggtataatgaaaaatccgacggtagatgggatagtagccatcgatttggaccctgtagtgtacgacgcaaagtttgagaagcaactaggtcaaataatgttattaatattatgtaccagccaaatactcctaatgagaactacgtgggcattatgcgaatcaataaccttagccacaggcccactaacgactttgtgggaagggtcacccggaaagttttggaatacgactattgcggtttctatggccaacatatttaggggaagctatttagcaggggctggtctcgcttttagcttaatgaaatcactcggaggtggcagacgtgggactggagcgcaaggggaaaccttaggcgaaaaatggaaaaggcagttaaaccaactgtcgaaatccgagttcaatacatataagcgaagcgggattatggaagtagaccgttctgaagccaaggaaggactaaaacgtggtgaaacaacaaaacacgcagtgtcgcgtggtaccgctaaactcagatggtttgtagagcgtaacctggttaagcctgaaggtaaagtcattgacttaggttgtgggagaggaggttggagttattactgtgccggtctgaagaaagttaccgaagtaaaaggttacacgaaagggggcccgggacatgaagaaccaattccaatggccacatatggttggaatttagttaagttacactcaggaaaagacgttttctttattccacccgagaaatgtgacacacttctttgtgacattggggaatcttcaccaaacccaactattgaagaaggccgaacactaagagtactcaaaatggtagaaccgtggctccgcggcaatcaattctgtattaagatcttaaatccatacatgccgtcagttgtggaaactctagaacaaatgcaacgaaaacatggcggcatgctcgttaggaatccgctaagtagaaattctacacacgaaatgtactgggtctcatgcggtacaggtaacatagtctccgcagtaaacatgacgtccaggatgttactcaacaggtttacaatggcacaccgtaagcctacatatgagagagacgttgacttaggggcaggtacaaggcatgtggctgttgagcctgaagtagctaacttagacattattggtcaaagaatagaaaatattaaacacgaacataagtcgacgtggcactacgacgaggataatccatataaaacatgggcgtatcatggaagctatgaggtgaagccatctggatccgcaagctctatggtgaatggcgtcgtgaaattgcttacgaagccatgggacgtaatcccaatggtaacacagatcgcaatgacggatacaacaccatttggacaacaaagggtattcaaagagaaagtggatacccgtactccaaaagcgaaacgcggcacggctcaaataatggaggtcacagcaaaatggttatggggattcctaagcaggaataagaaaccacgtatatgtactagggaagaatttacgcgcaaggtacgatctaatgcggcaataggagcagtttttgtagatgaaaatcagtggaacagcgcaaaagaagctgttgaagacgagagattttgggatttagtacatcgagaacgcgaacttcataaacaaggcaaatgcgccacctgtgtgtacaatatgatgggtaaacgcgagaagaaattaggagagttcggtaaggcaaagggatccagagcgatatggtacatgtggttgggagcgcgtttcttggagtttgaagcgttaggttttatgaacgaagatcactggttttcgagagaaaattcgctatcaggtgtagaaggtgaaggacttcacaaattaggatacatattacgagatatttcgaaaatacctggaggcaatatgtatgcggacgatactgccggctgggatactaggataactgaagatgatctacaaaatgaagcgagaataactgatatcatggaaccggaacacgcattacttgctcgaagcatcttcaaacttacatatcaaaataaagtggtacgcgtacaaagaccagctaaaaatggaacggtaatggatgtaatctctaggcgcgatcaacggggttctggccaggtgggaacatatggattaaacaccttcacaaatatggaagcccaacttattcgacaaatggaatccgaaggcatatttagccccagtgaactagaaacccccaatctagccgaaagggttctggattggctagaaaagtatggtgtagaacgcttaaaacgaatggccataagtggggacgactgtgtggttaaacctatcgatgataggtttgcaacggctcttacagcattgaacgacatgggtaaagttagaaaggacataccgcaatgggaaccaagtaaaggatggaacgactggcagcaggtcccattctgctctcatcatttccatcaattaatcatgaaagacggtcgagaaatagtagttccgtgtcgaaaccaggatgaattagtaggcagagctagggtttcccaaggtgctggttggtcattacgtgaaacagcatgcttagggaaatcatacgcgcagatgtggcaactaatgtatttccacaggagggatcttagacttgcagcaaatgctatatgtagtgctgtaccagtagactggatcccaacaagcaggacaacctggtctatacacgcacatcaccaatggatgacaactgaggatatgttatcggtttggaacagagtatggatagaggagaatccatggatggaagacaagacacatatatcttcgtggggcgacgttccctacttaggaaagcgcgaagatcagtggtgtggctctctcattggattgacagcacgagctacgtgggctacaaatatacaggtagcaataaatcaagtcagacgcctgatcggtaatgaaaattatcttgattacatgacttcaatgaaacgctttaagaatgaatcggacccggaaggtgctctttggtaa

SEQ ID NO: 21780 - RNA, 9879 nt, synthetic construct
  misc_feature 1..9879: note = derived and/or modified CDS sequence (opt6) from DENV-1__GQ868614__SS-prME
  source 1..9879: mol_type = other RNA
agtgtaaccatgcttttaatgttaatgcctacagcgttagcattccacctcacaacacgcggcggagaaccacatatgatcgtaactaaacaagaaagaggaaaatcattattgtttaaaacatctgcaggagtcaatatgtgcacgctgatagcgatggatctaggtgaactttgtgaagatactatgacatacaaatgtcccagaattactgaagcagaaccagacgacgtcgattgttggtgcaatgcaacggacacttgggtaacgtatggtacttgctcgcaaacgggggaacatagaagagataaaagatccgtcgcgctagcgccccatgttggattaggattagaaacgagaacggaaacttggatgtcatctgaaggtgcgtggaaacaaatacaacgagttgaaacatgggcattgcgacatccaggctttactgttatcgccttgtttctagcacatgcaattggaacaagtataacacaaaaaggcataatatttattttgctcatgttggtgactccctctatggcaatgcgatgtgtcggaatcggtagtcgggactttgtagaagggctaagtggcgcgacctgggtagatgttgtcctggaacatggaagctgtgttacaacaatggctaaagataaacctacgctagacatagaattattgaaaactgaagttaccaacccagccgtactacgtaaattatgcatagaagcaaaaattagcaatacaacgacagattcgcgatgtccgacacaaggagaagctacgctaatggaagaacaagacgcaaatttcgtatgtagacgaacttttgttgacaggggttggggaaatgggtgtgggctctttggaaaaggaagcctgataacatgtgcaaaattcaaatgtgtaactaaactggaaggtaaaatagtccaatatgaaaatctgaaatatagtgttatagtaacagttcacactggtgatcaacaccaagtaggtaacgaaagcactgaacatggcacaactgctactataacaccacaagcaccaacatcggaaatacagctgaccgattatggagctctaacactagactgttcaccaagaacgggcttggattttaatgaaatggtcttattgacaatgaaggagaaaagttggcttgtccacaaacaatggtttttggatcttcctctaccttggaccagcggagcgtccacttcacaagaaacgtggaatagacaagatctcttagtaacatttaaaactgctcatgctaagaagcaagaagtggtcgtattgggatcacaagaaggagcaatgcacacagcgttaacaggcgccacagagattcagaccagcggaacaactaccattttcgccggacacctcaaatgtcgccttaagatggataaattaaccttaaagggtatgtcatatgtaatgtgtactggtccatttaaattagagaaagaagtagccgaaacacaacacgggactgtcctggtccagataaaatacgaaggaaccgacgcgccgtgcaaaatacccttctcaacgcaggatgaaaaaggtgtaatccaaaatggcagattgatcactgcgaacccaattgtaacggacaaagagaagccggtaaacattgaagctgagccaccatttggggaatcttatatagtaatcggagtaggagaaaaggctttaaaattatcttggtttaagaaaggtagcagtataggtaagatgtttgaagccactgcccgaggggctcgaagaatggcaattttaggagataccgcatgggactttggaagcattgggggagtattcacttctgtcggcaaacttgtgcaccagatattcggtgctgcctatggtgtattattttcgggtgtatcttggacaatgaaaataggaataggagtcctattaacctggttgggtctcaacagtcgtagcacgtcgctatcgatgacgtgcatcgcagtgggtctggtcactctctacctgggcgtaatggtgcaggcagacagcgggtgtgtaataaactggaaaggacgtgaactaaagtgcggaagtggaatctttgtaacgaatgaagtccacacttggacagaacaatacaaattccaggcagatagccccaaaagactcagcgcggctattggtaaggcctgggaggaaggagtatgcgggatacgtagtgtaacacgactggagaatatcatgtggaagcaaatctcaaacgaactcaatcacatattattagagaatgatatgaagtttacagtcgtcgtaggagacgtagttggaatccttgcacagggaaagaaaatgatcagaccccagcctatggaacataaatatagttggaaatcttggggaaaagcaaaaattataggcgcagatgttcaaaacacaacgttcattattgatggtcccaacacacccgagtgtccagacgaccaacgagcttggaacatctgggaggtagaagactacgggtttggaatctttacgacaaacatttggctaaaacttcgtgattcatatacgcaggcttgtgatcacagattaatgtctgcagcgataaaagattctaaagcagtacatgctgatatgggatattggatagagtcagagaaaaatgaaacatggaagttagcacgggcgtcattcatagaagtaaagacatgtatatggccaaaaagtcatacactatggagtaatggagtgctagaaagcgaaatggttattcctaagatctacggtggaccaatatcacaacataattacagacccggttatttcacgcagacggctgggccatggcatctggggaaattggaactcgactttgatttatgtgagggaactactgtagttgtagacgaacattgtggtaatagaggcccaagtctccgcacgaccactgtaacgggcaaaattatacatgagtggtgttgtcgctcatgcactttgcctccgttgagatttaagggagaagatgggtgttggtacgggatggaaataagaccggttaaagagaaagaagaaaacttagtaaagagtatggtatccgctggctcgggagaggtcgatagtttttccttaggcctgttatgtataagtataatgatcgaagaagtgatgagaagtcgctggagcaggaaaatgctgatgaccggaacactggctgtattcctcttactaatcatgggtcaattaacatggaatgacctaattagattgtgtataatggtcggagctaatgcaagcgatcgaatgggtatgggaacaacatacctcgcattgatggctaccttcaaaatgcgtccgatgttcgctgtaggattactgtttaggcgattaacatcacgtgaagtgctattgctaacaataggacttagtctcgtcgcgtctgttgaattgccaaattcactagaggagctgggtgacggtctagcgatgggaataatgattctcaaactcctcaccgactttcagtcacaccaactttgggccactctattatccctgactttcataaaaactacgctatctttacattacgcgtggaaaacaatggctatggtcctctcgattgtgtccctttttcctctttgccttagtacaacttcgcagaaaactacctggctccccgtcctgttaggctcgctagggtgtaaaccgctaacaatgtttctcattgctgaaaataaaatctggggcaggaaatcctggccgctaaacgaaggtatcatggcagtaggagtggtttctatcctcttatcaagccttctcaaaaatgatgtaccactagccggaccgttgatcgctggaggaatgctaatagcttgttatgttatctctggatcgtcggcggacttatcacttgagaaggcagcagaggtttcatgggaggaggaagcagaacacagtggagcaagccataatatattggttgaagtacaagatgatggaacaatgaagataaaggatgaagaaagggacgatacgctcacgatacttctcaaggctacattactagctgtatcaggtgtctatccgctttccatacctgcaactctatttgtttggtatttctggcaaaagaagaaacaaagaagtggggttttatgggatacaccatccccgcccgaagtcgaaagggcggtcctagacgatggtatatatagaataatgcaaagaggacttttaggcaggagccaggtaggcgtgggtgtatttcaagaaaacgtatttcatactatgtggcacgtaaccaggggtgcagtactgatgtaccaaggtaaaagattagaaccttcgtgggctagtgtaaagaaagacttaataagctatggtggaggatggagattacagggtagctggaacacaggagaggaagttcaagttattgctgtagagccggggaagaatcccaaaaacgtgcaaacggcaccaggaacatttaaaactcctgaaggcgaggtaggagcgatagccttagatttcaaacctggcacctcagggtcaccaatagtaaatagagagggtaaaatagttggtctatacggaaatggtgtagtaacaacttctggaacgtacgtcagcgctattgcccaagcaaaggcttctcaagaaggcccattgccagagatagaggacgaggtgtttcgaaagcgcaatctaacaatcatggacctgcatccagggtctgggaaaacacgtcgttacctcccagcaattgtcagagaggccatcaaaagaaaacttagaactctcatccttgctccaacaagagtggtggcaagcgaaatggccgaagcattaaagggtatgccaataagatatcaaactacagcagttaaatcggaacacacaggtaaagaaattgtagatttaatgtgtcacgcaacctttaccatgagattactttcgccggtacgggttcccaattataacatgattataatggatgaagcccatttcaccgatccgtcctcaattgcggcacgaggatacataagtacacgtgtcggaatgggagaagccgcagcaatatttatgacagcaacaccaccgggatcggtggaggcttttccccaatcgaatgcagtaatccaggatgaagaaagggatataccagaaaggtcctggaactccgggtatgaatggataactgattttccaggaaaaacagtatggttcgtcccctctataaaatcagggaacgatatcgcaaattgtttgcgaaagaatgggaaaagagtaatacagctcagccgaaaaactttcgatactgaataccagaaaaccaaaaataatgattgggattatgttgtcactactgatatttcggaaatgggtgctaattttagggctgatcgagttatagatccgagaagatgcttgaaacctgtaatactgaaagatggacccgaacgagtaatacttgcaggtcctatgcctgttacggtagcaagcgcagcacaaagacgaggcaggatagggcgtaaccacaacaaagaaggagaccaatacatttatatgggacagcccttaaacaatgatgaagaccatgctcattggacagaagccaagatgctactggacaacataaacactcccgagggaattataccagctctttttgagccagagagggaaaagtcggcagcaattgatggtgagtataggctccgaggcgaagcaagaaaaacattcgtagaactcatgcgaaggggcgatcttccagtatggttatcatataaggtagccagtgaaggattccaatactcggatagaagatggtgtttcgatggagagagaaataatcaagttctagaagaaaatatggacgtagaaatatggacgaaagaaggtgaacggaagaaattaaggcctcgttggttggatgcaagaacatactctgatccacttgctttaagagagttcaaagaatttgcagctggtcgacgaagtgtttcaggggatctcattttagaaataggaaagttaccacaacacctaacgcagcgggctcagaacgcactagataatcttgtaatgttacataatagcgaacaaggaggccgagcgtatagacacgcgatggaagaattacccgatacaattgaaacattaatgctactcgccttaattgcagtgttaacgggtggtgttacgctctttttcttgagcggcagaggtttaggtaaaaccagcataggactactctgtgtgatggcaagcagcgtattattatggatggcgtcagttgagcctcattggatcgccgctagcattatcctggagttctttctaatggtattacttattccagaacctgacagacagagaactccacaggataaccaattagcctacgttgtaataggtctgctatttatgatactgactgtggcagccaatgaaatggggttactagaaaccaccaagaaagatctgggaataggacacgtagctgtggaaaaccaccaccatgcaacaatgttagacgtggatctacaccccgcatcagcttggactctatatgcagttgcaacaacgataattacaccaatgatgaggcacacaattgaaaatacaaccgcaaacatttctctcacagctattgcgaatcaggcagcgatactcatgggattagataagggatggcccatatctaaaatggatatcggggttccgttactagctttagggtgctatagtcaagtaaacccattgacactaactgctgcagtattgatgcttgtagctcattacgcaatcatcgggcccggattgcaagcaaaagcaactcgcgaagcacagaaaagaactgcagctggcattatgaaaaaccctacagtcgacggaattgtagctatagaccttgatcctgtcgtttatgatgcaaagttcgaaaaacaactaggacaaatcatgctacttattttatgtacaagtcagattttattaatgcgaacaacatgggctttatgcgaatcaataacattggctaccggaccgcttactacattgtgggaaggctcaccaggaaaattctggaacacaacgatcgctgtcagtatggctaatattttcaggggttcttacctcgcaggagcaggactagctttttcgctcatgaagtccttagggggaggaagacgtgggaccggagcacagggtgaaaccctaggagaaaaatggaaaagacaattaaaccaattgagcaagtccgaatttaatatatataaaagaagtggaattatggaagttgaccgatcagaagctaaggagggtctaaagagaggtgaaaccactagacacgcggtctccagaggaactgccaaactaagatggtttgtcgaaaggaatctcgttaaaccagaaggtaaagtaattgacttgggctgtggacgcggagggtggtcttattattgtgccgggctcaagaaagtgactgaggtcaaaggttacacaaaagggggaccagggcacgaggaacctataccaatggctacatatggatggaaccttgtaaaactccactctggcaaagatgtgttctttacacccccggagaaatgcgacactctactctgcgatattggagaatcatctccaaatccaaccatagaagaagggagaactcttcgagtcttaaagatggtggagccatggttacgtggtaatcagttttgtattaaaattcttaatccttacatgccaagcgtggtcgagactttagaacaaatgcaacgtaaacatgggggaatgttagtgcgaaatcctttgtctcggaatagcacgcatgagatgtattgggtctcgtgtggtacgggaaatatagtaagtgcagtgaatatgacctcaagaatgttacttaatagatttacaatggcacaccgcaaaccaacctatgagcgagacgtagatctgggcgctggtactcgccatgtggcagttgaaccagaggtagctaacttagacattataggacaaagaattgagaacattaagcatgaacataaaagcacatggcactacgatgaagataatccttataagacatgggcgtatcatggaagctatgaagtcaaaccttctggaagtgcttctagtatggtaaatggcgtagtaaaacttttaacaaagccctgggacgtcataccaatggtgacacaaattgcaatgactgatacgacaccttttggacaacagagggtgttcaaagaaaaagtcgacacaagaacaccaaaagctaagcgcggtacagcccaaatcatggaagtcactgccagatggttgtggggattcttgtctagaaacaaaaagccgagaatttgtacaagagaagagttcacccgaaaagtcagatctaatgcagcaattggcgcggtgtttgtagacgaaaatcaatggaatagcgctaaagaagccgttgaagacgaacgattctgggatttagtccaaaaagaacgcgaacttcacaagcagggtaagtgcgcaacatgcgtgtacaacatgatgggtaagcgagagaagaaactaggcgaatttggcaaggctaaaggatctagagcgatatggtatatgtggttaggtgccagatttttggaatttgaagcactcggatttatgaatgaagatcattggttctcacgtgaaaattccctgtccggggtagaaggagaaggtttgcacaaactcggatacatcctacgggatataagcaaaatccctggaggaaacatgtatgcggatgatacagctggttgggacactagaataacggaagacgacttacaaaatgaagcgaaaattacagatataatggaaccagaacatgcattattagcaacatccattttcaaattaacatatcaaaacaaggtggtccgtgtgcaaaggccagctaaaaatgggactgtaatggatgttatatccagacgtgaccaacgaggtagtgggcaagtaggcacttatggcttaaacacgttcacgaacatggaagcgcaactgataagacagatggaaagtgaaggtatatttctcccatccgaattagaaacccctaacctagctgaaagagtcttagactggttagaaaaacatggcgtggaacgccttaaacgcatggcgatttccggtgacgactgtgtagtgaaaccaatagacgatcgattcgccacagcgttaaccgctcttaacgacatgggaaaggttagaaaagacataccccaatgggagccaagtaagggatggaatgactggcagcaagtcccattttgttcgcatcattttcatcagcttataatgaaagatggaagagaaattgtagtaccttgtaggaaccaagacgaacttgttgggagagccagagtaagccaaggtgccggatggagtttaagggaaacggcttgtttaggaaagtcatatgcgcaaatgtggcaattaatgtattttcacaggagagaccttcgattagcagctaacgctatatgctcagcagtcccagttgactgggtaccaacatctcgtacaacatggagtatacacgcacaccaccaatggatgacaacagaggacatgttgtcggtctggaatagggtatggatagaagaaaatccatggatggaagacaagactcatgtctcttcatggggagacgttccgtatttaggaaaaagagaagatcaatggtgcggaagtcttattggcctgacagctcgggcgacatgggcatctaatattcaggtagcgattaaccaagtacgaagactaataggcaatgaaaattatttagattacatgacaagtatgaaaaggtttaaaaatgaaggggatccagaaggtgcgctttggtag

SEQ ID NO: 21781 - RNA, 9879 nt, synthetic construct
  misc_feature 1..9879: note = derived and/or modified CDS sequence (opt6) from DENV-1__GU131688__SS-prME
  source 1..9879: mol_type = other RNA
tcagttactatgctgttaatgttaatgccaaccgctttggctttccatttaacgaccagaggaggggaacctcacatgatagtcagtaaacaagaaagagggaaatcactattgtttaaaacatctgcaggagtaaacatgtgtacgctaatagccatggatctcggagaattttgtgaggataccatgacatacaagtgcccgagaattaccgaagctgaacctgatgatgtagattgttggtgtaacgcaactgatacttgggtaacctacggtacctgttcacaaacaggggaacatagacgcgataaaagatcagttgcgttagctccacatgtaggtctagggctagaaaccagaactgaaacttggatgtcaagcgaaggtgcatggaaacaaatacaaagagtcgaaacctgggccttaaggcatcctggatttactgtcatagccctatttctggcgcatgccataggaacatccataacccaaaaaggcatcattttcattttgttaatgttagttacaccttccatggcaatgcgttgtgtaggaattggaagtagagattttgtagaaggtttaagcggagctacctgggttgatgtcgtcttggaacatggtagctgtgtgactacaatggcaaaagacaaaccaacgttagatatagaattgttaaaaactgaagtaacggatccagcagtacttagaaaactttgtatagaagcaaaaatatcaaataccacaacggatagtcgctgtccaacccaaggcgaagccaccctagtcgaagaacaagacgctaatttcgtctgcagaaggacttttgtggatcgaggttggggtaatgggtgtggattattcgggaaaggaagcctaatgacgtgtgccaaatttaaatgtgtgacgaaactggaaggtaaaattgttcaatacgaaaatctaaaatattcagtaatagtgactgtacacaccggtgatcaacatcaagtcgggaatgaaagcacggaacatggtacaacggctacaattacaccacaagcacctagtacagaaattcagctaaccgattacggagcattaaccttagactgctcaccacggacgggcttagatttcaatgaaatggtgctacttacaatgaaagaaaaatcatggctagtccacaagcagtggttcctagatcttccattaccctggacatctggagcctcgacgtcacaagaaacgtggaacaggaaagacctgcttgtcacatttaaaactgcacacgccaagaaacaagaggtagttgtcttaggatctcaagaaggcgcaatgcatactgcccttactggagcaacggaaattcagacttcagggacaactacaatatttgcgggacatctaaaatgtaggctaaaaatggataaattaacgcttaagggtatgtcctatgtaatgtgcactggaagtttcaaactagaaaaagaagtagcggaaacacaacacggaaccgtattggtacaaattaaatacgaaggtacagacgctccttgtaagattccattctccacccaagatgaaaaaggcgttacccaaaacggacgactaataacggccaaccccatagtaaccgataaagaaaaacctgttaacattgaggcggaacctccgttcggtgaaagttatattgtcattggagctggggaaaaggctttgaaacttagttggtttaaaaagggatcctcgataggcaaaatgttcgaagctacagcacgtggggcacggaggatggcaatcctgggagacaccgcttgggattttggttcaataggaggtgtatttacatctgtcggtaaattagtgcaccaaatattcggcacagcatacggagtattgttttcaggtgtatcatggaccatgaaaataggaattggagtattactaacttggctaggattaaattcgagatcgacctcactatcaatgacgtgcatagcagtcggtctggtaacattatatcttggagttatggttcaagcagatagcggttgtgtcataaactggaagggccgcgagctaaaatgtggatctggaattttcgttactaatgaagttcatacatggactgaacaatataaattccaagctgactcaccaaaacgattgagtgccgcgatcggaaaggcttgggaggaaggagtatgtggaataagatctgccaccagactcgaaaatataatgtggaaacaaataagcaatgagcttaatcatattcttctcgaaaacgatatgaaatttaccgtagttgtaggggatgttgcaggtatccttgcccaaggcaagaaaatgataagacctcaacctatggaatataaatattcctggaaatcctggggcaaagccaaaataataggagcggatgtgcaaaatacaactttcattattgacggaccaaacacacctgaatgcccggacgatcagagagcatggaatatttgggaagtagaagactatggatttggaatcttcactacaaacatctggctcaaacttagagactcatacacccaagtttgtgatcatcgtttaatgtccgcagctataaaggattccaaagcagtacatgcagacatgggatactggatagaatcagagaaaaacgaaacatggaaacttgcacgcgcaagtttcattgaagttaaaacgtgtatctggccaaagtcccacaccttgtggagcaacggagtattagagtcggagatgataattccgaagatttatggcggacccatctctcaacacaattatcgacctggctactttactcaaactgcaggtccttggcaccttggaaaactagaattagattttgatctatgtgaaggaaccactgtggtggtcgatgaacactgcggaaacaggggcccgagtcttagaactacaacagtaacaggaaaaataatacacgaatggtgttgtagatcttgtacactcccaccactaagattcaaaggcgaagatggttgttggtatggaatggagatcagaccggtaaaggaaaaagaagaaaatttggtaaagtctatggttagtgcgggtagcggagaggtggattcatttagcctaggactactttgtattagtatcatgattgaagaagttatgcgctctaggtggagcagaaaaatgctaatgactggcacccttgcagtatttttcttactgataatgggtcagctaacttggaacgacctcatacgactatgtataatggttggtgcgaatgctagtgacaggatgggaatgggaactacatacctggctctgatggcaacatttaaaatgcgaccaatgtttgcagtgggattattatttagacgtctcacctcaagagaagtattattattaactattggtttgtcacttgttgcttccgtagaattacctaattccttggaagaattgggcgatggtttagctatgggaataatgattttaaaactgcttacagatttccagagccaccaactatgggccacattactgtcgctaacctttattaagactacatttagtctacattatgcctggaaaacaatggcgatggttctcagtattgtctctctattcccgttgtgcctttcgacgacaagtcagaaaaccacatggttgccggtattacttggaagtctaggatgcaagccgttaactatgttccttatagcggaaaataaaatatggggaagaaaatcatggccactaaatgagggaataatggcagttggaattgtgtctattttgttgtcagcgttactcaaaaatgacgttccactagcggggcctttaattgccggaggaatgttaattgcatgttatgtaatatcaggatcaagcgcggatctcagcttagaaaaagccgcggaggtcagttgggaagaagaagccgagcatagtggtgcatctcataatatattggttgaagttcaagatgatggtactatgaaaattaaagatgaagaacgggatgacactttaactatattgttaaaagctaccttgttagccgtaagtggggtgtacccactgagtatacccgccacattgtttgtgtggtatttttggcagaagaagaaacagcgtagtggagttttatgggatacgcctagcccacctgaagttgagcgagctgtactagacgacgggatttatagaataatgcaacggggacttttaggtcgatctcaagttggtgtgggagtctttcaagaaaacgtattccatacgatgtggcatgtgacacgtggagccgtactaatgtatcaaggtaagaggttggagccatcatgggcctcagttaagaaagatcttatatcatatggcgggggatggaggttgcaaggatcatggaacaccggtgaagaagtacaagttatagctgtcgaacctggcaagaatcctaaaaatgtacagacagcccccggaactttcaagacttcagagggagaagtaggtgcgatagctttagatttcaagccaggaacatccgggtcaccaattgtaaacagagaaggaaagatagttggtctttatgggaacggagtcgtgacaacttcaggtacatatgtatcagctattgcgcaagcaaaagcctcccaggaaggacctctgccagaaatcgaagatgaagtttttcgcaaaagaaatttaacgataatggatttacaccccggttcgggaaaaacgagaagatatttgcctgcaattgtcagagaagcgattaaacgaaaattaaggactctgatactggctccaactcgtgtggtagcgtctgagatggcagaagccttaaaaggcatgcctataaggtatcaaactacagcagtaaaatctgagcatacaggaaaagagatagtagatttaatgtgccacgcaaccttcacgatgagactactatcaccggtgagagtgccgaactataacatgatcataatggacgaagcacatttcacagacccatcgagtattgccgcccgaggttatattagcacaagagttggcatgggtgaagctgcagcaatatttatgaccgcaacgcccccaggctcagtcgaagcatttccacagagcaatgctgttatccaagacgaggaaagagatataccagaaagatcatggaacagtggttatgagtggattacagattttcccggaaagaccgtttggttcgtcccttcaataaaatcgggcaatgatattgcgaattgtctccgcaaaaatggtaaacgtgtgatacaattgtcacgaaagacgtttgacaccgaatatcagaaaactaagaataatgattgggactacgttgtgactactgatataagcgaaatgggagcgaatttcagagcggacagagtgattgatccaagacgatgtttaaaaccagtaatccttaaagatggtccggaacgtgtaatattggccggcccaatgcctgtaacagtagcttcagctgcgcaaagaagaggaaggataggaaggaatcataataaagaaggagatcaatacatttatatgggacaacccctcaacaacgatgaggatcatgcccattggacggaagcaaaaatgttactggataacattaatacaccggaaggcattatacctgcactctttgaacctgaaagagaaaaatctgctgcaatagatggggaatacaggctgcgaggcgaggcgcgcaaaactttcgttgaactaatgagacgcggagatttacctgtatggttgtcttataaagtagcatccgagggatttcaatactcggacagaagatggtgctttgatggagagagaaataatcaagtgttagaagaaaacatggatgttgaaatatggacaaaagaaggagagcgtaagaaattacgtcccagatggttagatgcccgaacatattctgatccattggcacttagagaatttaaggagtttgccgctggccgtcggtccgttagtggagaccttatactagaaattggaaaattgcctcaacatctaacacagagggcgcaaaatgcacttgacaatctcgtgatgttacacaactcagagcaaggaggaagggcttatagacatgcaatggaagaattaccggacacaatagaaacattgatgctgttagccctaatagcagttctgacagggggtgtaactcttttcttcctcagtgggcgtggactaggcaaaacatcgatcgggctattatgcgttatggcgtcgtcagtcttgttatggatggcgtcagtagaaccacactggatagctgcatctattatattagagttcttcttgatggtattgttaatccctgaaccagataggcaacgaacaccccaggataaccagctagcgtatgtagttatagggcttctatttatgatattaacagtagccgctaatgaaatgggactactcgagacaacaaagaaagatctcgggataggacacgtagccgtagaaaatcatcatcacgcagcaatgctagatgtcgaccttcatccagcttcagcatggacgctctatgcagttgctacgacgattataacccctatgatgagacatactatcgagaatactacagcgaatatatcgctgacggctatcgcgaaccaagcagctattctaatgggcttagacaaaggatggccaatatctaagatggatattggagttcctctacttgccttagggtgttactctcaagtaaatcccttaactctaacagccgctgtgttgatgttagtagcccactatgcaatcataggacccggattacaggcgaaagccacgagagaagctcagaaacgaacggccgccgggattatgaaaaatcctacagtagatggcattgtggcgatcgatctagatccagttgtgtatgacgcaaaatttgaaaaacaattgggccaaataatgctactcatactttgtacatcgcagatattgctaatgcgaacaacgtgggctctatgtgaatcaataacgttagccacgggacccctgactacattatgggaggggagccctggaaaattttggaatacgacaattgcagtaagtatggcaaacatattcaggggttcgtacttggcgggtgcgggactagcattctcgttaatgaagtctctcggtggagggagaagaggtacaggagcccaaggagagactttaggcgaaaagtggaaaaggcaactaaaccagctatctaaatctgaatttaatacatataaaagatcgggcataatggaagtcgatcgatcggaagcaaaagaagggcttaaaaggggtgaaacaacgaaacatgcagtttctcgtggtacagccaaattaaggtggttcgttgaaagaaaccttgtaaaaccagaaggaaaagtaatagacttaggctgtggaaggggaggatggtcgtattactgtgcaggtcttaagaaagttacagaagtaaaaggatatacaaagggcggacctgggcatgaagaaccaattccaatggctacgtatggatggaatttggtaaaattacattctgggaaagatgtcttcttcatccctccagaaaaatgtgacacactcctgtgtgatatcggtgaaagtagtccgaaccctacaattgaagagggacgcacattaagagtcttaaaaatggtagaaccctggcttcgtggaaaccaattctgtataaaaatattaaatccttacatgccgagcgtagtagaaaccctcgaacagatgcagagaaagcacggcggaatgttggtaagaaacccactatcgcgaaattcaacacacgagatgtattgggtatcttgtggtacaggaaatatcgtctcggcagtgaacatgacgtcacgaatgctattaaacagattcacgatggcacatagaaagccgacctacgaaagagacgttgacctaggagcaggtactcgacacgttgccgtagaaccggaagtagcaaacttagatatcataggtcaaagaattgaaaatattaaacacgagcataaaagcacatggcattatgacgaggacaatccctacaagacatgggcgtatcatggtagttacgaagtgaaaccatcaggatctgcatcatcaatggtcaacggggtagtaaagctactaactaagccttgggacgtcataccgatggtgacccagattgctatgaccgacaccactccattcggacaacagagagtgttcaaagaaaaagtggatacaagaacacccaaagctaaaaggggtacagcacaaataatggaagtaactgcaaagtggctatggggttttctttctagaaacaagaaacctcgtatctgtacacgtgaagaatttacacgaaaagtacgatcaaacgcagccatcggtgccgtatttgttgatgaaaaccaatggaatagtgcaaaggaagcggtcgaagacgaaagattttgggacttagttcatcgggagagagaattacacaaacagggaaagtgcgcgacgtgtgtatataatatgatgggtaaacgagagaagaaattaggggaatttggaaaagctaaaggctccagagcaatatggtacatgtggttaggagcaaggtttctagaatttgaagcacttggatttatgaatgaggatcactggttttctcgcgagaacagtttgtccggagttgaaggagaagggttgcacaaattaggatacatcttaagagatatatcaaagattccaggagggaatatgtatgcagacgatacagcaggatgggacacgagaataacagaggacgatttacaaaacgaagccaaaataacggacattatggaacctgagcatgcattattggcgaaaagcatttttaagctgacatatcaaaacaaggttgttagggttcaacgaccagccaaaaatgggacagtcatggatgttatatcgcgccgggaccaacgaggatccggacaagtaggcacttatggactgaatacattcactaatatggaagcccaactcatacgacaaatggaaagtgaaggaatatttagtccgtcagaactggaaactcctaatttggcaggtcgagtacttgactggcttgagaagcacggtgtagagcgcctaaagagaatggccataagcggtgatgattgtgtagtaaagcctatagacgatcggtttgcagcagccctaaccgcgctcaacgatatgggcaaggtgaggaaagatataccacagtgggaaccttctaagggttggaatgattggcaacaagttccattctgctcacatcattttcatcaactaataatgaaagacggtagagaaattgttgtaccatgcaggaaccaggacgagctagtagggagggcccgagtatcccaaggtgctgggtggtcgctacgtgaaactgcgtgtctaggcaaatcttacgcccaaatgtggcaactaatgtactttcatagacgagacctacgattagcagcaaatgcgatatgtagcgcagttcctgtggactgggttccgacatcacgaaccacttggagtatacatgctcaccatcagtggatgacaacggaggatatgctcagtgtctggaatagggtatggatcgaggaaaatccctggatggaagataaaacccacatctcctcatggggcgatgttccgtatttgggcaaaagagaggatcaatggtgcggaagtttgataggacttacagcacgggcaacctgggctacaaatatacaagtggcgatcaatcaagtacggagactaatcggaaacgagaactacttggattatatgactagcatgaaacgcttcaaaaacgaaagcgaccccgaaggagcactatggtga

SEQ ID NO: 21782 - RNA, 9879 nt, synthetic construct
  misc_feature 1..9879: note = derived and/or modified CDS sequence (opt6) from DENV-1__GU131689__SS-prME
  source 1..9879: mol_type = other RNA
agtgttactatgtttttgatgttaatgccaactgccctcgcctttcatctaactacacgagggggtgaacctcatatgattgtaagcaaacaagaacgagggaaaagtctgctctttaaaacatcagcgggggttaatatgtgtactttaatagcaatggacttaggtgaattttgtgaagatacaatgacatacaaatgcccacgaataacagaagcagaacccgatgacgtagactgttggtgtaatgcgacagacacatgggtcacatatggtacatgctcccaaacaggggaacacaggcgtgataaaagaagtgtagcacttgcgccacacgtaggattaggactcgagacacgtactgaaacgtggatgtcgtcagaaggggcatggaaacagattcaaagggtcgagacttgggcactaagacatcccggatttacagtcatagcattattcttagcacatgcaataggaacatccattacacaaaaaggaattattttcatactcttaatgcttgttacccctagtatggctatgcgctgtgtggggataggttcgcgagattttgtggaagggttaagcggagcaacctgggtcgacgtagtgttagaacatggatcgtgtgtaacgacaatggccaaagataaaccgaccttagatatagaactacttaaaacagaggtaaccaacccagcagtactacgtaaactgtgtatagaggcaaaaatatcgaacactacgacggattctcgctgcccgactcaaggagaggccaccttagtagaagaacaggacgctaattttgtgtgtaggaggacgttcgtagatcgaggatggggaaatggatgcggcctctttgggaaaggaagtttgattacctgcgctaaatttaaatgtgtaactaaacttgaggggaaaatagtacaatatgaaaatcttaaatactcggtcattgtaaccgtacacactggagaccaacatcaagttggaaatgaatctacggagcatggaacgacggctactataacaccgcaagcgccatctactgagatacaactaacagactatggcgcattgactcttgactgttctcctcgtactgggctagatttcaatgaaatggtattattaacaatgaaagagaaaagttggctcgtacataaacaatggtttcttgacctgccgctcccctggaccagcggagcaagcacaagtcaagaaacctggaatcgacaagatctgctcgttacgttcaaaacagctcatgcgaagaaacaagaagtagttgtcctaggatcacaggaaggtgctatgcacacagctttgaccggtgcaacagaaatccagacaagtggcacaacaaccatatttgctggtcacctgaaatgccggctaaaaatggataaattaacattaaaaggaatgagttacgtaatgtgcacaggaagttttaaattagaaaaagaggtagcagaaactcaacacggaacagttctggtacaaataaaatatgaaggcactgacgcaccttgtaaaataccattctccacccaagacgaaaaaggagtgacgcaaaacggtagactcattaccgcaaacccgattgtaacggataaagagaagccggtgaatattgaagcagaaccgccatttggagagagctatattgtaattggtgcgggtgaaaaggctttgaaactctcctggtttaagaaaggtagtagtatagggaaaatgtttgaggcgacagctagaggggctagaagaatggccatattaggagataccgcctgggactttggttcgatcggtggagtctttacatcagtcggcaagctagttcaccaaatctttggaactgcctatggcgtcttattcagtggagtcagctggacaatgaaaatcggaattggagtactactaacatggctcggtctcaacagcagatccacaagtttaagtatgacatgcatagcagtgggcctagtcaccctttaccttggagtcatggttcaagctgatagcgggtgcgttatcaattggaaaggacgtgagctaaaatgtggaagcggtatattcgtcaccaacgaagtacatacatggacagaacaatataagtttcaagctgactctccaaaacggttgtcggcagcgatagggaaagcatgggaagaaggagtttgtggtatacgaagcgcaacacgattagaaaatataatgtggaaacaaattagcaacgaattaaatcatattttgttagaaaatgatatgaaactaacagttgttgtcggcgatgtagcaggcatattagcacaaggaaagaagatgatccgaccacagcctatggaatacaaatattcatggaagtcatggggaaaagccaaaattataggcgcagacgtccagaacacaacgttcataatcgatggtcctaataccccagaatgtccggatgaccagagggcatggaatatttgggaagtagaagattacggcttcggaatattcaccacaaatatatggttaaaactcagggattcatatacacaagtctgcgaccatcgactaatgagtgcggcaatcaaggattcaaaggctgtacatgctgacatggggtattggatagagtcagaaaagaatgaaacttggaaattagcacgagcgtcgtttattgaggtaaaaacctgcgtttggccgaaaagccacactctgtggtctaatggggttttggaatcagaaatgataattcctaaaatatatggagggcccatatcccaacataattacagacctggctatttcacacagacagctggcccatggcatctcggaaaattagaattagattttgatctttgtgaaggcaccaccgtggtcgtcgacgagcattgcggcaataggggaccaagcctaagaacgaccaccgtaaccggaaaaatcatccacgaatggtgttgcagaagctgtacactacctcctcttagatttaaaggcgaagatggatgctggtatgggatggaaattcgaccagtgaaagaaaaagaagaaaacctggtgaaatcaatggtaagtgcaggaagtggagaagtagatagttttagcctgggactactatgcataagtatcatgattgaagaagtgatgcgaagtcggtggagtagaaaaatgctaatgaccggaaccttagcggtcttctttctactgattatggggcaacttacttggaatgacttaattcgtctctgtattatggtcggagctaatgcttcagatcgaatggggatgggaactacctacctagcactaatggcaacatttaaaatgagaccaatgttcgcagtcggccttttgtttcgaagacttacatcaagggaggttctgttacttacaataggtttatcactggttgcatcagtagaacttcctaacagtttagaagaacttggggatggattggcaatgggcattatgatacttaaattgctaacggattttcagagtcaccaactgtgggccacacttttgtccttaacgtttatccgcacaacatttagcttgcactacgcatggaaaacaatggccatggttctctctatagttagcttatttccactttgtttgagtacaacaagtcaaaagaccacgtggttacctgttcttctgggatcacttggatgcaaacctttgactatgtttctaatagctgagaataaaatctggggtagaaaaagttggccattaaacgaaggaattatggcagttggaatagtttcgatactcctgagctcacttttaaagaatgacgtacctctagcagggccgttgatcgcaggaggaatgttaatcgcttgttatgtgatatcaggatcatcggctgacttatcactagaaaaagcagctgaagtctcttgggaagaagaagcagaacatagcggagctagtcacaacatattggtagaagtacaagatgatggaacaatgaaaataaaggatgaagaacgcgatgatacgcttacaattctgcttaaagctacattactagccgtttcgggcgtatatcctctcagtatcccggcaacgctctttgtctggtacttctggcagaaaaagaaacagcggtcaggagtcctttgggataccccttcgccccctgaagtagaacgagctgttttggatgacggcatatatagaataatgcaaagggggttattagggcgatcacaagttggagtcggggtctttcaagagaacgtctttcatacaatgtggcacgtaacaagaggcgccgtactcatgtatcaaggcaagcgtttagaaccctcatgggcatctgtgaagaaggatttaatttcatatgggggaggatggcgattacaaggatcatggaataccggcgaagaagtacaggttattgcagtagagccaggtaaaaatcccaaaaatgtacaaacggcacctggaacattcaaaacctccgaaggcgaagtgggggcaatcgcactcgactttaaacccggaacatccgggagcccaatagtaaacagagagggaaaaatagttggcctttatggcaacggtgttgttacgaccagtggaacttatgtaagcgccatcgctcaagctaaagctagccaggaaggaccgcttccagaaattgaggatgaagtttttcggaaaagaaatctgaccatcatggatctacaccctggcagcggaaaaacgagaagatacttgcctgcgatagttcgagaagccatgaaacgaaggttgcgtacgttaatactagcacctacaagagtagttgctagtgaaatggctgaggctttaaaaggaatgccaatccgatatcaaaccacagccgtaaaaagcgaacatacggggaaggaaattgtcgacctaatgtgtcacgctacatttactatgcggctacttagcccagtgagggttccaaattacaacatgattataatggacgaggcccattttactgatccatccagcattgcggcaagaggatatatttctaccagagtcggcatgggggaggctgcggctatctttatgacagcgacaccgccagggtctgtggaagcattcccccaaagcaacgcggttatacaagatgaagaaagggacatacctgaacgaagctggaacagtggatacgaatggataactgactttccaggtaaaacagtctggtttgtaccttctattaaatcgggcaacgatatagccaactgtctaaggaaaaacggcaaaagagtaattcaactgagtcggaaaacatttgacactgaatatcaaaagactaaaaataacgattgggattatgttgtaacaactgacataagcgaaatgggagcaaacttccgagcggatcgagtaatagatccacggcggtgtttaaaaccagttatattaaaagatggacctgaacgcgtcatccttgcaggtccaatgccagtgaccgtggctagtgcagcacaacgtagaggtagaataggacggaatcataataaagaaggtgatcagtacatatatatgggacaaccgctaaataacgacgaagatcatgcacactggaccgaagcaaaaatgctattggacaatatcaacacacctgaaggtattataccggctctctttgaaccggaaagggaaaagtcagcagcaattgatggagaatacagacttagaggcgaagcaagaaaaacgttcgtcgaattgatgcgaagaggcgatttaccagtttggttaagttataaagtagcaagtgaaggcttccaatacagtgaccgcagatggtgttttgatggggaaagaaacaatcaagtacttgaagaaaacatggatgttgaaatatggaccaaagaaggagaaagaaagaaattacggccaagatggcttgacgctcgcacttactctgatcccctagcattaagagaatttaaagaatttgccgcaggtagaaggtctgtatcaggtgatctaattttagaaattgggaagttacctcaacatctaacacagagagcacagaacgcacttgataacttggtcatgctccacaattcagaacaaggaggtcgggcctatcgacatgctatggaagaattaccagacactatcgagactctaatgctactagccttaattgctgtattaactggaggtgttacactattctttttatcaggacggggtttaggtaaaacatcaatcggactattatgcgtaatggcatcatctgtactgttatggatggcatcagtagaaccccattggattgcagcctcgattatactcgagttcttcttaatggtactgttaatacccgaaccagaccgtcaaagaaccccacaagacaatcagttggcgtatgtagtaatcggattactattcatgattttaaccgtagctgcgaatgagatggggctacttgaaaccactaagaaagatctaggaataggtcacgttgctgttgagaatcatcatcatgccgctatgctagatgtagacttacaccctgcaagcgcatggacattgtacgcagtagccacgacaataataacaccaatgatgaggcatacgatagaaaacactactgcaaatataagcctaacagcaatcgcgaatcaggccgcaatactgatgggcctggataaaggatggccaataagtaaaatggatataggtgtaccactgcttgcccttggttgctattcacaggtcaatccactaacattaacagcagcagttttaatgcttgtagcacattacgcaattattggtccagggttacaagcaaaagctacacgggaggcacaaaaacggacagcagcaggaattatgaaaaacccaacggtagatggcatcgttgccattgatctagatccggtagtttatgatgcgaaatttgaaaaacaattaggacaaataatgctacttatactatgcacgtcacagatactgcttatgcgaactacttgggccctttgcgagtcgataacgttggcgacaggaccgctgacaacactttgggaggggagtccaggaaaattttggaacacgacaattgcggtgagtatggcaaatatctttaggggatcttacttagctggtgcagggcttgcgttttcactgatgaaatcgctaggaggtggtcgacgaggcacaggggcacaaggtgaaacactaggagagaaatggaaacgacaactcaatcaactgagcaaatcagaatttaatacatataaaagaagtggtataatggaggtcgataggagcgaggcaaaagaaggactaaaacgtggcgaaacaacaaagcatgctgtctcacggggtactgcaaaattaagatggtttgttgaaagaaatcttgttaaaccggagggtaaagtaatcgacttaggctgtggacggggtggctggtcctactactgcgctggacttaaaaaggtcaccgaagttaaaggatacaccaagggaggaccaggccatgaagaaccgatcccaatggcaacctatggatggaacctagtgaaattgcactcaggaaaagatgtatttttcataccaccggaaaagtgtgatacactcctttgcgacatcggcgaaagctcaccaaacccaactatagaggagggaagaacattacgagtattaaaaatggttgagccatggttacggggcaaccagttctgtattaaaattttaaatccttatatgccttcggttgtagaaactctagaacaaatgcagcgtaagcacggtggtatgctggttcgaaaccctctgtcaagaaattcaacacacgaaatgtactgggtaagctgtggcactggaaatattgtttctgcagtcaatatgacaagtcgcatgctgcttaacagatttacaatggcgcatcggaaaccgacatacgaaagggacgtcgatttaggcgctggaactagacacgttgctgtcgaaccagaagaggctaatctagatatcataggacagaggatagagaatatcaagcacgaacataaatcaacctggcattacgatgaagataacccttacaaaacttgggcatatcatggatcctatgaggtaaagccaagtggaagcgcatcatcaatggtcaatggcgtagtgaaattactcactaagccgtgggatgttatacctatggtaactcaaattgcaatgactgataccacacctttcggacagcaaagagtattcaaggaaaaggtagatactagaacgccgaaagctaaacgaggcaccgcacagataatggaagttacagcaaaatggctttggggtttcctttcacgcaataaaaagccaaggatctgtacgagggaagagttcactaggaaggtcaggtcaaatgcagccatcggggcagtttttgttgacgaaaaccaatggaatagcgcaaaagaggctgttgaagatgagcgattttgggacttagttcatcgtgaacgagaattgcataaacaagggaaatgcgcgacctgcgtatataacatgatgggcaaacgagaaaagaagctgggcgaatttggcaaagccaaaggaagtagagctatctggtacatgtggctcggggccagattcctagaatttgaagcattagggttcatgaacgaagatcattggttctcaagggaaaatagccttagtggcgtggaaggtgaaggattacacaagctcggttacattctcagagatatctccaaaattcctggtggtaatatgtacgcagacgacaccgcgggttgggacacacgaataaccgaagatgacttgcaaaacgaggctaaaataaccgacattatggaaccagagcacgccttgcttgccaaaagcatatttaagctaacctatcaaaataaggtggttcgtgtacaaaggccagctaaaaatggtacagttatggacgtgattagccggagggatcaaagaggatccggacaggtaggaacgtacggactgaatacattcacaaatatggaagcgcaattaatccgtcaaatggagtctgagggaattttcagtccttctgaattggaaacacccaatttagctgggcgcgtgctagactggttagaaaaacatggtgtagaacgactcaaaagaatggcgatatccggtgatgattgcgtcgttaaacccatagacgaccgattcgcaaccgctcttactgccctaaatgatatgggaaaagtgcgtaaagacataccacaatgggaaccatctaaaggttggaatgattggcaacaggtaccattctgctcacatcattttcatcaactaataatgaaagacggaagagaaattgtagtaccttgcagaaatcaggatgagctagtgggtagagcacgggtgtcacaaggagccgggtggtcgcttagggaaacagcatgcctggggaaaagctatgctcaaatgtggcaacttatgtattttcacagacgcgacctgcgcctcgcagctaatgctatatgcagtgcagtccccgtcgattgggtccccacaagccgtacaacatggtccatacacgctcatcaccaatggatgactaccgaagacatgttatccgtatggaatagagtttggatagaagaaaacccatggatggaagataagacacatgtaagctcatggggagacgttccatacctagggaaaagagaagaccaatggtgtggctccctcattggattaactgcgcgagcaacatgggcaacaaatatacaagtggcgataaaccaggtaagacggcttctgggtaatgaaaattatttagattatatgacttctatgaaaagatttaaaaacgagtccgatccggagggcgcactttggtaa

SEQ ID NO: 21783 - RNA, 9879 nt, synthetic construct
  misc_feature 1..9879: note = derived and/or modified CDS sequence (opt6) from DENV-1__GU131690__SS-prME
  source 1..9879: mol_type = other RNA
agcgttactatgttattaatgttgatgccaactgcactcgcctttcatctaacaacaaggggtggagaaccgcatatgatagtctcaaaacaagaaaggggtaaaagcctccttttcaaaacatcagcgggagtcaacatgtgcaccctcatagccatggatttaggtgaactatgcgaagatacaatgacctataaatgtcctcgaatcaccgaaacagagccagacgacgtagactgctggtgtaacgccaccgatacatgggtaacatacggaacatgttctcaaacaggggagcatcggagggataaaaggtctgtggccctcgcaccgcatgtaggactaggattagaaacgcgtacggaaacgtggatgtcatctgaaggcgcgtggaaacaaatacaaagggtggaaacgtgggcactacgccacccaggttttaccgtgatagcattgtttttggcacatgcaatagggacaagtataactcaaaaaggaataatatttatacttttaatgctagtgacacctagtatggcgatgcgatgcgtaggtataggatctagagacttcgttgaaggcctaagcggagcaacctgggtagacgtggtcttagagcatggtagctgtgtaacgaccatggcaaaagacaaaccaactttagatattgagttgttaaaaacagaggttacaaaccctgcagtattaagaaaattatgtatagaggcgaaaataagcaacaccacgacagacagtaggtgcccaactcaaggagaagccacattagttgaagaacaagacgcgaatttcgtatgcagacgaacctttgtagaccggggatgggggaatggttgtggattattcggaaaaggctctttaataacatgcgcgaaattcaaatgtgttactaaactagaaggaaaaatagttcaatacgaaaatcttaaatacagcgtcattgttacagtgcatacaggggaccaacatcaagtaggaaatgaatctactgaacatggcactacagcaaccattacccctcaagctcccactactgaaatacaattaacagattatggggccttgacccttgattgctcaccgcgaactggattagattttaacgaaatggttctcttaacgatgaaagaaaaatcatggctcgtacacaaacaatggtttttagatctcccgctaccgtggacgagtggtgcctctacaagccaggaaacatggaatagacaagatcttttagttacatttaaaacagctcatgccaagaaacaagaggtagttgtgttgggctcgcaggaaggagctatgcatactgccttaactggagcgaccgaaatacagacatcaggaaccaccacaatatttgctggacatctaaaatgtcgcttaaaaatggataaattaactttaaaagggatgtcctatgtaatgtgcacaggcagtttcaaactggaaaaagaattagctgaaacgcaacacgggacagtcttagtacagataaaatacgaaggaacagacgcaccttgcaaaataccttttagtacacaagatgagaaaggagttacacaaaacggacgactgattacagccaatcctattgtgacggacaaggaaaaaccggtaaatattgaagccgaaccgccattcggtgaaagctatatagttataggtgccggagagaaagccctgaagttaagctggtttaagaaaggatcaagcattgggaaaatgtttgaagccactgctagaggagcaagacggatggcaattctaggagatacggcttgggatttcggaagcattggcggggtatttacatctgtcggcaagctggtccatcagatatttggcaccgcatatggtgtattattcagtggagtgagctggaccatgaaaataggtataggagttttattaacatggttgggtctaaattcaagatctactagcttatctatgacgtgcatcgcagttggcctagttacactgtatctgggggttatggttcaagcggattcaggttgtgttattaactggaaagggcgcgaactaaaatgtggatcaggtatatttgtcacaaatgaggtgcacacgtggacggaacagtataaattccaagctgatagtccgaaaagactttccgcagcgatcgggaaggcatgggaagaaggcgtatgcggaattagatccgtcacacgactagagaatattatgtggaaacaaatttcaaatgaactaaaccatatacttctagaaaatgatatgaaatttacagtagtcgtgggagatgtggctggaattttagcacagggaaagaagatgatacgccctcaacccatggaacataaatattcttggaaatcgtggggaaaggcaaagattatcggagctgatgtacaaaatacaactttcataattgacggaccaaacacccctgaatgccccgatgatcagagagcttggaatatatgggaggtcgaagactatggattcggaatattcactacgaatatctggttaaagttgagagatagctatactcaggtatgcgatcatcgtctaatgagtgcagctataaaagattcaaaagcggttcacgctgacatgggatattggattgaaagtgaaaagaacgaaacctggaaacttgcacgtgcgagttttattgaagtcaagacatgtatatggcccaaatctcacacgttatggtccaatggtgttttggagagcgaaatgatcatacctaaaatatacgggggtcccatttcacaacacaattataggcctggatatttcacccaaacggcaggtccgtggcacctcggtaaactagaactcgacttcgacttgtgtgaagggacaacagttgtagtagatgaacactgtggtaataggggaccgagtcttcgaaccaccacagttacaggaaaaataatacatgaatggtgctgccggtcttgtacgcttccacctttacgttttcgaggagaagatggttgttggtatggtatggagatacggccggtcaaagaaaaagaagagaatctggtcaagtccatggtttcagctggatcaggagaggtagactccttctcattaggacttctatgtataagtattatgatagaggaggtgatgaggtcgcggtggagtcgtaagatgttaatgactggaacattggcggtattctttctcttaatcgttggccaattaacgtggaatgatttaataaggttgtgtattatggtgggggctaacgcttcagaccgcatgggcatgggtactacgtacctcgcactgatggccacttttaaaatgaggcctatgtttgctgtaggactactatttcgccgattaacatcacgcgaagtacttctattaaccataggactttctcttgtagcgtcggtcgaattgccaaattctttagaggagctaggagacggactagcaatgggcattatgatccttaaattactaacagatttccagagtcaccagctgtgggctacgcttctgagcctgacattcataaaaaccacctttagcctccactacgcatggaagactatggcgatggtactatcagtcgtatccctatttccactctgcctgtccacgactagccagaaaacgacgtggttacctgtgcttttgggaagtctaggttgtaagcctttaacaatgttcctaatagcagaaaacaaaatctggggaagacgatcatggccattaaacgaagggatcatggcagtaggaatagtaagtattctattgagtagtctattgaagaacgatgtacctcttgccggtcccctaatagcagggggcatgttaatcgcttgttatgttataagcggttcttccgctgatttgtctctggagaaagctgccgaagtcagttgggaggaagaagctgaacactcaggggcatcccataacatattggtcgaagttcaagatgacggcaccatgaaaattaaagatgaagaaagggatgatacactaacgatccttctgaaggctacactgttagccgtaagtggtgtttatccattgtcaattcctgcaacgttgtttgtatggtacttttggcaaaagaagaaacaaaggtccggagttctatgggatacacctagtcctccagaagtggagcgagccgtgttagatgatggaatataccgaattatgcagcgggggttacttggtagatcccaagtaggagtaggggtatttcaagaaaatgtgttccacacaatgtggcacgtgaccagaggggctgtgcttatgtatcagggtaagagactcgagccatcatgggccagtgtcaagaaagatcttattagttatggcggagggtggcgtttgcaaggaagctggaacaccggagaagaggttcaggtaattgccgtagaacctggcaaaaatcccaaaaatgttcaaaccgcacctggaacgttcaaaacccctgaaggtgaagtaggcgcaatcgcgttagattttaaaccaggaacttcgggttcacctattgtaaatcgtgaaggaaagatagttggtttatatggcaatggagtagtaaccacatcgggtacatacgttagtgcaatagcacaagcaaaagctagtcaagaaggcccattaccggaaatcgaggatgaggtatttaggaaaagaaatttgacgataatggatttgcatcctgggagtggaaagacacgaagatatcttccggcgattgtacgagaggcaataaagcgcaaattaaggacgttaatactagcacctacaagagttgtcgcgagtgaaatggcagaggctttaaaagggatgcctattcgatatcaaacgactgcagttaagtccgaacatacgggaaaggaaattgtggatctaatgtgccatgccacgtttaccatgagactcctttctcccgtaagagtgcctaattataatatgatcattatggacgaagcacattttactgatccaagttcaatcgcggcaaggggatacataagcacacgtgtcggaatgggagaagcagctgcgatttttatgacagctacacctcccggttctgtcgaagcctttccacaatcaaacgctgtgatacaagatgaggagcgtgacatcccagaaagatcttggaatagcggttacgagtggattactgactttcctggaaaaacagtatggtttgtaccaagcatcaagagcggcaatgacattgctaactgcttaaggaagaatggtaaaagggtaatacaattaagtcgcaaaacattcgacacagaataccagaaaaccaaaaacaacgactgggactacgtagtaacaacagatatatctgagatgggagcaaactttcgcgctgatagagttatagacccccgaagatgcttaaaaccggttatcttaaaggacggaccagaaagagtaatacttgctggaccaatgcctgtgacagtggctagtgcagcccaacgacggggtcgaataggcagaaatcataacaaagaaggagatcagtacatttacatgggacaacccttaaacaacgatgaagatcacgcacactggaccgaagcaaaaatgttgttagataatattaatactcctgaaggaataattcctgccttattcgagccagaaagggaaaaatcagctgccatagacggggaataccgtctgaggggagaagcacgaaagacgtttgtcgaattaatgagaagaggggaccttccggtatggctaagctataaggtagccagcgaagggtttcaatattccgataggcgttggtgttttgacggtgaaagaaataaccaggtgcttgaggaaaatatggacgtagagatatggactaaggaaggtgaacgtaagaaattgagaccaagatggctggacgcgagaacatactctgatcctctggcacttagagagtttaaagagttcgctgccggtcgaagatcagtatcgggagatttgattcttgaaattgggaaactaccacaacatctaactcaaagagcacaaaatgctcttgacaacctcgtaatgcttcataatagtgaacagggcggtagagcgtacaggcatgcaatggaggagctacctgacaccatagagactctaatgttgttagccctaattgctgtattaaccggtggtgttaccttgttctttttatccggtaggggcttgggaaaaactagcatcggcctattatgtgtaatggcctcatccgtccttctctggatggcgtccgtagaaccacattggatagcggcatctattatattagagttcttcctaatggtcctactgattcccgaaccagataggcaaagaactccgcaggataatcagctcgcatacgtcgttataggactcttgtttatgatactaactgtagcagcaaacgaaatgggcttgttagagactactaagaaagatctcggaattgggcatgttgcagtggaaaatcatcaccatgctgcaatgttagatgtagaccttcacccggcaagtgcttggacattatacgcggtagcaacgacaatcattactcctatgatgcgtcacactattgaaaacacgacagcgaatatcagcttaactgccatagcaaatcaagcagcaattcttatgggactcgataaaggctggccaatatcaaaaatggatataggagtcccactcttagctctaggctgttactcccaagtgaacccattaacgcttacagccgctgttcttatgttagttgcccactacgcaataataggacctggcctccaagctaaagcgacaagagaagcacagaaaagaacagcggccgggattatgaaaaatccaactgtcgacgggatcgttgctatagaccttgacccagtagtgtatgacgctaaattcgagaaacagttaggacaaattatgttgctaatcttatgtactagccaaatattgttaatgagaaccacgtgggcgttatgtgagagtattacgttagctactggaccattaacaacattatgggaaggatctcctggaaaattttggaatacgactatcgccgtttctatggctaacatttttaggggatcgtacttagctggagccggccttgctttcagtctgatgaaaagtctcggaggaggaaggcgcggtactggtgcacagggggaaacgcttggcgagaaatggaagagacagctaaatcagctgtcaaaatcagagttcaatacttacaaaagaagtgggataatggaggtagaccgtagcgaagcaaaagaaggactaaaacgaggtgaaacgacaaagcatgccgtttccaggggtacggcaaaactacgctggttcgtcgaaaggaatttggtaaagcccgaaggaaaggtaatagacttaggatgtggaagaggcggatggtcttattattgcgctggtctaaagaaagtgacagaagtaaaaggttacactaaaggaggccccgggcatgaggaaccaataccgatggcgacatatggttggaacttagtaaaactacacagtggaaaagacgtcttctttataccacctgaaaaatgcgatactttactttgtgacataggggagagttctccaaaccccactattgaggagggcaggacccttagagtacttaaaatggtggaaccttggttacggggcaaccaattttgtataaaaatactgaacccatacatgccatcggtggtagaaacactcgaacaaatgcaaaggaaacatggtggaatgcttgtccgtaatccgttatcaagaaattctactcatgaaatgtattgggtctcgtgcggaacgggtaatatagtctccgcggttaatatgacaagcagaatgttactaaatcgttttacaatggcacatagaaaaccgacctatgagagagacgtagacttaggtgccggtactagacacgtggcagttgagccagaagtagctaacctagacattataggacaacgtatagaaaatattaaacatgaacataaatcaacctggcactatgatgaggataacccatacaaaacatgggcctatcacgggtcctacgaagtaaaaccgtcaggatccgcaagttctatggtaaacggagttgtgaaattattaacaaaaccctgggatgtaatcccgatggttacacaaattgccatgacagacacgacaccatttgggcaacaaagggtatttaaggaaaaggttgacacaagaactccaaaggccaaaaggggaactgcccaaatcatggaagtgactgcaaaatggttatggggctttttatctcggaataagaagccgagaatctgtacaagagaagaatttacccggaaggtaaggtcaaacgctgccataggtgcagtatttgtagatgaaaaccaatggaatagtgcaaaggaagccgtagaagatgaaagattttgggatttagtacacagggaaagagaactccataagcaaggcaagtgtgcaacttgcgtgtacaacatgatgggcaaaagagagaagaaattaggtgagttcggaaaggccaaaggtagccgagctatatggtatatgtggctaggtgcaagattcttagagttcgaagcactaggttttatgaacgaagaccattggtttagccgagaaaatagtctttctggagttgaaggagaagggttacataaattgggatatattctgcgcgatatatcaaagataccaggaggaaacatgtatgctgatgacacagctggttgggatacaagaataacagaagacgatttacaaaacgaggcccggataactgatataatggaaccagagcatgctttattagctaaaagtattttcaaattaacatatcaaaacaaagttgttagagtgcaacgcccagccaagaatggcactgtcatggatgtaatatcaaggagggatcagagaggtagtggccaagtggggacttacggattaaatacgtttacgaatatggaagcccaattgatcagacaaatggaatctgaaggtatattctctcctagtgaactagaaacaccaaatcttgccgaaagagtactagattggctagaaaaatacggagtggaacgactcaaacgcatggcaatttccggagatgattgtgtagtcaaaccaatagatgatcggttcgctactgcactaacagccttaaatgatatgggtaaggtcagaaaagacattccacagtgggaaccaagtaaaggctggaatgattggcaacaagtaccattttgctcacatcacttccatcaattaataatgaaggacggacgcgagatagtagttccttgccgaaatcaggatgagctagttggccgtgctcgcgtgtctcaaggagcaggatggagtttaagagaaaccgcttgtttaggtaaatcatacgcccaaatgtggcagttaatgtattttcacagaagggacctacggttggcagcaaacgctatctgcagtgcagttccggtcgattggatcccgacgtcaaggacaacatggtcgattcacgcccatcaccagtggatgacaacagaagatatgctgtctgtgtggaatagagtatggatagaagaaaatccatggatggaggataaaacacatatatcaagttggggtgatgttccttacttgggtaaaagggaagatcaatggtgtggatcattaataggactaacagcaagagctacatgggcgacgaacatacaagtagcgatcaatcaagtgagaaggttgataggaaatgaaaactatctcgattatatgactagcatgaagcgttttaagaatgaaagcgatcctgaaggagcgctttggtaa

SEQ ID NO: 21784 - RNA, 9879 nt, synthetic construct
  misc_feature 1..9879: note = derived and/or modified CDS sequence (opt6) from DENV-1__GU131695__SS-prME
  source 1..9879: mol_type = other RNA
tcagtaacaatgttactaatgctaatgccaaccgcgctagcatttcatttaaccacgagggggggagaaccgcacatgattgtaagcaaacaggaaaggggtaaaagcctactttttaaaacatcggcaggcgtaaacatgtgtacgttaatagcaatggaccttggagaactgtgtgaagacactatgacatataaatgtccacgaatcactgaaacagaaccagacgatgtcgattgctggtgtaatgcaactgatacatgggttacctatgggacttgtagtcaaactggcgaacatcgacgtgataaacgatcagtagcgttagctccacatgtaggtttaggactggaaactaggacagaaacttggatgtctagcgaaggcgcatggaaacagattcaacgcgtagaaacgtgggcattaaggcatcccggctttacagtaattgcattattcctggctcacgccatcggcacctctataacgcagaaaggaatcatcttcatcctgcttatgcttgtcacaccctccatggcaatgagatgtgtcggaataggaagtagagacttcgtagaaggattatcgggagctacttgggtagatgttgtcttggagcatggttcttgtgtaacaaccatggcaaaagataaacctacattagatatcgaattattaaaaactgaagtgacgaatcctgcggtattgaggaagctatgtatagaagcaaagattagtaatactactacagacagcagatgcccaacgcaaggcgaagcaacattagttgaagaacaagatgccaatttcgtatgtaggaggacgtttgtagaccgaggttggggaaacggatgtggacttttcggtaaaggtagtttaattacctgcgcaaagttcaaatgtgtgacaaagttagagggcaaaatagtacagtacgaaaatctcaagtactcggtgattgttacagtacataccggcgatcagcatcaagttggtaacgaaagcacagagcatggtacgacagcaaccattacaccccaggctccaaccactgaaatccaattgactgactatggcgcactaacgttagattgctcgccacgaactggacttgattttaatgaaatggtactgttaacgatgaaagagaaatcatggctagtacacaaacaatggtttttagacctcccactgccctggaccagcggagcaagcacgagtcaagagacatggaaccgtcaagatctactagtaaccttcaagacggcgcacgcaaagaaacaagaggtggttgtactaggaagccaagagggtgcaatgcatacagctcttacaggtgcaacagaaattcaaacgtctggaaccacaactatatttgcaggccacttaaaatgcaggttaaaaatggacaagcttacattgaaaggtatgtcatatgtaatgtgtaccggaagtttcaaattagaaaaagaggtagcagaaacgcaacatggaacagtattagttcaaataaagtatgaaggtacggatgcaccatgtaaaatacctttttcgactcaagatgagaagggtgtcacacagaacggccggttaattacagctaatccaatcgtaactgacaaggaaaagccagttaatatagaagcggaacctccatttggagaatcatatattgttataggggcaggtgaaaaggctctcaagttgtcatggtttaaaaaagggagttcgatagggaaaatgttcgaggcaactgcgagaggagccagaagaatggctattttaggcgacacagcctgggacttcgggtcaataggaggtgtattcacaagtgtaggtaaacttgtccaccaaatatttggtacagcttacggtgtattattctctggtgttagttggacgatgaaaataggaataggggtgttactaacttggctaggtctgaattctcgttctacaagcctcagcatgacatgcatagcagtagggttggtcactctatacctcggagttatggtccaagctgactcaggctgcgtgattaattggaaaggaagggagcttaaatgcggatcaggcatttttgttactaatgaagtacatacatggactgagcaatataagttccaagcagactctcctaaacgtctaagtgctgctataggcaaagcgtgggaagagggagtatgcggtatacgctcagcaacacgtctggaaaatataatgtggaaacaaatttctaacgaattgaatcacatactacttgaaaacggaatgaaatttaccgttgtggtaggagatgttgcaggtatattagcccaaggaaaaaaaatgatacgaccacaaccaatggagtataaatatagttggaaaagttggggaaaagcaaagataataggtgctgatgttcaaaacacaaccttcataatagatggtcccaataccccggaatgccctgatgatcagcgagcatggaatatatgggaagtcgaagactatggattcggcatattcactactaacatatggctgaagctacgggattcatacacacaggtatgcgatcatagattaatgagtgctgcaatcaaagattcaaaggcagttcatgcagatatgggatactggattgagtccgaaaaaaatgaaacgtggaagttagctagagcgtcctttatagaagtcaagacctgcatttggccaaaatcacatacactatggagtaacggagtcctcgagtccgagatgataataccgaaaatatatggaggacctataagtcagcacaattatagaccagggtatttcacacaaacggcagggccatggcacttagggaaactggaactagactttgatctatgtgaagggacaactgtagtagtagatgaacactgcggcaaccgtggtccctcccttagaacaacaactgtgactggaaaaattatacatgagtggtgttgtaggacctgtacgctaccccctctccgttttagaggggaagatggatgctggtatgggatggagattagacccgtgaaagaaaaagaggagaacttagtcaaatctatggtgagtgccggatcaggagaagtcgatagcttcagtttagggttactatgcatttccattatgattgaagaagttatgagatcaagatggtcaagaaaaatgttgatgacaggcactcttgccgttttcttcctactgattatgggccaactaacatggaacgatcttataagactttgtataatggtgggagcaaacgcatcagacagaatgggaatgggtactacatacttagcactaatggcgaccttcaaaatgagacccatgtttgccgtaggactcttattccgaaggctcacaagtcgagaagtactcttgttgacgataggtttatccttagttgcatcggtagagcttccaaatagtttagaagaattaggtgatggactggcgatgggaataatgattctgaaactcctaacagacttccaatcccatcaactatgggcgacattactatctttaacttttattaagacaactttctctctacactacgcatggaagacaatggcaatggtgcttagcattgtatccctattccctctctgtttgtcaacgacgtcacagaaaactacatggctgccggtactattgggcagtttaggatgcaaacctttaacaatgtttcttatagcagaaaacaaaatatggggtaggaggagctggccacttaacgagggaatcatggcagtaggtatcgtatctatattattaagctccttattaaagaacgatgtgcccttagcaggtcctcttatagcagggggaatgttaattgcttgttatgtaatctcgggcagttcagctgatttgagtctagaaaaagctgccgaggtgtcttgggaagaagaagcagagcacagcggcgctagccataacattttagttgaggttcaggacgatggaacaatgaaaataaaagatgaagaaagagatgacacactaactatcctgttgaaagcaacacttttagcagtaagtggtgtatatcccctgtcgattcctgctacattgttcgtctggtatttctggcaaaagaagaaacaaagatcaggagtactatgggacaccccctctcctccagaagtcgagcgagccgttctagacgatggaatatacaggattatgcaacgtggactcttaggaaggagtcaagtgggtgtcggggtatttcaggaaaatgtcttccacactatgtggcatgtaacaagaggagctgtattaatgtatcagggtaaacgtctagaaccaagttgggcatccgttaaaaaagatctaattagttacggaggaggatggagactacaaggaagctggaatactggagaggaagttcaggtcatagcggttgaaccaggaaaaaatccaaagaatgtacagaccgctccaggaaccttcaaaacgccagaaggtgaagttggtgcaatagcgttagactttaaaccaggtacaagcggcagcccaatagtaaaccgcgaaggtaagatcgttggactatacggcaatggagttgtgaccacatcaggtacatacgtttcagctatagctcaagctaaagccagtcaagaagggccattgcccgaaattgaagacgaagtgtttaggaagcgaaatctgactattatggatttacatccgggatccggcaaaactcgccgttacttaccagcgatcgtgagagaagcaattaaacgaaaattacgcacattgatattagcaccaacaagagtggtagcatcggaaatggcagaagcactgaaaggcatgcccataagataccagactacggcagtcaaatccgagcacacgggtaaggaaattgttgatcttatgtgtcatgccacgttcactatgcgcctcctctcaccggtcagagtaccaaactataatatgataattatggacgaggcacatttcacagatccatcttcaatcgctgcccggggttatatctctacgagagttggaatgggggaagcagccgccatctttatgacagccacaccccccggatcagtagaagcatttccccaaagcaatgcggtgattcaggatgaggaacgggatatacccgaaaggtcgtggaatagtggatacgaatggattactgattttccaggtaaaaccgtatggtttgtaccaagcataaaatctggtaatgatatagcaaattgtttaaggaaaaatggaaagagagtgatacaattatcaaggaaaacattcgatacagaataccagaaaacaaaaaataatgactgggattatgtggtcacaactgatatatcagaaatgggcgcgaacttcagagccgatagggtaattgatccaagaagatgtctaaagccagttatcctaaaagacggccccgagcgtgtaatattggcagggcctatgccggtaaccgttgccagcgccgcacagagaagagggcgaataggaagaaatcacaacaaagaaggagatcaatatatctacatgggacagccccttaacaatgatgaagaccacgctcactggacagaagcaaagatgcttcttgataacattaatacacccgaaggaataataccagcattatttgaacctgagcgtgaaaagagtgcagcaattgatggagaataccggttacgcggtgaagcgagaaaaacttttgtggaattgatgcgaagaggtgatctaccggtctggttaagctacaaggttgcttcagagggatttcaatatagtgaccgacggtggtgtttcgacggggagcgaaataatcaggtcttagaagaaaacatggacgtcgagatatggaccaaggaaggagaacgaaagaaactacgacctagatggctcgatgcgagaacttactctgatccactcgccttacgcgaattcaaagaatttgctgccggccgtagaagcgtatcaggtgatttaatactggaaattggtaaactgccgcagcatttgacccaaagagcgcaaaatgcactggataatttagtaatgctgcataattctgagcagggaggcagggcttaccgacacgctatggaggagttgccagatacgattgagacattgatgcttctagctctcatcgcagttctaacagggggcgtaacattatttttcttgtctggccgcgggctggggaaaacatctataggtcttctgtgtgtcatggcctcaagcgtcttattgtggatggcatccgtagagcctcactggattgcagcctcgattattttagaattcttccttatggttttactaatcccagagccagacaggcaacgcacaccacaagacaaccagctagcctacgtagtgataggattactgttcatgatactaacagtagcggcaaacgagatgggcttacttgaaacaactaagaaagacctaggaataggacacgtagctgttgagaatcatcaccacgcagctatgttagatgttgacttacacccagccagtgcttggacactatacgcagtggcaactacgataataacccctatgatgcgacacactatcgaaaatactacagctaacatatcgctaactgcgatagccaatcaagcagccattttgatgggcttagacaagggttggccaatttcaaaaatggatataggcgttcccctactcgcacttggttgctattcacaagtgaatcccctgaccttaactgcggcggtcctaatgcttgtcgctcactacgcgattataggtccaggcttacaggctaaagcaacaagggaagcccagaagcgtactgcagccggtataatgaaaaatccaacagtcgatggtatagtggcgatagatttagaccctgtagtatacgatgccaagtttgaaaaacaactcggccaaatcatgctcttaatactatgcacgagtcaaatactattaatgagaacaacctgggctctctgcgaatcaattactttagcaactggaccgctaactactttatgggaaggttcaccgggaaaattttggaacaccacgattgctgtatcgatggctaatattttccgaggaagctatttagctggcgctggactggcattttcgttaatgaagagtttaggtggcggaagaagggggactggcgcgcaaggggaaacgctaggcgaaaagtggaaaaggcaactgaatcagttatctaagagcgaattcaatacctataagagatctggcataatggaggtggatcgttcagaagcgaaagaaggtcttaaacggggggaaaccaccaaacatgcagtcagtcggggtacagcaaaactgagatggtttgtggaaaggaatctagtaaagcctgagggtaaagtgatagacctgggttgcggtagaggaggatggtcttactattgtgctggtctaaagaaagtaacggaggtaaagggttatacaaaaggtggccccggccacgaagaaccaattcccatggccacttacggttggaatctcgttaaactccacagtggaaaagatgtttttttcattccccccgagaagtgcgatacacttctatgtgacatcggagagagttcacctaatccaacaattgaagagggacgtaccctaagagtattgaaaatggtcgaaccgtggctaagaggcaaccagttctgcataaaaattctaaatccttatatgccatccgtagttgaaacacttgaacagatgcaacgaaaacatggcggaatgctagtacgaaatccactgtccagaaatagtacacatgagatgtattgggtttcctgtggaaccggaaatatagtttctgccgtaaatatgacgtcaagaatgctgctcaatagatttacaatggcccataggaaacctacgtatgagagagatgtagatttaggggcaggaactcgccacgtagctgtagaacctgaggtcgcaaaccttgatataatcggccaaaggatagagaatattaaacacgaacataaaagcacatggcattacgatgaagataatccctataagacgtgggcgtaccatggatcatatgaggtcaaaccctcagggtcagcctcatcaatggtcaacggcgtagtaaaactattaacgaaaccttgggacgttataccaatggtaacgcaaatcgccatgacggatacaacaccattcggtcaacaaagagtatttaaagaaaaagtagacactagaactcctaaggcaaaacgaggtacagcacaaataatggaagtgacagctaaatggttatggggtttcttaagtagaaataaaaaaccaagaatctgtaccagagaagagttcactcgaaaagttaggagtaacgccgccataggagccgtatttgtcgatgagaaccaatggaacagtgctaaggaagcagtagaagatgaacgtttttgggatctagtacacagagaaagagaattacataaacaagggaagtgcgctacctgtgtttataatatgatgggtaaacgagagaagaaactaggagagttcggaaaagcaaaaggaagtcgtgcgatttggtatatgtggttaggcgcacgttttttggaatttgaagccctaggttttatgaatgaagaccactggttctctcgtgaaaactcgttaagtggggtggaaggtgaaggactacataagctcggctacattttacgtgacattagtaaaatacctggtggcaatatgtatgcagacgacaccgcaggatgggacacaagaataacagaagatgatctacaaaatgaagcacggattacggacattatggaaccagagcatgcccttttagcacgctcaatattcaaactgacataccaaaacaaggtagttcgtgttcagcgcccggcaaagaacggtacggtcatggatgttataagtcgacgagaccaacgagggtccggacaagtaggtacctatggtctaaatactttcacaaatatggaagcacaactgattagacaaatggaatctgagggaatcttttcaccatccgaattagaaacaccaaacttagccgaaagggtgttggattggcttgaaaaatatggcgtagagagactcaaaagaatggccataagtggagatgactgtgttgtgaaaccaatagatgatagatttgcaacagcactaacagccctgaacgatatgggtaaagtacgaaaagatataccacagtgggagccctcgaaaggttggaatgattggcagcaagttcccttttgtagtcaccatttccatcaattgatcatgaaagatggcagagagatagtggtgccctgccgcaatcaagatgaacttgtaggaagggcacgagtgagtcaaggtgcaggatggtcgttgagagaaacagcatgccttgggaaatcatatgctcaaatgtggcaattgatgtacttccataggcgagacttgagactagcagctaatgcaatttgcagtgctgtcccagttgactggattcctacaagtaggacaacatggtctatacacgcccaccatcaatggatgaccacggaagatatgctcagcgtttggaatagagtatggattgaagaaaatccatggatggaagataaaacgcacatatctagctggggagatgtaccttatttaggaaaaagagaagaccaatggtgtgggtcactgataggattaactgcacgagcaacttgggcgacaaacatccaagtagcaattaatcaagtccgacgattaattggaaacgaaaactacctggactatatgacatccatgaaacggtttaaaaatgagtcagaccctgaaggagccttatggtag

SEQ ID NO: 21785 - RNA, 9879 nt, synthetic construct
  misc_feature 1..9879: note = derived and/or modified CDS sequence (opt6) from DENV-1__GU131697__SS-prME
  source 1..9879: mol_type = other RNA
tcagttacaatgttattaatgttaatgcccactgcgttagcctttcatttgactacgcgcggaggtgaaccacacatgatcgttagtaaacaggaacggggtaaatctttgctatttaaaacatcagccggtgtaaacatgtgtacactaatcgccatggaccttggtgaattatgtgaagacaccatgacatacaaatgtccacgtataaccgaagcggaacccgacgatgttgattgttggtgtaacgcaactgatacgtgggttacctacggaacctgctcgcaaacgggtgaacaccggcgggacaaaagaagtgtggcactggcaccacatgtaggactagggttagaaaccagaactgaaacctggatgtcaagtgaaggtgcctggaaacaaattcaacgagtagaaacttgggcgttaagacatccgggcttcacggtaattgcattatttcttgctcatgcaatcgggacatcaataacccaaaaagggataatattcatcttgttaatgttagttacaccgtcaatggccatgagatgcgttggtataggaagtagagacttcgtagaaggactatcaggagcaacctgggtagatgtagtattagaacatggttcgtgcgttacgaccatggcaaaagataaaccaacactagacatagaacttctcaaaactgaagtgacaaatccagcagtattaaggaaattatgtatagaagcaaaaatttcaaacactacgaccgatagcagatgccctacgcaaggagaagctacgctggtagaagaacaagacgcgaactttgtatgtcgaaggacgttcgtcgatagaggatggggaaacggatgcggtctctttgggaaaggctcgttaataacatgtgcaaaattcaaatgcgtgacaaaattggaaggaaaaattgttcagtacgaaaacctaaaatactcagtaatcgtgaccgtccacacaggcgatcaataccaggtcgggaatgaatcgacggagcacgggactaccgcaaccatcaccccacaggcaccaactacagaaatacaactcacagactatggtgctctgacccttgactgctcaccaagaacggggctagacttcaatgaaatggtacttctgactatgaaagagaaaagttggctcgtacataaacagtggtttttagatttaccacttccttggacatcgggagcatcaacatcacaagaaacctggaataaacaagacctcttagtaactttcaagaccgcgcacgcgaagaaacaggaagtcgtagtactgggcagtcaagaaggagctatgcacaccgctctgaccggcgcaaccgaaatacaaacgagtggaaccacaacaatatttgccggacacctaaaatgtaggcttaaaatggataaacttacgttaaaaggaatgagttatgtaatgtgcactggtagctttaaactagagaaagaagtagcggagactcaacatggaactgtattagttcaaattaaatacgagggcacagatgcaccatgtaagatcccttttagtacacaagatgaaaaaggagttacacaaaatggaagactaatcacagcaaatccaattgtgactgacaaggagaaacccgttaacatagaagcagaaccaccgttcggagaaagctacatagtaattggagccggtgaaaaagccctaaagttatcatggttcaaaaagggatcaagtataggtaaaatgtttgaggctactgcccgtggagcaaggagaatggctattttaggggatactgcctgggatttcggttccataggtggcgtctttacgtcagtagggaaactaatacatcagatattcggaactgcttatggtgtattattttcaggtgtatcttggacaatgaaaattggaatcggtgtacttcttacttggcttggtttgaatagtcgctccacatccctgtccatgacatgtatagccgttggcttggtcaccttatacctcggcgtaatggtgcaagcagacagtggatgcgtaatcaactggaagggaagggaattaaaatgtggctctggaattttcgtgaccaacgaagtccacacatggactgaacaatataaatttcaagctgactctccaaagagattatccgcagcaatagggaaggcttgggaggaaggagtctgcgggataaggtctgcaactagattagaaaatattatgtggaaacaaatatccaatgaattaaaccatatccttttggaaaacgatatgaaactaacagtagttgttggcgacgttgccggcatactgggccagggaaagaaaatgataaggccgcaaccaatggagtataaatattcatggaagtcgtggggaaaggcgaaaataataggtgcggatgcccagaacacaactttcataatagatggtccaaatacgcctgagtgtccagatgaccaacgagcttggaacatatgggaggtagaagactatggattcggtatattcacgacaaatatatggttaaagttaagggattcgtacacccaggtgtgtgaccatagacttatgtcggcagcaataaaggattcaaaggctgtacatgctgacatgggctattggatagaaagcgagaaaaatgaaacctggaaacttgcaagggcatcatttatagaagttaaaacatgcatatggcccaagagccacaccttgtggtcaaacggagttttagagagtgaaatgatcatccccaaaatctatgggggtcccatcagtcaacataactatagaccagggtacttcacacagacagcaggaccctggcatttaggtaaactagaattagattttgatctgtgcgaaggaacaactgtcgtagttgacgaacattgtgggaacagaggtccaagtctaaggactactacagtgacaggtaaaattatacacgagtggtgttgtcgatcttgcacgcttcccccactacgctttaggggagaagacggatgttggtatgggatggagataagaccagtaaaagaaaaggaggagaatctcgtgaagtcaatggtctctgctggctccggtgaagtcgatagttttagtttggggctcttgtgcattagcataatgattgaagaagtgatgagatctcgatggtcgagaaaaatgcttatgacaggaacccttgctgtattctttttactcatcatgggacaactaacctggaacgacctaataagactctgtataatggtgggtgcaaatgctttcgacagaatgggaatggggacgacatatctagcccttatggcaacttttaaaatgaggccaatgttcgcagttggccttctgttccgaagactcacctcaagagaagttctactactcacaataggtctctctcttgttgcaagtgttgaactaccaaattcgttagaagaattgggtgacggcctcgcaatgggtataatgatattgaaattattaacagacttccaatcacatcaactctgggccacgttgttatcgttgaccttcattaaaacaacatttagcctacattatgcttggaaaacaatggctatggtactatcgatagtaagtcttttcccgttatgtttgagtacaacaagtcagaaaaccacatggctgccagtattattaggtagcttagggtgtaaaccgcttacaatgtttctaatcgcagagaataaaatctggggccgtaaatcttggcccctcaatgagggcataatggcggtcggtattgtatctatactgctgagttctctacttaaaaatgatgttcctttagcgggccccctaattgcgggtggaatgttgatagcatgttatgtcatatctggcagctcagcagacttatccctggaaaaggcagctgaagtctcatgggaagaagaagcagaacatagcggagctagccataatatattagttgaagttcaagacgacggtacaatgaaaattaaggatgaagaaagagatgatactttaaccatattactgaaagcgacactcttagctgtatcaggcgtatatcctttgagcatacctgctacgttattcgtttggtatttctggcaaaagaagaaacaacgatcaggggtgttgtgggacacaccatctccacccgaggtagaaagggcggtgttagatgacggaatttatagaataatgcaaagaggattactaggaaggagtcaagtcggcgttggagttttccaagagaatgtattccatacaatgtggcacgtcacgcgaggagcggttttgatgtatcaaggtaaacgactcgaaccatcatgggcaagcgtcaaaaaggacctaatttcatatggaggaggctggcgactacgcggatcgtggaacaccggcgaggaagtacaggtcatcgcagttgaaccgggcaaaaatccgaaaaacgtacaaactgcaccaggaacttttaaaacgccagaaggggaagttggagccatagcattagacttcaaaccgggtacaagcggatccccgatagtaaatagggaggggaaaatcgtggggctctatgggaatggagtagttactaccagtggaacatatgtgagtgccatagcacaagcgaaggcttcacaagaaggcccattgccagagattgaagatgaagtattcagaaagaggaaccttacaatcatggacctacaccccggatcaggcaaaacacggaggtatcttcctgctatagtaagagaagctataaaaaggaaactaagaaccctaatactcgcgccaaccagagtagtagcttcagaaatggcagaagctctcaaaggaatgcctattagatatcagacgacggcagtaaaatccgaacacacgggcaaagagatagtagatttaatgtgtcatgcgacctttactatgagactgttgagcccggtacgtgtacctaactataatatgataataatggacgaagctcactttacagacccaagttcgatcgcggccagaggttatatcagcacaagagtaggcatgggagaagcagcagccatcttcatgacagcgacaccaccaggatcagtcgaagcattccctcaaagtaatgccgtgattcaagacgaagaaagagatatcccagaacgttcttggaactccggacatgagtggattacggactttccaggaaaaacagtatggtttgttccatcaataaaatcaggcaatgacattgctaactgtttaaggaaaaatggtaagagagtcatccagttaagcagaaaaacattcgataccgaataccagaagacaaagaacaatgactgggattatgtagtcactactgatatatcagaaatgggggctaactttagagcagatcgagttattgatccaaggcgatgccttaaacccgtaattttaaaggatggaccagaaagagtaattttggcaggcccgatgcccgtgacagtggcaagtgccgcacaaagacgaggacgaataggccgaaatcacaataaagagggcgaccagtacatatatatggggcaaccactaaataacgatgaagaccacgcgcattggacagaggcgaaaatgcttctcgacaacataaatacaccggaaggaataatcccagctttgttcgaacctgaacgcgagaaaagcgccgcggttgacggtgaatacagacttagaggagaagcaagaaaaacgtttgtagaactcatgcggcgaggagacttaccggtttggttaagttataaggttgcatctgaaggatttcagtacagcgatcgacgttggtgcttcgacggggagcgtaacaatcaagtgcttgaagagaacatggacgtggaaatttggacgaaagagggggaaaggaagaaattgaggccaagatggctcgatgctaggacatattcagatcctttagcactacgtgagtttaaagaatttgcagctggtagacgctcagtttcgggggacctcatactagaaattggaaaattaccacaacatctcacgcagagggctcaaaacgcactggataatctcgtaatgcttcacaactcagaacaagggggtagagcctaccgtcacgctatggaagaactgccagacacaatagaaactctaatgttactcgctcttattgccgtcttgacaggtggtgttactttattctttctaagcggacgtggtttgggaaaaacatcaataggtctcctatgcgtaatggcttcgagcgtattactgtggatggcaagtgttgaaccacactggatagccgcgtcaataattttagaatttttccttatggtccttttgatcccagaaccggatcgtcaaagaacaccccaagacaaccagctagcatatgtcgtaattggtcttttatttatgatactaaccgtggccgcgaatgaaatgggactattagaaaccacaaagaaagaccttggaataggacacgtagcagtggagaaccaccaccatgctgcaatgctcgatgtggatttacatcccgcttccgcctggaccctgtatgcagtagcgaccacaataatcactccaatgatgcgtcacacgatagaaaatacaacggctaatatttcattgacagcaattgccaaccaagcagctatattaatgggactagacaaagggtggcctatatcaaaaatggatataggagttccattacttgccttgggatgttattcacaagttaacccattgactcttactgcggctgttttgatgttagtcgctcactatgctataataggccctgggttacaagctaaagctacaagagaagcacaaaaacggaccgctgctggaattatgaaaaatcctactgtggatggcatagtagcaattgatctggatccagtggtctacgatgccaagtttgagaaacaactggggcagataatgctattaatcttatgtacatcccagatattgttaatgagaactacgtgggctctatgtgagagtataactcttgcaactggaccgttgacaactctatgggaaggtagtccagggaaattttggaacactactatagcggtatcgatggcaaatatcttcagaggatcttatctagcgggtgccgggctagcattttcgttgatgaagtcactgggaggagggcgcaggggaacaggagctcaaggagaaacattaggtgaaaaatggaaaaggcaactcaatcaattatccaaaagcgaatttaacacctacaagcgaagtggaataatggaagtagatagatcagaggcgaaagagggacttaaacgaggcgaaacaacaaaacacgccgtgagcagaggtactgccaagttgagatggttcgtcgagcgaaacttagttaaaccggaaggtaaagttatcgacctagggtgcgggagaggaggatggagttattactgtgccgggctaaagaaagtaactgaagttaagggctatactaaaggtggccctggccacgaagaaccaatacccatggcgacatacggctggaatctagtaaaattacactccggaaaagatgtcttctttatacctcctgaaaaatgcgacacgttactttgcgacattggagaaagtagtcctaatcccacgatagaagaagggcgtacattgagagtgctaaaaatggtggaaccttggctcagaggtaatcaattctgtataaaaatattaaacccgtatatgccctctgtagtagaaacattggagcagatgcagagaaaacatggaggaatgctagttagaaatcccctatcacgaaattcaacacatgaaatgtattgggtttcctgtggaacaggcaacatcgtgtcggcagttaatatgaccagtagaatgcttctaaatagattcactatggctcaccggaaacctacatacgaaagagacgttgacttgggaaccggaacacgtcatgtagctgttgaacccgaggtagcgaacctagatataataggccaacgaatcgaaaacataaaacacgaacacaagtcaacttggcattacgatgaagataatccttataagacttgggcttaccatggatcatatgaagtaaaaccatccggcagtgcttcctccatggtgaacggagttgtgaaactattaacgaaaccatgggatgtgataccaatggttacacaaattgcaatgacggatacgactccatttggtcaacaaagagttttcaaggagaaggttgatacaagaacaccgaaagcaaaaagaggtacagctcaaataatggaggttacagcacgatggttatggggatttttatccagaaataaaaagcctaggatatgcacaagagaagagttcacgcgaaaagtaagaagcaatgctgcaataggcgctgtgttcgtagatgaaaaccaatggaactcagccaaggaggctgtagaggacgaacgattttgggatctagtacaccgagaacgagagttacacaaacaaggaaaatgtgccacttgcgtttacaacatgatgggaaaacgagagaagaaattaggcgagttcggcaaggcaaaaggatcacgtgcaatttggtatatgtggcttggcgctagatttctagagttcgaagctctgggctttatgaacgaagaccactggttttcgagggaaaattctctatcaggtgtagaaggagaaggattacacaaactcggatacatattaagagatataagtaaaatcccaggcggtaacatgtacgcagacgataccgctggttgggatactagaattactgaagacgacttacaaaatgaagctaaaattaccgacataatggaacccgaacatgcccttctagctaaagccatatttaaattaacatatcaaaataaagtggttcgcgtacaaaggccagcaaagaacggaaccgttatggatgtcatatcgagaagagatcagagaggtagtggacaagtaggcacttatggactcaacacatttacaaatatggaagcccagctgatacggcagatggaatcggagggtatcttttccccatctgaacttgaaaccccaaatttagccgaaagagcccttgattggttagaaaaatatggcgttgaaagattaaaaaggatggcaatttcaggagatgactgcgtagtgaaacctattgacgacaggtttgcaacagccttaacggcactgaatgacatgggtaaggttagaaaagacataccccagtgggaaccaagtaaggggtggaacgactggcagcaagttcctttttgttctcatcattttcaccagttaataatgaaggatgggagagagatagtagtaccatgtagaaatcaagatgaattagtgggaagggcccgcgtaagccaaggcgcaggatggtctcttcgagaaactgcatgtttaggaaagtcatatgctcagatgtggcagctaatgtacttccacagacgcgatttgagactagctgccaacgcaatttgctctgctgtacctgttgattgggtaccgacatcaagaacgacatggagcattcacgcacatcatcaatggatgactaccgaagacatgttgagtgtatggaaccgtgtatggatagaggagaatccatggatggaagacaaaacgcacatctctagttgggaagatgtgccgtaccttggaaaaagagaggatcaatggtgtggatccctgataggtctcaccgcaagagcgacgtgggctacaaatatccaagtcgccataaaccaagtccgacgactgatagggaatgaaaattatctagattatatgacaagcatgaaaagatttaaaaatgagagtgacccagaaggtgcattatggtag

SEQ ID NO: 21786 - RNA, 9879 nt, synthetic construct
  misc_feature 1..9879: note = derived and/or modified CDS sequence (opt6) from DENV-1__GU131700__SS-prME
  source 1..9879: mol_type = other RNA
tcagttacaatgctcttaatgttaatgcctacggcattagcttttcacctgaccactagaggtggtgaaccgcatatgatagtaagcaaacaagaaaggggtaaaagtctactgttcaaaacgagtgctggagtaaatatgtgtacattgatcgcaatggatctcggagaattttgtgaagacacgatgacttacaaatgtcctcgcataacagaagctgaaccagatgacgttgattgttggtgcaacgcaacggatacctgggtaacatacgggacatgctcccagaccggtgaacacagacgagacaaacgttcagtcgccctagccccacacgttggactcggtctagaaacgaggactgaaacatggatgagcagcgaaggtgcatggaaacaaattcaacgcgtcgagacttgggcattacgacatcctgggttcacagtcatcgcactctttctcgctcatgctatagggacaagcataacccaaaaaggtattatattcatcttgttaatgctagtaactccttctatggccatgagatgtgttggcattgggagcagagattttgtggaaggtttgagcggagctacatgggtagatgtcgtcttggaacacggttcttgcgtgactacaatggcaaaagataaacccactcttgacattgaacttctaaaaactgaagtgactaatccggcggtattgcggaaactctgtattgaagccaaaatcagtaacacaacaactgattctcgatgtcccactcaaggagaagctacactggtagaagaacaagatgccaatttcgtatgtcgcagaactttcgtggacagaggatggggaaacggctgtggtttatttggaaaagggtcgttaatcacatgtgccaaattcaaatgtgtaaccaaattagaaggaaagacagtacaatatgaaaatctcaaatactccgtaattgtcactgtacacaccggagaccaacatcaagtcggtaacgaaagcacagaacacggaacaacagcgacgatcacacctcaggcaccgtcaaccgagatacagctaaccgattacggggcccttaccttggactgtagcccacgaactggattagacttcaacgaaatggtattattaacaatgaaagagaaaagttggctagtacacaagcaatggtttttagatttacctctaccgtggacatcaggggcgtccacatcgcaagagacctggaaccgaaaagacttattagtgacatttaaaactgcacatgccaagaaacaagaagtagtagtgctgggatcacaagagggcgccatgcataccgctttaacaggagcaacggaaattcaaacgtcaggaacaactacaatctttgcaggccatctaaagtgtagactaaaaatggataaactaactctcaaaggaatgtcttatgtcatgtgtaccggatcatttaaactagaaaaagaggtcgcagaaacgcaacacgggaccgtactcgttcaaataaaatatgaggggacagacgcaccttgtaagattccgttcagtacacaagacgaaaagggagtcacacaaaacggcagactcatcaccgcaaatccaattgttaccgataaagagaaaccggtaaatatagaagcagagccaccattcggtgaaagttacatagtaataggagcaggcgaaaaagctctcaaattaagctggtttaaaaagggctcaagtatcggtaaaatgtttgaggccacagcaagaggggctcgtagaatggctatattaggagatacggcttgggacttcgggtctataggtggggtatttacctctgtaggcaaattagttcaccagatttttggtacagcgtatggagtattattttccggagtcagctggacgatgaaaataggcattggtgttttattaacgtggctaggactaaattcaagatcaactagcttatcgatgacctgtattgcagtcggattagtgactttatatctaggagttatggttcaagctgactcaggttgcgtaataaactggaaaggtagggaattaaaatgcggatcgggaatattcgttactaatgaagtacatacatggactgagcaatataagtttcaggccgatagtccaaaaaggctcagtgcagcgataggcaaggcttgggaagaaggtgtatgcggtattagaagcgcaacaaggctcgaaaacataatgtggaaacaaattagtaatgaacttaatcacatcttattagaaaacgatatgaaatttactgtagtagtaggtgacgtagcaggaatcttagcgcagggaaagaaaatgattcgcccccaaccgatggaatataaatacagttggaaatcgtggggcaaagcgaaaatcataggtgcagacgtacaaaatacaacatttataatagacggtccgaacacaccggaatgtccagacgaccaaagagcatggaacatttgggaagttgaagattatggttttggcatattcaccacaaatatatggcttaaactacgtgattcacacacccaagtctgtgatcatagacttatgagtgcagcgatcaaagattccaaagcggtacacgctgatatgggttattggatagaatcggagaaaaatgaaacgtggaaactggcaagagcatcatttattgaggtaaaaacgtgtatttggccaaaaagtcatacgctttggtcaaatggcgtactcgaatctgaaatgatcataccgaaaatctatgggggtccgatcagtcaacataattacaggcccggttactttacccagactgccggtccttggcatttaggtaaacttgagttggacttcgacttatgtgaagggacaactgttgtagtggatgaacattgcggaaacaggggtccgtcacttagaacaaccaccgtgacaggaaaaattatccatgaatggtgttgcaggtcgtgtaccttaccacctttacgattcaagggcgaagatggctgttggtacggtatggaaatccgacctgtaaaggaaaaagaagaaaacttggttaaaagtatggtttcagcaggttctggagaagtagactctttttcactaggactactatgcatttctatcatgatagaagaagtaatgcgatccaggtggtcaagaaaaatgttaatgacaggaactctggcagtatttttcttactaattatgggtcaacttacatggaacgatcttatacgtttgtgtataatggtaggagctaatgcaagtgatcggatgggaatgggtacaacttatctagcactaatggccacattcaaaatgcgaccgatgtttgccgtgggattactatttagacgactaacctcaagagaagttctgttattaacaattggcttgtccttagtagcctcagtagaattacccaacagtttagaagaactcggtgatggattagcaatgggtatcatgatacttaaattattaacagacttccagagtcaccaattatgggcaacgttattaagtctaacgtttataaaaacaactttctcacttcattatgcttggaagacaatggcgatggtattaagcatagtaagtttgttcccattatgtttgtcaactacttcccagaaaacaacatggcttcctgttttattaggatcactgggctgcaaacctttaacgatgtttctaatcgcggaaaataagatctggggacgtaagagttggccactcaatgaaggaataatggccgtgggaatcgtttcgatcttactatcatcgcttctaaagaacgacgtgccattagctggaccattaatagcaggaggaatgttaatcgcttgttatgtgattagtggttctagcgccgacttatctctagaaaaagcagcagaagtaagctgggaagaagaagccgagcatagtggagctagccacaatatattagtagaggtacaagatgacggaactatgaaaataaaagatgaggaacgtgatgacactttaacgattttattaaaagctacgcttttaacagtatcaggagtatatcccctatctattccagccacactatttgtttggtacttctggcagaagaagaaacaaagaagcggagtactatgggacaccccatcacctccaaaagtagaaagagcggttcttgacgacggcatatataggattatgcagcggggcttattgggaaggtctcaagtaggcgttggcgtattccaagaaaatgtcttccacactatgtggcacgtcacaagaggagccgtcttaatgtatcaaggcaaaagattagagccttcgtgggctagtgttaagaaagatttgatttcatacggaggtgggtggcgcttacaaggttcctggaatacgggagaagaagtgcaagtaattgctgttgaacccgggaagaacccgaaaaacgtacaaactgccccaggtactttcaagacaagtgaaggtgaggttggagcgatcgcactggatttcaaacctggcacatcggggtcccctatcgtgaatcgggaaggaaagattgttggactttacggtaacggtgtggtgactacaagtggaacatatgtctctgcaatagcccaagcaaaagcctctcaagaaggtcctttgcccgaaatagaagacgaggtgttcagaaaaagaaatttaacaattatggacctccaccccggttctggcaaaacacgaagataccttcctgcgatagtacgggaggcaataaagcgaaagttaagaacattaatactggcaccgacccgcgtagttgcatctgaaatggcagaagcactaaaagggatgcctattcggtaccaaactacggcagtaaagagcgagcatacaggcaaggagatcgtagacctgatgtgccacgccacgttcactatgcgtttactaagtccggtacgcgtccccaattacaatatgataatcatggatgaagctcattttacggatccgtcatcaatagcagcgcgagggtatatcagtacgcgggtaggaatgggtgaagcagctgctatttttatgactgctacgccgccaggatcagtagaggcattcccccaatcgaatgcagttatccaagatgaggagcgtgatatacccgaacggtcgtggaactcaggatatgaatggatcacggatttcccaggtaaaacagtatggttcgttccgagtataaagtcgggtaatgatattgctaactgtctacggaaaaatggaaaaagagtaattcaattgtctaggaaaactttcgacacggaatatcagaaaacgaaaaacaatgattgggattacgtcgtaactacggatattagtgagatgggtgctaatttcagagcagatagagtcatagaccccaggagatgcctgaaaccagttatattgaaggacggcccagaaagagttatacttgccggtccaatgcctgtaactgtggcatctgcggcgcaaagaagaggacgaatcggccgaaatcataataaagaaggagatcaatatatttatatggggcaaccgttaaataatgatgaagaccatgcgcattggacagaagccaagatgctgcttgacaatataaatacccccgaaggtataattccagccctttttgaaccggaaagagaaaaatctgctgctatagatggagaatatagactgcgcggcgaggctagaaagacctttgtggaactaatgagaagaggagatctaccagtatggctaagctacaaggtagcatcagaaggctttcagtactcagacaggagatggtgttttgatggggagagaaataaccaagttctagaggaaaacatggacgttgaaatatggacgaaggaaggtgaacgcaaaaagctacgtccaagatggttagatgcaaggacatattctgacccactcgcacttcgtgaatttaaagagtttgcagcaggtcgtagaagcgtgtccggtgatttaattttagaaatcgggaaacttccacagcacctgacacaaagagctcaaaacgctcttgacaatctcgtcatgctacataattcagagcaaggtggacgggcatatcgccatgcaatggaagaattacccgatacgatagaaacaatgatgctccttgcactaatagcggttcttacgggcggagtaacattattctttctaagtgggagaggtctaggtaaaacttcgatcggactcctatgcgtgatggcatcatccgtattactatggatggcatcagtagaaccccattggattgcagcctcaattattttagagttctttcttatggtcctgctcatacctgaaccagatcgacaacggacgccgcaggataatcaactggcttacgtcgttattggattattatttatgatattaacagttgcagctaacgaaatgggattactagaaaccacaaagaaggacctgggcatagggcacgtagcagttgaaaatcatcaccatgcagctatgcttgatgtagaccttcatcccgcctccgcatggactctatatgctgtcgctactacaataataacgcctatgatgcgtcacacgatagaaaacacgacagcaaacataagccttactgctattgcaaatcaagccgccattttgatgggtctagataaaggatggcccattagcaaaatggatataggagtacctttactggcgttggggtgttattctcaggtgaaccctcttacgctaacggcggcagtgttaatgctagtagctcactacgccattataggaccaggattacaagcgaaagccacgcgcgaagcacagaaacggaccgcagcgggaataatgaaaaacccaactgtggatggaatagtagctatagacctagaccctgttgtatatgatgctaagtttgaaaagcagcttgggcaaatcatgcttctcattctctgcacaagtcaaatactgctaatgagaacaacatgggctttatgtgaaagtattacattagcgacaggtcctctcacaacactttgggagggtagtccagggaaattctggaatactacaatcgcagtaagtatggcaaatatctttagaggatcatatcttgctggtgcaggcttagcattttcgttgatgaaatccctaggcggtggcaggagaggtacaggagctcaaggagaaacactaggtgaaaaatggaaaagacaattaaatcaattaagcaagtccgagtttaatacttataagagaagtggaatcatggaggttgaccgaagtgaagcaaaagaaggattaaagagaggggaaaccaccaaacacgcggtttctagaggcactgcgaaattgcgatggttcgttgaaaggaacttagttaaaccagagggaaaagttattgatctgggatgcggaagaggtggatggtcatactattgtgctggactgaagaaagtcacagaagttaaaggatataccaaaggaggccccggacacgaagaaccgattccaatggcaacgtatggatggaacctggttaaacttcatagcggcaaagacgtgttctttatacctccagaaaagtgtgatactttactttgtgatattggagaatcctcacctaatccgaccatagaagaaggaagaaccctacgagtcttgaaaatggtagaaccgtggctaaggggaaatcaattctgtataaaaatacttaacccatacatgccgagcgttgtagaaactctggagcaaatgcagcgtaagcatgggggaatgctagtacgtaaccccttatcacggaatagcacccacgaaatgtattgggtaagttgtggtacgggaaatattgtaagtgcagttaatatgacttcaagaatgttactcaatagatttacaatggcgcacagaaaacccacgtatgagcgcgatgttgatctcggtgcaggaactagacacgtcgcagttgaaccagaagtagctaacttagacataataggacaaaggatagaaaacatcaagcatgaacacaaaagtacttggcattatgatgaagacaatccctataaaacatgggcatatcatgggagctatgaagtaaaaccttctggttccgctagctcaatggtgaatggggtagttaaactacttacgaagccttgggacgttatcccaatggtaacccaaattgcgatgacggatacgactccatttgggcaacaaagagtctttaaagaaaaagtagacacaagaacccctaaagcaaaacgtggaaccgctcaaataatggaagtaactgccaagtggttatggggatttctatcacgcaacaagaaacctcgaatatgtactcgtgaagaatttaccaggaaggtacgttctaacgctgcaataggcgctgtatttgtcgatgaaaatcaatggaacagtgcgaaggaagccgtcgaagacgaacgattttgggatttggtgcatagggaaagagagcttcataagcaggggaaatgtgcaacctgcgtgtataacatgatgggcaagagggagaagaaattgggagaatttgggaaagcaaaaggctcgcgagccatatggtacatgtggttgggcgctcgtttcttggaatttgaagctcttggattcatgaacgaagatcactggttttcccgagagaactccctatcaggtgtagaaggtgaaggactgcataaacttggctatatattaagagacatctcaaaaatcccagggggaaacatgtacgcggatgatacagctggatgggatactagaatcaccgaagacgacttacaaaatgaagcaaagataacggatatcatggagcccgaacacgctctgctcgcgaagagtatttttaaactaacttaccaaaataaggttgtacgtgttcaaagaccagccaagaacggaactgtcatggacgtgatctcacgaagagatcagcgtggaagcgggcaagttgggacttatggactcaatacatttactaatatggaagcccaattaattagacagatggaatctgagggtatatttagtccctctgagctcgaaacccccaatttggcacgcagagtattagactggctagaaaaacatggcgtcgaaagattgaaaaggatggcaatctctggcgatgattgcgtagtcaagccaatcgatgatagatttgcaaccgctttgacagcattgaacgatatggggaaagttaggaaggacataccacaatgggaacccagcaaaggatggaacgactggcaacaagtaccgttctgtagtcatcattttcaccaattaatcatgaaagatggaagggaaattgtagtcccgtgtcgcaatcaagacgaattggtgggcagagcgcgagtttcacaaggagcagggtggtctcttcgagaaactgcttgtctgggaaaatcatatgcccaaatgtggcagctcatgtatttccatagaagagatttacgtcttgctgcaaacgcgatatgtagtgcagtcccggttgactgggttccaacatcaagaacgacgtggtccatacatgcacaccatcaatggatgacaactgaagatatgttaagtgtctggaaccgggtatggatagaagaaaatccttggatggaagacaagactcatatatcatcctggggtgacgtcccttatttgggaaaaagagaggatcaatggtgcgggtctcttattggcttgacggccagagctacttgggccacaaatattcaggtagcgataaatcaagtacggaggttgattggcaatgaaaactatctagactacatgacatctatgaaacgtttcaaaaacgaatcagatccagaaggtgcattatggtaa

SEQ ID NO: 21787 - RNA, 9879 nt, synthetic construct
  misc_feature 1..9879: note = derived and/or modified CDS sequence (opt6) from DENV-1__GU131701__SS-prME
  source 1..9879: mol_type = other RNA
agtgtcactatgttattgatgttaatgccaactgcattagcgtttcatttaacaactcgaggcggagaacctcacatgatagtctccaaacaagagaggggcaaatctttactttttaaaacaagtgctggagttaacatgtgcacgttaatagcgatggaccttggagaactttgcgaagataccatgacctataaatgcccacgtataacagaaacagaaccggacgatgtggactgctggtgtaatgctaccgacacttgggtaacatacggcacatgtagtcaaacgggtgaacacaggagagacaagcgttctgttgctttagcaccacatgtgggattagggctagaaaccagaaccgagacgtggatgtctagtgaaggagcctggaagcaaatccaaagagtagaaacctgggctcttagacatcccggttttactgtaactgctctttttctagcacatgtaataggaacgtctataactcaaaaagggataatatttatcttactaatgctagtaacgcccagtatggctatgaggtgtgttggaataggatcaagggattttgtcgagggtctatctggggctacatgggtagacgtggtgttagagcatggatcttgcgtaacaacaatggcaaaagacaaacctacgctcgatatagaattattgaaaacagaagtcacgaatccggctgtactacgaaaattgtgtatcgaagccaaaatttctaataccaccaccgattcgagatgtcctactcaaggggaggccacattagtggaagaacaagatgcaaattttgtttgccgaagaacttttgttgatcgtggatggggcaatggttgtggcctttttggtaaaggatctctcataacctgtgcaaaattcaaatgtgtaactaaattggaaggtaaaatcgttcaatatgaaaacctaaagtactctgttatcgtcacagtacatacgggggaccaacatcaagttggtaacgaaagtacagagcatggaaccacagcaacaataacaccacaagcccctacaacagaaatacaattaaccgactatggagctttaacccttgattgctctccacgaacaggtttagacttcaatgagatggtactccttacaatgaaagagaaaagctggcttgtacataagcaatggtttttagacttaccactgccatggacatcaggagcatcaacaagtcaagaaacgtggaaccgtcaagatctgctggttacatttaaaactgcgcacgccaagaaacaagaagtggttgtactaggttctcaggaaggtgcaatgcacactgcactgactggcgcaacggaaatccaaacaagtggaacgactactatatttgcaggacacttaaaatgtcgcttaaagatggataaactaacattaaagggcatgtcatacgtcatgtgcaccggttcctttaaactagaaaaagaggttgcagagacccaacatggaacagtacttgtacaaataaaatacgaaggaacggacgcaccttgtaaaatccctttttccacacaggatgaaaaaggagttactcaaaacggacgtcttataactgctaaccctacagtaacagacaaagaaaaaccagttaatatagaagctgaaccaccatttggtgaatcttacataataataggagctggagaaaaggcattgaaactaagctggtttaaaaaggggagttcaattggaaaaatgtttgaagcaacagcgagaggcgcaaggcgtatggcaattcttggggatacagcttgggattttgggagcatagggggcgttttcacaagcgtgggaaagttagttcaccaaatattcgggacagcatacggcgtactattctcaggagttagctggacgatgaaaattgggataggggtcttattaacgtggttaggactgaactcacgctccacatcattatcaatgacatgtatagcggtagggcttgtgactttatacttgggagtaatggtccaggctgattccggatgcgttataaattggaagggcagagaattaaagtgtggcagcggtatatttgttactaatgaagtacatacttggacggaacagtataaatttcaagccgattctcccaaacgtctaagcgctgccataggaaaagcctgggaagagggtgtatgtgggattcgtagcgctactcgactagagaatataatgtggaaacaaatatcaaacgagctcaaccatatcctattggagaatgatatgaagttcacggtcgttgttggagatgtcgcgggtatactagcccaaggcaagaagatgattagaccgcaacctatggagtacaaatactcctggaaaagttggggcaaggcaaaaataattggagctgacgtacaaaacacaacttttataattgacggaccaaatacaccggagtgtccagatgatcaaagagcttggaatatttgggaagtagaagattatggttttggaatttttactactaacatatggttaaaattaagagattcatacactcaggtctgcgaccataggctaatgtcggcagccataaaagatagtaaagcagtacacgccgatatgggctattggatcgaaagtgagaaaaatgaaacatggaaactggcgcgagcgtcgtttattgaagtaaaaacctgcatttggccaaaatcacatactctatggagtaacggtgtgttagagtctgaaatgatcatcccaaaaatttacggagggccgatttcccaacacaatcatcgcccaggttattttactcaaacagcaggcccatggcacttgggcaaactggagttagacttcgatctttgcgaagggactacagtagtagtcgacgaacattgtggtaatagaggaccttctttaagaaccaccacagttacaggtaagattattcacgaatggtgttgtcggagttgtactcttcctccactaaggttcagaggagaggatggctgctggtacggcatggagataagaccagttaaggaaaaggaagaaaatctagttaaatcaatggtttcagcgggaagtggtgaggtagattcattctctctgggcttgctatgtattagtataatgatagaagaagttatgcgatcccgatggtcaagaaagatgctaatgacaggcactctcgcagtcttcttcttattaattatggggcaattaacttggaacgacctaattagactatgtataatggtcggcgctaatgcatccgaccgcatgggtatgggtaccacatacctagccctgatggctacttttaagatgagaccaatgtttgccgttggactattatttcgtcgattaacatcccgtgaagtcttattgttgacgatcggattatctcttgtggcatctgtggaactaccaaactcattagaggagttgggggatggattagcaatgggaattatgatactaaaattactaacagatttccagcctcatcaattatgggcaaccttgctcagcttgacctttataaagacaacttttagtttacattatgcttggaaaaccatggccatggttctaagcatagtctccttatttccgctctgtttatccacaacttcccagaaaacaacatggttaccggttttattgggatccttgggatgtaagccattaaccatgtttctaatagcagaaaacaaaatatggggcagaagatcttggcccctaaatgagggaatcatggcggttggaatcgtatcaatactattgtcatcattgcttaaaaatgatgtccctttagctggcccattaatcgctggaggaatgctcattgcatgctacgttattagcggctcgagcgcggatttatcacttgagaaagcagcggaagtatcctgggaagaggaagcggaacattcaggagcgtctcacaacatattagtagaagtacaggatgatggaactatgaagataaaggacgaggagagagacgatactctaacaatactactaaaggcaacccttctcgcggtatctggtgtatatccattatcaatcccggcgaccctgtttgtgtggtacttctggcagaagaagaaacagagaagcggagtattatgggacacaccatcgcccccagaggtagaacgagctgtactcgatgatggtatatatagaattatgcaaagggggttactgggtagaagccaagtaggcgttggagttttccaagagaacgttttccatacaatgtggcacgtaacaagaggagcggtacttatgtaccaggggaaaaggctagaacctagctgggcaagcgtgaagaaagatctaatatcatacggaggtgggtggcgcttacaagggtcatggaatacaggcgaagaagtccaagtgatagcagtagaacccggtaaaaaccctaaaaatgtccaaactgcgccaggtaccttcaaaacaccagaaggggaggtaggcgcaatagcgttagattttaagccaggcacctctggttcacctatcgtaaatcgagagggaaaaatagtagggttatatgggaatggtgtagtgacgacaagcggcacatatgttagtgctatagcgcaagcaaaagcatcacaagagggacccctcccagaaatagaagatgaagtatttagaaaaaggaacctaacgataatggatctacacccaggtagtggcaagacacgacgatacttaccagcaattgtaagagaagcaatcaaacggaaacttagaacactaatcttggcacctacaagagtagtagcaagtgaaatggcagaagccttaaaaggaatgcctattcgataccaaacaaccgcggtaaaatccgaacataccggaaaagaaatagtagatcttatgtgccatgccacatttacaatgcggttgttaagcccagttcgagttcctaactataacatgataattatggatgaagctcattttacggatccatcatccatcgctgcaagagggtacattagcacaagggttggaatgggggaagctgctgcaatatttatgactgccacaccgcctggaagcgtagaagcatttccacaatctaacgctgtaatacaagatgaagagagggacatcccagaacgatcatggaacagtggctatgaatggataacagactttccaggtaaaaccgtctggtttgtaccatccattaaaagtggtaatgatatagcgaactgtttgagaaagaatggtaaacgagtgatacaactctccagaaagacctttgatacggaatatcagaaaaccaaaaacaatgactgggattacgtagtaactactgatatttctgagatgggagctaattttagagccgacagagtaatagatccaagacgatgtcttaaaccagtaatcttaaaagatggaccggagcgcgtaattctagcaggaccaatgcccgtaacagtagcaagcgccgcacaaagaagaggacggataggacgtaatcacaataaggagggtgatcaatatatatatatgggacagccactcaataatgacgaagaccacgcgcattggaccgaagctaagatgttattagacaacatcaatacacccgaaggaattattccagcattatttgagccggaacgcgagaaaagtgcggcaatagatggagaatatcgattacgaggagaggcgcggaaaaccttcgtagagttgatgaggagaggtgacctgccggtttggctttcatataaggtagcatcagaaggatttcaatactcggatagacgctggtgtttcgacggagaaaggaataatcaagtgctagaagaaaacatggatgttgaaatatggacaaaagaaggcgaacgtaagaaattacgtcctagatggctggacgcgagaacctattctgatccgttggcactcagagagtttaaagagtttgcagcggggagaagatcagttagtggagatttaatactagaaatcgggaaactaccacagcacttgacccaacgtgctcaaaacgccctagataatttagtaatgttacataattcggaacaaggagggagagcatacagacatgcgatggaagagttaccagacacgatcgaaacactaatgctactcgcgctgatagccgtccttaccggcggtgtaactctatttttccttagcggacgaggtcttggaaagacttccattggactattatgcgtaatggcatcatctgtccttctctggatggcaagcgtagaacctcattggatagcagcctcaataatattagagttctttctaatggttctacttatcccagaaccggacaggcagaggacgcctcaagacaatcaactagcttatgtagtaattgggctactttttatgattttaacggtagcagctaacgaaatggggctactagagacgactaagaaagacttgggcatcggacatgtggcagtcgaaaatcaccaccatgccgcaatgttagatgtagatcttcatccagcctctgcctggacactatatgcagttgcgacaacgattattacaccgatgatgcgacacacgatcgaaaacacgacagcaaatatatcgttaacagctatagctaaccaggcagcaattctaatgggattagacaaaggttggcccatcagcaaaatggatattggggtaccattgttagccctaggctgttatagccaagttaacccgctaaccctgactgcggccgttttaatgttagtagcgcattacgccataataggacccggtcttcaagccaaagcaacacgagaagcccaaaagagaacagcagctggtatcatgaaaaatcctaccgtagacggtatcgtagctattgatttagatccagtcgtctatgatgctaagttcgaaaaacaattagggcaaattatgctactgatattatgtacatcccagatcctactgatgcgaactacctgggcactgtgcgaatcaataaccctagcaacaggtccactcacaactttatgggaaggatcacctggaaaattctggaacacaaccatagcggtaagtatggccaacatattcaggggatcataccttgctggagccggattggcttttagtctaatgaagtcattaggaggaggaagacgtgggaccggagcacaaggagaaacactaggggaaaagtggaaaagacaattaaatcaattaagcaaatcagaatttaatacttataaacgaagtggaataatggaggtagacagatccgaagctaaagaaggtttgaagagaggtgaaacaacgaagcatgccgtatctcgtggaacagcaaaactccgatggtttgtagaaaggaatttggtaaaacccgagggaaaagtgatagatctaggatgcggtagaggcgggtggtcatactactgtgcagggttaaagaaagtgacagaggtgaaagggtatactaaaggtggaccaggacatgaagaacctataccgatggcaacctacggttggaatctggtgaaactgcactcagggaaagacgcattctttattccaccagagaaatgtgacacgttactgtgtgacataggagaatcaagcccgaatcccacaatcgaggagggccgaacattacgagttcttaagatggttgaaccctggcttcgtggaaatcaattttgtattaaaattcttaatccatacatgccatctgtagtggaaaccttagagcagatgcaacgtaaacatggcggaatgttagttagaaatccgctcagccggaactcgacgcatgaaatgtattgggtcagttgtgggacaggcaatattgtatcagcgatcaacatgacatcccgcatgctgttaaatcgatttacaatggcacaccgcaaacctacctatgaaagggatgtagatctgggggctggaacaaggcacgttgcagtagaaccagaagtagccaatctagatataataggtcaaagaatagaaaatataaagcacgagcataaaagtacatggcactatgacgaggataatccatacaaaacatgggcttatcacggatcatatgaagtcaagccctcaggtagtgcaagctcaatggtcaacggagtggtaaaattgctaactaagccatgggacgttatccctatggtgacacagatagcaatgacagacacgacgccattcgggcaacaaagagtatttaaagaaaaagtagatactagaacaccaaaagccaaaagaggtacggcacaaataatggaagtaacagcaaaatggctatggggttttctaagtaggaataagaaaccgagaatttgcactcgggaagagtttactagaaaggtcagatctaatgcggcaataggcgccgttttcgtagacgaaaaccaatggaactcagctaaagaggcagttgaggatgaaagattctgggacttagtacacagagaaagggaactccataaacaaggaaaatgcgcaacgtgtgtttacaatatgatgggaaaacgggagaagaaattaggagagttcggtaaagccaaaggttcacgagcaatctggtacatgtggctaggagcacgatttctggaatttgaagcgcttggttttatgaatgaagatcactggttttcgcgtgaaaatagtttaagcggcgtagagggtgagggtttacataggttaggctacattttacgcgacattagtaaaataccaggaggcaatatgtacgcggatgacactgcggggtgggatacacgtattactgaagacgacctacaaaacgaggctcgaataactgacataatggagccagagcacgccttactcgcaaaatcaattttcaaactaacataccaaaataaagtagtaagagtgcaaagaccagggaagaatggaacagtcatggacgtaattagccgaagagaccagaggggttccggacaagtaggcacctatggacttaatacttttactaacatggaagctcaattaatccgacagatggaatcagagggtatattttcgccaagcgaattagaaacgccaaacttagccgaacgggtattagactggcttgaaaaatatggagtagagagacttaaaagaatggccatatccggtgatgattgtgtagtgaaacccattgatgatcgattcgcaaccgctctgaccgcactcaacgacatgggcaaagtacggaaagatataccgcagtgggaaccgtcaaaaggatggaacgactggcaacaggtgccattctgctcccaccattttcaccaattaataatgaaggacggacgtgagattgtcgtcccatgcagaaatcaagacgaactcgtgggtagggctcgggtttcgcaaggtgccggttggtcattaagggagacagcctgtttgggcaaatcttacgcccaaatgtggcaattgatgtattttcatcgtagagatctgagattagctgcaaacgctatatgctctgctgtccctgtagattggatcccaacatctcggacaacttggtccatacatgcccatcaccagtggatgactaccgaagacatgttatctgtctggaatagagtatggatagaagagaatccctggatggaagacaaaacgcatataagttcatggggagatgtaccttatctggggaagcgcgaagatcagtggtgtggatcattaattggcctaaccgcccgagctacctgggccacaaatatccaagtggcaatcaatcaagtgagaaggctgattgggaatgaaaattacctagactacatgacaagcatgaaacgctttaaaaatgaaagcgatcccgagggagcattatggtaa

SEQ ID NO: 21788 - RNA, 9879 nt, synthetic construct
  misc_feature 1..9879: note = derived and/or modified CDS sequence (opt6) from DENV-1__GU131703__SS-prME
  source 1..9879: mol_type = other RNA
tctgtaacgatgctgttaatgttaatgccgacagcactggcctttcacttaacaacgagaggcggggaaccacatatgattgtctcaaaacaagaaagggggaaatcgttactttttaaaactagcgccggagttaatatgtgtactctaatcgccatggatctaggtgaactgtgcgaagatacaatgacatataaatgcccgcgcataacggaaactgaacctgatgatgttgattgctggtgtaatgcaactgacacgtgggtaacttatggaacatgcagccaaacaggcgaacacagaagagataaaagaagtgtcgcactcgcgccccatgtcggcttagggttagaaactcgtacggaaacctggatgagctcagaaggtgcttggaaacaaatacaacgagtggaaacctgggctttacgtcatccgggatttacggtcatcgccctatttctagcacacgcaattggtacaagtataacacaaaaaggaataatatttatactattaatgttagttactccatctatggcaatgcgctgtgtcgggatcggatcgagggactttgttgaagggttatctggtgcaacttgggtagatgttgtactagagcatggttcgtgtgtcacaaccatggcaaaagataaaccgacattagacattgagttattaaaaactgaagttactaatcctgcaatcctaagaaaattatgcatcgaagcaaaaatctcgaatacgacaacagatagtcgctgcccaactcaaggtgaggctactcttgttgaagaacaagacgctaatttcgtttgcagacgtacttttgtagacagaggatggggaaatggatgtggtctattcggcaaaggttcgttgatcacttgtgcaaaatttaaatgcgttacaaaacttgaaggaaaaatagttcagtatgaaaaccttaaatactcagtgatcgtaacggttcataccggtgaccaacaccaagttgggaacgagtcaacagagcatggaaccactgcaactataacaccacaagcacccacgactgaaatacagctgacagattatggagcgcttactctcgattgttcgcctagaacaggtttagattttaacgaaatggtattgttaaccatgaaagaaaaatcgtggctcgtccataaacaatggtttctagatttgcctctgccttggacgtcaggagcgtctacatcacaggaaacttggaaccgccaagacctattagtgacatttaaaacagcacatgccaagaaacaagaggtagtagtactaggaagccaagaaggagctatgcacaccgctttgaccggagcaactgaaattcaaacaagcgggacgaccactattttcgctgggcacctaaaatgccgattaaaaatggacaaactaactctgaaaggaatgagttatgtaatgtgcacgggatcctttaaattagaaaaagaagtagcagaaacacagcacgggactgttttagtgcaaatcaagtatgaaggaacggatgcaccctgcaagataccgttctcaacgcaagacgaaaaaggagtaacccaaaatggacggctgattacggcaaaccccatagttacggataaagaaaaaccagttaatatagaagcagagccaccattcggagaatcctatattgtaataggtgcaggggaaaaggcattgaaactgtcctggtttaagaaaggatcttcgatcggtaagatgtttgaagctactgctcgtggagcaaggagaatggcgatactgggtgatacggcatgggatttcgggagtatcggaggtgtttttacatcagttggcaagctcgtacaccagatattcggcacagcttacggcgtactattttccggagtctcatggacaatgaaaataggcataggcgtactgttaacatggttgggattgaatagtcgaagcacaagtctctcaatgacttgcatcgctgtaggattggtgactctctacctgggagtaatggtacaggccgattcgggatgcgtaatcaactggaaaggaagggaacttaaatgtggttcgggaatctttgtcaccaatgaagtacatacatggacagaacagtataaatttcaagctgatagtcccaaaagactatctgccgccataggaaaggcatgggaagaaggcgtatgtggtataagatcagccactcgtcttgaaaatataatgtggaagcaaatttccaatgaactaaatcatatcttacttgaaaatgatatgaaattcacggtagtagtaggagatgtagcaggcattctggcacaaggtaagaaaatgattagacctcaaccaatggaatataagtattcatggaagagttggggtaaagcaaaaataattggagccgacgttcaaaacaccacatttataatagatggtcctaatactccagaatgtcccgatgaccaaagagcctggaatatctgggaagtcgaggattatggttttggaatctttactacaaatatatggctcaaacttcgagactcttacacacaggtttgtgatcacagattaatgtctgcggcaatcaaagatagtaaagctgtacacgcggacatgggttattggattgaatccgagaaaaacgaaacttggaaactagcgcgagcaagttttattgaagtaaaaacatgtatttggccgaaaagtcatacattatggagtaacggagtactggagtcagaaatgattataccaaagatatatggaggcccaatatcgcaacacaattatcggcccgggtattttacacagacagcaggtccttggcacctcggaaagctagaattagatttcgatctgtgtgaaggcactacagtagtggtagatgaacactgtggcaaccgcggtcctagccttagaacaacaacggtcaccggtaagataatacacgagtggtgctgcagatcttgcaccttacctcccctaaggttcagaggagaagatggatgttggtatgggatggaaatcaggccagtcaaggaaaaggaagaaaatctagtaaaaagcatggtatctgctggttcaggagaagttgattccttttcattgggattattatgtatttcaataatgatagaagaagtaatgagatcacgttggagcagaaaaatgctaatgactggcacattagcagtgtttctcctacttataatgggccaattaacatggaatgatttaatcagactgtgtattatggtgggagcgaatgccagtgatcgaatgggcatgggaacgacttatcttgcccttatggcaacatttaaaatgcgacccatgtttgcagtaggacttctatttcggcgtctgacaagcagggaagtgctattacttacgataggtttatctttggtagcaagtgtggaattgccaaattctttagaagagttaggagacggtttggccatgggaatcatgatactaaaacttctcacagattttcaaagtcatcagctctgggcaactcttctttctttgacctttataaagaccacttttagcctccactatgcatggaagacaatggcgatggtgctatcaatagttagtctttttcccctttgcctgagcacaactagccagaaaactacatggctgcctgtattattaggatccttaggatgtaaacctttaaccatgtttcttatcgctgaaaataaaatatggggacgaaggtcatggccattaaacgaaggtataatggccgtcggcatagtatcaatacttttatcatcattgctcaaaaacgatgttccattagcaggtcccttaattgccgggggcatgctcatagcctgctacgtcatcagtggtagttcggcagacttatccctcgagaaagcagcagaagtctcatgggaagaggaagcagaacactcgggtgcaagtcataacattctagtagaagtacaagatgatggtacgatgaaaataaaagatgaggaacgcgacgatacccttacaattctcttaaaagcaacattactagcagtctccggtgtataccccctctcaattcctgctaccctatttgtttggtatttttggcaaaagaagaaacagagatccggagtgctatgggacacaccatccccaccggaagtagaacgggctgtcctagatgacggaatatatcggattatgcaaagaggattgcttggaagatcccaagttggagtcggtgtattccaagaaaacgtctttcatactatgtggcatgtaacgagaggagccgtactaatgtaccaaggaaagcgactagaaccatcatgggcatcagtcaaaaaggacctaatatcatacggtgggggatggcgactccaaggctcttggaacacgggcgaagaagttcaggtaatagcagtggaacctggaaagaaccccaaaaacgtccagacaacgccaggtacatttaaaaccccagaaggggaagtaggagcgatagcacttgactttaagccaggcacaagcggttctcccattgttaatagagaaggaaaaatcgtaggattatatggaaacggcgtcgtaactacatctggcacctatgtcagtgctatagctcaggcaaaggcttctcaagagggtccgttgcctgagatagaagatgaagtattcaggaaacgaaacttaacaattatggatttacacccaggtagtgggaaaacgagaaggtacctacccgcaattgtacgagaagccataaaaagaaaacttaggaccttgatattagctcctacccgggtggtagcatcggaaatggcagaggctttaaagggcatgcccatacgataccaaactacagccgtaaaatcggaacacacaggaaaagaaatagtcgatttaatgtgccacgctacctttacaatgagattattaagtccagttagggtgcccaattataatatgatcataatggatgaagcccactttacagacccttcaagcatcgctgctagaggctatatatccactcgagtcggtatgggagaagcggcagcaattttcatgactgcgacaccacctggatccgtagaagcatttccgcaatctaacgcagtaatacaggatgaagaacgtgacatcccagaacgttcatggaactcggggtatgagtggatcactgatttccctggcaaaactgtttggttcgttccaagcatcaaatcaggaaacgatatagcgaattgtttaaggaaaaatggtaaaagggtaatacagctcagtagaaaaacgtttgatacagaataccagaaaaccaaaaacaatgactgggattatgtagttaccactgacatatccgaaatgggagctaattttagagcagacagagttattgatccaaggagatgcttgaaaccagtcattttaaaagatggccccgaaagggtgattttggcaggaccaatgcccgtcactgttgcatctgccgcccaaagaagaggtagaataggaagaaaccataacaaagaaggtgaccaatatatatacatgggtcagccactaaacaacgatgaggaccatgcacactggaccgaagctaaaatgctattggataatataaatacgccggagggcatcatacctgcattatttgaaccagagcgcgagaaaagtgcagccatcgatggagaatatcgcttgcggggtgaagcacgaaaaacgtttgtggagttaatgaggcgtggcgatttgccagtttggctctcctacaaagttgcaagtgaagggtttcagtatagcgatcgaagatggtgcttcgatggggaaaggaacaaccaagtattggaggaaaacatggacgtagagatctggactaaagaaggagagcgcaagaagttgaggcctaggtggctagatgctaggacgtattcagatccgctagcacttcgcgaatttaaagaatttgctgctggaagacgatctgtgtccggggatctaattttagaaataggtaaactcccacaacacctgacccagagagcgcaaaacgctctcgacaatttagtgatgttgcataacagtgagcaaggaggtagagcttatagacacgctatggaagaactaccagataccatagaaactcttatgctactagcactaattgcagtactcactggtggtgtaactctatttttccttagcgggagaggccttggtaaaacttctattgggctattatgtgttatggcaagttcggttctcttatggatggcatccgtagaacctcactggatcgccgcctctattatacttgagttctttctaatggttttattgataccggagcccgatcggcaaaggactccacaagataaccagttagcctacgtagtaatcggcttattgttcatgattttgacagtcgctgcaaatgaaatggggttattagaaactaccaagaaagatttaggaattggacatgtagctgttggaaatcaccaccatgctgcgatgttagacgttgatctgcatccggcctcagcatggacactctatgcagtagcgacaaccataattactcccatgatgaggcacactatagaaaacacaacggctaatatcagtttgacagcgatagcaaatcaagctgccatattaatgggtttagacaagggatggccaatatcaaaaatggatattggggtccccttactagcactcggatgttactcgcaggttaacccattaaccctcacggctgctgtcttgatgttggtagcacattacgccataataggcccaggactacaagccaaagcaacgagggaggcgcagaaaagaacagctgccggaatcatgaagaaccccacagtagacggaatcgtggccatagatctcgaccctgtcgtttatgacgcaaaattcgaaaagcagttgggacaaataatgctattaattctttgcaccagccagatattgctgatgcggacaacatgggcattatgcgaaagcataacactagctacgggcccgttaacgacgctatgggaaggtagtccgggcaaattttggaatacaactatcgccgtaagcatggcaaacatattccgtgggagctatttggcaggcgcgggactcgcgttttcattaatgaaatcgttaggagggggacggcgaggaaccggtgcacaaggggaaactttaggtgaaaagtggaagagacaactaaatcaattatcaaaaagtgaatttaatacatataaacggagtgggataatggaagtagaccgatccgaagcgaaagagggacttaaacgcggtgaaaccacaaaacacgctgtctcaagaggcacagcgaagctgcggtggttcgtagagcgtaatcttgttaaaccggaaggaaaagtcatagacctaggttgcggtaggggcggatggtcctattactgcgctggactaaagaaagtgactgaagtaaaagggtataccaaaggcggacctggtcacgaagaaccgataccaatggcaacctacgggtggaatctagtcaaattgcatagtggtaaggacgtattctttattccaccagaaaagtgtgacacgctgttatgcgatattggagaatcaagcccaaatccaacgatagaagaaggtcgaacattgcgggtattaaaaatggtggagccttggttaaggggaaaccaattctgtataaagatattaaatccatatatgcccagcgtagtagaaacgcttgagcaaatgcaaagaaaacatggagggatgctcgtacgcaacccacttagtagaaatagcactcatgagatgtattgggtatcctgtggaaccggaaacatcgtaagtgcagtaaatatgacaagtcgaatgttactgaatagatttacaatggctcatcgtaagcccacttacgaacgcgatgttgacctaggagctggtacgagacacgttgcagttgagcctgaggtcgcaaatctggatatcatcggtcaaagaattgaaaacataaaacacgaacacaaaagtacatggcactatgacgaggataatccatataaaacatgggcataccacggatcatatgaagtcaagccttcaggcagtgcatcgtccatggtaaatggtgtagtgaaattattgaccaaaccgtgggatgtcattcccatggtaacacaaatcgcaatgactgataccacgccatttgggcaacaacgagtttttaaagaaaaggtagatacacggactccaaaagccaaaagaggcacagcacaaataatggaagttacagcaaagtggttatggggctttctttcgcgaaataagaagccgcgaatatgcacgagggaagaatttacaaggaaagttaggagtaacgccgcaataggggcggtattcgtcgacgaaaatcaatggaatagtgcaaaggaagctgttgaggatgaacgattctgggacttggtacatagagagcgcgagcttcacaaacaaggtaaatgcgcgacgtgcgtttacaatatgatgggtaagcgagagaagaaactaggagaatttggtaaggcaaaaggtagtcgcgcgatttggtacatgtggctaggggctagattcttagagtttgaagcgctgggatttatgaacgaggaccattggttttcccgcgaaaattctctatcaggagttgaaggtgaaggattacacaaactgggatatatactaagagatataagtaagatcccgggtggaaatatgtatgcagatgatacggcagggtgggacactcggataactgaagatgaccttcagaacgaagcgcggattaccgacataatggaacctgaacacgctttattagctaaatctatcttcaaattaacctaccaaaacaaggttgtccgggttcagaggcccgctaaaaacggaacagtaatggatgttatcagtcgccgtgatcagcgtggtagtggacaagtcgggacttatggattaaacactttcactaatatggaagctcaactcataaggcagatggaaagtgaagggatatttagcccgtcggaactcgagacaccaaatctcgcagaaagagtcctagattggctcgaaaagtacggcgtggaaagacttaaaagaatggcaataagtggtgatgactgcgtcgtaaagcctatagacgatcgatttgccaccgcacttacagctttaaacgatatgggcaaagtacgaaaggatattccacaatgggaaccaagtaagggatggaatgactggcaacaagtccccttctgctcgcatcattttcaccaactgattatgaaagacggtagagaaatcgtggtgccttgcagaaatcaagatgaacttgtaggacgagcacgggtttcacaaggcgccggatggtcattgcgagaaacagcatgtctaggaaagtcttatgctcaaatgtggcaattaatgtacttccataggcgggacttacgactagccgcgaatgcaatatgtagcgctgtacctgttgattggataccaactagcaggacaacatggagtatacacgcccatcatcaatggatgacgacggaggacatgctttcggtatggaatagagtttggatagaagagaacccttggatggaagacaagacccacataagtagctggggagatgtaccatatctgggtaaaagggaggatcagtggtgtggtagtctaattggtttaaccgcgagagcaacatgggccactaatatacaagtagcaatcaatcaagtacgacgtcttattggaaatgagaattatttggattatatgacatctatgaaacgtttcaaaaacgagagcgacccagaaggtgcattatggtaa

SEQ ID NO: 21789 - RNA, 9879 nt, synthetic construct
  misc_feature 1..9879: note = derived and/or modified CDS sequence (opt6) from DENV-1__GU131706__SS-prME
  source 1..9879: mol_type = other RNA
tcagttactatgttactaatgttgatgcccaccgcactggcgttccatctaaccactcgtggaggggaacctcacatgatagttagtaaacaagaacgcggaaaatcattactattcaaaacaagtgctggagtcaacatgtgtactttaattgctatggaccttggagaactgtgtgaggatactatgacttataaatgcccgagaataacggaaacagaaccggatgatgttgattgttggtgcaacgcaacggatacttgggttacgtatggtacctgttcacaaacaggtgaacacagacgtgataaaagaagtgttgcactagctccacatgtaggtttaggtttagagacgcggacagaaacctggatgtcgagcgaaggtgcctggaaacaaatacaaagagtagaaacctgggcattgagacatcccggctttacagttatagcactgtttttagcacatgccatcggtacgagcatcacacaaaagggtataatctttattctcctaatgttagtgactccctctatggcaatgagatgtgtagggataggaagcagagattttgttgaagggttaagcggagcaacatgggtcgatgttgtcctagaacacggtagctgcgtaactacaatggccaaagacaagccaactcttgacattgaactgctgaaaacagaagttacgaaccctgctgttctacgaaaattatgtatagaagccaaaatctcaaacacaaccacggattccaggtgcccgacccaaggtgaggcaacacttgtggaggagcaggatgcgaatttcgtctgcagaagaacttttgtagacagaggttggggtaacgggtgtggccttttcggtaaaggtagtcttataacctgtgcaaaatttaagtgcgtaactaaactggaagggaaaatagttcaatatgagaacctaaaatatagcgtgattgttacagttcatacaggagaccaacaccaagttggcaatgaatcaacggagcacggaacgacggccaccataacgccacaggcacctaccacagaaatccaattaacggattatggggcgttaacactagactgtagtccgagaactggtttagatttcaacgaaatggttctcttgactatgaaagaaaagtcatggttagttcacaaacaatggttcttagatctacctttgccttggacaagtggagcatcgacatcacaagagacgtggaatcggcaagatttattggtcacatttaaaacggcgcacgccaagaaacaagaagtcgtggtactagggagccaagaaggtgctatgcacactgctttaacgggagccacagaaatacaaacctctggaaccactactattttcgcaggacatctcaaatgcagactaaaaatggataaactcacactaaagggtatgtcgtacgtgatgtgtactgggagttttaaactagaaaaagaagtggccgaaactcaacatggtactgttcttgtgcagatcaaatacgaagggacagacgcaccctgtaaaataccattttccacacaagacgaaaaaggagtcacgcaaaatggaaggctgataacggcgaaccctattgtgaccgacaaagagaaaccagtgaatatagaagccgaaccgccttttggtgaaagttatatcgtaataggagcaggggagaaagctcttaagttaagctggtttaggaaaggtagcagcataggaaaaatgttcgaagcaactgcaagaggagcgcgcagaatggcgatactaggggatacagcatgggactttggcagcataggaggggtatttacgtctgtagggaagttagttcatcagatatttggaacagcgtacggcgtactattttcaggagtgagttggacaatgaaaataggaatcggtgtcctccttacatggctaggacttaactcacgaagcacaagcctaagtatgacctgtatcgcagttggtttagttacgctatatcttggagtaatggtacaggccgatagcggatgcgtaattaactggaaaggtagagagttgaaatgtggctccgggattttcgtgaccaatgaggtgcacacatggacggaacagtataagttccaagccgattcgccaaaacgattaagcgcagctataggaaaagcatgggaagagggagtttgtggaatcagaagtgcgactagattagaaaatattatgtggaaacaaatatctaatgagttgaaccatatattattagaaaacgacatgaaatttactgtagtagtgggtgacgttgcgggaatattagcacaggggaagaaaatgattaggccgcaaccaatggagtacaaatactcatggaaatcctggggcaaagccaaaatcataggagctgatgtccagaatacaacgtttataattgacggacctaacacaccggaatgcccagatgatcagagagcgtggaatatctgggaagtagaagactacggatttggaatttttacgacgaatatatggctaaaacttcgtgattcatatacccaagtctgtgatcatagattaatgtccgcagcaattaaagatagtaaggcagtccacgcggacatgggctattggatagaatcagaaaagaacgaaacttggaaattagcaagagccagctttattgaagttaaaacttgtatatggcccaaaagtcataccttgtggtcaaatggagtcctggagtcagaaatgattatacccaaaatttatggtggacctatatcacaacacaactatagaccaggatattttacacaaacggccggcccttggcacctaggcaaacttgaactagacttcgatctttgtgagggtacaacagtggttgtagacgaacactgcggcaatcgaggtccatctctaaggacaactaccgtaacagggaagatcatccatgaatggtgttgtcgatcctgcacactgccgccattacgatttagaggtgaggatggttgttggtacggtatggaaatcagaccagttaaagagaaggaggagaatctcgtgaaaagcatggttagtgcaggatccggagaggtagattcattctccctcggacttctttgcataagcataatgatagaagaagtaatgagatcacgatggagccgaaagatgttaatgaccggcacattggcagtcttcttcttgttaataatgggacaactaacgtggaatgatcttatacgactatgtataatggtcggagcaaatgcctccgatcgaatgggaatgggcatgacatatttagcattaatggcgactttcaaaatgagaccaatgttcgctgtaggcttattatttaggaggttgacttctcgtgaagtattattgttgaccatagggctttcattagtagcgtcagtcgaattacctaactcgctagaagaacttggtgacggacttgcaatgggaataatgatattgaaactactaacagacttccagtctcatcaattatgggcaacattattaagtttaacatttataaaaaccacattttcactgcactacgcctggaaaactatggcaatggtattatcaatagtttccttattcccattatgtttgtcaactacaagccagaagactacttggttacctgtactattaggctcgttaggctgcaagccattgactatgtttctgatagctgaaaacaaaatttgggggagacggtcctggcccctaaatgagggaattatggcagtaggaatagtatcgatcttattgtcatcgttactgaaaaatgatgtccctctagcaggtccactcatagcaggaggaatgctgattgcatgttacgtgatttcaggaagttctgctgatctatcacttgaaaaagccgcagaagtctcttgggaggaagaggcagaacactcaggggcatcacataatatcctagtcgaggtacaggacgacggtactatgaaaatcaaagatgaagaaagagacgataccttaactatactgctaaaggccaccctattagcagttagtggtgtttacccattaagtatacctgccacccttttcgtctggtatttttggcagaaaaagaaacaaaggagcggagtcctatgggacacgccgtctcctcccgaagtagagcgggcagtgttggatgacggtatttaccgaataatgcagaggggattactcggccgttctcaagttggcgtaggcgtatttcaagaaaatgtatttcacacaatgtggcatgtaacaaggggagcagttttaatgtaccaaggtaaacgactagaaccctcctgggccagcgtcaagaaagaccttatctcctatggaggtggatggcgattacaaggatcgtggaatactggagaagaagtacaagtgatagcagtagaaccaggcaaaaatcctaaaaatgtccaaactgctccaggaacattcaaaacgcctgaaggtgaggtaggagcgatagcattggattttaaaccaggcactagcggaagcccaatcgtcaacagagaaggcaaaatcgtagggttgtatggtaatggtgtagttacgacgtctggcacgtacgtatcagctatcgcacaagctaaagcatcacaggaggggcctcttcccgaaattgaagacgaggtttttagaaaaaggaatctaactataatggacttacaccctggaagcggtaaaactagacgctacctgccagccattgtgagagaagctataaaaagaaaactacgaacacttatcttagctccaactcgtgttgttgcatccgaaatggccgaagcgttaaaggggatgcctatacgataccaaacgactgcagtcaaatcggaacacacaggaaaagaaatagtggatcttatgtgtcatgcaacattcactatgcgtttgctgtcaccagtacgagtacctaattacaacatgataatcatggatgaagcacatttcacagatccctcatcaatagcagcgcgaggatatataagcaccagagtaggcatgggggaagctgctgcaatatttatgactgccacaccacctggcagtgtcgaagcgtttccccaaagtaatgctgttatacaagacgaagagagggatataccggaacgaagttggaatagtggctacgaatggattacagatttccctggaaaaactgtttggtttgtaccatcgataaaaagcggaaacgacatagccaattgtctaaggaaaaatggaaaaagagtcatacaactttcgagaaaaacctttgatactgagtaccagaaaacgaagaacaacgactgggactatgtcgtgactacagatataagtgaaatgggcgcgaattttagagcagacagagtaatagacccgcgtaggtgtctaaaaccagtcattcttaaagacggtcctgagcgagtcatactagcaggaccaatgccagtaaccgttgctagtgccgctcaacgtagaggcaggattggtagaaatcataataaagaaggagaccaatatatatatatgggacaaccgctgaataacgacgaagaccatgcgcactggacagaagcaaaaatgctcttagataacatcaatacccccgaaggaataatacccgcactgttcgaaccagagagagaaaaatcagccgctatcgacggcgaatacagactgagaggcgaagcacgtaaaacatttgttgaactaatgagacgaggtgacttgccggtctggctcagctataaagtagcgagtgagggatttcaatactcggacagaagatggtgttttgatggcgaaaggaataatcaggtgcttgaagaaaacatggatgttgagatatggacaaaagaaggtgaacgtaagaaactacgaccgagatggttagacgcgcggacatatagtgatcccttagcacttcgagagttcaaggaatttgctgcggggcggcgatctgtttcaggagacttaatacttgaaataggtaagttgccacaacatctaacacaaagagctcaaaacgctttagataatctcgtaatgttacacaactcagaacaaggaggtcgcgcttatcgccatgcgatggaagaattacccgataccatagaaactttaatgctgttagcactcatagcagttttaactggaggtgttaccctattcttcctatcaggacgtggactcggcaaaacgtccattggtctcttgtgcgttatggcgtcatctgtcttattatggatggctagcgttgaaccacactggattgccgcgagtatcatcttagagttctttttaatggtattgctaataccagaaccagaccgtcaacgaactcctcaagacaaccaattagcctatgtggtaatcggcttgctattcatgatcctaacagtggccgcaaatgaaatggggttactagaaactaccaaaaaggatttaggaattggtcatgttgcggttgaaaaccaccatcacgcagctatgctggatgttgatttgcatccggcttcagcgtggaccctatatgcggtagccactacgattataacacctatgatgcgacacactattgaaaatactacggcaaatatttcactaacagctatagctaaccaggcagctatcttaatgggactagacaaaggttggcctattagcaaaatggacattggagtacctctattagcgttaggatgctactcacaagtaaatcctcttactctgaccgctgctgtcctaatgctggtagcacactatgcaattataggccctggtctccaagcaaaggctacaagggaagctcagaaacgtacagcagctgggattatgaaaaaccctacggtggatggaatcgtagctatcgaccttgacccagtagtatatgatgcaaagttcgaaaagcaactggggcagatcatgctcttgattttatgcacctctcagatactcctgatgcggacaacatgggcactatgtgaatcaataaccttagctacgggacctttaactactctttgggagggatcacccggaaaattttggaatactaccattgccgtatctatggcgaacatattcagaggatcctatttagccggtgcggggctcgccttcagtctcatgaaaagcctagggggaggtagaaggggcactggagcacaaggagaaacactgggggagaaatggaagcgtcaattaaatcaattaagtaaatctgagttcaatacatacaagagaagtgggattatggaagtcgataggtctgaagcaaaggagggattaaaacgaggtgaaactaccaaacatgcagtgagtcgaggtacggctaaactaagatggttcgttgagagaaaccttgttaagccagaaggaaaggtgatagacctgggatgtggccgaggcgggtggagctactattgtgctggtctaaagaaagtaaccgaagtcaaaggatatacaaaaggagggcctggtcacgaagaacccatccctatggcaacctacggatggaacttagtcaaattgcacagtggaaaagatgtgttcttcatacctcccgaaaaatgtgatacgctattatgcgatattggtgaatcttcaccaaacccaacaatcgaagaaggtaggactctacgtgtattgaaaatggtagagccatggcttaggggtaatcagttttgtattaaaatactaaatccgtatatgccctcggtagttgaaacccttgagcaaatgcaacgcaagcatggaggaatgttggtgaggaatcccctgtcaagaaacagtacacatgaaatgtattgggtaagctgtggaacaggaaacatcgtatcggctgttaatatgacttctcggatgttattaaacaggttcactatggcgcataggaaacctacttatgaacgagacgtagacttgggggccggcaccaggcacgtagccgtagaaccagaagttgccaatctggatatcataggacaaaggatagagaatataaaacacgaacataaatcaacatggcattatgacgaggacaatccgtacaaaacatgggcgtaccatggcagttatgaagtaaaacctagtggatcagcgagttcaatggtgaacggtgtggtgaaactacttacaaagccatgggatgtaatacctatggttacccaaatagctatgacagatacgacaccatttggacaacaaagggtctttaaggaaaaagtagacacaaggactcctaaggcgaaaagagggacagcgcagataatggaagtaacagcaaaatggctatggggatttctatcaaggaacaaaaagccgcgaatatgtacccgagaagagtttactcgaaaagttagatcgaacgcggctatcggcgctgtctttgtagatgagaatcagtggaactcagctaaggaagctgtagaagatgaacggttctgggacttagtccatagagagcgcgagcttcacaagcaaggaaaatgcgcgacttgtgtttataatatgatggggaaacgtgagaagaaactaggggaatttggcaaagctaaaggatcgcgagctatatggtatatgtggttaggcgcccgtttcttagaatttgaggctttgggcttcatgaatgaagatcattggttctccagagaaaatagtttatctggtgtagagggagagggacttcacaaactaggatatatattgagggacattagcaagatcccaggaggcaacatgtacgccgatgatacagcaggttgggataccagaattaccgaggacgatttacaaaatgaggcacgcataacagacattatggagccggagcatgcactactcgcaaaatcgattttcaaactaacttaccagaataaagtggtacgtgtacagcggccagccaaaaacggcacagtcatggatgtaatttcgagaagggatcagcgtggaagtggtcaagtggggacctacggcctaaacacctttacaaatatggaagcacaactcattaggcaaatggaatctgaaggaatattttctccaagtgagcttgagacgccaaatttagctgaacgagtactggactggctcgaaaaatacggagttgaacgcctgaagcggatggctatttcaggagatgactgcgtcgtaaaaccaattgatgacaggttcgcaactgctctgaccgccctcaacgacatgggtaaagtacgcaaagatataccccagtgggaacctagcaaagggtggaacgattggcaacaagtacccttttgttcccaccactttcaccaattaataatgaaagacggacgtgaaattgtcgtaccctgtagaaatcaagatgaattagtcggacgagcacgtgtctctcaaggagcgggctggagtctaagagaaacagcgtgccttgggaagtcttatgcgcaaatgtggcaactcatgtattttcacagacgagatttgaggttagccgccaatgctatctgcagtgcagtacctgtagattggataccaacgagcagaacaacatggtcgatacatgctcaccatcaatggatgacgacagaagatatgttatctgtttggaacagggtttggatcgaagaaaatccatggatggaggataaaacgcatataagtagttggggtgacgtaccctatttaggtaaacgagaagatcaatggtgtggaagtctgataggattaactgcgcgagcgacctgggccaccaacatacaagtagcaatcaatcaggtgagacgattaattggaaacgagaattatttggattacatgacgtcaatgaagagatttaagaacgaaagcgatccagaaggtgctttatggtga

SEQ ID NO: 21790 - RNA, 9879 nt, synthetic construct
  misc_feature 1..9879: note = derived and/or modified CDS sequence (opt6) from DENV-1__GU131708__SS-prME
  source 1..9879: mol_type = other RNA
agcgtaacgatgctgctaatgttaatgccaacagcactagcatttcatcttacaacaagaggaggggaaccgcacatggttgtatcgaaacaagaacgagggaaaagccttttattcaaaacgtctgctggtgtcaatatgtgcacactaatagcaatggatttaggtgaattgtgtgaagacactatgacatataaatgccccagaataactgaagcagagcccgacgatgtggattgttggtgcaatgcaacagatacatgggtaacatacggcacgtgtagtcagactggagaacaccgtcgcgataaacgcagcgttgccttagcaccgcatgtaggattaggattagaaacccgcaccgaaacttggatgtcttctgaaggggcatggaaacaaatccaacgagtggaaacctgggccttacgacatcctggatttactgtaattgccctatttttagcacacgccataggtacgagtatcacccaaaaagggataatatttatactcttgatgttggttacccctagtatggctatgagatgcgttggtataggatctcgtgatttcgtagaaggcttaagcggagcgacatgggtagatgtagtattagaacacggatcctgcgtgactacaatggcaaaagacaaaccgaccctagacatcgagttacttaaaaccgaagtaacaaatccagcaattctgcgaaaactctgtattgaggcgaaaatttccaatactacaactgacagcagatgtccgactcaaggggaagcaaccctagtggaagaacaagatgctaattttgtttgtagacgtacatttgttgacagagggtgggggaatgggtgtggcctatttgggaaaggaagcctgataacttgtgcaaaatttaaatgtgtaaccaaattagagggaaaaatcgttcaatacgagaatctgaaatattccgtcattgtaactgtgcatacaggggatcaacaccaagtaggtaatgaatcgacagaacatggcaccacagccacaataactccacaagctccaacgactgaaattcaactaacagattacggagccctaaccctagactgttcaccaagaacaggcttagacttcaacgaaatggtacttcttacgatgaaagagaaaagctggcttgtccataaacaatggttcctagatctcccattaccatggacaagtggagcttcaacttctcaagaaacatggaacagacaagatcttttagtgacctttaaaacagctcatgccaagaaacaagaggtcgtagttctcggatcgcaagaaggagctatgcatacagcactaaccggtgccacggagatacaaacatcaggcaccacaacaatatttgcaggacacctcaaatgtaggctgaaaatggataaattaaccctcaaaggtatgagctatgtaatgtgtacttcctcgttcaaattagaaaaagaggtagcagaaacacaacacggaacagtgctagtacaaataaaatatgagggaaccgatgcgccttgtaaaataccattctcaactcaggatgaaaaaggggtaactcagaatggccgattgataacagccaatccaattgtaacagataaagaaaaaccagttaatatagaagccgaaccacctttcggagagtcatatatcgtaataggtgctggagagaaagccttaaaactctcttggtttaagaaaggttcaagcatcggaaaaatgtttgaggctacagctagaggagcgcggagaatggcaatattaggggatactgcatgggatttcggaagtattggtggagtgtttacaagcgtagggaaactcgtgcaccaaatattcggcacggcgtacggagtacttttctcgggggtctcatggacaatgaaaattggtttgggcgttttgttaacgtggctaggccttaattcacgttcaacatctcttagcatgacgtgcatcgccgttggcctggttactctatacctaggtgtaatggtacaggctgactctggatgcgttataaattggaaaggacgtgagttaaaatgcggcagtggaatctttgtaacaaacgaagttcacacatggaccgaacaatacaaattccaagccgattccccaaaacgtctcagtgcggccataggaaaggcctgggaggaaggagtatgcgggataagatctgctactaggttagaaaatgttatgtggaaacagatatcaaatgaattaaatcatatactattggaaaacgatatgaaattcacggttgtagtaggagatgtcgctggtatattggctcaaggcaaaaagatgatccgaccacaaccaatggaatacaaatatagttggaaatcttgggggaaagcaaagattatgggtgcggacgtgcaaaatactacattcattatagatggaccaaatacgcctgaatgcccagatgatcaacgtgcatggaacatttgggaagttgaagattacggctttggaattttcacgacaaacatttggttaaagttacgtgatagttatacccaggtatgtgaccatcgcttgatgtcagcagctatcaaagactccaaagcagtccatgcagacatgggttattggatcgaatcagagaaaaacgaaacgtggaaattagcgcgagcttcattcatagaagtgaaaacgtgcatatggccaaagagccatacgctctggagtaacggggtacttgaatcggagatgattatacctaaaatatatggcggccctatctctcaacataattatagaccaggttatttcacacagacagcaggtccttggcacttaggtaaactagaactagattttgatttatgtgagggcactactgtagtcgtggacgaacattgtggtaatcgcggaccaagtctccgcacgactacagtaaccgggaaaatcatacatgaatggtgctgtaggtcttgtacgctcccacccttaagattcagaggagaggatgggtgttggtatggaatggagatacgacctgtaaaagaaaaggaggaaaacttagtcaaaagtatggtatcagctgggtccggagaggtagatagcttttctcttggactgttatgcatatctataatgatagaagaagtaatgcggagtaggtggtcaaggaaaatgttaatgacaggtactttagcggtctttttactcctaatcatgggacaacttacatggaatgatttaatacgcctatgtatcatggttggtgctaatgcctcagacagaatgggtatgggaacaacatatctagctcttatggcaacctttaaaatgcgacctatgttcgcagtgggattgctgtttcgacgattaaccagcagagaagtgttgcttctaacaattggcctatcccttgtagctagtgtagagctacccaatagcttagaagaacttggggacggactagcaatgggtataatgattttgaagttactcactgactttcaaagtcatcaactctgggcaacgcttttatctcttacgttcattaagactactttctcactccattatgcttggaagaccatggctatggtgcttagtattgtaagcctattcccgctttgtctttctacaactagccagaaaactacatggttaccagtactgctagggtcactagggtgtaagccattgacaatgtttctcattgctgaaaataaaatatggggtagaaggtcctggccactcaatgagggtataatggctgttggtattgtgagcatactattatcttcgcttctaaagaatgacgtgccattagctggcccactgatagccggcggcatgttaatagcttgctacgtcatttctggatcatcagcggacttgagtctggaaaaggcagcggaagtaagttgggaagaggaagctgagcactccggagcttcccataacatattggtagaagtccaagatgatggtacgatgaaaatcaaagatgaagaaagagacgatacattaaccatactcctaaaagcaactctacttgccgtatccggagtgtacccactgagtataccagcaacgcttttcgtatggtacttctggcagaagaagaaacagaggtcgggagtattatgggacacacccagtcccccagaggttgaacgtgcggtacttgatgatggaatataccgtatcatgcaaaggggcttactaggcagaagtcaagtaggtgtgggtgtattccaggaaaatgtcttccacacgatgtggcacgtaacacgtggggccgtacttatgtatcaaggtaaaagattggagccctcatgggcctctgtgaagaaagacttaataagttacgggggaggatggcgtctacagggtagttggaacactggagaagaagtacaagtcatcgcagtcgaaccgggcaaaaatcctaagaacgttcaaactgcaccagggactttcaagactccggaaggtgaggtaggtgcgatagcactagatttcaagccaggcacaagcggaagcccaatcgttaacagggaaggcaaaatagttggcctttatggaaatggagtggtgacaacttcaggaacttatgtctcagctattgctcaagcgaaagccagccaggaaggaccattgcctgaaatagaagatgaagtattcagaaaaagaaacctaacaattatggatctacatcctggcagcgggaaaactcgaagatatttacccgcgattgtgcgtgaagcaataaagcgaaaattgagaacactaattctggcgccaacaagagtcgtagcatcagaaatggctgaggccctgaagggaatgccgatacggtaccagactactgcagtaaaatcagaacataccgggaaagaaatcgtagatctaatgtgtcatgccacatttactatgcgtttactttcaccagtcagggtccccaattataatatgatcattatggacgaggcacatttcaccgacccctcaagtatagctgcgaggggctacatcagcacaagggtaggcatgggtgaagcagctgcaatatttatgactgcaaccccaccaggaagtgtggaagcatttccacagtcaaatgcagtcattcaagacgaggaacgagatatcccagaaagatcatggaactccgggtacgagtggataacagacttcccaggaaaaaccgtatggttcgtaccttcaataaagtcgggcaatgatatagcaaactgtttaaggaaaaatggcaaaagagtaatacaactttcgagaaaaactttcgatacagaatatcagaagactaaaaataatgattgggattatgtagtgacaactgatatttccgaaatgggtgcaaattttagagcagatcgagtaattgaccctaggagatgtttaaagcctgtaattttaaaagatggtcctgagagggtcatcttagcgggaccgatgccggtaactgtcgcttcggcagcgcaaagaagaggaagaatagggagaaatcataacaaggaaggagaccaatatatatatatgggtcaacctttgaataacgatgaagaccatgcacattggacagaagctaaaatgttgctggataatattaatacacccgaaggaataataccggctcttttcgaacctgaaagagaaaaatccgccgcgatagatggcgagtacaggttaagaggtgaagcaagaaagacatttgtggaactgatgaggagaggagatttaccagtttggttaagttacaaggtcgcatcagagggttttcaatattccgatagaagatggtgcttcgatggagaacgaaacaatcaggtgttagaagagaatatggacgtcgaaatatggaccaaggagggtgaaaggaagaaattgagaccaagatggttagacgctcgaacatattctgatccattagctctgagggaatttaaagaatttgcagcgggccgacgttcagtctcgggtgacttaatcttagaaataggcaaattaccacaacatttaactcaaagagcgcaaaatgccctggacaacctagtaatgttacacaattcagaacaaggaggacgagcatatcggcacgcaatggaggaattgccagatactatagaaacgctaatgttgttagcacttatagctgtgttaacagggggagtaacattattctttttgagtggcaggggactcggcaaaacaagtataggactactatgcgtcatggcatcatctgttttgctctggatggcgagtgtggaaccacactggatagcagccagcataattcttgaatttttcttaatggtactcctcataccggagccggaccgacaacgcactccacaagataatcaactagcttacgtagtcattggactactttttatgatactaaccgtagcagccaacgaaatgggattgctcgaaactactaagaaagatttaggcataggccacgcggctgtagggaatcatcaccacgcggctatgttagatgtagatctgcatcctgcttcagcttggacgctatatgcggttgccacaacgattattacgccgatgatgagacatacgatagaaaatactacagcaaacatatcattaacggcaatagcaaaccaagcggccatcctgatggggctcgacaaaggttggccaatatcaaaaatggatatcggagtcccactactggctcttggttgttacagccaggtaaaccctctaactttgactgcggccgtactaatgctggttgcgcattatgctatcataggccccggccttcaagctaaagctacacgcgaggcacagaaaagaaccgccgctgggatcatgaagaatcccacagttgacggtattgtagcaattgacttagaccctgtagtgtatgatgcgaagtttgaaaagcaactgggtcaaataatgctgcttatattatgcacttcacaaattctcttaatgaggacaacatgggcgttatgcgaaagtattaccctagctacagggccgctaactacgttgtgggaaggcagtcccggtaaattttggaatacaaccatagctgtatctatggcaaatatatttagggggtcgtatctagcaggagcaggacttgcctttagtttaatgaaatctcttggcgggggtcggcgaggtacaggggcacagggtgaaacattaggagaaaaatggaaaagacaattaaatcaactttcaaagtcagaatttaacacctacaagagatccggtatcatggaagtcgatcgaagtgaagcaaaagaaggtctcaagcgaggtgagactactaaacatgctgtaagccggggtaccgcaaaattaaggtggttcgttgagcggaatctagtgaagcctgaaggaaaagtaatagatttaggatgtgggagagggggatggagctattactgcgcgggcctgaagaaagtaacagaagtaaagggctatacgaagggcggaccaggacacgaggaaccgattcctatggcgacgtacggttggaatcttgtaaaattgcatagtggtaaagacgtattctttatcccaccagaaaagtgtgacactttactgtgcgatataggcgaatcctcccctaatcccacgatagaagaaggtagaaccctaagggttctaaagatggtagaaccttggttgcggggcaatcagttctgtattaaaatattaaatccatatatgcccagtgtcgtagaaactttagaacaaatgcaaaggaagcacgggggtatgttagtccgaaatcctctatcgcgtaattcaacgcacgaaatgtattgggtatcatgcgggaccggcaacatcgtttctgcggttaacatgacaagtcgaatgttattgaatcgattcaccatggcccatcgtaagccgacgtacgaaagagatgtcgacctaggtgctgggacacgccatgtggcagttgaacccgaggttgcaaatctagatattattggacaacgtatagaaaatattaagcacgaacacaagagtacttggcactatgacgaagacaatccttataaaacatgggcttatcacggtagttatgaagtaaaaccatcgggttctgctagttcaatggttaacggcgtagtcaaattacttacaaagccatgggatgtaatacctatggtcacccagatcgcaatgactgacactacaccgtttgggcagcaacgagtttttaaggaaaaagtagatacaagaacgcccaaagctaaaagaggcacggcccaaattatggaagttactgcgaagtggttgtggggatttttaagtaggaacaagaaacctagaatatgcacaagagaagaatttacacgaaaagtaagatcgaacgcggcaattggcgccgtattcgtagatgaaaaccaatggaatagtgctaaagaggctgtagaagatgaaagattttgggatttagttcaccgtgaaagagagctacacaaacagggcaaatgcgctacatgtgtatataacatgatgggcaaacgagaaaagaaactaggtgaatttggcaaagcaaagggttctcgagccatatggtatatgtggctaggtgctcgattcctagagtttgaagcattaggattcatgaacgaggaccattggttttccagagaaaactcactctcaggagtcgaaggtgaaggacttcacaaattaggttatatacttcgggatatatccaaaatacctggtggtaatatgtatgcagatgacacagcagggtgggacacccgaattacagaagatgatttacaaaatgaagctagaataacagacatcatggaaccagaacacgcactgctcgctaaaagtatatttaaattaacatatcaaaataaagtagtaagagtacagcgcccagccaaaaacggcaccgtcatggacgtaataagtaggagagatcaaagagggtctggtcaagtagggacctatgggctaaatactttcacaaacatggaagcacaattaataagacaaatggaatcagaaggaatattcagtccaagtgaattagaaactcccaatttagctgaacgagtactagactggcttgaaaaatatggggtagaaagattaaaacgaatggcaatctcaggagatgactgcgtggtaaaaccaatcgacgataggttcgctactgcattaactgcacttaacgacatgggcaaagtacgcaaagacatcccccaatgggaaccgtcaaagggttggaatgattggcaacaagtgcctttctgttcacatcattttcatcaactgataatgaaagatggtcgtgagatagttgtcccttgtaggaaccaagatgagctagtaggaagggcaagagtaagtcaaggagcagggtggtcattacgagaaactgcttgcttaggcaaaagctatgcacagatgtggcagctaatgtacttccatagaagagatttacgtctagcagcgaatgctatatgtagtgctgtaccagtagattggattcctacatcgaggacaacgtggagtatccatgcgcaccatcaatggatgacgaccgaagatatgctttcggtttggaatagagtatggatagaggaaaatccttggatggaggacaagacacacatcagttcatggggcgacgtgccatatttaggaaaacgagaagatcagtggtgtggctctttgataggcctgactgcgcgtgcaacttgggctactaatatacaagtcgcaattaatcaagttagaagattaatagggaatgagaattatttggactatatgacttccatgaaacgattcaaaaatgaatcagaccctgaaggtgctctatggtag

SEQ ID NO: 21791 - RNA, 9879 nt, synthetic construct
  misc_feature 1..9879: note = derived and/or modified CDS sequence (opt6) from DENV-1__GU131710__SS-prME
  source 1..9879: mol_type = other RNA
tctgttacaatgcttctaatgcttatgccaactgcactagcgttccacttaacgactagaggaggtgaaccacacatgattgcatctaaacaagaacggggtaaatcacttctattcaaaacatcagcaggagtaaacatgtgcacactaattgcaatggatttaggagaactatgcgaagatacaatgacctataaatgtcctagaataacagaaacagaaccggatgatgtagactgctggtgtaacgctactgatacatgggttacatatggtacatgttcccaaacaggagaacataggcgcgataaacgatctgtagcactagcaccacatgtcggattaggcttagaaacacgtactgaaacatggatgagctcagaaggagcatggaaacaaattcaacgcgttgagacctgggccctacgacacccaggattcactgttatcgctctatttctggcacatgcgattggtacttcaataactcaaaaaggaataattttcatcttattgatgctcgtaacgcctagtatggcaatgcgttgcgtcggaatcgggtcccgcgatttcgtagaaggactgagtggcgcgacgtgggttgatgtagtactagaacacgggtcatgcgtaaccaccatggcgaaagataaaccaactcttgacatagaactattgaaaacggaagtgacaaaccctgccgtattaagaaaactatgtatagaagcaaaaatcagtaatacgactacggattcacgatgtcctacccaaggtgaggctacattggtagaagaacaagatgccaattttgtttgcagaagaacttttgttgaccgtggttggggtaatggttgtggactattcgggaaaggcagtctaataacgtgcgccaaatttaaatgcgttacaaaactagagggaaaaattgtccaatatgaaaacttaaaatattcagttatagtaacagttcatactggagatcaacatcaagtgggtaatgaatcaactgagcatggcacaacagctacaatcaccccacaagcaccaactacggagatacaacttacagactacggtgctctaaccttagactgtagcccacgaactggcttagattttaacgaaatggtgctattgacaatgaaagaaaaatcatggttggttcacaaacaatggtttctcgacctgcctttaccatggaccagtggagctagcacgagtcaagagacgtggaatagacaagacctcctagtaaccttcaaaaccgctcatgccaagaaacaagaggttgttgtactgggaagccaagagggagcaatgcatacagcgctaactggtgcgactgaaattcaaacaagtggtacgacgactatcttcgctgggcacctaaaatgccgtctgaaaatggataaattaacactaaaaggcatgagctatgtaatgtgtacaggcagtttcaagctcgagaaagaagtagctgaaacgcaacatggaactgttcttgttcaaataaaatatgaaggaaccgacgcgccatgtaaaatacccttttctacacaagacgaaaaaggtgttactcaaaatggacggctcataactgccaacccgatagtgacagataaagaaaagccagttaatatcgaggcagaaccaccattcggcgaatcatatatagtaatcggtgcaggagaaaaggctttaaaattaagctggttcaagaaaggttcatcgatagggaaaatgtttgaggcaactgcaagaggagcgcgcagaatggcaatccttggagatactgcttgggacttcggatcaatcggaggagtcttcacatccgtgggaaaattagtacatcaaatttttggaaccgcctatggtgtgttatttagcggtgtcagctggactatgaaaatagggataggtgttttattaacttggttgggtttaaacagcaggagcacctctttatcaatgacatgtattgctgttgggctaataacgttatatttaggcgtaatggtccaggcagatagtggctgtgtcataaattggaaaggtagagaattaaaatgcggttccggcatcttcgtcacaaacgaggtacacacatggacggaacaatataagtttcaagctgattcacctaaacgattgagcgctgctattggaaaggcatgggaagagggggtatgcggtataagatctgcgacacggttggagaatatcatgtggaagcaaataagcaatgaactcaatcatatactgcttgagaacgacatgaaatttacagtcgtagtaggagatgttgcgggaatccttgcccaaggtaagaaaatgataagaccacaaccaatggaatacaagtatagctggaagagttggggtaaagctaagataataggggcggatgtgcaaaacaccacatttataatagatggaccaaacacacccgagtgtcccgatgaccaacgagcgtggaacatctgggaagtagaagattatggattcggcatctttacgacaaatatatggctcaaacttcgggattcttacacccaggtttgtgaccaccgcctgatgtcggcagcaatcaaagattcaaaggccgtccatgcagacatggggtactggatcgaatcagagaaaaatgaaacctggaaactagcaagagccagcttcattgaagtaaagacatgcatttggccaaaaagtcataccttgtggtccaacggagtcctcgagtcggaaatgatcattccaaaaatatacggtggaccgatatcccaacataattatcgcccaggatattttacacaagctgcgggaccatggcacttaggcaaactcgagttagactttgacctatgcgaaggaactacggttgtagtcgatgaacactgcggcaatagggggccctcactaaggacaacaacggttaccggcaaaataatacatgaatggtgctgtaggagctgtaccttaccaccgttaaggttcagaggggaagatggatgttggtacggtatggaaattagaccagtcaaagaaaaagaagagaatttagtaaagagcatggtatcagcgggttcaggtgaagtggatagtttctcactgggactactttgtataagcatcatgatagaagaagttatgaggagtcggtggagtagacgaatgctgatgactggaactctagccgtgttctttttattgataatgggacagttaacttggaacgacttgattaggctttgtatcatggttggcgcaaatgcgagtgacaggatggggatgggaacaacatacctggcactaatggctacttttaagatgagacccatgtttgctgtggggcttctcttcaggaggctaacaagcagagaagtgttattgctgacaataggattatcactcgttgcctccgtagaactaccaaactcactggaagaactgggcgatggcttagccatgggtataatgatacttaaattgttaacagactttcaatctcaccagctttgggcaactttattgtcactcacctttattaagaccacgttctccctgcactatgcatggaaaaccatggcaatggtcttaagtatcgtaagtctatttccattatgcttatcaacaacaagccagaaaacgacttggcttccagttttactaggttcgctaggatgtaaaccgttgacgatgttcctgatcgcagaaaataaaatctgggggagaagaagctggcccttaaatgaggggatcatggcagttggaatagtatcaattttactcagtagcttactgaagaatgatgtgccgcttgctggcccgttaatcgccggtggtatgctaatagcatgctacgtcatatctggttcgagcgcagatttatccctcgaaaaagccgcggaggtcagttgggaagaagaagctgaacactccggtgcctcccacaatatccttgtggaagtgcaagatgatgggactatgaaaatcaaagatgaagaacgagatgatacactaacaatcctactcaaggccacattattagcagtctctggagtatatcctctaagtattccggcaacactgtttgtatggtacttttggcagaggaagaaacaacgatctggggtcttgtgggatactccatctcctccagaagtagaacgagccgtattagatgatggtatataccgaatcatgcaacgcggtcttctaggtcgctcacaagtcggagtaggggtgttccaggaaaacgtatttcacacgatgtggcacgtgaccagaggcgccgtactgatgtatcaagggaagagattggaaccctcatgggctagtgttaagaaagacctaatatcctatggaggaggttggagattgcaaggaagctggaatactggtgaagaagtccaggtgatagccgtagaaccggggaagaatcccaaaaatgtacaaaccgcaccgggaacattcaaaacacccgaaggcgaagttggagctatagcactagactttaaaccagggacaagtggtagtcccattgttaatagagaaggaaaaatagtaggattatatggcaatggtgtggtcaccacctcaggtacctatgttagcgccatagcacaagcaaaggcttcacaagaagggccgctcccagaaatagaagatgaggtctttaggaagagaaacttgacgataatggatctccatccgggaagcggaaaaactaggcgctatttaccagcaatcgtcagggaagcgattaaaagaaaactaagaacccttatccttgcgccaactcgtgtagttgcttctgagatggctgaggctttaaaagggatgcctatccgatatcagacaactgcagtaaaatctgaacatacgggaaaggaaatagttgatctcatgtgccatgccacattcacaatgagattgctctctcccgtaagagtgcccaactacaacatgataatcatggatgaggcgcatttcactgatccatcaagtatagcagcaaggggttatatatcaacaagagttggtatgggcgaagcagctgccatattcatgactgcaacaccccctggatccgtagaagcgttcccacaatctaacgcagtcatccaagatgaggaaagagacattccagaaagatcatggaatagtggatatgaatggattaccgacttccccggtaaaacagtgtggtttgtgccctctataaaaagcggcaacgacatagctaactgtttaaggaagaacggcaaacgagttatacagttatcccgtaaaactttcgacacagaataccagaaaactaagaataatgactgggattacgttgtcacaacggacattagcgagatgggggcaaattttagagctgatagggtaatagatccgagacgatgcctcaaacccgttatcttaaaagacggaccggagagagtgatactagcaggtcctatgcccgtaacggtagcgagtgcagctcaaaggcgaggaagaattggaaggaaccacaataaggaaggagatcagtatatatatatggggcaacctcttaataatgacgaggaccatgcacattggacagaagcaaaaatgctacttgacaatataaacacgccagaaggaatcataccagctctatttgaaccagaacgagaaaagtcagccgctatagacggggagtataggcttcgtggagaggcaaggaaaacttttgtcgagctgatgaggaggggagatttaccggtatggctaagttataaggtggcctctgaaggtttccaatattctgataggcgttggtgcttcgatggagagaggaataatcaagtacttgaggaaaacatggatgtagaaatatggacaaaggaaggtgagaggaagaaactaaggcctcggtggcttgacgcccgaacgtatagtgatccgctagctttgcgagaatttaaagaatttgcagcagggagaagatcagtttcgggagatctaattctagaaataggcaaattaccccagcaccttacacagagggcacaaaacgctttggataacctcgtcatgttacacaattcagagcagggcggaagggcatataggcatgctatggaggagctacctgacactatcgaaactttaatgttgttggctttaatcgcagtattaacaggtggggtaacactgttcttcttatccggacgtgggttgggtaaaacctcaataggattactctgtgtaatggctagttcagtactactatggatggcatcagtagaaccgcattggatagcagcttccattatacttgagttctttctgatggtcttattaataccggagccagacagacaacgaacacctcaagataatcagctagcctatgtggtaatcggactgctctttatgatactaaccgttgccgcgaatgagatgggactgcttgagacgacaaagaaagaccttggcattggacatgttgcagtagaaaaccatcaccacgccgctatgctcgacgtagatttacatcctgcatcagcttggaccttgtatgctgtcgcaacaactattatcacgcccatgatgcggcatacaattgagaacacgaccgctaacataagtttgaccgctatcgcaaatcaagctgccatattaatgggattagataagggatggccaatttccaagatggatataggagttcccctcttggccttaggttgttatagccaagtaaatccactgaccttgacagcagcagtattaatgttagtcgctcactatgctataattggaccaggccttcaggcaaaagcaacacgtgaggcgcaaaagaggacggcagccggtataatgaaaaatcccacagtggatggtatagtagcaatagacttagacccagtagtatatgatgctaaatttgaaaaacaattaggacagatcatgcttctcatcttgtgcactagccaaattctactaatgcgaacgacatgggcactttgtgagagcataacattagctacaggaccactgactacgctttgggaaggctctccaggaaagttttggaacacaacaatagccgttagcatggcgaatatatttaggggttcctatttggcaggagctggtcttgcttttagtctgatgaaaagtttaggtggaggaaggagaggtacgggtgcgcagggagaaactctaggggaaaaatggaaacgacaactgaaccaactatcaaaatccgaatttaacacatacaagagatcgggaattatggaggtagataggagtgaagcgaaagaaggacttaagagaggagaaacaaccaaacatgctgtttcacggggtacggcaaaactacgctggttcgtagaaaggaacctcgttaagcctgagggtaaagtgatagacttgggctgtggaagaggtggctggtcatattactgcgcgggtttgaagaaagttactgaagtaaaaggatacacaaagggaggccctgggcacgaagaaccaatacctatggctacatatggatggaatttggtaaaactccatagcggaaaggatgtctttttcattccacctgaaaaatgtgatacattactatgtgacataggtgaatccagtccaaatccgactatcgaggagggccgcactttaagagtcttgaaaatggtagaaccgtggttgcgaggcaatcaattctgtataaaaattctgaacccatatatgccctcagttgtagaaactttggaacaaatgcaaagaaaacatgggggtatgctagtgagaaacccccttagcagaaatagtacacacgagatgtactgggtaagctgcggaaccggaaatattgtgtctgctgttaatatgacgtccagaatgcttctaaacagattcacgatggcacaccgcaagcctacgtatgaacgggacgttgatttaggtgcaggcaccagacacgtagccgttgagccagaggtcgccaatttagacatcattggacaaagaatagaaaacataaaacatgaacataaatcaacttggcattatgatgaagataatccctataagacgtgggcatatcatgggagctatgaagtcaagccgtctggatcagcatcttcaatggtgaatggtgtggtaaagttgcttactaagccttgggacgtaattccgatggtaactcaaatagccatgactgacactacgccatttggacagcaaagagtgttcaaggaaaaggttgataccagaacacccaaagcaaagaggggaaccgctcaaataatggaagtaactgcgaaatggctttggggatttttgtcgaggaataagaaaccccgcatttgcactagagaagaatttactagaaaggtgcgaagtaacgcagcgataggtgccgtgttcgtggatgaaaatcaatggaactcagctaaagaagctgttgaggatgaaagattctgggacttagtgcacagggaacgagagctacataaacagggtaaatgtgcaacctgcgtgtataatatgatggggaaaagagaaaagaagttaggtgagtttgggaaggccaaaggaagccgagcaatttggtatatgtggcttggcgcccggtttttggaatttgaggctttaggattcatgaatgaagatcattggttctcacgtgaaaattctttaagcggagtagagggcgaaggtctacataaattaggctacatattgcgagatatcagtaaaattccaggaggaaacatgtatgccgatgatactgcaggatgggatacacgaataactgaagacgatcttcaaaacgaagcacgaattacagacatcatggagcccgagcatgcacttttggcaaaaagcattttcaaacttacatatcaaaataaagtagtaagggtccagagaccagccaaaaacggtactgttatggacgtaatttccagacgagaccagcgcggtagcggtcaagtcggcacgtatggacttaacacgttcacaaacatggaagcacaactaattagacagatggaaagcgaaggaatattctcaccttcagaattagaaacacccaacttagcggaacgtgtacttgactggctagaaaaatatggcgttgaaagactcaaaagaatggcaataagcggtgatgattgtgtggttaaacctatagatgaccggttcgccacagctctcacggctctaaatgacatggggaaagtacgcaaagatattccacaatgggagcccagtaagggttggaacgattggcaacaggtacctttctgctcacatcacttccatcagcttataatgaaagacgggcgtgaaatcgtagtgccctgtcgaaaccaagatgaattagtaggcagagcaagagttagtcagggagcaggatggtcactgcgggaaacagcctgcctaggcaaatcttatgcgcaaatgtggcaactgatgtattttcatagacgtgatttaagattagcagcaaacgctatatgttcagctgtacccgttgattggatacccacatctcgtacaacatggagcatacacgctcatcaccaatggatgactacagaagatatgttatccgtgtggaacagagtatggatagaggagaacccctggatggaggacaaaacgcacatctcaagttggggcgacgtaccctatttaggtaaaagggaggatcaatggtgtggttccctgataggattaactgcaagagcaacctgggctaccaatattcaggtcgctattaaccaagtcaggagactaataggaaacgagaattacctagactatatgacgtcaatgaaaaggtttaaaaatgaaagtgatccagaaggggcactatggtag

SEQ ID NO: 21792 - RNA, 9879 nt, synthetic construct
  misc_feature 1..9879: note = derived and/or modified CDS sequence (opt6) from DENV-1__GU131717__SS-prME
  source 1..9879: mol_type = other RNA
agtgtaacaatgctgcttatgttaatgccaacagcgcttgcgtttcacttgactacaaggggtggggaaccacatatgatagtatcaaaacaagaaagagggaaaagtcttttattcaaaacgtctgcgggagtgaatatgtgcacccttattgcaatggatctaggagaattttgtgaagataccatgacatacaaatgccccagaataactgaagctgaacctgatgatgtagattgttggtgcaatgctacggacacatgggttacctacggaacctgttcacagacgggtgaacaccgaagagataaacggagtgtggcacttgcgccccacgtaggactaggattagagacgagaacagaaacatggatgtctagcgaaggagcatggaaacaaatccaaagggttgagacatgggctcttagacatccaggatttacagtaattgccttgttcctggctcatgctatcgggacaagcataacgcaaaaaggtataatatttatccttctaatgttagtaacaccttcaatggcgatgaggtgtgtaggaataggttcacgagactttgtggaagggttaagcggtgccacctgggtggacgtagtcttggagcacggaagttgcgtaactactatggcgaaagacaaacccactctagacatagaacttctgaaaacagaagtaacagacccggcagtattgcggaaattatgcatcgaagcgaaaatatccaatacaacaactgactccagatgtccgacgcaaggagaggcgacattagttgaagaacaagatgccaatttcgtgtgtagaagaacttttgttgatagaggatgggggaatggatgtggtttatttggaaaaggcagcttgatgacatgtgcaaaatttaaatgcgttacaaaactggaaggaaagatagtccagtacgaaaacttgaagtactcggtaatagtaactgtgcatacgggagaccaacaccaagttggaaatgaaagcacagaacacgggacgactgcaaccataacaccacaagcaccatcaacagaaatacaattaactgattacggtgcacttacactagattgcagcccgcggactggtctagatttcaatgagatggtactcctgactatgaaggaaaagtcctggcttgtacataaacagtggttccttgatctaccactaccctggacttcaggcgcgtcgacttcacaagagacctggaataggaaagatcttttagtcactttcaaaaccgcacatgcaaagaagcaagaagtagtcgtgttgggatcccaagaaggggcaatgcacacagccttaacaggagccaccgaaatacaaacgtcaggcacaaccacaatctttgctggtcatttgaaatgtagattaaaaatggataagttaacactcaaagggatgtcatatgtcatgtgcactggctcattcaagctagaaaaggaagtagccgaaacacaacatggtacagtattagtccaaataaaatatgaaggtacggacgcgccgtgtaaaatacctttctcaacacaggacgagaaaggagtaacccaaaatggcagattaattactgctaatccaatagtaacagataaagagaaacccgtaaacatagaagctgaaccgccattcggagaatcgtatatcgtcatcggggcaggagagaaaacactaaagttaagttggtttaagaaaggaagtagtatagggaaaatgtttgaagcaactgctagaggagcgaggaggatggcaatacttggcgacacagcatgggactttggatctataggtggagttttcacatccgttggcaagttagtacaccaaatctttggaacggcttacggcgtattattctcaggagtctcttggactatgaaaataggaatcggcgtattgctgacatggctaggactcaatagtcgatcgacgagtttatcgatgacgtgtattgcagtaggacttgtgacgttatacttaggagtcatggttcaagccgacagtggttgtgtaattaactggaaaggacgagagctaaaatgtggatcggggatatttgttaccaatgaggttcatacgtggactgaacaatataagtttcaagcagattcaccaaaacgattgtcagctgccataggaaaggcttgggaagaaggtgtatgcgggattagatcagcgacgagattggagaatataatgtggaaacagataagtaacgaactgaatcatatcctattagagaatgatatgaaattcacagtagtggttggagacgtagctggaattttagctcaaggtaagaaaatgattagacctcagcctatggaatataagtactcatggaaatcatggggaaaagcgaaaattataggagccgatgttcagaatacaacattcattattgacggacctaacactcctgagtgcccagacgaccaaagagcctggaacatttgggaggtagaagattacggttttgggatttttacaactaatatatggctgaagttacgcgactcttacacccaagtatgcgatcatagactaatgagtgcagccataaaagatagcaaggctgttcatgcagatatgggatattggattgagtctgagaaaaatgaaacatggaaactagcacgcgctagctttatagaagtaaaaacgtgcatctggcccaaaagccatactctttggagtaatggtgttcttgaaagcgaaatgattatacccaaaatatacggtggaccgatatctcaacacaattatagacctgggtatttcacacaaacggcaggcccttggcatttaggaaaattagagcttgattttgacttatgtgaaggtaccactgtggtagtagatgaacattgtggaaatcgaggaccttcacttcgaaccacaaccgttactggaaaaataattcatgaatggtgctgcagatcgtgtacactgccccctctacgatttaaaggagaagacggctgctggtatggcatggaaatcagaccggtaaaagaaaaagaagaaaacctagtaaaatcaatggtgtcagcggggagcggcgaggtagactctttttccttaggtttgctgtgcatcagtataatgattgaagaagtaatgagatcgagatggtcgcgcaaaatgctgatgacagggacattagctgttttctttttactaattatgggacaattaacgtggaacgacctaataagattgtgcatcatggtaggggcaaacgcatcagacagaatggggatgggcacgacatacttggcactaatggcaacctttaaaatgcgaccgatgtttgcggtcggactgctatttcgtcgactaaccagcagagaagtcttattgctaacaatcggactaagccttgtggcatcggtagaactaccaaattcactcgaggaactaggggatggactcgcaatggggataatgatactaaaacttttaaccgattttcaatcacatcaactgtgggctacactgttaagcctaacatttattaaaactacattctctttacactacgcatggaaaacaatggctatggtattgtcaatcgtttcactttttccactgtgtctatctaccacatcgcagaaaaccacttggctcccagtcttactgggtagtcttggctgtaagcctcttacgatgttcctaatcgcggagaataagatatggggcagaaaatcatggcctctaaatgaaggaataatggcggtaggcatcgtaagtattctgttaagtgccttactcaaaaatgatgtgccgttagccggtccactaatagctggtggaatgttaatcgcctgttatgtcatttcgggaagctctgcggacctgagccttgaaaaagccgcggaggtgagttgggaagaagaggcagaacactcgggagcctcccataatatcctagtagaggttcaggatgacggtacaatgaaaattaaggacgaagagagagacgacacgctaacaatactcctaaaagcgacgttactagcagtttcaggtgtatacccactatcgatacctgctacactgttcgtatggtacttttggcagaaaaagaaacaaagaagtggtgtattatgggacaccccaagcccaccggaagtagaacgagcagtcttagatgatggaatatatcgtataatgcaaaggggacttttaggtagatctcaagttggtgtaggtgtatttcaagagaacgtttttcataccatgtggcatgttacgagaggcgctgttcttatgcaccagggtaaaaggctagaaccttcttgggcctcagtcaagaaagacttgataagctacggtggaggctggcggctacagggctcgtggaacacaggagaggaggtacaagtgatagcagttgaaccaggtaaaaaccccaaaaatgtacaaactgctccaggaacattcaaaacaagcgaaggagaagttggagctattgcgcttgacttcaaacctggaacatcaggcagccctattgtaaacagagagggaaaaatagtaggattatatggcaacggggtagttaccacatcagggacctatgtttctgcaatagcacaagccaaagcaagtcaagagggcccactcccagaaattgaggatgaggtgtttcggaaacgcaacctcacgattatggatctgcatccgggttctggtaaaaccaggcgctatctcccggcgatagtaagagaggcaataaaacgaaaactacgaacacttattctcgctccaacaagagtagttgcctctgaaatggcagaagccttaaaaggtatgccaatcaggtaccagacaactgctgtaaaatctgaacatacaggcaaagaaatagtcgatttaatgtgccatgccacgtttacgatgagacttttatcacccgtacgagtaccaaattacaacatgataataatggatgaggcacactttacggaccctagttccatcgctgctaggggctatattagcacaagagtcggaatgggtgaagcagcagccatttttatgactgcaacgcccccagggtcagtagaagcattcccacagagcaatgcagtaattcaggacgaagaaagagacattcccgaacggagctggaactcgggatatgaatggatcaccgacttccctggtaaaaccgtctggtttgtgccatcaatcaaatcgggaaacgatatagcaaattgcctaaggaaaaatggaaagcgtgtaattcaactctcgcgtaaaacctttgatactgagtaccaaaagacgaaaaataatgattgggactatgtggtcacaactgatattagtgagatgggtgctaactttagggcagatagagtaattgacccgagacggtgtctaaagcctgtgattttaaaagatggaccagagagagtaatactagctggccctatgccggttactgttgcaagtgccgcacaacgacgagggcgaatcggaagaaatcataataaagaaggagatcaatatatatacatgggacagcccttaaacaatgatgaagatcatgcgcattggacggaagcaaaaatgttactagataatattaatacgccagaaggcataatacctgccttgtttgaaccggaaagagagaagtccgcagccattgacggcgaataccgtcttcgaggcgaagctagaaaaactttcgttgagttgatgagacgtggagaccttccagtgtggctatcgtataaagtagcatcagaaggatttcaatatagtgataggcgatggtgcttcgacggagaaagaaataaccaagtattggaagaaaatatggatgttgaaatatggaccaaggagggagaaagaaagaaactcagacccagatggctagatgcccgtacttattcagatccgctagctctaagagagttcaaggaatttgccgcaggcaggcgatccgttagtggagatctcattttggaaataggtaaactccctcagcacttaacacaacgcgctcaaaatgcacttgataacctggtaatgctgcataactcagaacaaggaggcagagcataccgacatgcaatggaagaattacctgacacaatcgaaacactcatgcttttagccttgatcgcggtactcaccgggggtgttacgttgttctttttatcaggacgagggttgggaaagacatcaatcggactactgtgtgtgatggcatcatcagtgcttctgtggatggcgagcgtagaaccacactggatagcggcttcgataatacttgagttctttttaatggtactacttatacctgaaccggatcgtcaaagaacaccacaagataaccagttggcctatgtcgtaatagggttactttttatgattctaaccgtggcggctaatgaaatgggcttattagaaactacgaagaaagacctaggtatagggcatgtagctgttgaaaatcatcatcatgctgcaatgctagacgtagatcttcacccggcttccgcatggacactatatgctgttgccacgactattataacacccatgatgagacatacaatagaaaatacaaccgctaacatctcgttaaccgccatagctaatcaagccgccatcttaatgggcttggacaaaggatggcccataagtaagatggatattggagtaccacttttggcattggggtgttactctcaagtaaatcctctgacattaacagctgccgtactaatgttggtggctcactatgccataattggacccggacttcaagcgaaagcaaccagagaagcacaaaaacgaacagcggctggaataatgaaaaatccaacagtggacggtatagtagcgattgatctagacccagtggtgtatgatgcaaaatttgaaaaacaacttggacaaataatgttacttattctgtgcacaagtcaaatccttttaatgaggaccacctgggcactgtgtgagtccataactctcgcaacaggacccctgacaactctatgggaagggtcccctggaaaattttggaatactacaatagcagtttctatggctaatatatttcgtggttcatatcttgcaggagcgggtttggcttttagcctaatgaaaagtttaggaggagggcggcgaggtacgggagctcaaggcgaaacactgggtgagaaatggaaacgccaacttaaccaacttagcaaatccgaatttaatacatataagcgttctggaattatggaagtagatagatcggaagccaaagaaggactaaaaagaggagaaaccactaaacacgcggtttcaaggggtacggccaagctaaggtggttcgttgagaggaatttggtgaaacctgaaggaaaggtcatagatttaggctgtggtcgaggcggctggtcttattattgtgcaggactcaaaaaggtaacagaggtaaaaggatacacaaagggagggcccggacacgaagaacctattcccatggccacatacggatggaacttagtaaaactacacagcggcaaagatgtgttcttcataccaccggaaaagtgcgacactctactatgtgacattggagaatcatcgccaaatccaacaatagaagaaggccgaacactacgggttcttaaaatggtcgaaccctggttaagaggaaatcaattttgtatcaaaattttaaatccgtatatgccttctgtagtggagactttagagcagatgcaacgtaaacatggcggtatgctggttagaaatccattgtctaggaactcaacacatgagatgtactgggtttcttgtgggacgggcaatattgttagtgctgtaaatatgacctcacgaatgttactaaatcgttttactatggcacatcgaaagccaacctatgaacgagacgtcgacttgggagcgggcactagacatgtagcggtcgaaccagaggtggcaaatctcgatataataggacagcgaatcgagaatattaaacacgaacacaagtcaacgtggcattatgacgaagacaacccatataagacatgggcgtatcatggaagttatgaagtaaaacccagcggatcagctagcagtatggtgaatggcgtggtaaagctgcttacaaagccctgggatgttatacctatggtaactcaaattgcaatgactgacacaactccgtttggacaacaacgagtttttaaggagaaagttgacactaggacaccaaaagcaaaacgaggtaccgctcagataatggaagttacagcaaagtggctatggggattcctatcaaggaataagaaaccacgtatttgtacaagagaagaatttacacgaaaggtcagaagcaacgcagcaatcggagccgtatttgttgacgaaaaccaatggaatagcgcaaaggaagccgtggaagacgagaggttctgggacttagtacatcgagagcgagaattgcataaacaaggcaaatgtgccacctgtgtttataacatgatgggtaaaagggagaagaaactgggggaatttggtaaagccaaagggtcaagagcaatatggtatatgtggttaggagcacgtttcttggaatttgaagccctaggatttatgaatgaagaccattggttttcccgagagaatagtttgagcggcgttgaaggagaaggtttacataagttaggttatatcttacgcgacatcagcaaaatacctggtggaaatatgtacgctgacgacacggcaggatgggacacccggattaccgaagacgatttacaaaacgaagcaaaaataacagatatcatggagcccgaacatgcgctactcgctaaaagcatatttaaattaacttatcaaaacaaggtcgtacgagtacaaaggccagccaaaaacggaacagttatggacgtaatttcgcgtagagaccaaagaggaagtggacaggttgggacgtacggattaaatacatttacaaatatggaagcacaacttatcagacagatggaatcggaaggaatattcagcccaagcgaactggaaactcctaacttggcggggcgtgttttggattggctagagaagcacggcgtcgagcgccttaaacgtatggctatatcgggagacgactgtgttgttaaaccaattgacgatcgctttgccgctgcattaacggctctcaatgacatgggcaaagttcgcaaggacattccccaatgggaaccatccaaaggttggaatgactggcaacaagttcccttctgtagccatcactttcatcaactcataatgaaagatggtcgagaaatagtcgtcccatgtcgaaaccaggacgaactggtgggacgcgcacgggtgtctcaaggtgcgggatggtcattgcgagagaccgcatgccttggaaaatcttatgcacaaatgtggcagctaatgtatttccacagacgtgatttaagactagcggctaatgccatttgttcagcagtgccggtagattgggtcccgacaagccgaacgacttggtctatacatgcgcatcatcaatggatgacaacagaagacatgttgtcggtctggaacagagtttggattgaagaaaacccttggatggaagataaaactcatataagttcatggggagatgtaccatatctaggtaaaagagaggatcagtggtgcggttcgttgattggactaaccgcaagggctacctgggctaccaatatacaagttgcaattaaccaagtacgtaggttgattgggaatgaaaattacctcgactacatgacttcgatgaaaagatttaaaaacgaaagtgatcccgaaggagctctgtggtaa

SEQ ID NO: 21793 - RNA, 9879 nt, synthetic construct
  misc_feature 1..9879: note = derived and/or modified CDS sequence (opt6) from DENV-1__GU131718__SS-prME
  source 1..9879: mol_type = other RNA
agcgtaactatgctattgatgctcatgcccacagctctagctttccacctaacaactcgtgggggtgaaccacatatgatagttacaaaacaagaaaggggaaaaagtctattattcaaaacaagcgctggcgtgaatatgtgtaccttaatagctatggatcttggtgaattgtgcgaagacacaatgacctataaatgcccgcgcataactgaggcggaacctgatgatgtagattgttggtgtaatgcaacggacacatgggtaacctatggaacatgctcacaaacaggtgaacataggcgtgacaaacgaagcgttgctctagcgccgcatgttggactaggtctagaaactcgaactgagacttggatgagcagtgaaggagcgtggaaacaaattcaaagggttgagacttgggcattgcgtcaccccggatttacggttattgcactattcttagcacatgcgatcggaacatcgatcacacaaaaaggtataatctttattttattaatgctggtaactcccagtatggctatgaggtgtgtgggaattggaagtagagattttgtagaaggcttgtcaggtgcgacgtgggtggacgttgtgctagaacacggtagttgtgtaacaacaatggcgaaagacaaaccaactttagacatagaactattaaaaactgaagtaactaatccggcagttcttagaaaattatgcatagaggctaaaatatccaatactaccacagacagtaggtgtccaacacagggagaggcaaccctaatggaagaacaagatgctaattttgtatgccgtcgtacctttgtagatcgtgggtggggcaatggttgtggactttttggcaaaggttcattaataacatgtgccaaattcaaatgtgtgacgaaattagaaggaaaaatagtgcaatacgaaaatctcaaatattccgtaatagtaacagtccacacgggagatcaacaccaagtaggcaatgaatcaattgagcacggaacaacagctacaattacaccacaagcgcctacatcggaaatacaactgacagattacggtgcgttaactcttgattgtagcccccgaaccggattagatttcaatgaaatggttctactaacaatgaaagagaaatcatggttagtacacaaacaatggtttctagacttacctctaccttggacctcaggagcaagtacatcccaagaaacatggaacagacaagacttacttgttacttttaagactgcacacgccaagaaacaagaggtagtagttctaggaagtcaagaaggagccatgcatactgcgctgacgggtgccacggaaattcaaacatcaggtaccacgacaatcttcgcaggacatttaaagtgtcgtctgaaaatggataaactcacattaaaaggaatgtcatacgtaatgtgcacaggtagtttcaagctagaaaaggaggtggcagagacgcagcacggcactgtactggtgcaaattaagtatgagggaaccgatgcaccatgcaaaataccattcagcacgcaggatgagaaaggtgtcactcaaaacggtcgattaattacagctaatccgattgttatcgacaaggagaagcctgtcaacatagaagctgagccaccttttggcgagagttatatcgttataggagccggagaaaaagcgctgaaattatcatggtttaaaaaggggagctctataggcaaaatgttcgaagccaccgcaagaggggcaaggaggatggcgatacttggtgacactgcttgggattttggcagcatcgggggcgtttttacatctattggtaagttagtacatcaaatctttggaacggcctacggagtcctattcagcggagtgtcgtggacgatgaaaatagggataggagttttactaacatggctgggcctgaacagcagaagtacatcccttagtatgacttgtattgcagttggattggtgactctttatcttggtgtaatggtacaagcggattctggatgtgtaattaattggaaaggcagagagttgaaatgcggaagtggaatattcgtcacaaatgaggtccatacttggaccgaacaatacaagtttcaagcggatagtcccaagagactctcagcggcgatcggtaaagcgtgggaagaaggagtctgtggaataaggagcgccactagactcgagaatatcatgtggaaacaaattagcaacgaattaaaccatatacttctagaaaatgatatgaagtttactgttgtcgtaggagacgttgtcggtattcttgctcaagggaagaaaatgataaggcctcaaccgatggaacataaatacagttggaaaagctggggaaaagctaagatcataggcgccgacgttcagaacaccacgttcataattgacggccccaatacaccggaatgcccggatgatcagagggcttggaatatatgggaagttgaggactacggatttggaatatttacgactaacatttggctcaagatgcgagactcatacacacaagtttgtgaccataggctcatgagtgcagctataaaagacagcaaagctgtacatgctgatatgggatactggatcgaatcagagaaaaatgagacgtggaagttagcgagagcttcctttatagaagtgaaaacctgtatctggccaaaaagccacacgttatggagtaacggggtcctagaaagtgaaatgatcatcccaaaaatctatggcggcccgatctcacaacataactatagacccgggtatttcactcaaacggccggaccgtggcacttaggaaaactagaattagactttgacctatgtgaaggaacaacggtagtagtggacgaacactgcggtaatagagggccttcacttagaacaactactgtcacaggcaaaataattcatgagtggtgttgcagatcttgtactttacctcctttaagatttaaaggtgaagacggttgctggtatggaatggaaatcaggccggtaaaagaaaaagaagagaatctagtgaagtcaatggtatccgcaggtagcggagaagtagattcattctcactgggattattatgcatttcaattatgatcgaggaggtgatgaggagtaggtggagcagaaaaatgctaatgacaggtactttagcagtattcctgctacttataatggggcaactcacatggaatgatttgatacgattatgcattatggtcggcgctaacgcatccgataggatggggatgggtacaacctatttagcactaatggccacttttaaaatgcgtcctatgtttgcagtagggttactctttcgaaggctaacaagcagggaagtcctattactaactataggacttagtctagtagcgtcagtggaattaccaaattccctagaggaattgggagacggactcgcaatggggataatgatcctaaagttacttacggatttccaatcacatcagttatgggcaactttgctatccttgacattcataaagaccacgctaagtttgcattacgcgtggaaaacaatggctatggtattatctatagtaagtcttattcccctgtgtttaagcacgacttcccagaagaccacatggctaccagtactcctcggatcattaggctgcaaacctttaactatgtttttgattgccgaaaataaaatatggggtaggaaaagttggccactaaatgaaggtataatggctgttggagttgtgtcaatattgctctcttcactactcaaaaatgatgtacccctagccggacccctgatagccggaggtatgctaatcgcttgttatgtcatatctggtagttcagcagatttatcattagagaaagcagccgaagtgtcctgggaggaagaagcggaacacagtggcgcatctcataacatcctagttgaagtgcaagacgatggtaccatgaaaataaaggatgaagaacgcgatgatactctaaccatactgctgaaggcaactctcctcgcagtttccggggtatatccattatcaatacctgcaactttgtttgtttggtacttttggcaaaagaagaaacaacgatcaggagttctttgggatactccatcacctccagaagtagaacgagctgtactagatgatgggatttaccggataatgcaaaggggcttgttaggaagaagtcaagtaggtgttggtgtctttcaagaaaatgtatttcataccatgtggcatgtgactcgtggagctgttcttatgtatcaaggaaagagacttgaaccatcctgggcatctgttaagaaagacctaatatcgtatggaggtggatggcgtttacaaggtagctggaatacgggggaagaagtccaagttatcgctgtagaacctggaaagaaccccaaaaatgttcaaacagcaccgggaactttcaagaccccggagggggaagtgggagcaatagcactggattttaaacctgggacttcaggatcgccaatcgtaaatagagaaggtaaaatcgtaggactgtacgggaacggagtcgtaacaacgagtggtacttacgtaagtgcaatagcacaggcaaaagcaagtcaggaaggaccattaccggagattgaggacgaagtgtttcgcaaaagaaatttaaccattatggatttacatccaggaagtgggaaaacgaggcgatatcttccggctatagtacgagaagcgattaaacgtaagttacgaaccctgattctagctccaacacgagtagtcgctagtgaaatggcagaagcactaaaaggaatgcccatacgctatcaaactactgcagtcaaatctgagcatactggaaaagaaatagtagatcttatgtgtcatgctacttttacaatgagactattaagtccggtcagagtcccgaattacaacatgattataatggatgaagcccactttactgacccctcgtcgatagctgctagaggctacatatcaaccagagtcggtatgggagaagcagctgccatctttatgacagcaacaccacccggatcagtcgaagcattcccacaaagcaatgccgtcatccaggatgaagaaagagatataccagagagaagttggaactcaggatatgaatggatcacagacttccctggtaagacagtttggtttgttccatccatcaaaagtggtaatgatatcgcaaattgtttacggaaaaatgggaaaagagttatacaactctcaagaaagactttcgataccgagtaccagaaaactaagaataatgattgggattacgtcgtaacaaccgatatctccgagatgggggcgaacttcagagcagacagagtcattgatcctagacgttgtttgaagcctgttatacttaaagacggccctgaaagagtcatactcgcaggaccgatgccggtgacagtcgcatcagctgcccaacgtaggggtaggataggtaggaatcataataaagagggagaccaatatatatatatgggccaaccactcaataatgacgaagatcatgcgcactggaccgaagcaaagatgctacttgataatatcaacacacccgaaggtattatccccgctctgtttgagcccgagcgagaaaaatcggctgccatagatggcgaatatcgcctacgaggagaggcacggaaaacatttgtggagctaatgagaagaggtgaccttccggtatggttatcatacaaagtagccagtgagggctttcagtactcagacagacggtggtgttttgatggggaaagaaataatcaagtactagaggaaaacatggatgtagaaatttggaccaaagagggagaaagaaagaaattacggccgagatggttagacgccagaacctacagtgatccactcgcactgagggaatttaaagaatttgccgccggaagaagatcagtttcaggagatttaattttagagataggtaagctcccacaacatttaactcagagagcccaaaatgcattagataatctagtgatgttgcacaattccgaacaaggtggacgggcctatcggcatgcaatggaggagcttcctgatactattgagactttaatgttattagcattaatagcagtactaactggcggagtaactttattctttttatcgggaagagggcttgggaaaacctcaatcggactcctgtgcgtcatggcaagcagtgtactcctatggatggcatcagttgagccacattggattgccgccagtataatcctcgaatttttcttaatggtattgttaattcctgaaccggacagacaacggactccccaagataaccaattggcttacgtagtaatcgggttattattcatgattttgactgtagctgcaaatgaaatgggcctactggaaacgaccaagaaagatttgggcattgggcatgttgccgtagagaaccatcaccacgcaactatgttggacgtggaccttcatcctgcatcagcatggactctatacgcagtagccactacgatcataacaccaatgatgcgtcataccatagagaatacgaccgcaaacatttcactgacggcgatagcgaatcaagcggctatcttaatgggattagacaaaggttggcccatctccaaaatggatatcggcgtccctcttttagccctaggttgctattcacaagtaaacccactcaccctaacagcagccgttttaatgttagtggcacactatgcaataataggtcctgggctccaggccaaagcgacccgtgaagcacagaaaaggacagccgccgggatcatgaaaaacccaacagtggatggaatagtcgccatagatctggatccagtagtgtatgatgccaagtttgagaaacagctcggacaaataatgctccttattctatgtacatctcagatcttgttaatgcgcacaacttgggcattatgtgaatcaataacattggcgacaggtccgcttacaacgctgtgggaggggtcaccaggaaaattctggaatactacaatcgcagtgagcatggcaaacatttttcggggatcatatcttgcaggagccgggttagcattctctctaatgaaatcacttggcggaggaagaagaggaactggcgctcagggagagactctcggggaaaagtggaagagacagctcaaccaacttagtaaaagcgaatttaatatatataagcgatcaggaattatggaagtagaccgaagcgaagcgaaagaaggactaaagagaggggaaaccacaaggcatgcagtaagcagaggtacggctaagttgcgatggttcgtagagaggaacttagtaaaaccggaaggtaaagtcatcgatctcgggtgtggaaggggaggttggtcatattattgtgctggactgaaaaaggttacagaagttaaagggtatacgaaagggggaccgggacatgaagaacctatcccaatggccacgtacggttggaacttagtaaaacttcattcaggtaaggatgtattctttacaccacccgaaaaatgtgatacactcctttgcgatatcggagaatcgtcaccaaatcctaccattgaagaaggcaggaccttgcgtgtactgaaaatggtagaaccctggctacgcggaaaccaattttgcattaaaatattaaatccatatatgccctcggtcgtagaaaccttagaacaaatgcaaagaaaacacggaggaatgcttgtgcggaatccactaagcagaaacagtacacatgaaatgtattgggtctcgtgcggcactggaaatattgtaagtgctgtaaatatgaccagtagaatgctattaaatagatttacgatggcacaccgaaagcctacctatgaaaaagatgtggacttaggtgcaggtaccagacatgttgctgtggagccagaggtggcgaacctcgacataattggacaaagaattgaaaacataaaacatgaacataagtcaacatggcactacgacgaagataatccatataaaacctgggcataccacggtagctatgaagtaaaaccttcgggatctgcctcttctatggtcaatggagtagtaaaacttctcacgaaaccttgggatgttataccgatggtaacccaaatcgcaatgacagacacaacaccctttggtcagcagagagtgttcaaagaaaaagtagatactaggactcccaaggcgaaaaggggaacggtgcaaattatggaagttacggcgcgatggctctggggattcctttcccgaaataagaaacccagaatatgcactcgtgaagaatttactagaaaagtacgatcgaatgcagcaataggagctgtttttgttgacgaaaaccaatggaactccgctaaagaagctgtagaagacgaacgattctgggatcttgtcaagaaagaacgagagcttcacaaacaaggaaaatgcgcaacatgcgtttataacatgatgggcaaaagagaaaagaaacttggagagttcggaaaagctaaaggcagtagagcaatttggtatatgtggcttggggctcgattcctggagttcgaggcattaggatttatgaatgaagaccattggttttcgagagaaaactctttatcaggggttgaaggagagggtttgcataaattaggatatatattaagagatataagtaaaataccaggtggaaatatgtacgctgacgataccgccggttgggacaccaggattaccgaagatgaccttcaaaatgaggcaaagatcacagacataatggagcctgaacatgcgctattggcgacaagcatttttaaattaacatatcagaataaagtagtcagggtccagaggcctgccaaaaatggcacggtaatggatgtaataagcagacgagaccagagaggaagtggccaagtaggcacatatgggctaaacacatttactaacatggaggcacaactaatacgtcaaatggagtcggaaggaatctttctacctagtgaattggaaacacccaatttagcagaacgtgtattagattggctggaaaaatacggagtagaacgacttaaaagaatggcaatatcaggggatgattgtgttgtcaaacctatagatgatcgctttgccactgcgcttacagcgttaaacgatatgggaaaagtgcgaaaagacattccgcaatgggaacctagcaaaggttggaatgattggcaacaagtaccgttttgctcacatcattttcatcaacttataatgaaagacggaagggaaatagtcgtaccttgtagaaaccaagacgaattggtggggagagctcgagtttctcaaggcgctggatggtcactaagggagacagcatgcctagggaaatcatatgcgcaaatgtggcaactgatgtacttccacagaagagacctacgactagccgcaaatgcaatttgttcagcggttccggtggattgggtacctacaagccgcacaacatggtccattcacgcacatcatcaatggatgaccaccgaagatatgttaagtgtgtggaatagagtttggatagaagaaaacccgtggatggaggacaagactcacgtttcatcttggggagatgtaccatacttagggaaaagagaagatcaatggtgtggaagcctaataggattaacggctagggccacatgggctagcaatatacaagtggctataaatcaagtaagaagattaatagggaacgaaaattacttagattatatgacgtccatgaaaaggtttaagaacgaaggagatcctgaaggggcgttgtggtag

SEQ ID NO: 21794 - RNA, 9879 nt, synthetic construct
  misc_feature 1..9879: note = derived and/or modified CDS sequence (opt6) from DENV-1__GU131720__SS-prME
  source 1..9879: mol_type = other RNA
agtgtaacaatgctattaatgcttatgcccactgcactggcttttcacttaacaactagaggtggagaaccccacatgattgtcactaagcaagaacggggaaagtcactattgtttaaaacttcagctggagtcaatatgtgcacactgattgctatggatttaggggaactatgcgaagatacgatgacttacaagtgtccacgaataacggaggccgaaccggatgacgtagattgctggtgtaatgcaacagatacctgggtaacctatggaacctgcagccaaacaggggaacaccgtagagacaaacggagtgttgcactcgcccctcatgttggtctaggactagaaacacgtacagagacttggatgtcgtcagaaggtgcatggaagcaaatacagagagtagaaacatgggctctacgacatccaggcttcactgtgattgcactattcctggcccatgcaataggtacatcaataacacaaaaaggcattatatttatactcttaatgctagtaacaccctcgatggctatgcggtgcgtgggcattggatccagagattttgtagaaggactcagcggtgcaacgtgggtggatgttgtcttagaacatggatcatgtgtaacaaccatggctaaagataaacctactttggacatagaactgctcaaaacagaagtaacaaatcctgcagttctacgtaaattatgtatagaggctaagatatcaaatacaacaacagacagtagatgcccaacacaaggggaagcaacgctaatggaagaacaagatgctaacttcgtttgcagaaggacattcgtagacagaggatggggtaacggctgtggattattcggaaagggatctttaataacatgcgccaaatttaaatgcgtaacaaaattagaaggcaagatcgtccaatacgagaacttaaaatattcagttattgtaacagtacacacgggggaccaacatcaagtaggcaatgaaagcactgaacatggcactaccgctacaataacccctcaagcaccgacttcagaaatacaacttaccgattatggtgccttaactctagactgctcacctagaactggtttagattttaacgaaatggtattgttaactatgaaagaaaaatcctggttagtccacaaacagtggttcttagatctcccgttgccctggaccagtggagcgagtacttcacaagaaacatggaatcgccaggatctgttagtgacttttaaaaccgcccatgcaaagaaacaagaagttgtagtgttggggagccaggaaggtgcaatgcatactgcattgacaggagcaacggagatacaaacgtctgggactacgacaatttttgctggacatttaaaatgtcgtttgaagatggacaaattgaccctaaaggggatgagttatgtgatgtgcactggtagctttaaactagagaaagaagtggcagaaacccagcatggaacagtcttggtacagattaaatatgaagggacagacgcaccttgcaagataccattcagcacacaggacgaaaaaggagtaacacagaatgggagattaatcacagcaaatcctatagtgacagacaaggaaaagcctgtaaatatcgaagcagaaccacccttcggagagtcgtatatcgtaatcggggctggcgaaaaagctctaaagttatcttggtttaagaaaggctcatccattggaaagatgtttgaggctacagcacgcggagctcgtagaatggcgatactcggtgacaccgcctgggacttcggatctgtaggtggggtttttacctcagtagggaagctagtgcaccaaatattcggaactgcttacggggttctattcagtggagtttcgtggaccatgaagataggaattggagttctattgacatggcttggtctaaattcgagaagcacgagtctgagtatgacatgtattgctgttggtctagtgaccctgtatctaggggtaatggtacaggccgatagtgggtgcgttataaactggaaaggtcgtgaattgaaatgtggatcaggaatttttgtgaccaatgaagtacatacgtggacagaacaatacaagtttcaagctgatagcccaaaaagattatccgcagccataggaaaagcatgggaagaaggtgtatgtggtatacggagtgccactcgtctagaaaacatcatgtggaaacaaataagtaatgaattaaaccatattctgcttgaaaacgatatgaaatttacagtggttgttggcgatgtcgttggaattttggcacaaggaaagaaaatgataagaccgcagcctatggaacataagtacagttggaaaagctggggtaaagcaaaaattattggagcggacgtgcaaaacaccaccttcataatagatggtccaaatactccggagtgccctgatgatcaacgagcctggaatatctgggaggttgaagattacggcttcggaatttttgccactaatatttggttaaaattgagagattcttatacacaagtttgcgatcatagattaatgtccgctgcaattaaagacagtaaggcagtacacgcggatatgggttattggatagaatcagagaaaaatgagacctggaagttggctcgagcttcgttcatagaagtaaagacatgtatttggccgaaatcacacactttatggtccaatggagtgttggaatctgagatgatcatcccaaaaatctatgggggaccgattagtcagcataactataggccaggttattttacgcaaacagcaggcccctggcacctaggaaaactcgaattagattttgacctctgcgagggaactacagtagtcgtagatgaacattgcggaaatcgcgggccaagtctccggaccacaactgtcaccggtaagattattcacgaatggtgttgtagaagctgcacattacccccattgagatttaagggagaagatggatgctggtatggcatggaaatcagaccagtaaaagaaaaagaggaaaacctagttaaaagtatggtatcagcaggttcgggtgaggtagattcattttctttaggactattatgtatctcgataatgatcgaagaagtaatgcgatctaggtggagccgaaaaatgttaatgacaggcacacttgcagtgtttctgctgttaatcatgggacagctcacatggaatgatcttatccgcctatgcattatggtcggagcaaatgctagcgatagaatgggtatgggaactacctacttggccctaatggcaacttttaagatgaggcctatgtttgcagttggcctactatttagaagactgacaagtagggaagttctcttattgacaataggtctcagtttagttgcttccgtagaactacctaattcactggaagaactaggtgatggattagcaatgggaatcatgatattgaaactacttacagattttcaatcccaccaattatgggcgacacttttatcactaacgtttataaaaacaacgttgagcctccattatgcttggaagacaatggctatggttttatctattgtatctctatttccactatgtcttagcactacgagccagaaaacaacatggttgcctgtattgctaggatcttttggatgtaaacctcttacaatgtttctcattacagaaaacaagatctggggcaggaaatcatggccactaaacgaaggaatcatggctgttggagtagtttcaatccttctatcatccttattgaagaacgatgtaccgttggctggacctcttattgcagggggtatgttaattgcatgctacgtaatatcaggttcatccgctgatctcagcctagaaaaagcagccgaagtctcttgggaagaggaagctgaacatagcggcgcaagccataacatattagtagaagtgcaggacgatggcactatgaaaataaaggacgaagaacgagatgatactttaaccatactcctcaaagctacgctgcttgcagttagtggtgtatatccactatcgatcccggctactctttttgtttggtacttctggcaaaagaagaagcagcgaagtggtgttttatgggatactcccagtccaccagaagtagagagagctgtcttagatgatggtatatatagaattatgcaaagaggattgctaggaagaagccaagttggagtaggcgtatttcaagaaaacgtatttcatactatgtggcatgtgactagaggcgcggtactgatgtatcagggaaagcgattagaaccgtcctgggcgtctgtaaagaaagacctaatttcctatggaggtggatggaggttacaaggatcatggaacactggggaagaagtgcaagtaatagccgttgaacccggtaaaaacccgaaaaacgttcaaacggccccagggacatttaagactccagagggagaagttggagccatagcattggactttaagccggggacgtcaggatcacccattgtgaacagggaaggaaaaattgtggggctgtatggtaacggcgtcgtgacaacaagcggtacctatgtcagcgctatcgcacaggcaaaagcctctcaagaaggaccgttaccagaaattgaagatgaagtctttcgaaagagaaatttaactattatggacttacaccctggaagcggcaaaacccgaagatatttaccagcaatagttagagaagcaataaagaggaaattgcgaacattgatactcgctccaacgagagtagttgcgagtgaaatggctgaagcacttaagggaatgcctattagatatcaaactactgctgtgaaaagcgaacatactggcaaggaaatagtggacttaatgtgtcacgctacgttcactatgcgtctactttcgccagtacgagttccgaattacaatatgataatcatggatgaagcgcattttactgatccttctagtatagcagcaagagggtacataagcacacgagtaggaatgggggaagctgcagccatatttatgaccgctacacctcctggttctgtggaagcatttccacagtctaatgcagtgatacaagatgaggaacgcgatatcccagaacgatcttggaacagtggatatgaatggatcacagattttccaggaaaaacggtatggttcgtacccagcataaaatctggaaatgacatagctaattgtttgaggaagaacggcaaaagagtaatacaacttagtcgcaaaacgtttgacaccgaataccagaagaccaaaaataatgattgggactacgtggttacaactgacatatcagaaatgggagctaacttccgagctgatagggtcatagatccacgccgctgccttaaaccagttatcctaaaggacggcccggaacgcgttatattggcaggaccaatgcctgtaacagtagcttcagcggcccaaagaagaggcaggattggaagaaatcataataaagaaggagatcaatatatttatatgggtcaacctctaaataatgatgaagaccacgcgcactggacagaagccaaaatgctattagataacattaatactccagaaggtataatacccgcactattcgagccagaaagggaaaagagcgccgccatagatggtgaatatagattgcggggtgaggcaaggaagacgtttgttgaattaatgcgaagaggggacctcccagtttggttaagttataaagtagcgagtgaaggattccaatattcagaccgcagatggtgttttgacggggagagaaacaaccaagtactcgaagaaaatatggatgttgaaatatggacaaaagaaggcgaacgcaagaaactacggccccgttggttagacgcaagaacgtattcagaccccctagctctgagagaatttaaagaatttgcggcaggacgaaggtcagtaagcggagaccttatcttagaaataggtaaactgccacaacatctcactcaaagggcacaaaatgcattagataacctcgtcatgcttcacaattcggaacaaggcggtagggcttaccgacacgcaatggaggaattaccggataccattgaaacattgatgttactggcactgatagcagtcttaactggcggagttacgctattctttttatctggacgcggcctaggtaagacaagcataggcctattatgtgtgatggcatcttcggtccttctttggatggcaagcgttgaaccccactggatagctgcatcgataattttagagttctttctaatggtactactaattccagaacctgatagacaacgaacacctcaagataatcaactagcatatgtggttatcggtttactgtttatgatacttactgtagcggcgaacgagatggggttgttggagactacaaagaaagatctaggaattggacatgtagctgttgagaatcatcaccatgcaactatgcttgacgtcgatctccacccggccagtgcatggacactatacgccgtagctactactatcatcacgcctatgatgcgtcacaccatcgaaaacacaacagccaacatatctctaactgcgattgcaaatcaggcagcaatactaatggggttagataaaggttggcctatatctaagatggacataggagtaccattgttagccttggggtgttattcccaagtgaacccgttgactttgaccgctgccgtactaatgcttgtagcacattacgcaattattggtccagggctccaagcaaaggcgacacgagaggctcaaaaacgaactgcagcagggataatgaagaaccccacagtggacgggatcgttgcaatagatttagaccccgtcgtctatgacgcaaaattcgaaaaacagcttggacaaattatgttactgatattatgcacctcacaaattctactaatgcgaaccacatgggcgctttgcgaaagcataacactcgccacgggccccttaacgaccttatgggaaggttccccaggtaagttttggaatacgacaatagctgtaagcatggcaaatatttttagaggaagctatttagcaggagcaggactagcgtttagtttaatgaaatcattaggaggtggtagaagaggaaccggcgcacaaggagagacactcggagaaaagtggaaaagacaattgaaccaactatcaaaatcggaatttaatatttataagagaagcgggatcatggaagtagaccgatctgaagctaaagagggtcttaaacgtggagaaacaacacgacatgcagtatcacgtggcactgcgaaacttcggtggtttgtagaaagaaatttagtaaagccagaagggaaagttatcgatcttggatgcggtagaggaggatggagttactattgtgccggactgaagaaggttacagaagtcaaaggatacaccaagggtggaccggggcacgaggaaccgatcccaatggcaacttatggatggaacctagttaaactacatagtggtaaggacgtcttctttactccccctgaaaaatgtgatacgctgctatgtgatataggtgaatcatcaccgaatcctaccatagaagaaggacgaacattacgagttttaaaaatggtagagccatggttaagaggtaatcaattttgcataaaaatcctcaacccctatatgcctagcgtagtcgagacactagaacaaatgcaaagaaaacatggcggcatgttagtgagaaatccccttagtcgaaactctacacacgaaatgtactgggtatcatgtggtacgggtaacatagtgtccgcagttaacatgacctctcgaatgttattaaaccgatttactatggctcatcgtaaaccgacatatgagagagatgtagacttaggggcgggaaccaggcatgtggcggtcgagcctgaggtcgcaaatttagatataattggacagcgaatcgaaaacatcaaacacgaacataaatcaacatggcactatgacgaagataacccatacaaaacctgggcatatcacgggagttatgaagtaaagccttccgggtccgcgagtagcatggtaaatggtgtagttaaattattaacgaaaccttgggacgtaattcccatggttacgcagattgcaatgaccgatacaactccgttcggtcaacaaagggtatttaaggaaaaagtagacactcgaactccaaaagcaaaacgtggcaccgcacaaattatggaagtaacggcccgatggctgtggggtttcctcagtagaaataagaagccaaggatctgtacaagggaggagtttactcgcaaagtaagatctaatgcagcaatcggcgcagtgtttgttgatgagaatcaatggaatagcgctaaggaagcagttgaagatgaacgattttgggacctggttcagaaagaacgagaactacataaacagggtaagtgtgcgacttgtgtgtataacatgatgggtaaaagagaaaagaagttgggtgagttcggtaaagcaaaaggatctcgggcaatttggtatatgtggctaggagcgaggttcttagaatttgaagcgcttggttttatgaacgaggatcactggtttagcagggaaaatagtcttagtggagttgaaggagaaggtctacataaattaggatatatattacgagacatttcaaagatacctggcgggaacatgtatgcagatgacacggcaggatgggacacacgtatcactgaggatgatcttcaaaatgaagcgaaaataacagatataatgaagccggagcatgctctgttagcaacgtcaatatttaagttaacatatcaaaataaagttgttcgggtccagaggccagctaaaaatgggactgtaatggatgttatctcccgaagagatcaaaggggatcaggtcaagtggggacgtatggtttaaatacatttactaatatggaagcccagttaataaggcaaatggaatcagagggtatatttttgccgtcggaattagaaacaccgaacctagctgaaagagtcttagattggttagagaaatacggtgttgaaagattaaagcgaatggcaattagtggtgatgattgcgtcgttaagcccattgatgaccgtttcgcaaccgctttgacagctctgaacgacatgggtaaagttcgaaaggatatccctcaatgggaaccctcgaaaggatggaacgattggcagcaagttcccttctgtagccaccacttccatcaactaataatgaaagatggaagagaaatcgtagtaccctgtcgaaatcaggatgagctagtgggacgagcacgagtctcacagggcgcaggttggtcattacgagaaactgcttgcttaggcaaatcctacgcccaaatgtggcaactaatgtattttcacaggagggatttacgacttgcggctaacgctatatgcagcgcagttccgattgactgggtcccaacgtctagaaccacatggtctatacatgcccaccatcagtggatgacgacggaagatatgttatcagtatggaaccgtgtatggatagaagaaaatccttggatggaagataaaacgcacgtatcgtcatggggagatgtcccgtacctagggaaaagagaagatcagtggtgtggatccttaataggactaactgctcgagcgacatgggcatcaaatatccaagtggcgataaaccaagttcgaagactgatagggaatgaaaattatctagactatatgacaagtatgaagagattcaaaaatgaaggagaccctgaaggcgcgctatggtaa

SEQ ID NO: 21795 - RNA, 9879 nt, synthetic construct
  misc_feature 1..9879: note = derived and/or modified CDS sequence (opt6) from DENV-1__HM181960__SS-prME
  source 1..9879: mol_type = other RNA
tcggttacaatgttgctcatgttgatgccaaccgcgcttgcttttcatcttacaacacgagggggagaaccacatatgatcgtatctaaacaagaacggggtaaatcgcttctatttaaaacttcagcaggagtaaatatgtgcactctaatagcaatggacttaggtgaactatgcgaagatactatgacctacaaatgtccaagaataacggagacagagccagatgatgtagactgttggtgtaatgcaactgacacttgggtaacgtatggaacgtgtagtcaaacaggcgaacacaggcgcgacaaaagaagtgtagcacttgcaccacatgtagggttaggattagaaactagaactgagacctggatgagttccgaaggagcgtggaaacaaatacaacgagtagaaacatgggctctacgacatcctggattcactgtaattgcgctctttttggcacatgcgatcggcacatcaatcacacaaaagggaataattttcatcctcctaatgctagtaaccccatctatggccatgcgatgtgtaggcataggttcacgcgatttcgttgagggacttagtggagctacgtgggtagacgttgtacttgaacacggctcctgcgttacgactatggcaaaagataagccaacgctagatatagagctattaaaaactgaagtcacaaacccagcggtcctaagaaaattatgtatagaagctaaaataagcaatactactacagatagtagatgccccacacaaggtgaggcaaccttagtagaagaacaagatgcaaattttgtatgtagaagaacctttgtcgatagaggatgggggaacggctgcggactgtttggaaaaggtagtttgatcacatgtgctaaatttaaatgtgtgacaaaattagagggaaagattgttcaatatgaaaacctaaaatacagtgtaattgtcactgtacatacaggagatcaacatcaagtgggtaatgagtcaactgaacacggtaccacagcaacaataacgccacaagctcccacaacagaaattcaacttactgactatggcgctttaacactagactgcagtcctcggactggacttgacttcaatgaaatggttcttctgacaatgaaggaaaagtcatggttagtacataagcaatggttcttggatctcccgctaccatggacatcaggagcatccacgagtcaagagacatggaatcgccaagatttattagtaacattcaaaaccgcgcatgcaaagaaacaagaagtggtagtcttaggatcacaagaaggtgcaatgcacacagctttaaccggcgcaacagaaatccaaaccagtggcacaacaaccatattcgctggccacttaaaatgtcgactaaaaatggataaactaacattgaaaggaatgagttacgtgatgtgcaccggatcattcaaactagaaaaagaggtggcagaaactcaacacggcaccgtcttggtgcaaattaaatacgaaggcaccgatgcaccttgcaaaatcccattcagcactcaggacgaaaagggagtaacccaaaatggtagattgataacggctaaccctatagtgaccgacaaagaaaaaccggtaaatatcgaagccgagcctcctttcggcgaatcatatatagttatcggagccggtgaaaaggcactcaagctaagttggttcaaaaagggatcgagtataggaaagatgttcgaggcaaccgcaagaggagcacgaagaatggcaatacttggtgacacagcgtgggactttggatcgatcggcggagtgttcacaagcgtcgggaagctcgtacatcaaatcttcggaaccgcctatggagtgttattcagcggtgttagttggacgatgaaaataggaattggagtattattaacatggttgggactgaactcacgaagtacgagtcttagcatgacatgtatagctgtaggattggtgaccctttaccttggcgttatggtacaagcagacagcggatgtgttataaattggaaaggccgagagttaaagtgtggatcaggtatattcgtcacaaacgaagttcatacttggactgaacagtataaattccaagcagattctccaaaaagattaagcgctgccataggcaaagcatgggaagagggagtatgcggtattcgatctgcgactcgactagaaaacatcatgtggaaacagatctcaaatgagctaaatcacatattattagaaaatgatatgaaatttaccgtagtagtcggagatgtcgcgggcattctcgcccaaggtaaaaagatgattcgaccgcaacccatggagtacaaatactcctggaaaagttgggggaaagcaaaaataatcggcgcggatgttcaaaatacaacttttatcatcgacggcccgaacacaccggaatgtccagatgatcaacgagcctggaatatttgggaagtggaagattatggtttcggaatatttactacgaatatatggttaaaactacgcgatagctacacgcaggtctgtgatcacaggctaatgagcgcagcaataaaagactcgaaagcagttcacgcagatatgggctattggattgagagcgaaaagaacgagacctggaaattagctcgtgccagctttatagaagtcaagacgtgtatatggccgaaatcacatacattgtggagtaacggagtactagagtcagaaatgataataccaaaaatatacgggggtcctatctcgcaacataactacagacctggatattttacccaaacggcaggaccgtggcatttaggaaaacttgaattagattttgatttatgtgaagggacaacagtagttgttgatgaacattgtggaaacagaggacccagtttaaggactactaccgtcaccggtaaaattatccacgagtggtgttgtcggagttgcactctcccaccactaagatttagaggagaagacggatgctggtacggaatggaaataagacccgtgaaagaaaaagaagaaaacctagtaaaatcaatggtatcggctggatccggagaagtggattcctttagtcttggactgctttgtatcagtattatgatagaagaggtaatgagaagccgatggtctagaaaaatgctcatgacgggtacgctggctgtgttctttcttttaataatgggccagttgacttggaacgatctaatacggctatgtatcatggttggggcaaatgcaagcgaccgtatgggaatgggaacgacttatttggcactgatggccactttcaagatgcgaccaatgtttgctgttggccttctattccgcagacttacaagccgcgaagttctattactaactataggattatctctcgtagcatcagttgaactaccaaactctctcgaagaacttggcgatggattagccatgggcataatgattctaaagttgctgacagactttcaaagccatcaactatgggcaacattattaagtttgacatttatcaagacaaccttttcccttcattatgcgtggaaaactatggcaatggtcctctcgattgttagcttattcccgctatgccttagcacaacatctcaaaagacaacttggcttcctgtccttcttggatcattaggatgcaaaccacttaccatgtttctaatagcagagaataagatctggggtagaagatcgtggcccctaaacgagggaataatggctgttggcattgtatctatactgttatcgagtcttttaaagaatgatgttcctttagcgggaccgctaattgctggtggtatgcttatagcatgttatgtcatcagtggttctagcgccgacctatcgttggaaaaagcggcagaggtgagttgggaagaagaagcggaacactctggggctagtcacaacatattagtagaggttcaagacgacggcaccatgaaaatcaaagatgaagaacgcgatgatacactaactatactcttaaaggcaacattattagccgtatccggtgtgtatccgttgtcaattccagctacattatttgtttggtacttctggcagaagaagaaacagcgttccggagtattgtgggacacaccctctccacccgaagtaggcagagcagtattagacgacgggatttatcgtattatgcaaagaggcttactaggcagaagtcaggtcggcgtaggtgtatttcaagaaaatgtctttcatacaatgtggcacgtaacgcgaggagcggttctcatgtatcagggcaaaagactcgaaccaagctgggcatccgttaagaaagacttaataagttatggaggtggatggcgactgcaaggatcatggaatacaggtgaagaggtccaagttatagctgttgaaccagggaagaaccccaaaaatgtacaaacggcgccaggcacgttcaaaactccagaaggggaagtaggagcaatagctctcgactttaagccaggaacgagtggatctcctatagtaaatagggaaggaaagattgtaggactttacggaaatggtgttgtcaccacctcggggacttatgtgtcagccatagcacaggctaaagcgtctcaagaaggtccattgcctgaaatagaagatgaagtattcagaaaaaggaatttaacaattatggatttacacccaggttcaggaaaaacacggaggtacttaccagctatcgtgagagaagcaataaagagaaaattacgtacattaatcctggctccaactagagtagttgcatccgaaatggcggaagcgctcaaggggatgccaatacggtatcaaacaacagcagtaaaatcagagcatacaggtaaagaaatcgttgatctaatgtgccacgcaaccttcacaatgagactcttatcaccagtacgagttcccaattataatatgatcattatggatgaagctcatttcacagatccatcttcaatagcggctaggggttacataagtactagggtaggaatgggagaagctgcggctatattcatgacggcaacgccaccaggcagtgtggaagccttcccacaatctaatgcagtaatacaggacgaagaaagggatataccagaaaggagttggaactcaggttacgaatggattacagactttccggggaaaacagtatggttcgtaccatcaataaaaagtggaaacgacattgcaaactgtttgaggaaaaatggtaaaagggtaatccaactgtcgagaaaaacctttgatacagaatatcagaaaacgaaaaacaacgactgggattacgtagttaccactgatataagtgaaatgggagcaaattttagggcagatagggtgatagacccaagacgctgtctaaagcctgttattctgaaagacggccctgaacgcgtaatcctagcaggcccaatgcccgtaacagttgcttcagcagcgcaaaggaggggcagaatcggaagaaaccacaacaaagaaggcgaccaatatatctacatgggacaacccctaaataacgatgaagatcatgcccactggactgaagctaagatgctcctagataacataaatactccagaagggatcatccccgcattattcgaacctgaaagggaaaaatcagcagcgatagatggggagtatcgattgaggggagaagctcgtaaaacattcgtagagttaatgagacgaggagatcttcctgtttggttatcgtataaggtcgcatcggaaggatttcaatactcagacagacgatggtgtttcgacggagaacgcaataatcaagttttagaggaaaatatggacgtcgagatatggactaaagaaggtgaaagaaagaaacttaggccccggtggttagatgcaaggacttacagtgatccgttagccctaagagaatttaaggagttcgccgctggacggcgatctgtaagtggcgatctaatcctagaaataggcaagttgcctcaacacctaacccaaagggcacagaacgcgctcgataatctagtcatgttacataacagcgaacaaggaggtagagcgtataggcatgcaatggaagaattgcctgatactatagagactttaatgcttctggcattaatcgcagtcttaaccggcggtgtgaccctcttctttttaagtgggcgcggcttgggaaaaacaagcatcgggctattatgtgtcatggcgtctagtgttttgctctggatggcttcagttgaacctcattggatagcagcctctataatactcgagttctttctgatggttctactcataccagaaccggataggcaacgtacaccgcaggataatcaattggcatatgtagttattgggttactttttatgattttgactgttgccgcaaacgagatgggtctacttgaaacaaccaagaaagacttaggaataggacacgtggcagtagagaaccatcatcacgctgcgatgctggatgtagacttacatcccgctagtgcgtggacattgtatgcagtggcgacgactataataacaccaatgatgagacataccatagaaaatactaccgctaatatttccttgaccgcaatagcaaatcaagcagctatccttatgggtctagataaaggctggcctatctcaaaaatggatataggtgtccctctactagcgctcgggtgttactcccaagtaaatcccttaactctaactgccgcggtattgatgttagttgcccactatgctattataggacctggcttacaagcaaaagcaacacgggaagcacaaaaacgaacagccgccggaataatgaaaaacccaactgtagatggcattgtggctatcgatctagatccagtagtttatgacgctaaatttgagaagcaattgggacaaataatgctattgatcctgtgtactagccaaatactcttaatgagaactacgtgggctctatgcgaatcaattactttagctactggaccgctaacaacattatgggaagggtctcctggaaaattttggaacacgacaatagcagtttcaatggcgaatatttttcgaggatcctacctcgcaggagcgggtttagctttttctcttatgaagagtctcggaggagggcgacgaggaacgggggcgcaaggtgaaacgcttggtgaaaagtggaaacgacagttaaatcaattatccaagtctgaatttaacacttataaaagatctggtataatggaggtggatagatcagaagcaaaagaaggactaaaaagaggggaaactaccaaacacgcagtaagcagaggcaccgctaagttaaggtggttcgttgaaagaaatttagtcaagccggagggacgggtcattgacctaggatgtgggcgtggcggttggtcttattattgcgcaggtctaaagaaagttaccgaagttaaaggatacacaaaaggaggaccaggacacgaggaacccataccgatggcgacctatgggtggaatcttgtaaaactacactctggaaaggatgtcttctttatcccaccagaaaaatgtgatactttattgtgtgacataggagaaagttcacctaatccaacaatagaggaaggccgcacactaagagtgcttaaaatggtggaaccatggcttaggggtaatcagttttgtatcaaaattttaaacccgtacatgccatccgtggtcgagactctagaacaaatgcaaagaaaacatggtgggatgttagttaggaaccctttatctcgtaatagcactcatgagatgtactgggttagttgtggaactggcaatatagtttcagccgttaacatgacgtcaaggatgctactaaatagatttacaatggcccacaggaaacccacgtacgaacgagacgtagatttaggtgcaggtacgaggcatgtagccgtagaacctgaagtagctaacttagatataataggtcagaggatagagaatataaagcacgaacataaatccacatggcactacgatgaggacaatccttataaaacatgggcatatcacgggtcttatgaagttaaaccatcaggtagtgcaagcagtatggtcaacggagttgtaaaattactaactaaaccatgggacgtgattccaatggtgacacaaatagccatgactgatactaccccgtttggacaacaacgtgtatttaaagaaaaagtagatacccgaacgccgaaagctaaacgtggtacagctcaaataatggaagtaactgccaagtggttgtggggatttttaagccgtaacaagaaaccacgcatatgtacgcgagaggaatttactagaaaagtgcgatcaaatgctgctatcggagccgtatttgttgatgaaaatcaatggaatagtgccaaagaggcagtagaagacgaaaggttctgggatttagttcacagagaaagggaacttcacaaacagggtaaatgcgcaacgtgtgtttataacatgatgggaaaaagagagaagaaattgggtgagttcggaaaagccaaaggcagtagggcaatttggtatatgtggttaggcgcgagattcctagaatttgaagcccttggatttatgaacgaggaccattggttctctagagaaaactcactaagcggagtcgaaggcgaaggccttcataaattagggtacattttaagagatatatcaaaaatcccaggtgggaatatgtacgccgacgatacagccggttgggatactcgcattacagaagatgacctacagaatgaagcacgaataaccgatattatggaacccgaacatgctcttttagctaaatctatatttaagttaacttaccaaaataaagtagtacgtgtccaacgtccagctaagaatggtactgttatggatgttatttcccgcagggatcaaagaggtagtggccaggtaggaacttatggactaaatactttcacaaacatggaagcccaattgataagacagatggaatccgaaggaatcttcagtcctagcgaattggaaactccaaacttggcagaaagagtgctagactggttggaaaaatacggggtcgaacgactcaaaaggatggctatcagtggagatgattgtgtggttaagccaatagacgatagattcgccacagcgctaacggcgttaaacgatatgggtaaggtccgaaaagacatcccacaatgggagccaagcaagggatggaacgattggcaacaagtacctttctgctcgcatcatttccatcaacttattatgaaagacggacgagagattgtcgttccatgtagaaatcaggacgagttagtaggtagagctagagtcagccaaggcgcaggttggtcacttcgcgaaactgcctgtttaggaaaatcatacgctcaaatgtggcaattgatgtactttcacagaagagacttaagattggcagccaatgcaatatgttcagcagtacctgtagactggattcccacctccagaaccacatggtccatccatgctcatcaccagtggatgacaacagaagacatgctctcagtctggaatagagtatggatcgaagaaaatccgtggatggaggataaaacccacatttcatcatggggcgatgttccatacttgggcaagcgggaggatcaatggtgcggttcacttattggattgacagctagggctacatgggctaccaacatacaagtggcaataaatcaagtaaggaggttaattggcaacgagaactacctagattatatgacgtcaatgaagagattcaaaaatgagagcgatccagaaggagcgttatggtga

SEQ ID NO: 21796 - RNA, 9879 nt, synthetic construct
  misc_feature 1..9879: note = derived and/or modified CDS sequence (opt6) from DENV-1__HM181963__SS-prME
  source 1..9879: mol_type = other RNA
agcgtcactatgcttcttatgttgatgcccactgcgctggcgtttcatctcactacgcgaggtggtgaaccacatatgatcgtaagtaaacaagaacgggggaagtccttactatttaaaacttcagctggagttaatatgtgtacacttattgctatggatctaggagaattttgcgaagacaccatgacttacaaatgcccgcgcattacggaggctgagcctgatgacgtggattgttggtgcaatgcaactgacacgtgggtgacttacgggacttgtagccaaattggagaacatcgaagggacaagagatcagtagcgctcgcacctcatgtgggacttggactagaaacaagaacagaaacttggatgagctccgaaggagcatggaaacaaatccaacgggtggaaacatgggcacttcggcaccctggattcacggtaattgcactttttcttgcacatgctataggaacgagcataacccaaaaagggatcatttttatattactaatgttagtaacaccctctatggcaatgaggtgcgtaggaatcggatcacgtgattttgtagaaggtctttcaggggctacttgggttgacgttgtactcgaacacggatcatgtgtcacaaccatggctaaagataaaccaaccttggatatagagctgctaaaaaccgaagtgacaaatccagctgtattaagaaaactatgtatagaagctaagatatcaaatacgactactgattcacgatgtccaacacaaggagaagctaccctagtagaggaacaagatgcgaattttgtctgtcgtaggacattcgtagatagaggatggggaaatggttgcggtttatttggaaagggatcgttaattacatgcgcaaagtttaaatgcgtcacaaaactagagggcaaaatcgttcagtatgaaaatttaaaatattcagtaatagtcacagtccatactggagatcaacatcaggttggcaatgaaagtacagaacatgggactactgcgacaatcacaccccaggctccaagtaccgaaatacagcttacagactatggtgcactaactctagattgttctcccaggaccggcttggatttcaatgagatggttttactgacaatgaaggagaaatcgtggcttgtgcataaacaatggttcttagatctaccactaccctggacaagtggagcaagtactagccaagaaacttggaatcggcaagatttattagtaacatttaaaaccgctcacgcaaagaaacaagaagtcgtcgttctgggttcgcaagaaggagccatgcacactgcattaacaggagccactgagatccagacaagtggaacgacaacaatctttgctggtcatctcaaatgtagacttaaaatggacaaactaacgctaaaaggcatgtcatacgttatgtgcacgggctcctttaaactagaaaaagaagtagccgagacgcaacatggtaccgtgctcgtacaaatcaaatatgaaggtacagatgcaccatgtaaaatacctttctcaacccaagatgaaaaaggagtaactcaaaatggcagattaattacagccaatccaatcgtgacagataaagaaaagccagtaaacattgaagcagagccaccttttggagaaagttacattgtaatcggagttggagaaaaagccttaaaactcagttggttcaaaaagggatcgtcaatagggaaaatgtttgaagccactgctcgaggagccagaagaatggctatcctaggagacacagcttgggacttcggtagcataggtggcgtctttacaagcgttggtaaattagtacaccagatatttggtaccgcttacggagtactattttcaggagtcagctggacaatgaagatcggaattggagttctccttacatggcttggattaaattcccgatcgacaagtttgtctatgacctgcatagcggttgggttagtcacgttgtacctaggagtcatggtacaagctgattcgggttgtgtaataaattggaaaggcagagaacttaaatgcggtagtgggatcttcgtaacaaatgaggtacacacctggactgaacaatacaaatttcaggcagatagtcccaaaaggttatctgccgcaataggcaaagcatgggaggaaggagtatgtggtataagaagcgctactagattggagaacatcatgtggaagcagataagtaatgagctcaaccatatattgttagaaaatgacatgaagttaactgtcgttgtgggtgacgtagcgggcatactagcacaaggaaagaaaatgataaggccgcagcctatggaatataaatatagctggaaatcatggggcaaagctaaaataataggagccgacgtacaaaatacaacatttataatcgatggaccaaataccccagaatgcccggatgatcaacgagcatggaatatatgggaagtagaagactacggttttggaatctttacaacaaacatttggttgaaattacgagattcctatacacaagtttgtgaccatagattgatgagtgcagcgatcaaagacagcaaagctgtccatgctgatatgggatattggatcgaatctgagaaaaacgaaacatggaaactcgcacgggccagtttcatagaagtaaagacgtgcatctggcctaaatcacatacgttatggagtaacggggtccttgaatcagaaatgatcattcccaaaatctatggtggtccaatctcgcaacataattaccgacctggatatttcacccaaacagctggcccctggcatttagggaagttagagctagactttgacttatgtgaaggaacaactgtggtagtcgatgaacattgcggaaaccgtggaccatccttacggacgacaactgtaacagggaaaatcatccatgaatggtgttgcagatcatgtactctcccaccgctaaggtttaagggagaagatggatgctggtatgggatggaaataagaccggtgaaggagaaagaagaaaatctagtaaaatcgatggtttccgctgggtctggcgaagttgatagcttctcgctaggattactctgcatatcaattatgatcgaagaagttatgagaagtagatggtccagaaagatgttaatgactgggactctagcagtattcttcttattgataatgggacagttaacttggaacgatttgatacggctatgtataatggtcggtgcaaacgcttcagataggatgggaatgggaactacctatttagctttaatggctacttttaagatgagaccaatgtttgccgtaggtctactttttagacgattgacaagtcgagaagttttgctattaacaattggtctaagtctagtagcttcggttgaactcccaaattccctcgaggaactaggagatggactagctatgggcataatgattttgaaattgttaacagattttcagtcacatcaactatgggcaacacttcttagtatgacatttataagaactacgttttcactacattatgcatggaaaactatggctatggtcttaagcatcgtgtcacttttccctttgtgtttatcaacaacgtcgcagaaaacaacatggctcccagtattattagggagccttggttgtaagccactaaccatgtttttaattgccgaaaataagatttggggacgtaaatcatggccattaaatgaggggataatggcggtagggattgtgtcaattttactaagctctctacttaaaaatgacgtgccgttagcgggcccgctcatcgcgggtggaatgctcatagcatgctatgtaattagcgggtcaagtgccgacctgagtttggaaaaagcagcagtcgtaagttgggaagaagaggcagaacatagtggggcatctcataatatcttagtggaagttcaggatgatggcactatgaagattaaagatgaggaacgggatgatacactaactatactattaaaggcaacccttttggcagtaagtggagtatacccgcttagtatacctgcaacactctttgtatggtacttctggcagaagaagaaacaacggtcaggcgtattatgggatacaccgtctcctcctgaagtagaaagagccgtattggatgacggaatatatcgtataatgcaaagaggattattaggacgatcccaagtaggtgtgggtgtatttcaagagaacgtatttcatacgatgtggcacgttacacgaggcgcggtcttaatgtaccaaggtaaaagattggaaccaagttgggcttcagtaaagaaagacttgataagttatggcgggggttggagactccaaggaagttggaacactggagaggaggtacaggttatcgcggttgaacccgggaaaaatccgaaaaatgtccagaccgctcccggaacattcaaaacctcagagggcgaagtaggtgcgatagcgctagattttaaacccggcacaagtggaagtcctatcgttaatcgtgaaggtaaagtagttgggctatatggaaatggcgttgtgactacaagtggtacctatgtctctgcaatagcccaagccaaagcgtcacaagagggccctttgccagagatagaagacgaagtctttcggaaacggaacttgacaattatggacttacatcccggatcgggtaaaacaagaagatatttaccagcgatagtgcgagaagcaataaaacgcaagctaagaactctaattcttgcacccacaagagtggtggcaagtgaaatggcggaagccttgaaaggaatgcccattcgctatcaaacaacagccgtcaaaagcgaacacactggaaaggaaatagtagatcttatgtgtcatgcaaccttcacaatgcgtctattatctcctgttcgtgttccgaattataatatgataatcatggatgaggctcatttcacagatccgagttcgatagctgcaagaggatacataagcactcgcgtaggcatgggtgaggcagctgctattttcatgactgcgaccccaccgggcagcgtcgaagcgtttccacaaagtaatgcagtaatacaagatgaggagagagatataccagaaagatcatggaactcaggttatgagtggataaccgactttccaggcaagacagtatggttcgtaccttcaataaaaagtgggaacgatattgccaattgtcttcgaaagaatggtaaaagagtaatacagctctcaagaaaaactttcgacactgaatatcaaaagacaaagaataacgattgggactacgtagttacaacggacatatccgaaatgggagccaatttccgagctgatagagtgatagacccaagacgttgtctaaaacccgtaatattaaaagatggtccagaaagggtcatactggccggtcctatgcctgtaactgtagcttccgcagcacagcgaaggggccggataggacgtaatcacaataaagaaggcgaccagtatatttacatgggacaaccattaaacaatgatgaggaccatgcacattggactgaagcaaaaatgttactagataacattaatactcccgaaggtattataccagctctgtttgaaccagaacgcgagaaaagcgctgcaatagacggagagtacagattacgtggagaagcaagaaaaacattcgtggaactaatgagaaggggtgacctaccagtctggctgtcctataaggtagcatcagaaggatttcaatattctgaccgaagatggtgctttgatggtgaacggaacaatcaagtacttgaagagaatatggatgttgaaatatggactaaagaaggggaacgaaagaaattgagaccacgatggctagacgcacgcacatactcagacccattagcgcttcgagaatttaaagaatttgctgcaggaagaagatcagtctcaggggatttaatactggaaatcggaaaacttccgcaacacttgactcaacgagctcaaaatgctttagacaatttagtaatgctacataacagcgagcaaggtggaagggcctaccgccatgcaatggaagaattgccagacacaattgaaacgttgatgctgctcgcgttaatagccgttcttacaggtggcgtgacgttgttctttctgtctggtcgtggattaggtaaaacatcaataggccttctctgcgtgatggcgagcagtgtactattatggatggcttcagtagagccacattggatagcagcgtctatcatcctagagttctttcttatggttctattaattcccgaacccgatagacaaagaacacctcaagataatcagttagcatatgtcgtaattggtttactttttatgattctgaccgttgcggctaatgaaatggggttgcttgaaaccaccaagaaagatttagggatcggtcacgtagcagttgaaaatcaccaccatgcagccatgctagatgtggacctacaccctgctagtgcttggacattatatgcagtagctacaacaattataacccctatgatgcgacacactattgagaacactactgcaaatataagtctgactgcaatagccaaccaagcagcgatattaatgggactagacaaaggatggccaatttcgaaaatggacataggagtacctctgttggcgctaggttgttattcgcaggtaaatcctctcacacttaccgccgccgtgcttatgttggtagcacactacgcaatcataggaccaggtctacaagcaaaggctacaagagaggcacagaaaaggaccgcagctgggataatgaaaaacccgactgtagatggcattgttgctatagatttagaccctgtggtgtatgatgccaaattcgaaaagcaattaggacaaataatgctactgattttgtgtacttcacaaattctattaatgcgtaccacctgggctctttgcgagtcaatcacgcttgctacgggtccgttaacgactttatgggaaggatctcctggcaaattttggaatacaacaatagcagtctcaatggctaatatattcaggggtagttatttagctggtgctggcttggcgtttagtctaatgaaatcattaggcggtggtcgcagaggaactggtgcccagggtgaaacactgggagaaaaatggaaacgtcaactaaatcaattatcgaaatcagaatttaacacatataaaagatcgggaattatggaagtagaccgaagtgaggccaaagaggggctaaaacgtggagaaaccaccaaacatgcggtttcacgagggaccgcaaaacttaggtggttcgtcgagagaaatcttgtaaaacccgaaggaaaggtaatagatttaggatgtggaaggggcggatggtcgtactattgcgccggccttaagaaagtaacagaagtcaaaggatataccaaaggaggtcccggtcatgaagaacctattcccatggcaacttacggatggaatcttgtaaaattacattcaggtaaagacgtattctttatacccccagaaaaatgcgataccctgctatgtgatataggtgaatcgagtccaaaccctacgattgaagaggggaggaccctaagagttcttaagatggtggaaccatggctccgtgggaatcaattctgtattaaaatactgaacccatacatgccttctgtggtggagacgctcgaacaaatgcagcgaaaacacggcggaatgttagtacgaaacccgctaagccgaaattctacacacgaaatgtattgggtttcgtgtggcacgggtaatattgtaagcgcagttaacatgacaagtagaatgttactaaatcgttttactatggcccaccgtaagcctacatacgaacgagacgttgatttgggtgctggaacacgacacgtggctgtcgaacctgaagtggctaatttagacatcataggtcaaagaattgagaatataaaacatgagcataagtctacttggcactatgatgaggataatccttataagacttgggcgtaccatgggtcatatgaagtaaagccaagcggttcagcatcatctatggtaaatggtgtagttaaattacttaccaaaccatgggatgtaatccctatggttacccaaatagcgatgacggacactacgccatttggacagcaaagagttttcaaggaaaaagtcgatacaaggacgccaaaggcaaaacgaggcacggcacaaataatggaagtcacagcaaaatggttatggggatttttaagccgaaacaaaaagccccggatctgtaccagggaagaatttactagaaaggttagaagcaatgcagccataggagctgtttttgtagatgaaaatcaatggaactcagctaaagaagccgtcgaagatgaaaggttttgggatttagttcacagagaaagagaactacataaacaaggaaagtgtgcaacctgcgtatacaacatgatggggaaaagagaaaagaaattgggagaatttggcaaagccaaaggttctagagcgatatggtatatgtggcttggagcgcggtttttagagttcgaagcgctaggatttatgaatgaagatcattggttctctagagaaaatagcctaagtggagttgaaggggaaggtcttcataaactaggatacatcctaagagacatttctaaaataccgggcggtaatatgtatgctgatgacacagcaggttgggacacaaggatcactgaagatgatcttcaaaatgaggcaaagataaccgacataatggaaccggaacatgccctattagctaaatctatttttaaactaacatatcaaaataaagtagttagagtgcaacgaccggccaagaatggcaccgttatggacgtaatctctaggagagatcaacgaggatctggacaggtagggacatatggcttaaacacattcacaaacatggaggcacaactcatacgacaaatggaatcggagggtatattttcaccaagtgaactggaaaccccaaatttggccggtagagccctagattggttagagaaacatggggttgaaaggttaaaaagaatggcaatcagcggtgacgactgcgtcgtaaagccaatagacgacagattcgctacagcattgaccgctcttaatgatatgggcaaagttcgaaaagacataccacaatgggaaccatctaagggatggaacgactggcagcaagtgcctttttgttcgcaccattttcaccaattaatcatgaaagatggtcgagagatagtagtaccttgtagaaaccaagacgagcttgtcggtagagcaagagtatcccaaggagcagggtggtcactccgggaaactgcctgtttgggtaaatcctacgcccagatgtggcagttgatgtattttcatcgacgcgacttgagactagccgcaaatgcaatatgttcggctgtgccggttgattgggttccgacgagtcgtacgacttggtctatacacgcccatcaccaatggatgacaacggaagatatgctaagtgtctggaatcgcgtttggattgaggagaacccgtggatggaagataagacacacattagtagctggggcgacgtgccgtatctaggaaagagagaagatcaatggtgtggtagcctcatcggactaacagccagagcgacatgggcaacaaacatacaggttgcaattaatcaagtacgtcggttgttaggaaatgagaattacttggactatatgacgtctatgaagcgctttaaaaacgagtccgacccagaaggtgccctctggtaa

SEQ ID NO: 21797 - RNA, 9879 nt, synthetic construct
  misc_feature 1..9879: note = derived and/or modified CDS sequence (opt6) from DENV-1__HM181964__SS-prME
  source 1..9879: mol_type = other RNA
tcggttactatgttattgatgttaatgcccaccgcattagcgttccacctaaccacacgaggaggagaaccacatatgatcgtatcaaagcaagaacgtggtaaatctcttctttttaaaacaagtgcaggggtgaacatgtgtactctaatagcaatggacttaggcgagttatgtgaagatacaatgacgtataagtgtccacggattacggaaacggaaccagatgatgttgattgctggtgcaatgcgacggacacttgggtcacttacggtacatgttcgcaaaccggcgaacatagaagagataaacgcagcgtagcacttgctccacatgtgggcctcggactagaaacacgaacagagacttggatgtcaagcgaaggagcatggaaacaaatccaaagagtagaaacctgggcactaagacacccgggcttcacggtgatcgcactatttcttgctcatgcaatcggcacatccatcacccaaaaaggaatcatttttatcctattgatgctagtaactccgtctatggcaatgcgttgtgtaggaattggatcacgggactttgttgagggcttatcaggggcaacttgggtagacgtagtgctggaacacggttcctgcgtaacaacaatggcaaaagataaacctacactggatatcgagctcttaaaaacagaggtaacgaatcccgcagtattacgaaaattgtgtatagaagcaaaaatctcaaacaccaccacagactcccgttgtccaacacaaggagaagcgacattagtagaggaacaagacgcaaacttcgtctgtcgtagaacctttgtagataggggttggggcaacggctgcggactatttgggaaagggagtctcatcacatgcgcgaagttcaagtgcgtcaccaaattagaagggaaaattgtgcaatacgagaatctgaaatatagcgttatagtgacagttcatactggagatcaacaccaagtaggaaatgaatccacagaacatggcacaaccgcgacgataacaccgcaggcacccacgaccgaaatacaacttacagattacggtgcacttactcttgactgttcaccgcgaactggactagactttaatgaaatggtcttattgacaatgaaagaaaaatcttggttagtacataaacaatggtttctagacttaccgcttccatggacaagtggcgcttcaacaagccaagaaacgtggaacagacaagatctattagtgacttttaaaacagcacacgctaagaaacaagaagttgtagtcctaggaagccaagaaggggcgatgcatacagcattgactggggcaactgaaatacagaccagtggtacgacaacaattttcgccggacatctaaaatgcagattgaaaatggataaactcacactgagaggtatgtcctacgtaatgtgtaccggcagctttaaactcgaaaaagaagttgcagaaacacagcacggaaccgtcttagtacaaataaaatatgaaggaacagatgcgccttgcaaaatacccttttctacacaagacgagaagggagttacacaaaatggccggttaattacagcaaatcctattgtaacggataaggaaaagccagtaaatatagaggcagaaccgccatttggagagtcttatatagtcataggcgccggagaaaaagccttaaaactctcctggtttaagaaaggtagtagtataggcaaaatgttcgaagcaaccgccaggggtgctcgtaggatggctatcctaggagacactgcatgggatttcggaagtattggtggcgttttcacatcagtgggcaaattagtacatcaaatattcggcacggcatacggagtattattttcaggagtttcttggactatgaaaataggtatcggcgtcctccttacttggctaggattgaatagtcggtctacttcattgagcatgacttgcatagctgtaggattggtcaccttatatctgggcgtaatggtgcaggccgactcggggtgtgttataaattggaaaggaagagaattaaaatgtgggtctggtatatttgtaacaaatgaggtacatacatggacagagcagtataaattccaagctgattctccaaaacgtttatcagctgctattggcaaggcatgggaagaaggagtttgtggtattcgaagtgccacacgcctagaaaatattatgtggaaacaaatcagtaacgaactaaaccatatcttgctagaaaatgatatgaagttcaccgtggtggtgggagatgtggcggggatcctcgcccagggaaagaaaatgattaggccacaaccaatggaatacaaatacagttggaaatcatggggaaaagcgaagataattggagccgacgttcaaaatacaactttcataattgatggtcccaacacgccggagtgcccagatgatcaacgagcgtggaatatatgggaagtggaagactatggatttggtattttcactacgaacatctggctaaagttaagagacagttatacacaggtgtgtgatcacagattaatgtcggcagcaattaaggactctaaagccgtgcatgccgatatgggatattggatagagagtgagaagaatgagacatggaaattggcaagagcatcgtttatagaagtgaagacatgcatttggccaaaatctcacaccctatggagtaatggtgtgctagaatcggaaatgataatacctaaaatctatggaggaccaatcagtcaacataactaccgaccaggctatttcacgcagactgcaggaccctggcatctaggcaaactagaattagattttgatctctgtgaagggacgaccgtcgtagtagatgaacactgtggtaatagaggaccaagtctgaggacaacaactgtaacaggaaaaataatccatgaatggtgctgtaggtcctgtactctaccccctttgcgctttagaggtgaagatggctgttggtatggtatggaaattcgacccgtaaaggaaaaagaggaaaacttggtgaaaagtatggtatctgcgggcagtggagaagtcgattcgttttcactcggacttttatgtattagtatcatgatcgaagaagtaatgcgtagtaggtggtcgcgcaagatgctgatgacaggtacattagctgtatttttcttattaattatgggacaacttacgtggaacgatttgatacgtttatgtataatggtaggggccaatgcctcagatagaatgggcatgggcactacctatctggctctcatggcgacttttaaaatgcgacctatgttcgcagttgggctgttgtttagacgattaacatcgcgtgaagtgctgctgctgactattggtttatcactcgtcgcttcggttgaattaccaaatagtctcgaggaactcggagacggcctagcgatgggaataatgatcctcaaactcctcactgacttccaaagtcaccaattgtgggctacattactctcactaacattcataaagacaacattttcgttacattgcgcatggaagaccatggcgatggtactctctatcgtaagtttatttcccttgtgcttaagtacgacgtcgcagaaaactacctggttgccggttttattgggatctttagggtgcaaaccgttaacaatgttcttaatagcagaaaataaaatatggggtcgacgatcatggcctttaaacgaagggataatggcagttgggattgtttcgatattgttgagttctctccttaaaaacgatgtacccctagctggtccgctaatagcaggaggcatgttaattgcatgttatgttatttctgggagcagtgccgacctatcattagaaaaggcagccgaagtatcttgggaagaagaagctgaacatagtggcgcttctcataacatacttgttgaggttcaagacgatggtacaatgaaaattaaagacgaggaacgagacgatacgctaacaatacttttaaaagccacacttctggctgtttccggcgtgtacccactaagtatacccgccacactgtttgtgtggtatttttggcaaaagaagaaacaaaggtcaggtgtactatgggacactccgagtccccctgaggttgaacgagccgttcttgacgatgggatatacagaataatgcaaaggggattgcttggcagatcacaagtaggcgtaggagtattccaagaaaacgtgtttcatacaatgtggcacgttaccaggggcgcagtactaatgtaccaaggaaagaggctagaaccatcttgggcttctgtaaagaaagaccttatttcatacggcggagggtggagactgcaaggatcatggaacacgggggaagaagttcaagttatagccgtagaacccggcaaaaacccgaaaaacgtacaaacagcacctggaacatttaaaactccagaaggagaagttggtgcaatcgcattggattttaaaccaggtacaagcggaagtccgattgtaaatagagaaggcaagattgttggcttatatggaaacggtgtagtaacaacttcagggacatatgtaagtgccatagcacaagcaaaagcctcacaagagggccccttaccagaaatagaagacgaagtgttccgtaaaagaaatttaacaataatggatcttcatccaggatcaggaaaaactagacgttacctaccagcgattgtacgcgaagccataaagcggaaactaagaacattaatccttgctccaacacgtgtagttgcaagcgaaatggcggaagctcttaaaggtatgccgataagatatcaaacaaccgcagtaaagtcagaacatacaggcaaggaaatagtagatcttatgtgtcatgctacatttacaatgagactgctaagtccggtgagggtaccgaattataacatgataataatggatgaagcccacttcactgatccttcgagcattgcggccagaggatacatttcaacacgagtgggtatgggtgaagcagcggcaatttttatgactgcaacgccacccggtagcgtggaagcgttccctttaagcaatgctgtgatccaagatgaagagagagatataccagaaagatcatggaactctggctatgaatggataacagattttccaggaaagacagtttggtttgtgccttcaataaagtctggcaatgatattgctaattgtttaagaaagaatggaaaacgagttatacaactcagtcgaaaaacattcgacacagaatatcagaaaactaaaaataatgactgggattacgttgtaaccacagacatttctgagatgggagcgaacttccgagctgaccgagttattgacccaagacgttgtttaaaaccagtaatcttgaaagacggcccagagagagtaatattagcaggaccaatgcctgtcacagtggcgtcagcagcacaaagacgtggtagaatcggaaggaaccacaacaaagaaggagatcaatatatatacatgggtcagcctctaaacaatgatgaagatcacgctcattggactgaggcgaaaatgttactagataacattaatacacctgaagggatcatacccgcattgtttgaacccgagcgggagaaaagcgcagccatagatggggaataccgattaagaggagaagcacgtaaaacctttgtggagctgatgcgaagaggagatctgccagtctggctttcgtataaagttgcttccgagggttttcagtattcagaccgtcgttggtgttttgatggtgaacgtaataatcaagtattagaagaaaacatggatgtcgaaatatggaccaaagagggcgaacgtaagaaactaagacctcgttggctcgatgcgagaacctattcggatcctttggctttacgtgagtttaaagaatttgcagccggcaggaggagtgtatcgggagacttgattcttgaaataggaaaacttccacaacaccttacacaaagggcccagaacgcgctcgacaatttggtcatgctacataacagtgagcaaggaggtcgagcctataggcacgcaatggaggagttaccagatacaattgaaacactgatgctgcttgccttaatcgcagttctgacaggaggtgttacgctgtttttcttgagtgggagaggattaggaaagacaagtataggattattatgcgttatggcatcgtccgtcttactatggatggcttctgttgaacctcattggatagcggcctccattatcctcgagttctttcttatggtattattaatcccggaaccagataaacaaaggactccacaggacaaccaattggcttatgtggtaatcggattgctatttatgatattgacagtggctgctaatgaaatgggactgttagaaaccacgaagaaagacctgggaataggacatgtagctgttgaaaaccatcatcacgccgccatgctcgacgtggatttacacccagcgtcagcctggacattatatgcagtagccacaaccataattacaccaatgatgcgccatacaattgagaatacaacagccaacatatccctaaccgccatagcgaatcaagcggcaatactcatgggccttgataagggatggcccatttcaaaaatggatataggagtacctctcctagcactaggctgctactctcaagtcaatccattaacattaacagcagccgtccttatgctagtcgctcactacgcgatcataggaccgggcctccaagctaaggctactagagaggcccaaaagagaacggccgcgggaataatgaagaatccaaccgtggacggcatcgtagctatagatctggaccctgtagtttatgatgctaaattcgaaaagcagctaggccaaatcatgctattaatactatgtacaagccaaatactgcttatgcgaacgacctgggcactttgtgagtcaatcaccttggctacaggccctttgactacgctttgggaaggaagtccaggtaaattttggaatacgacgatcgcagtatcgatggcaaatatctttagaggatcttacctagccggtgctggccttgcgtttagccttatgaaatccttaggaggtgggcgaaggggcactggagcacagggagaaactctaggtgagaaatggaaaaggcaacttaatcaactatccaaaagtgaatttaatacatataagaggtcggggataatggaagttgacagatctgaggctaaagaagggttgaaaagaggtgaaaccacgaaacatgcagtttctagaggcacagcgaagttaagatggttcgttgaacgaaatctagtaaaaccagaaggaaaggtgattgatcttgggtgtgggaggggtggatggagctattattgcgcaggccttaagaaagttacagaagttaaagggtatacgaaaggagggcccggacatgaggaacccataccaatggctacatatggctggaatttagtaaagttacactctggcaaagatgttttctttatcccaccagaaaaatgtgataccttactatgtgatattggagaaagttctcctaatccaacgatagaagaaggccgaacgctccgagtccttaaaatggtcgagccctggctcaggggaaatcaattctgcattaaaatactaaatccctatatgccctctgtcgttgaaacattggagcaaatgcaaaggaaacacggaggaatgttagtgcgtaatcccttaagtagaaatagtacacatgaaatgtattgggtgtcatgtgggacaggaaatatagtttctgctgtaaacatgacatcgagaatgttactaaataggttcactatggcccacagaaaaccaacatacgagcgagatgttgatttgggcgcaggaaccaggcatgtggctgttgagcctgaagttgctaatctcgatataataggtcaacgcatagaaaatataaagcatgaacacaaatcaacgtggcactacgatgaagacaacccctataaaacgtgggcttatcacggctcatacgaagtaaaacctagtggaagcgccagttcaatggtcaacggtgttgtaaaattgttaacaaaaccatgggatgttataccaatggttacccaaattgcaatgacagacactactcccttcggccagcagcgtgtatttaaagaaaaagtcgacactcgcacacctaaggcaaaaagagggactgcacaaataatggaggtcacggctaaatggttatggggcttcctaagccgaaacaagaaaccaagaatatgcactcgagaagagtttacccgaaaggtccgaagtaacgcagctattggagcagtctttgtagacgaaaaccaatggaactcagcaaaggaagcagtcgaagacgaaagattttgggacctagtacatagggaacgagaacttcacaaacaggggaagtgtgcgacctgcgtatacaatatgatgggtaaaagagagaaaaagttgggagagttcggaaaagctaaaggtagcagggctatttggtatatgtggttaggagcgaggtttctagaatttgaggcactgggatttatgaacgaggaccactggttttccagggaaaattcactaagtggtgtggaaggtgaagggcttcacaaactcgggtatatcttacgagatataagcaaaattccagggggaaacatgtacgcagacgataccgcaggctgggatacaagaataacagaagatgaccttcaaaatgaagccaggatcactgatataatggagcccgaacatgcactactggcgaaatctatattcaaactaacctatcagaacaaggttgtacgtgtacagaggcccgcgaaaaacgggacggttatggacgtgatcagcagacgggaccaaagaggatcgggtcaagtaggcacttatgggcttaatacattcacgaacatggaggctcaattaattcggcaaatggaatccgaagggatattctcaccgagcgaacttgaaacacccaacttggcagagagagtcctcgactggcttgagaaatatggggtagaaaggctcaagagaatggcaataagcggcgacgattgcgtagtgaaacctatcgacgatcgatttgcgacggcactaaccgctttgaatgatatgggaaaagtgcgaaaagacataccacaatgggaaccatcaaaaggatggaatgactggcaacaagtcccattttgctcccatcactttcatcaactcataatgaaagacggaagagaaattgtggttccgtgtaggaaccaagacgaacttgttggtagggcgagagtttcacaaggggccggatggtcgctaagggagacagcatgtctcggcaaatcttatgcacaaatgtggcaactcatgtatttccacagaagggatttaagattagccgcaaacgcaatatgttcggcggtaccggtagattggatacccacaagccgtactacttggtcgatccatgcgcaccaccagtggatgactactgaagacatgttaagcgtctggaatagggtatggatagaagaaaacccgtggatggaagacaaaactcacatcagtagctggggagatgttccatatctcgggaaacgtgaagatcagtggtgtgggagtctcattggcttaaccgcgagggcaacatgggcgacaaatatacaagtagcgattaaccaggttagaaggttgataggaaatgaaaactatctagactatatgacctcgatgaaaagatttaaaaacgaatccgatccagagggtgcactatggtaa

SEQ ID NO: 21798 - RNA, 9879 nt, synthetic construct
  misc_feature 1..9879: note = derived and/or modified CDS sequence (opt6) from DENV-1__HM181966__SS-prME
  source 1..9879: mol_type = other RNA
agtgtaactatgctactcatgctgatgccgaccgccttagcctttcatctgactactaggggtggggaaccgcatatgatagtcacgaaacaagaaagaggaaaatcgctactattcaaaacttctgttggggtgaatatgtgcaccttaattgcgatggacctcggagaattatgcgaagatactatgacctataaatgtccacgtattacggaagcggaaccagacgatgtggattgttggtgcaatgccaccgatacgtgggttacatatggaacatgctcccaaactggtgaacacaggagggataaacgctccgttgcgttggcacctcatgttggcctcgggctcgaaactcggacagaaacgtggatgagtagtgaaggggcttggaaacaaattcaacgtgttgaaacttgggcactaagacaccccggattcactgttatagcgctttttctcgcacacgcgataggaactagcatcacacaaaaaggaataatttttatacttttgatgcttgtcacaccatccatggccatgaggtgtgttggaattggttcaagagattttgtcgaaggactatccggggctacatgggtagatgtagtgctcgaacatggaagctgcgtgactactatggctaaggataaaccaacattagacattgagctactcaaaactgaagttacaaacccggcggttttacgaaaattatgcatagaagccaagatcagcaacacaacgaccgattctcgctgcccgacacaaggcgaagcaacattgatggaggagcaagatgcaaacttcgtttgtcgaaggacgttcgttgatagaggatggggaaatgggtgtggactatttggtaaagggagtttgatcacatgtgcaaagtttaaatgtgtgaccaaattggaggggaaaatcgtacaatatgaaaacctaaaatatagtgtaatagtaacagtccacacaggtgatcagcatcaagtgggaaatgagtctaccgagcatgggaccactgctaccattacaccacaagctccaacatcggaaatacagttaacggattatggtgcactaacattagactgctctccaaggactggattggattttaatgaaatggtactattaactatgaaagagaaaagttggctcgtacacaaacaatggtttctagacctaccattaccatggacgtcgggcgctagtacatctcaggaaacatggaatagacaagatttattggtgacgtttaaaaccgcccacgcaaagaaacaggaggtagtagttttgggatcgcaagaaggggccatgcacactgccctgacaggagccactgaaatacaaacgagtggaacaacgacgatattcgcaggccatttgaaatgtcggctaaaaatggacaaacttacgctgaaagggatgtcatatgtaatgtgtacaggatcttttaaactagaaaaagaagtggctgaaacacaacacggcacggttttagttcaaatcaaatacgagggaacagacgctccctgtaaaataccatttagcacattagatgaaaaaggcgtaactcaaaatggaagattaataactgcgaaccctattgttaccgacaaggaaaaaccagtcaacattgaggcagaacctccgttcggagagagctatatagtaataggcgcaggagaaaaggcattaaaattaagttggtttaaaaagggttcctcgatcggcaaaatgttcgaagcaaccgctcgaggcgccagaagaatggctatcctgggggacactgcgtgggattttggttccattggaggagttttcacgtcagtcggaaagttagtacaccagatcttcggtactgcctatggagttctattcagcggtgtaagctggactatgaaaatcggtatcggtgtgctcttaacatggttgggcctaaatagcagaagtacaagtttaagtatgacatgtatcgctgtaggacttgtgacgctatatttaggtgtgatggttcaagctgatagcggttgcgttattaattggaaaggtagagaactaaagtgcggtagtggaatattcgtaacaaatgaagtgcatacctggactgaacaatataaattccaagcagattcacctaaacgactatcagccgcaattggtaaagcgtgggaagaaggggtttgtggaatacgttctgccacccgattggaaaatattatgtggaagcaaatctcaaacgaattaaatcacattctgttggaaaatgacatgaaatttactgtagtcgtaggagacgttgtggggatactcgcgcagggcaagaaaatgattcgaccgcaaccaatggaacacaaatatagttggaaaagttggggcaaggctaagataatcggcgccgacgtccagaacacaacttttataattgatggacccaatacgcccgagtgtcccgacgaccaacgagcatggaacatatgggaagttgaagattacggttttggaatatttactacaaatatatggttaaaattgagagattcgtatacacaagtatgcgaccataggctgatgagcgccgcaattaaagactctaaagcagtacatgcggacatggggtactggatcgaaagtgagaaaaatgagacatggaaactcgcaagagcttcattcatagaggtaaaaacttgtatatggccaaaaagtcatacattatggagtaacggagtgctagagtcagagatgattattccaaagatttatggtggaccaatctcacaacacaattaccgaccaggttattttactcaaacagcaggtccctggcacttaggtaaattagaactggactttgacctttgtgaaggcacgactgtagttgtagatgaacattgcggaaatagaggtccttctctgcgaacaaccacagttacaggcaagatcatccatgaatggtgctgcagatcatgtactctgcctccactaaggtttaaaggtgaggatggctgctggtatggcatggaaatacgaccggtcaaggaaaaggaagagaacttggtaaaaagcatggttagtgctggaagcggggaagtagactcttttagtttgggtcttttatgtatatctatcatgatagaggaagtaatgcggtccaggtggtcaagaaagatgctgatgactggaacgttagctgtctttttactactcataatgggacaattaacttggaacgatctcataagattgtgcattatggtgggtgccaatgcatctgatcgaatgggcatgggaacaacctacctagctctaatagcaacattcaagatgcgtccgatgttcgcagttggcttgctctttagaaggcttacctcacgagaggttttgctcctaaccatcggattaagtctagtagcctccgtcgaactacctaattcgttagaggaactgggagatgggctagcaatgggaattatgatactaaaactcctcactgactttcaatctcatcagctgtgggcaacattacttagttttacattcataaaaacgacattgtcgttacattatgcatggaaaacgatggctatggtcctttcaatagtctcactctttccgctgtgtctaagtactacaagtcagaaaactacctggctgccagtactcttaggatccctcggatgtaagcctctcactatgtttctaattgccgagaataagatttggggacgcaaaagctggccccttaacgaaggaataatggcagtaggtgttgtctcaatactactttcatccctgctaaagaacgatgtaccattagcgggaccgttaatcgccggcggaatgttgatagcatgttacgtgatttctggatccagtgctgatttgtccctggaaaaagctgcagaagtctcgtgggaagaagaagcggaacattctggtgcaagtcataatatactggttgaagttcaggatgatggaactatgaaaattaaggatgaagaacgtgacgatacactaacaattcttttgaaagcaaccctcctagctgtaagcggtgtttatccattaagcatacccgcaacactattcgtctggtatttctggcagaagaagaaacaaagaagtggagtattgtgggacacgccaagtccacctaaagttgagagggctgtcctcgatgacggtatataccgaattatgcagcgaggacttttaggaagatcgcaagttggtgtaggtgttttccaagaaaacgtgtttcatacaatgtggcatgtgactcgcggagcagtattaatgtaccaagggaaaagactagaaccatcgtgggcttcagtcaagaaagatctaatttcgtatggtggtggatggcgtttacaaggaagctggaataccggtgaagaggttcaggtcatcgctgttgaaccaggcaaaaaccccaaaaacgtacaaacagcgcctggaacgttcaagacctcagaaggcgaagtaggtgccatcgcactggacttcaaaccaggcaccagcggtagtcctatagtcaacagagaaggcaaaattgttggattatacggaaacggagtagttacaaccagtggaacatacgtaagcgcaatcgcgcaggcaaaagcatctcaggaggggccattaccagaaattgaagatgaggtcttccggaaacgaaacttaaccatcatggacctccatcccggaagtgggaaaacaagaagatacctacccgctattgtaagagaagcaataaaaagaaaacttcgtactttaattttagctccaacaagggtagtagcatcagaaatggcagaggcattaaagggaatgccaatacgttatcaaacaacggctgttaaaagtgaacacaccggaaaggagattgttgatctcatgtgccatgcaacattcactatgagattactttcaccggtgcgcgtcccaaattacaatatgatcattatggatgaagcacatttcacggacccgtcttcaattgctgctagaggatacataagcaccagagtaggcatgggcgaagctgctgccatctttatgacagcaacgccacccggatcagttgaagcatttccacaaagtaacgctgttatccaagatgaggaaagagatatcccggaacggtcctggaactctggatatgaatggataacagatttccctggaaagacggtatggtttgttccttcaattaaatcaggtaatgatatagcgaattgcctacgaaagaacggtaaaagggtaatacaattaagtagaaaaacgtttgacactgagtaccagaaaactaaaaataatgattgggattatgtggtaacgacagatataagtgaaatgggcgccaatttccgtgcggatagagtaatcgatcctagacgatgtcttaaaccagtaattcttaaagacggacctgaacgcgtaatactagccggacccatgcctgttacagttgcctcagccgctcaaagacgcggaaggattggccgcaaccataataaggagggagatcaatacatctatatgggccaaccactgaataacgacgaagatcatgcacattggacggaagccaagatgctattggacaacattaatacaccggaaggaatcatacctgctctttttgagccagaacgagagaaaagtgcagcgatagatggggaatataggctccgaggtgaagcacgcaaaacatttgtagaactcatgaggcgaggagatctgccggtttggctatcatacaaggtagctagtgaaggttttcagtacagcgatagacgttggtgttttgatggagaacgaaataatcaagttttggaagaaaatatggacgtagaaatctggacaaaagaaggggaaagaaagaaacttagacctcgttggcttgatgctagaacatattcggacccgctagcgcttagggagttcaaagaatttgctgctggtcgcagatctgtatcaggagatctaatactcgaaatagggaaattaccccagcaccttacgcaaagagcacaaaacgctttagataatttagttatgttacacaacagtgagcagggtggaagggcttatcgacatgcaatggaggagcttccagatactatagagaccctaatgttattagctttaattgcagtcctaacaggaggggtaacactattctttctttcgggcagaggtctagggaaaacatccatcggattactttgtgtgatggcaagcagtgccctcttgtggatggcttctgtagagccgcactggatcgcggcatctatcattttagagttctttttaatggttctgttaataccagaaccggaccgacaaagaacaccacaggataatcaacttgcttacgttgttattggattactatttatgattcttacagtagctgcgaacgagatggggcttttagaaacaactaagaaagatctagggattggacacgttgccgtagaaaaccatcatcacgcgacaatgttggatgttgatcttcatccggccagcgcatggactctatatgcggtggctacaacaattattacacccatgatgagacataccattgaaaatactactgctaacatttcactaactgcgatagcgaatcaggccgcaattttaatgggtctagataagggatggcccatctctaaaatggatattggagttcctttactagcattaggatgttactctcaggtaaatcccttgacactaacagcagcagtgcttatgttagtagcgcattacgcgatcatcggaccggggttgcaggccaaggcaacaagggaagcacagaaaaggactgcagctggaattatgaagaatccgactgttgatggaatagttgcaatcgatttagaccccgtagtatatgatgcgaaattcgaaaaacaacttggacaaataatgctgcttatcctttgtacttcccaaatacttctaatgaggacaacatgggcactatgtgagtcaattacccttgccaccggacctttaactacattgtgggagggctctccaggaaaattttggaacacaaccatagctgtttccatggctaatattttcaggggctcgtatttagccggagcgggactggcgttcagtttaatgaagagtttaggtggcggccggagaggcacaggagctcaaggagagacattaggcgaaaaatggaaaagacaactgaatcaactgagcaaatcggagttcaatatatataaacgaagcggaataatggaggtagatagatcagaagctaaagaaggcttaaaaagaggggaaacaactcggcatgcagtgagcagaggaaccgccaaattacgctggttcgtagaaaggaatcttgtaaaaccggagggtaaggtcattgatctaggatgcgggcgtggtggttggtcatattattgtgctggcttaaagaaagtcacagaggttaaaggttacactaaaggaggaccaggtcatgaagaacctatacctatggctacctacggatggaacttggtgaaacttcattctggtaaagatgtctttttcacgccccctgagaaatgcgatacgctattatgtgacattggagaatcctctccaaatcctacgattgaagagggaagaactttaagagttctgaaaatggttgaaccctggttgaggggaaatcaattttgtattaaaattctaaacccatatatgccaagcgtagtagagacgttggaacaaatgcaaaggaagcacggagggatgttggtaagaaaccctttaagcagaaatagcactcatgaaatgtactgggtatcttgtggcacaggaaatattgtttctgccgtgaatatgacatctagaatgttgctcaacagattcacaatggcccatagaaaaccgacatatgaacgtgatgttgacttaggggcagggacaagacacgttgcagtagaaccagaggttgcaaatcttgatataatagggcaaagaatagaaaacattaagcacgaacacaaaagcacatggcactatgatgaagataatccttacaaaacttgggcctatcacgggagctatgaagtaaagcctagtggaagcgctagttcaatggtaaatggagtggttaaactcttaactaaaccttgggatgttatcccgatggtaacacaaatagctatgactgatacgacaccttttggacagcaaagagtattcaaggaaaaagttgatacaagaactccaaaggcaaaaagaggaactgctcaaataatggaggtaacagcgcgttggctgtggggtttcctaagtcggaacaagaaaccacgaatatgcactcgtgaagaatttacaagaaaagtccgatcaaatgcagctatcggagctgttttcgtcgacgagaatcagtggaactcggcgaaggaagctgtggaagatgaacgtttctgggatctagtgcaaaaagagagagagctacacaaacagggaaaatgcgcaacttgcgtgtataatatgatggggaaaagagagaagaaacttggggagtttggaaaggcaaaagggagccgagcaatatggtatatgtggctaggggcaaggtttttggagttcgaggcgttaggatttatgaatgaagatcattggttttcccgagaaaactcattaagtggcgtcgaaggagaaggcctacataaactagggtatatattaagagatatatcaaaaataccgggagggaatatgtatgccgatgatactgcgggatgggacacccgaataacagaagatgaccttcaaaatgaggctaaaattactgatattatggaaccagaacacgcgttattggcgacaagtatcttcaaattaacatatcaaaataaagtagtaagagtacaacgaccggccaaaaatggaacagttatggacgttataagtaggcgtgaccaaaggggctcgggtcaggttggcacgtatggactaaatacttttacaaatatggaggcccaactcataagacagatggaaagtgaaggaatatttttgccaagcgagttagaaactccaaatcttgccgagagggtattggattggttggagaaatatggtgttgaaagactaaagagaatggcaatttcgggagacgattgtgtagtaaaacctatagatgataggttcgctacagcattaacagcattaaacgatatgggaaaagtgagaaaagacatcccccagtgggaaccatccaaaggctggaatgactggcaacaagtgccattttgctcacatcatttccatcaattagtgatgaaagatggaagggagatcgttgtaccatgcaggaaccaggatgaattagtaggccgagcgagagtaagccaaggggcaggatggtccctgcgagaaaccgcttgtttgggaaagagttatgcacaaatgtggcaacttatgtattttcatcgtagagacttgagattagcagcgaacgcgatctgtagtgctgtgcctgtagattgggtcccgacttctaggacaacctggagtatacatgcacatcaccagtggatgacaacagaagacatgctatcagtatggaatagagtatggattgaagagaatccatggatggaagacaaaacccatgtaagcagctggggagatgttccttatttaggtaaacgagaggatcaatggtgcggctcgctgatcggacttactgcaagggctacatgggcgagtaatatacaagtagcaatcaaccaggtaaggaggttaattggaaacgaaaactatctggattacatgacaagtatgaagagatttaagaacgagggtgacccggaaggagcactatggtaa

SEQ ID NO: 21799 - RNA, 9879 nt, synthetic construct
  misc_feature 1..9879: note = derived and/or modified CDS sequence (opt6) from DENV-1__GU131721__SS-prME
  source 1..9879: mol_type = other RNA
agcgtgacaatgttactaatgctgatgccgacagctctagcattccacttaacaacgagaggaggagaaccacacatgattgtatctaaacaagaaagaggaaaaagtttactattcaaaacctcagccggtgtcaatatgtgtacactaatagcaatggatctaggtgaattatgcgaagacacgatgacctataaatgtccaagaataacagaaacagaaccagacgacgtagattgttggtgtaacgcaacagatacatgggttacttatgggacctgcagccagactggcgaacatcggcgcgacaaacgtagtgtagctttggcacctcatgtgggactggggctagaaacaagaacggaaacttggatgtcaagcgaaggcgcatggaagcaaatacagagagtcgaaacatgggctctgagacacccgggcttcactgtcattgcactatttttagcgcatgcaataggaacatctataacacaaaaaggtattatattcatattactaatgttagtaactccatcaatggcaatgaggtgcgttggtattggatccagggatttcgtagaaggcttgagtggggcaacatgggttgacgttgtattagaacatggaagctgcgtaaccacaatggctaaagacaaaccaacattagatatagaattattaaaaacagaagttactaacccggcagtcttgagaaaactatgtatcgaagcgaaaattagcaatacgactacggacagcagatgtcctactcaaggagaagcaactttagtcgaggagcaagatgcaaacttcgtgtgtcggagaacgtttgttgatagaggatggggaaatggttgtggtctctttggaaaagggtccctgattacatgcgcgaaatttaaatgtgtcacaaaactagaaggaaaaatagtgcaatacgagaatttgaaatattccgtcatagtgaccgtacataccggggatcaacaccaagtaggtaacgaaagtactgaacatgggaccactgcgactatcacacctcaagctccaacaacagaaattcagttaacagactatggagctttgaccttagactgcagtccacgaacaggattagactttaatgaaatggtattgttaaccatgaaagagaaaagttggctagtccataagcaatggttcctagaccttccgttaccttggacaagtggagcttcaaccagtcaggaaacctggaatcgacaggatctattagtgacatttaaaacagctcacgccaagaaacaggaagtcgtggtcctgggatcacaagaaggtgctatgcatacagcgcttacaggtgctacggagattcaaacgtccggtaccaccactatttttgcaggacaccttaaatgtagattgaaaatggacaaactcacactgaagggaatgagttatgtaatgtgtactggatcattcaaactagaaaaagaagtagcagagacacaacatggaacggtcttagtacaaattaaatatgagggaaccgacgccccttgtaaaatcccatttctaactcaagatgaaaaaggcgtaactcaaaacggaagattgattacagctaacccaatagtaactgataaagaaaaacccgttaatattgaagcagagccgccgtttggagagtcttatatcatcatcggagcaggagaaaaagcattaaagttaagctggtttaagaaaggatcttcgatcggcaagatgtttgaagcaacggcgaggggtgcaagaagaatggcaattctaggcgatacagcgtgggattttggttctataggcggcgtgttcacatctgcaggcaagttagtgcatcaaatctttggaaccgcatacggagtactattttcaggtgtatcttggaccatgaagattgggattggtgtattgttaacctggcttggactaaactcacgctctaccagtttaagcatgacatgtatcgcagtaggcttagttacgttgtacctcggagtaatggtacaagcggactctggctgcgtgattaattggaaaggaagagaattgaagtgtggaagcgggatattcgtaactaacgaagtccatacgtggacagagcagtataagttccaagctgacagtcccaagcgactctcagctgcaattggtaaggcgtgggaggaaggggtgtgtggcataagatctgcaaccagattagaaaacataatgtggaaacagatatctaatgaattaaatcatatcctattagaaaatgatatgaaattcacggtggtggtaggggacgtagccgggattttagcgcagggtaaaaagatgataaggcctcaacctatggaatataagtattcttggaaatcctggggtaaggcaaagataattggcgcggatgtgcaaaatactacgtttataatcgatggaccgaacacacccgagtgtccggatgatcagagagcttggaatatctgggaggtagaagattacgggttcggaatatttacaaccaacatatggttgaaactcagagatagttatacacaggtttgtgatcaccgactgatgtccgcagcaatcaaggactcaaaagcagtacatgcagatatggggtactggatagagagcgagaaaaatgaaacttggaagttagcccgagcttcttttatagaagtcaaaacttgtatatggcctaaaagtcacaccttgtggagcaacggagtattagagtctgagatgattgtaccaaaaatatacggcggtccaatcagtcagcacaattataggccaggatacttcacacaaaccgctggaccgtggcacttaggaaagttagaactagatttcgacttatgtgaaggtacaactgtagtcgtagacgagcattgtggaaacagaggtcccagtctgagaacaactacagtcacgggtaaaatcattcacgagtggtgttgtaggagttgcacgttacccccactccgatttcgcggtgaagatggttgttggtatggtatggaaatacgacccgttaaagaaaaagaagaaaatttagtaaaatcgatggtctcagcgggaagcggagaagtagattctttttccttaggcctattatgtatttcaataatcatagaggaagtgatgagatctaggtggagtcgaaaaatgttaatgactggtacattagcagtatttttccttttgatcatggggcagctaacatggaatgacctcataagattgtgcataatggtaggtgccaacgcaagcgatcgcatgggcatgggtacaacgtatcttgcgctcatggctacatttaagatgcgaccaatgttcgcagtgggtcttttgtttcgaagacttacatcaagagaagtattgttacttacaattggattgagtttggtagcatcagtcgagctaccgaactcacttgaagagttaggggatggtttagcaatgggtattatgattctgaaattgctaaccgatttccaatcacaccaattatgggccaccttattaagcctaacatttataaaaacgactttctcactgcattacgcttggaaaacgatggccatggttcttagcatagtaagtttattcccattatgtctgtcaaccacaagtcagaaaactacatggctgcccgttctcctaggatcactcggttgcaaaccactcacaatgttcctcatagcggaaaacaaaatatgggggaggagatcttggccacttaatgaaggcataatggcagtaggaatagtgtcgatactattaagctcattattaaagaatgatgtcccactagccgggccgctaatagcgggcgggatgcttatagcgtgctacgtaatatcaggaagctcggctgatctaagtctagagaaagcagcggaggtttcatgggaagaggaagctgaacatagtggagctagtcataatatccttgtagaagtccaagatgatgggactatgaaaattaaagatgaagaaagagacgacacattaactatactcttaaaagccaccttattagctgtaagcggcgtgtatcctttatccataccagcaacattattcgtatggtatttttggcaaaagaagaaacaacgatcaggtgttctatgggatacaccatcgccaccagaagtagaacgagcagttttggatgatggaatataccgaatcatgcaacgaggactactaggacgatctcaagttggagttggagtattccaagaaaacgtgtttcacacgatgtggcacgtaacaagaggtgcagttttaatgtatcaaggaaaacgtctagagccgtcttgggcaagtgtcaagaaggatttgattagttacgggggaggctggagactgcaaggtagctggaacacaggagaagaagttcaagttatagcggtagagccaggcaaaaatcccaaaaacgttcaaaccgccccaggtacatttaagacaccggaaggggaagtgggagcaatcgcgttagactttaagcctgggacgtccggcagccctatagttaatagagagggtaaaatcgtaggactatacggaaatggtgtagtcacaacgtcgggtacttacgtgtcagctattgctcaagcaaaagcaagtcaagagggaccactgcctgagatagaggacgaagtctttagaaagcggaatttgaccattatggacctacatcccggtagtggtaaaactagacgatatctacctgctattgttagagaagccataaaaagaaaactaagaactcttatattggcaccaacaagagttgtcgcgtcagagatggctgaggcattgaagggaatgcccattcgataccaaactactgcagtcaagtcagaacatacaggtaaggaaatagtggacttaatgtgccacgccacttttacaatgcgcctgctgagcccggtaagggttcccaattataatatgattattatggacgaagctcatttcactgacccatcaagcattgcagctcgaggatacatatctacaagggtaggtatgggagaggcggcagcaatattcatgacggcgaccccgcccggcagcgtagaagcatttccacaaagtaatgcagttatacaagatgaagagagggatataccagaaagatcctggaacagtggttacgaatggataactgactttccaggcaaaacagtctggtttgttcctagtataaaaagtggaaatgacatagctaattgcctgaggaaaaatggaaaaagagttatacaattgtctcgaaaaacttttgacactgaataccagaaaacgaaaaacaacgactgggactacgtagttactactgacattagtgaaatgggagctaattttagagcggatagagtcattgacccacgaagatgcttaaaaccagtaattttgaaagacggccctgaaagagtaatcttagctggacctatgcctgttactgtcgcaagcgcagcacaacgtcgtggacgcatcggaagaaatcataataaagagggcgatcagtatatatatatgggtcagccactaaataatgatgaagaccacgctcattggaccgaagcaaagatgttacttgacaacatcaacacacctgaaggtataataccagccctttttgaaccggaacgggagaagtcagctgcaatcgacggcgaatatagacttagaggagaggcgcgaaaaacctttgtagaactcatgagaagaggggacttgcctgtttggctatcatataaggttgcgtctgaaggcttccagtacagtgataggaggtggtgtttcgacggcgaacgaaacaaccaggtattagaagagaacatggacgtagaaatctggactaaagagggcgaaaggaagaaattaaggcctcgatggttggacgcgagaacttattccgatcccttagctttacgagaatttaaagagttcgctgcaggtaggcgtagcgtcagcggggatttgatattagaaatagggaaattaccgcagcatctaacgcagcgagcgcaaaatgcattagacaacttggttatgttacataattcagaacaaggcggcagggcttatcgccacgcaatggaagaattaccagacaccattgaaaccctcatgctactcgcgctaatcgccgtgctgacaggtggtgtaactttatttttcttaagtggaagaggtttaggaaagacatcaattggattgctatgtgtgatggcttcatcagttctcctatggatggcatcagtagaaccacactggatagcagcttccataatactggagttcttcttaatggtgttactcatcccagagccagaccgacaaagaactcctcaggacaatcaacttgcgtatgttgtcattggattgttatttatgatattgactgttgccgctaacgaaatgggcttgttagaaaccactaaaaaggatttgggtataggtcatgtagcagtcgagaatcaccaccacgctgcaatgttagacgtagatctaaggcctgctagtgcgtggacactatatgctgttgcaacgacaattattacacctatgatgcgacatacgatagaaaacaccacagcgaacatatctttaactgcaattgccaaccaagcagctatactaatgggcttagataaagggtggccaatatcaaaaatggacataggagtaccattactggctttgggctgctactcccaagtaaatccattgacgctcacggcagcagttctgatgctggttgcccattacgcaattatcggaccaggcctacaagccaaagccactcgagaagctcagaaacgaactgccgctgggataatgaagaatccgacagttgacggaatcgtggccatagatttagacccagtcgtgtatgacgccaaattcgagaaacaacttggacagataatgttactaatcctatgcacaagtcagatattattaatgagaactacatgggcgttatgtgaaagtataacactggcaacaggaccccttacaacactatgggaaggatcaccgggcaaattctggaatacaacgattgccgtgagcatggctaatatattcagaggttcatatttggcaggagcaggccttgcattcagtcttatgaaaagtttaggcggtgggagaaggggtacgggagcgcaaggtgagacattaggggaaaagtggaaaaggcagttgaatcagctctcgaagtctgaatttaatacttataaacgcagcgggattatggaagtcgatagaagtgaggccaaagaaggtttaaaaagaggtgaaaccacaaaacatgcagtttcaagaggcacagctaaattacgctggtttgttgaaagaaatctggttaaaccagaaggcaaagttatagacctaggatgcggacggggcggatggtcttactactgtgcgggtcttaagaaagtaacggaggtaaaagggtatactaaaggaggtccgggtcatgaagaacctatccccatggctacatatggttggaacttggtgaaactacactccggcaaggacgttttcttcatacctccggagaaatgcgacacgttgttgtgtgacataggggaaagtagtcctaaccctacgatagaggagggaagaacgctgcgtgtactaaaaatggtagagccctggttacgaggtaaccaattctgtattaaaatcctcaacccatacatgccaagtgtagtggaaaccttggaacaaatgcaacgtaaacatggaggtatgttagtgcgcaatcccttatcaaggaactcaactcacgaaatgtactgggtgtcgtgtggaacaggaaatatagtatcagcggtgaacatgacttcgcgtatgttattgaatcgattcaccatggcacacaggaaacccacgtatgagcgggatgtcgacctaggtgccggcactagacatgtagccgtggaaccggaagtcgcaaatttagatatcataggccagcgtatagaaaacataaaacatgaacataaaagcacctggcattatgacgaggacaatccgtacaaaacatgggcataccacggaagttacgaggtaaagccctctggctcagcttcatcgatggtgaatggagtagtcaaactattaactaaaccttgggatgttataccgatggtgacacaaatcgcaatgacggacactacaccgttcggccaacaacgcgtcttcaaggaaaaagtggacaccagaaccccaaaagctaaaaggggtacagcacaaataatggaagttacagcaaaatggctgtggggctttctcagtcgaaacaagaaacctagaatatgtaccagggaagaatttactcggaaggtgaggagtaatgccgcaattggggctgtgttcgtggatgagaatcaatggaactctgctaaagaagccgttgaagatgaaagattttgggatctggttcacagagaacgtgaattacacaagcaaggaaaatgtgcaacatgcgtgtataatatgatgggtaagcgcgagaagaaattaggtgagttcggcaaagcaaaaggaagtcgagcaatatggtacatgtggctaggagctcgattcctcgagttcgaggctttaggattcatgaatgaagatcactggttctcgagagaaaatagtttatccggagtagaaggagagggtctccacaaactcgggtacattctcagagatataagcaagataccaggaggaaacatgtacgctgatgatactgctggttgggatacaagaataacggaggatgatctacaaaatgaggcaagaataactgacatcatggagccagaacatgcattgttagcgaagagtatcttcaaattaacctatcaaaataaagtagtgagagtacaaagacctgcgaaaaacggcacagtaatggacgtaatatctagaagagaccagcgtgggtcaggacaagtggggacatacggactgaacacatttaccaacatggaagctcaattaatacgacaaatggaatcagaaggaattttcagcccgtctgaactggaaacgcctaacttggcggaaagggtactagactggctagaaaagtatggagtagagaggctaaaaaggatggcaatatcaggcgatgattgcgtggtcaaaccaatagacgacagattcgccactgcgttaaccgcacttaacgatatgggaaaagtcagaaaggatataccgcagtgggaaccatcgaagggatggaacgattggcaacaggtgccattttgtagccatcattttcatcaacttataatgaaagacggcagagagatcgtagttccatgccgcaaccaggatgaattagtcggtcgtgctagagttagtcagggcgccggatggtcattacgcgagacggcatgcctaggcaaatcatatgcgcagatgtggcaactaatgtacttccataggcgtgacctaaggctagctgcaaatgccatatgcagcgctgtaccggtcgattggatccctacctctagaacaacatggtcaatacatgctcatcatcagtggatgacaactgaagatatgttaagtgtatggaatagggtctggattgaagaaaatccttggatggaagataaaacacatataagcagttggggagatgttccatacctaggaaaaagagaagaccaatggtgtggatcgttgattggactcaccgctagagcgacctgggccaccaatatacaggtagcaataaatcaggtacgcagactaataggtaacgaaaactatttagattatatgacgtcgatgaagcgattcaaaaacgaaggtgaacccgagggagcattatggtaa

SEQ ID NO: 21800 - RNA, 9879 nt, synthetic construct
  misc_feature 1..9879: note = derived and/or modified CDS sequence (opt6) from DENV-1__GU131723__SS-prME
  source 1..9879: mol_type = other RNA
tcagttactatgttattaatgctcatgcctacagcattagccttccatctaactactaggggtggggaacctcatatgattgtttcaaaacaagaaagaggaaaatctctcctatttaaaacgtccgctggcgtaaatatgtgcaccttaatagccatggacttaggagaactctgtgaagatactatgacttacaaatgtccgcgtataactgaaactgaacctgacgatgtagactgctggtgcaatgccactgatacctgggtgacatacggtacatgttcacaaactggcgaacacagaagggacaaaagatccgtggcgcttgccccgcatgtaggtcttggcttagaaactcgcacagaaacatggatgtcatcggaaggggcttggaaacaaattcaaagggtggaaacatgggcgttacgacaccccggttttacggttatagcactctttttggcgcatgcaatagggacttcgataacccaaaaaggaataatatttatattgcttatgttagtaacgccttcaatggctatgaggtgtgtaggaattggttcacgtgactttgtagaaggtctttccggtgctacatgggtcgatgttgtattagaacatggttcctgtgtcaccacaatggcaaaagataaaccaacactcgacatagaactactaaaaacggaagtaaccaatcctgctgtcttgcggaaattatgcattgaagccaaaatttcaaacactacaacagactcaagatgccccacacaaggcgaagccaccttagttgaagaacaagacgcaaattttgtatgtaggagaaccttcgtcgacaggggctggggcaacggttgtggcctatttggtaaagggagcctcatcacatgtgcaaaattcaaatgtgttactaaactagaaggaaaaatcgttcaatacgaaaatctaaaatatagcgtaattgtaaccgttcataccggtgaccagcatcaagtaggtaatgagtcgacagaacatggcacaaccgctacgataacccctcaagctcccactaccgagatacaattaacggattatggggcccttaccctagactgttcaccgcgaacgggcctagatttcaacgaaatggtgttattaacaatgaaagagaaatcgtggctagttcacaaacagtggtttttagatctgcccttgccatggacgtccggggcaagtacttcccaagaaacatggaatcgacaagacctattagttactttcaaaacggcacatgcgaagaaacaggaagttgtagttttagggagccaagaaggcgctatgcacaccgctttgacaggtgctactgaaattcagacatctggaacaacaaccattttcgcgggacatttgaaatgtcggttgaaaatggataaactaaccttaaaaggaatgtcgtatgttatgtgtaccggtagttttaaattggaaaaagaattagcggaaacacagcatggaacagtattagtacaaatcaagtacgaagggacagatgcaccatgcaaaatccccttttcaacccaagatgaaaaaggagtaactcagaatggtcgactaataaccgctaatcctatcgtcacagacaaagaaaaacctgtaaatatagaggcagagcctccatttggtgagtcgtatatagtgataggggcaggagagaaagcgttaaaactatcatggtttaagaaaggatctagtataggaaagatgttcgaagcaacagcaaggggagcacgtaggatggcgatattaggagacaccgcatgggattttggatcaataggaggagtttttaccagcgtcggaaaacttgtccatcagatctttggaacggcatatggagtattatttagcggagtctcatggacaatgaagatagggattggagttcttttaacctggttgggattaaatagtcgatctacatcattatccatgacatgtattgcggttgggctagtaactctgtatttaggagttatggtacaagctgactcaggttgtgtaataaattggaaaggaagggaattaaagtgtggatcgggcatatttgttacaaatgaagtacatacatggactgagcagtataaattccaagcagactccccaaagagacttagtgcggcaataggtaaagcatgggaagaaggtgtttgtggcattaggagtgcgacgcgactcgaaaacataatgtggaaacaaatcagtaatgaactaaatcatattctactagaaaatgatatgaaatttactgtagtagtaggggacgtggccggaatcttggcacaaggcaaaaagatgatacgtccacaaccgatggaacataagtactcttggaagtcatggggaaaagctaaaattattggagcagacgtgcagaatactacgttcattatagatggcccaaacacaccagagtgccctgacgatcaacgagcgtggaatatatgggaagtagaagactatggatttggtatattcactacaaatatctggctaaagttacgtgatagttatacgcaagtttgtgatcacaggttgatgagtgcagctataaaggattcgaaggcggtacatgctgacatgggttattggatagaaagcgagaagaacgaaacatggaaattagcaagagcctcattcatagaggtaaaaacatgtatatggccaaaatcgcatacactatggtctaatggggttttagagtcggagatgataataccgaaaatatatgggggccccataagtcagcataattataggccaggttattttacacagacagcaggaccctggcatctaggtaaactagaattggatttcgacttatgcgaggggacaacggtagtagtcgatgaacactgtggtaatcggggaccttcattacgaacgacaactgtcactggtaaaataattcatgagtggtgttgcaggtcatgcactttacctccgctacgttttagaggagaggatgggtgttggtatggtatggaaattagaccagttaaagaaaaggaagagaacttggttaaaagcatggtttcagccggctcaggtgaggtcgactcatttagtcttgggttactctgtatatcgattatgatagaagaagtaatgagaagccgctggtcaaggaaaatgctaatgactggcactttagcagtatttttcctactgattgtgggtcagttgacatggaatgatcttatacgcctttgcatcatggtaggagccaatgcttctgacagaatggggatggggacaacatacttagctttaatggcaacatttaaaatgagaccaatgtttgcagttggattactcttccgaagacttacctcacgcgaagtgctgctacttacaattggacttagcttagtagcgagcgtggagctaccaaatagtttagaagaattaggtgatggcctcgctatgggaattatgattttgaaactgctgacagacttccaatctcatcaactatgggccacgttactatcattaactttcataaaaacaacattttcgctacactatgcatggaagactatggcgatggtactttctgtagtaagtttattcccgttatgtctcagtacaacaagtcagaaaactacatggctacctgtcctactagggtctctagggtgcaagccacttacaatgttcttgatagccgaaaataaaatatggggacgacgctcttggccgctcaacgaaggtattatggctgtaggtatagtaagtattttattgtccagcttattgaaaaacgatgtgccactagccggtccgctcatcgccggaggaatgttaatagcttgttatgtcatctctggtagcagtgcagatctcagcttagagaaagctgcggaagtttcatgggaagaggaggcggaacatagcggagcatcccataacatcctagttgaggtgcaagatgatggtacaatgaagataaaagatgaagaacgtgatgatactcttacaatattactcaaagcgactctactggctgtttccggagtttatccactaagcatacccgctacactcttcgtgtggtacttttggcagaagaagaaacagcgtagtggtgtactatgggatacgccaagtccaccagaggtggaacgggcagttttagatgacgggatatacagaatcatgcaacgtggtttgcttggaagaagtcaagtcggcgtcggcgtcttccaagaaaacgtgttccatactatgtggcacgtgacaagaggagccgtattgatgtatcaaggtaaacgattagagccgtcctgggcaagtgtcaagaaagatttaatctcttatggtggagggtggagactgcaaggatcttggaacacaggagaagaagttcaagttattgcggtagaacctgggaagaatccaaagaacgtacaaacagctcccggcacatttaaaacgcctgaaggagaagtaggagcaatagctctggattttaaaccaggtacttctggctctccaatagtcaatagggaaggaaaaatcgtaggattatacggaaatggggtagtgactacctctggaacatatgtatccgcgattgcgcaggcgaaagcaagtcaagaagggcccttaccagagatcgaagacgaagtcttcagaaaaaggaatttaacaataatggatttgcatcctggatctggtaagacccgcaggtatttaccagccatcgtgcgagaagccataaaacgaaaactcagaacgctaatactagcaccaacaagagttgtagcctctgaaatggcagaagctcttaaaggaatgccaatacgctatcagactacagcagttaaatcggaacacacgggaaaagaaatcgttgacctgatgtgtcacgcgacatttacaatgcgtcttttatctcctgtgcgcgttcccaattacaatatgatcattatggacgaagcgcattttacagacccgagctctatagctgcaagaggatatatatcaacccgcgttggaatgggagaagcagctgcgatatttatgactgcgacacctccaggatcagtggaggctttcccacaatcaaatgcagtaatacaagacgaggaaagggatatacccgaaagaagttggaactcgggatatgaatggatcacggacttcccgggaaagactgtttggttcgtaccgtccataaaatctgggaatgacatcgcaaattgtttacggaaaaatggcaagagagtgattcaattgtcgcgtaaaactttcgataccgagtatcagaagacgaaaaacaatgactgggattatgtcgtaacaacagatatctctgaaatgggtgctaactttagagcggatagggtcatagatccacgaaggtgccttaagcctgtaatactgaaagatggaccagaacgggtaatattagcaggtcctatgccagttacagttgctagtgcggcgcaaagacgggggcgagtaggcagaaatcataacaaggaaggtgatcaatatatctatatgggacaaccattaaataatgacgaagatcacgcacactggactgaggcaaagatgttactcgataacataaacacccctgaaggcattattccggcattgttcgagcccgaaagagaaaaatcagcagccatagatggcgagtaccgtcttagaggtgaagctagaaaaacattcgtagaattaatgagaagaggagatcttccagtatggttgtcatacaaagtagcttctgagggattccaatatagtgatagacgttggtgttttgatggtgaacgcaataatcaagttctagaggaaaatatggacgtcgaaatttggacaaaagaaggggaaaggaagaaattgagacccaggtggttagatgcaagaacttactctgatccattagctctaagagagttcaaagaatttgcagcaggacgacgttcagttagtggtgatttgattttggagatcggtaaactaccgcaacacctaacacagcgtgcgcaaaacgcactcgataatctagtgatgctccataattctgagcaaggaggccgtgcatacagacatgcaatggaagaactcccagatacaatcgaaactctcatgctactagcgttgatcgccgttcttacaggaggggtcacattatttttcctttcagggagaggacttggaaaaacaagtataggtctattatgcgtgatggcatcaagtgtcttactgtggatggcctccgtggagcctcattggatagcggcatcaattatactcgaatttttcctaatggtacttctcatacccgagcccgatcgtcagagaaccccacaagacaaccaattggcgtacgtagtaatcggtctattattcatgatattgacagtcgctgcgaatgaaatggggctgctagaaacaacaaagaaagatctagggattggacatgtcgctgtagagaaccatcatcatgccgcaatgctagatgtggatctacatcctgcgagtgcgtggacactatacgcggtagctaccactattatcacaccgatgatgagacatactattgaaaacacaaccgcaaacattagtctaaccgcaatcgcgaaccaagcagcaatattaatgggtctggataaaggctggccgataagcaagatggacataggagttccactactagcccttggatgctattcacaagtaaatcccttaactctaacagcagctgtcttgatgcttgtagctcattatgctattattggtccgggactccaggccaaagcgacgagagaggcccagaagagaaccgcggctggtataatgaaaaacccgacagtagatggaattgtagccattgatttagatccggtggtatatgacgctaaattcgaaaaacaattgggacaaataatgctactcatcttatgcacatcacaaattcttctgatgcgaactacttgggctctttgcgaatccattactctagcaacgggtccactgacaacgttatgggaagggtcgccaggtaaattctggaatacgactattgcggtttcaatggccaatatttttagaggcagctatctagcaggcgcggggttggcgtttagcttaatgaaatctcttggcggcggccgacgaggtacaggagctcaaggagaaacattgggagaaaaatggaaaagacaactaaatcaactgtcaaaaagtgagttcaatacctataaaaggtctggaatcatggaggtagatcgtagcgaagccaaggaaggtctaaaacgtggtgaaacaacaaaacatgcagtaagtaggggcacggcaaagctacgatggtttgtagaacggaatttagtcaaaccggaaggtaaagtcatcgatctaggttgtggtagaggaggatggtcatactactgtgctggactaaagaaagtaacagaggtaaaaggttatacaaaaggagggccaggccatgaagaacccataccgatggctacatatggctggaacttggttaagctccatagcggaaaagatgtattctttattcctccagaaaaatgtgacactttactatgcgatataggggaaagttcaccgaacccaaccatagaagaaggaagaacattaagagtgttgaagatggtagaaccctggttacggggcaatcaattttgtataaaaatattgaacccatatatgccctcggttgtcgaaacattagaacaaatgcaaagaaaacatggaggaatgttagtcaggaatccactatctagaaatagtactcacgaaatgtactgggtgtcatgtgggacaggaaacatagtaagtgctgtaaatatgacctctcgaatgttgcttaatagattcaccatggctcaccgaaagccaacatacgagagagacgtggatcttggagcagggacaagacacgtggccgtagagcccgaagtagctaatcttgatataataggtcaacgaattgaaaatataaaacatgaacacaaatccacctggcattatgatgaggataacccttacaagacttgggcataccatggcagttacgaagtaaagccatcaggctcagcgagcagtatggttaatggagtagtaaaattactaactaaaccttgggacgtcatacctatggtaacacagatcgccatgactgacacaacaccatttggacaacagagggtttttaaagaaaaggtagatacccgcaccccaaaggcaaaaaggggaacagcacaaatcatggaagttactgcgaaatggctgtggggctttctcagccgaaataagaaacctcgaatttgcacgagggaagagttcacacgaaaagtaaggagtaatgcagctataggtgcagtattcgtcgacgaaaatcaatggaactcggcgaaagaagcggtagaagatgaacgattctgggatttggtgcatagggaaagagaactacataaacaaggcaagtgcgccacgtgtgtatataacatgatgggaaaacgtgaaaagaaacttggagagttcggcaaagcgaaggggagtcgagccatttggtatatgtggctgggagcgaggttcctcgagttcgaggcccttgggttcatgaacgaagatcattggttttcaagagaaaattcactgtcaggagttgaaggagaaggtttgcataagttaggctatattctgcgagacatcagtaaaattcctggaggaaatatgtatgcggatgatacagccggttgggatacgaggataacggaagatgacctccaaaatgaggccagaataacagatataatggaaccggagcacgccctattggcaaagagtatttttaaacttacatatcaaaataaagtagttcgtgtccaaaggccagctaaaaacggaactgtaatggatgtaatatccaggcgagatcaaaggggcagtgggcaagtcggtacctatggattaaataccttcacgaatatggaagcccaactaataaggcaaatggaatctgaagggatattttctccatctgaactagaaacgccaaacctagccgaaagagtattagattggcttgaaaagtatggtgtagaaagattaaaacgtatggcaatctctggcgatgattgtgttgttaaaccgatcgacgatagatttgcgactgcgctaaccgcactaaatgatatgggaaaagtaaggaaagatatcccacaatgggaaccttccaagggatggaatgactggcaacaagtgccattttgtagtcatcattttcatcagctaataatgaaagatggacgagagatcgttgtgccctgtagaaatcaagatgagctagttgggagagctagagtctcccaaggagctggatggagcctaagagagactgcatgtctagggaaatcatacgcacagatgtggcaacttatgtattttcatagaagggatttaagacttgcagctaacgcaatatgtagtgccgtgccggttgattggattccgacaagtagaaccacatggtcaattcatgctcatcatcaatggatgacaactgaggatatgttaagtgtttggaaccgtgtgtggatagaggaaaatccatggatggaagataaaacccacatttcatcttggggagacgtaccctatttgggaaaacgtgaagatcagtggtgcgggtctctaatcggtttaactgccagggccacctgggcaactaacatccaagttgccatcaatcaagtcagacgtttaatcggtaatgaaaactacttagattatatgacatcgatgaaaagattcaaaaacgaatcagatccagagggagcactctggtga

SEQ ID NO: 21801 - RNA, 9879 nt, synthetic construct
  misc_feature 1..9879: note = derived and/or modified CDS sequence (opt6) from DENV-1__GU131725__SS-prME
  source 1..9879: mol_type = other RNA
tcagttactatgctcttaatgttaatgccaaccgcactagcctttcacctgactacacggggaggcgaaccacatatgatagtgtcaaaacaagaaaggggaaaaagtctattatttaaaaccagtgcgggtgtaaatatgtgtactttaatagcaatggatctcggagaactttgtgaagacacaatgacttataaatgcccaaggataactgaagctgaacctgatgacgtggattgttggtgcaacgccacggatacttgggtgacttatggaacatgcagtcagaccggagaacacaggagagataaaaggtccgtcgctttggctccacatgttggtttaggtttagaaacgagaacagaaacgtggatgagttctgaaggcgcctggaaacaaattcaacgagttgaaacgtgggcactgcgccatccaggcttcacagttattgctctattccttgcacatgcaataggaacatctattacgcaaaaaggtataattttcatattactaatgttggtgaccccgtctatggctatgagatgcgtaggcattgggagtcgagattttgtagaaggattgagtggcgcaacttgggtcgacgtggtacttgaacatgggagttgcgtaacgacaatggcgaaagataaaccgacacttgatatagaattgttaaaaacagaagtaacgaatccggctgtactgcgaaaactgtgcattgaagctaaaatttcaaacaccaccacagatagtagatgccctacacaaggagaagctaccctcgtcgaagaacaagatgcaaattttgtctgccgacggacttttgtagatagggggtggggtaatgggtgtggactatttggtaaaggttccttaatcacttgcgccaaatttaaatgtgtaactaaactcgaagggaaaattgtccaatatgaaaatctgaaatactcagtaattgttactgtccacacaggagatcaacaccaagtaggtaatgaatctacggaacacggcactactgcgacaataacgccacaagctcccacgacagaaatacaattaaccgactatggggccttaaccctagattgtagtccccgaacggggctcgatttcagcgaaatggtgctgttaacaatgaaagagaaaagttggttagtacacaaacagtggttccttgatttaccattaccttggacatcaggtgcttcaacgtctcaagaaacatggaatcggcaagatctattagtaactttcaaaacagcacatgcgaagaagcaagaagtagtagtattgggttcccaagaaggtgcgatgcacacggcacttacaggcgcaacagaaatacaaacatccggcactacaactatcttcgcagggcatctcaaatgcaggctcaagatggataaactgactctaaaaggaatgagttatgtaatgtgcacaggttcatttaaattggaaaaggaagttgcagaaacgcaacatggcactgtgttagtacagataaaatacgagggtacagatgcaccttgtaagataccgttttcaacccaagatgagaaaggggtaacacagaatggacggcttattacggctaatccaatcgtaaccgacaaagaaaaaccggttaatattgaagcagagcctccctttggcgagagctatattgtaatcggtgcaggagaaaaagcactcaaactatcgtggttcaagaaaggttccagtattggaaaaatgtttgaagcgacggcacgcggagcaaggagaatggcaattctgggagatacagcatgggattttgggtcaattggaggggtgtttacatcagtaggaaaattagtgcatcagatttttggtacggcatacggtgttctattttcaggggtatcgtggactatgaaaattggaattggagtactcttaacgtggttaggattaaactcccgttcaacgagcttaagtatgacatgtatagcagttggattagtgacactgtatttaggagtgatggtacaagcagactcaggatgtgttattaattggaaaggtagagagctaaaatgtggatctgggatattcgtaacaaacgaggtgcacacttggaccgagcaatataagttccaagcagattcaccaaaacgattatctgcggctattgggaaggcgtgggaagagggagtatgtggcataagatccgcgactcgcttggaaaacattatgtggaagcaaataagtaacgaattgaatcatatacttctagagaacgacatgaagttaactgtagtggtgggtgatgtagcaggaatccttgggcagggcaaaaagatgataagaccacagcctatggaatacaaatacagttggaagtcgtggggaaaagctaaaataataggagcagacgcgcaaaacactacattcatcatcgatggtccaaacacgcctgaatgcccggatgaccaaagagcatggaatatatgggaggttgaagattacggttttggtatatttacaacaaacatatggctaaaactccgggattcatatacacaggtgtgtgatcataggttgatgtcggcggctatcaaagattcaaaagccgttcatgccgacatgggttattggatcgagagcgagaaaaatgaaacatggaaacttgcaagagcttcgttcattgaagtaaaaacatgcatatggcctaagtctcacactttatggagtaatggcgtattagaaagtgaaatgataatcccaaaaatttacggaggacctatcagccaacacaattacaggccaggttacttcactcaaactgcgggtccatggcacttaggcaaattagaactagacttcgatctgtgtgaaggaacgactgtagtagttgatgaacattgtggcaatcgcggtccatcattaagaacaactactgtaactggaaaaataatacacgaatggtgctgtaggagttgtacgctacctcccttaagattccgtggagaagacgggtgttggtacgggatggaaatcagaccggtcaaagaaaaagaagaaaatcttgtcaaaagcatggtgtcagcaggaagtggcgaagtagatagcttctcgctgggtctcctatgtatctccataatgattgaagaggtaatgcgcagtaggtggtcacgaaaaatgttaatgacaggaactctcgctgtattctttctactaataatgggccaattgacctggaatgatttaattcgtttatgcattatggtaggagctaacgcgtcagaccgaatgggaatgggtaccacctacttagctcttatggcaacctttaagatgagaccgatgtttgcagtggggctattattcagacgcttgacaagtcgagaagtgctattattaaccataggcttaagtttagttgcgtctgtagaactaccaaattctctcgaggaattaggagacgggttagcaatgggtatcatgatactcaaactcctcacagacttccagagctaccaattatgggcaaccctactctctcttacattcataaaaaccacattctcattacattacgcttggaagactatggccatggttctatcaatcgtatcattgtttccactatgtttaagtactacgagccagaaaacgacgtggttacccgttctgttagggtcgttggggtgtaagcccttaacaatgtttttaattgctgaaaataagatttggggacgaaagtcatggcccctcaacgaaggtataatggcagtaggaattgtgagcattctattatcttcgttactcaagaatgatgtccctctcgctggtccacttattgcaggagggatgctaatagcatgctacgttataagcggatcatcagcggatctatctctagagaaagcagccgaagtaagctgggaagaggaggccgagcactctggagcgtcgcataacattctcgtcgaagtacaagatgatggaacaatgaaaataaaagacgaagaacgagacgacacattaacaatcctactaaaagctacattactggcagtctcaggagtctatccgttgagtattcccgcaaccctatttgtatggtatttttggcagaagaagaaacaacgctctggtgttctttgggatactccaagtccgcccgaggtagagagagctgtactcgatgacggtatctacagaattatgcaaaggggtttactgggtcgtagtcaagttggagtaggagtattccaggaaaacgtatttcacacgatgtggcacgtaacgagaggagcggttcttatgtaccaaggcaaacgactcgaaccatcttgggcgtcagttaagaaagacctaatatcttatgggggaggttggaggctcagagggtcttggaataccggagaagaagtacaagttattgcagttgagccaggaaagaaccccaaaaacgttcaaacggcaccagggacatttaaaaccccggagggagaagtaggggcaattgcgctggatttcaaacctggtacttcagggtcgccaatcgttaatagagaaggtaaaatagtcggtctatatggtaatggtgtagtcacaacaagtgggacatatgtctcggccattgctcaagcaaaagcatcacaagaaggcccgcttcctgaaattgaagatgaggtcttcaggaaaagaaacctcaccatcatggacctacatcctggctcaggtaagaccagacggtacttaccagcaatagttcgcgaagctataaaacgcaagctaaggacgcttatattggctcctacgcgggtagtagcgtccgaaatggcagaggcactaaaaggcatgcccatacgatatcagactactgctgttaaaggggaacataccggaaaagaaatagtcgatttgatgtgccacgcaacctttactatgagattactaagtccagtaagagtacctaattataacatgattataatggacgaggcgcacttcacagatccctcatctatagcagcacggggctacatatccacaagagtgggtatgggcgaagcggctgcaatattcatgacagcaactccaccaggctcagtagaggcttttccccagagcaatgcagttatacaagatgaggaaagagatataccagaacgaagctggaatagcggttacgaatggattacggatttccctggaaaaactgtctggttcgtaccatcaataaaatccgggaatgacatagcaaactgcctccgtaagaacggtaaacgtgtaattcagttgagtcggaaaacatttgacaccgaatatcaaaagaccaaaaataatgactgggattatgtcgtcactacagatattagtgagatgggcgcgaatttcagagcagatagagtaatagatcctagaagatgcttaaaaccagtaatactaaaggatggtccggagagagtaatcttagcaggcccaatgcctgtaactgttgccagcgcagctcaacgtcgtggtcgtataggcagaaatcataataaggaaggtgaccaatatatatatatgggccaacccttaaataatgatgaagaccatgcccactggacagaagctaaaatgctattagacaatataaatacgcccgaaggtattatcccagccttattcgaacctgagagggagaaaagtgcagcagttgatggagagtacagacttagaggcgaggcaaggaaaacatttgtagaattgatgaggcgtggcgaccttcctgtttggttatcttataaagtagcctcagaaggatttcaatatagtgatcgtcgatggtgctttgacggagagcgtaacaatcaggtactagaagaaaatatggatgtcgaaatatggacaaaagaaggtgaaaggaaaaagttacgaccgaggtggcttgacgcgcggacgtattccgacccattggcattaagggaatttaaagagttcgcagctggtcggcgaagtgtttccggtgatctcatacttgagattggaaagctaccgcaacacttaacccaaagagcacaaaatgcgttagataacctagtgatgttacataatagtgaacaaggtggtcgagcataccgacacgcaatggaagaattaccagatacaattgaaacactaatgttattagcgcttatagcagttttaactggtggtgtcactctctttttcctatcaggaaggggactagggaaaacaagtataggactactctgcgtcatggcctcatcagtacttctatggatggcgtcagtggagccgcattggattgcagcatcgatcatactagagttctttcttatggtactacttataccggagccagatcgtcagagaacacctcaagacaatcaattagcttatgttgtaataggactattattcatgattttaacagtggccgcgaatgagatggggttattagaaacgactaagaaagacttaggtataggtcatgtagcagtagaaaatcatcatcatgccgcgatgttagacgtagacctacacccagcaagcgcatggacattgtatgcagtagcaaccacgatcattacccctatgatgaggcatactatagaaaataccacggcgaacatatcattgacagcaatagctaatcaggccgcgatcctcatgggtcttgataaagggtggcctatcagcaaaatggatataggtgttcctcttcttgcattaggatgctattctcaagtcaacccattaacgcttactgcagcagtattaatgttagtagcgcattacgcaattataggtcctggattacaagcgaaggcgacaagagaggcacagaaaaggacagcagcaggtataatgaagaacccaacggttgacggtatcgtagccatagacttagatcctgtcgtttacgatgcaaagttcgaaaaacaattggggcaaatcatgttactaatcctttgtacttctcagatcctgctcatgcgaacgacgtgggcactgtgtgaaagcataaccttggccacaggtcctttaacaacattatgggaaggaagtccaggcaagttttggaacacgacaattgcagtgtctatggccaacatatttagaggctcctacctggccggcgcaggattggcattttcgctaatgaaatccttaggtggaggaagaaggggaacaggtgcacagggtgagactttgggagagaaatggaaacgccaacttaaccagctgagtaaatccgaatttaacacctacaaaaggagtggcatcatggaagttgatagatcagaagctaaagagggtctaaaacggggtgaaacgaccaaacacgcggtttctcgaggtaccgccaagttacgatggtttgtagaacgaaatctggtgaaaccagaaggaaaagtcatagacttgggctgtggtagaggaggttggagttattattgtgctggtctaaagaaagtaacagaggtcaaaggatataccaaaggtggaccaggccacgaagaaccaataccaatggctacatatggctggaatttagtcaaattacacagcggaaaagacgttttctttattccacctgaaaaatgcgatacgttattatgcgatatcggtgaatcaagtcctaatcctacaattgaagagggaagaactcttagagtattaaaaatggttgaaccctggttgcgtggaaatcaattttgtataaaaatcctaaatccctacatgcctagtgttgttgaaactctcgaacaaatgcaacgtaagcatggaggaatgttagtaagaaatccattatccagaaattctacacatgagatgtattgggtgtcatgcggaacaggaaatatcgtttctgcagtaaatatgacaagtcggatgttattaaaccgatttacaatggcacaccgaaagcctacctatgaaagagacgtagatttaggaactggaaccagacacgtggcagttgagccggaggttgcgaacctagacataataggacaaagaattgaaaatataaaacacgaacataaatcaacttggcattatgatgaggacaatccctataaaacatgggcatatcatggttcatatgaggtaaagccgtcaggctcagcaagctctatggttaatggagtagtgaagctcttaacaaaaccttgggacgtgatacctatggtaactcaaatagctatgacggatacaactccttttgggcaacagagggtttttaaagaaaaagtcgatacaagaacaccaaaagcaaagcgcggtacagcacaaattatggaggtgaccgctcgttggttatgggggttcttgtcgcgtaataagaagcctcgaatttgtaccagagaggaatttacgcggaaagtgaggtcaaacgccgctatcggagctgtattcgtggatgaaaatcaatggaacagtgctaaagaggcagtagaggatgagcgcttttgggacttagtacatagagaaagggaattacataagcaggggaaatgtgcaacatgcgtatacaatatgatggggaagagagagaagaaactaggtgaatttggtaaggctaaaggttcacgagctatatggtatatgtggttaggtgcaagattcctagagttcgaagcgttaggatttatgaatgaagatcattggttctccagagagaacagtctttctggcgtagaaggagagggacttcacaaattgggttatatattgagagatatatcaaagataccaggaggtaatatgtacgcagatgataccgctggctgggatacaagaataaccgaagacgatcttcaaaatgaagcaaagattacagatattatggagccggaacatgctctactcgcaaaagcaatattcaaactaacgtaccaaaacaaggtggtacgcgtacagcgacccgctaaaaatggaacagttatggatgtaattagcagacgcgaccaacgaggttcaggtcaagtaggaacatatgggctcaatacgtttacaaatatggaagcacagttaatacgtcaaatggaaagcgagggaatcttttcaccaagtgaactagaaactccaaacctagcagagagagccctagactggctagaaaaatatggagttgagagattaaaacgcatggccataagtggtgacgactgcgttgtaaaacccatcgacgatcgctttgcgacagcattgactgctctaaatgatatggggaaagtaagaaaagacatcccacaatgggagccaagcagaggatggaatgactggcaacaggttcccttttgtagtcatcacttccaccagttaattatgaaggatggaagagaaatcgttgtaccttgtagaaatcaagatgaattggttggacgcgcgagagtaagtcaaggagcgggatggagtctgagagaaactgcatgtttaggcaaaagctacgcacaaatgtggcaacttatgtattttcacagaagggatctaaggctcgctgctaatgcaatatgctcggcagtgccggtagattgggttccaacttcaagaaccacgtggtcgatccacgcacaccatcaatggatgacgacggaagatatgttatcagtctggaatagagtatggatcgaggagaatccttggatggaggacaaaacgcacatatcaagttgggaggatgtaccatatttaggaaagagagaagatcagtggtgtggatcacttataggactgacagcacgtgctacttgggctactaacattcaggtcgctataaatcaagtgcgtaggctcattggtaatgaaaattatttagattatatgacctccatgaaaagattcaagaatgaaagcgaccctgaaggtgctctttggtaa

SEQ ID NO: 21802 - RNA, 9879 nt, synthetic construct
  misc_feature 1..9879: note = derived and/or modified CDS sequence (opt6) from DENV-1__GU131726__SS-prME
  source 1..9879: mol_type = other RNA
tcagtaacaatgctattgatgctgatgcctacagctctcgcttttcacctgacaacccgtgggggagaaccacatatgatagtaacaaaacaagaacgtgggaaatcgttactattcaagacgagcgcaggagtgaatatgtgtacgttgatcgctatggatctgggagaattatgtgaagatacaatgacttataagtgtccacggattacagaagcagaaccggatgacgttgactgctggtgtaacgcaactgatacatgggtaacctatggaacgtgttcacagacaggagaacatcgccgagataaacgtagtgtggccctagccccgcacgtgggtttaggtctagaaacacgaaccgaaacttggatgtcaagcgaaggggcatggaagcaaatacaaagagtagaaacatgggcattgcgacaccctgggtttaccgtaatcgcattgttcttggcacatgctattggtacatctattacacagaagggcataatattcatattgttaatgttagttacgccgtccatggcgatgcgctgtgtggggataggcagccgtgatttcgtagaaggactttcaggagcgacatgggtagatgtagtactagaacacgggtcctgtgtcacaacgatggctaaagacaagcctactttagacatagaattattgaaaactgaagttacgaacccagctgttttacgcaaattatgtatagaagcgaaaatctcaaacacaacaaccgatagtagatgcccgacacaaggtgaagcaacgctaatggaagaacaagatgctaacttcgtatgccgacgaacttttgtagatcgaggatggggcaacggatgtgggttgtttggtaaaggatcattaattacgtgcgctaaattcaagtgtgtcacaaaacttgaagggaaaatcgtccaatatgaaaatttaaagtattctgttatagttacggtccacacaggagatcagcaccaagtcggtaatgaatccacggaacatggaactactgctactataacaccccaagcaccaacgagtgaaatccaattaaccgattatggcgctttaaccctcgattgttccccaaggactggattagattttaacgaaatggtactactaacaatgaaagagaaaagctggctagtacataaacagtggtttctcgatctacccctaccatggacgtcaggggcgtcaacctcccaagaaacttggaatagacaagacttattagtaacctttaaaacagctcacgctaaaaagcaagaagttgtagttctgggttcacaggaaggtgccatgcatacagctctaaccggggcaacagaaatccagacctcgggtacaacgacgatctttgccggtcaccttaaatgtcggttaaagatggataaactaacacttaaaggaatgagctatgtaatgtgcacgggaagttttaaactggaaaaagaagtagccgagacccaacatggaactgtattagtacagattaaatacgaggggacggacgcaccatgtaaaatacctttttcaactcaagatgagaaaggggcgacgcaaaacggaaggctaataacagcaaacccaattgtaacagataaagaaaaaccagtaaatatcgaagccgaaccccctttcggcgaaagttatatcgtcatcggtgcaggagaaaaagctctgaaactgtcgtggttcaagaaaggaagtagtattggtaaaatgtttgaggccacggcaagaggggctagacgaatggctattctaggagatactgcatgggattttggctccgtaggaggggttttcacgtcggtaggcaagctggtccatcaaatattcggtactgcatatggagttctattcagcggcgtcagttggacaatgaaaataggtataggagtactactaacgtggttgggtctaaattctcgatctacaagtcttagtatgacatgtatagcagtaggattagtgaccttgtatctgggcgttatggtacaagctgatagtggatgtgtaataaattggaaaggtcgcgagttaaaatgtggctctggaatctttgtaactaatgaagtacatacctggacggaacaatataaatttcaggcagatagtcctaagagacttagtgcagctattggcaaagcatgggaagaaggtgtttgtggcatccgctcagccacaagattggaaaacataatgtggaagcaaataagtaacgagttaaatcacattttattagaaaatgacatgaagttcaccgtagtagttggggacgtcgtgggcattctggcacaagggaagaagatgattagaccacaaccaatggaacacaaatattcttggaaatcatggggtaaagcgaaaattataggggcagatgtccaaaatactacttttataatagatgggccgaacactccagaatgtcctgatgatcaaagagcgtggaatatttgggaggtggaagattacggattcggaatatttgcaactaatatttggctcaagctacgtgattcttacacacaagtctgcgaccatagattaatgtctgctgcaattaaagacagcaaggctgtgcacgcggatatgggatactggatagaaagtgagaaaaatgaaacatggaaacttgcccgagcttcgttcatagaagtaaaaacttgcatatggcctaaaagccacacactatggagtaatggggtcttagaaagcgaaatgattatcccaaagatttatggaggtcccatttcgcaacataactacagacctggatacttcacccagaccgcaggaccttggcatttaggaaaattagaattagatttcgacctgtgcgagggaacgaccgtcgtagtagatgaacactgcggaaataggggaccttccctgaggactactaccgtcaccggcaaaataatacatgaatggtgttgtagatcatgcacattaccaccgcttcgattcaaaggagaagatggttgttggtatggaatggaaattcgaccggtaaaggaaaaagaggaaaatttggtaaagagcatggtttcggcaggttcaggagaagtcgattccttcagtctgggattgctatgtataagcatcatgatagaagaagtaatgcgatctaggtggagcaggaaaatgttgatgacaggtactctcgctgtgtttctattactgatcatgggacaattaacatggaatgatctaattagattgtgtataatggtcggtgcaaatgcatctgatagaatgggtatgggaaccacatacttagccctcatggcgacgttcaaaatgcgacctatgttcgcagtgggattactacttcgaagacttacaagtcgcgaagtgctccttcttaccataggattatcattggttgcatcagtggagttacccaactctttagaagagttaggagatggattagccatgggcataatgatactgaaactgttgactgactttcagtcacaccagctctgggcgacattactatcactaacattcataaagactacacttagtcttcactatgcatggaagacaatggcaatggtattgtcaatagtctcgttattccctttatgtttgtccacaactagccagaaaaccacatggttaccagtcttattaggctcatttggatgtaaacctctgacgatgtttttaataacagaaaataaaatttggggccgtaagtcttggcctctgaacgaaggcattatggcagttggggttgtttctatattattatcatcacttctgaaaaacgatgtacctttggccggccctctaattgcaggcggtatgttaatagcgtgttacgtcatttcgggttctagtccagacttgtcactcgaaaaagcagcagaagttagttgggaggaagaagctgaacactcaggagcaagtcataacatcctagtggaagtccaggatgacggtacaatgaaaatcaaagatgaagaaagagacgacacattaacgatcttactgaaagcaacattattagcggttagtggagtatatccactatcgatccccgcaacactgtttgtctggtatttttggcaaaagaagaaacagcgttccggcgtactatgggatacgccttctccgcctgaggtggagcgtgccgtccttgatgatggaatatatagaatcatgcagcgtggattgttgggaagaagtcaagtaggtgttggagtatttcaagaaaatgtcttccatacaatgtggcacgtaactaggggagcggttttaatgtaccagggcaaacggttagagccatcatgggcatcagtgaaaaaggatttaataagctacggagggggatggcgtcttcagggcagctggaacactggtgaagaagtacaagtaatagctgttgaaccgggcaagaatccaaagaatgttcaaacagcgcctggaacttttaagacacctgaaggcgaagtgggggcgattgcactcgatttcaaaccaggaacatcaggatccccaatagttaaccgagaaggaaaaatcgtaggtctctatggaaatggtgttgtaacaacttcaggcacgtatgttagtgcgattgcacaagccaaagccagtcaagagggcccgttgccggagatcgaagatgaagtgttcaggaagcgaaacctaaccataatggatctacatcctggatcaggaaaaacgcgaagatacttacctgcaatagtacgcgaagcaataaaaagaaaactgagaacactcatattagcgcctactcgcgtcgttgcaagtgagatggctgaggcactgaaggggatgccaatacgttatcaaacaacagcagttaagtcggaacatacagggaaggagattgtggatctaatgtgccacgcgacttttacaatgcgactcctctcgccagtgagagttccaaattataatatgattatcatggatgaggcccactttacggatccatcgagcatagcagcaagaggatatatctccactagggttggaatgggcgaggctgcggcgatatttatgactgcaacgcctcccggaagcgtggaagcatttccacaaagtaacgcagtgatccaagatgaagaacgagacattccagaacggtcgtggaactcaggttacgaatggataacagactttccaggaaagacagtatggtttgttccctcgataaaaagtggtaatgatatagcgaactgtttacgaaagaatgggaagagggtgattcaattgtcaagaaaaacatttgatactgaatatcagaaaaccaaaaataacgactgggactacgttgtaactacagatataagcgagatgggagcaaattttagagcagacagagtaatagacccgagaaggtgcttgaaacctgtaattttgaaagacggcccggaacgagttatcttggcaggtccgatgccggtgacggttgcaagcgctgcacaaagacgtggacggatagggagaaatcacaataaagaaggagatcaatatatatatatgggccaacctttaaataatgatgaggaccatgcacactggacggaagcaaaaatgttactagataacattaataccccagaagggataatccccgctctctttgagcccgaacgcgagaaaagcgcagctatagatggagaatatagattgcgaggagaagctagaaaaacattcgtagagcttatgcggcgcggggacctaccggtatggctatcatacaaagtcgctagtgagggttttcaatattcggacagaaggtggtgttttgacggtgagcgtaacaaccaagtattggaagaaaacatggacgttgaaatttggacgaaagaaggggaaaggaaaaagttgagacctcgctggctcgatgccaggacttacagtgatcctttggcccttcgagaatttaaagagtttgcggctggtcgaagatcagtatcaggggatttaattttagaaatcggaaaattacctcaacacttgacgcaacgtgcacagaatgcactagacaatttagttatgttacacaattccgaacaaggaggacgcgcttatagacacgccatggaagaactacccgacacaatagaaacattgatgctgttggcgttaattgccgtattaacgggaggagttaccctattcttcctttcaggtagaggcttaggtaagacctctataggattattatgtgtcatggcgtcgtctgtcttattgtggatggcaagtgtggaaccacactggatagcggcttctataatacttgagttcttcctaatggtactgcttatccctgaaccggataggcaaaggaccccacaggataatcaactagcgtatgtagtgataggtctattatttatgatcctcaccgtggccgctaatgaaatgggtctgcttgagacaacaaagaaagatctcggtatcggccatgtcgcggtagaaaaccaccatcacgcaacaatgttggatgtggatttgcatccggcttctgcctggaccttatacgccgttgctacaactatcataactccaatgatgagacacactatagaaaatactactgcgaatattagcctcacggccatagcgaatcaagcagcaattttaatgggactagacaaaggatggccaatatcaaaaatggacattggtgtaccgctcctagccttaggctgttatagtcaggtaaatccactaacgctaacagcagcagtgctaatgttagtagctcactacgctattataggccccggattgcaagcaaaagccacgagagaagcacagaagagaactgctgcaggtataatgaaaaaccctactgtggatgggatagtagctatagatcttgacccagtggtctatgatgcaaagtttgaaaagcaacttggtcaaattatgttacttatactctgtacatcacaaatattactaatgaggacaacatgggcattatgtgagtcgattacactagctacaggcccgttgaccacactatgggaaggatccccgggaaaattctggaatacgacgatagcagtaagcatggctaatatttttagaggttcgtatctcgccggagccggattagcattttcactgatgaaatctctgggaggtggaagacgtggcactggagcgcaaggggaaactttaggggaaaagtggaaacgacaacttaatcaactttcaaaatcagagttcaacatatacaaacgtagcggaattatggaagtggatcgctcagaggcaaaagaggggttgaagagaggggaaacaacacgacacgcagtatctagaggaacagccaaactacgatggtttgtggagaggaatctggttaagccagaaggaaaagttattgacttaggatgcggaagaggagggtggtcgtattattgtgctggcttgaagaaagttaccgaagtaaaaggatacaccaaagggggacccggacatgaagaaccaatccccatggccacgtatggttggaatctggtaaaattacattctggaaaagatgtattctttactccacccgaaaagtgtgatacactattatgcgatatcggtgaatcaagtcccaaccctacaatagaggaaggcagaacactccgggttctaaaaatggttgaaccatggttaagaggaaatcaattctgcataaaaatcttaaatccatacatgccatcagtagtagaaacattagagcagatgcaacgtaaacatggaggtatgttggtaagaaatcctcttagtaggaacagcacccacgaaatgtattgggtaagctgcggtacggggaatatagtcagcgcagtcaatatgacaagtagaatgttgttgaaccgttttacaatggcccaccgtaaacctacatatgaaagggatgtagaccttggtgcgggaaccagacacgtcgctgtagagccggaagtggctaatcttgatatcatagggcaaaggatagaaaacataaaacacgagcacaaatcaacatggcattatgatgaagataacccatacaaaacatgggcttatcacggcagttatgaagtgaaaccgagcggctcggcaagttcaatggttaacggagtagttaaactgttgacaaagccttgggacgtcattcccatggttacgcaaatcgccatgacagatactacaccgtttggtcagcaacgtgtctttaaagaaaaagtagacacaaggactcctaaagcgaaaaggggaaccgcgcaaataatggaggtgacagctagatggttgtggggatttcttagccgaaacaaaaagcctagaatctgcacacgggaagagtttacacgtaaagtacgatccaatgctgccattggagcagtatttgtagacgagaatcaatggaactctgctaaagaagcagtagaagatgaaagattttgggacttagtacaaaaagaacgcgaattacataaacaaggtaaatgtgcgacgtgtgtgtataacatgatgggcaaaagagagaagaaattgggtgagttcggcaaagcaaaaggaagtagagccatctggtacatgtggctcggtgcaagatttttagagttcgaagcgctcggatttatgaatgaggaccactggttttctagggaaaattccctatcgggtgttgaaggagaaggactacacaaattaggctatattttgagagatatatcgaagattccagggggtaatatgtatgctgatgatacagctggatgggatacaagaataactgaagacgatctgcaaaatgaagctaaaataactgatatcatggaacctgagcatgcactacttgcaacatctatattcaaattaacataccaaaataaggtggtgagagtccagagaccggccaagaatggtacagtgatggacgtaatttcaagaagggaccaacgtggctctggacaagtaggtacatatggacttaatactttcacaaatatggaagcacaattaatcagacagatggaaagcgaaggtatctttctacctagtgaacttgaaactcccaacctcgcagaaagagttttagattggctagaaaaatacggagtagaaaggttgaaacgaatggcaatatcaggtgatgattgtgttgtaaaacctattgatgaccgcttcgctactgcactcacagcattaaatgacatggggaaagttaggaaagacataccgcaatgggaaccctccaaaggttggaatgattggcaacaagtgcctttctgctcacatcatttccatcagctcataatgaaagacggaagagaaatcgtcgttccatgtagaaaccaagatgaattagtcggacgtgccagagtatcacagggagctgggtggtcgctccgtgaaaccgcttgtttagggaaatcatatgctcaaatgtggcaactaatgtattttcataggcgagacctaaggttagcagcaaacgcaatatgttcagcagtccctatagattgggtacccaccagtagaaccacctggagcatacatgcacatcatcagtggatgactaccgaggacatgttatctgtatggaatagagtatggattgaagaaaatccgtggatggaagacaagactcatgtctcgagttggggtgatgtcccatacctaggtaagagggaagatcaatggtgtggaagtctaattggcctgacagcgagagcgacctgggcaagtaacatacaggttgctataaaccaggtgaggagattgattgggaatgaaaattatttagactatatgacttcgatgaaaagattcaaaaatgaaggggatcctgagggtgctctctggtaa

SEQ ID NO: 21803 - RNA, 9879 nt, synthetic construct
  misc_feature 1..9879: note = derived and/or modified CDS sequence (opt6) from DENV-1__GU131727__SS-prME
  source 1..9879: mol_type = other RNA
tcagttacgatgttattgatgcttatgccgacagcgttggcttttcatttaacaactcggggaggagaaccgcatatgatagtaactaaacaagaacgtgggaaaagtttattgttcaaaacttccgctggtgttaatatgtgcactttaatcgcaatggatttgggtgaattgtgtgaagatactatgacatacaaatgcccacgaattactgaagccgaacctgatgacgtagactgttggtgcaatgccacagatacatgggtgacttacgggacatgttcccaaacaggagaacatcgtagggataaaagaagtgttgcgttagcacctcatgtcggtttaggtttggaaacgcgtacggaaacttggatgagtagtgaaggagcttggaaacagatccaacgtgttgaaacatgggcactacgccacccagggtttactgtaatagctttgttcttagcccatgcaataggtacatcgatcactcaaaaaggaattatttttatccttctaatgctagttactccaagtatggcgatgagatgtgtaggcattggtagcagagatttcgtagaaggattgtcaggagcgacttgggtcgatgtggtactagagcacggatcttgtgttacgactatggctaaagacaaaccaaccctggatatcgaattattaaaaactgaagttacaaatccagcagtgttacgcaaattatgcatagaagcaaaaatatctaacacaacaacagattctcgttgccctacacagggcgaagcaactctaatggaagaacaagatgcaaactttgtatgcaggagaacgtttgttgatcgcggttgggggaacggatgcggacttttcggcaaaggttcattaattacctgtgcaaaattcaaatgcgtgaccaaacttgaaggaaaaattgtacaatatgaaaatctaaaatatagcgttatcgttacagtccatacaggagatcaacatcaagtaggaaacgaaagtactgagcatggaacaactgcaacaataacaccacaagcacctacaagcgagattcaattaactgactatggtgctttgacattagactgttcccccaggactgggctagatttcaacgaaatggtacttcttacgatgaaagaaaagtcatggttagtccacaaacagtggttcttagacctgcccttaccctggacgtcaggtgccagtacctcgcaagaaacatggaacagacaagatctcctggtaacctttaagacagcacatgcaaagaaacaagaggttgttgttttaggatcacaggagggagctatgcatactgctttaacgggggccactgagatccaaacttccggaacgacaactatattcgcagggcatttgaaatgccgactaaaaatggataaattaactttaaaggggatgtcatacgtaatgtgtactggatcgtttaaactcgaaaaagaagtagctgaaacccaacacggcacagtcctagtccagataaaatatgaaggaactgatgcaccctgtaagattcccttctctacacaggatgaaaaaggtgttacacaaaatgggagacttataacggctaatccaattgttaccgataaagagaaaccggtcaatattgaagctgaaccaccgttcggggagagttatatagttattggtgcaggagaaaaggctttaaaattatcctggtttaaaaagggaagtagcataggaaagatgtttgaagccacagctcgaggagcaaggcgaatggcgatattaggcgataccgcatgggactttggttcggtcggaggcgtcttcacatcggttggtaaattagttcaccaaatctttggaacagcatatggcgtgctatttagtggagtgtcctggacaatgaaaatagggataggcgtactcttgacctggttaggtctaaattctagatctacctcactaagtatgacttgcattgcagtaggtttagtcacactatatttaggagtaatggtccaagcagactcggggtgtgtgataaactggaaagggcgggaattaaaatgcggatcaggcatcttcgtaacaaacgaggtgcacacgtggacggaacaatacaagtttcaagcggattcccccaaaagactaagtgctgcaataggaaaggcttgggaagaaggagtctgtggaatcagaagcgcgacacgcctagaaaatataatgtggaaacaaatctcaaacgaactaaatcacatcctcttagaaaatgatatgaaattcacagtggtggtaggtgacgtagtaggcatattagcccagggcaagaaaatgataaggccccaacctatggaacacaaatatagttggaaaagttggggaaaagctaaaatcatcggagcagatgtacaaaacacaacattcattatagacggtccaaacacgccagaatgcccggatgaccaacgggcatggaacatttgggaagtagaagactacggattcggtatctttacaacaaatatatggttgaaactcagagattcctacacccaagtttgcgatcatagactaatgtcagctgccatcaaggattcaaaagctgtccatgccgatatgggatactggatagagagtgaaaagaatgaaacttggaaactagcaagagctagctttattgaggtaaagacgtgcatctggccaaaatcccatacactatggtcaaatggtgttctagagagtgaaatgataataccgaaaatatacggaggacccatcagccaacataactacagacccggttatttcacacaaacggccgggccatggcatttgggaaaactcgaactagactttgatctgtgtgaaggcactacagtggtagtagatgagcattgcggtaaccgagggccttcactaaggacaacgacagtaaccggcaaaatcatccacgaatggtgttgtagatcgtgcacattgcccccgcttaggtttaaaggcgaagatggctgttggtatggcatggaaattaggcctgtcaaagaaaaagaggagaacctggttaaaagcatggtaagcgctggctctggtgaagtggactctttctctttaggtttactatgtatttcaataatgatcgaagaagtgatgaggtccaggtggagtagaaaaatgctgatgacgggtacccttgcggtttttcttttattgattatgggtcaattaacgtggaacgacttgatccgactatgcattatggttggcgccaacgcgtctgatagaatgggtatgggcacaacatacttagcgctcatggctacttttaaaatgagacctatgttcgcagttgggctattatttaggaggctaacctcaagggaggtattactactaaccatcggattgtctctcgttgcatcagtcgaactacctaatagtttagaggaactaggtgatggtttagcaatgggaataatgatcttaaagctcttgaccgacttccagtcacatcaattatgggccacattactaagtttaacctttatcaaaacgacacttagtttacactatgcctggaaaacaatggctatggtattatctattgtctctctatttccactgtgtttgagcactacaagtcagaaaactacttggttacctgtattactaggtagcttaggatgcaagccattgacgatgtatcttataacggaaaacaagatctggggtaggaaatcctggccactgaacgaagggataatggcagtaggggttgtgtccatcttattaagctccctgttgaaaaacgatgttcccctagcaggtccgttaatagcgggagggatgttaatagcttgttatgtaatttcagggagtagtgccgatctatcgcttgaaaaagcagcggaagtgtcctgggaagaagaggccgagcatagtggggcttcacacaacattctagtggaagtacaagacgacggaacaatgaagataaaagatgaagagagagatgatacactaacaatactcttgaaagcaactttattagctgtatcaggggtttaccctttaagtattcctgccaccctattcgtatggtacttttggcagaaaaagaaacaacggtcaggagtcttatgggacacgccaagtccaccagaagtagaacgcgcggtcctagacgacggaatatacagaattatgcaaagaggcttgctcggtcgaagccaagttggagtaggtgtatttcaagaaaacgtatttcacaccatgtggcacgtaacaagaggagctgttctgatgtatcaaggtaaacgtttagaaccatcctgggcatcagttaagaaagatttaatttcatatggcggaggatggagactccaaggatcttggaatacaggtgaggaagttcaggtaatcgcggtcgagcccggaaagaacccaaagaacgttcagacagctccaggcacatttaaaacaccagaaggtgaagttggagcaatagctttagattttaaaccaggaacatcgggtagtccaattgttaatagggagggtaaaatagtgggactatacggaaacggggttgtaacaacaagtggaacatatgtcagtgcaatagcacaagcaaaggcttcccaggaaggacctttacctgaaatagaagacgaagtatttcgaaaacggaatcttacaataatggacttacacccaggcagcggcaagaccaggcgatatctcccagcgatcgttagagaagccattaaaaggaagctaagaacacttattcttgctccaacgcgtgtcgttgcatccgaaatggcagaagcgttaaagggaatgccaatccggtatcagacaacagcagtgaaatctgaacatacgggaaaagaaattgtagatctaatgtgtcacgctacttttaccatgcgactactaagtcccgtacgtgtacccaactataacatgattattatggatgaggcacattttactgacccgtcaagcatagctgccagaggatatatttcaactcgagtgggaatgggagaggctgccgcgatatttatgaccgcaaccccgcccggcagtgtcgaagcatttcctcaaagtaacgcagtcatacaagatgaggaacgcgacattcctgaacggtcatggaactcgggttacgaatggatcacagacttccctggcaaaacagtttggtttgttccgtctatcaagagtggaaatgacatagcaaactgcctcaggaaaaatgggaaaagagtgatccaattaagtagaaaaacattcgacactgaataccagaaaactaaaaataacgattgggattatgtcgttacaaccgatatatcagaaatgggagcaaatttccgcgcagatagggtgattgatccgagaaggtgcctcaaaccagttattttgaaagatgggcctgaaagggtaatcttggcaggacccatgccagtaacggtagcatcagcagctcagaggcgaggtcgaatcggtagaaaccacaacaaggagggagatcaatacatatatatgggtcagccacttaacaacgatgaagatcatgctcattggacggaagccaaaatgctcttagacaacatcaatactccggagggaattattcccgcgctatttgagccagagagggagaaaagtgccgcaatcgatggcgaataccgattaagaggcgaagccaggaagacattcgtagaactcatgagacgtggtgacttacctgtgtggctgagctataaagttgccagtgagggttttcaatacagtgatcgacgctggtgttttgatggcgaaaggaacaatcaagttttagaagaaaacatggatgtcgaaatatggacgaaagagggtgaacgcaagaaattgagaccaaggtggctagatgcgagaacgtatagtgatcctttggctttaagggagttcaaagagtttgccgcaggtagaaggtcagtatctggtgatctaatcctagaaatcggtaaactgcctcaacatcttactcagagggctcaaaacgcactcgataacctggtcatgctccacaattctgagcaaggaggcagagcatatcgccacgccatggaagaacttcccgatacgatagagactctaatgctattggccctgatagccgttttaacgggtggagtgactttattctttctttctggacgcggcttaggaaaaacgagcattggacttctctgtgtgatggcatctagtgttctcttgtggatggcttcggttgagccacactggattgccgcatccataattttagagttctttttaatggttctactcatcccggaacctgatcgccagcgaacaccccaagataatcaattagcatatgtagtaataggattattatttatgatactaaccgttgcagcgaatgaaatgggtctattagaaactaccaagaaagatttaggcataggtcacgttgcagtagaaaatcaccaccatgcaactatgttagatgtggacctccatccagctagtgcttggacattatatgctgtagctactactattatcacgcccatgatgcgtcacacaattgaaaacacgactgcaaacattagtctaacagcgatagccaaccaggcagcgattcttatgggcctagataaagggtggccaatatcaaaaatggacattggagtaccactactggccctcggatgctactcacaggtcaacccattgacattaacagccgccgttctaatgttagttgcgcattacgcgattattggaccaggacttcaagctaaggcgacaagagaggctcaaaaacgcaccgcggcaggcattatgaagaatcccacagtagatggtattgtggcgattgacttagacccagttgtatatgatgcgaagttcgagaaacagctagggcaaatcatgttattaatcctttgtactagccagattttgttaatgcgcactacttgggcactctgtgaatctataactctcgccacgggccccctcaccactttgtgggaaggaagtccagggaaattttggaatacaacaatagcagtatcgatggcaaacatctttagaggatcgtatctcgctggcgccggactagcattctcattaatgaaatcacttggtggtggaagacgtggaaccggtgcgcaaggagaaacactgggagagaaatggaaaagacaattaaaccagctatcaaaaagcgagtttaacatatataagcgaagtgggataatggaagtagaccgcagtgaggcaaaagaagggctcaaacgtggagaaacaactcgacacgcagtgtctagggggactgccaaactacgatggtttgttgagcgtaatctagttaaacccgaaggcaaagttattgatttaggatgcggaagaggtgggtggagttattactgtgctggtctcaagaaagtaacagaagtaaaaggttatacaaaaggaggtcctgggcacgaagaaccgataccaatggcaacatacggctggaatttagtaaagctacactcagggaaagacgtgttctttactccacctgagaaatgtgatactcttctttgtgatataggagaatcaagtccaaaccctacaatagaagaaggacgaactttgagggtattaaagatggttgaaccgtggttaagaggaaatcaattttgcataaaaattttaaacccatacatgcctagtgttgtcgaaacattagagcaaatgcaacgaaagcacggaggaatgttagtcagaaatccactgagtaggaatagtacacatgagatgtattgggtctcatgtggaactggcaatattgtctctgcagtgaatatgacctctcgaatgctcctaaaccgttttacaatggcacatagaaagcctacgtatgagagagacgtcgacctgggtgcgggtaccaggcacgtagcagtagaaccagaggtcgcgaatctagatataataggacagcgtatcgagaatatcaaacatgaacataagagcacttggcattacgacgaagataatccatataaaacttgggcttaccacggcagctacgaggttaagccttcaggaagtgccagttctatggtaaatggcgtcgtaaaattattaacgaaaccctgggacgtaatacctatggtgacacagatcgctatgaccgatacaacaccattcggacaacagcgtgtattcaaggaaaaagtagatactcgaacgccaaaagcaaaacgtggaacggctcaaattatggaagttacagccagatggctttggggatttttgtctagaaataagaaacccagaatttgcaccagagaagagtttacaagaaaggtaagaagtaatgcggcaataggggctgttttcgtagacgagaaccagtggaactctgcaaaggaagcagtggaagacgagaggttttgggacttagtacagaaagaaagagaactgcataaacagggaaagtgcgcgacttgcgtatataatatgatgggaaaacgtgagaagaaactaggggaatttggtaaagccaaaggaagcagagctatctggtatatgtggcttggagcacgttttcttgagttcgaagcactagggttcatgaacgaagatcactggtttagcagagagaatagtttatcaggagtagagggagaaggtctccataaattgggatatattttaagagatattagcaagattcctggaggaaacatgtacgctgacgataccgcaggatgggatactaggataaccgaagatgatttgcagaatgaagctaaaataactgatataatggagccagaacatgctttactcgcaacaagtatattcaaactaacgtaccagaacaaggttgtccgtgtgcaaaggcccgctaaaaacggcacggtcatggacgtgatatcgagaagagatcagaggggatctggtcaagtaggaacatatgggttaaacacgtttaccaatatggaagcccaactgattagacaaatggagagcgaaggaatatttttgccgtcagaactagaaacacctaatttagcagaaagggtgttagactggttagagaaatatggtgtagaaagattaaagaggatggccatctcaggagatgactgcgtggttaaaccaattgatgataggtttgcgaccgccctaacggcacttaatgatatgggaaaggtgcgcaaggacatcccgcaatgggagcctagcaaaggatggaatgactggcaacaagttccattttgttcacatcattttcatcaactaataatgaaggacggtagggaaattgtcgtgccatgtagaaatcaggacgaattagtagggcgagcacgggtcagtcaaggcgcaggatggtcacttcgtgaaactgcgtgtttagggaaatcttatgcccaaatgtggcagttaatgtatttccatcgtagagatctgagacttgctgccaatgcaatatgctcagctgtaccggttgactgggttccaacatcccgtacgacttggtcaattcatgcgcatcatcagtggatgacaacagaagacatgttatcagtatggaacagagtatggattgaagagaacccgtggatggaagataagacgcatgtatcaagttggggtgatgtaccatacttaggtaaaagagaagaccaatggtgcggatctctgataggactaacagcccgagctacgtgggcgtcaaacatacaagtggcaattaatcaggtcagacgtctaataggtaatgaaaattatttagactatatgacatccatgaaacgttttaaaaatgaaggggatccggagggggctctatggtga

SEQ ID NO: 21804 - RNA, 9879 nt, synthetic construct
  misc_feature 1..9879: note = derived and/or modified CDS sequence (opt6) from DENV-1__HM631850__SS-prME
  source 1..9879: mol_type = other RNA
agtgttacaatgctattaatgttaatgccaacagcacttgctttccacttaactacaagagggggcgaacctcatatgatcgttagtaaacaagaaagaggtaaaagtttgttgttcaaaacgtctgcaggggttaatatgtgcacattaattgcaatggatttgggcgagttctgtgaagatacaatgacatataaatgccctagaataacagaagcagaaccggacgacgtagactgttggtgtaacgcaacagatacatgggttacatatggcacatgcagtcaaacaggtgaacatagaagagacaaaagatctgtggcactggctccccacgttgggttaggattagaaactagaaccgaaacatggatgtctagtgaaggggcatggaaacaaatccagagagtagaaacatgggcacttagacacccaggatttactgttatcgctctattcctagctcatgccatagggacttcgataacacagaaaggaattatatttattttattaatgctggtaacaccatctatggccatgcgatgtgtaggaattggatcaagagattttgtggagggcctgagcggagccacatgggtagatgtagtactagaacatggctcctgcgtcacaacgatggcaaaagataaaccaacgttggatatagaattattaaaaacggaagtaacaaaccccgcagtgctaagaaaattatgtattgaggccaaaatttcaaatacaaccaccgattcccggtgtcctactcagggagaagccactctagtcgaggagcaggatgctaattttgtgtgtagacgtacttttgttgatcgaggatggggaaatggatgtggcctattcggaaaaggttcactgattacttgtgcaaaatttaaatgtgttacaaagctagaagggaaaacagtgcaatatgagaatctcaaatactcagtcatagtgacagtacatacaggagaccaacaccaagttggcaatgaaagtacggagcatggcactaccgcgaccatcacgccacaggcacccagtacggagatacagttaactgattatggagctttaactttagactgttcacccaggacaggacttgatttcaatgaaatggtcttactaacaatgaaagaaaagagctggctagtacataaacaatggttcttggatttgccattaccctggacaagtggggctagtacttcgcaggaaacttggaatcggaaagacttattagtaacttttaagacggcccatgccaagaaacaagaggttgtggtccttggcagtcaagaaggagctatgcacacagcgctgaccggtgcaaccgaaattcagacctcaggaacaacaacgatttttgcagggcatttaaaatgtcggctaaaaatggataaactgacgctaaagggaatgtcatacgtaatgtgtacgggaagttttaagttagaaaaggaagttgcggaaacacaacacggcactgtattagtgcagattaaatatgaaggtaccgacgcaccttgtaagattcctttttccacgcaagacgagaagggtgtaacccaaaacggtagattgattacagcaaatccgatcgtgacagacaaggaaaagccagtgaatattgaagcagaacctccattcggagaatcttatatagtaattggtgctggggaaaaagcacttaaactttcctggtttaagaaaggatcttccataggtaagatgtttgaggctactgctaggggagctagacgtatggccatattgggggacacagcatgggacttcggaagcatagggggagtattcacaagtgttgggaagctagttcaccagatatttggtactgcatacggcgtactattttcaggagtaagctggacaatgaaaataggtattggagtcctattaacctggttaggattaaactctagatccacatcattgagcatgacctgtattgcagtaggcctagtcactttatatttaggtgtgatggtacaggctgacagtggctgcgtgataaattggaaaggacgtgaattaaaatgtgggagtgggatctttgtaacaaatgaagtccacacctggactgaacagtacaaatttcaggcggacagtccaaaaagactatcagccgctataggcaaggcttgggaggaaggcgtttgtggcatacgatcagcaacacgcttagaaaatataatgtggaaacaaatctcaaacgaattaaaccatattctattggagaatgacatgaaatttacagtagtagtgggtgacgtcgccggcattttagcacaagggaagaaaatgattcgaccacaacctatggagtacaaatattcatggaaatcatggggcaaagcaaaaattataggagccgacgtccaaaacacaacctttataatagacggaccgaacacacctgaatgtccagacgaccagagggcatggaatatttgggaagttgaggattatgggtttgggattttcacgactaacatatggctaaagctaagagatagttatacccaagtgtgcgaccaccggttaatgagtgctgccattaaagatagcaaagctgtacatgcagatatgggttactggatcgaatctgaaaagaatgaaacttggaaactagcacgggctagttttatagaggtaaaaacgtgcatttggcctaaatcacacacattatggtccaatggcgtactcgaatccgaaatgatcatacccaaaatttatggaggacctataagtcaacataactatcgccctggttacttcactcaaacagcaggcccgtggcacctaggaaaattagaacttgacttcgacttgtgcgaaggtacgaccgtagtagttgacgaacactgtggcaaccgtgggccatcactaaggaccaccactgtcacgggcaaaataattcatgaatggtgttgtcgatcttgcacattacccccattgcgattcaaaggagaagatgggtgttggtacggtatggagatcaggcctgtaaaagagaaagaagagaatttggtcaaatcgatggtatcagcagggagcggagaagtcgatagcttcagtttaggcctattatgtattagcataatgatcgaagaagtcatgaggagtagatggtcacgtaaaatgttgatgaccgggacgctagcagtattcttcctattaataatgggacaattgacatggaacgacttaatacggctatgtattatggtaggcgctaatgctagtgacagaatggggatgggaacaacatatttagcgcttatggcaacatttaaaatgcgacctatgtttgcagtaggattgctgttcagaagattaacatcacgtgaagtgttactattaacaattggtttatcccttgtagcctcggtcgaattaccaaacagcctagaggaattaggagatggactcgctatgggaattatgatccttaaattactaacagattttcagtcacatcaactgtgggcgacactactcagtcttacgtttattaaaactactttctcgttacattatgcctggaaaactatggcaatggtattaagtattgtatctctattccctttatgtttatcaacgacttcccaaaagacaacttggttacctgtgttacttggatcactaggatgcaaaccactaacaatgtttttaattgctgaaaataagatttgggggagaaaatcatggccattgaatgaaggtataatggccgtcggaatagtaagtatattactgtcatccctacttaaaaatgatgtacccctagcaggacctttaattgctggtggtatgctgatagcatgttatgttatttcaggatcatcaccagacctcagtttggaaaaagcagctgaagtaagttgggaagaagaggctgagcactcaggtgcttctcacaatatactggtcgaggtccaggacgatgggacaatgaaaattaaagacgaagaaagagacgataccttgactatattacttaaagcaactctgttagcagtaagtggagtgtatccgctcagtataccggccacactgtttgtttggtatttttggcaaaagaagaaacagagatccggggtcctttgggacacacccagtcccccagaagtagaacgagccgtgttggacgatggtatctacaggataatgcaaaggggtttgctggggagaagccaagtaggagtaggcgtttttcaggaaaacgtctttcatacaatgtggcatgtaacaagaggagccgtactcatgtaccaagggaagcgactagagccctcgtgggcatcagtcaagaaagatttgataagctacggagggggttggcgattacagggatcatggaatacgggcgaagaagtacaagtcatagcagtagaaccaggaaagaaccctaagaatgtccaaactgctccagggaccttcaaaacctcggaaggtgaggtcggtgccatagccctggattttaagcccggtacgtcgggttccccgatcgtaaatagagaggggaaaatcgtcggcctatacggcaacggcgtagtaaccacttctggcacttacgtatcagcaatagctcaagcaaaagcgagtcaagaaggacctctaccagaaatagaagatgaagtctttagaaaacgaaacctaactatcatggacttacatccaggtagcggaaaaacaagacgatatttacctgctatcgttcgggaagccataaagaggaaactacgaaccctaatcctagcgcctacgagagttgtagccagtgaaatggccgaggctctgaaggggatgcccattcgttaccaaactacagccgtaaaatctgagcacacaggtaaagaaatcgtggatctaatgtgtcatgcaacattcacaatgaggctattgtctccagtgagagtgcccaattacaatatgataattatggacgaagcacatttcacggacccctcttcaatcgctgccaggggatacatttctacccgagtaggaatgggggaagcagctgccatctttatgacagcaacgccaccaggaagtgtggaggcatttccacaatcgaatgcagttattcaggacgaggaaagagatatacccgaaagatcatggaatagtgggtatgagtggattacggatttccctggaaaaacagtgtggttcgtacctagcataaaaagtggaaatgatatagccaattgtctcaggaaaaatggaaaaagggtaattcagttgtcacgcaaaacgttcgatacagaatatcaaaagactaaaaataacgattgggactatgttgttacgacggacatatctgaaatgggagcaaacttccgggctgaccgtgtaatagacccgagaagatgtttaaagcctgtgattttaaaagacggtcccgaaagggtgattttagcagggccaatgccagtaacagtcgcttcagcagcacagagacgaggtaggatcggacgaaaccataataaagagggtgaccaatacatatatatgggtcaacctttaaacaatgatgaagatcacgcacattggacagaggcaaaaatgcttcttgacaacataaatacaccagaagggataatacctgctctgttcgaaccagaacgtgagaaaagcgccgcgattgatggagaatacagattaaggggtgaagcgcgcaagacgtttgttgaattaatgagaaggggagatttaccggtctggttatcatataaagtagcaagtgaaggatttcaatattccgataggaggtggtgttttgacggtgagcggaataatcaagtgttggaggaaaacatggatgtagaaatatggactaaggaaggagaacgaaagaagctcagacctagatggctcgatgctaggacatattctgaccccttagctttaagggaatttaaggagttcgcggccggacgtcgatcggtttcaggtgacctgatattagaaattgggaaattacctcaacacttgacacagaaggcgcaaaatgcgttagataacctggtgatgctccataactccgaacaaggtggacgcgcctaccgccacgccatggaagaattaccagataccattgaaacgctaatgttgttagctttaattgctgtgctaacaggaggggtaacgttgttcttccttagcggaaggggactagggaagacatcaattggactcctatgtgtaatggcttcatcggttcttttgtggatggcatccgtagaaccacattggattgctgcttcaataatattagagttcttcttaatggtattattgataccagaaccagatagacaacggacaccacaagataatcaactagcttacgtagtaataggcctactttttatgattttgacagttgctgcaaatgaaatgggactgcttgaaaccaccaaaaaggatttaggaatcggtcatgtagcagttgagaatcatcatcacgcagccatgttagatgttgatctgcaccctgcatctgcctggactttatatgcggtagcaacgacgataataacacctatgatgcgtcacactattgaaaatactactgctaacatatcgttaacagctattgccaaccaagcagcaatcctgatggggctcgacaaaggttggcccattagcaaaatggacatcggggtaccattacttgctcttggatgttactcacaagttaacccgttaactcttacagctgccgtactcatgcttgttgcacattatgcaataataggcccggggttacaagctaaggcaacacgagaagctcaaaagagaacggctgctggtataatgaaaaatccgaccgttgacggtatagttgcaatagacttagatccggtagtttatgatgctaagtttgagaagcaattgggacaaataatgctattaatcttatgtaccagtcaaattcttttaatgcgtaccacgtgggctttatgtgagagtatcactctagcgacaggacctttaacgacattatgggagggtagtccagggaagttctggaatacgacgatagcagtctcaatggcaaacatatttcgaggttcttatttagcgggcgcgggactagcattttctttaatgaaatcattaggtggcggccggcgtggcactggagcacagggtgaaactttgggggaaaaatggaaaagacaattaaatcaattatctaaatcggagtttaacacctacaaacgtagcggaatcatggaggtggaccgaagtgaagcaaaagaaggccttaaaaggggagaaaccacgaagcatgccgtatcacgcggaactgctaagctaagatggtttgtggaaaggaacctagttaaaccagaaggaaaggtgattgatctaggctgcggacgaggagggtggtcgtactattgcgccggtttaaagaaggttacagaagtaaaaggatatactaaagggggccccggtcacgaagaacctattccaatggcaacctacggatggaatttagtcaaattgcacagtggaaaagacgtattctttatccctcccgagaaatgtgacacgctattatgcgacataggagaaagctcgccaaaccctactattgaagaaggtcgtactctcagagttttaaaaatggtagaaccatggcttagaggaaaccaattttgtataaagattttgaacccttatatgcccagcgttgttgaaactttagaacagatgcaaagaaaacatgggggtatgttagtaagaaatccgttgagtagaaacagcacgcatgagatgtactgggtctcatgcggcacaggaaacatagtatctgccgtaaatatgacctccagaatgttattaaacagatttacaatggcacatagaaaacctacatacgaaagagacgtggatcttggtgcgggaacgagacatgtagcagtagaaccggaagttgcaaacttggacattataggccaaagaatcgaaaatataaaacacgaacacaaatcaacgtggcactacgatgaagataacccatacaagacctgggcctaccatggaagttatgaagtcaaaccgagcggtagcgcaagcagtatggtaaatggcgtagtaaagttattaactaagccatgggatgtaattccaatggtaacgcaaattgcaatgactgacacaactccatttggccaacaacgagtatttaaggagaaagttgatactagaacacctaaagccaagcgaggaacagcacaaataatggaggtaacagctaagtggctgtggggattcctatcacggaacaagaaaccacgtatatgcactagggaggaatttaccagaaaagtgcgctcaaatgcagctattggagcagtcttcgttgacgaaaaccaatggaactcagctaaagaagctgtggaagatgaaagattttgggatctagtacatagggagagggaattacacaaacaaggaaaatgtgcaacgtgcgtatataacatgatgggtaagcgcgagaagaaactaggcgagttcggaaaagctaaagggagccgagcaatatggtatatgtggctaggagccagatttttggaatttgaagcattgggattcatgaacgaagatcactggttttcaagagaaaattcattgtctggagtagagggagaaggattacacaaactaggttacatattacgggacatatcgaaaatacccggagggaatatgtacgcagatgatacggcgggttgggacacaaggattactgaagatgatttacagaacgaagcaaaaataacagacataatggaaccagaacacgcgttactagctaagtcaatcttcaagttaacatatcaaaataaggttgtgagagtccagcgccccgccaaaaatgggaccgtaatggacgttatatcaaggcgagatcagcggggctcaggtcaggtaggaacatatggattaaacacgtttactaatatggaagcccaactcataaggcaaatggaatcggaaggcatatttagcccatctgaacttgaaactccgaatttggctggacgtgtgctcgattggctagagaaacacggtgttgagcgtctcaaaagaatggctatttcaggtgatgattgtgtggtcaagccaatagacgatcgattcgcaaccgcattaactgcattgaacgatatgggtaaagttcgtaaagatatacctcagtgggaaccgagcaaagggtggaacgattggcagcaggtaccgttctgctcacatcattttcaccagctgataatgaaagatggaagagaaattgttgtgccatgccgcaatcaggatgaactggtagggcgtgctcgcgtttcccagggagcgggatggagcctcagagaaaccgcatgtctaggcaaatcttatgcacaaatgtggcagttgatgtactttcacagacgagatttaagacttgctgcgaacgcaatatgcagcgccgtccccgtggattgggtcccgacaagtagaaccacatggagtatccatgctcatcaccaatggatgactacggaggacatgttatctgtctggaatcgagtctggatagaagaaaatccgtggatggaagacaagactcatatatcgaattggggagatgtaccttacctcggcaaacgagaagatcaatggtgtgggtcgctaattggtctgacggcacgcgcaacatgggcaacaaatattcaagtcgcgataaatcaagttcggcggttaataggaaatgaaaattatttagattatatgacatccatgaaaaggtttaagaatgagtccgatccagaaggtgccctatggtaa

SEQ ID NO: 21805 - RNA, 9879 nt, synthetic construct
  misc_feature 1..9879: note = derived and/or modified CDS sequence (opt6) from DENV-1__KF955446__SS-prME
  source 1..9879: mol_type = other RNA
tccgttacaatgtttttgatgttaatgccaacagcattagcgtttcaccttactacaagaggaggggaacctcacatgattgtaagcaaacaagaacgtgggaaatcattactattcaaaacgagcgctggggtaaatatgtgcactcttatagcaatggatcttggagagttatgtgaggacacgatgacttacaagtgtccgcgaattacagaaactgaacccgatgacgtagattgttggtgcaatgcgaccgatacttgggtaacctacggcacatgcagtcaaacgggggaacataggagggataaacgaagtgtggcattggcgccacacgttggtttaggattggaaactcgaactgagacatggatgtcttcagaaggcgcttggaaacaaatacaacgcgtagaaacatgggctctaaggcatccagggttcacagtaatagcactctttctagcgcatgccatcggcacttcaattacacaaaaaggtatcatattcattttgttaatgctagttacaccatcaatggctatgaggtgcgttggtattggttcaagagactttgtggaagggttatcaggtgcaacatgggtggatgtcgtacttgaacatggctcttgtgtaacgactatggctaaagacaaaccaacattggacatcgaattactaaaaacagaagttacaaatccggctgttcttaggaaattatgtatagaggctaaaatatcgaatacaaccacggatagccgatgtcctacacagggagaagctactctagtggaagaacaagacgctaattttgtatgtcgaagaacgtttgttgaccgcgggtggggaaacggatgcggactatttggtaaaggatcccttataacgtgtgcaaaatttaaatgtgttactaaattagaaggcaaaatagtacaatacgagaatctgaaatacagtgtgatagttacagttcacacaggcgaccaacatcaagttggaaatgaatcaacagaacatggcacaacggctacaataacgccacaagcgccaactacagaaatccaattgactgattatggagcactaaccttagattgctctccacgaactggtcttgacttcaacgaaatggttcttctgacgatgaaagagaaaagttggctagtccataaacaatggtttttagacttgcccctaccatggacatccggtgcaagtactagccaggaaacctggaatagacaagacctcctagtaacttttaaaactgcgcacgccaagaaacaggaagttgtggttctagggtcacaagaaggtgctatgcatacagcactcaccggtgccacagaaatacaaacaagcggaactacaacgatatttgctggtcatctgaaatgtcgattaaaaatggataaattaactttgaaaggaatgagctatgttatgtgcacaggaagtttcaaattagaaaaagagcttgcagaaacccaacatggaacagtactcgttcaaataaaatatgaaggtacagacgcaccgtgcaaaatccctttttcgacccaagacgaaaaaggtgtcacacaaaatggacggctaatcacagcgaatcctattgtaacagataaagaaaaacctgtgaacatcgaagccgagccgccatttggcgagagttatatagttataggtgccggtgaaaaagcgctgaaactaagttggtttaagaaaggatcgagtatcggaaaaatgtttgaggcgacagcacgaggtgcgcgcaggatggctatattaggggatacagcctgggatttcggcagtatcgggggagtatttacatcagtaggaaaactggtacaccaaatttttgggaccgcctatggcgtgttgtttagcggtgtctcatggacgatgaagattggtatcggagtattgctaacatggttaggattaaattcgcgaagtacaagtttgtcaatgacctgcatagcggttggattagtgacgttatatctcggggttatggtacaagcagattccggttgcgtaataaattggaaaggccgagaattaaaatgcgggtcaggtatatttgttactaatgaagtacacacgtggacggagcaatataagttccaagcagacagcccaaaaaggctaagcgcagcaataggaaaagcctgggaggaaggagtgtgtggaataagaagtgcaactcggctcgagaatattatgtggaaacagatatcaaacgaactaaatcacattttattagagaacgacatgaaattcacagtcgttgttggagatgttgcaggtatcttagctcagggtaagaaaatgatcaggccacagccaatggaatataaatacagttggaaaagttggggaaaggccaaaataataggggctgatgttcaaaatacaacttttatcatcgatggcccgaatacccccgagtgtccggatgatcaaagagcatggaacatttgggaagtggaagactatgggtttggaatatttacaaccaacatatggctcaaactaagagacagctatacgcaagtttgtgatcacagactcatgtccgcggccataaaagattcaaaggcagtacacgctgatatgggttactggatagaatccgagaaaaatgaaacgtggaaattagcacgagctagcttcatagaagtaaaaacgtgtatttggccaaagtcacacacactttggagtaacggtgttttagaaagtgagatgataataccgaagatatatggtggacccatttcacaacacaactatcgtccaggatattttacacaaaccgcaggtccctggcacttgggtaagctagaacttgatttcgacctatgcgaggggactacagtagtagtcgacgagcattgtggtaatcgaggaccaagtcttagaacaactactgtaactggtaaaattattcatgaatggtgttgtagatcatgtacgctgccgccgctacgttttcgaggggaagacggatgttggtacggaatggagataagaccagtgaaagaaaaggaggaaaaccttgttaaatctatggtttctgcagggagcggcgaagtcgatagcttcagcctaggattactatgtatatctatcatgatagaggaggtgatgcgtagtagatggtcccgaaaaatgttaatgactgggacacttgcggtattctttttactcataatggggcaattaacctggaatgatctaatccggctgtgtattatggtaggggcaaacgctagtgatcgaatggggatgggtacaacgtacctagctttgatggcaacattcaagatgagaccaatgtttgcagttgggcttctatttagacgcctaacatcccgtgaagtcttattactaacgatagggttatcattagttgcctctgtagaactgccaaattctttggaagaattaggagatggactagcgatggggataatgatattaaaacttctaactgactttcaaagtcatcaattatgggctacactcctgtcactcacattcatcaaaacaaccttcagcttacactatgcatggaaaacgatggcgatggtactatcgatagtgagcctcttccctctatgtttatcaacaacatcacagaaaacaacttggcttccagtattacttggctccttaggttgtaaacctttgactatgtttcttatcgcggaaaataaaatttggggacggcgaagctggccgttaaatgaaggaataatggccgttgggatagtctccatccttctatcaagtcttctcaaaaacgatgttccattagccggcccattaatcgcgggaggtatgctaatagcctgttatgttatcagtggtagctctgcggatttaagtttagaaaaagcggcagaagtaagctgggaggaagaagctgaacactccggagcatcacacaatatactcgtggaagttcaggatgacggaactatgaaaatcaaagacgaagaaagagacgatactcttacgattttattaaaagccacattacttgcagtatcaggagtatatccactttccatacccgccacgttattcgtttggtatttttggcagaagaagaaacaacgctcgggcgtattatgggacactccttctccacctgaagttgaaagggcagtactagatgacggaatatacagaataatgcaaagaggacttcttggcagatcgcaagtaggggtgggtgttttccaagagaatgtattccacactatgtggcatgtaacacgtggcgccgtacttatgtatcaggggaaacgactggaacccagttgggcatcagttaaaaaggaccttattagttacggtggtggatggagattgcaaggctcatggaacacaggagaagaagtacaagtcatagctgtcgaacctgggaagaaccctaaaaatgtacaaacggcacctggtacctttaaaactccagagggtgaagtcggagcaatagctcttgactttaagcccggaacttccggaagtccgattgtcaacagggaagggaaaatcgtaggactgtatggaaacggggtcgtaaccacatctgggacttatgtgagcgcaatcgcacaagccagagcaagtcaagaggggcccttgcctgagatcgaggcagaggttttcagaaaaagaaatttgacgattatggatctacaccccggttcaggtaaaacacgccgatacttacctgctatagtgcgagaggcgattaaaagaaaacttaggacattaatactagcgcctacaagggtaggtgcttcagaaatggccgaagccctaaaaggaatgcctatcagataccagacaactgcagtaaaaagcgaacacacaggtaaagagatagtagatctaatgggccacgccacttttacaatggggttattagctcctggacgagtgccgaactataatatggtaattatggatgaagctcattttacagatccatccagaatcgcagctcgaggatacatcagcacccgtgttggtatgggtgaggccgccgcaatttttatgacagcaacaccaccaggatcagtagaggcttttcctcaaagtaatgctgtaatacaagacgaagaaagagacataccagagcgatcctggaacagtggttatgagtggatcaccgattttccgggaaaaactgtttggtttgtaccatcaataaagtctggaaatgatatagcgaactgcctgagaaagaacggaaagcgcgttatacaactaagtagaaagactttcgatacagaataccagaaaaccaaaaacaacgattgggactatgttgtaacgaccgatatatctgagatgggagccaactttagggctgatcgagtaatcgacccacgtcgatgtctaaatccagtcattttgaaagatggaccggaacgcgtcatcttggctggtcccatgccggtgacagtcgcttctgcagctcagaggaggggaagaattggaagaaatcataacaaagaaggcgaccaatatatttatatgggacagcccttaaacaatgacgaagatcatgctccctggacggaagcaaaaatgttgcttgacaatataaacacgccagaaggaattatcccagctctgtttgagcccgaaagggagaaaagtgcagccattgatggggaatccagacttagaggggaagcaagaaaaacatttgtggagctaatgagacgaggagatttaccggtctggttaagctacaaagttgcaagcgagggttttcagtatagtgataggagatggtgctttgatggggagcgaacaaaccaggtcctagaagaaaacatggcggtggagatttggccaaaagaaggagaaaggaagaagctaagaccaagatgtttagatgccagaacttacagcgatcccctggctctacgagaatttaaggaatttccaccaggtcgcagaagtgtaagtggcgacctcatcttggaaataggtaaactaccacatcctttgactcagagaccgcagaatgcgctcgcgacacttgtaatgagtcacacttcggaacaaggcgggcgagcataccgacatgcgatggaagagttaccagctaccatagaaacattaatgcttctcgcgctcatagcagtcttgaccggaggcgtaacgctgttctttttatctgggaggggcttgggtaaaacaagtataggcctattatgtgtaatggcatcctctgtattactatggatggctagcgtcgaaccccactggatagctgccagcataattttagagttctttttgatggtactactcataccggaaccagatagtaatgcaacaagacaggataatcagttagcctatgtcgttatcggattgctatttatgatacttacagtagctgcaaatgaaatgggcttattagagaccactaagaaagatttaggaatagggcatgttgcagtcgagaaccaccatcatgctgctatgcttgatgtagaccttcatccggcatccgcttggactctttacgcagtagcaacaaccattataaccccgatgatgagacataccatagaaaacacaactgcgaacatctcgttaacagcgatcgctaatcaagctgcaatactgatgggtctagctaaaggatggccaataagtaaaatggatataggagtacctttattagccctaggttgttactcccaagttaacccgctaactttaacggccccggttttgatgttagtgcctcattatccgattataggacctggactgcaagcgaaagcgacaagagaagcacagaaaaggacagcagctggaataatgaaaaatccgaccgtagacggtattgtggcaatagatttagacccggtggtctatgatgctaaattcgaaaagcaactgggacaaataatgctattaatactctgtaccagtcaaattctattaatgcgcactacttgggcgttatgtgaaagcataaccctagcaacaggacctttaacaactttatgggagggcagtcctggaaagttctggaatacaactatcgcagtaagcatggctaacatttttcgtggttcatatttagctggtgctggccttgccttctcgcttatgaagagtctcggtggcggacgacgaggtacgggagcgcagggtgagacgctaggtgaaaaatggaaaagacaattaaaccagcttacaaagtcggagttcaatacatataagagatccggtattatggaggtggaccgatcagaagcgaaggaaggtctaaaacggggagaaacaaccaaacaccctgtatcaagaggaactgcaaaattaagatggtttgtagaacggactcttgtaaagccggaagggaaagttatagatttaggatgcgggcgaggtggctggagttattattgcgctggactaaagaaagtaacagaagtaaaggggtacacgaaagggggaccaggacacgaggaccccattcccatgggtacatacggatggaatctagttaaactcagaagcggtaaagacgtctttttcattccaccagaaaagtgcgatactttactatgtgatataggagaaagttcaccaaatccaactattgaagagggaagaactttaagggtgttgaaaatggtagaaccttggttgagaggaaatcaattttgcataaagatcttgaacccatatatggcttccgttgtagaaaccctagagcagatgcaacgtaaacacggtggcatgttagttaggaatcccttaagtagaaactcaactcatgaaatgtattgggttagctggggcacaggaaatattgtcagcgctgtaaatatgacatcgcgaatgcttttaaacagatttacaatggcccatagaaaaccaacatatgagagagacgtagacctaggggcaggtacacggcacgtagcagtagaacccgaggtagcgaacctcgacataattgggcaaagaatagagaatatcaaacatgaacacaagagtacatggcattacgatgaagacaatccttataaaacatgggcttatcatgggtcatacgaaggaaaaccttctggttcagcaagtagcatggttaatggtggtgtaaaactattgacaaagccatgggatggtattccgatggtgactcagatagcgatgacagatacgaccccattcggccaacaacgcgttttcaaagaaaaagtcgatacaagaacccctaaggccaagcgagggacggcacaaattatggaagttacagctaagtggttgtggggatttttaagcagaaacaaaaagcctagaatttgtaccagagaggagtttacacgaaaggtacgctcaaatgctgccattggagccgtttttgttgatgaaaaccaatggaactcagcaaaagaggcggttgaagatgaaagattttgggatttagtacacagagaacgggaattacataaacagggaaagtgtgctacgtgtgtatacaacatgatggggaagagagagaagaaattaggcgaatttggaaaggctaagggatcccgagcgatttggtatatgtggttaggggcacgtttcttggaatttgaagcgttaggattcatgaatgaagaccattggttctcgagagaaaactcactgtcaggcgtcgaaggcgaaggactgcataaactaggctacattttacgagacatatcaaagattccaggaggcaatatgtacgccgatgacacggcaggatgggataccaggataaccgaggacgacttacaaaacgaggcacgtataacagatatcatggaaccagagcatgcattactcgcaaaatccatttttaaactcacttatcagaataaagtagttcgcgtgcaaagaccggctaaaaacggtacggtgatggatgtaatatcaagacgtgatcaaagggggtcggggcaagttgggacatatggattaaatacgtttactaacatggaagcacagctaatcagacagatggagagcgggggcatattttctccacgagaactagagacgcctaacttagcggaacgtgtattagattgggtagagaaatacggcgtcgaaagactcgagagaatggcaatctctggtgatgattgtctaggtgaaccaatatacgataggttcgctaccgctctaacagctctcaatgatatgggaaaagtaagaaaggatattccacaatgggaaccatccaaaggatggaatgattggcagcagggtccattctgcagccaccattttcaccaactcatcatgaaagacgggcgcgaaatagtcgttccttgtcgaaatcaggatgaattagtcggtagggcaagagtttcgcaaggcgccggctggagtctcagagaaacagcatgtttaggaaaaagctatgctcaaatgtggcaattgatggattttcatcgaagagacttacggctcgccgccaatgccatatggtcagcaggcccgggagattggattccaactagaaggacgacatggtcaattcacgcacatcatcaatggatgaccacagaggacatgctatcagtctggaacagggtgtggatcgaagaaaacccctggatggaagacaaaacccatatatcttcttggggagacgtaccataccttggcaaacgagaggatcaatggtgtgggagtctaattggacttacagccagagccacctgggcaacaaatatacaagtcgcaataaatcaagtacgtagactcataggaaatgaaaattatctagattatatggcgagtatgaaaagatttaaaaatgaatcagatcctgaaggtgcactttggtaa

SEQ ID NO: 21806 - RNA, 9879 nt, synthetic construct
  misc_feature 1..9879: note = derived and/or modified CDS sequence (opt6) from DENV-1__KF921942__SS-prME
  source 1..9879: mol_type = other RNA
tccgtaacgatgttattgatgttaatgcctactgcattagcatttcatctcactacacgaggcggagaacctcacatgatagtgtcaaaacaagaaaggggtaaaagcctcctgttcaaaacttctgctggcgtaaatatgtgcacactcattgcaatggacttaggtgaactgtgtgaagatacaatgacgtataaatgccctcgtataacagaaactgaaccagacgacgtagattgttggtgcaatgccaccgatacgtgggtgacctacggtacttgcagtcaaacaggggaacatcgaagagacaaacgaagtgttgcactcgcgccacacgtaggactgggattggaaacaagaaccgaaacgtggatgagctcagaaggggcttggaaacaaatacaaagagtagaaacatgggctctgcgacatcctggatttactgtaatcgctttatttcttgctcatgcaataggaacaagtataactcaaaaaggaataatttttatcctattaatgttagttaccccttcgatggcgatgagatgtgtagggattgggtcacgagattttgtagaaggacttagcggcgctacctgggttgatgttgttctagaacatggaagttgtgtaactacaatggccaaagataaaccaaccttagacatagaactactaaaaaccgaagtggcaaatccggcggtacttagaaaactttgcatagaagcaaaaatttcaaatacaacgaccgactcacgttgtccaactcaaggagaagccacattggtggaggagcaagatgctaattttgtatgccgccgaacctttgtagatcgcggctggggaaatggctgtgggctatttggaaaaggtagtttaataacctgcgctaaatttaaatgcgttaccaaactcgaagggaaaatagttcaatatgaaaatctaaagtactcggttatagttacggtacatactggggatcaacaccaagtaggcaatgagtctacggagcatggaacgacggcaacaattacgccacaagccccgacaacagagatacaacttacagattacggagcactcacattagattgctctccaagaacaggacttgacttcaatgaaatggtactcttaacaatgaaagaaaagtcatggttagtgcataagcaatggttcctggacctaccattaccttggacaagtggagctagcacctcgcaagagacatggaatcgccaagatttattagtcacctttaagactgcacatgccaagaaacaagaagttgttgtcctagggtcacaagaaggagctatgcatacagcactaactggtgcaacagagattcaaacatcaggaaccaccacaatttttgcaggccatctgaaatgcagattaaaaatggataagctaaccctcaaaggtatgtcctatgtaatgtgcacaggatcatttaaactagagaaagaactagctgagacacaacatggcacagtgttggttcaaattaaatatgaggggaccgacgctccatgtaagataccgttttccacgcaggacgaaaagggtgtaacacaaaatggtaggttaattactgcgaacccaatagtaactgacaaggaaaaacccgtcaatattgaagcagagccaccgtttggagagagttacatagtaattggtgcaggggaaaaggcgctaaaattatcttggttcaagaaaggaagtagcatcggcaagatgtttgaagcaactgcgaggggtgcaaggagaatggctattttaggcgatacagcttgggattttggatctattggcggggttttcacttctgccggaaaacttgtacatcaaattttcggcactgcgtatggcgtattattcagcggtgtaagctggacaatgaaaattggaatcggcgttttattgacatggctaggtttaaatagtaggtcaacttcactatccatgacatgcatagctgtcggtctcgtaactctgtatctgggtgtaatggtgcaggcagattcaggttgtgttattaattggaaggggagagaactgaaatgtggaagcggaatctttgtaaccaacgaagttcatacctggacagaacaatataagttccaagcagactcacccaagagactgtcagccgcaattggcaaagcatgggaagagggagtctgtggcataaggtctgcaacgcgtctggaaaacattatgtggaaacaaatttcaaacgaactaaatcatatattacttgagaacgacatgaaattcacagtagttgttggggacgtcgccgggattttagcccaggggaagaaaatgattagacctcaaccaatggaatacaagtactcatggaaatcatggggtaaagctaagataataggagccgacgtacaaaacactacgttcataatagatgggcctaatacaccagaatgtccagatgatcaaagagcatggaacatctgggaagttgaggattatgggtttggtatatttaccactaacatttggttaaagctgcgagattcatatactcaagtatgtgaccatagactaatgtctgcggcaataaaagatagtaaagccgttcatgcagacatgggatattggattgaatcagagaaaaatgaaacatggaagttagcccgagcctcgtttatagaagtgaaaacgtgcatttggccaaaatctcacacactctggtcgaatggagtactcgaatcagagatgattattccgaaaatatacggagggcctatatcacaacacaactatagaccggggtattttacccaaacagcaggaccatggcatttaggcaagctagaattagattttgatctgtgtgagggaaccacggtcgtggttgatgaacattgcggcaacagggggccctctttaaggacgacaacagtcacaggaaaaataatacacgaatggtgttgtaggtcgtgcactttaccgccattgcgatttaggggagaggatggctgctggtacggaatggaaatcagaccagtaaaagaaaaagaggaaaatctcgtcaaatcaatggtcagtgctggcagtggagaggtagatagtttctctttaggactcttatgcatcagcataatgattgaggaagtcatgaggtcaagatggagtagaaaaatgctaatgacaggtactttagcggtgttctttttattaatcatgggacaattgacatggaacgatctgatacgtctgtgcattatggttggagctaatgcgagtgatagaatgggcatgggcacaacataccttgcactaatggcaacttttaaaatgagacctatgttcgcagtagggctactcttcagaaggttaacatctagagaggttctcttgttaactataggtttatctttagttgcatcggtagagctcccgaactctttggaggaattgggtgatgggctagccatggggattatgattttaaaattattaacggactttcaatctcatcaattatgggctacattactttctttgacttttattaaaacaacgttttctctacattatgcatggaaaacaatggccatggttctttccatcgtcagcctgttcccactgtgtctatcaacgacaagtcagaaaactacgtggctacccgttctattaggatccttaggctgtaaacccctaacaatgttcttaatagcagagaacaaaatatggggtaggaggtcttggccattaaatgaggggataatggctgtgggaatcgtatccatactactgagctcattattgaagaatgatgtccccctagccggtcctctgatagcgggtggtatgttgattgcatgttacgtgatatcgggctcgtcagctgacttatcgctagaaaaagcggctgaagtatcctgggaagaagaagccgaacatagtggagcctcacataatatcttagttgaagtgcaagacgatggaacaatgaagattaaagatgaagaacgagatgatacgctaacaattcttttaaaagcgacattattagcagtaagtggtgtgtatcccctaagtataccagcaacactctttgtatggtatttttggcaaaagaagaaacaacgttctggagtcctttgggacaccccttctccaccagaagtagaacgagcagtccttgacgatggaatatacaggataatgcagagagggctcctaggccgctctcaggtaggagttggcgtgttccaagagaacgtattccacactatgtggcatgtcacaagaggcgctgtgcttatgtatcaaggcaagaggttggaaccttcatgggcgtcagtcaagaaagatttaatatcttatggcggtggctggaggcttcagggcagttggaatacaggcgaagaagtccaggtaatagccgttgaacctggtaaaaatcccaaaaacgtacagactgctccaggaaccttcaaaacacccgaaggagaggtcggggcaattgcgttggatttcaagccaggaacatcgggatcccccattgttaatcgagaaggaaaaatagtagggctatacggaaatggtgtagtaacgacctcaggtacgtatgtatctgcaattgctcaagcaaaagcatcacaagagggaccattacctgaaatagaagacgaagtatttagaaaaagaaacctaacgattatggacctccatccagggtcaggaaaaacccgtcgatacctgcccgctattgtcagggaggcaataaaaaggaaacttcgtacccttatacttgcaccgacacgcgtcgtggcctcagaaatggctgaagcattgaaaggcatgcctataagatatcaaaccaccgcagtaaaatcagagcacacagggaaagaaatagtcgacttgatgtgtcatgctacatttaccatgagattattaagtccagtgagagttccaaattataatatgataataatggacgaagcacatttcacagatcctagttctatagcagcacgcgggtacatatcaacaagggtaggaatgggggaagcggccgcaattttcatgaccgcaactcctccaggatcagtcgaggcgtttccccaatccaatgctgtgatccaggatgaagaacgtgacataccagaacgtagttggaactctggatacgaatggattactgattttccaggaaaaaccgtatggtttgtaccctcaattaaaagcggaaatgatattgcaaactgccttcgcaaaaacggaaaacgagtcatccaactctctcgtaagacgttcgatactgaatatcagaaaaccaaaaataacgattgggattatgtagttaccacggatataagcgaaatgggtgcaaactttagggcggacagggtaatcgaccccaggcgttgcctgaagcctgtgattttgaaagacggaccagaaagagtaatcttggcaggtccaatgcccgtcacggtagccagtgccgcacagagacgaggcaggattggacggaatcacaacaaagagggcgaccaatatatatatatgggccaaccattaaataatgacgaggaccatgctcactggactgaggcgaaaatgttattggacaatataaacacaccagaaggcattatacccgcactttttgaacccgaacgtgaaaaatccgcagccattgacggagagtacagactgagaggcgaagctcggaaaacttttgtggaattaatgcgccggggagacctccccgtttggctaagttataaagtagctagtgaaggctttcaatatagcgatagaagatggtgttttgacggagagagaaataatcaggttttggaagaaaatatggacgtcgagatttggacgaaggagggtgaaagaaagaaattacgacctagatggcttgatgccaggacttacagcgatcctttagccttgcgtgagtttaaagagttcgcggcaggtaggcgatctgtttccggagatttaattctagaaataggcaaacttccgcagcatcttacacagagagcgcaaaacgccctagataatttggttatgctacacaattcagagcagggaggacgtgcttacaggcatgcgatggaagaattgccagacactatagagactcttatgttgcttgcgctgatagccgttttaacaggaggagttactctgtttttcctctcaggtagaggactagggaagacaagtatagggctattatgcgtaatggcaagttcagtactcttatggatggcaagtgtagaacctcactggatagcagcaagcataattttagagttcttcctcatggtgttattaataccagaaccagatcggcaacgaacaccacaggacaatcagcttgcttacgtcgtaataggattacttttcatgatacttacagtagcggctaatgaaatgggcctccttgaaacgaccaagaaggacctcggtataggacacgtagcagtagagaatcaccatcatgcggcaatgttggacgtagacttgcatcccgcatctgcctggacgctttatgcagtggctacaacgatcatcaccccaatgatgagacatacgattgagaacactaccgcaaatatatctctaaccgcaatagctaaccaagcggcgatcctcatgggactagataaagggtggcctatcagtaaaatggacattggcgtaccattgttagctttgggctgctattcccaagtcaatccgctcacgctaacagcggcagtactgatgctagtcgcgcactacgcaataattggacccggattgcaggccaaagctacgcgtgaggcacagaaaagaacagctgccggaataatgaaaaacccaactgtcgatggaatagtagcaatcgatttggaccccgtagtctatgatgcaaaatttgaaaaacaattgggacaaataatgttactgattctttgtaccagtcaaatactactaatgagaactacctgggcattatgtgaatcaataacattagctaccggaccattaaccacactttgggagggaagtcctggaaaattttggaatacaactattgctgtatcgatggcgaatatatttcggggtagctacttagcgggagctggcttagcttttagtttgatgaaatctttaggtggagggaggagagggaccggagcacaaggagaaaccctcggtgaaaagtggaaaaggcagttaaatcaactatctaagagcgagttcaacacatacaaaagatctggaatcatggaggtagatagatctgaagcaaaagagggccttaaacgaggagaaacaactaagcacgcagttagtcgaggtaccgcaaaattacgttggttcgtagaaaggaacctagtaaaacctgaaggcaaagtcatagatttaggatgtggccgaggtgggtggagttattattgcgctggtctgaagaaagtaacagaagtaaaaggatacactaagggtggtcctgggcacgaagaaccaatccccatggcgacttatggatggaacttggtcaaattacactcaggaaaggatgtatttttcatcccaccagaaaaatgtgacactctcctatgcgacattggagagagttctccgaatcctactatagaagaaggacgtacattgagagtattgaagatggtcgaaccgtggttacgaggtaatcaattctgcattaagattctaaatccatacatgccttcagtcgtagaaactctagaacaaatgcaacgtaagcatggtggaatgctagtaagaaatccactttcacgtaattcaacacatgaaatgtactgggtatcttgtgggaccggaaatattgtatcagcagtaaatatgacttccagaatgctactaaacagatttaccatggcccaccgtaaaccaacatacgaacgtgatgtagatcttggagcaggcacgagacatgttgctgtagagccagaagttgccaatctcgacataatagggcagagaatagagaacataaaacacgaacataaaagtacctggcactacgacgaagacaacccttataaaacgtgggcttaccatggttcgtacgaagtaaaacccagtggcagtgcctctagtatggttaatggcgtagtgaaattattgacgaagccgtgggatgtcatcccaatggtcactcaaatagcgatgaccgacacgacgccgttcggccagcaaagggtctttaaggaaaaggtagacacgcgaactccaaaggccaagcgtggcacagcacagattatggaagtaaccgcaaaatggttgtggggatttttatctcgaaataagaaacctcgaatatgtacaagagaagaatttactagaaaagtacgctcaaatgctgcaattggtgctgtgtttgtggacgaaaaccaatggaactcagcaaaagaagccgttgaagacgagagattctgggacttggtacatagagagagagaactgcacaaacagggaaaatgtgcaacatgtgtttacaatatgatgggtaaaagggagaagaaactaggtgaatttggaaaagccaaaggtagcagagcaatatggtatatgtggttaggagctagatttttggagtttgaggccttaggattcatgaatgaagatcattggttttcaagagaaaactcattatccggtgttgaaggggagggtctacataaattgggttatatactcagagatatttcaaaaatacctggtggcaacatgtacgcggatgatacagctggatgggacacaaggattacagaagatgacctacagaatgaggcaagaataacggatataatggaacccgagcatgccctacttgcaaaatctatattcaagctaacataccaaaataaagttgtgcgtgtacaaagacctgcaaagaacggcacggtaatggacgtgattagccgtagagatcagcgtggttcaggtcaagttggcacatacggattaaacaccttcacaaatatggaagcgcagttaattcgacaaatggagtcggaggggatattttctccaagtgaactagaaactcccaatttagcggagagagttcttgattggttagagaagtacggcgtcgaaaggttaaagcgaatggcgataagcggtgatgactgtgtagttaagcctatcgacgaccgatttgcaactgcactaactgcattaaacgatatgggaaaagttagaaaagacatcccccagtgggaaccctcgaaaggttggaatgattggcaacaagtccccttttgttcacaccattttcatcagctcattatgaaagatggaagagaaattgttgtaccatgtcgcaaccaagacgaattggtaggccgtgccagggtgtctcagggcgcaggctggagtctaagagaaacagcgtgtctaggaaagagctacgcgcaaatgtggcagttgatgtactttcatagaagggatctaaggctagcagccaacgcaatatgcagcgctgtacctgtcgactggattccaactagcaggaccacctggagtatacatgctcatcatcaatggatgacgacagaagatatgttaagcgtctggaaccgtgtgtggattgaagaaaatccatggatggaggacaaaacgcacataagctcgtggggagacgtaccatacttaggaaaacgtgaagaccagtggtgtggaagtttgataggactcacagcacgagccacatgggcaactaacatacaagtagccattaatcaagtacgccgcttaataggaaacgaaaattatcttgattacatgacctccatgaaacggttcaaaaatgaatcggaccctgagggtgctttatggtaa

SEQ ID NO: 21807 - RNA, 9879 nt, synthetic construct
  misc_feature 1..9879: note = derived and/or modified CDS sequence (opt6) from DENV-1__JF937602__SS-prME
  source 1..9879: mol_type = other RNA
tcagttaccatgctactcatgctcatgccaacggcactagcatttcaccttactacccgtggtggtgaaccacatatgatagtcagcaaacaagaaaggggaaaatctttgctatttaaaacttcagcaggggttaatatgtgtaccttaatagcaatggacttaggtgaattttgtgaagatactatgacttacaaatgcccaagaataacggaagctgaaccagatgatgtcgattgttggtgcaacgcaacggatacgtgggttacttatggaacctgtagccaaacaggagaacaccgaagagacaaaagaagtgtggcgctagcacctcacgttggtttgggtttagaaacacgaacggaaacatggatgagttctgaaggggcatggaaacaaatacaacgggtggaaacatgggccctcagacaccccgggtttactgtgatagcgttattcctcgcgcatgcgattggtacctctataactcaaaaaggaattattttcatactactgatgttagttaccccctcaatggcgatgagatgcgtgggtataggatctagagattttgttgaaggtctcagtggagcgacttgggtggacgtagttcttgaacatgggtcatgcgtaacaactatggctaaggataaaccaacgttggatattgagttattaaaaacggaagtgactaatccagcagtattgagaaaattatgcattgaagctaaaatttccaacacaactaccgatagcagatgccctacacaaggggaagcaaccctagttgaagaacaggatgctaattttgtatgtcggcgaacttttgttgatcgaggatggggaaatggatgtggtctatttggtaaaggatcacttattacgtgtgcaaagttcaaatgcgtaacgaaattagaaggaaaaatagtccaatatgaaaatctaaaatattcagtaattgtaactgttcacaccggagatcaacatcaggttgggaatgaaagtacagaacacggtactacggccacgatcactcctcaagcccctagtaccgaaatccaattaactgactatggcgcgctaactctggattgttcaccgagaactggactagattttaacgagatggtcctccttaccatgaaagagaaaagttggctagtacataagcaatggtttttagacttgccattaccttggacatcaggagcaagtacttcacaagaaacgtggaatagacaagacctccttgtaacatttaaaacggcgcacgctaaaaagcaagaggtagttgtactggggtctcaagagggagctatgcatacagcgcttaccggtgccacagaaatacaaacgagtgggactactacaatcttcgcaggtcatctaaagtgccgattaaaaatggataaactcacgctaaaggggatgtcgtatgtcatgtgcaccggatcttttaagctagaaaaggaggttgcagaaactcagcatggaactgtattggtacaaattaagtatgaaggaacggacgctccgtgtaaaataccatttcttacacaagatgaaaaaggagtaacacaaaatgggcgattaataactgctaacccaatcgtgacggataaggaaaaaccagtaaacatagaagcggagcccccttttggcgagtcatacatagtcataggagcaggagaaaaagcactaaaattgtcgtggtttaagaaaggttctagtataggtaaaatgtttgaggctactgcaagaggtgcacgtagaatggccatactgggtgataccgcgtgggattttggtagcataggaggtgtatttacgtcagtcggaaaactcgtacaccaaatattcggaacagcatatggagtactattcagcggggttagttggacaatgaagataggtattggagtactattaacttggctcgggcttaattcaagaagcaccagcctttcaatgacctgcatagcggttggcctagtaactttgtacctcggcgtgatggtacaggcagatagtggctgcgtcataaattggaaaggaagggaattaaagtgtggatcgggaatttttgtaacaaatgaagtacacacatggacagaacagtataaattccaagcagactcaccaaagcgactatcagccgccataggaaaggcctgggaagaaggtgtatgtggaataaggtctgctactagactcgagaacattatgtggaaacaaatatctaatgagttgaactatatcttattagaaaacgatatgaagctaacagtggttgtgggagacgttgccggaatattggcacaagggaagaaaatgattcgcccacagccgatggaatataaatattcttggaaaagctgggggaaggcaaaaatcataggagccgatgtgcaaaatacaacatttataattgatggtcctaatacacccgaatgcccggatgatcaacgagcctggaatatctgggaggtcgaggattatggtttcggaatatttacaactaacatatggttaaaattacgagattcttacacacaagtttgtgatcatcgactgatgtccgcggcaataaaggactcgaaggcagttcacgcagatatggggtattggattgaaagtgagaaaaatgaaacatggaaactcgcaagagccagctttatagaagtcaagacgtgtatctggccgaagtctcatactctttggagcaacggagtcctagagtcagaaatgataataccaaaaatttatggcggaccaataagccaacacaattatcggccaggatactttacgcaaaccgctggaccgtggcacttgggtaaattagaactggactttgatctttgtgaaggaacgacagtagtcgttgatgaacattgcggtaatagagggccatcactacgaacgacaacggtgacaggcaaaatcatacacgagtggtgttgtaggagttgcacgttacctcccctcagatttaagggagaagacggttgttggtatggaatggaaatacgacctgtaaaggagaaggaagaaaacctcgtaaaaagcatggtatccgcaggatccggcgaggtagatagtttttccctcgggttactttgtatatcaattatgattgaggaagttatgcggtcacgatggtcaagaaaaatgcttatgactggtactctggctgtattctttttgctaataatgggacaattaacatggaatgatctaattagactatgcatcatggtgggagcaaatgcttcagaccgaatgggcatgggtactacatatcttgccctaatggcaacttttaagatgaggccgatgtttgctgtcggccttctttttcgtagattgacaagtagggaagtactattattaacaatcggactttccttagtggccagcgtagaacttcccaacagtctagaagaattaggtgatggacttgcaatgggaatcatgatattaaaattactgaccgactttcaaagccatcaactttgggctacacttttgtcgttgacatttgttcgaacaactttcagtttacattatgcttggaaaacaatggcaatggtattgtcaatagtgagccttttccctctttgtctctccactacatcacagaaaacaacatggttaccggtactactaggtagtttaggttgcaagccattaactatgtttttaattgctgagaataagatatgggggcgtaagagctggccattaaatgagggcattatggcggtaggcatagtgagcatactgctgtcgtcccttctgaaaaatgatgtgccattggcaggacctttaatcgctggtggaatgctaatagcatgttacgtcattagtggatctagtgcggatttgagcctggaaaaggctgctgtcgtgtcatgggaggaagaagccgaacattcaggagctagtcataatatattggttgaagtacaagatgacggtacaatgaaaattaaagatgaggaaagagacgatacattaactatacttctaaaagcaacattgcttgctgtatcaggtgtatatcccctcagcataccggcaacattgtttgtctggtatttttggcagaagaagaaacaaaggtccggagttctttgggatactccaagtccaccggaggtagaaagagcggttctagatgacggcatctacagaattatgcaacgaggattgttaggaagatcacaagttggagtaggggtgttccaggaaaacgtattccacacaatgtggcatgtaacaaggggagcagtattaatgtatcaagggaaaagattagaaccttcttgggcatcggttaaaaaggatttgattagctatggaggaggttggcgacttcaaggatcctggaataccggagaagaagtacaggtaatcgcggtggagcctggtaaaaacccaaagaacgtacaaacagctccgggcacttttaaaacaagcgaaggtgaggttggagcgattgcccttgacttcaaaccaggtacaagtggcagcccgatagttaatcgtgaaggaaaaattgtaggactatatgggaatggagtagtaacgacctccgggacttacgtgagtgccattgctcaagctaaggcatcgcaggagggccctttaccagaaatagaagacgaagtgtttagaaaacgaaacctaactatcatggacctacatcccggatcaggtaaaacgagacgttatctacctgcaattgtgagagaagcaataaagagaaaattacggacattgatattagccccaacgagagtagtagcatcagagatggcagaggcactgaaaggtatgccaatcagatatcaaacaactgcagtaaaatcagagcataccggcaaagaaatagttgaccttatgtgccatgctacatttactatgagattattgagtcctgttagggtaccgaattacaacatgattataatggatgaggcgcattttaccgacccgtcttcaatcgcggcgagaggctacatttccacgcgcgtaggcatgggggaagcagctgctatatttatgaccgcaaccccaccgggatctgtcgaggccttcccgcaatccaatgctgtaatacaagatgaagaaagagacattccggaaagatcctggaactcgggctacgaatggattaccgattttccgggaaaaacggtgtggtttgtaccttccataaaatctgggaatgatatagcaaattgtctaagaaagaatggaaaaagagtgattcaactgagccgtaaaacgttcgacacagaataccagaagactaaaaacaacgactgggactatgttgtaacaactgatatctcagaaatgggagcaaattttcgcgccgatagagttatagatccccgaagatgtctaaaacctgtaattctaaaggatggaccagaaagagtaatacttgcgggaccgatgcctgttactgttgcatcggcggcgcaaagacgagggagaataggacgcaaccacaataaagaaggagaccaatatatatacatgggtcagccactaaataacgacgaggaccacgctcattggacggaagcaaagatgttattagataacattaacactccagaggggattattccagcacttttcgagcctgagagagagaaatcagccgctatagacggcgaatataggcttagaggggaagcgcgcaagacatttgtggagctcatgaggaggggcgatctacctgtgtggcttagctacaaagttgcatcagagggcttccagtattcggatagaaggtggtgctttgatggagaaagaaataaccaagtattagaagagaatatggatgttgaaatatggactaaagaaggtgaaaggaagaaattacggcctagatggttggatgctcgaacttattcggatccactcgcattgcgggaatttaaagagttcgcggcaggaagaagatctgtaagtggagacctaatcctcgaaatagggaaacttccacaacatttgacacagcgtgcgcagaatgcactagacaatcttgttatgctccataattctgaacaaggaggtcgggcataccgccatgctatggaagaacttccagatactattgaaacacttatgttattggccttaattgctgtactaaccgggggagtaactctgttctttttaagcgggaggggtttaggcaaaacctcaatcggattattgtgcgttatggcttcatcagtcctcttgtggatggcttcagtagaaccccattggattgcggccagcattattctagaatttttccttatggtgctgcttatacccgaaccggacagacaaagaacaccacaggataatcaacttgcgtatgtagtcatcggtttactgttcatgatattaaccgtggctgcgaacgaaatgggcctattagaaactactaagaaagacctaggtattggacatgtggcagtagaaaatcatcatcatgctgcaatgttagacgtagatctacacccggcttcagcttggacattgtacgcagtcgccaccacgattataactcctatgatgcggcacacaattgaaaatacaacagctaatataagtttaacagctatagcaaatcaagcggccatcctcatggggctagacaaagggtggccaatctccaaaatggatataggggtacctctcttagcattaggatgttattctcaagtaaatccgctaactttaacagctgcggtgctgatgctcgtagctcattatgcaataattggtccgggactgcaagcaaaagcaacaagagaagcccagaaaaggactgcagcaggcatcatgaaaaacccaacagtagacggcattgtagcaatcgatctagatccagtcgtatatgatgctaagttcgaaaaacaactgggccaaataatgctcttaattctatgcacttcacaaatactgctaatgagaacaacatgggcattatgcgagagtatcactctagctacaggtccccttactacgttatgggaaggaagccctggcaaattttggaatacgactatagccgtaagcatggcaaatatattcagggggagctatctcgctggggccggtcttgcttttagcttaatgaaatcactcggaggaggacgtcgtggtacaggagctcaaggagagaccctgggggaaaaatggaaaagacagttaaaccagcttagcaaatcagaatttaacacatacaaacgctctggtattatggaagtggaccgtagcgaggctaaagaaggactcaaaaggggtgaaaccacgaagcatgccgtgtcacgtggcacagcaaagctccggtggtttgtagaacgaaatttagtgaaaccagagggaaaagtaatagacttgggctgcggaagaggtggttggtcatattactgtgcaggactcaaaaaggtaaccgaagtaaagggttacactaaaggcgggccaggacatgaagaaccaataccaatggccacatatggatggaatttagtgaaactccactcaggcaaagatgtgttctttattccaccggaaaaatgtgatacactattgtgcgatatcggtgaatcatcacctaatcccacaatagaagagggtcgtacactaagagtacttaagatggtagaaccatggttgagagggaaccagttttgcattaaaatattaaacccatatatgccaagcgtggttgaaacactagaacaaatgcaacgaaaacacggaggaatgttagtaagaaatccattaagtagaaacagtacacatgaaatgtattgggtctcatgcggaactggtaatatagtatccgcagtaaatatgacctcgcgtatgctattaaacagatttacaatggctcaccgaaagccaacgtatgaacgagatgtcgaccttggtgctggtacccgtcatgtcgctgtcgagccagaagtagctaatctggacataatcggacaacgtatagaaaatataaaacatgagcacaaaagtacctggcattacgacgaagacaatccgtataaaacatgggcgtatcacggatcatatgaggttaaacctagtggtagtgcttccagcatggtaaatggtgtagtaaaactcttaactaaaccatgggatgtaattccgatggtgactcaaatagccatgacagacactacaccatttggacaacagagagtttttaaagaaaaagttgatacaagaacacccaaagcaaagcgaggaacagcccagattatggaagtgacagcaaaatggctatggggatttttatcacgcaataaaaagcctaggatatgtactagagaggagttcacacgaaaagtaagaagtaatgcagcaataggtgctgtcttcgtggacgagaaccaatggaactctgcaaaagaagctgttgaggatgaacgtttttgggaccttgtccacagggaaagagaattacataaacaaggtaaatgcgcgacatgcgtgtataatatgatgggaaaaagagaaaagaaattaggtgagttcggcaaagcaaagggctcgagagcaatttggtacatgtggttgggagcaagattcctagaatttgaagcattgggtttcatgaatgaggaccattggttttctcgggaaaattcattatcaggagtggagggagaaggacttcataaacttggatatattcttcgagacattagtaaaataccaggtggtaacatgtatgcggacgatacagcgggctgggacacaaggataacagaagatgatctacaaaatgaggctaaaattaccgatataatggaaccagaacatgctcttttagcaaaaagcatatttaagctaacgtatcaaaataaggtagtaagggtccaacgaccggccaaaaatggaaccgtaatggacgtcatttccaggagagatcagcggggtagtgggcaggtaggaacctacggcttgaacacattcaccaacatggaagcgcaattaatacgtcaaatggaatctgaaggtatcttctcgccaagtgaactggaaacacctaacttagccggacgagttctagattggctggaaaaacatggagtagagagattgaaaagaatggctatcagtggagatgattgtgttgtaaagcccatagatgacagattcgcaacagcactcacagcactaaatgacatgggaaaagtaagaaaagacatccctcaatgggaaccatcaaaaggatggaatgattggcaacaagtacctttttgctcccaccactttcaccaactaataatgaaagatgggcgggagatagttgtgccatgccgaaatcaagatgagctcgtaggtagagcacgggtatcccagggagctggttggagtttgagggaaacagcttgtttaggtaaatcatacgcacaaatgtggcaattaatgtattttcatcgtcgtgatttaaggctagccgccaatgccatttgttcagctgtaccggtcgattgggttccgacttcgaggacaacttggtcgatacatgcacaccaccaatggatgactactgaagatatgttaagtgtatggaatagagtttggatagaagaaaatccatggatggaggataaaacgcatataagttcgtggggtgatgtcccgtatcttggaaaacgagaagatcagtggtgcggctctttgatcggactaactgccagagcaacctgggctacaaacatacaagtggcaataaatcaagtacgtcgtctattgggaaacgaaaattacctagactatatgacgtctatgaagcggtttaagaatgaaagtgatccagaaggtgcactatggtag

SEQ ID NO: 21808 - RNA, 9879 nt, synthetic construct
  misc_feature 1..9879: note = derived and/or modified CDS sequence (opt6) from DENV-1__GU131729__SS-prME
  source 1..9879: mol_type = other RNA
tcagttactatgttgcttatgttaatgcctacggctctagcatttcatttaactaccagaggtggagaacctcacatgattgtatcgaaacaagaacgcggtaaatccttacttttcaaaaccagcgccggagtgaatatgtgtaccctaatagccatggacttaggtgaattatgtgaagacaccatgacatacaaatgtccaagaatcactgaaactgaacctgacgacgtcgattgttggtgtaatgccacggatacatgggtgacgtatggaacgtgctctcaaactggagaacacaggcgagataaacgctcagttgccctggctcctcatgtcggtctgggattagaaacacgtactgaaacgtggatgtcgtcagaaggtgcttggaaacaaatacaacgggttgaaacatgggcactgagacatcccggttttaccgttattgctttatttctagctcatgcaattggtacaagtataacacaaaaaggaataattttcatactactgatgttagtcacaccctctatggccatgagatgtgttggaattggttcgagagattttgtagaaggactttcaggtgcaacatgggtagatgtagtactggagcacggttcgtgcgttactacaatggctaaagacaaacccacattagatattgaattactgaaaacagaagtgacgaaccctgcagtgctaggaaaactatgtattgaggcaaaaatctcaaatactaccactgacagccgatgtccaactcaaggtgaggcaacgttagtagaagaacaagatgctaatttcgtatgtagaagaacgtttgttgaccgcgggtggggcaatgggtgtggattgtttggaaaaggtagtctaataacatgtgcaaaattcaaatgcgtaaccaaattagagggaaaaatagttcaatacgagaatttaaaatattctgtgatagtcactgtacacacaggagaccaacaccaggtaggaaatgaatcgacagaacacggtacaacggcaactattacaccgcaagcgccaacaacagaaatacaattaactgattatggagcgctaacattagattgtagtccgagaacaggcctagactttaacgaaatggtactgctaacaatgaaagagaaaagttggttggtccataaacaatggtttttagatctgccattaccttggacaagcggcgcatctaccagccaagagacatggaacaggcaggatctcctagtcactttcaaaactgcacacgccaagaaacaagaagtggtcgtcctcggttcacaggagggagcaatgcacactgcgctaactggtgcaacagaaatacaaacaagcggaacaacaacaatattcgcaggccatctgaaatgccgattaaagatggataagttaaccctgaaaggtatgtcttacgttatgtgtaccggttcattcaaactggaaaaggaactcgccgaaacacaacatgggaccgtgttggtccagataaaatacgaaggtacagatgcaccatgcaaaatacccttcagcactcaagacgaaaaaggcgtcactcagaacggacgtctaataacggccaatcccatagttaccgataaggaaaagccggttaacatcgaagctgaaccaccattcggcgagtcatacatagtaattggggccggcgaaaaggctttaaagctctcttggtttaagaaaggttcatctattggaaaaatgtttgaagcaaccgcaaggggagcaaggcgcatggcaattcttggtgatacagcatgggattttggaagcattgggggagtttttacaagtgttggcaagctagtgcaccaaatattcgggacagcatacggcgtgctattttcaggcgtcagttggacaatgaagataggcattggtgtattactaacttggttagggcttaattcaaggagtacatctttaagcatgacatgtattgcggtgggattggtaacattatatttaggggtcatggtgcaagctgactctggatgtgtcattaattggaaagggcgcgaattgaagtgtggctcaggaattttcgtaactaacgaagtacatacatggactgaacagtataaatttcaggctgatagtcctaagcgattaagtgcagccataggaaaagcatgggaagaaggagtctgcgggattcgatcagctacacgcttagaaaacataatgtggaagcagatatctaatgaattaaaccatatactgctagagaatgatatgaaattcactgtagtggtaggagatgtggcaggaatcttagcccaaggaaagaagatgatacgcccccaaccaatggaatacaagtatagctggaaaagttggggaaaggccaaaataataggagcagatgttcaaaacaccactttcattatcgatggaccaaatacccctgaatgccctgacgatcaacgggcttggaacatttgggaagtagaagattatggattcggtatctttacaacaaatatatggctcaaactccgagatagctacacacaagtctgtgaccataggttaatgagcgccgcaataaaagacagtaaagctgtacatgcagatatgggatattggatagaatcggagaaaaacgagacgtggaagttagcaagagcctcatttatagaagtaaagacctgcatatggcctaaaagccatacgttatggagtaatggtgttctagaatcggaaatgattataccgaaaatctatgggggcccaataagtcaacataattacagaccaggttactttactcagacggcaggcccttggcacctaggaaaattagaactagactttgacttatgtgaaggcacaaccgtggtggttgacgaacattgtggtaaccgaggacccagcttaaggactaccacagtcacggggaaaataattcatgaatggtgttgtcggagttgcaccctaccaccacttcgtttccgaggagaagacgggtgctggtatgggatggaaattaggccagttaaggaaaaagaagaaaatttagtaaaaagtatggtgtctgctggaagcggagaagttgactcattctccttaggattgctatgcatcagtattatgatagaggaagtaatgagatctaggtggagtcggaaaatgcttatgaccggaacactcgctgtattctttttgctcattatgggacaattgacatggaatgacttaattcgcttatgtatcatggtaggtgcaaatgcgagtgatcgcatgggaatgggcacgacttatttggcattgatggctacatttaagatgagaccgatgttcgcagtaggcttattgttcagaagattaacttcaagggaggttttacttctgacgattggtctctccctggtcgcttctgtagaactgccaaattcactagaagagttgggtgatggtttagcaatgggaattatgatcttaaaactattaaccgattttcaatcacatcaactttgggcaacgctgttaagtttgacttttattaaaactactttcagcctacattacgcatggaagaccatggcaatgatattatctatagtatcactgttccccttatgtttgtccacaacgtcacagaaaaccacatggctccctgtgttattgggctctttaggttgtaagcccctgacaatgtttttaatcgcggaaaacaaaatatggggaagaaggtcatggcctttgaatgaaggaattatggcagtcggcattgtatctatactactgagttcattactcaaaaacgatgtaccattagcaggaccattaatagctggcgggatgctcattgcttgctatgtaatatctggatcatccgctgatttatcattagaaaaagctgcggaagtatcatgggaagaagaggccgaacattccggcgcatcccacaacattcttgtagaagtacaagatgatggacccatgaaaatcaaagatgaagagagagatgatacgctcaccatactcttaaaagcgacattactggctgtctctggtgtctatcctctaagtatccctgcgacgctttttgtgtggtatttttggcagaagaagaaacagcgatctggagtgttatgggatacaccttcccctcccgaagtggaaagagccgttttagatgatggcatatacaggataatgcagagaggacttttagggcgtagtcaggtcggtgtgggcgtattccaagaaaacgtttttcacacgatgtggcatgttacacgaggggcagtgctcatgtaccagggtaaacgtcttgaacccagttgggctagcgtaaagaaagacttgatttcatacggcggagggtggaggctgcaaggaagttggaatacaggagaggaggttcaagtcatagccgtggaacctggcaaaaatcccaaaaacgtccaaacagcaccggggacctttaaaacaccggaaggagaagtaggtgcaatcgcactggatttcaaaccagggacttcgggatcccctattgttaatcgtgaaggtaaaatagtaggattatatggaaatggagtagtaaccacttcaggaacctacgtttctgcaatagcccaagctaaggcttctcaagaaggacctttaccggaaatagaagatgaagtattccgcaaacggaacttgaccataatggatctgcatcctggttctggaaaaactcgtcggtaccttcccgccatagtgcgtgaagccataaaacgaaaactacgaacgttgatactagctccgacacgagttgtggctagcgaaatggccgaagcgttaaaaggcatgcccataagataccaaactacagctgttaaatccgaacacacgggcaaagagatagtagatctcatgtgccatgctacatttacaatgcgcctattgtcgcccgttagagtgccgaactataatatgataatcatggacgaggctcactttaccgatcctagtagtattgctgcccgaggttatatctccacaagggtgggaatgggtgaagcagcagctatattcatgacagcaacgccacctggatcagtcgaagcattcccacaatctaatgcggtaattcaagatgaggaaagagatatccccgagagatcctggaatagtgggtatgaatggataaccgactttcctggtaaaacagtgtggtttgtgccatcgataaaaagtggaaatgacatagccaattgcttgcgcaaaaatgggaaacgcgtgatacaattatcacgtaaaacctttgatacggaatatcagaaaactaaaaacaatgactgggactatgtggtcactacggacatatcagaaatgggagcaaacttcagagctgcccgcgttatagacccaagaagatgcttaaaaccggtaatattgaaagatggtccggaaagggtcatactagcaggtcctatgcctgtcacagttgcttcagccgcacaacgacgaggaagaatcggaagaaatcacaataaagagggtgatcagtatatatatatgggacaaccactgaataatgacgaggatcacgcgcattggacagaagctaaaatgcttttggacaacatcaatacacctgaaggaataattccggctctatttgaacccgaacgggagaaatctgcagctattgatggcgaataccgtctgagaggagaagctagaaagacgttcgtagaattgatgaggagaggggacttaccagtatggttatcatacaaagtggcatctgaaggtttccaatattcagacagacgatggtgtttcgacggcgaaagaaacaaccaagttcttgaagagaacatggatgtagagatttggactaaagagggagaacgtaagaaactgcgacctagatggttagacgctaggacatactctgacccccttgcattacgagaatttaaagagtttgcagccggaagaagatcagtatctggggacttaatactggagattggtaaactaccacaacatttaacacaaagagcacaaaatgcgttagataatctagtaatgctacataattcagaacaaggcggacgggcatataggcatgctatggaagaacttccggatacgatcgaaacgctcatgttactggcgcttattgcggtacttaccggtggtgtgacactatttttcttgagcgggcgtggattaggcaagacttcaatcggcttactctgcgtaatggcttcaagcgtacttctgtggatggccagcgtagaacctcactggattgcagcatcaataattcttgaatttttcctaatggtattattaattcccgaacccgaccgtcaaaggactcctcaagataaccagttagcctatgttgtaataggactactctttatgatcttgacggtagcagcaaatgagatgggtctattagaaaccactaagaaagatctgggcataggccacgttgctgtggaaaatcatcaccacgccgcgatgctcgatgtagacttacatccagcaagcgcttggacattgtatgctgttgcaactacaataataactccaatgatgcgtcatacaattgagaacacaactgcaaacatatcattgactgctatagccaaccaagctgcaatattaatgggcctggacaaaggatggcccatatcaaagatggatattggggtacccttattggcattaggctgctatagtcaagtaaatccattgaccctcacagcagctgttctcatgctagttgctcactatgcaataattggaccgggtttacaggctaaagcaacgagagaagcccaaaagcgcacagcagcaggcataatgaaaaatcctacagtggatggaattgtcgcaatagatctggatccagtggtatatgatgccaaattcgaaaagcaactggggcagattatgttactaatactgtgtacttctcaaatactattaatgaggactacatgggcactatgtgaaagcattactctcgctacaggtccacttactaccctttgggaagggtcgccaggcaaattttggaacacaactatagctgtctctatggcaaatatattcagaggatcgtacctagcaggggcgggcttagcctttagcttaatgaaaagtttagggggtggtagacgaggaacaggtgctcagggagagactctaggtgaaaagtggaaacgacaactgaaccagttgtccaaatccgaatttaatacctataaacgatcaggaatcatggaagttgacagatctgaagctaaggaaggtttaaagcgaggcgagacaacaaaacatgcggtttcacgtgggacggctaaactaagatggtttgtagagcgtaccttagttaaacctgaaggaaaggttattgatctaggatgtggtaggggtggttggtcttattattgtgcgggtctcaagaaagttacagaagtgaaaggctatacgaagggcggcccaggacatgaggagccgataccgatggccacttatggatggaacttagtcaaactacattcgggaaaagacgtatttttcatacccccggaaaagtgcgatactctgttatgtgatattggtgagagttctccaaacccgacgatcgaagaaggtagaacacttcgagtactaaagatggtagaaccatggctaagaggaaaccagttctgtataaaaattttgaatccttatatgccatcagttgtagaaactttagaacaaatgcagcgcaaacacggtggaatgcttgtaaggaacccgctatcaagaaattcaacccacgaaatgtattgggtatcatgtggtacaggtaatatcgtaagtgctgtaaacatgactagccgtatgctcttaaatcgttttacaatggcccaccgaaaacctacatatgaaagagatgtcgatctaggtgcaggaaccagacatgtagctgttgaaccagaagtagccaaccttgatataattggtcaaagaattgaaaacattaaacacgagcataagagtacctggcattacgacgaagataacccgtataaaacttgggcttatcatggttcatatgaaggtaagccatcaggttccgcgtcgtctatgggaaacggggttgtaaagttattaacgaaaccctgggatgtcattcccatggtaacacaaatagcgatgacagatacaactccattcggtcaacagcgtgtgttcaaagagaaagtagacacacgcactcccaaagctaaaagaggtacagcgcaaattatggaagtaacagccaaatggttatggggatttttaagccgcaataaaaagccaaggatttgcactagagaagagttcactagaaaggtgcgttcaaacgctgcaataggagccgtctttgtagatgaaaatcaatggaatagtgccaaggaagcagtagaagatgaacgattttgggatctagtacatagagaaagggaactccacaaacaaggaaaatgtgcgacctgtgtgtataatatgatgggaaagcgagaaaagaaacttggggaatttggtaaagctaaagggtctcgtgcaatttggtacatgtggttaggagcaaggtttttagaatttgaggctttaggcttcatgaatgaagatcattggttttccagagaaaattcattatcgggcgtcgaaggagaaggtctacataaactgggatatattttaagggacatatcaaagattcctggaggtaatatgtatgctgacgacactgcgggatgggataccagaattacagaagatgacctacaaaatgaagcaagaataactgacattatggaaccagagcacgcattgctagccaaatcaatttttaaactcacatatcaaaacaaagtagttagagtacaaaggcctgctaaaaatggtacagtaatggacgttatttctaggagggaccaacgtggaagtggacaggttggcacctatggacttaatacgtttaccaacatggaagcacaattaattagacagatggagtcagaagggatttttagtccctcagaactagaaacgccaaatctggcagaacgtgtacttgactggttagaaaagtacggagtagagagactaaagcggatggcaatatcaggggacgattgtgtcgtcaaaccaattgatgacaggtttgccacggctcttacagcgttgaatgatatgggaaaagttagaaaagacatccctcaatgggaacctagtaaaggatggaacgactggcaacaagtacccttctgttcacaccattttcatcagctgataatgaaggatggacgtgaaatcgtagttccttgtcgaaatcaagacgaactcgttggacgagcgcgagtcagtcaaggagcgggatggtccctgcgagagactgcatgtctgggtaaatcgtatgcacaaatgtggcaactgatgtactttcataggagagatttaagactagcagccaacgcgatttgttctgcagtcccagttgactggatacccacaagtcgcacaacatggtcgatacacgctcaccatcagtggatgacgacagaagatatgctcagtgtctggaacagagtatggatagaagaaaatccgtggatggaggacaaaacacacatttctagttggggcgacgtaccgtatcttggaaaaagggaagatcagtggtgcggcagcctcataggtcttacagcacgggcaacatgggcaactaacattcaagtggctataaaccaagtgcgtcgactcattgggaatgaaaattacctagactacatgacaagtatgaagagatttaaaaacgaaagcgaccctgaaggggcactatggtaa

SEQ ID NO: 21809 - RNA, 9879 nt, synthetic construct
  misc_feature 1..9879: note = derived and/or modified CDS sequence (opt6) from DENV-1__GU131730__SS-prME
  source 1..9879: mol_type = other RNA
tcagttactatgttacttatgttaatgccgacagcattagcatttcatctaacgacgcggggtggagaaccacatatgatagtatcaaaacaagaaagaggaaaatcactgctatttaaaacttccgccggagtaaatatgtgtacattgatagcgatggatctaggagaattttgtgaagatacaatgacatataaatgcccaagaataacagaagcagaacctgacgatgtggattgttggtgtaatgctactgatacatgggttacatacggaacttgcagtcaaacgggtgaacacagacgcgataaaagatccgtagcgctcgctcctcacgttgggttaggactagaaacgagaactgaaacatggatgtccagtgaaggtgcgtggaagcaaattcaaagagtcgaaacatgggccctgaggcatcctggttttactgttattgctttgtttcttgcgcatgcaatagggacttcaattacacaaaaggggataatattcatacttttaatgctcgtcacacctagtatggcgatgcgttgcgtaggaataggtagtagagattttgtcgaaggtctaagcggtgcaacatgggtagatgtagtactcgaacatggtagttgtgtcactacaatggcgaaagacaaaccaactcttgacatagaactactaaaaacagaagtcactaatcccgcagtattacggaaattatgtatagaagcaaaaatctcaaatactacaactgatagccgttgtccgacgcaaggtgaagcaaccctagttgaagaacaagacgctaactttgtttgtcgacgaacatttgttgatagaggttggggtaatggatgcggcttatttggtaagggatcattaatcacttgtgcaaaatttaagtgtgtgacaaagttagaaggcaagattgtgcaatatgaaaatttgaaatatagcgtaattgtaacggtacatacaggtgatcaacatcaagttggaaatgaaagcactgaacacggtacgacagctaccataacgccacaagctcctagtacagaaattcaattaactgactacggagcattaacactggactgctcaccacgaacagggctcgactttaacgagatggttttactaacaatgaaggagaagtcttggttggtccacaaacaatggtttcttgacttacctttaccttggacatcgggagcaagcacatctcaagaaacatggaatcgtcaagaccttcttgttacctttaagactgcacatgccaagaaacaagaagtcgttgtattaggatctcaagaaggtgctatgcatacagcattgacgggtgcgactgaaatacaaacttctggtacaacaacaattttcgcaggccacctaaaatgccgattaaaaatggataaactaacattaaaaggtatgagttatgtgatgtgcacaggtagttttaaactggaaaaagaagtagctgaaacacaacatggaacagttttagtacaaattaagtacgaaggaacggatgctccttgcaagataccatttagcacgcaagacgagaaaggggttacccaaaacggcaggctcataacagcaaatccaatagtgacagataaagagaaacctgtgaatatagaagcggaaccacctttcggtgagtcttacatagtaattggcgcaggcgagaaggcactaaagttatcatggttcaagaaaggctcgtccattggaaaaatgtttgaagctacagctcgtggagcacggagaatggcgatattaggagacaccgcatgggattttggatcaataggtggagtgttcacatccgtcggcaagctagttcatcaaatatttggaacagcctatggagttctctttagtggagtaagttggacaatgaaaatcgggatcggggttttattgacctggttgggacttaacagtcgatctacctcactttcaatgacctgcattgcggtgggcctagtaacgttgtatcttggagtaatggtccgagcagatagtggatgtgtcattaattggaagggtcgcgaacttaaatgcggctcaggtatcttcgttacgaacgaggtgcatacatggacggagcaatacaaattccaggcagatagcccgaagcggctaagtgctgcaataggaaaagcgtgggaagaaggagtttgcgggattagaagcgcaacgagactcgagaacataatgtggaaacaaataagtaatgaattaaaccacatcctactcgaaaatgatatgaaacttacagtggtggttggtgatgttgcaggcattttagcacaaggtaaaaagatgatacgcccgcaaccgatggaatataagtactcgtggaagtcatggggaaaagcgaagatcataggagccgacgtccaaaacaccacatttataatagatgggcccaatacacctgagtgtcctgacgatcaaagagcttggaatatctgggaagtagaagactatggattcggtatttttacaaccaatatttggctgaagttaagagattcatacactcaagtttgtgaccacaggctaatgtcagctgcaattaaagactctaaggcggtgcacgcagatatgggttactggatcgagtccgagaaaaatgaaacatggaaacttgcacgagcatcatttatcgaagtcaagacctgtatatggcctaagtcacatacactttggagcaatggcgtgttagaatctgagatgataataccaaaaatttacgggggaccaatttcacaacacaactatagacccgggtactttacccaaacagcgggaccttggcatttgggcaagttagagttagattttgatctatgtgaaggcaccacagtagttgttgacgaacattgtggaaacagaggaccttcgctgagaacaacgactgtgactggaaaaattattcacgaatggtgctgtcggagttgcaccctgcctcccttacggttcaaaggggaggatgggtgctggtatgggatggaaatccggcctgtgaaagaaaaggaagagaatctagtgaagtcgatggtaagcgcaggatccggtgaggtagacagtttcagtttaggactattatgtatatcgattatgatcgaagaagtaatgcgctctaggtggtctcgaaaaatgcttatgacagggactttagctgtcttcttcttgctaatcatgggacaattaacatggaatgatttgatcaggttatgtatcatggttggtgctaacgcctccgaccgcatgggcatgggcacgacctacttagccttaatggcaacttttaagatgagaccaatgtttgcagtggggcttctgtttaggaggttaaccagccgtgaagtactattattgaccataggactatcattagttgcatctgttgaattacctaacagtctagaagaattgggggatggtttggctatgggtattatgatcctaaaactactaacagacttccaatcccaccaattgtgggccaccctgttatcgttaacgtttataagaacgaccttttcactacactatgcatggaaaactatggccatggtcctgtcaatagtcagtttgtttccactatgtttgtcgacaacttcacagaaaacaacatggttacctgttctattgggttcacttggatgcaaacccttaactatgttcttaatagctgaaaacaaaatatggggtagaaaatcctggccccttaacgaaggcataatggccgtaggaattgtatctatcctattatcatcactacttaaaaacgatgtccccttagcaggaccactaatagccggaggaatgttgatagcatgctacgttattagcggtagttcggccgatttatccttagaaaaggccgcggtggtgtcctgggaagaggaagcagaacattcgggtgcctctcacaatatactcgttgaagttcaagatgatggtacgatgaaaattaaggatgaggagcgagacgataccttaacaatacttcttaaggcgaccttattggcagtcagcggcgtgtatcccctaagcataccagcaaccttatttgtttggtacttttggcagaaaaagaaacaacgatctggggtgttatgggacacaccatcaccaccagaagtggagcgcgcagtacttgacgatggtatttaccgaattatgcagcgcggtcttctcggtagaagtcaagtcggagtaggagtatttcaagagaatgtctttcataccatgtggcacgtaacacgtggggctgtcttgatgtaccaaggaaaacgtttagaaccaagttgggcttcagtcaaaaaggacttaatttcatacggagggggttggaggcttcagggctcctggaatacaggagaagaagttcaagtaatagcagtggagccaggcaaaaatcccaaaaatgtccaaacggctcccggaacttttaaaacgtcagaaggtgaagtaggagcaattgcacttgatttcaaaccaggaaccagtgggagccccatagtgaaccgagagggaaaaattgtaggcttatacggaaatggagtggtaacaacaagtgggacatacgtttctgcaatagctcaagctaaggcttcccaggaaggaccacttcctgaaattgaggatgaagtatttcgtaagaggaacctaacgacaatggacttgcatccaggttccggtaagacacgacgatacttaccagcaattgtcagagaagctataaagagaaaattaagaactttaattttagcaccaacacgtgtagtagcgtcagaaatggccgaagcacttaagggaatgccaattagatatcaaactacagcagttaaaagtgagcacactgggaaagaaatagtagacttgatgtgccatgctacattcacaatgagattattatcaccggtgcgagttccgaactataatatgattataatggatgaagcccactttactgatccatcgtcaatagcagcgcgcggttatataagcacgcgtgttggcatgggcgaagcagcagcgatattcatgacggctacacctcctggaagcgtagaggcttttccccagtcaaatgcagtaattcaagatgaggaaagagatattcctgaaagatcttggaactcaggatatgagtggataacagacttcccgggaaagacggtatggtttgtcccgtcaattaaatcggggaatgatatcgccaattgcttacgcaaaaatggaaaaagggtaattcaactaagtcggaagaccttcgatacagaatatcagaaaaccaaaaataacgattgggattatgtagttactacggatatcagcgaaatgggagctaattttagggcagaccgggtaatagatccaagaagatgtttaaaacctgtcatattgaaggatggtccggaaagagtaatattggcaggaccgatgccggtaactgttgctagtgcagcgcaacgacggggacgaatcggtcgaaacccgaataaagaaggagatcagtatatctatatggggcaacccttgaataatgatgaagaccatgcaccctggacagaagcaaaaatgttactggacaatattaatacgccggaagggataataccagctctttttgagccagaaagagagaaaagcgcggcgatcgatggagaatacagattaaggggcgaggccagaaaaacttttgtggaattgatgagaagaggcgatttaccagtatggctaagttacaaagtcgcctccgagggttttcagtactcagaccgaaggtggtgttttgacggagaacgcaataaccaggtactagaagaaaatatggatgttgagatctggaccaaagaaggggagaggaagaaactacgacctaggtggttagatgctagaacctattcagaccctttagccttgagagaatttaaagagttcgccgcaggacggagatcagtttcaggggacttaattttagaaataggcaagttgccacaacatcttactcaaagggcgcaaaacgcccttgacaatttagttatgttacataacagtgagcaaggtggtcgagcatacaggcatgctatggaggagctcccagatactatagaaacactcatgttgttggcattgattgctgttctaaccggtggggttactttattctttttaagtggaagggggctgggaaagacttcaattggattgctttgtgtcatggcgtcatcagttctcttatggatggcgagcgtagaaccgcattggatagccgcaagcataattttggagttctttttaatggttttgttaattcctgaacctgatcgacagaggacaccacaagataaccaactggcctacgtagtgatagggttactatttatgattttaactgttgcagcaaacgaaatgggactacttgaaactacaaagaaggatctgggtataggccatgtagcggtagagaaccatcaccatgcagcgatgttagacgttgatttgcatccggcctcagcatggaccttgtatgcagtggcaactacaataatcactccaatgatgcgacacacaatcgaaaatactacagccaatatcagcttaacagctatagctaaccaagctgcgattttaatggggctcgataagggctggcctattagtaaaatggatataggggtcccacttcttgcactcggctgttatagtcaagttaacccattaacattgacagccgcggttttaatgctcgtcgctcactacgctattattggacctggcctccaagcaaaggctaccagagaagcccaaaaacgaactgctgccggcattatgaaaaatcctacagtagatggaatagtggcaattgatctagacccagtagtatatgacgcaaaatttgaaaaacaattgggacagattatgcttctaatcctttgtactagccaaatactattgatgagaaccacatgggcattatgtgaatcaataacattggcaacggggcccctgacgactctttgggagggaagcccaggaaaattttggaatactacaatagcagtaagcatggcaaacatttttagaggctcttatctagctggtgcgggattggcctttagtttgatgaagtcgctgggtggaggaagacgaggcacaggagcccaaggcgaaactttaggtgaaaagtggaaaaggcaattaaaccaactttccaaatcagagtttaacacatacaaaaggtcaggtatcatggaagtagacaggagtgaagccaaagagggactaaaaagaggagaaactacaaagcacgcagtaagtcgagggactgctaaattgagatggttcgttgaaaggaatttagttaaaccggagggaaaggtaattgacctgggctgtggtagagggggatggtcttactactgcgccgggctaaagaaagttactgaggtcaaggggtacacaaaaggcgggccggggcacgaagaaccgatacccatggccacctatggctggaacttagtcaaactacattcaggaaaagacgtgttctttatcccacctgaaaaatgtgatactttgttatgtgatatcggcgaatcgagtcctaacccaactatagaggaagggcgcaccctacgagtattaaaaatggtagaaccatggttgcgtggtaatcaattttgcataaaaattttaaatccttacatgcctagcgtcgtagaaacactagaacagatgcaaagaaagcacggcggcatgttagtacgtaatccgttatcccgaaatagcacgcatgaaatgtattgggtatcctgcggtacaggtaacatagtatctgcagtaaacatgacaagtcgcatgctactcaatcgtttcaccatggcacatagaaaaccaacttatgagagggacgtggatctaggcgcgggcacaagacacgttgctgtagaacctgaagttgcaaatctagatatcattggacaacggatagaaaatatcaaacatgaacacaaatctacttggcattacgacgaagataatccctataagacgtgggcatatcacggaagttatgaggtcaagcctagtgggtctgctagctctatggtaaacggtgtggtcaagctacttacaaaaccctgggatgtaatacctatggttacacaaatcgccatgaccgacaccaccccttttggacaacaacgcgtctttaaagagaaagtagacacaagaacgcctaaagcgaaaagaggaacagcccagataatggaagtgacagctaagtggctgtggggatttctttcaagaaataagaaaccacgcatatgtacaagagaagagttcacacgaaaagtaagaagcaatgcagcaattggagcagttttcgtagatgaaaatcagtggaactcagctaaagaggcagtcgaagatgagcgtttctgggacttagtacatagggaacgagaactgcataaacagggtaaatgcgcgacatgtgtttacaacatgatgggaaaaagggagaagaaattaggtgaatttggcaaagctaaaggaagtagagcaatatggtatatgtggctgggtgctcgatttctcgagttcgaagcactgggcttcatgaacgaagatcattggttttcgagagaaaattcattaagtggagtagaaggagaggggctacataaactaggatatatattacgtgacatatccaaaataccaggtggcaatatgtatgcagatgataccgcgggctgggatacaagaataacggaggatgatcttcaaaatgaagcaaaaataaccgacataatggaaccagaacacgctttactcgcaaaatctattttcaaattgacatatcaaaataaagtagttagagttcaaaggccagccaaaaacggcacagtaatggacgtgatcagtaggagagatcaaagaggctctggccaagtcggaacgtatggattaaacacattcacaaacatggaagcacaattaataagacagatggagtctgaaggtatattttctcctagcgaactggaaactcctaatctcgctggaagagtactagactggctagaaaaacatggagtagagagattaaagagaatggccatttccggagatgattgtgtggtgaagccgatcgacgataggtttgctacagcactcacggctttaaatgatatgggaaaagttagaaaagatataccccaatgggaaccgtcgaaaggatggaacgattggcaacaggtaccattctgctcacatcacttccatcagttgatcatgaaagatggacgcgaaatagtggtcccttgccgtaatcaagatgagttagtaggaagggccagggtgagtcaaggagcaggatggagcttacgcgaaacggcttgccttgggaaaagctatgctcagatgtggcaattgatgtattttcacagacgagatttaaggctcgctgcaaatgccatatgttcagccgtgcccgtagattgggtacccacttctcgtacgacatggtcaatccacgctcatcatcaatggatgactaccgaagatatgcttagcgtatggaatagagtctggattgaggaaaacccttggatggaagataaaacccacatttcaagttggggagatgtcccctaccttggtaaacgagaggatcaatggtgtgggagtctgattggtttaacggcaagagcaacttgggcaaccaacatccaagtagcgataaatcaagtaagaagattattgggaaatgagaattacctcgactatatgacatcgatgaagagattcaaaaatgagagcgacccagaaggtgcactatggtaa

SEQ ID NO: 21810 - RNA, 9879 nt, synthetic construct
  misc_feature 1..9879: note = derived and/or modified CDS sequence (opt6) from DENV-1__GU131731__SS-prME
  source 1..9879: mol_type = other RNA
tcagtgactatgctactgatgctgatgcccacggctttagctttccacttgacaacaagaggaggtgaaccacatatgatagttacaaaacaagaaagaggtaaatcattgctatttaaaacttcggccggtgtaaatatgtgcacactaatagcgatggatctaggtgaactatgtgaagatacaatgacatacaagtgccccaggattacggaagcagaaccagatgatgtagactgctggtgcaacgcaaccgatacttgggtgacgtacgggacgtgctctcaaaccggagagcatagaagggataaacgctccgtggcacttgcaccgcatgtcggactaggtttggaaacacgtacagaaacgtggatgagctctgaaggcgcttggaaacaaatacaaagagttgaaacatgggcactaaggcatccaggattcactgtaatagcacttttcttagcacacgcaataggaacgtcaattacacaaaaaggaataatatttatattacttatgctggtaaccccgtcaatggctatgagatgtgtaggaataggtagccgagacttcgtggaagggttgagtggtgccacatgggttgacgtcgttttagagcatggatcttgcgtaaccacaatggcaaaggataaacctacgttggatattgaacttttaaaaaccgaagtaaccaacccagcagttctaaggaaactttgtattgaagccaaaatttctaatacaactacagattccagatgccctactcaaggtgaggctaccctcatggaagaacaagatgcaaacttcgtatgtagacgaacattcgtagacagaggatggggaaatggatgtggattatttggtaaagggtcgttaataacgtgcgccaaatttaagtgcgtaacaaaattagaaggaaaaattgtacagtacgaaaacctgaaatactctgtgattgtgactgtgcacaccggagatcaacatcaagtaggaaatgaatccacagaacacggaacgactgccactatcactccacaggctcccacttcagaaatacaactcacagattatggcgcattaacactggattgcagcccaagaactggcctggactttaatgaaatggtacttttgaccatgaaagagaaatcttggttagttcacaaacagtggttcttagatctgccccttccctggacatcaggtgcatctacttcacaagaaacatggaataggcaagatctattggtgacctttaagacagcccatgctaaaaagcaagaggtagtagtgttaggtagccaggaaggagccatgcacacagcattaacaggcgcaacagagatacaaactagcggaacgacgacgattttcgccggacatcttaaatgcagactaaaaatggataaactgactttaaaaggcatgtcttacgtaatgtgtactggcagctttaaactagaaaaagaagtcgcagagacacaacacgggacggtcctagtgcaaataaaatacgaggggacagatgcaccgtgcaaaataccgttttcaactcaagatgaaaagggggttacccaaaacggaagattgattacagcgaacccaatcgtgacagataaagagaagcccgtgaatatagaagcagaaccaccatttggagaatcatatatagttattggtgctggtgaaaaagccttaaaactttcttggttcaagaaaggctcatccataggtaaaatgtttgaagcgacggcaagaggggccagaagaatggcaatcctaggcgatacagcctgggactttgggtcagtaggaggtgtgttcacaagcgttggaaaattagttcatcagatatttggaacagcatatggggtgctcttttctggagtttcctggacaatgaaaatcggcataggcgttctattaacctggctcggacttaatagtcggagcacaagtttaagcatgacttgtattgcagtagggttagttacactatatcttggggttatggtacaagcagactctgggtgcgtaataaactggaaaggtagagaattaaagtgtggatctggtatatttgtaactaacgaagtacatacatggacggaacaatataaatttcaggcagacagtccgaaaagattatctgccgctataggaaaggcttgggaagaaggtgtatgtggaatccggtcagccacacgattagaaaacattatgtggaaacagataagcaatgaactaaaccacatattgttggaaaatgatatgaaatttacagtagtggtaggagatgtggttggcattcttgcacagggcaagaaaatgatcaggccacaacccatggaacataagtactcttggaaaagctggggcaaagctaaaataataggcgctgatgtgcaaaatacaactttcataatagatggaccaaacacacctgaatgtccagatgaccagagagcgtggaatatctgggaagtagaagattacggcttcgggatattcaccaccaatatatggttgaaactacgagattcatacacacaagtgtgtgaccatagacttatgtccgcggcaataaaagactccaaagcagtccatgcggatatgggatattggatagaatcggagaaaaacgaaacatggaagctagcaagggcatcttttattgaagttaagacatgcatatggcctaaaagccatacattatggtcaaatggagttctcgaatcggagatgataattcctaaaatttacggaggccctatatcacaacataactatagacctggttatttcactcagacagccggcccatggcatctaggcaaactagaacttgatttcgacttgtgtgaagggacgacagttgtagtagacgaacactgtggaaatagaggtccaagtctgaggacaacaacagttacgggtaaaattatacacgaatggtgttgtagaagttgtactttaccgcctttacgctttaaaggggaagacggatgctggtatggcatggaaatacgccctgttaaagaaaaagaagaaaatctagtgaaatccatggtaagtgccggatctggagaagttgattctttcagcttgggccttttatgtatatcaataatgatcgaagaggtgatgagaagtagatggtctagaaaaatgttaatgacaggcactcttgcagtatttcttttattaataatgggtcaactgacctggaacgatctcatacgactgtgcattatggttggtgcaaatgcctcagaccggatgggcatgggaactacatatctagcgttaatggcaacctttaaaatgcgaccaatgtttgctgtcggtcttttatttagaagactaacctcaagagaagtattgttactaacaataggactttctcttgttgcctccgtagaacttccaaatagcttagaagagttaggtgacggtcttgccatgggaattatgatattgaagctactcacggactttcaatcacatcaattgtgggcaacattattgtcattaacgttcattaaaaccactctatcattgcactacgcatggaaaactatggccatggtactatcaatagttagtttgtttccattgtgcctttctacaacttctcagaaaacaacatggctgccggttctattagggtcacttggatgtaaacccctgactatgtttttaattacagaaaacaagatatggggcaggaaaagttggccgctgaacgaaggaataatggcagttggagttgtgagtattctactttcatcactcctcaaaaacgacgttcctctggctggtcccttgattgcaggaggtatgttgatagcatgctatgtcataagcggaagcagtgccgatctttcgctagaaaaggcagcagaagtaagttgggaggaagaagcagagcatagtggagcttctcataatatcctcgtggaggtccaagacgacggcactatgaagataaaagacgaagaaagagacgacacactaactattttattaaaagccaccctattggctgtgagtggggtttatcctttatctattccagccaccttattcgtgtggtacttctggcagaagaaaaagcaacgatccggagttttatgggacacacccagtccaccagaagtagaaagggcagttttagatgatgggatatacaggataatgcaaagaggattgttgggacgatcacaagtcggcgttggagtatttcaggaaaacgtattccacacaatgtggcacgtgacaagaggagctgtcctgatgtatcaaggaaaacgtttagaaccctcatgggcgtcagtaaagaaagatcttataagctatggaggcggatggaggctacaagggtcatggaataccggcgaagaagtacaagtaattgcagtagaaccaggcaaaaatccaaagaatgtgcagacggcccccggcactttcaaaacgccagaaggagaagtaggtgctattgcgttggactttaaacccggtacaagcggaagcccaatagtcaacagagaaggcaagattgtaggattatatggtaatggtgtagttacaacgtcaggaacgtatgtgtcggccatagctcaggctaaggcaagtcaagaaggtccattgccagaaattgaggatgaggtttttcgtaagcgaaacctcactattatggatttacatcctggaagtggtaagacaaggcggtaccttcctgccattgtaagagaagctatcaaacgtaaactacgaacgttaatattagctccgacccgtgtcgtggcgtccgaaatggcggaagccctcaaaggaatgccaatacgttaccaaaccacggccgtcaaatctgaacataccggtaaagaaatagtcgacctcatgtgccacgctacatttacaatgcgtttgctatcccccgtacgagtgccgaattacaatatgattataatggatgaggcgcattttaccgacccgtcttcaattgcagctagaggatatatatcgacaagggtcggaatgggagaggccgccgcgatattcatgacagccacaccaccaggtagtgtcgaagcattcccacagtcgaacgctgtaatccaagacgaggaacgagatatccccgaacgatcgtggaactccgggtacgagtggataaccgactttccgggcaaaacagtgtggttcgtaccatccataaaatcagggaatgacatagcgaattgtcttaggaagaatgggaaaagagttatccagttgagcagaaaaacctttgatactgaatatcagaaaaccaaaaataatgattgggactatgtcgtcacgacagacatatcagaaatgggggctaatttccgtgctgatagagttatagatccccgacgttgtctaaaacccgtgatcctgaaagatggaccagagagggtaatcctggcagggccaatgccagtaactgttgcatctgcagcccagcgccgaggtagaatcggacgcacgcataacaaagaaggtgatcagtacatctcaatgggtcaaccactcaacaccgcagaagaccacgcaccatggacggaggccaaaatgttactcgataatataaatacaccagaaggaattattcccgcacttttcgaaccagagagggaaaaatctgcggctatcgacggggaataccggctacgtggggaagctaggaaaacatttgttgaactgatgcggagaggtgaccttccggtatggctgtcatacaaagtagcatcggagggattccaatacagcgatcgaaggtggtgctttgacggagaacgcaacaatcaggttttagaagaaaacatggacgtggaaatttggacaaaagaaggagagaggaagaaattacgtccacgctggcttgatgcacgaacatactcagaccccctcgcattacgggaatttaaagagttcgccgcagggcgaagaagtgtaagtggggatttaatcttagaaatcggaaaattaccccaacacctgacacagagagcacaaaatgcgttagataaccttgttatgttacataattcggaacagggaggccgagcttatcgtcatgctatggaggaactaccggacacaatcgaaacactcatgctacttgcacttattgccgttctcaccggcggtgtcactctattcttcttgagtgggcgaggacttggtaagacttcaatcggactgttatgcgtaatggctagttcagtacttttatggatggcatccgtagagcctcattggattgcagcatccataatcttggagttcttccttatggtgttattaatacctgaacccgacagacaaagaacaccgcaagacaaccaactagcgtacgtagtcataggattattattcatgattcttacagtagctgccaatgagatgggcttactcgaaacaactaagaaagatctgggcataggacatgtcgctgtagaaaaccaccatcacgccaccatgctagacgtcgatttacatccagctagtgcgtggactttatacgcagtagcgacaactataataacccctatgatgcgacataccatcgagaataccacagcgaatattagccttacggctatagcaaatcaagcagcaatactaatgggtctagacaaaggctggcccatatcaaaaatggatattggtgtaccactactggcattgggatgttatagtcaggttaatccattaacccttactgccgctgtattaatgctggtcgcgcattatgcgataatcggccctgggttacaagcgaaagctactcgcgaagctcagaaaagaacagccgctggcataatgaaaaatcctacagttgacggaatcgtcgcaattgacctagaccccgttgtatatgacgccaagtttgaaaaacaactaggccaaattatgcttctaatactttgtacatcacaaatattacttatgaggactacctgggcattatgtgagagcattacgttagccacgggtcctttgacgactttatgggaaggaagcccaggaaaattctggaatactacaatcgctgtgagtatggcaaatatcttcagaggatcctaccttgctggagctgggttagctttttctctaatgaagtcactaggaggtggacgtagaggaactggtgcgcagggcgaaactttaggtgaaaagtggaagcgccaattaaatcaactatccaaaagtgagtttaacatctacaagcggtctgggattatggaggttgatcgcagtgaagcaaaagaaggattgaaacgaggagagacaacaagacacgctgtctcacgaggaactgctaaattgaggtggtttgtcgaacgtaatctcgtaaaaccagaagggaaagtaatagatttaggctgtgggagaggcgggtggagctactactgtgccggattgaaaaaggtaactgaggtaaaagggtacaccaaaggtggacccgggcacgaagatccaatacccatggcaacgtacggttggaacctagtgaaacttcattcaggtaaggatgtatttttcacccctcctgaaaaatgtgacaccctcctctgtgacataggagaatcatctccgaacccgacaatagaagagggacgtactttaagagtgctcaagatggtagagccatggttacgtggaaatcaattttgcataaaaatcttaaacccatatatgcctagtgtagttgagacgctggaacaaatgcaaaggaaacacggtggtatgctagtaaggaatcccctatcgcgtaattcaactcatgaaatgtattgggtgagttgcggaacgggcaacatcgtgtctgcagtaaatatgacatcccgcatgctactaaatagatttacaatggcccaccgaaaaccgacgtatgaacgtgatgtagacctaggtgctgggactaggcatgtcgccgttgaacctgaggtcgcaaatctggatataatcggccaaagaatagaaaacattaaacacgaacacaaatccacatggcattacgatgaagacaatccctacaaaacatgggcctaccacggaagttacgaagtaaaacccagcggcagtgcgagtagcatggttaacggtgtagtaaaattattaacgaagccatgggatgtgatcccaatggtgacgcagatagctatgactgatacgacaccgtttggtcaacagcgcgtattcaaagagaaagttgatacgagaacaccaaaagcaaaaagaggaacagctcaaatcatggaggtgaccgccagatggttatggggttttctctcaaggaacaagaaaccgcgtatatgtactcgagaagagtttacgaggaaagtgcgctcaaacgcagccataggtgcagtatttgtagacgagaaccaatggaactcagctaaagaagctgttgaggacgagaggttctgggatcttgtacagaaagaaagagaattgcacaaacaaggaaaatgtgcgacctgtgtttataatatgatgggaaaaagagagaagaaattaggtgaatttgggaaagcgaaaggatccagagccatatggtatatgtggttaggggcaagatttttggagtttgaggccttaggatttatgaatgaagatcactggttcagccgggagaacagtttgtcaggagtagagggtgaaggtttacacaaacttggatatatcttgagagacatttctaaaattccaggcggaaacatgtatgcagatgacacagcgggttgggatacaaggataacagaggacgacttgcaaaatgaggcaaagatcacagatattatggaaccggaacacgctctattagcaacatctatcttcaaactaacttatcaaaacaaagtagtgagagtccaaagacctgctaaaaacggtacagtcatggatgtaatatctagaagagatcaacgcggctctgggcaagtaggtacttatggtctaaatacgttcactaatatggaggctcaacttattagacaaatggagagtgagggtatattccttccaagcgaattggaaaccccgaacttagccgagagagtactcgactggttagaaaaatacggggtagaaagactgaaaagaatggcaatctcgggcgatgattgtgtcgttaagccaattgatgacagatttgctacagcgctcacagcacttaatgatatgggtaaagtaagaaaagacattccccaatgggaaccgagtaaaggctggaatgattggcaacaagttcctttttgtagccaccactttcaccaattaataatgaaggacggtcgagaaatagtagtaccgtgcagaaaccaggacgaattagttgggcgtgctcgggttagccaaggagcgggttggagtttgcgtgagactgcatgtttgggaaagagttatgctcagatgtggcaattaatgtactttcatcgaagggatttaaggcttgctgccaacgctatatgcagtgcagttcctgtagattgggtaccgaccagcagaaccacctggagcatacacgcacaccatcaatggatgaccactgaagacatgctatcagtatggaaccgagtgtggatcgaagaaaatccatggatggaagataaaacacacgtaagttcttggggtgatgtcccgtacttgggcaagcgcgaagatcaatggtgtgggtcgttaataggacttacagccagagcaacctgggcctcaaatatacaagtagccatcaaccaggtccggagactcataggaaatgaaaattatctagattatatgacaagtatgaaacggtttaaaaatgagggggacccagaaggagcgttatggtaa

SEQ ID NO: 21811 - RNA, 9879 nt, synthetic construct
  misc_feature 1..9879: note = derived and/or modified CDS sequence (opt6) from DENV-1__GU131733__SS-prME
  source 1..9879: mol_type = other RNA
tctgttacaatgtttctaatgcttatgccaactgcacttgcatttcacctaactacgagaggaggagaacctcacatgatagtaagcaaacaagaacgagggaaatctttgctatttaaaacaagcgcaggagttaatatgtgtacgcttatagctatggatttgggagaattatgtgaagatacaatgacttacaaatgtccaagaatcacagaaacagaaccagatgatgtagactgttggtgtaacgcaacagatacatgggttacttatggcacatgctctcaaacaggagaacacagacgcgacaaacgaagcgttgcgttggcaccacatgtagggttaggcctagaaacgagaactgaaacatggatgtcgagtgaaggggcgtggaaacaaatacaaagggtcgaaacgtgggccttgaggcatccaggattcacggtcatcgcgttattcttggcacacgctatagggacatccattacacaaaaaggaatcatatttatactactaatgttggttaccccgtctatggctatgcgttgcgtcggaataggatctcgggatttcgtcgaagggctttcaggcgcaacatgggtagacgtagtactcgaacatggttcatgtgtcaccactatggcaaaagataaaccaacgttggatatagaactgttaaagaccgaagtaactaatccggcagttcttagaaaactgtgtatagaggccaaaataagcaatactactacagattcaagatgcccaactcaaggggaagcgaccctagttgaggaacaagacgctaattttgtgtgtagacgtacttttgttgaccgaggctggggaaatggttgtggactatttggaaagggatccttaattacgtgtgccaagtttaaatgcgttactaaattagaaggcaaaatagtgcaatacgaaaaccttaaatattctgttatagtaactgtgcacaccggcgatcaacatcaagtcggaaacgagagcaccgaacatgggaccaccgccactattacaccacaggcgccaactacagagatccaattaacagattatggtgccttaacgcttgattgttctccacgaacggggttagattttaatgaaatggttctactaacgatgaaggagaaaagttggttagttcataagcaatggtttctagatttaccattaccatggacaagtggtgcaagtacaagtcaggaaacgtggaatcgtcaagatctgctggttacatttaaaacagcccacgctaaaaagcaagaagttgtagttttaggcagtcaagagggagcaatgcatacagctctaaccggcgctactgaaatccagaccagcggaacaaccaccattttcgcgggtcacttgaaatgtaggttaaagatggataaattaactcttaaaggaatgtcatatgtaatgtgcacgggttcattcaaactagaaaaagagttagccgagacacagcacggtactgtgttagtgcaaatcaaatacgaaggcacggatgcgccatgtaaaattccattttcgacccaagatgaaaagggtgttacacaaaatggtcggttaattacagctaaccctattgttacagataaagagaaacccgtaaacatagaagcagaaccaccattcggtgaatcttacatagtaataggcgctggagaaaaggctttaaaattatcttggttcaagaaaggatcctccatcgggaaaatgttcgaagccacagcccgaggagcccgacggatggcaatacttggggacaccgcatgggatttcggcagcattggcggagtctttacaagtgttggaaagctagtacatcaaattttcgggaccgcgtatggagtactttttagcggagttagctggacgatgaaaataggaattggagttttacttacatggcttgggttgaatagcaggtctacctcactcagtatgacatgtattgcagtaggtttagtgacattatatctaggagtaatggttcaagctgatagcggatgcgtcataaattggaaagggagagaattaaagtgcggatcagggatattcgtaacaaacgaggttcacacatggacagaacaatacaagtttcaagcggactctccgaaaagattgtccgcagcaatcggtaaagcatgggaagagggtgtttgtggcattagatctgcaacacgtttagaaaacattatgtggaaacaaatcagtaatgagttaaatcacatattactagaaaatgacatgaaatttacagtagtagtaggagacgttgcgggaatcttagcccaaggaaagaaaatgattcgacctcagcccatggaatacaaatactcttggaagtcgtggggaaaagctaagattataggtgccgatgtgcaaaacacgacatttatcatagatggccctaatacaccagaatgccccgatgaccaaagggcatggaatatatgggaagtagaagactatggattcggaatatttaccactaatatatggcttaaacttagagatagttatactcaagtttgcgatcataggcttatgtcagccgcgattaaagatagtaaagcagtgcatgcggacatgggttattggattgaaagcgagaaaaatgaaacttggaaactagcacgagccagctttatcgaagtcaaaacatgcatttggcctaaatcccataccctgtggtctaatggcgtgctggaaagtgagatgataatcccaaaaatctacggtggaccaatatctcaacacaactacagaccaggatacttcacgcaaacagcggggccatggcacctaggtaagttagagttagatttcgatttgtgcgaaggtactactgttgttgtagacgagcactgtggcaatcgaggacccagtctgaggaccacaacggtcaccggaaaaataatacatgaatggtgttgccgatcatgcactttgccaccattacgttttcgaggagaagacgggtgttggtacggaatggaaataaggcctgtaaaagagaaagaagaaaatttagtcaaaagtatggtgtccgcgggatcgggagaagttgactcctttagcttaggactattatgcatatctataatgatagaagaagtaatgaggtcaagatggtccaggaaaatgctaatgacgggaacacttgcagtattctttctactaataatgggtcaactcacttggaatgatttgatccggctttgtataatggtaggtgccaatgcaagtgacaggatgggcatgggcactacttacctggctcttatggctacattcaagatgcgccctatgttcgcggtaggattactatttagacgtctcacatcaagggaagtattacttcttacgataggactttctcttgtagcatctgtagaactacctaactcgctagaagaactcggtgatggtttagctatgggaattatgatcttaaaactcttaacagactttcaatcacaccagttatgggcaactctactctccctgactttcatcaagactacctttagtcttcattacgcatggaaaacaatggcgatggtactgagtattgtgagtttattccctctatgcctgagtacaaccagtcagaaaactacgtggttaccagtacttcttggatcattaggctgcaaaccgttaacgatgtttttaattgcagaaaataaaatatggggcagaagatcttggccacttaatgaaggtataatggcagttggtatagtgtccatattgttatcttctctgctcaaaaacgatgttccccttgccggtcctttaatagccggtggtatgttgattgcctgttatgtaatctcaggtagttcagctgatttgtctttagagaaagctgctgaagtatcatgggaagaagaagcagaacacagcggcgcctcgcataatattctggtggaagtacaagatgacggcactatgaaaattaaagatgaggaaagagacgatacactgacaattctacttaaagctaccctcttagcggtatcaggagtttatccattgagcattcccgcaacattattcgtttggtacttttggcagaaaaagaaacaacgctctggcgttttatgggatacgccttcacctccagaagttgagcgagcagttttggatgatggtatttatagaataatgcaacgaggattgttaggtcgaagccaagtaggcgtcggagtctttcaggaaaatgtctttcataccatgtggcacgtaacaagaggggcggtgctcatgtaccaggggaaaagactcgaaccaagttgggcctcagtgaaaaaggacctaatttcttacggtggcggatggagactgcagggaagttggaatacaggcgaggaagtacaggtgattgcagttgaacctggtaaaaatcccaaaaatgtacagacagcaccagggacatttaagactcccgagggagaggtgggcgctattgcattagatttcaaaccgggaacgagcggtagtccaatagtgaatagggaggggaaaatcgttggactttatggaaacggcgtagtgaccacttcgggaacatatgtgtcggcaatagcccaagctagggccagccaagagggacctcttcctgaaatcgaagacgaagttttcagaaaaaggaaccttacaataatggatcttcacccgggttctggaaaaacccgaagatacttaccggcaattgtaagagaagcaattaagagaaaactccgtacactaatcctcgctcctacacgagtagtagcctcagagatggctgaagctcttaagggaatgcctataaggtatcaaacaacagctgtaaaaagcgaacacaccgggaaggaaatagtcgacctgatgtgtcatgctacgtttacaatgagattgctaagcccagttcgagtaccgaattataacatgataataatggacgaggcccatttcacagatccaagcagcatagcagccagaggctacatttcaacgagggtaggaatgggagaagcagccgcaatcttcatgactgccaccccgccagggtccgtggaggcgttccctcaatcaaacgccgtaatccaggacgaagaacgggatatacccgaaagatcctggaatagtggttacgaatggattacggacttccccgggaagacagtgtggtttgtaccaagtataaaatcgggaaacgatatagcaaattgtctccgtaagaatggaaaacgagtaatacaattgtcaaggaaaacgttcgatacagagtaccagaaaactaagaataacgattgggactatgtggtaacgacagatataagcgaaatgggagcaaattttagggcagatagggtcattgacccacgacggtgtttaaaaccagtcatcctgaaggacggaccagagagagttatcctggctggtccaatgcccgtgacggtagcctcagcagcgcaacgcagaggaaggattggaagaaatcataacaaagaaggagaccaatatatatacatgggtcaaccgttgaataacgatgaagatcatgcacattggacagaagcaaaaatgctgttagataacataaatacgccagaaggcattatacctgcactttttgaaccggaaagagagaaaagtgcagcaattgatggggaatacagattacgtggcgaagcacggaaaacgttcgtagaactaatgcgcagaggggatttaccagtttggttgagttacaaagtggcctcggaagggttccaatactcagatagacgatggtgctttgatggtgaaaggaataaccaagtattagaagaaaacatggacgttgagatatggactaaagaaggggagaggaagaaacttcgcccaaggtggctagatgcgagaacatattcggacccactcgctctgagggagtttaaagaatttgcggcaggtaggagaagtgtgtcaggagatctcattcttgaaataggtaaactaccgcaacatctcacacaaagggcacaaaatgcactagataatttagtgatgcttcataactcggaacagggtgggagagcttaccgacacgctatggaagaactacctgatactattgaaactctgatgttattggccctaatagcagtattaaccgggggcgtaacactattctttctttcaggacgaggactgggtaagacgagcataggattattatgcgtcatggcaagctcagtgcttctatggatggcatctgtagagccacattggatagctgcatcgatcatactcgaatttttcctaatggtactcctaatccccgagccggacagacaaagaacaccccaggataatcagctagcatacgttgtaatagggcttctgttcatgatattaaccgttgcagcaaatgaaatgggcttgttagaaacgaccaagaaagatctgggtataggtcatgttgctgtagaaaatcatcatcatgctgccatgttagacgtagacttacaccccgctagtgcatggacattatatgcggtagcgactactataattacgccaatgatgaggcacacaatcgaaaatacgactgcaaacattagtctaacagccattgccaaccaggccgccatcttaatggggttggataagggatggccaatttctaagatggatattggcgtaccattacttgcgttgggatgttatagtcaagtaaatccccttacattgacggctgccgttctcatgttagtagctcattatgcaatcattgggcccggactacaagctaaagctacaagagaagcacagaaaagaaccgcggcagggatcatgaagaatcctactgtagacgggattgtcgcgatagatttggaccctgtagtatacgacgcaaaatttgaaaaacaacttgggcaaattatgttactaattctttgtactagccaaattttgttaatgcggacaacatgggcactatgtgaaagtatcaccttggcaacaggtccattaacaactttatgggagggatctccaggaaagttttggaacacaacaattgccgttagcatggctaatattttcagaggatcgtacctagccggtgcagggctagcgtttagtttaatgaagtctctaggaggtggtcgacgtgggactggggcacaaggagagaccttaggcgaaaagtggaagagacagctaaatcaactaagtaagtcggagttcaacacatataaaaggagcggaattatggaggtcgatcgaagcgaagcaaaagaaggattgaaaagaggagaaactacaaaacacgctgtaagtagaggaacggctaaattacggtggtttgttgaacggaacctagttaaaccggaggggaaagtaatagatttagggtgtggacgtggtggttggagttactattgtgcggggcttaagaaagtaacggaagttaaaggatatacaaaaggaggtcccggacatgaggaacccataccaatggctacttatggatggaacctggtcaaattacattcaggaaaagacgtcttctttataccaccggaaaagtgcgatacattactatgtgatattggagagtcgagtccgaacccaactatagaagaggggaggactttacgggttctcaaaatggtcgaaccctggttacgcggcaatcaattttgtattaaaattttaaatccgtacatgccttcagtcgtagaaacactcgaacagatgcagcgcaaacacggcggaatgcttgtcagaaaccctctctcccgaaactcaacacatgaaatgtactgggtatcttgtggtactggaaatatcgttagtgcggtaaacatgacatcaagaatgcttctcaaccgtttcactatggcacacagaaaaccaacatatgaaagagatgtggatttaggtgccggaacaagacacgtggccgtagaacccgaggtagcgaatatcgatatcataggacagagaatagaaaatataaaacacgaacataaatcgacatggcattatgacgaggacaacccatacaaaacgtgggcctaccatggttcatacgaagtaaagccttccggatccgcctcatctatggttaacggagtagtaaaactattaacaaaaccatgggatgtcataccaatggtaactcaaatcgcaatgactgacacgacaccatttggtcaacaacgagtttttaaagaaaaagtcgataccagaacaccaaaggctaaaagaggaactgctcagattatggaagtgactgccaaatggctatggggatttttgagccgtaacaagaaaccccgcatttgtactagggaagaatttacacgaaaagtaagatctaatgccgcaataggtgctgtatttgttgacgaaaatcagtggaactcggctaaagaagcagttgaagatgaaagattctgggatttagtacatcgagagagggagctccacaagcagggtaagtgcgctacatgcgtatataatatgatggggaaaagagagaagaaactgggtgaatttggtaaagcaaaagggtcgcgggcaatatggtacatgtggcttggtgctagatttttagagttcgaagcccttggatttatgaatgaggaccactggttctccagagaaaacagcttgtctggcgtagaaggagaaggattacataaactaggatatatacttcgagatataagcaagatcccaggagggaatatgtacgccgatgatactgctggatgggacacacgcataacagaagacgatctacaaaatgaagctaggatcacggatattatggaacccgaacatgcacttctcgcgaaatccatttttaaacttacttaccaaaataaagtagtaagagtccaaagacccgcgaagaatggtacagtaatggatgtgataagtagaagagaccaacgaggtagtggtcaggtcggaacgtacggtttaaatacgtttaccaacatggaagcacaactcatccgacaaatggagtcagagggaatttttagcccgtcagagttagaaacgccaaacctcgcagaaagggtcttagactggcttgaaaaatacggagttgagcgattaaagcgaatggcaattagcggcgacgactgtgttgtaaaaccaatcgacgacaggtttgcaactgccctcactgcattaaacgacatgggtaaagtaaggaaagatattccgcaatgggagccttcaaaagggtggaatgattggcagcaggtaccattctgtagccaccattttcatcaattaatcatgaaagatggacgagaaatcgtagttccgtgtagaaatcaggacgaattagtaggcagggcaagagtgtcacaaggtgcaggatggtccttacgtgaaacagcgtgtttgggcaaaagctatgcccaaatgtggcaacttatgtattttcataggagagacctgcgacttgcggccaatgcaatatgcagcgccgtgccagttgactggattccaacgtcacgaacgacctggtcaattcatgcacaccatcaatggatgaccacagaagacatgctatctgtatggaatagagtatggatcgaagaaaacccatggatggaagataaaacacacatatcgtcttggggtgacgtaccctatctaggtaaaagagaagatcagtggtgcggctctttaatcggtctaacggcgagagcgacatgggctacgaatatacaagtagccatcaaccaggtaagaagactgattggaaatgagaattacttagactacatgacaagtatgaaaaggttcaagaacgagtcggatccagaaggagcactatggtag

SEQ ID NO: 21812 - RNA, 9879 nt, synthetic construct
  misc_feature 1..9879: note = derived and/or modified CDS sequence (opt6) from DENV-1__GU131734__SS-prME
  source 1..9879: mol_type = other RNA
agcgtaacaatgctactaatgctaatgccaacagcactagcctttcacttgaccacaagagggggagaaccacatatgatcgttagtaaacaggaacggggtaaatctctactattcaaaacgtcagcaggagttaatatgtgtacattgatagccatggacttaggagagttctgtgaagatactatgacgtacaaatgcccaaggattactgaagcagaacctgacgacgttgattgttggtgcaatgccacagatacatgggttacatatgggacatgcagtcagacaggcgaacatagaagagacaaaagaagcgtagctttagctccccatgttggactgggcttggaaacacggaccgaaacatggatgtcatccgaaggtgcttggaaacaaatacaacgagtcgaaacctgggccttacgtcatccaggcttcaccgttattgccctgtttctagcacatgccataggaacatcaattactcagaaaggcatcatatttattttattaatgctagtaacaccatcaatggctatgcgatgcgtgggaatagggtccagagactttgttgaaggattgtctggtgcaacctgggtcgatgtggtgcttgaacatggatcgtgcgtaaccactatggcaaaagataaaccgacacttgatatagaactactaaaaacagaagttactgacccggcggtcctcaggaaattatgcatagaagcgaaaataagtaatacgacaactgattcacgttgtccgacacaaggagaagctactctagtcgaagaacaagatgcgaatttcgtttgcagacgcacattcgtggatagaggttgggggaatggttgtggcttatttggcaaaggatctctcatgacatgtgcgaaatttaaatgcgtcactaaactggaaggcaaaattgttcagtacgaaaatcttaaatatagcgtcatagtaactgtccatacaggagatcaacatcaagtaggtaacgaatccaccgaacacggaactacagccacaatcacaccacaagcacctagtaccgaaatacaattaacagactatggggctctaacgcttgattgctcacctcgcacgggattggattttaacgaaatggtactactaactatgaaagaaaaatcttggctagttcataaacaatggtttttagacctaccattaccgtggacttcaggtgctagtactagccaggaaacgtggaatcgtaaagatttattggtaacatttaaaacagcacatgccaagaaacaggaagtggtagtattaggtagccaggaaggcgcaatgcatacagcattgacgggtgcaaccgaaatccaaacaagtggaactacaacgatttttgccggccaccttaaatgtagactaaaaatggataaattaaccttgaaaggaatgtcatatgttatgtgcacagactcatttaaactcgaaaaagaagtagcagaaacccaacatggaacggttctggtacagataaaatatgaagggactgatgcaccatgtaaaattccattctctacacaagacgaaaaaggtgttacacaaaatggcaggcttattacggcaaacccaattgttacagacaaagaaaaaccagtcaatatagaagctgaaccgccatttggagaatcctacatagttattggagccggagagaaagcgctcaaattatcatggttcaagaaaggaagctcgataggcaagatgttcgaggccacggcacgtggtgcaaggagaatggcaatattaggggacactgcctgggattttggcagcataggtggtgtattcacaagcgttggaaagctagtacaccaaatattcggaacagcatacggtgtactatttagcggcgtctcttggacaatgaaaataggaatcggtgttttattaacatggctagggctaaacagtcgtagcacgtcccttagcatgacatgcatagcagtaggtttagtaaccctctatttgggagtaatggttcaggccgactcaggatgtgtaattaattggaaagggagagaattgaaatgtggatctggaatttttgttaccaatgaagtgcacacttggacagaacaatataaatttcaagcggattcaccaaaaagattgtcagctgctataggaaaagcatgggaagaaggagtgtgtggcataagatcggcaacaagacttgagaatataatgtggaaacaaatctcaaacgagttaaatcacatactgttagaaaacgacatgaaattcactgtagtagtcggcgatgtcgccgggattctagcacaaggcaagaaaatgattcggccccaaccgatggaatataaatactcatggaaaagttggggaaaagccaagatcatcggcgcagacgtgcagaacacaacttttataattgatggtccaaacaccccagaatgtccggacgatcaaagagcctggaacatttgggaggtagaagactacggttttggtatttttacgaccaacatctggttgaaattaagagactcatacacgcaagtttgtgatcatagattgatgagtgcagctataaaagattccaaagcggtgcatgctgacatgggatactggatagaatcagagaaaaatgaaacgtggaaattggctagagccagttttattgaagtaaaaacatgtatttggcctaagtctcataccttatggtccaatggggtccttgaaagtgaaatgataattccaaagatctatggcggaccaatctcacaacacaattatcgcccgggctactttacccaaactgcaggtccctggcatttaggtaaactagaactcgatttcgatttatgtgaaggcaccaccgtcgtggtagacgagcattgcggaaaccgtggaccgtcgctgagaacaacaactgttacagggaaaatcatacatgaatggtgctgtagatcatgcaccttacctccgttacgattcaaaggagaagacgggtgctggtatggcatggagattcgccctgtgaaagagaaggaagaaaacctggtaaaaagtatggtatcagcaggaagtggagaagttgattccttctcgcttggtctattatgtatttctattatgatagaagaagtcatgcgaagtcgctggagcaggaaaatgcttatgacgggcaccctagcggttttcttcttattgataatgggccaactaacatggaacgatctaatacgtctatgtataatggtaggagcaaacgcatcagaccgaatgggaatgggaaccacttatcttgcactcatggctacatttaaaatgagaccaatgtttgcagtgggactcctattccgtaggctgacctcaagggaagttttgttacttacaataggactttccttagtagccagtgtagagctacctaactctttagaagagttgggtgacggattagccatgggcatcatgatattaaaactgctaatagattttcagtcacatcaactctgggcaacattattgagcctcacatttattaaaacaacattttccctacattacgcctggaaaacgatggcgatggttctcagcatagtatccctatttcccttatgtctaagcactacctcccaaaagacgacttggctacccgtacttctgggttcactaggctgtaagcctctaacaatgttcctaattgcagaaaacaaaatctggggcagaaaatcatggccgctaaatgaggggatcatggctgtcggtatagtttcaattttactatcagccttactgaagaacgatgttccattagctggacctctaatagcagggggtatgttaattgcctgttacgtaatatccggtagtagcgctgacctaagtttagagaaagctgctgaggtcagctgggaagaagaggcagaacactctggcgcttctcacaatatattagtcgaagttcaagatgatggaacaatgaaaatcaaagatgaggaacgcgacgatacattaaccattcttttaaaagcaacacttctagcagttagtggtgtgtacccgttatcaataccagcgacactatttgtctggtacttttggcagaagaagaaacaacgttccggtgtcctatgggatactccaagtcctccggaagtagagagagccgtcttagacgacggtatatataggattatgcaaagaggattattgggtagatcacaagttggcgtaggagtttttcaagaaaacgtatttcatacaatgtggcatgttacaagaggagcagttttaatgtatcagggtaaacgccttgagcctagctgggcttcggttaagaaggaccttatttcatacggagggggctggagactgcaaggatcgtggaacacaggagaggaagttcaggttatagctgtcgagccaggtaagaaccccaaaaatgttcaaacagcacccggaacctttaaaacatcagagggtgaagttggtgctatcgcgttggattttaaacccggaacatctggtagccctatcgtaaacagagaaggcaaaattgttgggctctacggaaatggggtcgtgacaacaagcgggacttatgttagtgcaatagcacaagcaaaagcatcacaagaaggtcccctaccagagattgaagatgaggtgtttcgaaaacgaaatttaaccatcatggacttacatcctggatcgggtaaaacccgacgttatcttcccgctattgtacgggaggctatcaagcgcaaactacgaacgctgatattggctccaaccagagttgtcgcgtcggaaatggccgaagccttaaaaggaatgcctataagatatcaaacaaccgccgtcaaaagcgaacataccggaaaagagatagtcgatttgatgtgccacgcgactttcacaatgcgattactctcaccggttcgagttccaaattataatatgataataatggatgaggcccactttacagacccatcatccatcgcagctcgcggctacatatcaacgagagtcggaatgggggaggcggctgcgatattcatgactgccacaccacccggctcagtcgaagcatttccgcaaagcaacgctgtaatacaagatgaggaaagagatataccagagagatcgtggaactcgggctacgaatggattaccgatttccccggaaagacggtatggtttgtaccatcaataaaaagtggaaatgatatcgcaaactgcctaaggaaaaatggaaaaagagtaattcaactgtcacgaaaaacattcgacactgaatatcagaaaaccaaaaataatgattgggattatgtagtaacgacagatatctcagaaatgggagcgaattttagagctgatagagtaattgatccaagacgttgtcttaaacctgtaattttgaaggacggccctgaaagagtaatattagccgggcctatgccagttacagtcgcaagtgcggctcagcgtagagggagaattggacggaatcataacaaagaaggagaccaatacatctatatgggccaacccttgaataatgatgaggaccatgcgcactggacagaggccaaaatgctcttagacaatataaatactcctgaagggattatcccagcactattcgagcccgagagggagaaatcagcagcaatcgatggagagtataggttgcgcggagaagcacgtaaaacattcgtagagttaatgcgtagaggagacttacccgtatggttgtcctataaagtagctagcgagggttttcaatattctgaccggcgatggtgctttgacggagaaagaaataatcaagtattggaagaaaacatggacgtggaaatatggacaaaggaaggtgaaaggaagaaattgagaccacgctggctagacgctcgaacctatagtgatccattagctttgcgggaatttaaagaatttgccgctggaaggaggagcgtctctggtgatttaattctcgaaattggcaaattgccacagcatttaactcaaagagcgcagaacgctctagataatttagtgatgctccataacagtgaacagggcggacgagcatatagacatgcaatggaagaactaccggatacaatagaaactctaatgttgttagctttaatagcagtgcttacaggcggcgtcactttattctttctctcggggagaggcttaggcaaaacttcaattgggttactttgtgttatggctagttcagtattactttggatggcgagcgtagaaccacattggattgcagcgagtataatactcgagttctttttaatggttctcttgattcctgaaccagatagacaacggactcctcaggacaaccagcttgcttacgtagtaattggtcttttatttatgattcttacagttgcagcgaacgaaatgggattattggagacaacaaagaaagacttaggtattgggcatgtggccgttgagaatcaccaccacgccgccatgctggatgtcgacctacatccagcatctgcatggacgttatacgccgtagccactactataattacgccaatgatgagacacacaattgaaaatacaacagcaaacattagtctaaccgcaatcgcaaatcaagctgcgattttaatggggctggacaagggatggcccatatctaaaatggatataggcgtacctctattggcgcttggatgttacagccaggtaaatcctttaactctcactgctgctgtactaatgctagtggctcattatgcaattatcggacctggtctacaagcaaaagctacacgggaagctcaaaaacgaacggctgctggtataatgaagaaccccacagtcgatggcattgtcgctattgatttggaccctgtcgtatacgatgcaaaatttgagaagcaattgggacaaataatgttattaatactctgcacctcacaaatcttattaatgagaacaacatgggcattatgcgaatcgataacactggctacaggacctcttacaaccttatgggaaggctcaccgggcaaattctggaatacgaccattgctgtaagtatggctaacatatttcgaggatcttatttagcgggagccggacttgcattttctttgatgaaatctttaggcggaggaaggagaggaacaggagcacaaggcgagactttaggagaaaagtggaaacgccagttaaatcaattgagtaaatcagagttcaatacatacaaaagaagtggaatcatggaggtagaccgttcggaagcaaaggaaggtctcaaaagaggggaaactactaaacacgctgttagtcgtggaaccgcaaaactgagatggtttgttgaacgaaatttagttaaaccggaggggaaagttatagacttaggttgcggccggggcggatggtcttattattgtgctggactcaagaaagtaaccgaagtgaaaggctacacaaaaggtgggcctggacatgaggagcctattccaatggcaacctacggatggaatttagtcaaactgcattctggtaaagacgtattcttcatcccaccggaaaaatgtgacactcttttatgtgatataggagaatcaagtccaaatccaacaattgaggaaggaagaacccttcgggtattaaaaatggtagagccatggctgcgaggcaatcaattctgtattaagatattaaatccatacatgccgtcggtggttgagacgttagaacaaatgcagaggaaacatggaggtatgttagtcaggaacccattatcacgaaatagcacacacgaaatgtattgggtatcttgcgggacaggaaatatcgtatcagcggttaatatgacctcacggatgctgctaaatcgcttcacaatggcccaccgtaaaccaacatatgaaagggatgttgacctcggagcaggaacaagacatgtagcagtagaaccagaagtagccaacttagatatcattggtcaaagaatagaaaatatcaaacatgaacacaaatccacttggcattatgatgaagacaatccctacaaaacatgggcatatcatggaagttatgaagtgaaaccctccggttcagcctcctcaatggtaaatggagtagttaagttgcttactaagccctgggacgttatccctatggtaacgcagatagcaatgaccgatactacgccctttggacaacaacgcgttttcaaagaaaaggtagatacccggacacctaaggctaaacggggcacagctcagataatggaagtaactgctaagtggctatggggattcctgtcgcgaaataagaaacctaggatttgtacgcgagaggagttcactagaaaagttcgaagcaacgcggccataggtgcagtcttcgtagacgaaaaccagtggaactccgccaaagaagctgtagaggacgagagattttgggacctagtccatagggaacgcgaattacacaaacaaggcaaatgcgcaacatgcgtttataatatgatgggaaaacgagagaagaaacttggagaatttggaaaagctaaagggtccagggccatatggtatatgtggcttggcgcacggtttcttgaatttgaagcgctggggtttatgaatgaagatcattggttctcacgtgaaaactccttaagcggcgtagaaggagaaggtttgcacaaacttgggtatattttacgagacatttcaaaaattcctggtgggaacatgtacgctgacgatacagcggggtgggatacgcgtataacagaagatgatttacaaaatgaggcaaaaataacggatatcatggaacctgaacatgcacttttagccaaaagtattttcaagttgacatatcagaacaaagtcgtccgagtacaacgcccagccaagaatggaacagttatggacgttataagtagaagagatcaaagaggctctggacaagtcggaacatatggccttaacacatttacaaatatggaggcacaactaataagacaaatggaaagcgaaggaatcttcagcccatcagagctggaaacaccaaatttagctggaagagtattggattggttagagaaacatggtgtggaaagattaaaaaggatggcaatcagtggggacgattgtgtagttaaacccattgacgacaggttcgcagccgcacttacagccctgaacgacatgggaaaagttagaaaagatatacctcaatgggaaccatctaaaggttggaacgattggcaacaagtgccattttgtagtcatcatttccaccaattgataatgaaagatggtagagaaatagtggtaccttgcaggaatcaagatgagctagtcggacgtgcaagagtgagccaaggtgctggttggtcattaagggaaactgcatgtctaggcaaaagttacgcacaaatgtggcaactaatgtactttcatcgtcgtgatttgcgactagcagcaaacgctatatgcagtgctgttcccgttgactgggtacccacttcaagaacaacctggtccatccatgcgcatcatcaatggatgacaactgaagacatgttatcagtatggaatagagtatggatagaagaaaacccttggatggaagacaaaacacacataagctcatggggagacgtcccatatcttggaaagagggaagatcaatggtgtggatctctaataggcttaaccgcgcgagcaacctgggcaactaatatacaagttgcaatcaaccaagtccgacgactaattggtaacgaaaattatcttgactacatgacctcgatgaaacgatttaaaaatgaaagcgatcctgaaggtgcgctctggtga

SEQ ID NO: 21813 - RNA, 9879 nt, synthetic construct
  misc_feature 1..9879: note = derived and/or modified CDS sequence (opt6) from DENV-1__GU131738__SS-prME
  source 1..9879: mol_type = other RNA
tcagtaactatgttattaatgttaatgccgacggccttagcgtttcacttgactactagaggaggggaaccgcatatgattgtgactaaacaagaaagaggaaaatctctcttatttaaaacgagtgcgggagtcaacatgtgtaccctaatagcaatggaccttggggaattatgcgaagatacaatgacttacaaatgtcccaggataaccgaagcagaacctgacgacgtcgactgctggtgtaatgccactgatacatgggtgacttacggtacctgtagtcaaactggcgaacataggcgagataaacgctctgttgctttggcgccacacgtaggtttgggtctcgaaacacgaacggaaacatggatgagctccgaaggcgcatggaaacaaatacagcgtgtagaaacttgggccctacgacatccaggatttactgtaatagcacttttcctcgctcacgcgatcggaaccagcatcacacagaaaggaattatttttatattactaatgctagtcactccatcaatggctatgcgatgcgttggaatcggctcccgagacttcgtagaagggttatcaggagcgacatgggttgatgttgtacttgaacatggtagctgcgtaacgacgatggccaaagacaaacccacattggacatagaattgttaaaaaccgaggtcactaacccagctgtactgcgaaaactgtgcattgaagcaaaaatatccaacacaacaactgatagccgctgtcctacccaaggagaagcgacgttaatggaagaacaagacgcgaatttcgtatgtaggagaacattcgtagatagaggttggggtaacgggtgcggtttatttggtaaaggaagtctaattacctgcgcgaaatttaaatgcgttacgaaattagaaggcaaaatcgtccaatacgaaaatttaaaatattctgtaattgttactgtgcatacgggtgaccagcatcaagtcggtaatgaaagcaccgaacatgggacgacggcaactataacgccacaagcaccaacaagtgaaatccagcttactgattatggcgcattaacactagattgctcccctcgaaccggattagatttcaatgaaatggtcttactaacaatgaaggaaaaatcttggttagttcataagcaatggttcttagatcttccattaccgtggacgagcggcgcatccacaagccaagaaacgtggaatagacaagacttactcgttacatttaagaccgcccatgcgaaaaagcaggaagtagtagtgcttggatcgcaggaaggcgcaatgcatactgcgttgacaggagctactgaaattcaaacctcaggtactacaacaatatttgcaggccacttgaaatgtaggctaaaaatggacaagttaacacttaagggaatgtcatatgtcatgtgtactggatcatttaaattagaaaaagaagtagcagaaacccaacatggaaccgtcctagtgcaaataaagtacgaaggaacggacgcaccatgtaaaattccatttagtacacaagacgaaaagggagttatccaaaatggacgactaattactgccaatcctatagtaactgataaagaaaagcctgtgaatattgaggccgaacctccgttcggcgagtcctatatcgtgattggggccggagaaaaagcattaaaactatcatggtttaagaaaggttcctctataggtaagatgttcgaagcaacagccagaggtgcaaggaggatggcaattctcggagacacagcctgggactttggaagcgttggtggtgtatttacgtctgtaggtaaacttgttcatcaaatttttgggacagcgtatggtgttttatttagcggagtgagctggaccatgaaaatcggtataggagtcttgttaacatggcttggattgaacagccgaagcacttcactctccatgacctgtatcgcggtaggtctagttaccttgtatttaggtgtaatggtacaagcagacagtggatgcgtgatcaattggaaggggagagaacttaaatgtggcagtggtatttttgttacaaatgaggtacatacttggaccgaacaatataagttccaagctgattcccctaagagactatcagcagccataggaaaggcatgggaagagggggtgtgtggtatacgatcagcaacgcgacttgaaaacataatgtggaagcaaatttcgaatgagctaaatcacatccttctagagaatgacatgaagttcaccgtagtggtaggtgacgtagtcggcattttagcgcaagggaagaaaatgattagaccgcagccaatggaacacaagtactcatggaagtcatggggtaaggctaaaattataggtgcagacgttcaaaatacaacatttattattgacgggccaaacacaccagagtgcccagacgatcagagagcatggaatatctgggaggtagaagattatggattcggtatatttactacaaacatttggttaaaattacgtgactcatatacccaagtttgtgatcataggttaatgtctgccgctattaaggactctaaggctgtccacgccgacatgggttactggattgagagtgagaaaaacgagacttggaaactcgcaagagcatcgttcatagaggtgaaaacatgcatatggccaaaatctcatactttatggagcaacggtgtcttggaatcggagatgatcataccgaagatatacggtggtccgatatcccagcataattataggccgggttattttacacaaactgcaggaccatggcatttaggcaaactagagcttgattttgacttatgtgagggcaccacggtagtggttgatgaacattgcggcaatagaggtccgtcactacgcacaaccacggtcactgggaaaattattcatgaatggtgttgtcgatcgtgcaccctgccacccttacgtttcaaaggtgaggacggatgttggtatggcatggaaatacgacccgttaaagaaaaagaagaaaacctcgtgaaatcaatggtctccgctgggtcaggcgaagttgattcatttagcttaggactactatgtatcagcataatgatagaagaagtcatgagatcacgatggtctcgaaaaatgttaatgaccgggacgcttgcagtgttcttgctattgattatgggacaattaacatggaacgatcttatccgcctgtgcataatggtcggagccaacgcaagtgacagaatgggcatggggacaacttacttagccctaatggcaacctttaaaatgcgaccaatgtttgcagttggtttgttatttagaaggttaacatcgagagaagtactcctattgacaataggtttgtctttggtagcaagcgtggaactaccaaattcgcttgaggaacttggagatggattagccatgggtataatgattctgaagttgctaactgattttcagtcacaccaactttgggctacactcctgagtttaacattcattaaaacaacgctatcacttcattatgcatggaaaactatggcgatggttttaagtatagtctctctattcccgttgtgcctgagcacgacaagtcagaagaccacctggctaccagtcttgctgggtagtttaggctgcaagccacttactatgttcctaataacggaaaacaaaatatggggacgcaagagttggcctttgaatgaaggtataatggctgttggtgtagtcagcatccttctatcctcattacttaaaaatgatgtgcccctcgcgggacctttgatagcaggaggaatgttaattgcctgttatgtaatttcaggcagttccgcagatttgtccctagaaaaagcagcggaggtaagctgggaagaagaagcagaacatagcggcgcttctcataatatactggttgaagtccaagatgatggtacaatgaaaataaaagacgaggagagggacgacactctaacaattttgctaaaggcgacactattggccgtttctggagtgtatccactttctatacccgccacattgtttgtgtggtatttctggcaaaagaagaaacaacgtagcggagtcctctgggacactcctagccctcctgaggtcgaacgtgcagtgctagatgatggcatttatagaatcatgcagagaggcctgttaggacgaagccaagtaggggtaggagtgtttcaagaaaatgtatttcatacaatgtggcatgtaaccaggggagcggtgctaatgtaccaagggaaaaggttagaaccttcatgggcaagtgtaaagaaagaccttataagctatggaggagggtggcgtttacaaggtagttggaatactggagaggaagtacaagtaatagcagttgaacccggtaaaaatccgaagaatgtccaaactgcacctggtacgtttaaaacgcctgaaggagaagtaggagcaatcgcattagattttaaaccaggaaccagcggaagtcccatagtcaaccgtgaaggaaaaatagtcggtctatatgggaatggagtcgtgacaacatcgggaacttatgtctcagcaatcgcccaagctaaagctagccaagaaggccccttaccggaaatagaagatgaagtattccgtaagcgaaacttaacgataatggacctacatccaggatcaggaaagacacgccgttatctacctgctatagtaagagaagctattaaacgtaaattgcgaacattaatactagcgccaacgagagttgtcgcctcagagatggcagaagcacttaaaggaatgccaatacgatatcaaacaacagctgtcaagtctgaacatacgggtaaggaaatcgtggatcttatgtgtcatgccacattcacaatgcgtctactaagtccggtccgagttccgaactacaatatgataattatggacgaagcccatttcacggatccttcaagtatcgccgctcgaggttacattagcacaagggtaggaatgggagaggctgctgcgattttcatgacagccacaccacccggatcagtagaagcattcccccagtcgaatgcagtaatacaagacgaagagagagatataccaggaagatcttggaactccggctacgaatggataaccgacttcccgggaaagacagtatggtttggaccaacgataaaatcaggaaatgacatagcaaattgtttacggaaaaatggaaaaagagtgatacaattgtctcgaaaaacttttgacacagagtatcagaaaacgaagaacaatgactgggattacgtcggtaccactgatatctcagaaatgggtgctaatttcagagcggatagagtgatagaccctcggcgatgtttaaaaccggtaatattaaaagatggaccggagcgagtaatattagcagggccaatgccagtaacagtagcttcagcagcacaacgaagaggaagaatcgggagaaatcacaacaaagagggcgatcaatatatttacatggggcaaccgttgaataacgacgaggatcacgcacattggacagaagcgaaaatgttactagacaatattaatacgcctgaaggcatcataccagctcttttcgagccagagagagaaaaatctgccgctatagatggtgaatacagattacgcggagaagcccgaaaaacatttgttgaacttatgcgaagaggagatttgcctgtgtggttgagttataaggtggctagcgagggatttcaatattctgacagaagatggtgtttcgacggagaacgcaacaaccaagtattagaagagaatatggatgttgaaatctggaccaaagaaggtgagcgcaagaaacttagacctcgatggctagacgccagaacgtattctgaccccctagctttacgggaatttaaggagtttgcggccgggcgtagatccgtctcgggagatttaatattagagataggcaaattaccacaacatttgacacaacgggcacaaaacgcactagacaatctggtcatgctacataattcagaacaaggtggtagagcgtacagacatgcgatggaagaattacccgatactatagaaactctaatgttacttgcacttattgcagtcttaactggcggtgtcaccttgttctttctttcgggaaggggactgggcaaaacatcaatcggactattatgtgtcatggcaagttcagtccttctctggatggcatcagtcgaacctcactggatagcagcatcaattatattagaatttttcctaatggtgttactaatcccggaacctgacaggcaacgaacccctcaggataaccaactggcgtatgtagtaatagggctactgtttatgatactaacggttgctgcaaatgaaatgggcctgttagagacaacgaagaaagatttaggaataggccatgttgctgtggagaaccaccaccatgcaacaatgctagatgtagatctgcatcccgcatccgcatggacgctatatgcggttgccacgacgatcataacaccgatgatgagacacaccatagaaaacactacagcaaacattagtttaaccgctattgctaaccaggcagctatccttatgggtctagataagggctggcctatctccaagatggatattggtgtgccacttctagcattaggatgttatagtcaagtgaatccattaacgttgacggcagcagtacttatgctagtcgcccattatgcaataataggccccggactccaagcaaaagctacacgagaagcacaaaaacgaactgcagctggcattatgaaaaacccgacagtggacggaatagttgctatcgaccttgacccagtcgtatacgatgcaaaatttgagaaacagttaggacaaatcatgcttctaatattatgcacatcgcaaatattactaatgcgaacaacttgggctttatgtgaatcaattacactagccacgggtccactaaccacactatgggaagggtcaccaggtaagttttggaacaccaccatagcagtatcgatggcgaacattttcagaggttcttacctagcgggagcaggactagccttttccttaatgaaatcattaggaggtggtcgacgtggaacaggtgcacaaggtgagaccctaggtgaaaaatggaagagacaattgaatcaactgtcgaaaagcgaatttaacatatataaacgttcaggaataatggaagtggaccgatctgaagctaaagaaggactcaaacgtggagagacgacgcgacatgcggtatcgcgaggcacggccaaactcagatggttcgttgaaagaaatttagtaaaaccagaagggaaagtgatagatttaggatgtggtcgaggagggtggagttactactgcgccgggctgaagaaagttaccgaggtgaaaggctatacgaaagggggccccgggcatgaagaacccatcccaatggcaacttatggatggaatctggtaaaacttcatagtggcaaagatgtattctttacaccaccggaaaaatgcgacactcttttgtgtgacattggagagtcatctccaaacccgacaatagaagaagggaggacgcttagagtattaaaaatggtagagccctggctgagaggtaatcagttttgtataaagatattaaacccctacatgccctcagtagtcgaaacattagaacaaatgcagagaaagcatggtggaatgctcgtcagaaacccactttcccgaaattcaacacatgaaatgtactgggtttcctgcggaactggtaatatcgtttccgctgttaacatgacatctagaatgttgttaaatcgattcaccatggcgcatagaaaacctacatacgaaagggacgtcgatttaggagccggcacaagacatgttgcggttgaacctgaggtcgctaatctagacattattgggcagcgaatagaaaatataaaacatgaacacaaatctacatggcattacgacgaagacaacccatataaaacctgggcttatcacggctcttacgaagttaaaccatcagggtcagcttcaagcatggtaaacggagtagtcaaattgctgacaaaaccatgggacgtgatacccatggtaacacaaattgctatgactgatacaacaccttttggccaacaacgagtatttaaggaaaaagtagatactcgtactcctaaagcaaagcgaggcactgcacaaatcatggaggtaacagcgagatggctatgggggtttctgtctagaaacaagaaaccccgaatatgcaccagagaagagttcacaagaaaggtcagaagtaatgcagcgatcggcgctgtattcgtagatgagaaccaatggaacagcgcaaaggaagcagtagaagacgaaagattctgggacttaggacaaaaagagagggaattacataaacaaggcaaatgtgccacatgcgtatataatatgatgggcaaacgtgagaagaaactgggtgagttcggcaaagcaaaaggatcaagggctatttggtacatgtggttaggagccagatttcttgagttcgaggcgttaggcttcatgaacgaggatcattggtttagccgtgaaaatagccttagtggtgtagaaggagaagggttacacaaactagggtatatattaagagatatatcgaaaatacctggtggcaacatgtatgctgatgacactgcaggatgggataccaggattacagaggatgatttacaaaacgaagcaaaaattaccgatatcatggagccagagcacgcacttctcgcgacgagcatattcaaactaacatatcaaaataaagtagttcgagtacaaagaccagctaaaaacggtactgtcatggatgtaatttcaagaagagaccaaagaggttcgggacaagtaggcacttatggacttaacacatttactaatatggaagcacagctaataagacaaatggaatccgaagggatattcctgccgtccgagctagaaaccccaaacttggcggaaagagtacttgactggttagaaaaatatggagttgaacgtcttaaaagaatggccataagtggagacgactgtgttgtcaagcccatagacgataggtttgccaccgcgttaacagccctgaatgatatgggaaaggttagaaaagacattcctcaatgggaacccagcaaaggttggaatgactggcaacaggtaccattctgcagtcatcattttcatcaattaataatgaaggacggtagagaaatcgtggtaccctgccgaaatcaggatgaacttgtaggcagggccagagtatcacaaggagctggttggtctttacgtgaaactgcatgcttgggtaagtcatatgcacaaatgtggcaattaatgtactttcacaggagagacctaagattagccgccaatgcaatttgctcagccgtaccagttgattgggtccctacaagtcgaactacatggagcatccacgcacatcatcagtggatgacgactgaggatatgctaagcgtctggaatagggtttggattgaggaaaatccatggatggaagacaagacgcacgttagttcatggggagatgtaccatatctagggaaaagagaagaccaatggtgtggttcactaataggattaacagcacgcgccacatgggccagcaacatccaggttgcaatcaatcaggtcagaagacttatcggaaatgaaaattatttggactacatgacaagtatgaaacgattcaaaaatgaaggggatcctgaaggggccctttggtaa

SEQ ID NO: 21814 - RNA, 9879 nt, synthetic construct
  misc_feature 1..9879: note = derived and/or modified CDS sequence (opt6) from DENV-1__JF937604__SS-prME
  source 1..9879: mol_type = other RNA
agtgtaaccatgttactaatgctcatgcctaccgctctggcatttcatcttacgactcgcggaggagaacctcatatgattgtatctaaacaggaaagaggaaaaagtttattgtttaagacaagtgctggggtaaacatgtgtacactcatagcgatggatttaggtgaattgtgcgaagatactatgacgtacaaatgtcctagaatcaccgagacagaacctgacgacgttgactgttggtgcaacgcaactgacacttgggtgacctacgggacttgctcacaaacaggagaacatcgaagagacaaacgtagtgtggcgcttgcaccccatgttggacttggacttgaaactcgtacggaaacctggatgagctcagaaggcgcgtggaagcaaatacaacgagttgaaacatgggcacttagacatccaggttttaccgttatcgcacttttcttggcgcacgccatagggacttcaataacacaaaaaggcataatttttattttgttaatgttggtaacgccaagtatggccatgagatgtgtaggaattgggtcacgagattttgtcgaaggactttccggtgcaacatgggttgacgtcgtgttggaacatggcagctgtgtaactacaatggctaaagataaacctacacttgatatagaattactgaagaccgaagttacaaatcccgcagtactacgtaaattatgtattgaagcgaaaatatctaataccacaacggactcccgctgtccaactcaaggcgaagcaaccttagttgaagaacaagacgctaactttgtgtgcagaagaacctttgtagacagaggatggggtaatggatgcggactgtttggaaaagggtcattgattacatgcgctaaattcaaatgcgtaacaaaactagagggtaagatagtacagtacgaaaatttaaaatattccgttatagtaacagtccatactggggatcaacaccaagtcgggaacgagtccacagaacacggcacaacagcgaccataacaccacaagctccaactactgaaatccaactgacagactacggcgccttaacattggactgtagtccaagaacaggtttggacttcaacgaaatggtactgttaactatgaaagagaaaagttggttagtccataaacagtggtttctggaccttccactcccgtggacgagcggtgcaagtacaagtcaggaaacctggaatagacaagatttacttgtgacattcaaaactgctcacgctaagaaacaggaagttgttgtactcgggtcgcaagaaggagcaatgcatactgcactaaccggtgcgactgagatccaaacatccggtaccaccacaatctttgctgggcacctaaagtgccggttaaagatggacaaattgaccctaaaaggcatgtcttacgtaatgtgtacaggcagtttcaagctagaaaaagaggtagctgaaacacaacatgggacagtacttgtacaaataaaatatgaaggtacagacgccccctgtaagatcccatttagcactcaagacgaaaagggagttacccaaaacggacgcctaataactgctaatccaattgtaacggacaaagagaaaccagttaacatcgaagctgaacctccttttggggaaagttatattgtaattggcgcgggcgaaaaagcactaaaattgagctggtttaagaagggtagtagtattggaaaaatgtttgaagcaacggctcggggtgcccgaagaatggcaattttaggcgacactgcttgggacttcggcagcattggtggtgtatttacttcagttggcaaacttgtacatcaaacattcggaacagcttacggcgtcttattctcaggtgtgagctggaccatgaaaattggaataggagtccttttaacttggctcggattaaacagtcgttcaaccagtttatcaatgacctgtatagcagtaggcctagtgaccctgtacctcggtgtaatggtccaagccgattcaggttgtgtaatcaattggaaaggaagggaattaaaatgtggttcagggatatttgtgaccaatgaagttcatacttggacggagcagtacaagttccaagctgactcgccgaaacgtctatcagcggctattggaaaagcatgggaagaaggcgtatgcggcattaggtcggctactcggctagaaaacatcatgtggaagcaaatatcgaatgagctaaatcatatactattagaaaatgatatgaaatttaccgtagttgtgggtgatgtcgctggaatattagcacaaggcaaaaagatgattagaccacagccaatggagtataaatatagttggaaaagttggggtaaggctaaaataattggagcagatgttcaaaacaccacatttataattgatggtccaaatacacctgagtgcccagacgatcagagagcatggaatatctgggaagtggaggattatgggttcggaatattcacaacaaacatctggttaaaattgagagattcatacacacaagtatgtgatcatcgattgatgtcagcagcaataaaagatagtaaagccgtacatgctgacatgggatactggatagaatcagagaaaaatgagacatggaagttagcccgggccagctttattgaagttaagacttgtatatggccgaaatcccatacactatggtctaacggcgtactagaaagcgaaatgataattcccaaaatatatggcggcccgataagtcaacacaattaccgcccagggtattttacacaaaccgctggaccatggcacctaggcaaacttgaactagatttcgatctatgcgaaggcaccactgtcgtagttgatgagcactgtgggaatagaggcccgtccttgaggacgaccacagttacaggaaaaataattcacgaatggtgttgccggagttgcaccctaccaccactaagattccgtggagaggatgggtgttggtacggaatggaaatacgaccagtaaaggaaaaagaggaaaacttggttaagtcaatggtatccgccggaagtggagaagttgattcattctctctaggacttctgtgtatttccataatgattgaagaagtcatgagatccagatggtcgcgaaagatgttaatgacgggaactttagccgtattcttcctgttaataatgggtcagcttacatggaatgatttaataagactttgtataatggtaggcgctaacgcctctgaccgaatgggaatgggcacaacatatttagcgttgatggctacgtttaaaatgcgtcccatgtttgctgtaggcttactattccgcaggctaacatctagagaagttcttttactgacgatcggcctttccctagtagcatctgtcgaattaccaaactcattagaagaactaggtgacggcctcgccatgggtattatgattttaaaactcttgactgattttcagtcgtatcagctctgggccacactattaagtctcacatttatcaaaactacgttctccttacattacgcttggaaaactatggctatggtattatcgatagtcagtttattcccactctgtttatcaacaacaagtcaaaagaccacatggttacctgtcctcctaggcagtctgggttgtaaaccactcactatgtttttgatcgcagaaaacaagatatggggccggagaagttggccattaaacgaaggaataatggcagttgggatcgtcagtatattacttagtagtctactcaaaaatgacgtacccctcgcaggaccactgattgccggcggaatgttaatagcgtgctatgttatttctggatcatctgctgatctgagtttggaaaaagctgctgaagtaagctgggaagaggaagcagagcactcgggagcatcacataatatcctagtagaagtccaagacgacggaacaatgaaaataaaagatgaagaaagggatgatactctgaccattctacttaaggcgactctcttagcagtatcaggagtttatcctcttagtattccagctactctatttgtctggtatttttggcagaagaagaaacaaagaagcggtgtactatgggataccccgtcgcctcctgaggttgaacgtgccgttttagatgatggtatctacagaattatgcaacgtggattattaggtaggagccaagtcggtgttggtgtttttcaagagaatgtgtttcacaccatgtggcatgttaccagaggggcagtcttaatgtaccaaggaaaaagactggaaccaagttgggcgtccgtcaagaaagacttaattagctacggcggaggctggaggcttcaagggttttggaatacaggcgaagaagttcaagtaattgccgttgagcctggtaaaaatcccaaaaatgttcaaacggcaccaggaacatttaaaactcctgaaggcgaggtaggagccatagctttagacttcaaaccaggaacaagtggcagtccaatagtaaatagagaagggaaaatagtgggcctatatggcaacggagttgttactacttcaggaacatacgtgtccgccattgcccaagcaaaagcaagccaagaagggcctttacctgagatcgaagacgaagtatttcgtaagcgcaatctaacaataatggacctacacccgggatctggtaaaacacgaagatatctcccagcaatagtaagagaagctatcaaacgcaaactaagaactctgatactagcaccaacaagagttgtggctagtgaaatggcggaagctcttaaggggatgccaatacggtatcaaacgacagctgttaaatcagaacatacgggaaaagaaatcgtagatttaatgtgtcacgcaaccttcactatgagacttttaagccccgttagggttccaaattataacatgattatcatggatgaagcacattttacggaccccagtagcatagctgctcgtgggtacattagcacaagagtagggatgggagaggcagcagctatcttcatgactgctacgcctccggggtccgtagaagcatttccacaatcaaacgccgtaatacaagatgaagaaagagacatcccagaacgcagttggaactctggttatgaatggataacagactttccaggtaaaaccgtatggtttgttccctcaataaaatctggcaacgatatagctaactgccttaggaaaaacggtaaaagggtgatacaattgagtagaaaaacgttcgacacggaatatcagaaaactaagaataatgattgggattatgtagtaaccactgacatatccgaaatgggagcaaatttcagagctgatagggtgattgacccaaggaggtgcttaaagcccgtcatactaaaagacggtcctgagagggtaatacttgctggacccatgccggtaacagtagcatcggcagcccaacgaagaggtcgaataggtagaaatcataacaaggagggggatcagtatatttatatgggacaaccattaaataacgacgaagatcatgctcattggacagaagctaaaatgttactagacaatataaatactccagaaggtattatacctgctttattcgaaccagagcgcgaaaaatcagcggcaattgacggggaatatcggcttcgcggggaagctcgaaaaactttcgtagaactgatgagaagaggagaccttccagtttggttatcttacaaagttgccagtgaaggattccaatattcagatagacgatggtgctttgacggagaacggaataatcaagtgctagaagagaacatggacgtggaaatatggacgaaggaaggcgagaggaagaaattgcgtccgcgatggctagacgcacgtacatatgcagatccactcgcactacgagagttcaaggaatttgccgcaggccgcagaagtgtgagcggggacctaatactcgaaattggtaaattaccccaacatctaacacagagggcacaaaatgctttagacaatttagtcatgttgcacaacagtgaacagggaggtagagcatataggcacgctatggaggaactaccagacacaatcgaaacgttaatgctgcttgcacttattgctgtattaacgggcggggtcaccttatttttcctttcgggtagaggtttaggaaaaacatcaataggtctactttgtgttatggccagttcagtattgctatggatggcgtcagtagagccacattggatagcggcaagcattattttagagttctttttaatggtattattaattccagaaccagatcgacaaagaactccccaggataatcaacttgcctatgtagtaatcggcctgttgtttatgatcttgacagtagcagcaaatgaaatgggactattggaaacaacgaaaaaggaccttggtatcggtcatgtggccgtagaaaaccatcaccatgcagcaatgttagacgtagaccttcaccctgcgagtgcatggacactctatgctgtagctactaccattattacacctatgatgcgacatactatagaaaataccacagcaaatatatcacttaccgcaatagcaaaccaagcagcgatccttatgggcttggacaaaggatggccaatcagtaaaatggacattggggttcccttactagctctcggatgctacagccaagttaatcccctaacccttactgccgctgttttgatgcttgttgcccattatgcgataatcgggcctggtttgcaagcaaaagctacgagagaggcacagaaacgaacggctgctggaataatgaaaaatcccacagttgacgggatagtagcaatagacctagatcctgtagtgtatgatgctaaattcgaaaaacaattagggcaaataatgctattaatattatgtacatcgcaaatactactcatgaggacaacttgggctttgtgtgaatcaattaccttggcaactgggcccctaacgacgctttgggaagggtccccgggtaaattttggaatactacgatagccgttagtatggcaaacatattccgtggttcttacctagctggcgctgggctggcattctctttaatgaagtctctagggggcggacgcagaggtaccggggcgcagggagagactttgggagaaaagtggaaacgacagttaaatcagctatccaagtccgaatttaacacatacaagaaaagtggtataatggaggtagacagaagtgaggcaaaagaggggttaaaacgaggcgaaactactaaacacgccgtttctcgaggaaccgcgaaactaagatggtttgtagaaagaaatttagtaaaacctgagggaaaggttatagacttaggttgtggacgtggaggatggtcttactattgtgcaggcttgaagaaagtaactgaggtaaaaggttacactaaaggaggccctggccatgaagaaccgataccgatggcaacctatggttggaatctagtaaaactacattcaggaaaggacgtgttctttattccccctgaaaagtgcgacacattgttatgcgacataggggaatcatcacccaacccgacaatcgaagaagggagaaccctaagagtattgaaaatggttgaaccgtggttaagggggaatcaattttgcatcaaaatactaaacccgtatatgccctctgtcgtcgaaacgctggaacaaatgcaacgaaaacatggagggatgctggtaagaaaccccttaagtagaaatagtactcatgaaatgtattgggtatcgtgtggcactgggaatatagtctccgctgtaaacatgacatcaaggatgttactcaaccgatttacaatggcacaccgtaagccgacttatgaaagagatgtggacttaggggcaggaacacgccacgtcgcagtagaaccagaagtagctaacttagatattatagggcaacggatagaaaatataaaacatgaacataaaagtacttggcactatgatgaggataatccttataaaacgtgggcataccacgggagctatgaagtaaaaccaagcggatcagcatctagcatggtaaacggggtggtaaaactacttactaaaccctgggatgtaataccaatggtaacccaaattgccatgacagacacaacaccatttggtcagcaaagggtcttcaaggaaaaggtagacactcggacaccaaaagctaagcagggaactgcccaaattatggaagtgacagctaaatggttatggggatttttatctagaaacaagaaaccaagaatctgcactagagaagagttcacccgcaaggtaagaagtaatgccgcaataggtgccgtatttgtcgatgagaaccagtggaatagtgcaaaggaagccgtagaagacgagagattctgggatctggtgcatcgggaacgtgagcttcataagcaggggaagtgcgcaacatgtgtatacaacatgatgggaaaaagggaaaagaaacttggagaatttggaaaggctaaaggttcccgagcaatatggtatatgtggctgggagcgcgttttctagaatttgaagctctaggattcatgaatgaagatcattggtttagtagagaaaattccttatcgggtgtagagggagaaggactgcataagttagggtacatcttgagagatattagtcaaatcccaggcgggaatatgtacgctgatgataccgctggttgggatactcgtattactgaagatgacttacaaaacgaagcacgtataacagacattatggagccagagcatgcacttctagcaaagtcaatatttaagttaacttaccaaaataaagtagtaagagtacagagacctgctaaaaatggaactgttatggatgttatttccagaagagatcaacggggatcggggcaagttggcacttacggcctaaacacattcacaaacatggaagcacaattaattaggcaaatggaatcagaaggaatattttccccgtctgaactagaaacacctaatttggcagaaagagtcttagattggcttgagaaatacggtgttgagagattaaaaagaatggctatcagtggagatgattgcgtcgttaaacctatagatgaccgattcgcaaccgctctcactgcacttaacgatatgggaaaggtacggaaagatataccacaatgggaacctagtaaaggatggaacgattggcaacaagttcccttctgtagtcatcatttccatcaattaataatgaaggacgggagggaaatcgtcgtgccgtgtcgaaatcaggatgaactggtgggcagagcgcgagtctctcaaggtgcaggttggtcattacgagagacagcttgtcttggaaaatcttatgcacaaatgtggcagctaatgtactttcataggagggacttacgcctagcagcaaatgcaatatgtagtgcagttccggtcgactggattccgacatcaagaactacatggtccatacacgctcatcatcagtggatgactactgaagatatgttgtcagtctggaacagagtctggatagaagaaaacccatggatggaagataagacccacatctcctcctggggtgatgtcccatacctggggaaaagagaagaccagtggtgtggctcactcattggactaacagcaagagctacctgggcaacaaatattcaggtagcaataaatcaagtacgacgacttatagggaacgaaaattacctagattacatgacatctatgaaaagatttaaaaatgaaagtgatccagaaggggcactatggtaa

SEQ ID NO: 21815 - RNA, 9879 nt, synthetic construct
  misc_feature 1..9879: note = derived and/or modified CDS sequence (opt6) from DENV-1__JF937605__SS-prME
  source 1..9879: mol_type = other RNA
agcgttacaatgttattaatgctaatgcctaccgcactagcattccaccttaccacccgcggtggtgaaccccatatgattgtaagtaaacaagaaaggggaaagagcttactattcaaaacatcggctggggtaaatatgtgcacattaatagcaatggacctgggagaactgtgtgaagacacaatgacatacaaatgtccaaggattacggaaacagaaccggacgatgtagattgctggtgtaacgctactgatacttgggtgacgtacggaacatgctcccagactggagagcatagaagagataaacgtagtgtggcactagctccacatgtcggactgggactagaaaccaggacggaaacttggatgtcttccgagggggcatggaaacaaatacaaagggtagaaacatgggcattacgtcatccaggattcaccgttatcgcattgtttctagcacacgcgataggtacaagtattactcaaaaaggaattatctttatattactaatgttagtaacgccatctatggcaatgagatgtgtagggataggtagcagagactttgtagaagggcttagtggggcaacatgggtagatgtagtacttgagcacggtagctgtgttacgactatggcgaaagataaacctactctagatattgaattactaaaaaccgaagtaacaaaccctgcagtactgcgcaaactttgcatagaggcgaagatatcgaacacaacgacagactctcgatgtcctacacaaggagaggcaaccttagtagaagaacaagatgcaaattttgtgtgcagaagaacctttgtcgatcgtggttggggaaacggatgcggtttatttggaaaaggctctcttattacgtgcgcaaaatttaaatgtgtaacgaaacttgagggaaaaatagttcaatatgaaaatttgaaatattctgtcatagtaacagtgcatacaggagaccagcatcaagtaggtaacgagtcgacggaacacggaactaccgcgacaataactccacaagcccctactaccgaaatacagctaacagattacggagctttaactctggattgtagtccgcgtacgggacttgatttcaacgaaatggttctcttgacaatgaaagagaagtcatggttggtacataaacaatggtttttggacctacccttaccatggacatctggagcctccacccttcaggagacatggaaccgtcaagacctacttgtaacgtttaaaacagcacacgctaagaaacaagaagtagtcgtattaggttcacaagagggtgcaatgcacactgcactaactggtgctactgagattcaaacatcaggtactacaacaatattcgcagggcacttaaaatgcaggctcaaaatggataaacttaccttgaaaggaatgtcatatgttatgtgcacgggatcatttaaattagaaaaggaagtagctgaaacacagcatggaacagtgttagtccaaataaaatatgaaggcacagacgcgccttgtaagataccctttagtacacaagacgaaaagggcgttacccaaaacggaagattgatcaccgcaaatcccattgtaacagataaagagaaacccgtgaatatagaagccgagccacccttcggtgagtcctacatagtaattggtgcgggtgaaaaggcgctcaaactatcgtggtttaagaagggaagcagtataggtaagatgtttgaggccactgccagaggggctcgaagaatggctatactaggcgatacagcatgggatttcggatccataggtggtgtatttacatcagtgggaaaacttgtgcatcagatcttcggtacagcctatggcgtactattttcaggcgtatcatggacaatgaagataggaattggagttctactaacatggcttgggttaaactcaagatccacatcattaagtatgacgtgtatagccgtgggcttggttacattatatttgggtgttatggtacaagctgatagtggttgtgtgattaattggaaaggaagagaattaaagtgtggcagcggaatcttcgtaactaatgaagtacatacatggactgagcaatataaatttcaagccgattctcctaaaagacttagtgctgcaatcggaaaagcgtgggaagagggggtatgtggtatcagatccgcgactagactagagaacatcatgtggaaacagatatctaacgaattaaatcatatacttctggaaaatgacatgaagtttaccgtagttgttggtgatgttgcagggatattggcacagggcaagaaaatgatacgtccacaacctatggaatacaaatactcctggaaatcgtggggcaaagcgaagataataggcgctgatgtacagaataccacatttataatagacggcccgaataccccggagtgtccggacgaccaaagagcatggaacatatgggaagttgaagattacggattcgggatatttaccacaaatatatggctaaaattaagagatagctacacgcaagtttgcgatcaccgcttgatgtctgcagctataaaggatagtaaagctgtacatgccgatatgggctattggatcgaatctgaaaagaacgagacatggaaattagcgagggcgtcatttattgaggtgaaaacttgtatttggcctaagtctcacacactgtggtctaacggcgtcttagaatctgaaatgataatccctaaaatatatggagggccaatatcacagcataattatagaccaggttactttacacaggcagcaggtccttggcacttaggaaaactagagctcgattttgacctatgtgaggggacaacagtagtggtggatgagcactgtggaaaccgcggaccatctcttaggacgaccactgtgacaggtaagataattcatgaatggtgttgtagatcatgcactttacctccactgcgtttcagaggggaagatggatgttggtacggaatggaaataagaccggtaaaagaaaaagaagaaaacttggtaaagtcaatggtatcagcaggaagcggagaagtcgactctttctcactaggactattatgtatatcaattatgattgaggaagtcatgaggtcacgctggtcacggagaatgttaatgacgggcaccttagccgtcttctttttactaatcatggggcaactaacctggaatgacttaattagactatgcatcatggttggtgcaaatgcctctgatagaatgggtatggggacaacatatttagccttaatggcaacattcaaaatgagaccaatgtttgccgtgggactattgtttaggagattaacgtctagggaagtgcttttactaactataggtcttagccttgtagcttcagtggagctaccaaattccctagaagaacttggagacggtctagctatgggaattatgatcttgaaactactaactgactttcaaagtcaccagctttgggcaacattgttatccctcacgtttatcaaaacgaccttttctctgcactatgcgtggaaaaccatggccatggtactttcaattgtctcattgtttccactttgtctttcgactacatcgcagaaaactacatggctcccagtactgttgggaagcctggggtgtaaaccacttacaatgttcttaatcgcagaaaacaaaatatggggccgccgcagctggccacttaacgagggcattatggctgtaggaattgttagcatactgctaagttcattactcaaaaatgatgtacctctcgctggtccacttatcgcaggaggcatgctaattgcgtgctatgtaatatcgggaagctcagctgatctatcgttggaaaaagctgcaaaagtgtcttgggaagaggaggcagaacattctggagcaagtcataatattcttgtagaagttcaggatgacggaaccatgaaaataaaagacgaagaaagagacgatacgttaacaattcttcttaaagccactctactggcagtgtccggggtttacccactatccataccagccaccctctttgtttggtatttctggcagaagaagaaacaacgttctggagtgctttgggacacaccaagcccaccagaagtggagagagccgtactcgatgacggaatatatagaatcatgcaacgaggtctactcggtaggagccaagttggagtcggggtatttcaagaaaatgtttttcatacgatgtggcacgttactagaggcgcagtgttaatgtatcaaggaaagagattagagccatcctgggccaacgttaagaaagatctaatttcatacggcggcgggtggaggctccagggatcatggaacaccggtgaggaagttcaagttatcgcagtagagcccggcaaaaatcccaagaacgtccaaactgcaccaggaactttcaaaacacctgaaggagaagttggtgcgatagctttagattttaaacctgggacaagtggtagtccgattgtaaacagagaaggtaaaattgttggtctgtatgggaatggggtagttacaacgagtggaacgtacgtatccgccattgcccaggctaaggctagtcaagagggacccctccccgaaatagaagatgaagtattcagaaaaagaaaccttacaataatggacttgcaccccggatcgggcaaaactagacgctaccttccagctattgtgcgggaagctattaagaggaaacttcgaacactcatcttagcaccaaccagagtagtggcttcggagatggcagaagcattaaagggcatgcccataagataccaaacaacagccgtcaagtctgaacatacaggaaaggaaatcgtcgacttaatgtgtcatgctacatttacaatgagactactaagtcccgtacgagtaccgaattataatatgataataatggacgaagcccattttacagatccgtcatcaatagcagcccggggatacatttcaacacgggtggggatgggtgaagctgctgctatattcatgactgctactccccctgggagcgttgaagcctttccgcaatctaacgcggtaattcaagatgaggaaagagatatacccgaacgtagctggaatagtggatatgaatggatcacagattttccaggcaaaactgtttggtttgttcctagtataaaatctgggaatgacatcgcgaactgcttacgtaagaacgggaagagggtcatacaattgtctcgcaagacattcgacacagagtatcagaaaactaaaaataacgattgggattatgtcgtgacaacggatatatccgaaatgggggctaattttagagcagacagagtcattgatccaagaaggtgtcttaaaccagtaatcctaaaagatggaccagagcgtgtaatcttagcaggacccatgccagttacagtagcatcagcggctcagcgtcgcggtcgaataggcagaaatcacaataaagaaggagaccaatacatttacatggggcagcctctcaataacgatgaagaccatgcacattggaccgaagctaaaatgctcttagataacattaacactccggagggaataataccagcactatttgaaccggaaagggaaaaatccgcagccatagatggagagtatagattaaggggagaagcgcgcaaaaccttcgttgaactcatgcgacgcggagatttacccgtttggttatcctataaagtagccagtgaaggtttccaatatagtgatcggagatggtgtttcgacggggagagaaacaaccaggtgttagaagaaaatatggacgtagaaatatggactaaagaaggcgaacgaaagaaactaaggcctcgctggctagatgctcgtacatattcagaccctttagcattacgtgaatttaaagaatttgccgctggccgtcgatcagtcagtggtgacttaatattggaaatcggtaaacttccacaacatctaacgcaaagggctcaaaatgcattagataatcttgtgatgctacacaactcagaacaaggaggacgagcttacagacacgctatggaagaacttccagacaccatagaaactctaatgttattagctttaatagcagtgctcactggcggagtaaccctattctttctttcaggacgtggattaggaaaaacttccataggattattgtgtgtaatggcgagttcagttttattatggatggcatccgtagaacctcattggattgcagcatcgatcatactagagttcttccttatggttttactcattcctgaacctgaccgtcaacgtacaccacaagacaatcagttagcgtatgttgtaatcggattattatttatgatattaacagtagcagcaaatgagatgggcttgctagaaactaccaagaaagacttaggtatcggacacgtagccgtcgaaaatcatcatcacgcagcgatgcttgatgttgaccttcacccagcatcggcatggactctatacgcggtagcaacaacaataattacacctatgatgagacacacaattgaaaataccacagcaaacataagtttaacggctatcgcaaaccaggctgctatactaatggggttggacaaaggctggccaataagtaaaatggacataggagttccattattagcattaggctgctattcgcaagttaatcccctaactctaacagctgcggtattaatgctagtagcacattacgcgataataggtccagggttacaagcaaaagctacaagggaagctcaaaaacgtacggcagcaggtataatgaaaaacccaactgtagatggcatcgtcgcaattgatttagaccctgtagtttacgatgcgaaatttgagaaacaactcgggcaaataatgcttttaatcctatgtaccagtcaaatactactcatgcgaacaacatgggcactatgtgaatctataactttagcaacgggaccactaaccaccctttgggagggatcaccaggaaaattctggaatacaactattgcagtcagtatggccaatattttcagagggagttatttagctggcgccggactagccttttcacttatgaaatcactcggaggagggcgacgagggactggagcgcagggggaaacattaggagagaaatggaagcgacaactcaatcaattatcaaaaagtgaatttaatacatataaacgtagtgggataatggaagtagatcgatcagaagcaaaagaaggacttaagagaggagaaactaccaaacatgccgtgagcaggggaactgcaaaacttagatggtttgtggaacgtaacctcgttaaacctgaaggaaaagtaatagacttaggttgcggtagaggcggctggtcatactactgtgctgggcttaagaaggttaccgaagttaaaggatatacaaagggaggtcccggacatgaagaacctattccaatggccacttacggatggaacttagttaaactacactccgggaaggatgtctttttcataccacctgaaaaatgtgacactctattatgcgacatcggcgaatcttcaccaaacccgactatagaagagggccgtacattgagagtgttgaaaatggtggaaccctggttacgtgggaatcaattttgtattaaaatattaaatccctatatgccttcagttgtggagacactagaacaaatgcagcgcaaacacggagggatgttggtacggaacccattgtcaagaaacagcacacacgaaatgtactgggtctcatgtggaacaggcaatatagtatcagcggtgaatatgacttctcgaatgttactcaacagatttaccatggcccatcggaaaccaacttatgagcgagatgtggatttaggggcgggaacaagacatgtcgcagtagaacctgaagtagcaaatctggatataattggacaaagaatcgagaatattaaacatgaacataaatcgacctggcattacgacgaagataatccatataagacatgggcttatcatgggtcatatgaagtaaaaccaagcggcagtgcatcatctatggtaaatggcgtggtgaaactactaaccaaaccatgggacgtcatacctatggtaacccaaatagcaatgacagacacgacgcccttcggccagcagagagtcttcaaagagaaagtagacacgcgaacgccaaaagctaaacgtggtacggcgcaaatcatggaagtcacagcgaagtggctctggggttttctaagccgaaacaagaaaccaaggatatgtactcgggaagagttcacgagaaaggtaagaagcaatgccgcaataggtgctgtgttcgtagacgaaaatcaatggaacagcgcaaaagaggctgtggaggatgaaagattttgggatttggtgcaccgagagcgagaactccataaacaaggaaaatgtgccacatgcgtctataacatgatgggaaaaagggagaagaaattgggagagttcggaaaagccaagggaagccgagccatctggtacatgtggttaggcgcccgtttcttagagttcgaagccttggggttcatgaacgaggatcattggtttagcagagaaaattcattaagtggagtggagggagagggtctacacaaactgggctacatattacgtgatataagtaagatacctggcggaaatatgtacgcagatgacacggctggttgggatactcgtataactgaagatgacttacagaacgaagccaggataaccgacatcatggagcccgaacatgcactattagccaagtcgatatttaaactaacatatcagaacaaagtggtaagggttcaaagacccgccaaaaatggaaccgtaatggacgtaatttcccgacgggaccaaagaggatcgggccaagttggcacatatggcttaaatacattcacaaatatggaagcacaattaataagacaaatggaaagcgaagggatattcagcccgagtgaattagaaacacctaacctagcggaacgggttcttgactggttggaaaaatatggagtagaaaggctcaaacggatggcaatatcaggagacgattgtgttgtcaaacctatagacgatcgctttgctacagcactgaccgctttaaacgatatgggaaaagtaaggaaggatataccacagtgggaacctagtaaaggatggaatgattggcaacaagtacccttttgttctcaccatttccatcaattaataatgaaggatggacgtgaaatagtagttccatgccggaaccaagatgaacttgtgggacgggcaagggtttcacaaggtgcagggtggtcactacgtgaaacggcttgtcttggaaaaagttatgcacaaatgtggcaattaatgtactttcatagacgggatttgagattggccgcgaacgcgatatgctcagcggttccagtagattggatacccacttcgagaacaacatggagtattcacgcacatcatcaatggatgaccacagaagacatgctaagtgtttggaatagagtctggatcgaagaaaatccctggatggaggacaaaacgcacatatcaagctggggagacgtgccctacttaggcaagagagaagatcaatggtgtggaagtctaataggtcttacagccagggcaacatgggcaactaatatacaagtagcgataaatcaagtacgtcggctaatagggaacgaaaattatctagactacatgacatccatgaagagatttaaaaacgaatcagaccccgagggtgctctgtggtag

SEQ ID NO: 21816 - RNA, 9879 nt, synthetic construct
  misc_feature 1..9879: note = derived and/or modified CDS sequence (opt6) from DENV-1__JF937608__SS-prME
  source 1..9879: mol_type = other RNA
tccgttactatgttattgatgttaatgcccacggcgcttgcatttcatttaaccactcgtgggggagaaccacatatgatagtgtcgaaacaagaaagagggaaatcactcctttttaaaacttcagcaggggtgaacatgtgcactctaattgcaatggacctaggagaattgtgtgaagacacaatgacttacaaatgccccaggattactgaaaccgaaccagatgacgtagattgttggtgcaatgcaacagatacatgggttacatatggtacatgctcccaaactggcgagcaccgacgagataaaagatccgtagcattagcgccacacgtgggcttaggtctagagacacgtaccgaaacatggatgtctagcgaaggtgcatggaaacaaatacaaaaagtagaaacctgggcactgcgtcaccccggattcacggtaattgcactctttctagcacacgctatcggcacgtctatcactcaaaaagggataatttttattctattgatgcttgttacgccgtcgatggctatgcgctgtgtcggaataggttctagggacttcgtcgagggtttatctggcgcaacatgggtagatgtagttctagaacatgggagttgtgtcacaaccatggcgaaagacaaacccacactagatatcgaacttcttaaaactgaagttactaatcccgcaatcctaaggaaactgtgcatagaagcaaaaataagtaataccactacggattcccgttgcccaactcaaggcgaagcaacgcttgttgaggagcaagatgctaattttgtctgtagacggactttcgtggatcggggatggggcaatggatgtggactattcggtaaaggttctctaataacatgtgctaaattcaaatgtgtaactaaacttgaagggaaaatagtccaatatgaaaaccttaaatattccgtaattgtaacagtacacactggagatcagcatcaagtcggtaatgagtcaaccgaacacggaactacagccactattaccccgcaagcgccaacgactgaaatacaattaacagattatggtgcgctcacattagattgttccccaagaactggcttagacttcaatgaaatggttctgttgacaatgaaagaaaaatcatggttagttcacaaacaatggttcttggatctcccgctcccttggacatcaggcgcatcgacgtctcaagagacctggaaccgtcaagatttactggtgacttttaaaacagctcatgccaagaaacaagaagtggtcgtgttaggttctcaggaaggtgctatgcacaccgcactaactggtgctacagagatacagacatcaggtacaacgactatttttgcaggccacttaaaatgcaggcttaaaatggacaaacttactttaaaaggtatgtcatatgttatgtgtacaggatcttttaaattggagaaggaagtcgcagaaacacaacacggcacagtattggtacaaattaaatatgagggcacagatgctccttgtaagattccttttagcacacaagatgaaaagggtgtcacccaaaatggacgtctcattacagccaatcctatcgtaacagataaagaaaagcccgtaaatatagaagcagaaccaccatttggagaatcttatattgtcattggagcaggcgaaaaagcattaaaattgagttggtttaagaaaggtagttctatagggaaaatgtttgaggctacagctagaggggcaagacggatggcaatactcggtgatactgcttgggactttggtagtatcggaggagtgtttacaagtgtgggcaaactcgtacaccagatatttggaacagcatatggtgtactattctcaggcgtctcatggaccatgaaaattggcatcggtgtattattgacctggcttggattaaattccagatcaacgagtctgtccatgacatgtatagccgtagggctagtaacactatatctcggcgttatggtacaagcggactcggggtgcgtgataaattggaaaggacgagaactaaaatgtggttctggcatttttgtaacaaacgaagtccacacctggactgagcaatacaaattccaagcggattctccaaagagactgagtgcagcaattgggaaagcatgggaagaaggcgtctgcggaatacgaagtgctacaagattggagaatattatgtggaaacaaatttcgaacgaattaaatcacatattattagaaaacgacatgaagttcaccgttgttgtaggagacgtcgcaggtatcctcgcccagggaaagaaaatgatacgtccacagccgatggagtataagtattcctggaagtcatggggtaaagcaaagattatcggagctgatgttcaaaataccacatttataatagatggaccaaacactccagaatgtccagatgaccaaagagcatggaacatctgggaagtagaagactacggattcgggatttttaccaccaatatatggctaaagctgagggacagttatacacaggtttgtgaccatcggttgatgtcagcagcaataaaagacagtaaagccgtacacgccgacatgggctactggatagaatcagagaaaaatgagacatggaagctcgctagagcatctttcatagaagtgaaaacatgtatctggccgaagtctcacactttatggtcaaatggcgtactggaatctgaaatgattataccgaaaatttatggtggaccgatttcccagcataactatcgacctggttacttcacacaaacagcaggaccctggcatttgggaaagttggaactcgattttgatctatgtgaaggaacgacagtagttgtagacgaacattgcgggaacaggggaccaagccttaggactactactgtaactgggaagataatacacgaatggtgttgtagaagttgcacgctaccaccattacgatttcgaggagaagacgggtgttggtatgggatggaaatccgtccagttaaggaaaaagaagaaaatctcgttaaaagcatggtatccgcaggatctggtgaagtagactcatttagtctaggcctactatgtataagcataatgatagaggaagttatgaggagtagatggagcagaaaaatgctaatgacagggacattagctgtctttttattactaataatgggacagcttacatggaatgatctgataagactttgtattatggtaggggccaacgcaagtgatagaatgggcatgggaaccacctatctggcgcttatggctacatttaaaatgagaccaatgtttgccgtgggactgctctttcgaaggctaacctctagggaggtattgctattaacaataggattatcacttgtagcgtcagttgagttaccaaacagtttagaagaattgggagatggattagcaatgggtataatgatattaaaattgctaactgattttcaaagccatcagctatgggcaaccctgctatctctaacttttataaaaactacattttccttacattacgcatggaagaccatggcaatggtgttaagcattgtgtcattatttccattatgcttaagcactacaagtcaaaagaccacttggttgcctgttctacttgggagtctgggatgcaaaccccttacgatgttcctcatcgcagagaataaaatttggggtagaagatcctggccgctgaacgaaggcataatggcagtgggaattgtatctatcttattatcatccctgctaaagaatgacgtaccgttagccggtcctttaatagccggagggatgctaattgcctgttatgtcatatcgggaagttcagcagacctaagtttagaaaaagcagctgaagtatcctgggaagaggaagccgaacatagtggagcaagccataatatcttagtggaagtacaagacgacgggacaatgaaaattaaagatgaagaaagagatgatacattaacaatcctactaaaagcaacattattagctgtatcaggagtatatcctttatccataccagcaaccttatttgtgtggtatttttggcagaaaaagaaacaacgctcaggtgtgctatgggacacgccaagcccacctgaggtggaaagggcggttctagatgacggaatatacaggataatgcaaagaggactgttgggccgctctcaagtcggagtgggtgtctttcaagaaaacgttttccatacaatgtggcatgttactcgtggagcagtacttatgtatcaaggtaagagattagaaccgtcgtgggcatcggtcaagaaagatctaatttcatatgggggcggatggagactacaaggttcttggaacaccggagaagaagtacaagtaatagctgtagagcccggcaaaaaccctaaaaatgtacaaacaacaccagggacttttaaaactccagaaggtgaagttggcgccatagcattagatttcaagccaggcacgtctggaagtcctatagtaaatcgtgaaggaaagatagtgggactctacgggaatggcgtagtgacaactagcggcacgtacgtgagtgcaatagcacaggctaaagcctcacaagaggggcctttgcctgaaattgaagacgaggtattccgcaagagaaatctaacaattatggacttgcacccaggaagcggcaaaacgaggcgttatctacccgcgattgtaagggaagctataaagagaaagctacgaaccttgatccttgcaccaacaagggtagtagcatccgaaatggcggaagcacttaagggcatgccaataagataccaaaccactgcagttaaatcagaacacactggaaaggaaattgtagatttaatgtgtcatgcaacttttactatgcgcctactaagtccagtccgagtacctaattataacatgatcattatggacgaggcacattttactgacccaagcagtatagctgcaagaggctacatatcgacaagggtcggaatgggcgaagcggcagcaatatttatgaccgctacacctccaggatcggtagaagcctttccacagtcaaatgcagtgatacaagacgaagaacgcgacattcctgaacgcagctggaatagtggctatgaatggataacagacttcccaggaaaaacggtatggttcgtgccttcaataaaatcaggaaacgatatcgctaattgtctccgtaaaaatgggaagagggtaatccagctttctagaaaaacctttgatacggaataccagaaaactaaaaataatgactgggattatgtagtcactacagatattagcgaaatgggggctaattttagagcggatagagtaatcgacccaaggagatgtctaaaacctgtaattctaaaagacggcccagaaagagtaatcttagcaggtcctatgcctgttaccgtagcctcagctgcgcaaaggagaggacgaattggacgcaatcataacaaagagggtgatcaatatatatacatgggtcaaccccttaataatgacgaagaccacgcacattggactgaagcaaaaatgctcttggacaacattaacacaccggaaggtataataccagcactgttcgaaccggaacgagaaaaatctgcagcgatagacggagaatatagacttagaggagaggccagaaaaacatttgtcgaactgatgaggagaggggatttaccagtatggcttagctataaagtggcgagtgagggttttcagtactctgatagacgctggtgctttgatggggaacgtaacaatcaagtattggaagaaaatatggatgttgaaatctggacgaaagaaggggaaagaaagaaactcagaccaagatggttagatgctaggacctattctgacccattggcactgagagaatttaaagagttcgcagccggtcggcgatcagtgtccggcgatctcatactcgaaataggtaagttgccacaacacctaacacaaagggcccaaaatgcacttgacaatttagtaatgttacataattctgaacaagggggtcgggcatatagacatgcaatggaagaactacctgatacaattgagacactgatgttactggcactcatcgcagtacttactggaggcgtaaccttgttctttttaagtggtagaggattaggaaaaacaagtattggattgctatgcgtaatggcctcatctgttctcttgtggatggcatccgtcgaaccacactggattgcagcctctataatactcgagttcttcttaatggtattgttgatccccgagcccgatcggcaaagaacgccgcaagacaatcaactcgcttacgtcgtcataggattattatttatgattctaacagttgccgcaaatgaaatggggcttttggaaactacaaagaaggatcttggtataggacatgtagctgtagggaatcatcatcacgcagctatgttggatgtcgatcttcacccagcgtctgcatggacgttatatgcggttgcgacgacgataattacacccatgatgcgtcacacaatagaaaacaccacagcgaacattagcttgactgcaatagctaatcaagcagctatcttaatgggccttgataaaggatggccaataagcaagatggacattggggttccacttttagcattaggctgctactcccaagtaaatccgctcactttaaccgcggcagttttaatgttggttgcacattacgcaattataggtccaggtttacaagcaaaagcgacaagggaggctcagaaaaggaccgcggccggaattatgaaaaatcccaccgttgatggtatagtagccattgatctggacccagtagtatatgacgcaaagttcgagaaacaattagggcagataatgttattgattctttgcacctcacaaatattattaatgagaacaacttgggcgctctgtgaatctataacattggcaacgggaccactcacaacgctttgggagggatccccaggaaaattttggaacaccacaattgccgtatcaatggcaaacatttttcgcggaagttacctcgcgggtgctggtctagcattttcgctcatgaaatcactcggtggagggaggcgggggacaggcgctcagggggaaacactgggtgaaaaatggaaacggcagttaaatcaattgtccaagtctgaatttaacacttataaaagaagtgggattatggaagtcgatagatcagaagcgaaagaaggactcaagagaggcgaaacaacgaaacatgcggtaagtagaggcacagcaaaactaagatggttcgttgagagaaatttagtcaagcccgaaggaaaagtgatagacttgggatgtggacgaggcggatggtcctattattgtgcaggactaaagaaagtaactgaggtcaagggttacaccaaagggggtccgggtcatgaagaaccgatacccatggcaacatacggatggaatttagtcaaacttcactcaggaaaggatgtgttctttatacctcccgaaaaatgtgataccttattatgtgacataggagaaagctcgccgaatccaactatcgaggaagggagaacactacgcgttctgaaaatggtcgaaccttggctgagaggtaaccaattctgcatcaaaatactcaatccctatatgccctcagtcgtagaaaccctagaacaaatgcaacgaaaacacggtggcatgcttgtaagaaatcctttaagtcgtaattctacccatgagatgtactgggtttcatgtggaacaggaaacatagttagcgctgtcaatatgacgagtcgcatgttactcaatagattcacgatggcccaccgaaaacctacttatgaaagggatgtcgatcttggcgcggggacaagacatgtagcggtggagcccgaggtggccaatttagatataataggtcaacgaatagaaaacataaaacatgaacacaaatctacatggcattatgacgaagacaatccttacaaaacgtgggcctatcatgggtcttatgaagtaaaaccgtccggatccgcatcaagcatggtcaatggtgtagttaaactattaaccaaaccttgggatgtaattcctatggtaactcaaatagccatgacggatacaacaccatttgggcaacaacgagttttcaaagaaaaagttgacacccgtactccaaaagctaaacggggaacagctcaaataatggaagtaacagctaaatggctatggggtttcctttcacgaaacaagaaacccagaatatgcacccgtgaagagttcacgaggaaagttaggagtaatgctgctataggagctgtatttgtggacgaaaaccaatggaatagcgctaaagaagctgtagaggacgagaggttctgggacttagtacatagagaaagagaactccataaacagggaaaatgcgctacttgtgtctacaatatgatgggaaagagggaaaagaaactgggggagttcgggaaagctaaaggaagccgtgccatttggtacatgtggttaggggcaaggttcttagagtttgaggctttaggatttatgaatgaagaccactggttctcgagagaaaatagcttatcgggggtagaaggagagggtttgcataaactgggatatatcctcagggatatttcgaagattcctggagggaatatgtacgcagacgatactgcagggtgggatactaggataacagaagacgatcttcagaatgaagcaagaataacagatataatggagccagaacatgccttacttgccaagtccatcttcaaactaacatatcaaaataaagtggttcgggtgcaaaggccggccaaaaatggaacagttatggatgtaattagtcgaagggatcaaagaggtagcggacaagttggtacatacggtctaaatacctttacaaatatggaggcacaattaatccgccagatggaatcagaagggatatttagtccgtccgagctagaaacccccaaccttgctgagagagtactagattggttagagaaatacggagtagaacgtctaaaacggatggcaatatcgggtgacgactgcgtggtcaaacccatcgacgacagattcgccactgcgttaacagcactaaatgatatgggaaaggttaggaaagacattcctcaatgggaaccaagcaaagggtggaacgactggcagcaagtaccgttttgtagtcaccactttcaccaactaattatgaaagatgggagagagattgtagtaccctgtagaaaccaagatgaactcgtaggtagggctcgggtaagtcaaggagctggttggagcttacgagaaacagcctgcctaggaaagagctacgcacaaatgtggcagctgatgtattttcataggcgtgacctaaggctcgccgctaacgccatctgctccgcagtgccagtggactggattccaacatctagaaccacatggtccatacacgcacatcaccagtggatgacgactgaagatatgctatcggtgtggaatcgagtgtggattgaagaaaacccatggatggaagataaaactcatataagctcctggggcgatgtaccttatctgggtaaaagagaagatcaatggtgcggaagcctaataggactgacagctcgagccacatgggctacaaatatacaagttgcaataaaccaagtaaggaggctaattggtaatgaaaattatttagactacatgacaagtatgaaaaggtttaaaaatgaaagcgatccagaaggtgctttatggtga

SEQ ID NO: 21817 - RNA, 9879 nt, synthetic construct
  misc_feature 1..9879: note = derived and/or modified CDS sequence (opt6) from DENV-1__GU131739__SS-prME
  source 1..9879: mol_type = other RNA
agtgtaacaatgttactcatgttaatgccaaccgcattagcattccacctaacaacgagaggaggagaaccacatatgattgtttccaaacaagaaagaggaaaatctttactattcaaaacatcagcaggagtcaatatgtgtaccctaatagcgatggacttaggagaattgtgtgaagacacaatgacctataaatgtccgagaattacagaaactgaaccggatgacgtggactgctggtgtaatgcaacagacacgtgggtaacttacggtacatgctcacaaactggtgaacatcgaagagataaaagatccgtagctctcgcaccgcatgtaggactaggattagaaacccgaaccgagacatggatgtcgtcagaaggggcgtggaaacagattcaaagagtcgaaacatgggcgttaagacacccaggctttacggttattgctttatttttagctcacgcgataggaacaagtattacacaaaaagggataattttcatattactaatgctagtaacccctagtatggcaatgcgttgtgtgggtataggatcacgcgactttgtagagggactatcgggtgcaacatgggtagacgtggtattggaacacgggtcgtgcgttacaacaatggctaaagacaaaccaacattagacattgaacttctgaaaactgaagtaacaaatcccgccgttttacgtaaactctgtatagaagctaaaataagcaatactactacagacagtagatgtccaactcaaggggaagcgacgttggtagaagaacaagacgcaaatttcgtatgtcgcagaaccttcgtagatcgcggatggggcaatggctgcgggcttttcgggaaagggagtctaataacgtgtgccaaatttaaatgcgttacgaaattagaaggtaaaattgtacaatacgaaaatcttaaatatagcgtaatagtcactgtacatactggagaccaacatcaagtaggtaatgaatcaacggagcacgggacaactgctactataacaccacaagctccaactacggaaatacagctgacagattatggtgccctcacactagactgcagtcccaggactggactcgattttaacgagatggtccttctcactatgaaagaaaaatcatggttagtgcataaacaatggtttctggacttaccgcttccttggacgagtggggcctccacctcacaggagacgtggaatagacaagatttattagtgacattcaaaactgcacatgccaagaaacaagaagttgtcgtcttaggttcccaagaaggagctatgcacaccgccttaacaggagcaactgagatacaaacgtctgggaccacaaccatcttcgcaggtcatttaaaatgtcgtctaaaaatggataaattaactttaaaaggaatgtcgtacgtcatgtgtacaggtagttttaaattagagaaagaacttgctgaaacacaacacggaactgtgctcgtacaaattaaatacgagggtaccgacgcaccgtgtaagattccgttttccacacaagatgagaaaggggtgacacaaaatggccgtttaataacagccaacccaatagtgacggataaggaaaagcctgtcaatattgaagctgaaccaccttttggtgaatcttacattgtaattggtgccggtgaaaaagcactaaaattgagttggtttaaaaagggctctagcataggaaaaatgtttgaagccactgctagaggtgcgagacgtatggccattttgggcgacacggcatgggattttggatcgataggaggagtgtttacatcagttgggaaacttgttcaccagatattcgggacggcgtatggggtactattttcaggagttagctggaccatgaagatcggtataggagttttactaacctggctcggtcttaacagtagatcgacaagcctatcaatgacatgtatcgccgttggtctcgtaaccctatatctgggagtcatggtacaggctgactcgggatgcgtaattaactggaaaggtagggagttgaaatgtggatcaggaatatttgtaactaacgaggtacatacctggacagaacaatataagtttcaggcagattccccgaaacggcttagtgctgccatcggaaaggcttgggaagaaggtgtgtgcggaatcagaagtgctactagactcgaaaacataatgtggaaacaaatttcaaacgaacttaaccacatacttctagaaaatgacatgaaatttacagtggttgtcggtgatgtagcgggtatcttagctcaaggtaagaaaatgattagaccacaaccaatggaatacaagtattcgtggaaatcgtggggcaaggctaagataatcggggcagacgtacaaaacactaccttcattatcgatggccccaatacacccgaatgtccagacgatcagagggcctggaatatatgggaagtggaggactatggtttcgggatatttactactaatatatggctaaaattaagagatagctatacacaagtttgcgaccaccgacttatgtccgctgcaataaaggattctaaagcagtgcatgccgatatgggttactggatcgagtcggaaaagaacgaaacatggaaactagcgagagcatcttttattgaagttaaaacatgcatatggccaaaatctcacactctctggagcaatggagtactagaaagtgaaatgattattcctaaaatatatggcggacctatttcacaacacaactaccgtccaggttattttacccagacagctggcccgtggcatttaggcaaattggagttagactttgacttatgtgaaggaacgacagtggttgtagacgaacactgtggaaatcgcggtccatcgctcaggactacaacggtcacaggaaaaataattcacgaatggtgctgcagaagctgtacccttcctcctttgagatttcgaggagaagatggctgctggtatggcatggagatccgtcctgtaaaagagaaagaggaaaatcttgtgaaatcaatggtaagtgccggcagtggagaggtcgactcattctctctgggattgctatgcatctctatcatgatagaggaagtaatgcgatcaagatggagccgaaaaatgcttatgacaggtactcttgctgtcttctttctactaattatgggacagctcacatggaacgatcttatcagactgtgcattatggtaggagctaatgcatcagatcggatgggtatgggaactacctatctagcacttatggctacattcaaaatgcgaccaatgtttgcggtcggattactattccgccggctaacatcaagagaggtactattactaactatcgggctatcattggtggcatcggtcgaacttcctaattcgttagaggagttaggagatggcttagcaatgggcataatgatattaaaactactcacagattttcaaagtcaccaattatgggcaacacttttatcactaaccttcataaaaacaacttttagtttacattatgcatggaaaacaatggcgatggtcttaagtatcgtctcattatttccgttgtgtttatcaactacttcgcagaaaactacttggttaccagtactactcggttcattgggatgcaaaccattgacgatgtttttaatagcagagaataaaatctggggaaggcgcagctggccgctcaatgaaggcataatggcagtaggtatagtgtcaattcttctttcctcgttactaaagaacgatgtacctctagctggaccattgatagccggaggaatgttgattgcatgttatgtgataagtgggtcaagtgctgacttgagcttagaaaaagccgcagaggtgtcttgggaagaagaggcagaacatagcggagcatcccataatatcctagttgaagtccaagacgatggaacgatgaaaattaaagacgaggaacgtgatgatacgcctacaatactgctcaaagcaaccctgctagcagttagtggcgtataccctctaagcatacccgccacattgtttgtttggtatttttggcagaagaagaaacaacgttctggggttttgtgggatactccttctcccccagaggttgaacgcgcggtacttgatgacggaatttacagaatcatgcagcgtggcctcttaggaagatctcaagtaggagttggtgtcttccaagaaaatgtttttcatacgatgtggcacgtcacaagaggagcagtactcatgtatcaggggaaacgattagagccaagttgggcctctgtcaagaaagatttaatatcctatgggggtggatggagattgcagggatcatggaatacgggagaggaggtgcaggtcatagcagtagagccgggcaaaaatccgaaaaatgtgcaaacagctccaggaacttttaaaactcctgagggagaggttggcgcaatcgcgctggacttcaaaccaggaacatcagggagtccaatagtaaaccgagaaggaaaaatagtagggttatatggaaatggggtcgtcacaacttcgggaacatatgtcagtgcgattgcccaagcaaaggcttcgcaagaaggaccgttacctgaaattgaagatgaagtttttagaaagcggaatctaactattatggatttacatccaggttcgggtaagacaagaagatatttacccgcaatagtgagagaagctattaaaaggaagctacgtacgttgattttagcccctacacgtgtagttgcatcagaaatggcagaggctttgaaaggaatgccgataagataccagacaacagctgtaaaatccgaacatactggtaaggaaatagtagatttaatgtgccatgcaacttttaccatgaggttactgagccccgttcgggtacctaattacaatatgataataatggacgaagctcactttactgatccttcttcaatcgccgcacgcggctacatttcaaccagggttgggatgggcgaagcagctgccatcttcatgacagcgacaccaccaggttcagtagaggcttttccgcagagtaatgccgttattcaagacgaagaaagagatattcctgaaagaagttggaatagtggttacgaatggattacagactttccaggaaagactgtttggtttgttccgagcatcaagagtgggaatgatattgctaattgcctcaggaaaaatgggaaacgcgtgatccaattatctagaaaaacctttgatacggaataccaaaagaccaaaaataatgattgggattacgtagtaaccacggatataagcgaaatgggagcaaatttcagagctgacagagtaatagacccacgaagatgtctcaagccagttatcctcaaagatggtccagaaagagtaatattggccggtcccatgccagtcacagtcgcaagcgcagcacaacgaagaggaaggatagggcgaaatcataataaggaaggagatcaatatatttatatgggacaaccactaaataacgatgaagatcatgcacactggactgaagcaaaaatgctcctagataacataaatactccagaaggcatcattccagctttatttgagcccgaacgggagaaatctgctgctatcgatggagaataccgattaagaggagaagctagaaaaacgttcgtggagctgatgagaaggggtgatttgccggtatggctgagttataaggtagcatctgaaggttttcaatattctgacagaagatggtgcttcgatggagaacgaaacaaccaagtgttagaagaaaatatggacgttgagatatggacaaaggaaggagaaaggaagaaactccgtccaaggtggctcgatgccagaacttattcggacccactagctttaagggagttcaaagaatttgcagctggacgaagatcggtttccggggatttgatcttagaaatcggtaaattaccacaacacctaacacaacgtgcacagaacgcgttagataacttagttatgttgcataactcagagcaaggaggacgtgcgtaccgccacgcaatggaagaactccctgatacaatagaaactcttatgttattagcattaattgctgtgttgacaggcggggtcacactatttttcttaagtggccgcgggttaggaaagacaagtataggattgctatgcgtaatggcttctagtgtactattatggatggcatcagtagaaccacattggatagcagcgagtataattctcgaatttttcttgatggttctcctaatacctgaaccggatcgccagaggacgccacaagacaatcaattagcttatgtggtaatcggactcttgtttatgatattaacagtagcggcaaatgaaatgggtttgttagaaaccactaaaaaggacctaggaataggacacgtggccgtcgaaaaccatcaccatgcagcgatgttagatgttgatctgcaccccgcaagtgcatggactctttatgcagtagccactactataattacaccaatgatgcgtcatactatagaaaacacaactgcaaatatttcattgacagccatcgcaaatcaggcagcaatattaatgggcttagataaaggatggccgatcagtaagatggacatcggagtgccattgttggcgttgggctgttacagtcaagtaaatcccttaaccttgacagccgcagtacttatgctagtagctcactatgctatcatcggaccaggtttacaagccaaagctacaagagaagcacaaaagaggacggcagcggggattatgaagaatccgaccgttgatggaatcgtcgcaattgatttagacccagtagtgtacgacgctaagtttgaaaaacagctggggcaaataatgttgctgatactgtgcacttcgcaaattctactaatgagaactacttgggctctttgcgaatcaatcaccctagcaactggacccctcacaacgctgtgggagggatctccgggaaaattctggaataccactatcgccgtatctatggccaacatatttagaggatcttacttagccggtgcgggattagcgttctcgcttatgaaaagccttggcggaggcagacgtggtacgggagctcaaggtgagacattgggggaaaaatggaaacgccaacttaaccagctatcgaaaagtgagttcaacacttacaaaagatcaggtataatggaagtagacaggtcagaggccaaagaaggactaaaaaggggtgagactacaaaacacgccgttagcagagggactgccaaactccgatggttcgtcgagaggaatctagtaaaacctgaaggtaaagtaatagacttagggtgtggaagaggtggatggagctattattgcgctggcctaaagaaagtcactgaggtaaaaggatacactaaaggaggacccggacacgaagaaccgatacctatggcaacatacgggtggaacctagttaaactacactctggcaaggacgtcttcttcatcccacccgaaaaatgtgacacattactatgcgacataggagaatcatcaccaaatcccacaatagaagagggaagaaccctacgagtgctgaaaatggtagaaccatggctgcgaggcaatcaattttgtattaaaattttaaacccctatatgccctcagtagttgaaacattggaacagatgcaacggaaacacggaggaatgttagtaaggaaccctttatccagaaactctacacacgaaatgtattgggttagttgtggaacaggcaatatcgtctcagctgttaacatgacttcaagaatgttgctaaatagatttacaatggcccatcgaaaacctacatacgaacgagacgtagatctaggtgcgggaactaggcacgtagctgtggaacctgaagtcgctaacttggatataataggacaacgtattgaaaacattaaacatgaacataaatcaacgtggcattacgatgaagacaatccctataaaacatgggcataccacggatcttacgaagtaaaaccatcagggtcagcttcttctatggttaatggggtggtgaaattactaacaaaaccttgggatgttatccctatggtgacgcagatagcaatgacagatactacaccatttggccagcaaagagtatttaaggaaaaagtagatacacggacaccgaaagcgaaaaggggtacagctcaaataatggaggtaacagctaagtggctctggggattcttatccagaaacaagaaaccgagaatttgtacaagggaagaatttacgagaaaggtaagatctaacgccgcaatcggcgctgtatttgtagatgagaatcagtggaactcagcgaaggaagcagtcgaggacgagagattttgggaccttgtgcatcgtgagagagagttacataaacaaggaaagtgtgctacatgcgtatacaacatgatgggaaaaagagagaagaaactgggcgaatttggaaaggcaaaaggttctagggcaatctggtacatgtggttgggagcacgatttcttgaatttgaagcactgggcttcatgaacgaagaccattggtttagcagagaaaactcattatcaggagtcgaaggagaagggctacacaaattaggctatattcttagagacatttccaagatacctgggggcaatatgtacgcagacgacacagcaggctgggacactcgaataacggaagatgatttacaaaatgaagcaagaattacagacattatggaacctgaacacgccttgttagccaaaagcatcttcaaattaacctatcaaaataaggtagtgagagtacaaagacccgccaaaaatggtacggttatggatgttatatccagacgcgatcaacgcggttcaggacaggtaggaacctatggattaaatacctttaccaatatggaggcccaactgataagacaaatggaatcagaaggcatcttttctccctctgaactagaaactccaaatctggcagagcgagtactagattggttagaaaaatatggtgttgaacgcttgaaacgaatggctatatccggtgacgattgtgtagtaaagccgatagatgacagatttgcaacagctctaactgcactcaatgacatgggcaaagtaagaaaagacattccgcaatgggaaccctccaagggatggaatgattggcaacaggtgcctttctgttcccatcattttcaccaattaataatgaaagacggtcgtgaaatagtagtaccttgtagaaatcaggacgagttagtaggacgtgcacgagtgagtcaaggcgcaggatggtcacttcgggaaaccgcttgtctaggcaaaagttatgcccagatgtggcaattaatgtattttcaccgacgtgatttgcgtttagcagctaacgcgatatgctcagcagtaccagtagattggatacccacgtcaagaacaacttggtcgatccacgctcatcatcaatggatgacaacggaagatatgcttagcgtctggaacagggtatggatagaggaaaatccgtggatggaagataaaacacacatcagttcctggggtgacgtcccatacctaggtaaacgtgaagatcaatggtgcggctcactgattgggttgaccgcaagggccacctgggcaactaacattcaagtagcaattaatcaagtgagacgtttgatcggaaatgaaaattatttagattacatgacgtcaatgaaacgctttaaaaatgaaagcgatccggagggagccttatggtga

SEQ ID NO: 21818 - RNA, 9879 nt, synthetic construct
  misc_feature 1..9879: note = derived and/or modified CDS sequence (opt6) from DENV-1__GU131740__SS-prME
  source 1..9879: mol_type = other RNA
agtgtaactatgttgttaatgctgatgcctacggcactagcatttcacctaactacacgtgggggtgaaccacacatgatagtttccaaacaagaaagggggaaaagtttgcttttcaaaacttctgcaggagttaatatgtgtacactcattgcaatggacttaggagaattttgcgaagatacaatgacctacaaatgtccaagaattaccgaagcggaacctgatgacgtagattgttggtgtaatgcaacagatacatgggtaacatacggaacttgtagtcagacaggagaacacagacgagacaaaaggtcagttgccttagccccgcacgttggattaggattagaaacaagaacggaaacctggatgtcctcagaaggtgcatggaaacaaatccaaagggtcgaaacatgggctctacgacatcccgggttcactgtcattgcactattcttagcacatgccattggaaccagtattacacaaaaaggaataatattcatattactaatgctcgtgacccctagcatggctatgcgctgtgtaggtattggaagtcgcgacttcgttgaaggattatcaggtgcaacttgggtggacgttgttttagaacacggatcctgtgtaaccacgatggccaaagataaaccaaccctagatattgaattacttaaaaccgaagtgacaaatccagcggtgcttaggaaattatgcatcgaagcaaagattagtaacaccacaacagattcaaggtgtccaacacaaggagaagcaactctagttgaagaacaagatgccaacttcgtatgccgtagaacttttgtcgatcggggatggggtaacggttgcggcctatttggaaaagggtctctaataacttgcgcaaaattcaaatgcgtcacgaaattggaaggtaagaccgtgcagtatgaaaacttaaaatatagcgtgatcgtgactgtccatacgggagaccagcatcaagtaggaaacgaaagcaccgaacacggaactactgcaacaatcacaccacaggccccatcaactgaaattcaactaaccgactatggagcccttaccctggattgctcgccaaggacgggtctagattttaacgaaatggttctgctcaccatgaaagagaaaagctggttagttcataaacaatggtttttggatctccctttaccttggacctccggggcaagtacaagtcaagaaacgtggaaccgaaaggatctcctagttacttttaaaacagcacatgccaagaaacaagaagtagtagtattaggaagccaggaaggagcgatgcatactgcactcacgggagcaacggaaatacaaacaagcggtacgacaacaatattcgcagggcatcttaaatgccgactaaaaatggataagttaaccctgaaaggcatgagctatgttatgtgtaccgggagctttaaacttgaaaaagaggttgcagagactcagcatggaacagtccttgtacaaattaaatacgaaggaacagacgttccatgcaaaattcccttctcaacgcaggatgagaagggagtaacgcaaaacggtcgtctaataacagcgaaccccatagtcactgacaaagaaaaaccagtaaatatcgaagcagaacctccattcggggaaagttatattgtcataggggctggcgaaaaagccttaaagctatcatggttcaagaaaggatcatcaatcggaaaaatgtttgaagccactgcaagaggtgccagacggatggcaatactaggagatactgcatgggatttcggcagcattggtggagtattcacctctgttggaaagctggtacatcagatattcggaacagcatatggcgttttgtttagcggagtaagttggactatgaaaatcggcatcggagtattgttaacatggctaggattaaatagtcggagtacaagtttatccatgacttgtatcgcggtcgggttagtgacgttgtatttaggtgtgatggtacaagcggacagcggatgcgtcataaactggaaaggccgggaattaaaatgtggaagtgggatattcgtaactaatgaagtacatacttggaccgagcaatataagttccaagctgattccccaaaacgcttatcagccgctattggcaaagcgtgggaagagggagtatgtggaatccgatctgcgactaggctggagaacatcatgtggaaacagataagcaatgaattaaaccatatattattggagaatgatatgaagttcacggttgtagtaggcgacgtagcaggcatactagcacaggggaagaaaatgataagaccacaaccaatggaatacaaatacagctggaaatcctggggtaaagctaaaataattggtgcagatgtacagaatacaacttttataattgatggacccaataccccagaatgtccagacgatcaaagagcctggaatatatgggaggtagaagattacggattcggtatctttactactaatatatggctgaaactaagagattcatatactcaggtatgtgatcatagattgatgtcagcagcaattaaggattcaaaagcggttcatgctgatatggggtactggatagaatccgagaaaaatgaaacatggaaattagcaagagcatcatttatagaggtcaaaacttgtatttggcctaagtcacatacgctttggtctaatggggtattagaatcagaaatgatcataccgaaaatatatggcggtccaatatcacaacacaattatagacctggatatttcacgcagacggctggaccatggcaccttgggaagttagaacttgacttcgatttatgtgaagggacaactgtggtagtcgatgaacattgtggcaatagaggtccaagtctgagaacaactacagtaacaggtaagataatacacgaatggtgctgtagaagctgtactttgcctccgcttcgatttaaaggcgaagatgggtgctggtacggaatggagattagaccagtaaaagaaaaggaagagaatctagtcaaaagtatggttagtgcgggtagcggtgaagtagatagttttagcttgggtctattatgtatctcaattatgatcgaggaagtcatgcgttctcgatggtcacgaaaaatgttaatgacagggacgttagcagtctttttcctgcttataatgggacaattaacatggaatgacctgatacgactatgtataatggtgggtgctaacgcatctgaccgcatgggaatgggtactacgtatctcgcactcatggcaaccttcaaaatgaggcctatgtttgcggtgggtcttttatttagacgcctaacgagtcgcgaagtcttactcttgacgatcggtttgtcattagttgcttcagtcgagttaccgaacagtcttgaagagttaggtgacggattagcaatgggcataatgattctaaaattactaactgatttccagtcacaccagctctgggcaactttactcagcttcacatttataaagaccacatttagtttacactatgcgtggaagactatggctatggtgttgagtatagtttcattattcccactatgtttaagcaccacatcacagaaaactacttggttaccagtgctccttggcagcttaggctgtaaaccattaacaatgtttttaatagccgaaaataaggtatggggacggaaatcttggccactaaatgaaggtataatggcagtaggaattgtttcaatactcctaagttctttactcaaaaacgatgtacctcttgcaggaccactaatagcaggcggtatgttaatagcttgctatgtcataagcgggagttccgcagacctatctctggaaaaagctgccgaagtatcatgggaagaggaagccgaacatagtggggcatcgcataatattcttgtcgaagtacaagacgacgggacaatgaaaataaaagatgaagaacgagacgacactttaacaatattacttaaggccacattattggcagtttccggggtatatccgctgtccatacccgcaacactcttcgtatggtatttttggcaaaagaagaaacaacgaagcggcgtgttatgggataccccgtcccctcctgaggtcgagcgagcagtcttggacgacggtatctatagaatcatgcaaagaggcctcctaggtagaagtcaagtgggagtaggggtttttcaagagaatgtatttcatacaatgtggcacgtcacaagaggagcagtgcttatgtaccaggggaaaaggttagaaccctcatgggcaagtgtcaagaaagacttaatttcatacgggggaggctggagattacaaggatcatggaataccggagaagaagtacaggtcatcgccgtagaaccaggcaaaaatcccaaaaatgtacaaacagcgcctggcaccttcaaaacgagcgagggggaggtaggagcgatcgctcttgacttcaaaccaggaactagcgggtccccgatcgttaaccgagagggaaaaatagtaggattgtacggaaacggtgtagtgaccacgtcaggaacatatgtatccgccatcgcccaagcaaaagccagccaggaaggacctttacccgaaatagaagatgaagtgttccgaaaaagaaatctcacgataatggacttacatcctggtagcggaaaaaccagaagataccttccagcgatagtcagagaagccataaaaagaaagttacgaacgttgatattagcccctacaagagtagtagcatccgagatggcagaagctctaaagggaatgccaatccgctatcagacaaccgcggtaaaaagcgagcacacaggaaaagaaatcgtagaccttatgtgccatgctactttcactatgagacttttatctccagtgagagtgccgaattataatatgataataatggatgaagcccattttacagacccatcatccatagcagctcgtggttatatctcaacgagagtggggatgggcgaggctgccgcgatatttatgaccgccacgccaccgggaagcatggaagcgttcccacaatcaaatgcggtgatacaggacgaggaacgggacatacctgaaagatcgtggaatagtggctacgagtggattacagactttccagggaagacagtatggttcgtaccaagtataaaatccggcaacgatattgcaaattgcttaaggaagaacggtaaacgtgtaatccaattatcaaggaaaacattcgatactgaatatcagaaaacgaagaataatgattgggattatgttgtcacgacagatattagcgaaatgggtgcgaacttcagagccgatcgagtaattgatccacggagatgcctcaaaccggtcattctaaaagatggcccagagcgggtaatcttagcaggacctatgccggtcactgtggcgtcggcggcacaacgtcggggtaggataggtcggaatcataacaaagaaggggatcaatatatttacatgggccaacctttaaataatgatgaagatcacgctcactggacagaggcaaaaatgttacttgataacataaacaccccagaaggaattattccagcgttatttgaaccagagagggagaaaagcgcagctatagacggcgaataccgcttacggggcgaagcaaggaagacatttgtagaattaatgcgtagaggggacctaccagtctggctcagttataaagtagcttcggagggtttccaatactccgaccgaaggtggtgcttcgatggagagaggaataatcaggttctagaagaaaacatggatgtagaaatatggacgaaagagggggagagaaagaaactaagacctaggtggctagacgctagaacatactctgaccccctcgcactacgcgagtttaaagagtttgccgcgggcagacgatcggtaagtggggatttaatactcgaaataggcaaacttccacagcacctgacacaacgagctcagaatgccctagataatcttgtgatgctgcacaattctgagcaagggggcagagcgtacagacacgcgatggaagaactacccgacactatagaaacattaatgctattagcattaatagctgtccttacaggtggagtaaccctattctttctatcgggtagaggtttgggaaaaacatctatcggattactatgcgtaatggcctcttccgtcttattatggatggcctcagtcgaaccccattggatagcagcgtcaataatactggagttcttcttaatggtactgttaattccagagcctgaccgtcagcggacaccacaagacaaccaactggcatatgtcgtgataggtttactattcatgatactcacagtagcagctaatgagatgggtttattagaaactactaagaaagacctcgggatagggcacgcggcagtagagaatcaccatcatgcagcgatgttagacgttgatctacacccagcatccgcatggaccttgtatgcagtagctactacgataataacaccgatgatgcgacacactattgaaaacactactgccaatatttccctaactgccatagcaaaccaggccgctattttgatgggacttgacaaagggtggccaataagcaaaatggacataggtgttccattacttgcactgggatgctactcgcaagtcaatccattaacattaacggccgcagtattgatgttggttgcgcattatgcaataataggaccagggttacaagcgaaagcaactcgtgaagctcaaaaacgaacagcggccggtatcatgaaaaacccaaccgtcgacggtattgtggcgatagacctagaccctgtcgtttatgatgcaaaattcgaaaagcaattaggtcaaataatgctacttattctttgtacatcgcagatacttctaatgcgtactacttgggcgctctgcgaaagcattactttggccactggaccattaactactttatgggaaggtagcccgggaaaattttggaatactactatagcagtgagcatggctaatatatttagaggtagctatcttgctggtgcgggtctggcttttagtttaatgaaatcactcggcggaggcagaaggggaacaggagcacaaggagaaaccttgggagagaaatggaaaagacaacttaatcaattgagcaaatcagagttcaatacatacaaacgttccggaatcatggaagtagaccgatcagaagccaaagaggggttgaaacgtggagaaactaccaaacatgctgtgtcaagaggcacagcaaaactccgatggtttgttgaacgtaatctagttaaacccgaaggtaaagtgattgacttaggatgtggaagaggcggttggtcatattactgtgcagggttaaagaaagtgacagaagtaaaagggtacacaaaaggtggaccggggcatgaagaacccataccaatggcaacttacggttggaatttggttaaactgcactccggaaaagacgtattctttattcccccggaaaaatgtgatacactcttatgtgatataggcgagagttctccaaatccaactatagaggaaggcagaaccttacgcgtattgaagatggtagaaccgtggttgagaggaaaccaattttgtattaaaatactcaatccatatatgccttctgtagttgaaacattagagcaaatgcaaaggaagcatggcggcatgttagtccggaatcccttatctagaaattccacccacgaaatgtactgggtaagttgcggcacaggaaatatagtaagcgcagtcaacatgacgtcaagaatgctacttaatcgcttcaccatggcacacaggaaaccgacatacgaacgtgatgtagacttaggagcaggtacaagacatgttgccgttgaaccagaagtagcaaatttagacataatcggtcagagaatagaaaatataaagcatgaacacaaatcaacttggcattacgacgaggacaatccttacaaaacttgggcgtatcacggatcatatgaagtcaaacccagtggtagtgcatcttcgatggtaaatggagtggtcaaactgttaacgaaaccatgggatgttatacctatggtaacccagatagcgatgactgacacaacgccattcgggcagcaacgggttttcaaagagaaggttgatactagaacccctaaggccaagagaggaacggctcaaataatggaggtaacagcaaagtggctctgggggtttctttcaagaaacaaaaagcctcgaatttgcacaagagaggagtttacacgtaaagtaaggtctaatgccgcaataggcgctgtattcgtagacgagaatcaatggaactctgcaaaagaagcagttgaggacgaacgtttttgggatctcgttcatcgtgagagggaactccataaacagggtaaatgcgccacatgtgtgtacaacatgatgggtaaaagagaaaagaaactaggagagttcggaaaagctaaaggttcacgcgccatttggtatatgtggttaggtgccagattcttagagttcgaagcattaggcttcatgaatgaggaccactggttctcacgggagaactctctaagcggagtggagggagaaggattacataaactagggtatattttacgagacatctcaaaaatcccgggaggtaatatgtacgccgatgacactgctggatgggacaccaggattacagaggatgatttacaaaatgaagcaaaaattacggacataatggaaccggagcatgctctattagccaaatccatcttcaaattgacgtatcagaataaggttgtaagggtacaaagaccagccaaaaatgggacagtaatggatgtcataagcagaagagatcaaagaggttctggtcaagtaggtacttatggcctaaacacttttacgaatatggaagctcaattgatacggcaaatggaatccgaaggaatcttctcaccttcagaactagaaactccgaatttagccggtcgggttttagactggctggaaaaacatggtgttgaacgcctaaagcgaatggcaatctcaggagacgattgtgtcgtaaagccaatagatgatagattcgcgacagcattaactgcactcaatgacatgggtaaagtaagaaaagacattccccaatgggagccatcaaaaggatggaatgactggcaacaagtgccattttgctcacatcactttcatcagttaataatgaaagatggcagagaaatcgttgtaccttgcagaaatcaagacgagctagtgggacgtgcaagagtaagtcagggagcaggatggtcacttagagaaacagcctgtctgggtaaatcatatgcacagatgtggcaattaatgtattttcacagaagagatttaagacttgctgctaatgcaatctgcagtgccgtcccagttgattgggtgcctacatcaaggacaacttggagtatacatgcacatcatcaatggatgaccactgaggacatgctgtccgtatggaatagagtatggatagaggaaaacccatggatggaggacaaaacacatatctcatcgtggggagacgttccgtatctaggtaaacgagaggatcaatggtgtggatcacttataggactaactgccagagctacatgggctactaatatccaagttgccataaaccaggtacgacggttaataggcaatgaaaattatctggattatatgacgagcatgaaacgattcaagaacgaatcagatcccgaaggggcgctttggtaa

SEQ ID NO: 21819 - RNA, 9879 nt, synthetic construct
  misc_feature 1..9879: note = derived and/or modified CDS sequence (opt6) from DENV-1__GU131741__SS-prME
  source 1..9879: mol_type = other RNA
tcggtaactatgcttctaatgttaatgccaacggccctagcatttcatttgactacccgtggaggtgaaccacacatgatagtttctaaacaagagagaggaaaaagtctattatttaaaaccagtgctggagttaatatgtgtactctaatcgctatggatctaggagaattttgtgaagatacaatgacgtacaaatgtccgagaattacagaagctgaaccggatgacgtagactgttggtgtaatgcaacagatacctgggttacttacggaacatgctcacaaactggggaacatcgcagggacaaacgatccgtagctctagcacctcatgtaggattagggttagaaacgaggacagaaacatggatgagtagcgaaggtgcctggaagcaaattcaaagagttgaaacctgggcattgcgacatcccgggtttactgtgattgcactgtttttagcacacgcgattggaacatcgatcacacaaaaaggcataatttttattttgctcatgttagttacaccaagcatggctatgagatgtgtaggaataggcagcagagattttgtagaaggtctgtccggagccacgtgggtagatgtggttttagagcacggcagctgtgttacaacgatggcgaaggacaagccaacactagatattgaattactcaaaacagaagtgaccaatcctgcagttctaaggaaactatgtattgaagctaaaatatcaaataccacaactgattcgagatgtccaacccaaggagaagcgacgttggtggaagaacaagatgcgaattttgtttgtaggcgtacttttgtcgatcgaggatggggaaatggatgtgggcttttcggaaaaggttcgttaataacatgtgccaaatttaagtgtgtgactaaacttgagggtaaaatagttcaatatgaaaatctaaagtacagcgtgattgtcactgtccatactggagaccaacatcaagtaggaaacgaatctacagaacacggtacaacagccaccataacaccacaagctcctagtacagaaatccaactcacggactacggagccttaaccttggattgttctcccagaaccggcctagacttcaacgaaatggtcctactgacgatgaaggaaaagtcctggttagtacacaaacagtggtttctagatttacctttaccatggacaagtggagtaagtacgtcacaagaaacatggaataggaaagatctattagtaactttcaaaacagctcatgctaagaaacaggaagttgttgtattaggaagccaagaaggggcaatgcatactgcacttacgggagccacagaaatccaaacaagcggaactaccacaattttcgcaggacaccttaaatgtcgcctaaagatggacaaactcactttgaaaggaatgtcatacgttatgtgcaccggtagcttcaagttagagaaagaagtcgctgaaacccaacatggtacagtgctggttcaaattaaatatgaaggtacagacgccccatgcaaaatccctttttccacgcaagacgagaaaggcgttacacaaaatggaagattaataacagcaaacccgatagtaacagataaagaaaagccagttaacattgaagcagaaccacccttcggagagtcgtatatcgtcatcggtgctggtgaaaaggctttgaaattaagctggttcaagaaaggatcaagtataggcaagatgtttgaagccacagctcgtggggcgcggagaatggccatactaggtgatacagcgtgggacttcgggtcaataggaggagtgttcacttcggtaggaaagctagttcaccaaatctttggcacggcttacggtgtgctattttcaggggtgtcttggacaatgaaaattggtataggagtattacttacatggctaggtttaaatagtagaagcacatcattgtcgatgacatgcatcgctgtgggcctggtaacgttgtatttgggtgtgatggtgcaggccgactcgggctgtgtcataaattggaaaggccgggagctcaagtgtggttccggaatctttgttacaaatgaagtccatacatggaccgaacaatacaagttccaggcagattctcctaaacgtcttagtgctgccattggcaaagcatgggaagaaggagtttgtggaatacgaagtgctacaaggctagagaacataatgtggaagcagatttcgaacgagttgaatcacatactattggaaaacgatatgaaatttacggtagtcgtaggagacgtagcaggcatactggcacaaggcaagaaaatgatacgtcctcaaccaatggagtacaaatactcatggaaatcttggggaaaagcaaaaataataggagcggatgtgcaaaatacgacctttataatagacggacccaacactccagagtgcccagatgatcaaagggcatggaacatttgggaggtagaagattatggatttgggatctttactactaacatatggttaaagctacgtgactcatacacccaggtatgtgatcatcggctcatgagtgctgccataaaagacagtaaagcggtacacgccgacatgggatattggatagagagcgagaagaacgagacttggaaacttgctagagcatcatttattgaagttaaaacgtgcatttggccgaaatcacatactttatggtcaaatggggtattagaatctgaaatgataattcctaaaatctacggagggccaatttcccaacacaattaccgacccggatactttacacaaacagcaggaccttggcatctggggaaactcgagctagactttgatttatgtgaagggacaacagtagtagtcgatgaacattgcggaaatcgcggaccaagtttaagaacaacgacggttacaggtaaaataattcatgaatggtgttgtaggtcttgcacactgccgccattacgtttcaaaggggaggatggatgttggtacggcatggaaattagaccagtaaaagaaaaggaagaaaacctagttaagtcaatggtttcagccggaagtggggaggttgatagcttctctctgggactcctatgtatatcgattatgatagaagaagtaatgcgatcccgttggtcgagaaaaatgcttatgacaggcacactcgcagtattctttctcctaataatgggacaattaacgtggaatgatctaattcgactatgtataatggtcggagcaaatgcatcagacaggatgggtatgggcaccacgtacttagctttgatggcgacttttaaaatgaggccaatgtttgccgttggtctattgtttcgacgcctaacatcaagagaggttttactgttaacaataggactcagccttgtggcaagtgttgaattaccgaacagtctagaagaactgggtgatggtttagccatgggaataatgattctaaagttgctcacggatttccaatcacatcagctctgggcgactctccttagcctaacatttatcaagactacattctcactccactatgcatggaaaactatggccatggttttatctatagtgagcctattccctttgtgtttatcaaccacgtctcagaagactacatggttacctgttctgttaggatcactaggatgtaagcctctcacaatgttcctcatagccgaaaataaaatatggggtagaaagtcttggccgttgaatgaaggaatcatggcagtaggaatagtctcaatcctattaagctctttactcaaaaatgacgtgccgttagctggacctcttatagctggaggcatgctgattgcttgttacgtcatttccggttcatcagcagacttaagtcttgaaaaagccgcagaagtctcctgggaagaagaagctgaacactctggagccagccataacattttagtagaagttcaagacgacgggacgatgaaaataaaagatgaagaaagagacgatactttaaccatactcctgaaagccacattactggcggtatcgggggtatacccgctaagtatccccgcaactttatttgtttggtatttctggcagaagaagaaacaaagaagtggcgttctctgggatacaccaagtcctccagaggtagaacgagcggtactcgacgacggaatatatagaataatgcaacgaggtctactcggccgtagtcaagtaggagtaggagtgtttcaagaaaatgtatttcacacaatgtggcacgtaactaggggtgcagtactaatgtatcaaggtaaacgattagagccctcgtgggcatcggtcaagaaagacctaattagttacggaggtggttggagactccaaggatcgtggaacacaggcgaggaggttcaagttatcgcggtcgagccgggtaaaaatcccaaaaacgtacaaactgctcctggaaccttcaaaaccagcgagggcgaggtaggcgcaattgctttagatttcaaacccggtacatcgggcagtcccatagttaacagagaagggaaaatcgtaggcttatacggaaacggtgtcgttactacttccggtacgtacgtttcggctattgcgcaagccaaagcgtcccaagaaggtcccctaccagaaatcgaagatgaagtatttcgtaaacgaaatcttacaataatggatttacatccagggtcagggaagactcgccgctatttacctgcgatcgttagggaagcaataaagcgaaaattacgtaccttgatattagctcccacgcgagtagtggcttctgaaatggctgaagctctcaaagggatgccaatacgatatcaaactactgcagtaaagtcagaacacacaggaaaggaaatcgttgatttgatgtgtcacgcaacatttactatgagacttctttcaccagtacgcgttcccaattataatatgatcataatggatgaggcacattttaccgatccctcatctattgctgctcgaggttatatatccactcgagtgggaatgggcgaggcagcagccatatttatgacagcaactccaccgggaagtgtcgaggctttccctcagagtaatgcagtaatccaagatgaagaacgagatataccagaacgaagctggaacagcggatatgaatggatcacagatttcccgggaaaaacagtttggttcgtaccctcgataaaaagcggcaatgatatagcaaattgcctcagaaagaacggaaaaagagttattcagttgtcgagaaagacttttgacacagagtatcagaaaacgaaaaataatgattgggattacgtggtaacaactgacatctctgaaatgggcgccaatttcagagctgacagagtaatagacccgcgaaggtgtctaaaaccagttatattaaaagacggtccagaaagagttatattagcaggaccaatgcctgtaactgtggcgtccgcagcccagagacgggggcgaataggcagaaatcacaataaggaaggagaccaatatatatatatgggacaacctttgaataatgacgaagatcatgcacattggacagaagcgaagatgctgctggataacataaacaccccggaaggaataattccggcactattcgaacccgaacgagaaaaatccgctgcaatcgatggggaatatcgactaagaggagaggcaagaaaaacgtttgtagaattaatgcgaaggggagatctcccagtctggttgagctataaggtagcatctgaaggattccagtatagcgatagaagatggtgtttcgacggtgaacgaaacaatcaggttctagaagagaatatggatgtagaaatatggactaaggaaggagagagaaagaagctaagaccaagatggctggacgcgaggacttattctgatccgttagctctaagagaatttaaggaatttgccgcaggtcgcaggagtgtttcaggagacctaattttagaaataggaaaattaccacagcacctaacgcagcgcgctcaaaacgctttagataatttagtaatgctacataactccgaacagggtggtagggcatacagacacgcaatggaggaattgcctgatacgatcgaaacgttaatgcttctagctcttattgctgttttaacgggtggtgtgaccttattctttctaagcggtagagggttaggcaagacgtctatcggattattgtgtgtaatggcttcaagcgtcctattatggatggccagtgttgaaccgcactggattgcagcatctatcattttggaatttttcttaatggtattattaattcccgaaccagaccgccaacgaacacctcaggacaaccagttagcttacgtagttatcggattgctatttatgatactaaccgtagcagcgaatgaaatgggactactagaaactacaaagaaggatttgggcataggacatgttgccgtagaaaaccatcaccatgcagctatgttagacgtcgatttacatccagcttcggcgtggacactttacgctgtagccaccacaattattactccgatgatgcgacacacgatagaaaacacgactgcaaatataagtctaaccgcaatagctaaccaggccgcaattttaatgggattagataaagggtggccgatatcaaaaatggatataggcgttccactcttagcactaggatgttatagccaagtaaatcctttgacattaactgccgcagtactaatgctagttgcacattacgctatcataggccccgggttgcaagctaaagcaacaagagaagcccagaaaaggaccgctgctggtataatgaagaatccaacggttgatgggattgtcgctatagatttagacccagttgtctacgacgcaaaatttgaaaaacagctaggtcaaattatgttattgatactctgcacgtcacagatactactgatgagaaccacatgggctctatgcgaatcgataaccctcgcaaccggacctctaacaactctttgggaaggatcaccaggtaaattttggaatacgacaatagccgtctctatggctaatatattccgtgggagctatctagctggtgccgggctagcgttctccctcatgaaaagtttaggtggtggcagaagaggaacgggtgcacaaggtgaaacacttggagaaaaatggaaaagacaattaaaccaactttcaaaatctgaatttaatacttataaaagatccggaattatggaagttgaccgatccgaagcaaaagaagggctaaaaaggggagaaacaaccaaacacgctgtaagtagaggaacagccaaattacgatggttcgtcgaacggaacctagtcaaacctgaaggaaaagttatcgacttgggttgcggtaggggcggttggagctactattgcgcaggactgaagaaagttacggaggtaaaaggatatacaaagggtggaccaggacatgaagaacctatcccaatggcgacatatggttggaatttagttaagctgcacagtggcaaagatgtattctttataccacctgaaaaatgcgatactctattatgtgacattggcgagagctcgccaaatccgacaatagaagaaggaaggactttaagagtcttgaaaatggtcgaaccatggttaagagggaatcaattctgcataaaaatcctcaacccttatatgccttcggtagtagaaacactagagcaaatgcaacgtaagcatggtggaatgctcgtccgaaatcctttatcaagaaactcgacacatgaaatgtattgggtgtcttgtggtaccggtaacatcgtaagtgctgtcaacatgaccagtcggatgcttttaaatagatttactatggctcaccgaaaaccaacatacgagagagatgtagatctaggggctggaacaagacacgtcgcagtcgaacctgaagtagcgaatcttgacatcattggtcaaagaatcgaaaatatcaaacacgaacataaaagtacatggcattatgatgaagacaatccatataagacatgggcttatcacgggtcatacgaagtaaagccctcaggatcggccagcagcatggtaaacggagtagttaaattgctcacaaaaccttgggatgtcataccgatggtcactcaaatagctatgacagacaccacgccttttggacaacagagagtattcaaggaaaaggttgatacgagaacacctaaggccaaacgaggtaccgcacagatcatggaggtaactgctaaatggttgtggggttttctatcacggaataaaaagcctagaatatgtactcgtgaagagttcactaggaaagtaagaagtaacgctgccataggggcggtattcgtagacgaaaatcaatggaactcagcaaaagaagcagtcgaggacgaacgattctgggatttggttcatcgtgaaagagaacttcataaacaaggaaagtgtgctacttgcgtctataatatgatgggcaaaagagagaagaaactaggcgaatttggtaaagctaaagggtctagagcaatatggtacatgtggttgggcgcacgcttcttggaatttgaagcacttggattcatgaatgaagatcattggttctctagagaaaatagtctttcgggagttgaaggcgagggacttcataaattgggctacatactacgtgatatctccaaaattccaggaggaaacatgtacgcggatgacactgcaggctgggacacccgaataactgaagatgacctccaaaacgaggcaaaaatcacagacataatggaacctgaacatgctttgttagcgaagtcaatatttaaacttacttatcaaaacaaagtggttagagtacaacgacctgcaaagaatggcacagtaatggatgtaatctccagaagggaccaacgaggctcggggcaagttgggacttacggcttaaacaccttcactaatatggaggcacaactaatcaggcaaatggaatcagagggcatatttagcccttcagaattagaaactccaaatttggcaggacgggtattggattggttagaaaagcatggagtagaacgactaaaacgtatggctataagtggcgatgattgcgtcgtcaaaccgatagacgacaggtttgcaactgctttaacggctctaaacgatatggggaaagttaggaaagacataccacagtgggagccttcgaaaggttggaatgattggcaacaagttccattttgttcgcatcattttcatcagcttataatgaaggatgggcgagagattgttgttccatgccgaaaccaggacgagctagtcggcagagctagagtatcacaaggggctggctggtcgctaagagagacagcatgtttaggaaaatcatacgcgcaaatgtggcaactaatgtattttcatcgccgtgatttgcgcttggctgcaaacgctatttgctcagctgtaccagtagattgggtgccgacctcgagaacaacatggtctatacatgcacatcatcaatggatgaccacagaagatatgctaagtgtttggaatagagtatggattgaagagaacccgtggatggaggataaaacgcatatatcgagctggggagacgtaccgtatttaggtaaaagagaagatcaatggtgcggatcgttaataggcctcacggccagagctacttgggcaacaaatattcaagtcgcaattaaccaggttaggcgtttaatcggaaatgaaaactatctagattatatgacaagtatgaagcgcttcaaaaacgagagcgaccccgaaggggctctatggtag

SEQ ID NO: 21820 - RNA, 9879 nt, synthetic construct
  misc_feature 1..9879: note = derived and/or modified CDS sequence (opt6) from DENV-1__GU131743__SS-prME
  source 1..9879: mol_type = other RNA
tccgtgacaatgctgctgatgctcatgccaactgctttagcatttcatttaacgaccagaggaggtgaacctcacatgatcgtatctaaacaagaaagaggaaaaagtctgttatttaaaacatcggcgggtgtgaatatgtgtaccctaatagctatggatttaggtgaactctgtgaagacacgatgacctacaaatgcccacgcatcaccgaaactgaacctgacgatgtggattgctggtgtaatgcaacagacacatgggtaacgtacggaacctgttcacaaaccggggagcatcgacgagataaaagaagcgtagcattagcgccacacgtggggctaggattggagacccgcacagagacatggatgagttcggaaggagcatggaaacaaatacagcgagtggaaacttgggcattgcgtcacccaggatttacggtcatcgctttgtttcttgctcatgcaattggaacttcgataacgcaaaaaggaataatttttatactacttatgctagttaccccatcaatggcgatgcgttgcgtcgggatagggagtagagattttgttgaaggtcttagtggagcaacatgggtcgatgtcgttttggagcatggatcgtgcgtgactacaatggccaaagacaaacccaccttagacattgaacttctaaaaaccgaagtaaccaatcctgcagtcttacgaaaactatgcatcgaagcaaagatatctaatactaccacagattcccgttgtccaacacaaggagaagctactctagtagaagaacaagacgccaactttgtatgccgtcggacgtttgtagatagagggtggggcaatggatgtggtttatttggtaagggtagcctcatcacttgtgccaaatttaaatgcgttacaaagttagaaggaaagatagtacaatatgagaacctaaaatactccgtaattgtcactgtacacactggagatcaacatcaagtgggtaatgaatcaacagaacacggcacaacagcgacaatcacgcctcaagcgccaacaactgagattcaattgacggactatggcgcgttaactttggactgtagccctagaactggactcgactttaatgaaatggtattgctaacgatgaaagagaaatcatggcttgtacacaagcaatggtttttggatcttccgttgccctggacgagcggtgcaagtacgagtcaagagacatggaatagacaagatcttctagtaacatttaaaacagcgcacgccaagaaacaagaagtagtagtcttaggtagtcaagagggcgccatgcatacagctttaacaggtgcaacggaaatccagacgagcgggactaccacaatatttgcggggcacttaaaatgccggctaaaaatggacaaattaaccttgaagggaatgtcatacgttatgtgtacagggtcattcaagttagagaaggaagtagctgaaacacagcatggcacagttttagtacaaattaaatatgaaggcactgacgccccatgcaaaatacctttctcaacacaggacgaaaagggcgtcacccagaacggcagattaattactgcaaacccaatagttacggataaagaaaaaccagtaaatatagaagccgagccacccttcggagaaagttacattgttataggagctggagaaaaggctttaaaactctcctggtttaaaaagggatcatcaatcggtaagatgtttgaagcaacagccaggggtgcacgtagaatggccatacttggagatactgcttgggacttcggatctataggaggggtatttacatccgtaggcaaactcgttcaccaaatttttggcactgcgtatggtgttctatttagtggagtttcttggacaatgaagataggaattggggttttattaacttggttaggattaaattcaagaagcacttcactgtctatgacatgcatcgcagtgggcctagtgaccttatatctcggcgtgatggtgcaggccgatagcggttgcgtaataaactggaaaggtagggagttaaaatgtggatcaggtatatttgtaactaatgaggttcacacatggactgaacagtacaagtttcaagctgatagtcctaagcggctttccgcggccatcggcaaagcctgggaagaaggggtgtgtggtattcgaagtgctacccgtctagaaaacataatgtggaaacagatctctaacgagctaaaccatatccttttagaaaatgacatgaaatttaccgtagtagtaggagatgtcgccgggattctagcacaagggaagaaaatgattagaccgcaacctatggaatataaatactcttggaaaagttgggggaaagcaaaaataataggagcggatgtccaaaatactacgttcataatcgacggaccaaacacgccggagtgtccagatgatcaaagagcatggaatatttgggaagttgaagactacggctttggtatattcaccacaaacatatggctcaaattgcgcgatagttatacacaagtatgtgaccatcgcctgatgtcagcggcaatcaaagacagtaaagctgtacatgctgatatgggatactggatagaaagcgagaagaacgaaacatggaaattagctagagcatcttttatcgaagtaaagacatgcatatggcctaaaagtcacacactgtggagcaatggagtactagaatcagaaatgatcattcccaaaatctatggaggtcctatcagccaacataattacagacctggctacttcacccaagcagcaggaccctggcacttaggaaaattagaacttgactttgatttatgcgaaggtacaactgtagtcgttgacgaacattgtggtaacagagggccatctttacggacaacgactgtaactggtaaaattattcacgaatggtgttgtagaagttgcacccttcctccgctgaggtttagaggagaggatggatgttggtacggaatggaaatccgaccagttaaagagaaggaagagaacttagtgaaaagtatggttagtgctggttcgggagaagtagatagtttcagcttaggattattatgtatttctatcatgatagaggaggtcatgagatcaagatggtcacgcagaatgttaatgacaggtactctggcagtatttttcttattaataatgggccaacttacgtggaacgatttaattaggctatgtattatggtcggagcgaacgcatcagataggatgggaatggggacaacttatctggcattgatggctacgtttaagatgcgaccaatgtttgcagtcggactactattccgcagattaaccagtagagaggttctattgttaaccataggtctgagcttggtggcaagtgtagaactacctaattcattagaagaattaggagacggcctagctatgggaatcatgatcttgaaactattgaccgattttcagagtcatcagttgtgggcaactttattgagcttaactttcataaagacaacgttctcgttgcattacgcatggaagactatggcaatggtattgagcatagtaagtttatttccattatgtttgagtacaactagccagaaaactacatggttaccagtacttctcggttcattaggttgtaaacctctaacaatgtttctgattgcggaaaataaaatatggggaagaagatcttggcctctcaacgaaggaataatggcggtcggcattgtctcaattttattaagctcgttactgaagaacgatgtaccattagcgggaccgttaattgctggcggtatgttaattgcatgctatgttataagcggatcatcagccgatctctcattagaaaaggcggctgaggtcagttgggaggaagaagcggaacactcaggagcttctcacaatatattagtcgaagtacaggacgatggtaccatgaaaataaaagatgaggaaagagacgacacactcactattctactgaaagctacattgcttgcggtatcaggagtatatcccctgtccataccagctactttatttgtttggtatttctggcagaagaagaaacaaaggagcggagtcctttgggatactccaagccctcctgaggtcgaacgagcagtgctagatgatggtatttatcgaattatgcaacgaggtcttctaggaagatcgcaagtgggtgttggtgtattccaagaaaatgtattccatacaatgtggcatgttactcggggcgccgtactgatgtatcaaggaaaaagattagaaccaagctgggcatcagtcaagaaagatcttatttcgtacggagggggatggagactacagggttcatggaatacaggagaagaggtccaggtaatagctgttgaacccggaaagaaccccaaaaatgtgcaaacagcaccagggaccttcaaaacgccagagggcgaagtgggtgctattgctcttgacttcaaacctgggacatcaggatctcccatagtgaacagagaagggaaaatagtcggattatatggaaatggagttgtgacaacatcgggtacttatgtctctgctattgcacaggcgaaagcatcccaggaaggaccgctcccagagatagaggatgaagtattccgtaaacgtaatttgactataatggatttgcatcctggctctggaaaaactaggcgttatctaccggctattgtaagagaggcgataaaaagaaaacttcgtacacttatactggctccaaccagggttgttgcaagcgaaatggctgaagcattgaaaggaatgcccataagatatcagaccactgcagttaaatcggaacacacgggcaaagagatagtcgatctaatgtgccatgcgacattcactatgagattattgtcaccagtaagagtaccaaattataatatgataataatggacgaggcacattttacagatcctagcagtatagctgccagaggatacataagcacaagagttggcatgggagaagctgcagccatattcatgacggcgacgccacctgggtctgtagaggcatttcctcaaagcaatgccgtaatccaagatgaagaacgcgatattccagaacgttcttggaactcaggttatgaatggataacagatttcccaggtaaaacagtatggtttgtcccgagcataaaaagtggaaacgatatcgctaattgtctcaggaaaaatggtaagagggtcatccaattatctcgaaaaacttttgatactgagtatcagaaaacaaagaataatgactgggattacgtggtaactacagacattagtgaaatgggtgcgaactttagggcggatcgagtaatagacccccgaagatgtttaaaaccagtgattcttaaagacggacctgaacgtgtaatactagcgggaccaatgccagttacagttgcttctgccgctcaaagaaggggccgaataggtcgcaaccacaataaagaaggggatcaatacatatatatggggcaaccgttgaataacgatgaagatcacgcacattggacggaagcgaagatgctcctcgataacataaacacacccgaaggaataataccagcgctatttgaaccagaaagagagaagtcggcagcgatagacggggagtataggctgcgtggggaggcccgaaaaacatttgtagagctgatgcgccggggtgatttaccagtctggcttagttataaagtcgcaagcgagggatttcaatactctgacagacgatggtgctttgatggggaacggaataaccaagtattagaagaaaacatggatgtagaaatttggacaaaagaaggagaacgaaagaaactcagacctagatggctcgacgccagaacctattctgatccgctagcactgagagagtttaaagagttcgccgccggaagacgttctgttagcggcgacctaattttagaaataggcaaattaccacaacatttaacccaaagagcgcagaatgctcttgataacctagtaatgctacacaactccgaacaagggggacgcgcgtatcgacatgcaatggaagaacttccagatactatcgaaacactcatgttattagctttaatcgccgtgctaacaggcggagtaacgttgtttttcttatccggcagaggactaggtaaaacaagcataggattattatgtgttatggccagttcagttctactgtggatggcatcagtagaaccacattggattgctgcaagtataatcttagagttctttctaatggtgttactaattcctgaacccgacaggcagcgtaccccacaagacaaccagttggcgtacgttgtaataggcttgctttttatgatactaactgttgcagccaacgagatgggcctattagaaacgactaaaaaggacttaggtataggacacgtcgcagtcgaaaaccatcaccacgcagccatgttagatgtagatcttcatccagctagtgcttggactttatacgcagtagccaccactataatcactccaatgatgcggcatacaattgaaaatactacagccaacatatctttaacagcaattgcaaatcaggccgcaatacttatgggactagataaaggatggccaatatcaaaaatggatatcggcgtccccctacttgctctaggatgctacagtcaagtaaacccgctgacgcttacagccgccgtactaatgctagtcgcacattacgcgattataggaccaggtctacaagccaaggcaacgcgagaagctcaaaaacgcacagcagccggaataatgaagaacccgacagtagatggtatcgtagcaatagatcttgatccagttgtatacgacgcaaaattcgagaaacaattgggacaaattatgttgcttatattatgtacgtcgcagatcctcctaatgcgcacaacctgggccttgtgcgagtcaatcacgttggcaactggacctttgaccaccttgtgggaaggctcacctgggaaattttggaataccacaatagcagtatcgatggccaatatatttaggggatcatacttagctggcgcaggattagcattctcgctaatgaaatcgttaggcggagggagaagaggaacgggggcacagggggaaacattgggagaaaaatggaaacgccaactaaaccaactaagtaaatcagagtttaatacgtataaaagaagtggcataatggaagtggatcgttctgaagcaaaagaaggtctgaaaaggggtgagactacaaaacatgcggtaagtagaggaacggcaaaattgagatggtttgtagagagaaacctcgtaaaacccgagggtaaagtaatagacttagggtgtggacgtggcgggtggtcatattattgtgctggactcaagaaagtgacggaagtcaaaggatatacaaaaggtggcccaggtcatgaagaaccgattccaatggcaacatacggatggaacctagtaaaattgcattccgggaaagacgtatttttcatacctcccgaaaagtgcgataccttattatgtgatattggtgagtcatcaccaaacccaactatagaggaaggtcggactctacgagtgctcaaaatggtggagccatggctgcgcggcaatcagttttgtattaagattctcaatccctacatgccaagtgtagtcgagaccttagagcaaatgcaaagaaaacatgggggtatgcttgttaggaatcctctcagtagaaattcaacccacgaaatgtattgggtttcatgcggcaccggtaatatagttagtgcagtaaatatgacatctagaatgttactgaacaggtttaccatggcccaccgtaagccaacgtacgagagagatgtagacctaggtgcaggaacgagacatgttgcagtagaacctgaagttgcaaatctagatgtaataggacaacgaatagaaaatataaagcatgaacataaatccacatggcactacgatgaagataatccttataaaacttgggcttaccatggaagctatgaagtaaagccatcgggatctgcttcatcgatggtaaacggcgtagtaaaactacttactaaaccatgggatgttataccgatggtaacacaaatagcgatgacagatacaacaccatttggtcaacaacgagtatttaaagagaaggtggatacacgaacacctaaggcgaagagaggaacagcacaaataatggaggtaaccgcaaaatggttatggggtttcctgagcagaaataagaagcctcgaatttgtacacgagaagagtttaccagaaaagttaggagtaacgcggcaattggtgccgttttcgttgatgaaaatcaatggaatagtgccaaggaggcagttgaagacgaacgattttgggatctagtgcatagagagcgggaattacataaacaaggtaaatgcgcaacatgtgtatataatatgatgggaaaacgcgagaagaaactcggcgagtttggtaaagccaaaggctcccgagccatctggtatatgtggttaggtgctcgattccttgagtttgaggcattgggattcatgaatgaggaccactggttcagtcgagaaaatagtctcagcggcgtcgaaggcgagggactacataaattaggctatatactacgcgatattagtaagatacctggagggaatatgtacgctgatgatactgctggttgggataccaggatcacagaggatgacctacagaatgaggcaagaataacggatatcatggaacctgaacacgccctactagcaaaaagcattttcaagttaacatatcaaaataaggtagttagggtacagcgacccgcgaaaaatggaaccgtaatggatgtcatttcacgtagagaccagcgcggatcaggacaagttggaacgtatggactaaatacttttacgaacatggaagctcaactaataaggcagatggaatctgaaggaatatttagtccaagcgaattagagacaccaaacctggccgaaagggttttggattggctaggaaagtacggagtagagagattaaagcgtatggccatcagcggcgatgactgcgtagtcaaacccattgatgaccgttttgccaccgcattaacggcgttaaatgatatgggaaaggtacgaaaggacatcccacaatgggaaccgtcaaaaggctggaacgactggcaacaggtaccattctgctcacaccactttcaccaactgataatgaaagatggaagggaaattgtggttccatgccgtaatcaggatgaattggtgggtagagcgagagtgagccaaggagcagggtggtctttaagagagacagcatgtctcggcaaaagttatgcccaaatgtggcaactgatgtacttccataggagggatcttcggttagcagctaatgcaatttgttcggcagtaccggttgactggataccaacttcccgaactacttggagcatacatgcacatcaccaatggatgacaaccgaagatatgttgtcagtttggaaccgtgtatggatagaggaaaacccgtggatggaagataagacacatataagcagttggggagatgttccataccttggaaaaagagaagatcagtggtgtggcagcttaataggccttacggctcgcgcaacatgggctacaaatatacaagttgcaattaaccaggtacgaagattaataggtaatgaaaactacttggactatatgacaagtatgaagcgatttaaaaatgaatctgatccagaaggtgcattgtggtga

SEQ ID NO: 21821 - RNA, 9879 nt, synthetic construct
  misc_feature 1..9879: note = derived and/or modified CDS sequence (opt6) from DENV-1__JN093516__SS-prME
  source 1..9879: mol_type = other RNA
agcgtgacgatgttattaatgttaatgcctacagctctggcattccacttaacaactcgtggaggagaaccccacatgatagtatcaaaacaagaaagaggtaaatcactattgttcaaaacatctgcaggcgtaaacatgtgtactttgatagcgatggatttaggcgagttctgcgaggacaccatgacatataaatgtccccgaataacagaagcagaaccggatgatgttgattgttggtgtaacgccacagatacttgggtaacatacggcacatgttctcaaactggagaacaccgccgagacaaaagatcggtggcactagcgccccacgttggactgggtcttgaaacgcgcacggaaacgtggatgagctcggagggagcttggaaacaaatccaaaaggtagagacttgggccctccgccatcctggattcactgtaatcgctttgtttttagcacatgcaattggtacgtcaataacccaaaaggggataatctttatattgttaatgctggttactccgagtatggcaatgcgttgcgtagggatcggatccagagattttgttgagggattatcaggagcaacatgggtggacgttgtcctagaacatggcagttgcgtcaccacaatggcaaaagataaaccaactttagatattgaattattaaaaacggaagttacaaacccagctgttttacgcaaattatgcattgaagccaaaatatccaacacgactacagactctcggtgcccaactcaaggcgaagcaacattagtagaagaacaagatgccaatttcgtttgtagaaggacatttgtagaccgagggtgggggaatggatgtggccttttcggaaaaggttctctcataacgtgtgcaaaatttaaatgtgtcacaaaattagaaggcaaaaccgtgcagcatgaaaatctgaaatactccgtcattgtaactgttcatactggcgaccaacatcaggttggtaatgaaagtacagaacacgggacaacagcaacgattaccccacaagctccttctacagaaatacaacttactgactatggagcactgacactggactgctctccaagaaccggcttggacttcaacgagatggtgctgttaacaatgaaagagaagtcatggcttgtacataaacagtggttcctggatttacctttaccatggacgtctggcgcgagtaccagtcaagagacttggaatcgaaaagatctcttggttactttcaaaacggcacatgccaaaaagcaagaggtagttgttcttggatcacaagagggcgccatgcacacagcgctaacaggtgcgacagaaatccagacaagtggaactactacgatttttgcagggcatcttaagtgtaggttgaagatggacaaacttacactaaaaggtatgagctacgttatgtgcactggaagttttaaattggaaaaagaggtagcagaaacacaacatgggacggtacttgtacagattaagtatgaaggaaccgacgcaccttgcaaaatacccttcagcacacaagatgaaaagggtgtcacacaaaacggtaggctaataacggcaaatcctattgtaactgacaaggaaaaaccggttaatatagaggcagaaccacccttcggagagtcatatatagtaatcggtgccggagaaaaagcactgaaactaagctggtttaaaaaggggtcaagtataggtaaaatgttcgaagctacgactagaggagcaagaagaatggcaatattaggtgacacagcatgggatttcgggtcaataggcggagtgttcacatctgtaggaaaattggtacaccagatatttggcacggcttacggcgtactgttctcaggagtaagctggaccatgaaaataggtataggagttctacttacctggcttggactcaactcacgaagcaccagcttatctatgacttgcatcgccgtaggtcttgtgactttatatttgggagtaatggttcaagccgactctggatgcgttattaattggaaagggagagaattgaaatgtggctctggaatatttgttacaaatgaagttcatacctggactgaacaatacaagtttcaagctgatagcccgaaaagattaagcgcggcaattggaaaagcgtgggaagaaggtgtatgcgggatcagatctgccaccagactagagaatattatgtggaaacaaataagtaatgaattaaatcacattcttctagaaaatgatatgaagtttaccgttgtcgtaggagacgtggcaggtatattagcccaaggaaagaaaatgatacgtccacagccaatggagtataagtacagctggaaaagctggggaaaagcgaagattataggtgcagatgtacaaaacacgactttcataattgacggacctaatacacccgaatgcccagatgatcagagagcgtggaacatatgggaagtggaagattatggttttggcatctttactaccaacatatggttgaagctcagggactcttacactcaagtatgcgatcatcgacttatgagtgcagcaattaaagactcaaaagctgtacatgcagatatgggctattggatagaatctgaaaagaatgaaacttggaaattagcaagagcatcgttcattgaggtcaaaacttgtatatggccaaaatcgcatactctttggagcaacggcgtactagaaagcgagatgattataccgaaaatctacggtggaccaatatcgcaacacaactataggcctggctattttacccaaacggctgggccctggcaccttggtaaattagaactagacttcgacctatgcgaaggaacaactgtggtcgttgatgaacactgtggaaatcgcggaccctcgttacgaacaactaccgttactggaaaaataatacatgaatggtgttgcagaagttgcaccttacctccactcagattcaaaggtgaagatggctgctggtatggcatggagattcgacctgtcaaggaaaaggaagaaaacttggtcaagagtatggtatccgcgggatcaggagaagtagatagtttctcgcttggcttactatgcatatcaataatgatagaagaagtgatgagatcacgatggtcacgtaaaatgttaatgaccggcaccctcgcagtgttctttttgctgataatgggacagttaacttggaacgatttaatccgcctgtgtattatggttggagcaaatgcatctgatcggatgggtatgggtaccacatatttggctttaatggctacatttaaaatgcgaccaatgtttgccgtagggttactatttagaaggttaacttcacgagaagttttacttttaactataggactatcactcgtcgcaagtgtcgaactcccaaattcgttagaagaattaggtgacggcctagcaatgggaataatgatacttaagttattaacagacttccaatctcatcaattatgggccacattgctttctttaacatttataaaaacaactttttcattacattatgcttggaaaaccatggcgatggtattgtcaatcgtaagtctatttcccttatgcttatcaacaacaagccaaaagactacatggttaccagttttactcggcagcctagggtgtaagcctttaacaatgttccttatagccgaaaataaaatctggggccgtaagagttggccgttaaatgaaggaattatggctgtaggtatcgtttcaattcttctgagttcactacttaaaaatgatgttcccctagctggtccgttaatagctggaggtatgctgatcgcatgttatgttattagcggctcatctgctgatctgagcttggagaaagcagctgaagttagctgggaggaagaagctgaacatagtggggcgagtcacaatatcctagtagaggtacaagatgatggtactatgaaaataaaggacgaagagagagatgatacattaacgatcctacttaaggccactttattagcagtaagtggtgtgtatccgcttagtataccagcaacattatttgtatggtacttttggcaaaagaagaaacaacgtagcggtgttttatgggacacaccatcaccacctgaagtagaacgagccgtactagatgatggtatatatagaatcatgcaacgtggacttcttggtagatctcaagttggggtaggagtattccaagaaaatgtttttcataccatgtggcatgttacgagaggggccgttttaatgtatcaaggaaaaagattggaaccctcgtgggcttcagtcaagaaagacttgatatcctacggtggaggctggcgtctccagggcagctggaacaccggtgaagaagtgcaggttattgcagtggaacccggtaaaaatcccaaaaacgtacaaacagctcctggaacatttaaaacctccgagggggaggtgggagcaatagcattagactttaaaccaggaacctccggaagcccaatagtgaatcgcgaaggaaagatagttggtctatatggaaatggtgtcgtgacgacttcagggacttatgtcagcgccatagcccaagcaaaggcaagtcaagaaggacccctgccggaaatcgaagatgaagtatttaggaaacgaaatctaacaataatggatctacatccaggatctgggaaaacaagacggtatcttcccgcaatagtaagagaagcgataaaacgaaaattaagaacactaatactggctcctactcgggtagttgctagtgagatggcagaagccttaaagggaatgccgatcagataccaaacaactgccgtaaagtctgaacacaccggtaaagaaatagtagacctcatgtgtcacgccacgttcacaatgcggttgctctctcctgtccgtgtacccaattataatatgattattatggacgaagctcactttactgacccatcttctattgcggcccgagggtacatatccacccgcgttggaatgggcgaagcagccgcgatatttatgaccgcaacacctccagggtccgtagaggcttttcctcaatctaatgccgtaattcaggatgaagaacgagatatacccgaacgaagttggaactcaggctacgaatggataacagactttccgggaaaaacagtctggtttgtacctagtataaaatccggcaatgatattgcaaactgtttaaggaaaaacggaaaacgagtaattcaactttcacgaaaaacttttgacactgaataccagaaaactaaaaataatgattgggattacgtggtgactactgatataagcgaaatgggggccaattttagggctgaccgggtgattgatcctaggaggtgcttaaagccagtgatcttaaaggatggtcccgaaagagtcatattagcggggccgatgccagtgaccgttgcttcagctgcgcaaagacgaggtcgcataggtagaaatcataacaaagaaggcgaccaatatatctatatgggacaaccccttaataatgatgaagatcacgcacattggactgaggcgaaaatgcttcttgacaacataaatactccggaaggaataattcccgccttatttgagcccgagcgagagaaaagcgcagcgattgacggtgaataccgactacgcggtgaagctagaaaaacgtttgtagaattgatgagaagaggagatctgcctgtgtggctctcatataaagtggccagtgaaggattccaatattcagatagacgttggtgtttcgatggtgaaagaaacaatcaagtcttagaagaaaatatggacgtggagatatggactaaggagggtgaacgtaaaaagctaagacctaggtggctcgatgcgagaacatactctgatccgttggcgctccgggaatttaaagagtttgcagctggaaggagaagcgtatctggcgatctaatcttagaaataggaaaactacctcaacacctaacccaaagagcgcaaaatgcattagataacctggtgatgttacacaatagtgagcaagggggtcgcgcataccgccacgcaatggaagagttacctgatacaatagaaacccttatgctcttggcattgatagctgtcctgaccgggggagtaactcttttcttcctgtctggaaggggtttgggcaaaacaagtattggtctattatgtgtaatggcatcttcggctttgctgtggatggcgagtgtcgaaccccactggattgccgcaagtattatattagagttctttttgatggtcctactcattccagaacctgatagacaaaggacaccgcaagataaccagttggcatacgtcgtaattggcctactatttatgatcctcacagttgctgcaaacgagatggggctgttagaaactaccaagaaagacctaggaataggccatgtggccgtagaaaaccatcaccatgcaacaatgttagatgttgatctccatccagcttcggcatggactctatacgcagtggcaacaacaatcataactccaatgatgcgccacacaattgaaaataccactgccaatatcagcttaacagcaatcgccaaccaagccgctatattaatgggactcgacaaagggtggccaatatcaaaaatggacatcggcgttccactcttagcactaggttgttactcgcaggtcaatcccttaactttaaccgcggcagtgttgatgcttgtagctcattatgcaattataggacctggtctacaagctaaagccacccgagaagcacaaaaacgaacagctgcagggatcatgaagaatcctacagtggacggcattgtggctatagacttagaccctgtggtatacgatgctaaattcgaaaaacagcttgggcaaataatgcttttgatactttgcacaagccaaatcttactgatgagaactacatgggctctttgtgaaagtattacgctggcaacaggaccgctcacgacattatgggaagggagtccgggcaagttctggaataccaccatcgcggtatcaatggcgaatatattccgtggaagttatctggctggcgctggcttagctttttccctcatgaaaagtctaggtgggggcagaaggggtacaggtgcacaaggtgaaacactaggggaaaaatggaaacgtcagttaaatcaactatcaaaatctgaatttaatacatacaaacgaagtgggataatggaagttgatcgatctgaagctaaagagggacttaaaagaggagaaacgaccaaacatgcagtgtcaagaggtactgcaaaattacgatggttcgtcgaacgtaacttagtcaaaccagagggaaaggtaatagatctgggatgtggtaggggtggatggagctattactgcgcagggctaaagaaagtaactgaagttaagggatatactaaaggaggtccaggtcatgaagaacccataccaatggcaacttatggttggaacctagttaaattgcattccggaaaggatgtattctttataccacccgaaaaatgcgatacgctattatgtgatattggcgaatcatcacctaacccgaccattgaagaaggaagaacattaagagtgttaaaaatggttgaaccatggttaagaggtaaccaattttgtattaagattttgaacccatatatgccctctgtggtagaaacgctggaacaaatgcaaagaaaacacggcggaatgttagttaggaatccactcagtagaaatagcactcacgagatgtactgggtaagttgtggaactggaaatatagtaagtgcagttaatatgacgagccgcatgctattgaaccgattcaccatggcacatcgtaaacctacatacgaaagagacgtggacttaggagctggaactaggcatgtcgccgttgaaccggaggtagctaacttagatatcataggtcaacgcatagaaaacataaaacacgaacataaaagtacctggcactacgacgaagataacccctacaaaacttgggcgtaccacggttcttacgaagttaagccgagtggatcagccagcagtatggttaatggagtagtaaaactattgactaaaccatgggatgtaattcccatggtaactcaaatagcaatgacggacaccacaccatttggacaacaacgtgtttttaaagaaaaagtggacacaagaacacctaaagcgaagaggggaaccgcgcaaataatggaggtgactgcaaaatggctttgggggtttttatcccgtaataaaaagccacgaatatgcaccagagaagaatttacaagaaaagttcgttcaaatgctgcgataggtgcagtgttcgtagacgaaaatcagtggaactctgcaaaggaagctgtagaagatgagagattttgggacttagtccaccgggaaagagaattacataagcaagggaaatgtgctacctgcgtctataatatgatgggcaaaagggagaagaaattaggggaatttggaaaagccaagggatctagagccatttggtacatgtggcttggtgcccggttcctagaatttgaggcccttggtttcatgaacgaagatcactggttcagtagggaaaactcactgagtggggttgaaggtgaaggtcttcataaattgggctatatccttagagatatctcaaagataccgggcggtaatatgtatgcagatgatacagctggttgggacaccagaatcacagaagatgatctgcaaaacgaggcaaaaataacagacattatggaaccagagcatgcgctcttagcaaaaagcatttttaaactaacttatcaaaataaagttgtccgagtccaacgaccagccaaaaatggaacagtaatggacgttatcagcagaagggaccaacgtggttctggacaggtgggtacctatggtttgaatacgtttactaacatggaggcgcaattaataagacaaatggaatccgaaggtatattcagtccttcggaattagagacaccaaacttagcagggagagtgttggactggcttgaaaaacatggagttgagaggctcaaacgtatggctatatcaggagatgactgtgtagtgaagcctattgacgatcgctttgctacggcactaacagctttgaatgatatgggaaaagtaagaaaagatattccacaatgggaaccgtccaagggctggaacgattggcaacaagtaccgttctgtagtcatcattttcaccagctaattatgaaggatggaagagaaatagtcgtaccttgtaggaatcaagatgaactcgttgggagagcacgagtaagccagggtgctggctggtcattacgggaaacagcatgtctaggaaaatcctacgcgcagatgtggcaactaatgtattttcacaggagagacttacgcctcgcggcgaatgctatatgctcagccgttcccgtggagtgggttcctacatcgagaactacttggtccatacacgcccatcatcagtggatgaccacagaggatatgctatcagtttggaaccgagtttggattgaagaaaatccctggatggaagataaaacgcacatatcttcctggggtgacgtaccttacttgggaaaaagagaagatcagtggtgcggttctcttataggtttgacagcccgagcaacatgggctactaatatccaagtcgccattaatcaggtaagaagattaatagggaatgaaaattatttggattatatgacgagtatgaaacgatttaaaaatgagagtgacccagaaggtgcactatggtga

SEQ ID NO: 21822 - RNA, 9879 nt, synthetic construct
  misc_feature 1..9879: note = derived and/or modified CDS sequence (opt6) from DENV-1__GU131746__SS-prME
  source 1..9879: mol_type = other RNA
tctgttacaatgttgcttatgctaatgccgactgcattggccttccacctcacaacacgtggaggagaacctcacatgatcgtttcaaaacaagagagaggaaaatcgttattgtttaaaacaagtgctggtgtaaatatgtgtaccctcatagcaatggacttgggggaattatgcgaggatactatgacttataaatgtccccgaattacagaaacagaacctgatgatgtagactgttggtgtaatgcaaccgacacctgggtgacttatggtacatgtagccaaaccggtgaacatagaagagacaaacggtcggttgctttggcaccacatgtcggtctcgggctggagacaagaacggaaacatggatgtccagtgagggggcttggaaacaaatacaacgagtggagacatgggcattgagacatcctggattcacagtaattgcgttgtttttagcacacgctatcgggacttctataacacaaaaaggtattatcttcatacttttgatgttagtcaccccgagcatggcaatgcggtgcgtcggaataggttcacgagacttcgttgagggactgtcaggagcgacatgggtagacgtggtattagaacacgggagttgcgtaacaacgatggccaaagacaaaccgactctagatatagaacttctcaaaacagaggtgacaaaccccgctgtactcaggaaactgtgtatcgaagctaaaatttcgaacactactactgatagtcgatgtccgactcaaggagaagcgaccctagttgaggaacaagatgcaaactttgtatgtagacgaaccttcgtggatagaggctgggggaacggttgtggcttattcgggaaaggaagcctaataacgtgtgctaaatttaaatgcgttacgaaacttgaaggaaaaatagtacaatatgaaaatttaaaatactccgtgatagttactgtccacacaggtgaccaacatcaagtcggtaacgaaagtacagaacacgggacaaccgctactatcacaccccaagcacctaccaccgaaatccaacttacagactatggagcattgacccttgattgtagccctagaaccggattagattttaatgagatggtcttgctaacaatgaaagaaaaatcttggctagtacataaacaatggtttctagatcttccactaccttggacgtctggagcgtctacgtcacaggaaacatggaatcgacaagatttattagtaacgtttaaaacggcacatgccaagaaacaagaagttgtagtattaggatcacaagaaggagcaatgcatacggccctcactggtgctacggaaatccaaacatcgggaactacaacaattttcgcaggccacttaaaatgtcggttaaaaatggacaaactcactttaaaagggatgtcatatgtaatgtgtaccggttcatttaaactagagaaagaacttgccgaaacacaacatgggacagtattagttcaaataaaatatgaaggcactgatgccccatgcaaaattccattttcgacacaagacgaaaaaggtgttacgcagaatggtagactaatcacagcaaaccctattgtgacagataaagagaaacccgtcaacatagaggccgaaccaccatttggagagtcatatatcgtaattggtgcaggagagaaagcgctgaaacttagttggtttaagaaagggtcgtcaataggaaagatgttcgaagcaaccgcgcggggagctcgtagaatggcaatattgggagacactgcatgggacttcgggagtattggcggcgtgttcaccagtgttgggaagctagtgcaccaaatattcgggacggcctatggagtccttttcagcggcgtaagctggacgatgaaaattggcataggagtccttcttacttggctcggactgaactcaagatcgacaagcctgagtatgacatgtatagcagtgggcctagttaccttatatctaggtgtaatggttcaggccgattccgggtgtgttattaattggaagggaagagaattgaaatgcgggagcggtatatttgtaaccaacgaagtacacacttggactgaacagtacaaatttcaagctgatagtcccaagagattatcagcggcgataggaaaggcatgggaagaaggagtgtgcggcatacgctcagccacaagactcgaaaatataatgtggaaacagatatcaaatgaactgaaccatattcttctagagaatgacatgaaatttacagttgttgttggtgacgtagccgggattttggcacaaggtaaaaagatgataaggccccaaccgatggagtataagtactcatggaaatcatggggtaaagccaagatcatcggcgccgacgtacaaaacacaacgtttattattgatggtcctaacacacccgaatgcccggacgatcaacgggcctggaatatttgggaagttgaggactacggttttggtatctttaccacgaacatctggctaaaattaagggatagttacactcaagtatgcgaccatcgactgatgtcggcagcaataaaagatagtaaagcggttcacgccgatatgggttactggatcgaatctgagaagaacgaaacttggaaattggcaagggcgtcgtttattgaagtaaaaacatgtatatggccaaagtcacacactctttggtcaaatggcgttctagaaagcgagatgatcattccaaaaatttacggaggaccgatatcccaacataattatagaccaggttactttactcagactgcaggaccctggcacttaggaaagttagaactagattttgacctatgcgaagggactacagttgtcgtagatgaacattgtggaaatcgtgggccatctctacgtacaacgacagtcactggtaaaataatacacgaatggtgttgcagatcttgtactttgcccccattgaggtttcggggcgaagacggctgctggtatgggatggaaataaggcctgtgaaagagaaagaagaaaatttagtaaaaagtatggttagcgcaggttccggagaggttgactccttctcacttgggttattgtgcataagcatcatgatagaagaagtgatgcgttcgagatggagcaggaaaatgttaatgacaggaactttagcggtattctttttattgattatgggacaattgacctggaatgatctcattcgtctatgcataatggtaggcgcgaatgcatcagaccgaatgggcatggggactacgtacttggcattgatggccacctttaaaatgcggccgatgtttgccgttggcctactattccgaaggttaacaagtcgagaagttttactacttacgattggattaagtcttgtcgcatcggtagaattaccaaattcgttggaagaattgggtgatggcttagcaatggggataatgatcctaaaacttttgaccgatttccaatcacaccaactgtgggcgacattactatcgctgacgttcattaagacaacttttagtcttcattacgcatggaagactatggccatgatacttagtatagttagtcttttccctttatgtctctccaccaccagccagaaaactacgtggcttcccgtattgctgggctcattaggatgcaaaccgctcacaatgttcttgattgcggaaaataaaatatggggaagaagatcgtggcccctcaacgaaggcataatggcagtaggtatagtgtcaatcctactctcctccctacttaaaaatgacgtaccactggcaggacccttaattgctgggggaatgctaattgcttgttacgtaatatctggtagtagtgcagacctcagtctagaaaaagcagcagaagttagttgggaagaggaagcagagcacagtggtgcgtctcataacatattagtagaagtacaagatgacggaacaatgaaaataaaagatgaggaaagagatgacacactaacgattcttttgaaagctacgttactagcggtgtctggagtctaccctctatcaataccagcaacgctatttgtttggtatttctggcaaaagaagaaacaacgaagcggtgttttatgggatactccaagtccaccagaagtcgaaagagcagtattagatgatggaatatatagaattatgcagagaggtttattagggaggtcacaagtaggtgtaggagtatttcaggagaacgtcttccatacaatgtggcacgtaacgcgaggggcagttttaatgtatcaaggaaaacgtcttgaaccgtcatgggccagtgtcaagaaagacctaatatcctacgggggaggatggagactacaaggatcctggaacactggagaagaagttcaagtaatagcagtagagcctggcaaaaacccgaaaaatgtacaaactgccccaggaacatttaaaactcccgaaggagaggtaggcgcgatcgccttagattttaagccgggaacatccggatccccaatagttaacagggaaggcaaaatagttggtttatatgggaatggcgtggtaacaacatcaggtacatacgtatcagccatagcacaagcaaaagcgagccaggagggaccattacctgaaatcgaagatgaagttttccgcaaaagaaatttaacaattatggatttgcatcccggctcagggaaaacaaggaggtatctaccagccatcgtcagagaagcgataaagagaaagctaagaactttaatcttggctccaacgcgtgtagtcgcgtcagaaatggcagaagctctaaaaggaatgccaataaggtatcaaactacggctgtaaagagcgaacacacaggaaaagagattgttgatctaatgtgtcacgcgacattcactatgcgattactaagtccggtaagggttccaaattataatatgattataatggatgaggcacattttacggacccgtctagcatcgccgctagaggctatatctcaacacgagttggcatgggtgaagctgcggcgatatttatgactgcgacacctccaggaagtgtggaggcttttcctcaatccaacgcagtaatccaagatgaggaacgggatataccagaacgatcatggaatagcggatacgaatggataactgactttcctgggaagactgtatggttcgtgcccagcattaaatctggaaacgatatagcgaattgcttacgtaaaaacgggaaaagagtcatacaactaagtcgaaaaactttcgatacagaatatcagaagaccaaaaacaatgattgggattatgtagtaaccacagacattagtgaaatgggagcaaattttagagctgatagagtaatagatcctagaaggtgcttgaaacccgtaatattaaaagatggtccagagcgagtaatattagccggacctatgccagtcacggtcgctagcgcagctcaaagaagaggaaggataggaagaaatcataacaaagaaggcgatcaatatatatatatgggtcaaccgctaaacaatgacgaagatcatgcacactggacagaagctaagatgcttttagataatattaacactcctgaaggtataattccggctctgttcgagccggaaagggagaaaagcgcagccatcgacggagaatatcgactacgcggtgaggcccgtaaaacgtttgtagaattgatgagaaggggtgatttaccggtatggttgagttacaaagtcgcatcggaagggttccagtactcagatagaagatggtgttttgacggtgaacgaaataatcaagtattggaagaaaatatggacgtagaaatatggaccaaggaaggtgagaggaagaaactcagaccaagatggttagatgcacggacatactcagatccgctggcactaagagaatttaaggaatttgccgctggccgcagaagcgtgagcggagatttgattttagagataggtaaactacctcaacatctgacacaaaaagctcaaaatgccctagataacttagtaatgctgcataactcggaacaaggaggcagagcctatagacatgcaatggaggaattacctgataccatcgaaacccttatgttactcgcactcatagcagtactaacagggggtgtcaccctcttctttctttcaggtagaggcttaggaaaaacaagtataggattgctgtgtgtaatggcgtcgtcagtgttattatggatggctagcgtggagccccattggatagcagcctctataattctagaatttttcttgatggttcttcttataccagagccggatagacagaggacaccacaggataatcagttagcctacgtggtaatagggttgcttttcatgatactaacggtggctgcgaacgaaatgggccttcttgaaactacgaagaaagatttagggataggccacgtcgctgtggaaaaccatcaccatgccgcaatgctagacgtagatctgcatccagcatctgcttggacattgtacgctgtcgccacgaccattatcacacctatgatgaggcatactatagaaaataccacagcaaatataagtctaacagccatcgcgaatcaagccgcgatattaatggggttggataaaggatggcctataagcaaaatggatattggtgtgcctcttctagcactaggatgctacagtcaagttaaccctttgactttaaccgctgcagttctgatgttggtagcacactatgccatcataggacccggcctacaggccaaagcaactagagaagcacagaaaagaacggcagctgggataatgaaaaatccaacagtcgacggcatagtggcgatagatttagatccagtagtatacgacgcaaaattcgagaagcaattaggacaaatcatgctactcattctatgcacctcccaaattctcttgatgagaactacctgggctctttgtgaaagcataactctagctacgggaccactaacaaccttgtgggagggttcaccggggaagttctggaacacgactatagcagtgtcaatggcaaatatattccgaggtagttatttagcgggggctggattagctttctctttgatgaaaagtctaggtggagggaggcgagggactggtgcgcagggagagacactaggcgaaaagtggaaacgacaattaaatcagctctcaaaatctgaatttaatacctataaaagatcaggcataatggaagtggaccgatctgaggcaaaagagggcttaaagagaggagaaactacgaaacacgcggtttcaagaggaacagctaaattgagatggtttgttgaaagaaatctagtgaagcctgaggggaaagttatcgatcttggatgcggacgaggtggctggtcatactattgtgctggattgaagaaagtaaccgaagttaagggttatacgaaagggggtcccggtcatgaagaaccaataccgatggcgacgtacgggtggaacctagtaaaattacattcaggaaaagatgtatttttcattcccccagagaaatgtgatacattattatgtgatatcggggaaagtagcccgaatcctacaatagaagaaggaagaacccttagagtactaaagatggtggaaccttggctcaggggcaaccaattctgtataaagatcctaaatccgtacatgccatccgtagttgaaacactggagcaaatgcaacgaaaacacggcggaatgctagtacggaatccgctgtccaggaacagtactcatgaaatgtattgggttagttgtggcacaggtaatattgtttctgcagtaaacatgacttcccgaatgctactaaatcgatttacaatggcacatagaaaaccgacgtacgaacgtgatgtggatctaggagcaggaacaagacacgttgcagttgaacctgaagtggcaaacttagacatcatagggcaacgaattgaaaatattaaacatgaacataagagtacttggcactacgacgaagataatccatataaaacgtgggcttatcatggctcttacgaagtaaaaccgagcggatcagcgtccagtatggtaaatggagtagttaaattattaacaaaaccgtgggatgttattccaatggtaacccaaatagccatgacagacacgacaccatttggtcaacagcgtgtattcaaggaaaaagtggacacaagaacaccaaaagctaaacgagggacagcccaaataatggaggtaactgctaaatggttatggggctttttgtcgcgtaacaagaaaccaagaatatgcacgcgagaagaatttacacggaaagtacgtagcaatgcagccataggagccgtatttgtcgacgaaaatcaatggaatagtgccaaagaagcagttgaagatgaaagattttgggatctagtacatcgagaaagagaattgcacaaacaaggtaagtgtgccacctgtgtatataatatgatggggaaacgagagaagaaattaggcgaatttggaaaggcaaaagggtctcgagctatctggtatatgtggctaggggctagattcctggaatttgaggccttaggttttatgaatgaagatcattggttttccagagaaaatagccttagtggagtagaaggagaagggcttcataagctagggtacatattgagagacatatcaaagatcccaggtggcaacatgtatgcggatgataccgcgggttgggatacacgcattacagaagacgatctacaaaatgaggccaggataacagatatcatggagcctgaacacgctttattggctaaatccatatttaagttaacgtaccaaaataaggtcgtaagagtccaacgaccagccaagaacgggactgtaatggatgtaattagccgacgagaccaaaggggatcaggacaggtagggacttatggcttaaacacctttactaatatggaagcgcaattgataaggcaaatggaaagcgaaggcatattctctccttcggaacttgaaacacctaacttagctgaaagagtccttgattggttagaaaaatacggtgttgaaagattgaagagaatggccatatcgggagatgactgtgtagttaagccgatcgacgaccgattcgctacagccttaaccgcactaaacgatatgggaaaagtccgtaaagatatcccgcaatgggaaccgtcaaaaggttggaacgactggcaacaagtaccgttttgtagtcatcatttccatcaactaatcatgaaggacggtagagaaattgtcgtcccatgtagaaaccaagacgagctcgtaggtcgagctagagtttcgcagggcgctggatggtccttaagagaaactgcgtgtctcggaaaaagctacgcacaaatgtggcaactaatgtattttcacaggagagatttacgattagcagcgaatgcaatatgtagcgcagtaccggtagactggatacccacctctaggacgacttggagcatacatgcgcatcaccaatggatgacgactgaagatatgcttagcgtatggaatagggtatggatagaagaaaatccgtggatggaagacaaaacgcatatatcatcgtggggagacgtcccttatttaggcaaaagggaggaccaatggtgcggcagcttgataggcctaacagcccgagctacgtgggcaaccaacatccaagtggccatcaatcaagtaaggcgtctaatcggtaatgagaactatctagattacatgacgtcaatgaaacgattcaaaaatgagtctgaccccgaaggagctctatggtaa

SEQ ID NO: 21823 - RNA, 9879 nt, synthetic construct
  misc_feature 1..9879: note = derived and/or modified CDS sequence (opt6) from DENV-1__JF937609__SS-prME
  source 1..9879: mol_type = other RNA
tcagtgacaatgttgttaatgctgatgcctacagcgttagcgtttcacctaacgactcgaggcggtgaacctcacatgattgtcagtaaacaagaaagaggaaaaagtttgttatttaaaacatctgcgggagtgaacatgtgtactctcattgctatggatctaggagaattatgcgaagacactatgacatataaatgtccacgaattacagaaacggaaccagacgacgtcgattgttggtgcaacgcgactgatacttgggttacatacggtacatgctcgcaaaccggggaacatcgaagagataaaagaagtgtagcactcgccccacatgtcggcctaggcctcgaaacacgcacagaaacttggatgagttccgaaggggcgtggaaacaaattcagagagttgaaacatgggcgctacgacacccaggattcactgtcatagcattgtttttagcacatgcgataggaacatcaataacccaaaaaggaataatctttatcttgctcatgctagtaacaccgtcaatggctatgcgttgtgtgggaataggaagtcgagatttcgttgaagggttaagtggagcaacctgggtagatgtcgtattagaacacggttcttgcgtgacaacaatggcaaaagacaaacctactttagatattgaactgcttaaaacagaagttacgaatccagctattttaagaaaattatgcatagaagcgaaaattagtaatacgacaaccgattcccgatgtccaacacaaggagaggcaactttagtagaggaacaagatgctaatttcgtgtgcagaagaacgtttgtcgatagaggatgggggaatggatgtggtctgtttggtaaaggcagcttaattacttgcgcaaagtttaaatgtgtaacaaagttagagggcaaaatagtacagtatgagaatttaaaatatagcgtgatagtaactgttcatacaggcgatcaacatcaggtaggcaacgaatcaacagagcatgggacaacggccactataacaccgcaagccccgaccactgaaatccaattaacagattatggagcactcacgttggattgcagcccaaggaccggcttagacttcaacgagatggtcctactcactatgaaagagaaaagctggttagtacataagcaatggtttttagaccttccactgccatggacaagtggcgcaagtacttcacaagaaacctggaacagacaagacctcctagtcacttttaaaaccgcacatgcgaagaaacaggaagtcgtcgtactaggttctcaagagggtgcaatgcatactgctctaactggtgcaaccgaaatccaaacaagcggaacaacgaccattttcgccggacatttgaagtgtagactaaagatggacaaacttacattgaagggcatgtcttacgtaatgtgcacaggatcgtttaaattagaaaaagaagtagcagagacgcaacatgggactgtcctagttcagatcaaatatgaaggaacagacgccccatgcaaaattccattttctacgcaagatgaaaaaggtgtaacacaaaacgggagattaatcacggcaaatccgatcgtaaccgacaaagaaaaaccagttaacattgaagctgagccgccatttggtgagtcctacatagttataggtgccggagaaaaggcgttgaaattatcatggttcaagaaagggagttcaatcggtaaaatgtttgaggctactgctcgcggtgctcgccggatggcaattttaggtgacactgcatgggactttggttctatagggggcgtattcacaagtgtagggaaattagtacatcaaatctttggtactgcttacggcgttctattctcaggagttagttggacaatgaagatcggaattggtgtactccttacatggctcggtttaaattcaaggtcaacgagcctaagcatgacctgtattgcagttggcctcgtcaccctttacctgggagtaatggtacaagcagactctggatgtgtgatcaattggaaaggtcgtgagttgaagtgtgggtccggaatattcgtaactaatgaagtacacacctggactgaacagtacaaattccaggccgattctcctaagaggttatctgcagctataggaaaagcatgggaggaaggagtatgtggaataagaagtgctacccgtctggaaaatataatgtggaaacagattagtaatgaattaaatcacattcttttagagaacgacatgaagtttacagtagtagtaggagatgtagcgggaattttagcacaaggtaaaaagatgatcagaccacaaccaatggaatataaatactcctggaaaagttggggcaaagccaaaattatcggggcagacgtccaaaataccacatttataatagatggaccaaatacaccggagtgcccagatgatcaacgggcgtggaacatatgggaggtcgaagactatggttttgggattttcacaacaaatatatggctaaaactgagagatagctacacacaggtttgtgatcacagattgatgtcggcagctatcaaagactcaaaagccgtacatgcagacatgggatactggatagaatcggagaaaaatgaaacctggaaattagctagagcatcctttatagaggttaaaacatgtatctggccgaaatcgcacaccctttggtcaaacggagtgttagaatccgaaatgataattccgaagatatatgggggtccaatttcgcaacataactaccgacctggctacttcacgcaaacagcaggaccttggcatctaggaaagctcgaattagacttcgatctctgtgagggcacaacagtcgttgtagacgaacattgcggaaatagaggtccaagtctccgcactactactgtaacgggcaagataatacacgagtggtgttgtcgctcgtgtactcttcccccacttagattcagaggcgaggatggatgttggtacggtatggagataaggccagtgaaagaaaaggaagaaaatcttgtcaagagtatggtttcagcaggatccggtgaagttgatagttttagcttgggacttctttgcatctcaatcatgattgaagaagttatgagaagtaggtggagtaggaaaatgctcatgactggtacgctagctgtatttttactcttaataatgggacaactcacatggaacgacttgataagactatgtatcatggtaggggcaaatgcatcagaccggatgggaatgggcacaacatatttagcactcatggctacgtttaaaatgcgccctatgtttgcagttgggttacttttcagacgactcacatcacgggaagtactacttttaaccataggtttaagtttggtagcatctgtggaactcccaaatagtttagaagaactcggcgacgggttggcaatgggtataatgatattaaaattattaactgatttccagagtcatcaattatgggccactctgctgagtctgacgttcataaaaacaaccttttctttacactatgcatggaaaaccatggcaatggtattaagtatagttagcctatttcccctgtgcttatccacaacaagtcagaaaactacgtggttacctgtcttattgggctctctaggatgtaaacctctgactatgtttttgatagccgaaaataaaatatggggaaggagatcttggccattaaatgagggaataatggcagtaggaatagtatcaattttgttatcttcactccttaagaatgacgttcctctagcgggtcctttaattgcaggaggtatgcttattgcgtgttatgtgataagcggcagtagcgctgatttatccttagaaaaagcagctgaggtttcatgggaggaagaagctgaacattcaggagcatctcacaacatattagttgaagttcaagatgatggtacaatgaaaataaaagacgaagaacgtgacgatacgcttacaattttattaaaagcaacattgttagccgtctcgggcgtctatcccctttcaatacctgcaactctattcgtatggtatttttggcaaaagaagaaacagcgttctggggtgttgtgggatacaccaagtcctcccgaggttgaacgcgcagtcctcgatgatgggatataccgtattatgcaacggggactactaggcagatctcaggtcggggtaggtgttttccaagaaaacgtattccatactatgtggcatgtgactcgcggagcagtattaatgtaccagggtaaaagattggagccatcatgggcgagtgtaaagaaagatttaataagctacggaggtgggtggagattacaaggatcttggaacactggagaagaagtacaagtgatcgctgttgaacccggtaaaaaccccaaaaatgtccagaccactcctggtacctttaaaacgccagagggagaggttggtgctatcgcactagactttaaacccggcacaagtggttctcctatagtgaatagggaagggaaaatagtgggcctttacggaaatggtgtagtaacaacaagtggaacatatgtctcagctatagcacaagcaaaagcatctcaggaaggtccacttccagaaatagaagatgaggtctttcgaaaaaggaatctaacaataatggacctacacccgggctcaggcaaaaccagacgttatttgcccgccatagttagagaagcgataaaacgcaaactacggacattaatcctagcaccaaccagggtagtagcatcagagatggcagaagcgctaaaaggtatgccaataaggtatcaaacgacagcggtaaagtcagagcatacgggaaaggagattgtggacttgatgtgtcatgcaactttcactatgagattgctatcaccagtgagggttcctaattacaacatgataataatggatgaagctcattttacagaccctagttcaatagcagcacgtggatatatatcaacacgagtaggaatgggtgaagctgctgcaatttttatgaccgccactccaccgggatcagtagaagcattcccacaaagcaatgctgtaatccaagatgaagaaagagatataccagagagatcatggaactcaggttatgaatggataacagattttccaggtaaaacggtatggtttgtacctagcatcaaatcaggtaatgatattgcaaactgtttacggaaaaatgggaagagagtgatacaactatccaggaaaacgtttgatactgaatatcagaagaccaaaaataatgattgggattatgtagtaactacagatattagcgagatgggggcaaatttccgggcggatagggtaatagacccacgcagatgtctcaaaccggtcattctaaaagacgggccggaaagagtaattcttgcaggaccaatgccagttacagttgcgtcagcggcgcaacgaagagggaggatcggtagaaaccacaataaggaaggggatcaatacatctatatgggtcaacctttaaataacgatgaggatcacgcacattggactgaagcaaaaatgctcttagacaatataaatacaccagaagggataatcccagcattattcgaaccagaacgggaaaaatccgccgccatagatggcgagtacagactaagaggtgaagcacggaaaacattcgtcgaactgatgcgcagaggagatttaccagtctggttaagttacaaagtagcaagcgaaggattccaatatagcgacagaagatggtgctttgatggtgaaaggaataatcaagtgttagaagaaaatatggacgtcgaaatttggacaaaagaaggagagcgtaagaaattgcgacctaggtggttagatgcacgcacgtactcggatccactagctttaagagaatttaaagagttcgccgcaggacgtagatcggtctctggtgaccttatcctagaaataggaaagttacctcagcatcttacccaaagagcacagaacgctctcgataatttagttatgctgcataactcagaacaaggaggtcgagcttacagacatgcaatggaagaactgcccgatacaattgaaacattaatgcttcttgcactaatagctgtattaactggaggagtaactctatttttcctgtccggaaggggcctaggtaaaacatctattggtttactatgcgtgatggctagttctgtattgctatggatggcatctgtagaacctcattggatcgccgccagtatcattcttgagttctttctgatggtactattaataccagaacctgatcgacaaagaacaccccaggataatcaattagcgtacgtagttatagggttgctttttatgatactcactgttgcagcaaacgaaatgggccttttagaaacgacaaagaaagatctaggtataggtcatgttgcagtaggtaaccatcatcatgcagctatgctagatgtggatttacacccggcaagtgcatggacactatatgctgttgccaccaccatcataaccccaatgatgcgtcatacaattgaaaatactacagctaacatttctcttaccgccattgcaaatcaggcggcaatactcatgggtctagacaaaggctggccaataagtaaaatggatataggtgtacctttgctagcgttaggatgttacagccaagtaaatcctctgacattaacagccgcagtattaatgcttgttgcgcattatgctattattggtcctggacttcaagcgaaagccacgcgagaagcgcagaaaaggacagcagctggtataatgaaaaacccgacagttgatggcattgtggcgattgacttagacccagtagtgtacgatgcgaagttcgaaaaacagttaggtcaaattatgcttttaatattatgtactagccagatcctactaatgagaacgacgtgggcattatgcgaatcaatcacactggctacaggaccccttacaactctgtgggaaggtagtccgggtaaattctggaatacaactatagccgtatcaatggcaaatatatttagaggatcatatctggctggagccggactagcattcagcttaatgaaaagccttggaggagggaggcgaggtacgggtgcacagggcgaaacactcggtgagaaatggaaaagacaattgaaccaattatcaaaaagtgaatttaatacctataaaaggagcggaataatggaggttgaccgatctgaagcgaaagaaggcctcaaaagaggtgagactaccaaacatgcagtatcccgtggcactgccaaattaagatggtttgttgaaaggaacctagtgaagcccgagggaaaagtaatagatctgggatgcggacgaggcggctggtcatactattgcgctgggctaaagaaagtaactgaagtgaaaggatatactaaaggtggtcctggtcacgaagaacctattcccatggcaacatatggttggaatttagtcaaactacattcaggaaaagatgtgtttttcattcctcctgaaaagtgtgacacactattatgcgacatcggcgagtcaagtccgaacccaaccatagaggaaggtcgtacgttacgagtcctaaaaatggtagagccttggttgagaggaaaccaattttgtataaaaatactaaatccttacatgccaagtgtggtggaaacattagagcaaatgcaacgaaaacacggaggtatgctagtgaggaaccctttgagcagaaactccacacatgaaatgtattgggtgtcatgtgggaccggaaatatagtttcagcagtcaatatgacaagtaggatgttacttaatcgatttacaatggcacaccgaaaaccaacttacgaacgagacgtagatttgggagcaggtactcgacatgttgcagtggaacctgaagtagcgaatttagacataattgggcagcgtatagaaaacatcaaacacgaacataagtctacttggcattacgatgaagataacccatataaaacatgggcctatcacggctcatatgaggtaaaaccttccggctcagcaagtagcatggtcaacggcgttgttaaactattaacgaaaccctgggacgtgatccctatggtaacgcagatcgccatgacagacactactccattcggacaacaaagggtctttaaggagaaagtagatacccgtacaccaaaagctaagcgtggtacggcccaaattatggaagtaaccgcgaaatggttgtggggatttttatcaagaaataaaaagccacgcatttgtacgagggaggagtttacaagaaaagtaagatctaacgccgccattggcgcagtttttgtagacgaaaatcaatggaactcggctaaggaagccgtggaagacgaacgattttgggatcttgtacaccgagaaagggagctacataagcagggcaaatgcgccacttgcgtatataatatgatgggcaagagagagaagaaactcggagagttcggtaaggcaaaaggatcccgagcaatttggtatatgtggctgggagcaaggtttctcgaatttgaagcactagggtttatgaacgaagatcactggtttagcagagaaaattcactgagtggtgttgaaggagaaggattgcataaattgggatatatcttaagagacatttcgaaaattcctggtggcaatatgtatgcagacgatactgcaggttgggatactagaattacggaagacgatctacaaaatgaagccagaattactgatataatggaaccagaacatgcattattagcacgtagcatcttcaaactaacatatcaaaataaggtagttagagtacaacgtccggccaaaaacgggactgttatggatgtgatatcaagacgggatcaacgcggtagcggacaagtaggaacatacggcttaaacacattcacaaacatggaggcacagcttataagacaaatggaaagtgaaggaatattttctccatctgagcttgaaacacccaatctggcagagcgtgtactcgattggctagaaaaatacggggtagaaagattaaaaaggatggctatcagcggcgacgattgcgtagttaagccaatagacgatcggttcgcgacagccctgacagccttgaatgatatgggaaaagtacgaaaagacataccacagtgggagccatctaaaggatggaatgactggcagcaagttccattctgttcgcatcactttcatcaattgatcatgaaagacgggcgagaaattgtagtaccctgtaggaaccaagatgaactggtaggacgggcgcgagtttcacaaggtgccgggtggagcctgcgagaaacagcctgtctcggaaaatcttatgcacagatgtggcaattaatgtatttccatcgtcgggatttacgcctagctgccaatgcgatctgttccgctgtgccagtagactggatacctacttctcgaactacgtggagtatacacgcacatcatcagtggatgacaacagaggacatgctaagcgtttggaatagggtatggattgaggaaaacccttggatggaggataagacacatatctcaagctggggcgacgtgccatacctaggcaaacgagaagatcaatggtgcggcagccttattggattaacggcgagggcgacgtgggcaaccaatattcaggtggctataaatcaagtccgaagactaatagggaacgagaactatctggattatatgacttcaatgaaaagatttaaaaatgaaagcgaccctgagggggctctttggtga

SEQ ID NO: 21824 - RNA, 9879 nt, synthetic construct
  misc_feature 1..9879: note = derived and/or modified CDS sequence (opt6) from DENV-1__KF921949__SS-prME
  source 1..9879: mol_type = other RNA
agcgtaacgatgctgcttatgttgatgccgactgcactcgcatttcacttaactactagaggaggagaacctcatatgattgtttctaaacaagaaagagggaaatcattattgtttaaaacttcagctggtgtaaatatgtgcacattaatagcaatggatcttggagaactttgtgaagacacgatgacatataaatgtcccagaataacggaaacagaacctgatgatgtagattgctggtgcaatgccactgatacttgggtaacatatggtacctgcagtcagacgggtgaacatcgacgtgacaaaaggtccgtcgctttggcaccgcacgtcgggcttggtttagaaacacgaactgaaacttggatgtcaagtgagggtgcatggaaacagatccaacgggtagaaacatgggcactaagacatccaggtttcacagtaatagcactattcttagcacatgcaattggtacctccatcacacagaaaggcattatttttatactcttaatgctagtaacaccatctatggcaatgagatgcgtagggattggaagtcgggattttgttgaaggtctctctggagctacttgggtagatgtagttttggaacatggatcatgtgtaacaaccatggcaaaagataaacccacccttgatatagaactattaaaaactgaagtcacaaatccagcagttttgagaaaactatgcattgaagcaaaaataagtaacacaacaacagactccagatgccccacccaaggagaggctaccttagtcgaagaacaagacgcaaattttgtttgtcgccgaacatttgtcgatagaggttggggaaacggctgtggactattcggtaaaggtagccttattacttgcgcaaagttcaaatgtgttaccaaattagagggaaagatcgtccaatacgaaaatctaaagtattctgttatagttacagttcatacgggtgaccaacatcaagtagggaatgaaagtacggagcatggaacaactgccactataacacctcaggcaccgactactgaaatacaactcacagactacggagccctcacactggattgcagtcctaggactggcttagatttcaacgaaatggttctgctaacaatgaaggaaaaatcatggttggtgcacaagcagtggtttctagatcttcctttaccgtggacatcaggtgcatctactagccaagaaacatggaataggcaagatttgttggttacgtttaaaaccgctcatgccaagaaacaagaggtagtagtgttagggtcccaggaaggtgccatgcatacagccttgacaggagcaactgaaatccaaacttcagggactacaaccatcttcgcgggccatcttaaatgtagacttaaaatggataaactaacactaaagggaatgagttatgtgatgtgcactggtagtttcaaattagaaaaagaagttgctgaaactcaacacggaacggtattagtccaaataaaatatgaaggtacagatgctccatgtaaaatcccattctcaacacaggatgagaaaggtgtaactcaaaatgggcgattaattacggccaatccgatagtgacagacaaagaaaaaccggtgaacatcgaagcagaaccgccctttggggagtcatacatagtaataggggccggcgaaaaagcactaaaattgagttggtttcggaaaggtagctctattggaaaaatgtttgaagcaaccgcaaggggagcacggagaatggcaattctaggggatacggcttgggattttggctcaatcggaggagtctttacatctgtaggaaagctagtacatcagattttcggaacagcctatggcgttttattcagcggggtatcttggacaatgaagattgggattggagtgcttttgacctggttgggactaaattcacgtagcacgtccctcagcatgacttgtatcgccgtaggtctagtgactttgtatttaggggtaatggtacaagcagacagtggatgtgtcattaactggaagggaagggaacttaaatgtggcagtggaatattcgtaactaatgaagtgcacacatggacagagcaatacaagttccaagcggattcacctaaacggttaagtgcggcaataggaaaggcatgggaggaaggtgtatgtgggattcgctctgcaactcggctggagaatatcatgtggaaacagatttccaacgagttaaatcacatattactagagaacgacatgaaattcacagtagtggttggggacgttacgggcattcttgctcagggaaagaaaatgattagaccacaaccaatggagtacaaatatagttggaaatcatggggaaaagccaaaataataggagcagacgtccagaacacaacatttatcatcgatggaccaaatacacccgaatgccccgacgatcaaagagcatggaatatatgggaagtcgaggattatggatttgggatattcacaacaaacatttggttgaaattaagagatagctacacgcaagtatgcgaccaccgcttaatgagcgcagcaataaaagactccaaagcagttcacgcggatatgggatactggatcgaaagtgagaaaaacgagacttggaaacttgcccgtgcgtcctttatcgaagtcaagacttgtatatggccgaaaagtcatacactatggtccaatggagtactagaatcagaaatgataataccgaagatctatgggggacctatatctcaacacaattacagacccgggtattttacacaaacggcgggaccgtggcacttaggtaaattagaattagattttgatctatgtgagggaaccacagtcgttgttgatgaacattgcggtaatagaggcccatcactacgtacaaccacagtcaccgggaaaataatccacgaatggtgctgccgttcatgcacactaccgccattgagatttagaggagaggacggttgttggtatggaatggaaataagacctgttaaagaaaaagaagagaatctagtaaagtctatggtaagtgctggttccggagaagtagattcctttagtctagggcttctatgtatatccattatgatagaggaagttatgcggtcacgatggtcaagaaaaatgctgatgacgggaacactagcggtatttctactattgattatgggtcagcttacatggaatgatttaataaggttatgtataatggtgggagcaaacgcctcagatagaatgggtatgggaactacctacctggccctaatggctacctttaaaatgcgaccaatgtttgccgttggattacttttccgacggctaacaagtcgtgaagtcttactccttactattggactatctttagtggcttcagtagagttaccaaactcattagaagaattgggtgatggactagctatggggattatgattctaaagttgttaacggactttcaaagtcaccaattatgggccacattattatcacttacatttattaaaactacattctctttacactacgcgtggaagaccatggcaatggtactatcaatagtaagtttatttcccctatgcttaagtacaacttcacagaagactacttggcttccagtacttttgggatcattgggctgtaaaccgttaacgatgtttcttattgcagaaaacaagatatggggtagaagaagttggccgttaaatgagggcattatggcggtgggaatagtatccattttgctgagttcactactgaaaaacgatgttcccttagcagggccactaattgcgggtggtatgctcattgcatgctacgtaatttcgggaagttcagcagaccttagccttgaaaaggcagcagaagtgtcatgggaagaggaagcagaacacagtggtgccagtcataatatactcgtagaagttcaggacgacggtacgatgaaaataaaagacgaagaacgtgacgatacactaacaattcttctaaaagcgacattacttgccgtgtcaggcgtgtaccctctttctatccccgcgactttattcgtttggtacttttggcaaaagaagaaacaacgctcaggagtcttgtgggacacgccgtcaccaccagaagtcgagagagcggtactagatgacggcatttatcggattatgcaaaggggtcttctaggaagatcacaagtcggtgttggtgtcttccaagagaatgtattccatacaatgtggcacgtaactagaggtgcagtattgatgtaccagggaaaaagactcgaaccatcatgggcaagcgtcaagaaagatctgattagttatggaggtggatggagattacaaggctcttggaatacaggcgaggaagtacaagttatagccgttgaaccgggcaaaaacccaaagaatgttcaaaccgcaccaggaacctttaaaacaccagagggcgaagttggggcgattgcccttgatttcaagccaggaacatcaggaagtccaatagtaaacagagaaggaaagatcgtagggctgtacggaaacggcgtcgtaactacaagcggtacatatgtctcagcaatagcacaagcgaaagcaagtcaagaaggccctttaccagaaatagaagacgaagtttttcgaaaacggaacttaacaattatggaccttcaccctggatctggtaagacaagaagatacttgcccgcaatagtgcgtgaggctattaagaggaagttgcgtacgctaatcctagcacctacgagagtagtcgcaagtgaaatggcagaagcattaaaggggatgccgataagatatcaaacaacggctgtaaaaagtgaacatacgggaaaagaaatagtagaccttatgtgtcatgctacattcacaatgagattgctatcgcccgttcgggttccaaattataatatgatcatcatggacgaggctcattttacagacccgtcatctattgcagcaaggggatacatttctaccagagtaggaatgggagaagctgccgctatatttatgacagcaacacctccaggcagtgtcgaagcctttccacaatccaacgctgtcatacaggacgaggaacgtgatatcccagaacgctcctggaatagtggttatgaatggataaccgacttcccgggaaaaacggtctggttcgtcccaagtattaaaagcggaaatgacattgcaaactgcttgaggaaaaatggtaaaagggtaatacagttgtctcgaaaaacatttgataccgaatatcagaaaacgaagaacaacgactgggattacgtagtaaccactgatatatcggaaatgggtgcaaactttcgtgcagatagagtaatagaccctcgcagatgcctgaagccagtgatcctaaaggatggaccagaaagggtgatcctagctggaccgatgccagtgacagtcgcatctgccgcacagaggaggggacgcattggaagaaaccataacaaagaaggtgatcaatacatatatatggggcagccgctcaataatgacgaggatcatgctcattggacagaagctaagatgctattagacaacattaacacaccagaaggcattatacccgcacttttcgaaccagaaagagagaaatctgctgcaattgacggcgaatacaggttacgcggtgaggctagaaaaacgtttgtagagttgatgagaaggggtgacctacctgtatggctgtcatataaagttgccagtgaaggattccagtatagtgaccgccgatggtgttttgatggagagagaaataaccaagttttagaagaaaacatggatgtggaaatatggacaaaagagggtgagagaaagaaactacgaccacgatggttagacgcgagaacatattccgatcctcttgccttacgtgagttcaaagagtttgccgcagggcgccgtagtgtctcgggagatttaatcttagagataggtaaacttccacaacatctgacacagagggcgcagaacgcattagacaacctagtaatgttacacaactccgaacagggagggagggcctaccgacatgccatggaagaattacctgatacaatagaaactttgatgctccttgcattaatcgctgttctaacaggtggagtaacccttttcttcttgtcaggtagaggattaggcaaaacatcaataggactgctttgtgtaatggcttcaagtgtgcttttgtggatggcaagcgtcgagccccattggatcgctgcgtctattatccttgagttctttttgatggtgttattaattcctgaacctgatcgacaacgaacgcctcaagacaatcaactagcatatgttgtcataggcctactttttatgatactaaccgtagcagctaacgaaatgggacttttagaaactactaaaaaggatttgggaataggacacgtcgcagttgagaaccatcatcacgctgcgatgctggacgtagatctacacccggcttcggcttggacactatatgcagtagctaccactattattacgcccatgatgcgacatacaatagaaaatacaacggcaaacatttccttaactgcaattgccaatcaggcggctattttgatgggattagataagggctggcctataagtaaaatggatataggagtccctctgttagcattaggttgttattcacaggttaacccacttacactcacggcagctgtattaatgcttgtagcccattacgcaataataggacccgggttacaggccaaagctacgcgagaagctcaaaagaggacggcagctggaatcatgaagaacccaacggtagatggcattgtggctatagatcttgaccccgtagtgtacgacgcaaaatttgaaaaacaacttggccaaataatgttactcatactatgtaccagtcaaattctcttaatgaggacaacctgggcattatgtgaatcaattacattagcaacaggacctctcacaactctatgggaaggttcaccaggaaagttttggaatactaccatagcggtaagcatggcgaatatattcagaggttcatatttagcaggagcagggttagcgttttcactcatgaaaagcctgggcggaggacggcgtggtacgggagcccaaggcgaaactctgggagaaaagtggaagagacagttgaatcaacttagtaaaagcgaatttaatacctataagaggagtgggattatggaagtagatcgttcagaagccaaagaaggtttaaaaagaggagaaacaacaaaacacgcagtttcgcggggaacagcaaaactacgttggttcgttgaacggaatttagtcaaacccgagggtaaagttatagacctaggatgtggaagaggaggttggagttattattgtgccggactaaagaaagttacggaggtaaaaggatatacaaaagggggaccaggacacgaggaaccaatccctatggcaacttatggatggaatttagttaaactccacagcggcaaagacgtatttttcatcccaccagagaagtgtgacactttattatgtgacataggcgaaagttctccgaatccgactatcgaagaagggagaactcttcgcgtccttaagatggtagagccatggttgagaggaaatcaattctgcatcaaaatcctcaacccttacatgccctcagttgtagaaacattagagcagatgcagagaaagcatggtggtatgttagtgcgaaacccactaagcagaaatagcacacatgaaatgtattgggtgagctgtggaaccggcaatattgtttctgcagtcaacatgacaagtcgcatgctacttaatagatttactatggcccatcgtaaaccaacctatgaacgcgatgtcgatcttggggcaggaacaagacacgtagcagtcgagccagaagttgctaacttggatattataggtcaaaggattgaaaatatcaaacatgaacacaaaagcacatggcattatgacgaagacaacccatataaaacatgggcttatcacggaagctacgaggttaaaccgtctggatcagcttccagtatggtgaatggagtagtaaagctattgacgaagccgtgggatgtaataccaatggttacacaaatcgctatgactgataccacaccattcggacaacagagggttttcaaagaaaaagtcgacactcgcactccaaaagccaaacgtggaacagcacagataatggaggtaactgccaagtggttatggggttttctcagtaggaataagaaaccgcgaatatgtactagagaagagtttactaagaaagtaagaagcaatgctgcaataggtgctgtgttcgtagacgaaaatcaatggaactcagctaaggaagcagttgaggacgaaagattctgggatttagtacaccgggaaagagaattacataaacaaggcaagtgtgctacatgtgtctataatatgatgggaaaaagagagaagaaattgggtgagttcggcaaggctaaaggtagtagagcaatatggtacatgtggctcggagcaagatttttagaatttgaagctcttgggtttatgaacgaagatcattggttttcgcgtgaaaattccctctctggcgtggaaggagaaggcttgcacaaattagggtatatattacgagatatcagtaagatcccagggggtaacatgtatgcggatgataccgctggatgggatacaagaataacagaagacgatctgcaaaatgaagccagaatcacagacatcatggaacccgaacacgctctattggcaaaaagtatattcaaacttacctatcaaaataaggtagtaagagttcaacgtccagcgaagaatggcacagtaatggacgtaatcagtcggcgcgaccagcgaggaagcggacaggtaggaacatacggactaaatacttttacaaatatggaagcccaattgatcaggcagatggaatcggaaggtatattttcacctagcgaacttgaaacaccgaacctagcagagagagtattagattggctagaaaaatatggggttgaaagactaaagcgcatggcaatctcaggggacgactgtgttgtaaaaccaatcgacgatagatttgcaacagcactaacagcgctaaatgatatgggtaaggtccgaaaagatattcctcagtgggaaccaagcaagggatggaatgattggcaacaagttccgttctgtagtcaccatttccatcaacttattatgaaagatggaagagaaatagtagtcccctgtagaaaccaggacgaattggttggacgagctagggtgagtcaaggtgcagggtggagtttacgtgagacagcttgtctcggaaaatcttatgctcagatgtggcagttaatgtacttccataggagagacctaaggctagccgctaatgctatatgtagcgcagtccctgtggactggataccaacatctcgtactacgtggagtatacacgctcaccaccagtggatgacaacagaagacatgttgtcagtatggaatagagtttggattgaagaaaatccctggatggaagataagactcatatttcaagttggggagacgttccatatttaggaaaaagagaagatcagtggtgtggtagtctcatagggttgacagcgagggctacatgggctactaacatacaagttgcgataaatcaggtgcgacggttgattggtaatgaaaactatctagactatatgacatcgatgaaacggtttaaaaatgaatcagacccagagggggccctatggtaa

SEQ ID NO: 21825 - RNA, 9879 nt, synthetic construct
  misc_feature 1..9879: note = derived and/or modified CDS sequence (opt6) from DENV-1__GU131747__SS-prME
  source 1..9879: mol_type = other RNA
agcgtaactatgttgcttatgttaatgccaactgcgttagcctttcacctaacaacacgcggaggagaaccacacatgattgtcagcaaacaagaaaggggaaaatcgttgttatttaaaactagcgccggtgtgaatatgtgcacattgatagccatggatctaggagaattatgtgaagatacaatgacttacaaatgtcctagaatcacagaaactgaacctgacgatgttgactgctggtgtaatgcaacagatacttgggtaacgtacggaacatgttcccaaactggagaacacagaagagataaaagatcagtggcattagctccacatgttggtctcggtttagagaccaggaccgagacttggatgagctcagaaggagcgtggaaacaaatccaacgtgtagagacttgggctctcagacatccgggttttaccgtaattgctttatttcttgcacatgcaataggtacttcaataactcaaaaaggaataatatttatactgctaatgttagtcacgccaagcatggccatgagatgtgtagggataggatcaagagactttgtggaggggctttctggtgcaacgtgggtggatgtcgtattagaacacgggagttgtgtaacgacaatggccaaagataaaccaacattagacattgagctattaaaaactgaagtaactaacccggcagtcttaagaaaactatgcattgaggccaaaataagtaataccactacggacagtaggtgccctacccaaggagaagcaactctagtcgaggagcaagacgcaaattttgtttgtcgtcgcacatttgttgacagaggttggggaaatggctgcggactatttggcaaaggctcattgattacgtgtgccaaatttaaatgtgtcacgaaattagagggtaaaattgttcaatacgaaaatttaaaatacagtgtaattgtaactgtccatacgggtgatcagcatcaagtaggaaatgaatccaccgaacacggcacgacagccacgataactccccaagccccaacaaccgaaatccaactaactgattatggagctcttacgttagactgttcacctaggacgggtcttgactttaatgagatggttctgttaacaatgaaagagaaaagctggttagtccacaaacagtggtttttagatttgcctttaccatggacttcaggagcaagtacatctcaagaaacatggaatagacaggatttgttggttacatttaaaacagcgcacgctaagaaacaagaagtagtagtcttaggttcgcaagaaggagccatgcacacagcattgacaggtgccacagaaattcaaacttcggggactacaaccatttttgcaggacatctcaagtgtagattaaagatggacaaattaaccttaaaaggaatgagctacgtaatgtgcacaggcagctttaagctcgaaaaagaattagcagaaacacagcatggtactgtgctagtgcaaataaagtatgaagggacggatgctccgtgcaaaatcccattctctacgcaagacgaaaagggtgttactcaaaacgggcgactaataacggccaatcctattgtaacagataaagagaaaccagtcaatattgaggctgagccaccctttggagaatcttatatagttataggtgcaggagaaaaagctctaaagctatcctggtttaagaaaggatcgtcgataggaaagatgtttgaggcaactgcaaggggagctcgtcgtatggctatattaggagacacagcttgggacttcgggagtataggtggtgtatttacatcagcaggcaaattggtacatcaaatattcggaacagcttatggggtattattttcgggggtatcgtggacaatgaaaattggaattggcgtactactaacctggcttggtctaaattcaaggagcacatccctaagcatgacttgtattgcagttggcctagtaactctttacctcggagtgatggtacaagcggactctggatgtgtcataaattggaaaggaagagaattaaagtgtggaagtggaatatttgtaaccaatgaagtacacacctggactgaacaatataaattccaagcagattccccgaagaggcttagtgcagcaataggaaaagcctgggaggaaggtgtttgcggcattcgttcggcgactcgacttgaaaatattatgtggaaacaaatttcgaatgagcttaaccatatccttctcgaaaatgatatgaaatttactgtggtggtaggggacgtagcagggatactagcacaagggaagaaaatgatccgacctcaaccaatggagtacaaatatagttggaaatcatggggaaaagctaaaatcataggggcagatgttcaaaacaccacctttattattgatggacccaatacacccgaatgcccagatgaccaacgtgcctggaatatatgggaggtagaagattatggttttggaatttttacaactaacatttggctgaagttgcgtgattcatatacgcaagtgtgtgatcacagattgatgtccgcagcaattaaagattcaagagcggttcacgcggacatgggttactggatagaatcggagaaaaacgaaacttggaaattagctcgcgcgtcatttatcgaggtgaaaacatgtatctggcctaaatcgcatacgctttggtccaatggagttcttgagagtgaaatgatcataccgaaaatatacggtggtcctatctctcaacataattatagaccaggttatttcactcaaaccgcgggtccctggcatctaggaaaacttgaattagattttgatttatgcgaaggaacgactgtagtagtagatgaacattgcggtaataggggaccatcattgagaacaacgacagttacaggtaagataatacacgaatggtgctgtcggtcttgcacgctacctcctttgcgatttagaggggaagacggttgttggtatggaatggaaattcgacccgtcaaagaaaaagaggagaacttagtgaaaagtatggtatcggcaggcagcggagaagttgactcattctcccttggattactttgcatctctattatgattgaagaagtcatgaggtcaagatggtctcggaaaatgctaatgacaggcactttggctgtatttttcctactaataatgggacaactgacatggaacgacctaattagactgtgtataatggtcggggctaatgcttcagacagaatgggtatgggaacaacatacttggcactgatggccacttttaaaatgaggccgatgtttgcagtgggactgctattcagacgactgaccagtcgggaagtgttattacttaccattggtctttctttagtcgcatcagttgaactgccaaattcactggaagaattaggtgacggcttagcaatggggattatgatcttaaagttgctaacggattttcaaagtcaccaactatgggcaacgttattgagtttaaccttcataaaaacaactttctccttgcattatgcatggaagacgatggcaatggtattgagcatcgttagtctgtttccgctttgcctttcaacgacttctcagaaaacaacgtggttaccagtatttctaggtagtttaggatgtaagccgttaacaatgtttcttattgcagaaaacaaaatttggggcagacgctcatggcctctcaatgaaggaatcatggccgtaggaattgtgtcaattctcttatcatctttactcaaaaatgatgtgcctttagcaggacctttaatcgcaggcggtatgctgattgcatgttacgtaatatcgggatccagtgccgatctatctctagaaaaagccgcagaggttagctgggaagaagaagcagaacattcaggcgcatcacataatatactcgtagaagtgcaagatgatggcaccatgaaaataaaagacgaagagagagacgatacacttacggtcttgctcaaagccacacttttagcagtcagcggagtatatccattatcgatccctgctacccttttcgtatggtatttctggcagaagaagaaacaaagatcaggagtattatgggataccccatcaccacccgaagtggagcgggcggtattagatgatgggatatatagaattatgcaacgtggactcttaggtaggagccaagtaggtgtgggagtttttcaagaaaatgtgttccacacaatgtggcacgttacaagaggggctgtccttatgtatcaaggaaaaagacttgaaccgagctgggcaagtgtcaagaaagatttaatatcatatggaggtgggtggaggctacaagggagctggaacacaggggaagaagtacaagttattgctgtagaaccgggcaaaaaccccaaaaacgtacaaactgcacccggcacattcaaaaccccagagggcgaagtcggagccatcgcattagactttaaaccaggaaccagtgggagtcccattgtgaacagagaagggaagatcgtgggcctttacgggaacggtgttgtgacaacatcagggacatatgtatcagccattgctcaagcaaaggcgtcgcaagagggacctttacctgaaatagaggatgaggtgttccgcaaacgcaacctcacgatcatggatttacacccagggtcgggtaaaacaaggagatatttgccagcaatcgtcagagaggctataaagagaaaactaagaacattaattctggcccctactcgagttgtcgcatccgaaatggcggaagctcttaagggcatgcctatccgttatcaaacaacagcggtcaaaagtgaacatacgggaaaagagatcgtagacttaatgtgtcacgctacatttacaatgagactactatctcctgttcgagttccaaattacaacatgataataatggatgaggcacactttacagacccaagttccatcgctgcacgaggttacatttctacgagagtagggatgggggaggctgcggcaatatttatgactgcaactcctccaggtagtgtagaagcattcccacagtcaaatgcagttatccaagatgaagagagagatatacccgaacgttcatggaatagtggttatgaatggattacagactttccgggaaaaactgtctggtttgtgccgtcaataaagtcggggaacgatatcgcaaactgcttgaggaaaaatggaaaacgggttatacaactatcccgtaaaacttttgacactgaatatcagaagacaaagaataacgactgggattacgtggtgacaactgacataagtgagatgggagccaactttagagcagaccgagtaatagacccgcgacgttgtttaaaaccagtcattttaaaagatggccctgaacgagtcatattagcaggcccaatgcctgtaacagttgcatcagcagcacagaggagaggacgaatcggcagaaaccacaacaaagaaggtgatcaatacatttatatgggtcaaccattaaacaatgatgaagatcacgctcattggactgaagcgaaaatgttattggataatatcaacacgccagaagggatcattccggccttgtttgaaccggaaagagagaaaagtgcagcgattgacggggagtacagacttagaggcgaggcgcgaaaaacgtttgtagaactgatgcgacgtggtgatcttccagtttggctttcatataaagtagcatcagaggggttccagtactctgacagaagatggtgttttgacggagaaagaaacaatcaggttctcgaagagaatatggacgtggaaatctggacaaaggagggcgagcgtaaaaagctaagaccccgctggttggacgcgagaacatacagtgaccctttggctctacgagaatttaaagagtttgcggcggggagacgttcggtatcaggtgatctaatattggaaataggtaaattaccacaacaccttacccaacgcgcacagaatgctttagataatctagtaatgctacataacagtgaacaaggagggcgggcatatagacacgcaatggaagaactaccggatacaatcgaaacgttaatgttactcgctttaatagctgtcttaacagggggagtaacattattctttctcagcggtagaggactaggcaaaacgagcatcggactattatgcgtaatggcctcaagtgttttactatggatggcgtcggtagaaccgcattggatagccgcttctataatccttgagttctttctaatggtccttctaattccagaaccagatagacaaagaactccgcaggataatcagttagcatatgtagttattggactcctatttatgatactgactgtagcagcaaatgaaatgggcctactagaaactaccaagaaagatcttggaatagggcatgtagcagtggagaaccatcatcatgcagcgatgttagatgttgacctacacccggccagtgcgtggaccctctatgccgtcgcaaccacaataataacgcctatgatgcgtcatacaatcgaaaatactactgccaatataagtttgacagccatagctaaccaggcggctattttaatgggtttagataagggctggcctatcagtaaaatggatataggcgttcctctacttgcgctagggtgttacagccaggtaaatcctctaacactcacagctgcagtcctaatgttagttgcacactatgctatcattggaccaggtttacaagctaaggcaactagggaagctcagaaaagaacagccgcagggattatgaaaaaccccacagtagatggaattgtagcaattgatttagaccccgtcgtctatgacgcaaaatttgagaaacaattgggccaaatcatgctattaatactttgtacttcacaaatcttattaatgagaaccacttgggccctatgtgaaagcataactctagcgactggacctctcactactctctgggagggttccccgggaaaattctggaatacaactatagctgtcagtatggcaaatatattcaggggttcgtatctagctggtgcagggttagcattttcccttatgaaatcacttggagggggcagacgaggtactggtgcacaaggtgaaacattaggggaaaaatggaaaagacaactgaaccaattatcaaaaagcgaatttaatacgtacaaaagaagtgggataatggaagttgataggtcagaagcaaaagaaggccttaaaaggggcgaaacgaccaaacatgcggttagcagagggacagctaaattgcgatggttcgtggagcgaaatttggtaaaaccagagggaaaggtaattgatctgggctgtggtaggggaggctggtcttactactgtgcaggattgaagaaagtgacagaagtgaaaggctatactaaaggcggtccaggacatgaagaacctataccaatggctacatatgggtggaatttagtgaaactccactctggtaaagatgtattctttataccccctgaaaaatgcgacacactactttgtgatataggtgagagtagtccaaatcctacaatcgaagaaggaaggactttaagagtattgaaaatggtagaaccatggcttcgaggaaatcaattttgcattaaaatattaaacccatacatgccttcagtggtagaaacactagaacaaatgcagcgcaagcacggaggaatgttggtgagaaatcccttgagccgtaactcaacacatgaaatgtattgggtgtcatgtgggaccggaaacatagtgtccgcagtcaatatgacatctagaatgctattaaacagatttacaatggctcatcgtaaaccaacatatgaaagagacgtggacctaggtgctggaacacgacatgtagcagttgagccagaagtcgctaaccttgacataatcggtcaaagaattgaaaacataaaacacgaacacaaaagtacatggcattacgatgaagacaacccgtataaaacgtgggcgtaccatggtagttatgaagttaaaccctccggttcagcatctagcatggtaaatggtgtcgttaagttgcttacaaaaccgtgggatgtaataccaatggtaacccaaattgccatgacagatacaacaccttttggacaacaaagagtatttaaggaaaaagtggacactagaacacctaaagccaagcgaggtacagctcaaatcatggaagtcacagcaaaatggttatggggcttcctaagcagaaacaagaaaccgagaatctgtactagggaagagttcacaaggaaagtaaggagtaatgccgcaatcggagcagtatttgttgatgaaaaccaatggaatagtgcaaaagaggcagtcgaagacgagcggttctgggatcttgttcatagagagagagaactccataaacagggtaagtgtgccacctgtgtttataacatgatgggaaaacgagagaagaaattaggcgagttcggcaaggcgaaagggtcgcgcgccatatggtacatgtggttaggagccagatttttggaatttgaagccttagggtttatgaatgaagatcattggttcagccgcgaaaattcattatccggagtggaaggagaaggacttcataaacttggttatatcttaagggatattagcaagatccccgggggaaacatgtatgcagacgatacagccgggtgggacacaagaataacagaagatgacttacaaaatgaagcacgaatcactgacataatggaacctgaacacgcgcttctagcaaaatcgatatttaagttgacctaccaaaataaagtagttcgagttcaacgaccagccaaaaatggcacagttatggatgtaatatctagaagggatcaacggggctcgggccaagttggaacatatgggttaaatacgttcaccaacatggaagcacaactaatacgacaaatggaatccgagggtatattttcccccagcgaactcgaaactccgaaccttgcggaacgagtactagattggctagaaaaacatggggttgaaagattaaagagaatggcaattagtggagatgattgtgttgtaaaaccaatagatgatagatttgcaaccgctctgactgccctgaatgacatgggaaaagttcgcaaagacattccacaatgggaaccatcaaaaggctggaatgactggcagcaggtaccgttctgttcacaccactttcatcagttaattatgaaagatggaagagaaattgtagtaccttgtcgtaaccaggatgagctagttggcagagctagagtatcgcaaggtgcaggatggtctctgcgcgaaacagcttgtttaggaaaaagctacgcccagatgtggcaattgatgtattttcaccggcgcgacttacgcttagcagccaacgcgatttgcagcgccgtaccagttgactggataccaacttctcgtacaacatggagtatacatgcacaccaccagtggatgactactgaagacatgctatcagtatggaatagagtatggatagaggagaacccatggatggaggataaaactcatatcagtagttggggtgacgttccatacctcggtaaacgtgaagatcagtggtgtggtagtttaataggtctaacagctcgtgcaacttgggcaacaaatatacaagtagcaattaaccaggttaggcgattgatagggaacgaaaattaccttgattacatgaccagtatgaaacgtttcaagaacgaaagtgacccggaaggggcgctatggtga

SEQ ID NO: 21826 - RNA, 9879 nt, synthetic construct
  misc_feature 1..9879: note = derived and/or modified CDS sequence (opt6) from DENV-1__GU131748__SS-prME
  source 1..9879: mol_type = other RNA
tcggtcactatgctattcatgttagtgccaactgccttagctttccaccttaccacccgcggaggggaacctcacatgatcgtatcaaaacaagaaagagggaaatcactcttatttaaaacctccgcaggagtaaatatgtgtacattaatagccatggatctaggagaattatgtgaagacaccatgacatataaatgcccgcgtataaccgaaacagaaccggacgatgtggattgttggtgcaatgcaacggacacctgggtaacctatggtacatgttcccaaactggagaacacaggagagataaacggtcggtcgccctcgccccacatgttgggcttggattagaaacgagaacagaaacatggatgtcatccgaaggagcatggaaacaaatccaacgagtggaaacgtgggcactgaggcaccccggcttcacagtgattgcattatttctagcacatgccattgggacatcaataactcaaaaagggatcatctttatattgctcatgctagtaacacccagcatggcgatgcgatgcgtcggaattggctcccgcgatttcgtcgaaggattgagtggagctacatgggttgacgtagttttagaacatggatcgtgtgtcacgacgatggccaaagataaacccacactcgatatcgaattactaaaaaccgaagtgactaaccccgctgtgttacgaaaactctgtattgaagcgaaaatatcaaacacaacaaccgacagcagatgtccaacacagggagaagccacgctagtggaagaacaagacgcaaattttgtgtgtaggagaacatttgtcgaccgtgggtgggggaatggttgcgggttatttggaaaaggatctttaataacgtgtgcaaaatttaaatgtgttacaaaattggaaggcaaaatagtacaatatgagaatttaaaatacagtgtcattgttaccgtacatacgggtgaccaacatcaagttggcaacgagtcaacagaacatggtacgacagctacaatcacaccccaagcccctacaaccgagatacaacttaccgattatggagccttgacactagactgttcaccacgaactggactggattttaatgaaatggtacttctcacgatgaaagagaaatcctggttagtacataaacaatggttcctggatttaccattaccctggaccagtggagcaagtacaagccaagaaacatggaatagacaagatctgttggtaacattcaaaacagctcatgcgaagaaacaggaagtagtagtcctagggagccaagaaggtgctatgcacactgcacttactggcgccactgaaatacagacaagtgggacaacaacaatctttgccggccacttaaaatgtaggcttaaaatggacaaattaacacttaaaggtatgtcttacgtaatgtgcactgggtcttttaaattagaaaaagaagttgcagaaacacaacacggtacagtacttgtgcaaataaaatacgagggaacagacgcaccatgtaaaatacccttctccacacaagacgagaaaggagtcactcaaaacggacgtttgataactgcgaatccaatagttactgataaagagaaacctgtaaacatagaagccgagccacctttcggggaatcatacattgtgataggcgctggagagaaagcattgaaattatcttggtttaagaaaggaagtagtattgggaaaatgttcgaggcaacagcaagaggagcaaggcgtatggccatcttgggagatacagcctgggatttcggaagtatagggggagtgtttacaagtgtaggaaagctagtacatcaaatttttggaacagcgtatggagtcctgttttccggtgtatcatggacaatgaaaataggaataggagtactacttacctggctcggtctaaactcaagatctacatctctatctatgacctgtattgcggttggactggttacattatatttaggagtaatggtacaagcggactcaggctgtgtaataaactggaaaggtcgagagctaaaatgcggtagtggcatatttgtaacaaacgaagtacacacatggacagagcaatataaatttcaggccgattcgccaaaacgtcttagcgcagctataggaaaggcttgggaagaaggtgtttgtggaatcaggtccgccactcgactcgaaaatataatgtggaagcagatttcgaatgaattaaatcatatcctacttgaaaatgacatgaagtttactgtcgtagtgggcgatgtagctgggatcctcgcgcagggcaagaaaatgatacggcctcaaccaatggaatacaagtactcctggaaaagttgggggaaagcaaaaataattggtgcggatgtacaaaatactacattcataatagatggacccaatactcctgagtgtccagatgatcagagggcctggaatatctgggaagtagaggattatggatttggcatatttactacaaatatatggcttaaactaagagacagctatacacaagtttgcgaccaccgcttaatgtctgcggctatcaaggactctaaagcagttcatgccgatatgggatattggattgaaagtgagaaaaatgaaacatggaagttggccagagcatcgtttattgaagtcaaaacatgcatttggcccaaatcacacactttatggtcaaacggggtcctagagagcgaaatgataatccctaaaatatatggtggacccatatcccagcataattatcggccaggatacttcacacaaacggcgggtccctggcacctgggaaaactagaacttgatttcgatctctgcgagggaacgactgtagtcgtagatgagcactgcggcaatcgcggcccttctctacgaacaacaacagttacaggaaaaattatacatgaatggtgttgtaggagctgtaccctcccgccactgcgattccgcggagaagacggatgctggtatggaatggagatacgacctgtgaaggaaaaagaagaaaatttagtcaaatctatggtatcagcaggttctggagaggtcgattcgttttccttaggtctattatgcatctcgattatgatcgaagaggtgatgagaagtcgttggtctcggaaaatgctaatgacaggaacactagcagtattctttctattgattatgggtcaactcacatggaatgacctaattcgtttatgtattatggttggagcgaacgctagcgacaggatgggtatgggtacgacttaccttgcgttaatggcaacctttaaaatgcggccgatgtttgcggtgggactattattcaggaggctaacgtcaagggaagtactattattgactattggattaagtttagtcgcgagcgtagagttaccaaattcactagaagagttaggggacggcttggcaatgggtataatgatcctgaaattgttaactgattttcaatctcatcagctatgggcaacattgctttcattaacatttataaaaacaacctttagtttgcactatgcttggaaaaccatggcgatggttttatccatagtatccttattccccctgtgtttatcaacaacaagtcagaaaacgacatggttacctgtactattgggttcgttaggatgcaaaccattaacgatgtttttgattgccgaaaataagatctggggcagaaggagctggcctctaaacgaaggaataatggccgtaggcattgtaagtatactgttaagttcattactaaagaatgacgttcccttagccggaccattgattgccggtggcatgttgattgcgtgctacgtaatatcagggtcaagtgcggatttaagtttagagaaggcggccgaggtatcgtgggaagaagaagcagagcattcaggagctagtcataacattttggtcgaagttcaagacgatggaaccatgaaaataaaagatgaggaacgtgacgatacactgactatcctgttaaaagccaccctattagctgtttcgggtgtatatccattatccatcccagctactttattcgtatggcacttttggcagaagaagaaacagagaagcggagtcttatgggatactccatcaccgcctgaggttgaaagagctgttctagatgacgggatttacagaataatgcaacgaggtcttttgggacgctctcaagtaggagtcggagtatttcaagaaaacgtttttcacacaatgtggcacgtaaccagaggtgctgtcctaatgtaccaaggtaagcgattggaaccatcttgggcttcagtcaagaaagatctaatttcgtatggcggaggctggcgtctccaaggttcctggaacactggtgaagaagtccaagttattgctgtagaacctggcaaaaatccgaaaaatgtgcaaacagctccaggcacattcaaaacacccgaaggtgaagtaggagccatcgcgctagattttaaacctggcacatctggatcaccaatagttaatagagaagggaaaatagtaggactctatggaaatggagttgtgactacatctggtacgtatgtaagtgccatcgcacaggctaaagcaagtcaggaaggtccattaccagaaatcgaagatgaagtcttcagaaaaagaaatctaacaatcatggatttacaccctggttccggaaaaactagaagatatctacccgcgattgtaagagaggcgataaaaaggaaattaaggacgttaatattggcacccacaagagttgtagcaagtgaaatggctgaagcactaaagggaatgcccatccgataccaaaccactgctgttaagtcagaacacactggtaaggaaatcgtggatttgatgtgccacgcgacatttactatgcgcctcttatcaccagttagagttcctaactataatatgataattatggatgaagctcattttacagatccatcgtcaatagcagcacgtggctatatctctaccagagttggaatgggcgaagctgcagcaatattcatgaccgcaacgccaccaggatcagttgaggcttttcctcaatcaaacgctgttatacaagacgaagaaagagatataccagaaagaagttggaactcaggttatgaatggataacggattttccaggaaaaacagtttggttcgtcccaagtataaaaagcggtaacgacattgcaaattgcctaagaaagaatggcaaacgcgtcatccagctctcaaggaaaacttttgatacggaataccagaaaacgaaaaacaatgattgggattatgtcgtaacgactgatataagtgaaatgggagcgaacttccgcgcggatcgtgtaatcgatccgcgaagatgtcttaaaccagtaatacttaaagacggtcccgagcgtgtaattttagcggggccaatgcccgttacagtagctagtgcagcacaaagaaggggccgaatcggccgtaatcacaataaagagggagatcaatacatatatatggggcaaccactcaataacgatgaagaccacgcacattggaccgaagcaaaaatgctattagataacataaatacgcctgaaggcatcattcctgcactatttgagccagaacgggagaaaagtgccgcgattgacggagaatatagactaagaggggaggctcgaaaaacatttgttgaattaatgagaagaggagacttaccagtttggttgtcctataaagtggcttcagaaggattccagtacagtgatcgccgatggtgtttcgatggagaaaggaataatcaagtcttagaagaaaacatggatgtagagatctggacgaaagagggagaacgtaagaaacttagaccaagatggttagacgccagaacatattccgatccacttgccttgagagaatttaaggaatttgctgcgggccgacggagtgtttctggggacctcattttagaaattggaaagttaccccaacatcttacacaaagagcacagaatgcccttgacaacctcgtaatgcttcataattcagagcaaggtggaagggcctacagacatgccatggaagaacttccagataccattgaaacgctcatgctactcgctctaattgcggtactaaccggaggtgtaacacttttctttttaagcggacggggacttggtaaaacttcaatagggctcttatgtgtcatggcaagttccgtgttattatggatggcatctgtagaacctcactggatagcagccagtatcattttggagttcttcttaatggtgcttttaataccagaacctgatcgccagagaactccgcaagacaatcaactggcttacgttgtcattggattattgtttatgattttaacagtggcagccaatgaaatgggtttacttgagacaactaagaaagatctgggaataggccatgtagctgttgagaatcatcaccacgctgcaatgttagatgttgatctccatccggcctctgcatggacactatatgctgtcgcgacaactatcataaccccgatgatgagacacactatagagaatactacagcaaatatcagcttaacggctattgccaatcaagcggccattctgatgggtctagacaaaggttggccaataagcaaaatggatattggtgtgcctttgctcgcgcttggctgctattcacaagtgaacccacttacacttactgcggcagttctgatgttggtagcacattatgcaatcattggacccggacttcaagccaaagccacacgagaggcacaaaaacgaacggccgcaggtattatgaaaaatccaactgtcgacggaattgtcgcaattgacttagaccctgtcgtatatgatgccaaattcgagaaacaattaggacaaataatgttattaattttatgtacaagccaaattttactaatgcgtacaacttgggcactgtgtgaaagcatcaccctagcaacggggccattgacgactttatgggagggttcacctggtaaattctggaacaccaccattgccgtatcaatggcaaatatattccgagggtcttacttagcgggagcgggactggcgttcagtctaatgaagtcactaggtggtggaagacgtggaactggtgctcaaggagaaactctcggtgaaaaatggaaaagacaactcaaccaattatcaaaatccgagttcaacacatacaaacggtccgggataatggaagtagatcgatcagaagccaaagaaggactaaaacgtggagaaacgacaaaacatgcagtaagtcggggaaccgccaagctgcgttggtttgtagagagaaacctagtaaaaccagaaggcaaagtaatagatctaggctgcggcagaggaggatggagttattactgcgccggactaaagaaagtgactgaagtaaaaggctacaccaaaggcggtccgggacatgaggaaccaataccaatggcaacatatggatggaatcttgtaaagctccacagcggtaaagacgtgttctttatcccaccagagaagtgcgatacacttttatgtgatataggagaatcatcgcccaatcctacgatagaggaggggagaaccttacgagtgctaaaaatggtcgagccttggctaagagggaaccaattttgcatcaaaatactaaacccatatatgccaagtgttgtggaaactcttgaacaaatgcaaaggaagcacggagggatgttggtaaggaatccactttctagaaattctacccacgaaatgtactgggtatcatgtggtacgggaaacatcgtaagcgcagttaatatgacgtcgcgaatgttactcaacagattcaccatggcacacagaaagccaacttacgaaagagacgtcgatttgggagcaggcactcgacatgtcgcagtcgaaccagaagtagcaaacctcgatataataggtcaaagaatagaaaatatcaaacacgagcataaaagcacatggcattatgatgaggacaacccttataaaacttgggcctatcatggcagttatgaggtgaaacccagcggctcagcctcttctatggtcaatggcgtagtgaaattacttacaaagccgtgggatgttatcccaatggtaacacaaatcgcgatgacggacactactccctttggacaacaacgtgttttcaaagaaaaggttgatacccgcacaccaaaggcaaaaagaggtacagctcaaattatggaagtcactgcaaaatggttgtggggatttctaagtcggaataaaaagccgaggatatgtacccgagaggaatttacacgaaaagtacgtagtaacgcagcaatcggggcagtattcgttgatgaaaatcaatggaactcagctaaagaagcggtagaggatgaaagattttgggatctggtacatagagaaagggaactgcataagcaaggaaagtgtgccacttgtgtgtataatatgatgggaaagagggagaagaaattaggcgaatttggaaaagcaaaaggttcgcgagctatatggtatatgtggttaggagctagattcctcgagtttgaggccctagggttcatgaatgaagatcactggttcagtagagaaaactcgctaagtggggtcgaaggagaaggtctgcataagctcggatatatattaagagatatctcaaaaataccaggagggaacatgtacgctgatgatacagctggttgggacacgagaataacagaagatgatttacagaatgaagcacgtataactgacataatggaaccagaacacgcactattggcgaaaagtatctttaaactaacataccaaaataaggtcgtgcgggtccaaagaccagcgaaaaatgggacagtcatggacgtcataagtagacgagatcaaagagggtccggacaagtgggcacatacggactgaatacatttacaaatatggaagcacaacttattcgtcagatggaaagtgaaggaatcttctcccccagtgagctcgagacaccaaatctagctgagagggttctcgattggctggaaaaatatggggtgaaaagacttaaaagaatggcaattagtggcgacgactgtgtagtaaagccaatagacgatagatttgcaactgccctaaccgccctaaatgatatgggcaaggtgaggaaagacatacctcaatgggaacctagtaaaggttggaatgactggcaacaggtaccgttttgtagtcatcactttcaccaactaataatgaaagatggaagagaaatagtagtaccatgtagaaatcaggatgagctagtaggtagagcgcgcgtgtcccaaggcgcaggatggagtctaagagagactgcctgtttagggaagtcctacgcacaaatgtggcaacttatgtatttccatcgtcgtgacttaaggcttgcagctaatgcaatttgcagcgcggtgccggtagattggattccaacttctcgcactacgtggagtatacatgctcatcatcaatggatgactacggaagatatgctctctgtctggaacagggtgtggattgaagaaaatccatggatggaagataaaacccatatatcatcatggggagacgtgccctatttaggtaagcgggaggatcagtggtgcggcagtttgattggactgaccgcccgagcaacatgggcaacgaatattcaggtagctatcaaccaagtaagacgtctaataggcaatgaaaattatctagattacatgacaagcatgaagagattcaaaaacgagagtgaccctgaaggagcactctggtaa

SEQ ID NO: 21827 - RNA, 9879 nt, synthetic construct
  misc_feature 1..9879: note = derived and/or modified CDS sequence (opt6) from DENV-1__GQ868615__SS-prME
  source 1..9879: mol_type = other RNA
tctgtgactatgctgttaatgttaatgccaactgccctagcttttcatctaacaacgcgaggaggggaacctcacatgatagttagtaaacaagaaaggggaaaatcattattgttcaaaactagcgctggagtcaacatgtgcacactaatagcaatggacttaggtgaactatgtgaagatactatgacctacaaatgtccaaggataacagaaactgaacctgatgatgttgactgctggtgtaatgccacggatacgtgggtaacttatggtacatgttcacaaacaggagagcaccgacgagacaaaaggtcagttgcccttgctccccatgttggacttggattggaaacccgcacggaaacatggatgtcttcagaaggagcatggaaacaaatacaaagggttgaaacttgggcattacgtcaccctgggtttacagtaatagcactatttctggcacatgctattggtacctctataactcaaaaaggaataatattcattctgttaatgctcgttactcctagtatggcgatgaggtgtgtaggtataggaagtagagacttcgtagaaggactatcaggagcaacatgggttgatgtagttcttgaacatggatcatgtgtaacaacaatggcaaaagataaacctacgttagatatagaacttctcaaaaccgaagtcactaaccctgctgtgttaagaaaattatgcatcgaagcaaaaatttcaaatacaacaacggattcaagatgtcccacgcagggcgaagcgaccttagtcgaagaacaagacgccaacttcgtatgccgtagaacttttgtcgaccggggttggggcaacgggtgtggcttgtttggtaaaggcagtttaatcacttgtgctaaatttaaatgtgttacgaaacttgaaggaaaaatagttcagtatgaaaatctcaaatatagtgtaatagttaccgtacatacaggtgatcaacatcaagttggtaacgaatcgacggaacatggtacaaccgcaacaataacaccacaagcgcctacaacagaaatccaattaacagattatggggcgttaacactagactgcagtcctagaacgggactcgacttcaatgaaatggtcttgctaactatgaaagaaaaatcctggttggtgcacaaacagtggtttcttgacctaccactcccttggacaagtggtgccagcacctcccaagaaacatggaatcgacaagacctattagttacctttaaaacagcacatgcaaagaaacaagaagtagtcgttttgggaagtcaagaaggtgcgatgcatacagcattgacgggtgctacagaaatacaaaccagcggtacaacaacaatatttgctggtcacctaaaatgcagactaaaaatggacaaactaacactcaaaggtatgtcttacgtaatgtgtacaggttcattcaaattggagaaagagctggcagaaacacagcatggcacggtgttggtacagattaagtacgaaggtacggacgcaccatgtaaaatacctttctcaacacaagatgaaaaaggcgttactcagaatggaaggttaataacagcaaatccaatagttacggacaaagaaaaaccagtgaatattgaagccgaacctccctttggtgaaagttatatagtaattggcgcaggggaaaaagcgttaaagctatcatggttcaagaaaggatcttcaattggaaaaatgttcgaagcaactgccagaggggctcgaagaatggcaatactcggtgatacagcctgggattttggttcgattggtggtgtatttacttcagtaggtaaattagtgcaccaaatatttggcactgcctatggcgtcttgttctccggcgtgagctggactatgaaaattggtataggagtactactcacatggctcggtttaaattctagatcaacaagccttagcatgacttgtattgcagtgggtttagtcacactttacctgggggtaatggttcaagccgactcaggctgcgttatcaattggaaagggagggaattaaaatgcggctctggaatattcgtaacaaatgaagtacacacttggacagaacaatataaattccaagcggacagccctaagaggctgtctgccgcaataggaaaggcatgggaagagggagtctgtggtattaggtctgctacaagactcgaaaacataatgtggaaacagatatctaacgagttaaatcatatactactcgaaaatgatatgaaattcactgttgtcgttggcgacgtagcgggtatactagcccaaggcaagaaaatgataaggccacaacccatggaatacaaatactcatggaaaagttggggtaaagcgaaaatcatcggagcagacgtacaaaataccacattcataatagatggaccaaacactcctgagtgccctgatgatcaacgcgcgtggaatatctgggaagttgaagactatggattcggaattttcacaacaaatatttggcttaaactccgagatagctacactcaagtgtgcgatcaccgactaatgtcagccgccataaaagattctaaggcagtacatgctgacatggggtactggatcgaaagtgaaaagaacgaaacatggaaattagctagagctagttttattgaagtaaaaacatgtatctggccaaaatcacacacactttggagcaatggcgtgctagagtcagagatgattattcctaaaatatacggaggaccaatatctcaacataattatcgcccgggatatttcacgcaaactgcaggaccatggcacttagggaagctggagttagactttgacctatgtgaggggactacagtcgtagttgacgaacattgcggaaatcgtggccctagtcttagaacaacgacggtcaccggaaaaattatacatgaatggtgttgtagatcttgcacactgccgccattacgctttagaggcgaagatggatgctggtacggaatggaaatacgtcccgtaaaagagaaggaagaaaatctcgtcaaaagtatggtgagtgccggatcgggagaagtagattcattctccctaggcttattatgtatttccatcatgatcgaggaagtaatgcgatctagatggtcacggaaaatgttgatgaccggcacactcgcggtattctttctattaattatgggacaactaacttggaatgacctgattcgcttgtgcattatggtgggagccaatgcgagcgataggatgggcatgggaactacatacttggctcttatggccacttttaaaatgagacccatgttcgcagtgggactattatttcgacgtttgacaagtagagaagttctattgctcaccataggtctgtctcttgttgcatcggttgaactacccaatagcttagaagaattaggtgatggtctagcgatgggaatcatgatattgaaattattaaccgacttccagagccaccagttatgggcaactcttctaagtctcacgttcataaagactactttctcactacattatgcatggaaaacaatggcaatgatactgtccatagttagtctgtttccgttatgtttatcaacgacgtcacaaaagactacatggttaccggtactactcggaagcctaggttgtaagcccctgaccatgtttctcattgccgagaacaaaatatggggtagaagatcatggcctttgaatgaggggattatggcggtaggaattgtatctattcttttaagcagtttactcaagaatgatgtaccgcttgcgggaccattgatagccggtggaatgttaatcgcatgctacgtaatttctggatcatcggccgatctaagcctagaaaaggcggctgaggtaagttgggaggaggaagcagaacattcaggtgcatcacataacatcctagtcgaggtacaggatgatggcactatgaaaataaaagatgaagaaagagatgatactttaactatcctactcaaagcaactttattagctgtttccggggtttacccgttaagtatacccgcaacgttgttcgtgtggtatttctggcagaagaagaaacagcgcagtggagtattgtgggacactccgtcgcctccagaagtggaaagagcagtactagatgatggtatatatcgaattatgcaaagaggactccttggacgcagtcaagtgggagttggagtattccaggaaaacgtattccatacaatgtggcatgtcactcgtggtgctgttctcatgtatcagggtaaacgtctagaaccctcctgggcctctgtgaagaaagatttaatttcatatgggggcggctggcgattgcaaggaagctggaacaccggcgaagaagtccaagttatagcggtagaaccaggcaaaaaccccaaaaatgtacaaaccgcaccaggtacatttaaaaccccggaaggagaagtaggggctatagcgttggactttaaacctggaacgtccggtagtcctatcgttaacagagaaggaaaaatagttggtctatacgggaatggtgtagtcactacaagtggaacgtatgtatcagcgatagcacaagcaaaagcatcccaggaaggtcccttacccgaaattgaagatgaagtgtttcgaaaacgcaacttaacaatcatggacttgcacccagggagcggaaaaacaagaaggtatttgccagcaatagtacgcgaagcaattaaaagaaaactacgcactcttatattggccccgacgcgagtggtggcctcagagatggcggaagcacttaaaggaatgcccattagatatcaaaccacggctgtcaaatcagaacatacaggaaaagaaatagtagatctcatgtgtcacgcgacgttcacaatgcgcctgctaagcccagtaagggtcccaaattataacatgataatcatggacgaagcgcactttactgacccgtcctcaatcgcggctaggggctatattagtactagggtcgggatgggagaggcggcagcaatattcatgaccgcaacaccacccggcagtgtagaagccttcccgcagtcaaacgcagtaatacaagatgaggaacgagatattcccgaaagatcttggaactccggatacgaatggatcacggattttcccgggaaaaccgtatggtttgtcccaagtataaaaagcggcaacgacatcgccaactgtctacgtaaaaatggcaaaagagtgattcagttatcgagaaaaacgttcgacaccgaatatcagaaaacgaaaaataatgattgggattatgtggtaactacagacatcagcgaaatgggggcaaattttcgtgcagacagagtaatcgatccaagacgatgtctcaaacctgtaatacttaaagatggaccagaacgtgtgatcctcgcgggtccaatgcctgtaacggttgctagtgctgcacaacgacggggtagaataggccgcaaccataacaaagagggtgaccaatacatttatatgggacagccattaaacaatgacgaggaccatgcgcattggacagaagcgaaaatgttgctagacaatataaacactcctgaaggaattatccccgctctctttgagcccgagagggaaaagtccgctgcaatagatggtgaatatagacttagaggtgaagcaagaaaaacattcgtagagcttatgaggagaggagatttacctgtctggcttagctataaagttgctagtgagggttttcagtattcagatagacgatggtgttttgatggcgaaaggaataatcaagtcttagaggaaaatatggatgtagaaatctggaccaaagaaggagaaagaaagaaactacgaccacgatggctggatgcacgcacttacagcgacccgctagcattacgagagttcaaagaatttgcggcaggaagaagaagcgtaagtggggatcttattttagagattggtaaattaccacaacatctcacacaaagagctcaaaatgcactagacaatctagttatgctacataattcagaacagggtggtagggcctatcgacatgccatggaagaattaccagatacaattgaaaccctaatgttactagcattaatcgctgtgctgacaggaggtgtaacattatttttcttatctggccgtgggttagggaaaacttctatcgggcttttatgtgttatggcttcgtcagtactcctgtggatggcgtcagttgaaccgcattggattgcggccagtatcattctagaatttttcttaatggtattacttataccagagccagacagacaacggacaccacaagacaaccaattagcatatgtggtaatagggttattatttatgatattaacagtcgctgctaatgaaatgggccttttggagacgaccaagaaagatttaggaataggacacgtcgctgtcgaaaatcatcatcatgccgccatgctagatgtagacctacatcccgctagcgcgtggacgttgtatgccgtagcaacgactataattacaccgatgatgaggcatactatagaaaatacaacggcaaatatctcactaacagctatagctaaccaagccgcaatactaatgggactggataagggatggcccatctcgaagatggacatcggagtgccacttttagccttaggctgttactctcaagtaaatccacttacattgacagcggccgtgttaatgctcgtggcccattacgctattattggacccgggctacaagcaaaggcaacaagagaagcgcaaaaacgtacggccgccgggataatgaaaaatcccacagtagacggtattgttgctatcgacctcgacccagtagtttacgacgctaaatttgaaaagcagctcggtcaaattatgttgttaattctttgcacgtcgcaaatactgttaatgaggaccacatgggcgctctgtgaaagtattacccttgcaacaggaccactaaccactctttgggaaggttcaccagggaaattttggaacactactatagcggtaagtatggcaaatattttccgaggtagctatttagcgggtgcaggcttagcattttcattaatgaaatcgctcgggggaggtaggagagggaccggagcacagggtgaaaccttaggagagaaatggaaaagacagctaaaccaattgagtaaatctgagttcaatacatacaaaagaagcggcattatggaagttgacaggagtgaagcgaaagaaggattgaaaaggggagaaactactaagcacgcagtaagcagaggaaccgccaagttacgatggttcgtcgagcgaaatttagtgaagccagaaggcaaagtcatagatttgggatgtggaagaggaggttggtcatactattgcgctggattgaaaaaggttacggaagtaaagggatacactaagggaggaccagggcatgaagaacctataccaatggcaacctacggatggaatctagtaaaactacatagtggtaaagatgtattctttatacccccggaaaagtgtgacacacttctatgtgacatcggagagagcagtccgaatcccaccatagaagaaggcagaacattaagggtactcaaaatggtagaaccttggctgagaggaaatcaattttgtataaaaatactcaatccttacatgccctcggtggtcgaaacactagaacagatgcaacgcaagcatggaggcatgctagtaagaaacccgctctcaagaaatagtacgcacgaaatgtactgggtgagctgtggtactggaaatatagtgagcgcagtaaatatgacgagtcgaatgttactaaaccgttttacaatggcacacagaaaacctacatacgaaagggacgtagatctaggagcaggaacaaggcacgttgcagttgaaccggaagtagccaatttggacattattggacaaaggatagaaaatattaagcatgaacacaaatcaacctggcactatgatgaagacaatccttacaaaacctgggcctatcacggttcatacgaagtaaagccttccggaagtgcttctagcatggtgaatggggtagtaaaacttctaacaaaaccatgggatgtcatcccaatggtgactcaaatagctatgacagatacaacacctttcgggcaacagagagtatttaaagaaaaagtagacacgagaacacctaaagcaaagcgaggaaccgcacaaattatggaagttactgcaaaatggctttggggattcttaagcagaaataagaaaccacgcatatgtactagagaagagtttaccagaaaagtcagaagtaatgcggctataggcgcagtcttcgtagatgaaaatcaatggaatagtgccaaagaagccgttgaggacgaaagattttgggacttggtacatcgggagcgtgaactacataaacaagggaagtgtgctacttgtgtatacaatatgatgggaaagcgagagaagaaattaggagaatttggcaaagctaaaggaagtagagctatatggtatatgtggttaggagcaagattcctagagttcgaagcgctcgggttcatgaatgaagatcactggttctcaagagaaaattcgttaagtggtgtcgaaggggagggactacataaattaggatatatattaagagacatatcgaaaatacccggaggaaatatgtacgcagacgatacagcaggttgggatactagaatcactgaggacgacctgcaaaacgaagcacgcatcactgatataatggaacctgaacacgcgctcttggccaaatcaattttcaaactaacataccaaaacaaagtcgtacgtgtacaacgaccagccaaaaacggaacagtaatggacgtaatctcaagaagagaccaacggggaagcggccaagtcggaacttacggcctgaatacatttacgaatatggaagctcaactaatacggcaaatggagagcgaaggtatattttccccatcggagttagaaacgcctaacttagctgaaagagtactcgattggctggaaaagtatggggtggaacgtttaaagagaatggccatcagtggcgatgattgcgttgttaagccaatcgacgacaggtttgccacggcactaaccgcacttaatgatatgggtaaggtaaggaaagatataccgcaatgggaaccaagtaaggggtggaatgattggcaacaagttcccttttgtagtcatcatttccatcaactcataatgaaggatggtcgggaaatcgtcgtgccgtgtcgaaaccaagacgaactggtaggtcgtgcgagagtaagccaaggagcaggttggtcacttagggaaactgcttgtctcggtaaatcatacgcacagatgtggcaacttatgtattttcaccgtagagatctccgccttgcagccaatgctatatgttcggcagtaccagttgattggatccctacttcacgcactacatggtcaattcatgcgcatcaccagtggatgaccaccgaagatatgctttcagtatggaacagagtctggatagaagaaaacccttggatggaagataagactcacataagctcttggggtgatgttccttatctcggaaaaagggaagaccaatggtgtggaagcctaattggactaacagcccgcgcgacatgggcaacgaacatacaagttgcaataaatcaagtaagaagattaattgggaatgaaaattacttagattatatgacctctatgaaaaggttcaaaaatgaaagcgatccggaaggggcactatggtaa

SEQ ID NO: 21828 - RNA, 9879 nt, synthetic construct
  misc_feature 1..9879: note = derived and/or modified CDS sequence (opt6) from DENV-1__GU131749__SS-prME
  source 1..9879: mol_type = other RNA
tcagttacaatgttattaatgttaatgccaaccgcactggctttccatttaactacacgtggtggagaacctcatatgatagtatcaaaacaagaaagaggaaaaagtctgttattcaaaacaagcgcaggggtaaacatgtgtacattaatagctatggatttaggcgagttatgtgaagatacaatgacttacaaatgtccacgaataacggaagcagagcctgatgatgtagactgttggtgcaacgcgacagacacgtgggttacttacgggacgtgcagtcaaacaggggaacatcgtcgcgagaaaaggagcgtcgcattagcaccacatgttggactcggactagaaacaagaacagagacttggatgtcctcggaaggagcatggaaacaaatacaacgcgtagagacatgggcattacgccatccaggcttcacagtcatagcactgttcttggcgcatgcaataggaacaagtataacacaaaaaggaataatctttatattgttaatgttagtaacaccatcaatggccatgagatgtgtaggtatcggaagcagagactttgtcgaagggctttcaggagcgacttgggttgacgtagtcttagaacatggtagttgtgttaccacgatggcaaaagacaaacctaccttagatattgagttactaaaaaccgaggttaccaatcctgccgttttgcgcaaattatgtatcgaggctaaaataagtaacacaactaccgatagtcgttgtcctacccaaggagaggccacattagttgaagaacaagatgccaactttgtctgtaggagaacctttgtagaccgtgggtgggggaatgggtgcggtttatttggaaaaggtagcttattaacatgtgcgaaatttaaatgcgtaacgaaactagaaggcaaaattgtacaatacgaaaacttgaaatactcagtgattgtcacggtacatacaggcgatcaacatcaagtgggtaatgagagcacagaacatggaacaacggcaacaataactccacaagcgcccacaacagagatacaactaacagattatggcgcgctaacactcgactgtagtccgcgaaccggattggattttaatgaaatggtactactaaccatgaaagagaagtcctggttggtgcataaacaatggtttttagacctacctctaccttggacatcaggggcaagcacaagtcaagaaacatggaatcgtcaggatctattagtgacttttaaaacagcacatgccaagaaacaagaggttgtagtcttagggtctcaggagggggccatgcatacggcattaaccggtgcaaccgaaattcagacctcagggaccacaacaatatttgcagggcatttaaaatgcaggctgaaaatggataaacttacgttaaaaggaatgtcctacgtaatgtgtacgggtagcttcaaattggaaaaagaagttgcggaaacacaacatggtaccgtcctagtacaaattaaatacgaaggcactgatgcaccatgtaagataccgttctcaactcaagatgaaaaaggagtcactcagaatgggagactcataacagctaacccaatagtaactgataaggagaaacctgtaaatatcgaagcggaacctccattcggagaatcttatattgtaatcggagcgggtgagaaggctttgaaactgagttggtttaagaaagggtcatcgatcggtaaaatgttcgaggccaccgccagaggtgcaaggcgtatggcaatcctaggggatactgcatgggactttggctctattggtggagtttttacatcagtaggtaaacttgtgcaccaaatctttggtactgcttatcgagtgctattttctggcgtatcatggacgatgaaaatcggaataggagttctattaacctggctaggattaaattcgagatcaacgtcactttcaatgacctgcatagcggtcggtcttgtgactctctaccttggtgttatggtacaagcagattcaggatgcgttataaattggaaaggtcgtgagctcaaatgtggatcaggtatttttgttacaaacgaagttcatacatggacggaacagtacaaattccaagcagattcacctaaaaggttaagtgctgctattggtaaggcttgggaagaaggggtctgcggaatacggtcagcgacccgattggaaaatataatgtggaaacaaatttcaaatgagttaaatcatatcctcctcgaaaacgacatgaagtttactgtcgttgttggggacgtggcagggatcctcgtccaaggtaagaaaatgatcagaccgcaaccaatggagtataaatacagttggaaaagctggggaaaagcaaaaatcatcggtgctgatgtacaaaatagcacttttatcattgatggacccaacacccctgaatgtcctgatgatcaaagagcatggaacatctgggaggttgaggattacggttttggcatttttactaccaacatatggcttaaacttcgggatagttatactcaagtgtgtgaccatagactcatgagtgcagcgataaaagattcaaaggcagttcacgcggatatgggatattggatagaaagtgagaaaaatgaaacatggaaacttgcacgagcatcattcatagaagttaaaacgtgcatttggccaaaatcacatactctatggagcaatggggtcctagagtctgaaatgataatcccaaaaatacacggcggcccaataagccaacataattatagaccgggatactttactcaaactgcagggccatggcacctaggaaaattagaattagactttgacctttgtgaaggaacgacggtagtggtcgacgaacattgtggaaaccgtggcccatctttaagaacgacaactgtcacgggaaagattattcatgaatggtgttgcagatcgtgcaccttacctccattacgatttagaggggaagatggatgctggtatgggatggagataagacctgtcaaagaaaaggaagaaaatttggttaagtctatggtaagtgcaggctcgggagaggtagactcattttctttagggctcctatgtatatcaatcatgatcgaagaagtcatgagatctcgttggtctcgaaaaatgcttatgactggaacgttggcagtattctttctcctaattatgggacaattgacgtggaacgatttgattcgactatgtattatggttggtgcaaatgcctccgaccgtatgggtatgggaaccacctacttagcattaatggctacttttaaaatgagacccatgtttgcagtaggacttctctttaggcgcctgacgtcacgggaagttcttttattaacaataggccttagtctggtagcttcagttgaattaccaaattcattagaggaactgggtgacgggctcgcaatgggaataatgatactcaagctattaaccgattttcagtcatatcaactatgggcaacgcttttatccctaacttttattaaaacaactttttcccttcactatgcatggaaaactatggccatggtactttctattgtgtccttattcccactatgcttaagtacgacgtcgcaaaagactacatggttaccagtattactgggttcgctaggttgtaaaccactcacaatgttcttgatagcggagaataaaatatgggggcgaaaatcatggcccttgaacgaagggataatggctgttggaattgtatcaattctactgtctagcctcctaaagaacgatgtaccactcgctggtcccctaattgctgggggcatgcttatcgcgtgctatgtaataagtggcagttcggccgatctgtcgttggagaaagcggctgaggtaagttgggaagaagaagctgagcacagcggagccagtcataacatcttagtagaagtacaggatgacggtacgatgaaaataaaggacgaggagagggatgatacactaactatattattgaaggcaactctactagcagtatccggggtttatccattgagtattccagcaactctattcgtatggcatttttggcagaaaaagaaacaacgatctggggtcctgtgggataccccttctcctccggaagttgaacgcgctgtactagatgatggcatatatcgaataatgcagcgtgggctcctgggtagatcgcaagtaggagtaggcgtattccaagaaaacgttttccatacaatgtggcatgttactcggggcgccgtgctaatgtatcagggaaaaaggttggaaccatcttgggcatccgtaaagaaagatcttataagttatggaggtgggtggcggtttcaaggttcatggaatactggagaggaagtacaagttatcgctgtcgaaccaggcaaaaatcctaaaaacgtacaaaccgcaccaggaacgtttaaaacacctgaaggtgaggtaggtgctatcgcgctggatttcaaacccgggacctcagggtcgccaatagtcaatagggaaggaaagatagtcggtttatatggaaacggggtagtaacgacttcaggaacttatgtgtcagcaatcgcccaagctaaggctagccaagaaggtccacttccagaaattgaagatgaagtttttagaaaaagaaatcttactataatggatttacaccctgggtccggcaaaaccaggaggtatctcccagctatagttcgcgaagcaataaaaagaaaactccgaacacttatcttagcaccaacaagagtggtggcctcagaaatggccgaggcactaaaaggcatgccaataaggtatcaaacaactgctgtaaaatccgagcacacaggaaaggaaatagtagatctcatgtgtcacgctactttcaccatgcgcctactttctccagtgcgggtgcccaattataatatgattataatggacgaagcacatttcactgaccccagttcaattgccgccagggggtacatcagcacgcgggttggtatgggagaagctgcagcaatatttatgactgcaacgccgccagggtcgatggaggcttttccacaatcaaacgcagtgatccaggatgaagaaagagatataccggagagatcttggaatagtgggtacgaatggataactgacttccctggtaaaacggtatggttcgtaccatcaattaaggcaggtaacgatatagcaaattgcttaagaaagaatggtaaacgagtaatccagctaagtcgtaagactttcgatacagaataccagaaaaccaaaaacaacgactgggattatgtagtaacaacagatatcagcgaaatgggcgcaaatttccgcgctgatagagttattgaccctcgtagatgtctaaaacccgtgatacttaaggacggtccagaaagggtaattttggcaggtccaatgccagtgaccgtggcatcggctgctcaaagacgcgggcgtataggccgcaaccataataaagagggtgaccagtatatatacatgggacaaccgttgaacaacgacgaagatcatgcacactggacagaagcgaagatgttactcgataacataaatactccagaaggtattataccagctctattcgaaccggagagagaaaaatctgcagccatagacggtgaatatagattaagaggtgaagcacgaaaaacatttgttgaattaatgagacggggagacctaccagtttggttgtcatataaagtcgcctccgaaggttttcaatatagtgatcgtcgttggtgttttgatggcgaacgaaataaccaagtcctagaagaaaacatggatgtcgaaatatggacaaaagaaggagaacggaagaaactgaggcctaggtggcttgatgctagaacttatagtgatccactagcactacgagaatttaaagagttcgcagccggaagaagaagtgtatcaggagaccttattctagaaataggaaaactacctcagcatctcacccaaagagcccagaacgcacttgacaacttggtaatgttacataactcagaacaaggtggacgtgcataccgccatgctatggaagaattgcccgatacgattgaaacactaatgttattagcactcattgcagtgctgacaggcggggtaacgctgttctttttgagtggaaaagggctaggtaaaacaagcatcggcttattatgtgtaatggcttcttcagttcttttgtggatggcaagcgtagaaccgcattggatagcagctagtataattctagagttctttttaatggtactcttaatccccgaaccagatcgacaacgaactccacaagataaccaattggcatatgttgtaatcggactccttttcatgatactaacagtcgcagcaaacgaaatggggttgctcgaaactactaagaaagaccttggtattggacatgtagccgtagaaaaccatcatcatgcagcaatgctcgacgttgatttacatcccgcctcagcatggactttatatgctgtagctacaacaataatcactcccatgatgcgacatacgattgaaaatacgactgctaatatcagtttgactgctattgcaaatcaagctgccatcctcatgggattagacaaaggctggcctattagcaagatggatattggggtaccgttattggcattaggatgctactcacaggtcaatcctctaacattaaccgccgctgttcttatgttagtagctcactacgcaataataggacctgggctacaagctaaagccacccgagaagcacagaaaagaacagcagcgggtatcatgaaaaacccaacaatagatggaatagtcgctattgacttagacccagtagtctacgatgccaaatttgagaaacaactaggtcaaataatgttgctgatcctatgcacaagccaaatattactaatgagaacaacctgggcgttatgcgaatcgataacacttgctactggtccactaacaacattgtgggaaggtagccccggtaagttttggaatactacaattgctgttagtatggcgaatatattcaggggctcatacctagctggtgctggtcttgccttcagcctaatgaaaagtttagggggtggtcgacgcggaacaggcgcgcaaggagaaactcttggtgaaaaatggaaacgacagcttaatcaattgtcaaaaagcgagtttaatacatataagagatctggaataatggaggtagatagaagtgaagcaaaagaggggctcaaacgtggagagacaaccaaacatgctgtttcaagggggacagcaaaactaaggtggttcgtagaaaggaatttggtcaagcctgaaggaaaagtcatcgacctaggatgtggtcgaggcggttggtcatattattgtgcaggactcaagaaagtcacagaagtaaaggggtacacgaaaggtggtcctggtcatgaggaacccatcccaatggcaacatatggatggaacttagtcaaattgcactccggtaaagatgtatttttcataccgcctgaaaagtgtgatactttactatgtgatataggcgagagctcccctaatccaaccatagaggaaggtaggaccctcagagtattaaaaatggtagaaccgtggttaagaggtaatcaattctgtatcaaaattttgaatccttacatgccttcggttgttgagacattagaacaaatgcagaggaaacatggagggatgcttgttagaaacccgttaagccgcaattcgacgcacgaaatgtactgggtaagctgcggcactggtaatattgtatccgctattaacatgacatcgcggatgctccttaaccggttcacaatggctcacaggaagccaacatatgaacgagatgttgatttaggtgcgggaaccagacatgtagcagtagagcctgaagtggccaaccttgatatcatagggcaaagaattgaaaacattaaacacgagcataaaagcacatggcattatgatgaagataatccatataaaacttgggcgtaccacgggagttacgaagtaaagccttccggatcagcgtcatcaatggttaatggggttgttaaattactaacgaaaccatgggatgttataccaatggtaacgcaaatagcaatgaccgacaccacaccttttggacagcaacgagtctttaaagaaaaagtagatacaagaacacccaaagctaaaaggggaacagcacaaatcatggaagtaaccgcaagatggttatggggcttcttatcgaggaataaaaagccgcgaatctgtacaagagaagaatttactcgaaaagtacgaagcaatgctgctataggagccgtctttgtggatgaaaaccagtggaatagtgctaaggaagccgtagaagatgacagattctgggatctcgttcatcgagagcgggagctacacaagcagggaaaatgcgctacttgtgtatataacatgatgggtaaaagagaaaagaagctcggagagttcggtaaagctaaaggaagcagggctatctggtatatgtggttgggggcgaggtttctcgaatttgaggcattaggtttcatgaatgaagatcactggttcagcagggagaatagtctctcaggagttgaaggagaaggtctccataaactaggatatattcttagagacatatccaaaatacctggtggaaatatgtatgccgacgatacggcaggatgggacacaaggattacagaagatgatctacaaaatgaagctaaaataacagacattatggaaccagagcatgcattattagcaaagagtatttttaaattgacatatcagaacaaagtagttagagtgcagaggccagccaaaaacggaacagtgatggacgttattagcagacgggaccaaagaggcagcgggcaagtaggaacatatgggttaaatacatttacaaatatggaagctcagctgattcggcagatggaatcagaagggattttcctacctaacgagctcgagactccaaatttagcaggacgagtgctagattggctagaaaaatatggtgtcgaaagattaaaacggatggccatcagtggtgacgattgcgtagtaaagccaatcgacgacagatttgcaactgcactaacagcactcaacgatatgggaaaagtaagaaaggacattcctcagtgggaaccctcgaaaggctggaacgactggcaacaagtacccttctgtagtcatcatttccatcaactgataatgaaagatggacgtgaaattgttgtcccatgtaggaatcaagatgaacttgttggaagggcacgagtatctcagggcgctgggtggtccctccgagaaactgcatgcctaggcaaaagttatgcacaaatgtggcaattaatgtatttccacaggagggacttaagattagctgccaatgcgatttgttcggctgttcccgttgactgggtaccaacgtctcgaaccacttggtcaatacatgcacatcaccagtggatgacaactgaagatatgctcagtgtgtggaatagagtgtggattgaagaaaacccgtggatggaggacaaaacacgaatctcaagttgggaagatgttccatatctaggtaagcgcgaagatcaatggtgcggatcgctaataggtcttactgcaagagcaacgtgggctactaacatacaggttgctataaatcaagtaaggaggctaattggtaatgagaattatagcgattatatgacgtcaatgaagagattcaaaaacgaatccgaaccagaaggagctttatggtaa

SEQ ID NO: 21829 - RNA, 9879 nt, synthetic construct
  misc_feature 1..9879: note = derived and/or modified CDS sequence (opt6) from DENV-1__GU131750__SS-prME
  source 1..9879: mol_type = other RNA
agcgtaacaatgttgctgatgctaatgccaactgctttagccttccatctcactacacgcggtggagagccgcacatgatagtcagcaaacaagaaagaggtaaaagcctattgtttaaaacgtcagccggagttaatatgtgcacattaatagcgatggatctaggagagttatgtgaagacacaatgacgtacaaatgtcctagaatcactgaaacggaaccggatgacgttgattgctggtgtaacgcaactgatacctgggttacatacggaacttgtagtcaaacgggagagcatcgcagagataaaagatcagtcgctttggcaccccatgtgggtctaggattagaaactcgtacggaaacatggatgtcgtccgaaggtgcatggaaacaaatacaacgagttgagacttgggcgttgagacacccaggttttactgtaatagcactattcctagcacacgcgatagggacttccatcacgcaaaaaggcatcatattcatccttttgatgttagttacgccatcgatggcaatgagatgcgtcggcataggatcaagagatttcgttgaaggactaagcggagcaacttgggttgatgtcgtactagagcacggatcgtgcgtaacaacaatggcgaaggataaacccactttagacatagaattgctaaaaacggaagtaacgaacccagcagtattaagaaaactttgtatagaagctaaaataagcaacactacaactgacagtagatgtcccacgcaaggtgaagcaacacttgtagaggaacaagacgcaaattttgtctgtcggcggacattcgtagacagaggatggggcaacggctgcggattatttggtaaagggtcactgataacttgcgccaagtttaaatgcgtcactaaacttgaagggaaaattgtacaatatgaaaacttgaaatacagtgtaatcgtcacagtgcatacgggggaccaacaccaagtcggaaatgaaagtactgaacacggaacaacagccacaataacaccgcaagccccaaccacagagatacagctaaccgattatggagcactaacgctagactgtagtccaagaacaggcctagacttcaatgaaatggtcctcttaacgatgaaagaaaaatcctggctcgtccacaagcaatggttcctcgatttaccacttccgtggacaagcggagcatctacgagccaagaaacatggaaccgtcaagacttgctagtcaccttcaagaccgcacatgcgaagaagcaggaagtagtcgttttaggatcgcaagagggcgcaatgcatacagctctgacaggggcgacagaaatacaaacatccggaacaactactattttcgcaggccatctgaaatgtagactaaaaatggataaactgactctaaaaggtatgtcctacgtaatgtgtacagggtcttttaaactcgagaaagaagtcgcagaaacacaacatggtacggtattagtgcaaataaaatatgaggggactgacgctccatgcaagattccattttcaacacaagacgagaagggagtgactcaaaatggacgtttaattacagcaaatcctatagtaacagacaaagagaagccggtcaatatagaagcagaaccgcctttcggagaaagttacatagttataggcgctggagaaaaagcattaaaacttagttggttcaaaaagggaagctcgattggaaaaatgtttgaagctacggccaggggagcacgccgaatggccatcctcggagataccgcttgggactttggttctattggaggagtctttacatcggttggcaagctagttcaccaaattttcggaacggcgtatggcgtccttttctctggtgtgtcatggacgatgaagattggtattggtgtattgttgacgtggcttggtctaaacagtaggtccacatcattatccatgacttgtatagctgttggacttgttacactctacttaggagtcatggtccaagcagacagtggatgtgtgataaactggaaaggacgcgaactaaagtgcggatcaggcatctttgttacaaatgaggtacacacatggacagaacaatataaattccaagcggattcacccaaaagattatctgcagcgataggaaaagcatgggaagaaggtgtatgtggtatcagaagtgctaccagattagaaaatataatgtggaaacaaatcagcaacgagctaaaccacatactactagaaaacgatatgaaattcaccgttgttgtaggtgacgtcgcaggaattttagcacaaggtaaaaagatgattagaccacaaccaatggaatataagtactcgtggaaaagttgggggaaagccaaaataatcggggcggacgtacaaaataccacttttataatcgatggacctaacactcctgaatgtccggacgatcaacgcgcttggaacatttgggaagtagaagattacggatttgggattttcacgaccaacatatggcttaaactaagagattcctatacgcaagtatgtgaccaccgtcttatgagtgcagcgataaaagatagcaaggccgtgcacgcggatatggggtattggatcgaatcggaaaagaatgaaacatggaagctcgcgagagcatcatttatagaagtaaaaacgtgtatctggccaaaaagccataccctttggtcaaacggggtactcgagagcgaaatgataattccaaaaatttatggtggccctatatctcaacataactatcgaccaggctacttcacacaaactgcaggtccatggcatctgggtaaattagaattagattttgacttgtgtgagggaacgacagtcgtggtggacgaacactgtggtaatcggggcccttcattacgaactacgactgtgactggaaaaataattcatgaatggtgttgccgtagttgtacactgcctccattgcgattcagaggcgaagatggttgttggtatggcatggagattcgacctgtaaaagaaaaagaagaaaatctagtgaaatcgatggtatcagcgggttcgggcgaggtagattcctttagcctcggacttttgtgtataagtattatgatagaagaagtaatgcggagtcgatggtcaaggaaaatgttaatgactggtacacttgctgtatttttcttgcttattatggggcaactgacctggaatgatttaattagattgtgcattatggtcggtgccaacgcttcagatagaatgggaatggggacaacttatctcgcactgatggcaactttcaagatgagaccaatgtttgcggtaggattgttgtttcgccgtctaacatcgagagaagtattgttgttaacgatagggttatcattagtggctagcgttgaactacccaactcactagaagaactaggggatggtttagctatggggataatgatactcaaacttttaaccgatttccaatctcatcaattatgggcaacgcttctgagcctaacatttatcaagaccacattttcattacactacgcctggaagacgatggcgatggttctctccattgtttcgcttttcccactatgccttagcacaacatcacagaaaactacatggttgcctgttttacttggaagtttaggctgtaaaccattaacaatgtttctcatagcggaaaacaaaatatggggaagacgatcttggccgcttaatgaaggcataatggctgtaggtatagtgtcaattctactatcatccttactcaaaaatgatgttccgctcgcaggaccattaatagcgggagggatgctcatagcctgttacgtaatctccggatcgagcgctgatttatccatagagaaagcagctgaagtaagctgggaagaagaagcggaacattccggtgcaagccataatatcttagtcgaagtgcaagacgatggcactatgaaaataaaagatgaggagcgggatgacaccctcacaattctactgaaagctacattattagcagtgagtggcgtttatcccctgagtataccagcaactttattcgtttggtacttttggcagaagaagaaacaaagatccggcgtgttatgggacacaccatcaccacctgaagtaggtagagcagttctcgacgacggaatctaccgcataatgcaaaggggactgttgggcagatctcaagtcggagtaggggtatttcaagagaacgtgttccacacgatgtggcacgtcactcgaggagctgtcctgatgtaccaaggaaaaagattagaaccttcttgggcatccgtcaagaaagacctaatttcatacggcggtggatggcgccttcaaggatcatggaacacaggagaagaagtacaagtaatagctgtagaaccgggcaaaaatcccaaaaatgttcagacagcacccggaacatttaaaacaccggaaggtgaagtcggcgctatagcattagactttaagccaggcacatccggcagcccaattgttaatagagaaggaaaaatagttggactttacggaaatggagttgttactacgtctggtacttatgttagtgctatagcccaagcgaaagcaagtcaagaaggaccgctgccagaaatcgaagacgaagtattcaggaagaggaatctaacaattatggatttacatccagggagcggaaaaaccaggcgttaccttcctgccatagtaagagaggcaataaagcgaaaactcagaacacttatactcgctccgacgagggttgttgctagcgaaatggcggaggctttgaaaggaatgccaatccgatatcaaactacagctgttaagagcgaacatacaggtaaagaaatagtagatctaatgtgtcacgcgacgttcaccatgagactacttagcccagtaagagtacccaactacaatatgatcataatggacgaggcacattttaccgaccctagcagtattgcagcaaggggctatatatcgacaagagtgggaatgggagaagccgctgccatttttatgaccgccacacccccaggaagcgttgaagcgttcccacagtctaatgctgtgatccaagatgaagaacgcgatattcctgaacgatcctggaactccgggtatgagtggatcacagatttccctggaaaaactgtatggtttgtgccatctataaaaagcgggaatgatatagcaaattgtctaaggaaaaacggcaaaagagtaattcaactttcaaggaaaacgtttgacacagaatatcagaaaacaaagaacaatgactgggactatgtggtcaccaccgatataagtgaaatgggggccaattttagagctgacagggttatagaccctcgtagatgcctaaaaccggttattttgaaagatggaccagaacgggtgatattggccggccccatgcctgtaacagtcgcatcagccgctcaaagacgaggacgtataggtcgaaatcataataaagaaggagatcaatatatttacatggggcaaccattaaacaatgatgaagatcatgcgcactggacggaggccaaaatgcttcttgacaacataaacacgcctgagggaatcatcccagcgctatttgaacctgaaagagagaagagtgcagctatagacggtgaatacagattgcgaggagaggctcgaaaaacatttgttgagctaatgagaaggggagacttacctgtatggctctcgtacaaggttgcaagcgaaggttttcagtactcagaccgaaggtggtgcttcgacggggaaagaaacaaccaagttcttgaagaaaatatggacgtggagatatggactaaggagggtgagagaaagaaattgcggccgcgttggctggacgccagaacatatagtgatccactggccctgcgagagttcaaagagtttgccgcgggccggagatcagtctcgggagatttgatcctagaaattggcaaattgccacagcacttgatgcaaagggcacaaaacgcattagacaatctggtaatgttacacaactctgagcaaggaggacgagcgtacagacatgctatggaggaattaccagacaccatcgaaacgctgatgttgttagccctgatagctgtgcttacaggaggagtgacgctattctttttaagcggaagaggcttaggaaaaacaagcattggacttttgtgtgtcatggcctctagtgttttactatggatggcctcagtagaacctcactggattgcagctagtataatattggaatttttcttaatggtgttacttattccagaacctgatcggcagaggactccacaagataatcaacttgcatacgtagttatcggactcctttttatgatattaactgttgctgccaatgaaatgggattattagaaacgacaaagaaagatttgggcatcgggcatgtagctgtcgaaaaccatcatcatgcagcaatgctagacgtagaccttcacccagcaagtgcctggacgctatacgccgttgcaacaaccataatcacacctatgatgcggcatacgatcgagaacaccaccgcaaatatatctttaacagctatagcaaaccaagcagcaatactgatgggattagataaaggttggcccataagtaaaatggacattggtgttccacttctcgctttaggatgttattcacaagtaaaccccttaacattaactgcagcggtattaatgctagtagctcactatgctataattgggccagggctacaagcaaaagcaactagagaagcacagaaaagaacagcggctggcataatgaaaaacccaacagtagatggaattgtggcaatagacctagatcctgtagtgtatgatgctaagtttgagaaacaattaggccaaataatgttgttaatactttgtacctctcaaattttgctgatgcgtaccacgtgggcattatgtgaatcaatcaccctagcaacaggaccattgactacactttgggaagggtcgccaggaaagttttggaatactactatagctgtttcgatggctaacatatttagagggagttatttagcaggggcaggactcgctttttcattaatgaaatcccttggagggggcaggcgaggcactggtgcccaaggagagacattaggggaaaagtggaaacgtcaactgaaccaactctcaaaatcagaatttaatacttacaaacgctccggaataatggaagtagaccgcagtgaggcaaaagagggactaaaacgcggagaaacgacaaagcatgccgtaagtcggggaactgcaaagttacgttggttcgtcgaaaggaacctagttaaaccggaaggaaaagttattgacttaggttgtggacgtggaggttggagttactactgcgcaggactaaagaaggtcacagaggtaaaaggttataccaaaggtggtcctggccatgaggagcccattccgatggcaacatatggttggaatctagtgaaattacatagcggaaaagatgtattctttataccacctgaaaaatgcgacacattattatgcgatataggggaaagcagtccaaatccaaccatagaggaaggcagaaccctccgtgttttgaagatggtagaaccatggttaaggggaaatcaattctgcataaaaatcttgaacccatatatgccatccgtagtggaaacattagagcagatgcaacgaaaacatgggggtatgttagttcgaaatccgcttagtagaaacagtacgcatgaaatgtactgggtaagctgtggtacaggaaacatagtcagcgcagtaaatatgacaagtcgtatgctactaaatcggttcacaatggcccatagaaaaccaacatatgagagagatgttgatcttggggcaggaaccaggcatgtagctgtggaacccgaggtagcgaaccttgatatcattggtcaaagaattgaaaatattaaacacgaacacaagtcaacatggcactatgatgaagacaatccctacaaaacatgggcttaccacggatcttatgaggtaaaaccaagtggttcggcgtcatcaatggtaaatggtgtggtaaaactattgacaaaaccgtgggacgtcatacctatggtaacccaaattgcaatgacggacacgacgccgtttggacaacaacgagtattcaaagaaaaagtcgacacccgaactccgaaagcgaaaagggggactgctcaaattatggaagtaacagctaagtggctatggggatttttatcaagaaataaaaagccacgaatatgcacaagggaagaatttacacgaaaagtaagatcgaatgccgcaatcggtgctgttttcgttgacgagaatcagtggaactctgcaaaagaagctgtagaagatgagaggttctgggatctggtccatagagagagagagctacataaacaaggtaaatgtgccacatgcgtttacaacatgatgggaaaacgtgaaaagaaactaggggaatttggaaaagccaaaggttcgcgtgctatttggtacatgtggctaggcgccagatttttagaatttgaagcattagggtttatgaatgaagatcactggttttccagagaaaacagtctttccggagtagagggtgaagggctacacaaactgggttacattttgcgggatatcagcaaaattcctggaggtaatatgtatgctgacgacaccgccggatgggatacacgaatcacagaagatgatctacaaaacgaagcaagaattacagacacaatggaaccggaacatgccttactggccaaatctattttcaagctgacgtaccagaataaggtcgtacgtgttcagcgaccagccaaaaacgggaccgtaatggacgtaataagtcgaagagaccaacgaggctccggtcaggtaggcacctacggtctaaacacctttacaaatatggaggcacaattaatccgtcaaatggaatcagaaggtatattttcaccgagtgagttggagacccccaatctcgcggaacgggtattagactggttagaaaaatatggagtagaaagactcaaacgaatggcaataagtggcgacgattgcgttgtcaaacctatagacgacagatttgctacagccttgactgctctgaacgacatgggcaaagtacgtaaagatatcccgcagtgggaacccagtaaaggttggaacgattggcaacaagttccattttgctcgcaccattttcatcaactgataatgaaagacggcagagaaatagtagtcccttgccgaaatcaggatgaacttgtaggtagagcaagagtatctcaaggagcagggtggtccttacgggaaaccgcgtgccttggtaaatcttatgcacaaatgtggcagctgatgtatttccatagaagagatttacggctagcggctaatgccatctgtagtgccgtcccggtcgactggataccaacttccagaactacctggagtatacatgcgcaccatcaatggatgactaccgaagacatgctttctgtttggaaccgtgtctggatagaagaaaatccatggatggaagataaaacacatataagttcgtggggagatgttccgtatcttggcaaaagggaggaccaatggtgcggatcactcataggtttaacagctagagctacgtgggcgacaaacatccaggtagcaatcaaccaagtacgaagactaatcggcaatgaaaactatcttgactacatgacgtccatgaaacgatttaaaaatgaatcagacccagaaggtgctctatggtag

SEQ ID NO: 21830 - RNA, 9879 nt, synthetic construct
  misc_feature 1..9879: note = derived and/or modified CDS sequence (opt6) from DENV-1__GU131751__SS-prME
  source 1..9879: mol_type = other RNA
tccgtcaccatgttgcttatgctcatgccaaccgcattggcattccacctaacaacacgcgggggtgaacctcacatgattgtatcaaaacaagaacgaggcaaatctttgcttttcaaaaccagtgcaggggtaaacatgtgcacattaattgcgatggacctaggtgaattttgtgaggacacaatgacatataaatgcccacggataacagaagcggaacctgatgacgtagactgctggtgcaatgctacggacacgtgggtcacttatggcacatgctctcaaacaggggagcaccgcagggataaaagatcagttgcattggctccacatgtgggacttggactagaaactagaactgaaacatggatgtcatcagaaggagcctggaaacaaattcaaagagtcgaaacgtgggcactgcgacatccagggtttacagtcatagctttgtttttagcgcacgcaataggtacaagtataacccagaaagggataatattcatattactaatgctcgtgaccccctcgatggcaatgagatgcgtaggaatcgggagtcgagacttcgtcgaagggttatcaggagctacatgggtggacgttgtcttagagcatggtagttgcgtaacaaccatggcaaaagataaacccaccctcgacatcgaattattaaaaactgaagtcaccaatcctgccgttttacggaaactctgtatagaggcgaaaatcagtaacacgactacggattcccggtgcccaacccaaggagaagcaacattggtcgaggaacaagacgctaattttgtctgcagacgaacttttgttgatagaggatggggtaatggctgtggactttttggcaaaggcagcttaataacatgtgcgaaattcaaatgtgtaacgaaattagaaggtaaaattgtacaatacgaaaacctaaaatatagtgtcatcgtcacagtacatacaggcgatcaacatcaagttggaaatgaaagtactgaacatggaactatagcaacaattactccgcaagcaccatcaacagagattcaactaacggactacggagcattaacacttgactgttcaccaagaacaggattggattttaacgaaatggtattattaacaatgaaagaaaaatcttggttagtacacaaacaatggtttctggatctaccgttaccatggaccagtggagcttcaacgtctcaagagacttggaatagacaggatttacttgttactttcaaaaccgcacatgcgaagaaacaagaagtagtagtcttgggctcacaagaaggagcgatgcacaccgcattaactggagcgaccgaaatccaaacatcaggcaccacaactatcttcgcaggtcacctcaaatgtaggttgaaaatggacaagctcacgttaaaaggtatgtcttatgtaatgtgtacaggatcgttcaaactcgaaaaagaagtagcagaaacgcaacacggtacagtacttgttcaaattaaatatgaaggcacagatgctccctgtaaaatacctttctctacccaggacgaaaaaggagtaacacaaaatggaagactaatcacagccaatccaattgtaacagataaagaaaagcccgttaacatcgaagccgagccaccatttggagaatcatacatcgtaataggagcgggagaaaaagcactaaaattaagttggttcaagaaagggagtagcattggtaagatgttcgaagccaccgcaagaggcgcgagaaggatggcaattcttggagatacagcctgggacttcggatcaatcgggggagttttcacttcagttgggaaattagtgcatcaaatatttggtacggcgtacggtgtattattctctggtgtgagttggactatgaaaataggaataggcgtcctactaacttggctaggattaaattctagaagcacttcactgtcgatgacctgcatagccgtcggattagtaactttatacttaggagttatggtgcaagcagacagcgggtgtgtcataaattggaaaggccgcgaattaaaatgtggaagcggcatatttgtcacgaatgaagtacatacatggacagagcaatacaaatttcaagcagacagtcctaaaagactcagcgccgcaattggaaaggcatgggaggagggcgtatgcggaataagaagcgcgactaggttagaaaacataatgtggaaacaaatatctaatgaattaaaccacatcctattagaaaatgacatgaagtttaccgtagttgtgggcgatgtagccggtatattggcccaaggtaagaaagtcattcggcctcaaccaatggaacataagtatagttggaaaagttggggtaaagcgaaaataataggcgcggatgtacaaaatactactttcataattgatggtccaaatacgccggagtgtccagatgatcaaagagcatggaatatatgggaagtggaagattatggatttggcatattcacaactaacatctggttgaagctgcgggattcatacacacaagtgtgcgaccatcgtttaatgtcagctgctattcgagatagcaaagcggtacatgcagatatgggatattggatagagtcagagaaaaatgagacatggaaattggcaagagcaagtttcatagaggtaaagacatgtatctggccgaagtcacatactctatggagtaatggagtccttgaaagcgaaatgatcatacccaagatttatggcggtcccatatcgcaacataattaccgacccgggtactttacacaaaccgctggtccttggcacttaggaaaactagaactagacttcgacctctgtgagggaaccacagtcgtagtcgacgaacattgtggaaatcgaggcccatctctaagaacgacaacagttaccggaaagataattcatgaatggtgttgtcggtcatgtactttaccgccactaaggttcaagggagaggatggatgctggtatggtatggaaatcagacctgtaaaagaaaaagaagagaatctagttaaatcaatggtttcagctggatcaggggaagtagactcattttctcttggcctgttatgtatcagtataatgatagaagaggttatgaggtctaaatggtcacggaaaatgctgatgacaggcacactcgccgtattctttctgctcattatgggtcaattaacttggaatgatttaataaggctttgcataatggtaggagcaaatgcatcagaccggatgggtatgggtactacctacttagcattaatggccacgtttaaaatgcgtcccatgtttgcagtcggtctcctattccgtagattgacatccagggaggttttactactaacaattggactcagtctagtagcctcagttgagctacctaatagtcttgaggaactaggagacggtcttgcaatgggaataatgattctcaaactattgaccgacttccaatctcatcagttgtgggcaactctattgtcactaaccttcataaaaaccacctttagtctacactatgcctggaagaccatggctatggttctaagtatagtatcattatttccgttatgcttatctacgacaagccagaaaacgacatggctccccgtccttcttggctcattaggatgtaaaccactgaccatgtttttgatagcggaaaataagatatggggcagaaagagctggccactaaatgaagggataatggccgtgggcatcgtcagtattttattatcttcattgctcaaaaacgacgttccactagcgggccccctaattgcaggaggcatgttaatagcatgctatgtaataagcggttcaagcgcagatctctctttagagaaagccgccgaagtaagttgggaggaggaagcagaacacagcggagcttcccacaatatcctcgttgaagtgcaagatgatgggaccatgaaaataaaagacgaagagagagatgataccctaacaattctcttgaaagctacgttactggcggtatctggagtttaccctctttctataccggccacactatttgtttggtacttctggcagaagaagaaacaacgatctggggtattatgggacataccgagcccacctgaagtggaaagagctgtcttggacgacggtatatacagaattatgcagagaggcctgctcggacgtagtcaagtaggtgtcggcgttttccaagaaaatgtatttcacactatgtggcatgttaccagaggagcagttctaatgtatcagggtaaaagattagaaccgagttgggcatctgttaagaaagacttaatttcatatggaggagggtggaggttgcaagggagctggaacactggtgaagaagttcaagtgatagcagtagaacctgggaaaaatcccaaaaacgttcaaacagctcccggcacattcaaaacaagcgagggtgaggtcggggcaatagcgcttgactttaaaccaggaacatcagggagtcctatagtgaatagggaagggaaaatagtcggactgtacggtaatggagtagtgacaacgtctggtacatacgtatcagcaatagcgcaagctaaggcttcccaggaaggacctttgccggaaatagaagatgaagtatttaagaaacgaaatctcactataatggatctacatccaggttctggcaagacgcgaagatatttacctgccattgttcgtgaagcaatcaagcgcaaacttagaacattgattcttgcgccaaccagggttgtagccagcgaaatggcggaagcgttaaaaggcatgccaatacgatatcaaacaactgcggtaaaatctgaacacacgggaaaggaaatcgtagatttaatgtgtcacgcgacgtttacaatgagattattatcacctgtaagggtaccgaattacaatatgatcattatggatgaagctcacttcaccgatccaagctcaattgctgcacgtggatatatctctacaagggtcggaatgggggaggcagcagcaatttttatgactgctacaccacctggatccgtagaagcctttcctcaatcaaatgcagttattcaggacgaagaacgagatataccggaaaggagctggaactctggctacgaatggattactgatttcccaggaaaaacagtttggttcgtccccagtatcaaatcaggaaatgacatagctaattgcctacgtaaaaatgggaagcgtgttatacaactcagcaggaaaacgttcgatacagagtatcagaaaactaagaataatgattgggactatgtggttacaaccgacatttcagaaatgggagctaactttcgcgcagatcgtgtcatcgatccgagaagatgtttaaaaccagttattttaaaagatggccctgagcgtgtaattcttgccggaccgatgccggtgacagttgctagtgcagctcaacgaagaggacgaataggtaggaatcataacaaagagggagaccaatatatatacatgggacaacccctgaataacgacgaagaccacgctcattggaccgaggcaaaaatgctattagataatattaacaccccagaaggaattataccagccctattcgagcccgaaagagaaaaatcagcagcgatcgatggagaatataggttaaggggtgaagctcgcaaaacctttgtggaactcatgcgacgtggcgatctgccagtatggctatcctacaaagtagctagcgaaggtttccaatattcagaccgcagatggtgttttgatggcgaaaggaataaccaagttttagaggagaatatggacgttgaaatttggacaaaagaaggagagaggaaaaagttacgccctagatggttagatgctcgaacatatagtgatcctcttgccctgcgcgaatttaaagaatttgccgcaggtcgtcgtagcgtctcgggcgatttaattctcgaaatagggaagctgccacaacatctaacacaaagggcccagaatgcacttgacaacttagtcatgctacacaacagtgagcaaggcggccgagcctaccgtcacgcaatggaagaactaccagacacgatcgaaactctaatgctattggccctaatagccgtattaacgggaggtgtgacactcttctttctgagtggccgtggactaggaaaaactagcattggcttgctatgtgtaatggcaagttccgtgcttctttggatggcttccgttgagccacactggatagcagccagcataatactcgagttctttttaatggtgttactgataccagaaccagatagacaacgcacgccccaggataatcaactagcctatgtggtaatagggcttttgtttatgattctaactgttgcagctaatgaaatggggcttctcgagacgaccaagaaagatcttggtataggacacgttgccgtagagaatcatcatcacgcagcaatgctggacgtagacttacatcctgccagcgcatggacactatatgcagttgcaacaaccataattacaccaatgatgagacatactatagaaaacacaacagctaacattagtttgacagctatcgcaaaccaagctgcaatcttaatgggattagataaggggtggccgatatcgaaaatggatataggagtaccgttgctggcattaggatgttattcgcaagtcaatcctttgactttaacggcgacagtattgatgttggtcgcgcattacgcaataattgggcccggattgcaggcaaaagcaacgcgagaagcgcaaaagagaacagctgctgggataatgaagaatcccactgttgatggcatagtcgcaatagacctagaccctgtagtatacgatgccaaatttgaaaaacaactcggacaaataatgcttctaattttatgtacctcgcagatacttcttatgaggacgacatgggcgttatgtgagtccattacactagccactggacctcttacaactctctgggaaggatctccagggaaattttggaatacaactatagctgtttctatggctaatatctttcggggtagctatttagcaggagcaggcctcgccttctctctaatgaaatcattgggaggtgggcgtagaggtactggtgcacaaggagaaacgctaggagaaaaatggaaaagacaactaaatcaactctcaaaaagcgaatttaatacctataaacggtctgggataatggaagtagatagaagtgaggcaaaagaaggtttaaaaagaggcgaaaccacgaagcatgcagtatcaaggggaactgcgaagttaaggtggtttgtagagcgaaatctagtaaaaccggaaggtaaagtcatagatcttgggtgcggtagaggtgggtggtcatactactgtgctggactaaagaaagtaacggaggtaaaaggatacactaaaggcgggcctgggcacgaagaaccaatacccatggctacttacggatggaatcttgttaaactacacagtggcaaagacgtatttttcataccgccagagaaatgcgacactctactttgtgacataggggaatcatcacctaacccgacaatagaagagggacgaacgctaagagtcttaaagatggttgaaccttggctcaggggcaatcagttttgcatcaaaattctcaatccatatatgcccagtgtagtagaaaccttagaacaaatgcaacgtaaacatggaggtatgcttgttcgaaacccactctcaagaaattcaacacacgaaatgtattgggtgagctgtggtaccggaaacatagtttccgcggtaaatatgacaagtcgaatgttactcaacagattcacaatggcccatagaaaacccacctatgaaagagatgtggacctaggagcaggaactaggcatgtggccgttgagcctgaagttgcaaatctcgatatcattggtcaacgcattgaaaatataaagcatgaacacaagagtacttggcactacgatgaagataacccatataaaacatgggcataccatgggagttacgaggtaaaaccgtccggttcagctagtagcatggtaaacggagtggttaaactgttgaccaagccatgggatgttataccaatggtcacacaaatcgcaatgacagatacaaccccctttggtcaacaacgggtcttcaaagaaaaagttgacacgagaactcctaaagcgaaacgtggaaccgctcaaattatggaagtaacagccaaatggctctggggatttttaagtagaaacaagaaacctcggatttgcacacgagaagaatttacaaggaaggttcgatcaaacgcagctattggagcggtattcgtagacgaaaatcagtggaacagcgcgaaagaggctgtggaagatgaaagattttgggatttagtccatcgagaaagggaattgcacaaacagggcaaatgcgcaacatgcgtatataatatgatgggtaagagagagaagaaactaggcgaatttggcaaagcgaaaggaagccgagcaatatggtacatgtggctcggagctagatttctagaatttgaggcgctcggctttatgaatgaagaccactggttttctcgagaaaactcactgtcaggagtagagggagagggactacataaactgggttatatacttagggatataagtaaaattcctggagggaatatgtatgcagatgatacagcaggatgggatactcgtataacagaggacgatttacaaaacgaagcgaaaattacagatattatggaaccagaacatgcactattagctaaatctatatttaaattgacctatcaaaacaaagtagtccgcgtacaaagacctgcgaagaacggaacggtcatggatgtgatcagtcgacgggatcaaaggggcagcgggcaagtaggtacgtacggattaaataccttcaccaatatggaggcgcaattgatacgacaaatggaatcggaaggcatattctctccgtcagaattggaaaccccgaatctagcaggtcgcgtattagactggcttgaaaaatatggggtggagagattaaaaagaatggcaatatcaggtgacgattgcgtcgtcaaaccgattgatgatcggttcgcaacagcattgacagcattaaatgatatggggaaagttaggaaagacatcccacaatgggaaccgtcaaaaggctggaacgactggcaacaagtacccttctgttcacatcacttccatcaactaataatgaaagacgggcgcgaaatagtagtgccttgcagaaaccaagacgagttagtcggaagggcccgtgtatcacagggcgcgggatggtccttacgcgaaacggcctgcctgggtaagtcatatgcacagatgtggcaattaatgtatttccatagaagagacctcaggcttgccgcaaacgcaatatgtagcgcggtgcctgtcgattgggtaccaacatcgcgtaccacctggtctatacatgctcatcatcaatggatgacaactgaagacatgctttcggtatggaatcgagtatggatcgaagaaaatccatggatggaagacaaaacacacatctctagttggggagacgttccctacctgggtaaaagagaggatcaatggtgcggctcactaattggactcacagctagagcaacctgggcaactaatatacaagtcgctataaaccaagtgaggagattaattggcaatgaaaactatttagactatatgacatccatgaaaagatttaaaaatgaatccgatccagaaggtgcattatggtga

SEQ ID NO: 21831 - RNA, 9879 nt, synthetic construct
  misc_feature 1..9879: note = derived and/or modified CDS sequence (opt6) from DENV-1__GU131753__SS-prME
  source 1..9879: mol_type = other RNA
tcagtaacaatgcttttaatgctaatgcccaccgcattggctttccatttaacaactcgaggaggggaaccacatatgattgtaaccaaacaagaacgaggtaaatcactgctttttaaaacgagtgcaggggtcaatatgtgcactctaatcgctatggatttaggcgaactctgcgaagatacaatgacttacaagtgccctaggattacagaagcagaacctgacgatgtggactgttggtgtaatgcaaccgatacgtgggtaacatatgggacatgttctcaaactggagaacatcgaagagacaaaagaagcgtagcactagcgcctcatgtgggtctaggcttagaaacacgtacagaaacatggatgtcctcagaaggcgcttggaaacaaattcaacgagttgaaacttgggcattgaggcatccaggatttaccgtcacagcgctctttcttgcacacgcaattgggacgagtattacacaaaaaggaatcatcttcatcctcttaatgcttgttacaccaagtatggcaatgcgttgtgtaggaatcggctcacgggacttcgtcgaaggcttatcgggcgccacatgggttgatgtagtattagaacatggtagctgtgtaacaacgatggccaaagataaacctacgcttgatatcgaattattaaaaacagaagttacaaatccagccgttctgagaaaactttgcattgaagccaaaatttcaaacacaacaactgactccagatgtccaacacagggagaagcgaccttaatggaagaacaagacgcaaattttgtatgtagacgcacattcgtcgaccgtggatgggggaatggctgtggtctattcggaaaaggctcacttataacttgtgcaaaattcaaatgcgttacaaagctcgaaggtaaaattgttcaatatgaaaatctaaaatatagcgtaatagtgacggtacatacgggagatcagcaccaagtaggaaacgaatctactgaacatggcactaccgctacaataactccacaagcaccaacttcagaaatacaattgacagattacggggctttaacattagactgtagcccccgcacaggtctcgattttaacgaaatggtattgttaactatgaaagagaagtcttggctggtgcataaacagtggtttctagacctacccttaccgtggacaagtggggcttccacctcacaagaaacttggaaccgtcaagaccttttagtgactttcaaaaccgctcatgcgaagaaacaagaagttgtggtactagggtctcaagaaggagcaatgcatactgcactaacaggagccacagaaattcaaaccagcggaacgaccactatttttgcaggacatctgaaatgtaggttaaaaatggacaaacttacactaaaaggaatgtcgtacgtcatgtgtacaggtagttttaagctagaaaaagaagttgcagaaacccaacacggtactgtcctagtacaaatcaagtatgaaggaacagatgctccttgcaaaattccattctctactcaagacgaaaagggagtaacccagaatggaaggctcataaccgcgaacccaataattaccgataaggaaaagcccgtaaatattgaagcggaacctccgttcggcgaatcatacatagtcatcggtgcgggggaaaaagcacttaaactgagctggttcaaaaagggatcatctatagggaaaatgtttgaagctaccgcacggggtgctaggcgaatggccatactgggagacactgcatgggattttggatccatcggtggcgtatttacgtcaataggaaaattggtacatcagatatttggtacagcgtacggtgttttatttagcggtgtaagctggactatgaaaattggcataggagtattattaacatggctcggtcttaatagccgttcaacatcgctatctatgacctgtatcgccgtaggactcgtgacattgtatctcggcgttatggtgcaggcggattccgggtgtgtgataaactggaaaggacgagaactaaagtgtgggtcaggaatcttcgtgacgaacgaggtacatacatggactgaacagtataaattccaggcagacagtccaaaaagattaagtgcagctattggaaaagcctgggaggaaggcgtctgtggaatacgttctgcaacacggttagaaaacatcatgtggaagcaaatatcgaatgaactcaatcacattttacttgaaaacgacatgaagtttacagtagtagtgggcgacgttgttggtatcctggctcaaggtaaaaagatgatacgcccccagccgatggaacacaaatacagttggaagagttggggaaaggcaaagattatcggtgcggatgtgcaaaatactacgttcattatagacggccctaacacgccagaatgcccggacgaccagcgggcatggaatatttgggaagtagaagattacggatttggaatatttacaactaatatctggttaaaaatgcgcgatagctacactcaagtatgcgaccatagactgatgtcagccgccattaaagacagtaaagctgtgcatgcggatatgggctactggatagaatcggagaaaaatgaaacgtggaaactagccagagcatcatttatagaagttaaaacctgtatctggccgaagtcccatacattgtggtcaaacggtgtattggaaagtgaaatgataatacccaaaatctacggaggtcctatttcacaacataattataggcctggctacttcacgcaaactgctggtccatggcatctcggaaaactggaacttgatttcgacctatgcgaaggaacgacagtggtggtcgatgagcactgcggaaataggggaccgagcctacggaccactacggtaactggaaaaattatacacgaatggtgttgcagaagttgcacattaccacctttgagatttaaaggagaagacggctgttggtacggaatggaaatacgtccggtaaaggaaaaagaagaaaacttagtgaaaagtatggtaagtgctggttccggagaggttgatagttttagtttaggacttttatgcatatctattatgatagaagaagtcatgagaagccgctggtcaagaaaaatgttaatgacgggaactcttgcagtgttcttactgctaatcatgggtcaattaacatggaatgatttgatacgtttatgcattatggttggcgctaacgcatcagacagaatggggatgggtaccacatacctggcgctgatggccacttttaagatgagaccaatgttcgcagtcggactactgtttaggaggctaacctccagggaagtacttttactaactatcggtctaagtctagtggctagtgtcgagctgccaaactctctagaagaactaggtgatgggttagcaatgggaatcatgatcttgaaattactaactgactttcagtctcatcaactatgggcaacattgctaagtttaacatttataaaaactacactctcattgcactatgcatggaagactatggcaatggttctaagtatagtttcattaataccactctgcttatcaacaacctcacagaaaactacctggcttcctgttctacttggaagtttaggttgcaagccactcactatgtttttaatagcagaaaacaagatctggggacgaaaatcgtggccactgaacgaaggaattatggccgtaggggtcgtaagtattttattaagttcgttacttaagaacgacgttccacttgcaggtccactaatcgccggtggaatgttaatagcctgttatgtaataagcggctcctctgcagatctgtcactagaaaaagcagcagaggtatcctgggaagaagaagcagagcatagtggagctagccataacattttagtagaagtacaagacgatggaacaatgaagattaaagatgaggagcgagatgatacattgactatcctattgaaggcaacccttttagcagtctcgggtgtatatcctctgtcaattccagctactctatttgtgtggtatttctggcagaagaagaaacaaaggagtggggtactatgggacacaccatcaccgccagaagtagaaagagctgtcctagatgatggaatatatcgcattatgcagcggggtctgctgggacgatctcaggtaggagtcggagtcttccaagaaaacgtcttccacactatgtggcatgttacaagaggagccgtgttaatgtaccaagggaaaagacttgaacccagttgggcatcggtcaagaaagatttaatatcatacggaggagggtggcgtttacagggctcgtggaataccggcgaagaagtgcaagtgatagcagttgagccaggcaaaaatcctaaaaacgtgcaaacagcaccaggaacttttaaaactccagaaggtgaagtaggtgcaatcgctctggacttcaagccgggaactagcggttccccaatagtcaaccgagagggtaaaatagtaggactatacggtaacggagtagtaactacaagcggcacttatgttagtgcaatagctcaggcaaaagcaagtcaagaaggtcctcttccggagattgaggacgaggtttttcgcaaacgaaatttgacgattatggatcttcacccagggtccggaaagactagacggtatttgccggcaatcgtccgagaagcaatgaaaagaaaattaagaactctcatcttggcaccaacaagggttgtagcttcagaaatggcagaagcattaaaaggtatgcctataagatatcaaacaacagcagtaaagtcagagcatacaggtaaagagatagttgatttaatgtgccacgcaacgtttacgatgaggcttctctctccagtccgggtgccaaattataacatgataataatggatgaagctcacttcacggacccgtcaagtatagctgcacgtgggtacatctcaacaagagtaggaatgggggaagcagcagctatctttatgacagcgactccacccggttcagtcgaggcctttccacagagcaatgccgtaatacaagacgaagaaagagatatacctgaaaggtcttggaactctggatacgagtggatcacagactttcccggcaagacagtgtggttcgtaccatctataaaatcaggtaacgatatagcaaattgtttaagaaagaatggaaaacgagtaatccaattgtctaggaaaacttttgatactgaataccagaaaactaaaaacaacgattgggattatgtcgtgacaactgacatctcagaaatgggagctaactttcgagcagatagagttatagatcctcgtagatgcctaaaaccagtaatcctaaaggacggacctgaacgtgtaatcctggctggaccaatgccggtaacagtggcatcagctgcacagcgtcgtggaaggataggtagaaatcacaataaggaaggggatcaatatatatacatggggcaaccgttaaataatgatgaagaccatgcacactggaccgaagcgaaaatgctgctagacaacattaatacacctgagggcatcataccagcattgtttgagcccgaacgcgaaaaatccgcagcaattgatggggagtaccgtttgcgaggagaagcgagaaagaccttcgtggaacttatgcgaagaggtgaccttcctgtttggttaagttataaagttgccagtgaaggcttccagtacagtgacagaagatggtgctttgatggggaaaggaacaaccaggttttggaagaaaatatggacgtcgaaatatggactaaagaaggggaaagaaagaaattacgacctcgttggctagatgccagaacatacagtgacccactcgctttaagagaatttaaagagttcgcagcaggcagacgaagcgtcagtggagatttaatattagaaattgggaagttgccacaacatctcacgcaaagagcacagaatgctcttgataaccttgtcatgctacacaattcagaacaaggtggaagggcttaccgccacgcaatggaagaactaccagacactatagaaactttaatgctacttgctttaatagcagtactaacaggaggcgtaactctatttttcttgagtggaagaggcttaggaaaaacgagtataggcctcttatgcgttacagcatcgtcagtcttattatggatggcatcagtagaaccacattggattgccgcaagtataatcttagagttctttttaatggtactattaatcccggaacctgacagacaaagaacacctcaagacaaccaactagcctatgtagtaatcggacttttatttatgattcttacggttgcggctaacgaaatggggctccttgaaacgaccaagaaagacttaggcattgggcacgtagcagtcgaaaatcaccaccacgctacgatgttagatgtagaccttcatcctgctagtgcctggaccttatatgcagtagcaactacaattattactcctatgatgagacatacaatagagaacacgaccgccaatataagtctaacagcaatagctaatcaggcagctattttgatggggttggataagggatggccgatttctaagatggatataggtgtcccgttactcgccttaggctgctatagccaagtcaatcctcttacgttaaccgcagctgtactcatgttagtggcacattatgcaataattggccccgggttacaagcaaaagcgactagagaagcacagaaaaggacagcagccggaataatgaaaaatcccacggtagacggcattgtggccatagatcttgatccagttgtttacgatgcaaagtttgaaaagcagcttggtcaaataatgttgttgatcctttgtacaagtcaaattttattgatgagaacaacatgggccctctgtgagtcgatcactctagctacaggacctctaacgaccctctgggaaggaagcccgggtaaattctggaatacaaccatagcagttagtatggccaatatatttagaggttcttatttagccggtgcaggattagctttttccttaatgaaatcgttgggcggtggtagacgtggcactggagcccaaggagagacactgggagaaaaatggaaacggcaattgaatcagctaagtaaatcagagttcaatatatacaagagatcagggataatggaagtagatcgctccgaagcgaaagaggggttaaaacgaggtgagacaactaaacacgcagtaagccggggaacagcaaaattgagatggtttgttgagaggaatttagtaaaacctgaaggaaaggtcattgacctaggttgtgggaggggaggctggagttattattgtgcgggcctgaagaaggttacagaagtaaaaggatatacaaaaggaggacctgggcatgaagaacccataccgatggccacttacggttggaacctcgtaaagctacattcgggaaaagatgtattctttacacctcctgaaaaatgtgatacattgctatgcgatatcggggaaagtagcccaaatcctactattgaagaaggaagaactctacgagtcttaaaaatggtagaaccatggctaaggggaaaccaattctgtattaagatactgaatccatatatgccgtcagttgtagagacgctagagcaaatgcaacgcaaacacggaggaatgttagttcggaacccattatcgagaaacagtacacacgaaatgtactgggtttcttgtggtacaggcaacatagttagtgcggtaaatatgacctcaaggatgttactaaatcgctttaccatggctcacagaaaaccgacatatgaaaaagacgtagaccttggtgcgggtaccagacacgtagctgtagagccggaggtagctaatttagatattattggacagaggatagagaatattaaacatgaacacaagtctacctggcattatgatgaagataacccttataagacctgggcgtaccacggcagttacgaagtaaagccaagtggatcggcaagctcaatggttaacggcgtggtaaaacttctgactaaaccctgggatgtaattccaatggtgacccagatagcgatgacagatacaacaccattcgggcagcaaagggtatttaaagaaaaagtggatactagaaccccaaaagcaaagagaggtaccgtgcaaataatggaagtaacggcacgatggctttggggttttctgtctagaaacaagaagcctagaatttgcactagagaggagtttacccgaaaagtaaggtcaaacgccgccattggagcggtcttcgtcgatgaaaatcaatggaactctgccaaagaggcagtagaagacgaaagattctgggatctggtcaaaaaggaaagagaattacacaagcaaggaaagtgtgcaacatgcgtctataatatgatgggaaaaagagaaaagaaactaggggagttcggtaaagctaagggaagtcgagcgatatggtatatgtggttaggagctagatttttggaatttgaagcattaggtttcatgaatgaagatcattggttttctagagaaaactcgcttagtggcgttgaaggtgaaggtttacataagctcggctatatattacgcgacatatccaagatccctggtggtaatatgtatgcagatgatacagctggatgggatacacgcataactgaagatgatttacagaacgaagcaaagattactgatattatggagccagaacatgcgctacttgcgacctcaatttttaaacttacgtatcaaaataaagtggtaagagtacaacgacccgctaagaacgggactgtaatggacgtaatatcgcgaagggaccaacgtggtagtggacaagtaggtacatacggtttgaataccttcacaaatatggaagcgcaacttattaggcaaatggagtcagaaggaatatttttacctagcgaactggagacaccgaaccttgcagaaagagtatttgattggctagaaaaatatggagtggagaggctgaaaagaatggctatcagcggcgatgactgtgttgtaaaaccgattgatgacaggtttgcaaccgctctcacagctcttaacgatatgggaaaagtaagaaaggatatcccccaatgggagccatctaaaggttggaatgattggcagcaagttcctttctgttcgcatcactttcaccagcttataatgaaagacggacgagaaattgtagtgccatgtagaaaccaagatgaactcgtcggaagggcgagggtttctcagggcgcaggatggagtttgcgcgagactgcttgtctaggaaaaagttatgcacaaatgtggcaactcatgtactttcatagaagggacttacgtcttgcagcaaatgcaatttgttctgctgtgcctgtagattgggtacccacatcaagaaccacttggtccattcatgcgcatcatcaatggatgactacggaagatatgttatcagtttggaaccgagtctggattgaagaaaatccttggatggaagataagacacatgtatcaagctggggtgatgtcccatacttaggtaaaagggaagaccagtggtgtgggtcgttaatcgggttaacggcaagggcaacatgggcttctaacatacaagtagccataaaccaagtacgacgcttgataggcaatgagaattaccttgattacatgacgtctatgaaaaggtttaagaatgaaggagatccggaaggggcactttggtaa

SEQ ID NO: 21832 - RNA, 9879 nt, synthetic construct
  misc_feature 1..9879: note = derived and/or modified CDS sequence (opt6) from DENV-1__GU131754__SS-prME
  source 1..9879: mol_type = other RNA
tcggtgaccatgttgttaatgcttatgccgacggcgctggcatttcatctaacgacacgcgggggagaaccgcatatgatagtcagtaaacaagaacgcgggaaaagtcttttatttaaaaccagtgctggagtaaatatgtgcacactgattgcaatggatctaggggaattttgtgaagatactatgacatataaatgtccaaggattacagaagcagaacctgatgacgtagactgctggtgcaacgcaacggacacgtgggtaacctacggtacttgtagtcaaactggagaacatcgaagggacaaacgaagcgtcgcacttgcaccacatgtgggattaggattagaaacaagaacagaaacttggatgagcagtgaaggggcttggaaacaaattcaaagggttgaaacttgggcactgcgccatcccggattcaccgttatagcattattcttggcacatgcaataggaacatcaattactcaaaaagggattattttcatattactcatgttagtgacgccaagcatggccatgagatgtgtaggaattggaagcagagatttcgtcgaaggtctgagcggagcaacttgggtcgatgtggtacttgaacacggaagctgtgtaacaacaatggccaaagataaacccacactcgacattgaattacttaaaacagaagtcacaaacccagctgtcctccggaaattatgtattgaagcaaaaatttctaacaccactaccgatagtcgatgtccaacacaaggagaggcaactctggtcgaagaacaagatgcaaatttcgtttgtagaagaacattcgttgatagggggtggggtaacggatgtggattattcggtaaaggatcgctcataacatgtgccaaatttaaatgtgtcaccaaattggaaggtaaaatcgtacaatatgaaaatctaaaatatagtgtaattgtcacagttcatacaggagatcaacaccaagtaggaaacgaatcaactgagcatgggacgacagctactattacaccacaagcaccaagtactgagatacaattgacggattacggtgcgctaacgcttgattgtagtccgaggacaggactagactttaacgaaatggtattactaaccatgaaagagaaaagctggctcgtccacaaacagtggtttctagacctgccattaccatggacaagtggagcatccacctcccaggaaacatggaaccgacaggatctattggttacatttaaaaccgcacacgcaaagaaacaggaagtcgttgtactaggatcgcaagaaggcgcaatgcatactgccttaactggagctaccgaaatacaaacttcaggtactacaacaatctttgctggtcaccttaaatgtagattaaaaatggataaactgacattaaagggaatgtcatatgtgatgtgcacaggaagttttaaattagaaaaggaagttgcagaaacacaacacggaactgtactggtgcaaataaaatatgaaggaactgatgcaccgtgtaaaataccattctctactcaggacgaaaagggagtaactcagaatggacgattaataaccgcaaacccaatagtaaccgataaggataaaccagtaaacatagaggcggaacccccttttggagagtcatatatagtaattggcgccggtgagaaagcgctcaaattatcatggtttaaaaagggatcttccattggaaaaatgttcgaagcaactgctaggggcgcaagacgcatggcaattctcggtgatactgcttgggattttgggtctatagggggagtatttacgtcagtaggcaagctagtacatcaaatttttggtacagcgtacggagtcctctttagtggagtttcgtggactatgaagattggtataggcgttttattaacgtggttagggctaaattcacgaagtacatctttaagtatgacttgcattgccgttggattagttactctttatctaggagtaatggtacaggctgacagtgggtgtgttgttaattggaagggtagagaactaaaatgtggaagcggcattttcgtaactaacgaagtgcatacatggacagaacagtacaaattccaagcagacagcccaaaacgactctccgctgcaattggaaaggcatgggaggagggcgtatgtggaatccgaagtgctacgcgtcttgaaaatataatgtggaaacagatttcgaatgaactcaatcatattctactcgaaaacgacatgaagtttacggttgttgtaggagatgtagcaggaatacttgcgcaaggcaagaaaatgattagaccacagcctatggagtataaatattcttggaaaagttggggaaaagctaagataatcggagcagatgttcagaatacaacatttataatagacggaccaaatacgcctgagtgtccagacgaccagcgcgcatggaatatttgggaagtagaagactacggctttggcatctttacgactaatatctggctaaaacttcgagacagctatacgcaagtgtgcgaccatcgtctaatgtctgcagcgatcaaagatagcaaagcagtgcatgctgatatgggatactggatagagtcggagaaaaatgaaacatggaaactggctagagcgagttttatcgaagtaaaaacgtgtatctggccaaaatctcatacgctttggtcaaacggagtactggaatctgagatgataatccccaagatctatggaggacctatttctcaacacaattaccgcccaggatactttacccaaactgcgggcccctggcacttaggcaaacttgagctagacttcgatttatgtgaaggaaccaccgtagtggtagatgaacattgcgggaatcgaggccccagtctcagaacaactacagtcacaggtaaaatcattcacgaatggtgctgccgaagttgtactcttccgcccctcagatttaaaggcgaagatgggtgttggtatgggatggagataaggccagtaaaagaaaaagaagaaaacttagtcaaatcgatggtttcagcaggatcgggagaagtagactcattttcattagggcttttgtgcatcagtattatgatcgaagaggtaatgcgttcacggtggtctaggaaaatgttaatgacgggaacattagccgtgttctttctattaattatgggccaactaacctggaacgatcttatacgcttatgcataatggtgggagcgaatgcaagcgacaggatgggcatgggaacgacttacttggccctcatggcgacgtttaagatgcgccctatgtttgcagttggactcttgttcagacgcctcacatcacgggaagtccttcttcttactataggcttatcccttgttgcttctgtagaactgccaaattcactggaagaactaggtgatggattagccatgggaatcatgatattaaaattactgaccgattttcagagccaccagctgtgggcaacgctcttatcactcactttcatcaaaactactttctcattacattatgcatggaaaacgatggcaatggtactttccatcgtaagcctgtttccgctctgtatgagtacgacatctcagaaaactacgtggttgcctgttctattaggatcgctaggttgtaaaccattaacgatgtttctcatagcagagaataagatctggggacgaaaaagctggcccttaaatgaaggaattatggcagtaggaatagtatcaattctattgagttcgctgctgaagaatgatgtaccattagcggggcccttaatagctggcggaatgctcatagcgtgttacgtcataagtggctcgagcgcagatctatcactagaaaaagcagcggaagttagctgggaagaggaagctgaacattcaggtgcatcgcacaacatattagttgaagttcaagatgatggtacaatgaaaataaaagacgaagagagagatgatactctaaccatccttcttaaagcgacgttacttgcagtctcaggagtataccctcttagcattcctgctacattattcgtctggtatttctggcaaaagaagaaacaaagatcaggagtgctatgggatacaccatcaccaccggaagtagaaagagccgtactagatgacggaatatataggataatgcaaagaggactacttggtagaagtcaagtaggggtaggggtgttccaagaaaatgtattccacacaatgtggcacgttactcggggcgctgtgttgatgtatcagggaaaacgtcttgaaccaagctgggctagcgtgaagaaagacttaatatcatacgggggcggctggcgactacaaggttcatggaatacgggcgaagaagtacaagttattgcagttgaacccggcaaaaaccccaaaaatgtacagacagctcctggaacatttaaaacctcagaaggtgaagtaggagctatagcattagacttcaagcctggaacatcaggatcgccaatagtaaatcgtgaaggaaaaatcgtggggctgtatggcaacggtgttgtgactacctcaggaacttatgtttctgcgatcgcgcaagccaaagcgtctcaagaaggccctctcccagaaatagaagacgaagtatttaggaaaagaaatttaaccatcatggatttacaccctggaagtggaaagacccgacgctatttgcctgcaatagtacgagaagctataaaaagaaagttaagaactctaatattagcaccaacaagagtggtcgctagtgagatggcagaggcgcttaaggggatgccaataagatatcagaccacggcggtcaagagtgaacacacgggtaaagagatagttgacctgatgtgtcatgcaacatttacgatgcgattactttccccagttagagtaccgaactacaatatgatcataatggatgaagcccatttcaccgacccttcctctatcgctgccaggggttacatatctacaagggtaggcatgggagaagcggcagcaatatttatgacggcaaccccaccaggaagtgtcgaagcgttcccgcagtccaatgccgtaatccaagatgaagagagggacatcccagaacgatcttggaatagcggatacgagtggataacagattttcccgggaagaccgtatggtttgtcccgagtattaagagtggaaacgacatcgccaattgcctaaggaaaaatggtaaaagagttatacagttatccagaaaaacttttgacacggagtatcagaaaactaagaacaatgactgggattacgtggttacaactgatatttcagaaatgggagcgaattttagagccgatcgagtcatagatccgcgtcgttgtttaaaacccgtcatactgaaagatgggcccgaacgggtgatattagcaggacctatgcctgtaacagtcgcaagcgcagcgcaaagaagaggacgtattggaagaaatcataataaggaaggagatcagtatgtgtatatgggtcagccccttaacaatgacgaagatcatgcacattggactgaggccaaaatgctacttgataacataaacacgcccgaagggatcataccggcactatttgagcccgaaagagagaaaagcgcagctatcgacggggaatatcgtttaagaggagaagcaagaaagactttcgtcgaattaatgcggcgaggagacttaccggtgtggctttcttacaaagtggcatccgaaggattccaatattccgacagaagatggtgtttcgatggggagcgtaataatcaggtcctcgaagaaaatatggacgtcgaaatatggaccaaggaaggggaacggaagaaactacgcccaagatggttagatgccagaacatattccgacccactcgcgctacgggaatttaaggagtttgcagcaggcaggaggtccgtctcgggagacttaatattagaaatcggcaaactgccacaacatctcacgcaacgcgcacagaatgcattagataacctggtaatgctgcataattctgaacagggaggtagagcttataggcacgcaatggaagaattaccagacactatagaaacgcttatgttgctggccctaattgctgtattaaccggaggagtcactttgttctttttatcaggcagaggccttggcaagacaagtatcggtctcttatgtgtcatggcaagtagcgcattactctggatggctagtgtggaaccacattggattgctgccagtataatactggaatttttcctcatggtgctcttgataccagaaccagatagacagaggactccccaggataaccagctagcctatgttgttatagggctcttgttcatgattctaacagtcgctgcaaatgagatgggcctactagaaaccaccaaaaaggatttaggaatcggccatgttgcagttgaaaatcaccatcatgcggctatgctagatgtagatctacatcccgcttcggcatggacactatatgcagttgcaacaacaataatcactccgatgatgcgacatacaatagaaaacacaacagcgaatatttcgttgacagcaattgcaaaccaagctgctatcttaatgggtttggataaaggatggccgatctccaaaatggatatcggagtcccactactagctctgggctgctattcccaggtaaacccattgactcttacggcggccgtacttatgctagtagcacactacgcgataattgggcctggattacaagcaaaagccacaagagaagcacaaaagcgaacggctgctggtattatgaaaaaccctacagtagacggtatcgtagcgattgatctcgatcctgtggtttacgatgcaaaatttgaaaagcaactaggacaaataatgcttttaattctttgtacatcacaaatactcttaatgcgaactacttgggctctctgtgaaagtataaccctagcgacaggtcctttgacaacgttatgggaaggttcccctggaaaattttggaacacgaccatcgccgtcagtatggcaaatatattccgaggatcttatttagcaggagcgggactagcatttagcttaatgaaatcactaggtggcggacgcaggggaacaggagcccaaggcgagacactcggtgagaagtggaagagacagttaaatcaattatcgaaaagtgagttcaatacttataaacgatcaggtatcatggaagttgatagatcagaagccaaagaaggactaaaaaggggtgaaaccactaaacacgcggtttccagaggaacagcaaaactaagatggttcgttgaaagaaatcttgtaaaaccagaaggtaaagttatcgatctaggttgcggtcgtggaggttggtcttactattgtgccggacttaagaaagtcacggaagtaaaaggatatacaaaagggggaccagggcacgaagaacctatcccgatggctacttacggatggaacttagtgaaactgcactcagggaaagacgtgttctttattccaccagaaaagtgtgatacactattatgtgacataggagaaagttcaccaaatcctaccatcgaagaaggcagaaccctgagagtcctaaaaatggttgaaccctggttacgagggaatcaattttgtatcaaaatcttaaatccttatatgccatcggtagttgaaactctggaacaaatgcaaagaaaacatggaggaatgcttgtaagaaatccactatctcgcaattcaacacacgaaatgtattgggtttcttgcgggacaggtaatatagtcagcgcagtgaacatgacatcaaggatgcttctcaatagatttacaatggcacatcgaaagcccacttatgaaagggacgtggacttaggagctggtacaagacacgttgcagtagaaccagaggttgccaatttggatataattggtcagcgaatcgagaatataaaacacgaacataaatcaacttggcattatgacgaagataatccatataagacatgggcttatcatggttcctatgaagtaaaaccttcgggatccgcctcgagtatggttaatggtgttgtaaaacttttaacaaaaccctgggacgtgataccaatggtaacgcagatagcgatgacagacacaacgccgttcggacaacaaagggtattcaaagaaaaagttgatacaagaacccctaaagctaaacggggtacagcacaaataatggaagtcacagcaaagtggttatggggatttttgtcaaggaataaaaagcctcgaatttgtactcgagaagaatttacgaggaaagtccgatcaaacgcagctataggagcagtctttgtcgacgaaaaccaatggaacagcgccaaagaagccgtcgaagatgaacgcttttgggatctagttcatcgtgaaagagaattacataaacagggcaagtgtgcaacttgcgtttataatatgatgggtaaaagggagaagaaattaggagaatttgggaaggcgaaaggctccagagcaatctggtacatgtggttaggtgcacggttcctcgagttcgaggctttaggattcatgaacgaagatcattggtttagccgtgaaaactccctatcgggtgtcgaaggagaaggtctacacaagctaggatacatcctaagagacattagcaaaattccaggcggaaatatgtacgcagacgatacagcagggtgggacactcgtatcactgaggatgatctgcaaaatgaagcaaaaattaccgatataatggaaccggagcatgcgctgttggccaaatccatattcaaactcacataccaaaataaagtggtacgggtccaacgacccgccaaaaatggcacggtcatggacgtaatatcgcgaagagatcaacgaggtagtggacaggtgggcacctatggcttaaacacatttacgaacatggaagcacaattaattagacagatggaatcggaaggtatattcagtccatcagaactagaaactcctaatcttgcaggacgtgttcttgactggctagaaaagcacggagtcgaacgtttgaagcgaatggcaatcagtggagatgactgcgtagttaaaccaattgacgacagatttgctacggctttaaccgcactcaacgatatggggaaggtaagaaaagatatcccgcaatgggaacctagtaagggatggaatgactggcaacaagttccattctgcagtcaccatttccatcaattgattatgaaagatggcagggagatagttgtcccatgtaggaatcaggatgaattagtcggcagagctagagtgtcacagggtgctggatggtcactcagagaaacggcatgccttggaaagagctatgcacagatgtggcaattaatgtattttcatagaagggacttaagactcgcagctaatgcgatatgttcagcagttccagtagactgggtacctacaagtaggacgacatggtcaattcatgctcaccatcaatggatgaccacagaggacatgttaagtgtatggaatagagtgtggatcgaagaaaatccatggatggaagataagacacatatatcgtcctggggagacgtaccatatttgggtaagagagaagaccaatggtgtggctcactaataggtttgactgcacgggcaacatgggccacaaatatacaagtagcaatcaatcaagtccgtaggttaataggtaacgaaaattatttagactatatgacgtcaatgaagcgatttaaaaacgaaagtgacccagaaggtgcattatggtga

SEQ ID NO: 21833 - RNA, 9879 nt, synthetic construct
  misc_feature 1..9879: note = derived and/or modified CDS sequence (opt6) from DENV-1__GU131755__SS-prME
  source 1..9879: mol_type = other RNA
tcggtgactatgctgttaatgctgatgccgacagccctcgcgtttcacttaacaacgcgtggtggagaaccccatatgatcgtgtcaaagcaagagcgaggaaaatccttgttatttaaaactagtgcgggagtaaatatgtgcactttaattgcaatggacttaggcgaactttgcgaagatactatgacctataaatgccccaggattacagagactgaacctgacgatgtagactgctggtgcaacgcaacagacacctgggtaacgtacggtacatgctcacaaaccggcgaacatcgacgagataaaagaagcgtagccttagcaccacatgttgggcttggactagaaactcggacggaaacgtggatgtcatcagaaggcgcgtggaaacaaattcaacgcgtagagacatgggcgctgagacatcccggctttacagtcatagctctattcttagcacacgcaattgggacatctataactcaaaaaggaattattttcatacttcttatgctagtcactccgagtatggccatgcgatgtgttggaataggtagccgggatttcgttgaggggctttcgggtgcgacctgggtcgatgtagttttggaacatggttcatgcgtaacgacaatggccaaagataaacccaccctagatatcgaactacttaaaacagaggtcacgaatcctgcagtcttgagaaagttatgtattgaagctaagatttcaaacactacaacagattcaagatgcccgactcagggagaagcaactctggtggaagaacaagacgccaatttcgtgtgtagacgaacatttgtggaccgggggtggggaaacggatgcggcttgtttggaaaaggctcattaatcacttgtgcaaaattcaaatgcgttacaaaactagaagggaaaattgtacagtatgaaaacctaaaatatagcgtaatagtgactgtccatactggagaccaacatcaagttggcaacgagtcaacagaacacggaaccacggcgacaattacgccacaggcacccactacagaaatccaactaacagattacggagcacttactctagactgtagtccgaggacaggacttgatttcaatgaaatggttctattgaccatgaaagagaaatcttggcttgtccataaacagtggtttttagatcttccattgccctggacctcaggagcgagtacatctcaagaaacctggaatagacaagatttactagtcacattcaaaacagcacatgcgaaaaaacaggaggttgtcgttttggggtcacaggaaggagcaatgcacacagcacttactggggcaacagaaatacaaacaagtggaacaacaacaatttttgctggccatctgaaatgccgccttaaaatggataagctgactttaaggggaatgtcatatgtaatgtgtacaggaagcttcaaattagaaaaagaggttgcagaaacacaacacggaacagttctagtccagatcaaatatgagggaacagatgccccctgcaaaattccgttctcaactcaagacgaaaaaggagtcactcaaaacggtaggctaatcactgcaaaccctatagtaaccgataaagaaaaaccagtgaatatcgaagctgagccaccatttggggaaagttatatagtaataggtgcaggagagaaggctcttaagttatcttggttcaaaaaaggttcaagcataggtaagatgtttgaggccacagcaagaggagcacgcagaatggctatactaggagatactgcatgggatttcggtagcattggaggagtatttacgagcgtaggcaaattagttcatcagatatttgggacggcatacggtgtgttgttttcaggcgtgtcctggactatgaagatcggtataggggtattactaacctggctaggcttaaattcacgatccacttccttatctatgacatgcattgcagtaggattagtaacactttacctaggcgttatggtacaagccgattccggttgcgttatcaattggaaaggacgagaattaaaatgtggttctggtatattcgtaactaacgaagtgcacacatggacagagcaatacaagttccaagcggatagtcccaagcgattatctgcagctattggaaaagcatgggaagagggagtctgtggtataaggtcggcaaccagactagaaaacataatgtggaaacaaatctcaaatgaactgaaccatatattattagagaatgatatgaaatttacggttgtagtcggagacgtagcaggaattttggcacagggcaaaaagatgataagacctcagcccatggaatacaaatattcatggaaatcttggggtaaagcgaaaattataggcgcagacgtccaaaacactacctttattatagatggtccaaacacccctgaatgtccagacgatcagcgtgcatggaacatatgggaagttgaagattatgggtttggaatatttactacaaatatatggttaaaactaagagacagctatactcaagtgtgtgaccataggctaatgagtgcagcgataaaagatagcaaagcggtacacgcagatatgggatactggatagaatcagaaaaaaatgagacatggaaattagcaagagcatcattcatagaggtcaaaacttgtatatggccaaagagccacacattgtggagtaatggagttctcgaatcagagatgataatacccaaaatctacggtggaccaataagccaacataattatcgaccaggatactttacccagacggcaggcccttggcatttgggcaaattagaactggatttcgatttatgcgaaggtacgacagtagtcgttgacgaacattgtgggaacagagggccgagcctccgaaccacaacagtaaccggtaaaattattcatgagtggtgctgtagatcctgtacattgcccccattgaggtttcggggagaagacggctgctggtatgggatggaaatcagaccggttaaagaaaaagaagagaacttagtcaaatccatggtatcggcaggatccggagaggtggatagtttttcgctcgggcttctctgcatctcgataatgatcgaagaagtcatgcggtccagatggagcaggaaaatgttaatgacaggaactctagccgttttctttttgttaattatgggacaattaacctggaatgatcttatccgcctctgcataatggtgggagccaatgccagtgaccgcatgggtatgggtactacctacctagcattgatggcaacatttaagataagacccatgttcgctgttggacttctgttcagacggctaacatcgcgggaagtcctattactaacaattggcttgtcgttggttgcatcagtggaattaccaaactctctcgaggaacttggtgatggattagcaatgggtataatgattcttaagttgcttactgattttcaatctcaccagctatgggctacattactttcactaacatttataaaaacaaccttttccctacattgtgcgtggaagacaatggcgatggtgctatcgatcgtatccttgttcccattatgtctttctaccacaagtcaaaaaacgacatggttaccagtgctattaggaagtcttgggtgtaaacccctaacaatgttccttatagctgagaacaaaatatggggacgtagatcatggccacttaacgaaggaataatggcagttgggatagtttcgatactactaagttctctacttaaaaacgatgtgcctttagcaggtccactgatcgccggaggaatgctgatagcttgttatgtaatatccggcagttcagctgatctatccctcgaaaaggctgctgaagtaagctgggaggaagaggctgaacacagcggcgcatcgcacaacatattagtggaggtgcaagatgacgggactatgaaaataaaagatgaagaacgagacgatactttaactatattattaaaagcaaccttgttagcagtatcaggagtatacccattatcaatacctgcaactctattcgtatggtatttctggcagaaaaagaagcaacgttcaggtgtactctgggatacgcctagcccaccagaggtagaacgagcagtacttgatgacggaatctacagaatcatgcaaaggggactattggggcgttcacaagtcggtgtaggagtattccaagaaaatgtattccacacaatgtggcacgtgactcggggtgcagtccttatgtaccagggaaaaaggctggaaccgtcctgggcttctgtgaagaaagatttaattagctacggcggaggttggagattacaaggctcatggaatacaggagaagaagttcaagtaatagcagtggagcctggcaaaaatccgaaaaatgtgcagactgctcctgggacattcaagacacccgagggcgaagtgggggccatcgcattggatttcaagcccggtacaagcgggagtccaatcgtaaaccgggaaggtaagattgtaggactatatggtaatggagtggttactacatcaggaacctatgtgtccgcgatagcccaagcaaaagctagccaggaaggtccactcccagaaatagaggacgaagtatttagaaaaaggaacttaacaattatggacctacatcctgggagtggtaagaccagaagatatcttccagctatagtcagagaagccataaaacgaaaactacgtacactaatactagcacctacgagggttgtagcatcagaaatggcagaagcactaaaaggaatgcccattagatatcaaacaacggcagtaaaatcagagcatacgggaaaggaaatagtggatcttatgtgccatgctacctttaccatgcggctgctatcaccagtccgtgtcccaaattacaatatgatcattatggacgaagcccattttaccgatccttcgtcaatagccgcaaggggatatatctcgaccagagtaggcatgggagaagcagcagctatttttatgacagcaacgccgccaggaagtgtagaagcgttcccacaatccaatgctgtgatacaagatgaagaaagggacattccagaaagaagttggaatagtggatacgaatggataaccgactttcctggaaaaacggtatggtttgttccctctattaaatccggtaatgatatagcaaattgcctaagaaagaatggaaaaagagttatacaactctctagaaagacgttcgacaccgagtatcaaaaaaccaaaaacaatgattgggattacgtagttacgaccgatatcagcgaaatgggagcaaatttccgagccgaccgggtaatagaccccagacgctgtctcaagccagtaatattaaaggatggtccggaacgagtaattttagctggaccaatgcctgtgacagtcgcgagtgcagcccaacgacggggaagaataggtaggaatcacaacaaagaaggggatcagtacatatatatgggtcaacctttaaacaatgatgaggatcatgcacattggacagaagcgaaaatgcttctagacaatattaatacacctgaagggatcattccagcattatttgaacctgagcgggagaaatccgcagcaatagatggcgaataccgccttagaggcgaagctagaaaaaccttcgttgaactaatgagacgaggtgatttacctgtgtggctatcctacaaagttgcatctgaaggtttccaatatagtgatagaagatggtgtttcgacggtgaaagaaacaaccaagtcttggaagaaaatatggacgttgaaatatggacaaaggaaggagagcgtaaaaaacttagaccccgatggttagacgccagaacatatagcgacccactagctctaagagagttcaaagaattcgcagcaggaagaaggtcagtgtcaggtgacttaattcttgaaataggcaaattaccacaacatttgactcaaagagcccaaaatgcgctagataatttagtcatgttacacaattctgaacaaggtgggcgcgcttaccgacatgcaatggaagaattaccggacacgatagaaacgctcatgttgcttgccttaatagcagtactaaccggcggagtaactttatttttcctgtccggacgaggtttgggtaaaacaagcatcggtttattatgcgtaatggcgtcatctgtgctcttgtggatggcaagcgtagagcctcactggattgctgcctcaataattttagaattcttcttaatggtattactaatacctgaacctgacaaacaaagaactcctcaagacaatcagttggcatatgtagttatcggcctactatttatgatactgactgttgcagccaatgaaatgggcctactcgaaacaacaaaaaaagaccttgggatagggcatgtggccgtagaaaaccaccaccacgccgctatgctagacgtagatctacatccggcctctgcgtggacattgtacgctgttgcaactacgattatcacccccatgatgcgccatacaatagaaaatactacagcaaatatttcactaacagccatagccaatcaagctgctattctgatgggcctcgataaaggatggccgatctcaaagatggacatcggggtacctttattagcactaggatgctattctcaagtcaaccccctaactttgacagcagccgtacttatgttggtggctcactatgccattataggtccaggtcttcaagctaaagcaaccagggaagcccaaaaacgaactgcggcaggaatcatgaaaaatccaactgtggacggtatagttgcaatagatcttgacccagtagtctacgatgccaaatttgaaaaacaactaggtcaaatcatgttattaatcttatgcactagccaaatactattaatgagaaccacctgggcgctctgtgaatctatcaccttagccacaggacctttaacaacgttatgggaaggatcaccaggaaaattttggaacacaactatagcagtgtccatggcaaatatttttcgcgggagctatctagcaggagcaggattagcattttcactaatgaagagccttggtggtggaagacgcgggactggcgcgcaaggtgagaccctaggagaaaagtggaaaagacagctcaatcagttatctaaaagtgagttcaatacttacaaacgatccggaataatggaggtagatcgttcagaagcaaaggaaggccttaaaagaggagaaaccaccaagcatgcagtttccagagggacggcaaagttaagatggtttgtggaacgcaatctagtgaaaccggaggggaaggtaatagatttgggatgtgggagaggggggtggtcttattattgtgctggactgaaaaaggtgactgaggttaaaggatatacgaaaggtggccctggtcatgaggaacccatcccgatggcaacatatggatggaatttggttaaactacatagcggaaaagacgttttttttattccaccggagaaatgtgacacgttattatgtgatattggtgaatcttctccgaatccaacgatagaggaaggaaggactttgcgagtactaaaaatggtagaaccatggctaagaggaaatcagttctgtattaagatactcaacccatatatgccatccgtggtagagactctggaacaaatgcagagaaaacacggcgggatgctcgtcagaaacccactctcacggaattctactcatgaaatgtactgggttagctgtggcacaggaaacattgtaagtgctgttaatatgactagcaggatgcttttaaaccgctttactatggcccatagaaaacctacttacgaaagggacgtagatctcggagccggcacaaggcatgtggctgttgaaccagaagtggcaaacttagacataattggacaaagaatagaaaatataaaacacgagcataaaagtacatggcactacgatgaagataacccttataaaacctgggcgtatcacgggtcttacgaggttaagccgtcgggtagtgctagttcaatggtcaatggcgttgttaaactactaacaaaaccttgggacgtcattcctatggtaacccaaatcgcgatgacggatactactccgttcggtcaacaacgggtattcaaggagaaagtagatacacgcacacctaaggcaaaacgcggcaccgcccaaatcatggaagtaacagctaaatggctctggggttttcttagtagaaacaaaaagcctagaatttgcactcgagaggagtttactcggaaagtgagatccaatgcagcaataggcgcggtgttcatagatgagaatcaatggaattcagccaaggaagcggtagaagacgaacgtttttgggatttagtccatagagaaagggagcttcacaagcaaggaaaatgtgcaacttgtgtatataatatgatgggcaaacgtgagaaaaaacttggggagtttggaaaggcaaaaggaagccgcgccatatggtacatgtggttaggagcaaggtttctagaattcgaagcattaggctttatgaacgaagatcactggtttagtagagaaaattcattaagcggggttgaaggcgagggattacataaattggggtatattttaagagatatcagcaagatacccggtggaaatatgtatgcagatgacacggctggatgggacacccgcataacagaggacgatctgcaaaatgaagcaagaataactgacataatggaaccagaacatgcactactagcgaagtcgatattcaaattaacatatcaaaacaaagtggttcgcgttcaaagaccggccaaaaatggaaccgtaatggatgtaatatcccgcagagaccagagaggttccgggcaagtcggaacttatgggttaaatacatttacaaatatggaagctcaattaatccgtcagatggaatcggaaggaattttctcaccgagtgaactggaaacaccaaatttagcagaacgtgtattagattggctagaaaaatatggggtagaaaggttaaaacggatggccatatcaggtgatgattgtgtggttaaaccaatagatgatagatttgccaccgcccttacggcgttgaatgatatgggtaaagtaagaaaggacattccgcagtgggaaccatccaaaggttggaatgactggcaacaggtgcctttctgcagtcatcatttccaccaattaataatgaaggatggacgtgagatcgtcgtaccttgcagaaatcaagatgaattagtaggtcgggctcgcgttagccaaggtgcagggtggtcacttagggaaacggcatgtctagggaaatcatacgcacagatgtggcaactaatgtactttcatagaagagatctccgattagcagcaaacgcgatctgcagcgccgtcccagtagattggatcccaacttccaggaccacgtggtcaattcacgctcaccatcaatggatgacgacagaagacatgttatccgtgtggaatagggtatggatagaagaaaacccctggatggaggataaaacacatatatcaagctggggagatgttccctatctgggcaaaagagaagaccaatggtgcggctctttgataggactcacagctcgtgctacatgggcaacgaatatacaagtcgccataaatcaagtacgaagattgattggaaacgaaaattatcttgattatatgaccagtatgaaaagatttaaaaacgaatcagaccctgagggtgctttatggtaa

SEQ ID NO: 21834 - RNA, 9879 nt, synthetic construct
  misc_feature 1..9879: note = derived and/or modified CDS sequence (opt6) from DENV-1__GU131756__SS-prME
  source 1..9879: mol_type = other RNA
tcagttacaatgcttttgatgctaatgccgacagcattagcttttcatcttactactagaggaggagagccgcatatgatagtgtcaaaacaagagcgagggaaatcgttactatttaaaacaagcgcaggcgttaatatgtgtactctaatcgctatggacctaggggaattttgcgaggacactatgacttataaatgtccaaggatcaccgaggcagagccggatgacgttgactgttggtgcaacgctacggacacttgggtaacttacggtacatgttctcaaactggcgaacatagacgggataaaaggagcgttgcactagctccacatgtaggtcttggtctagagactcgtactgaaacatggatgagcagtgaaggtgcgtggaaacaaatacaacgtgtagaaacatgggcgttacgacatccagggttcacagtcatcgcactatttctagcccatgctataggtacaagcatcacacaaaaaggaataatttttatactattaatgttagtaactccatctatggcgatgaggtgcgtaggtattggaagtcgagattttgtagaaggtctatccggggcgacatgggttgatgttgtattagaacatggaagttgtgtcaccactatggcaaaagataaacccacgttggacatcgagttactaaaaacggaggtaacaaacccagcagtattaaggaaactttgtatagaggccaaaatttctaatactacgactgatagtcgatgtccaacacaaggagaggcaacgctagtggaagaacaggacgccaattttgtttgtcgaagaaccttcgtggacagaggatggggcaatggatgtggcttattcggaaaaggatctttgattacttgcgcaaaatttaaatgtgtaaccaaactagaaggtaaaatagttcaatacgagaatttaaaatatagtgtaattgtcacggtacacacaggtgatcagcatcaggttggtaacgagagtactgaacacggaacaacagcaacaattacgccacaagctccatctacagaaattcaattaactgattacggggctctgacgttggactgtagtccccgaacgggattagacttcaatgaaatggtgcttcttacaatgaaggagaaaagttggttagtccacaaacaatggtttttagacttacccttaccatggacctcaggcgcaagcacatcacaagaaacctggaatagacaagatttgttagtaactttcaaaaccgcccacgctaagaaacaagaagttgttgttttgggctcacaggaaggcgcaatgcatactgccttaacaggagccacggaaatccaaacctccggaactacaacgatttttgcaggtcatctcaagtgcagacttaaaatggacaagttaactttaaaaggtatgtcatacgtaatgtgtacaggttcttttaaattagagaaagaagttgccgaaacgcaacatggaacagtcttagtccaaattaaatatgaagggactgacgctccctgtaaaataccattttcaacacaggacgaaaaaggagtaacccaaaatggcagattaataacggcgaaccctattgtcacggataaagagaagccagtcaacatagaagcagagccgcctttcggagagtcgtatatagtaattggagcaggagaaaaagctcttaaattgtcttggttcaagaaaggttcgtcaataggaaaaatgttcgaggcaactgctagaggagcacgacgtatggctattcttggagacacggcttgggactttggtagcataggcggagtgtttacatcagttggaaagttagtacaccaaatttttggaactgcatatggggttctatttagtggagtaagctggactatgaaaatcggtattggagttttactaacctggcttggattaaatagcaggtcaacgtccctgtccatgacatgcatcgcggtaggcttagtaaccctttacttaggtgtaatggtccaagctgattctgggtgcgtaatcaactggaaaggaagggagcttaaatgtggctcaggaatttttgtaacaaatgaagtacatacatggaccgagcaatacaaattccaagcggatagcccaaaacggctatccgcggccataggtaaggcttgggaagaaggagtatgcggaatacgatcagccaccagattagagaatataatgtggaagcaaatatccaatgaattaaatcacatactgttagaaaatgatatgaagttaacagttgtagttggagatgtggcaggaatcctcgcacaaggcaaaaagatgatcagaccccaaccaatggaatataaatattcgtggaagtcctggggaaaagccaaaataatcggcgccgatgtgcaaaatactaccttcataatagacggaccgaataccccggaatgcccggatgatcagagagcttggaatatttgggaggtagaggactacgggttcggaatcttcacaacaaatatctggttaaaacttcgcgacagctatacacaagtatgcgatcataggctaatgagtgccgctataaaggattcaaaagcagtgcatgccgacatgggatattggatagaatccgagaaaaacgaaacttggaagctggctcgagcctcatttatcgaggttaaaacttgtatttggccaaaatcacatacactatggagtaacggagtgttagagagtgaaatgattataccaaagatttacggtggtcctatatcccaacataactatagaccgggatactttacgcaaactgcaggaccatggcatctaggaaaactagaattagactttgacctgtgcgagggtaccacagtagtagtagacgaacattgcggtaatcgagggccatcactgaggactacaacagttacaggcaaaataattcatgagtggtgttgtcgttcatgtacactacctccattgagatttaaaggagaagacggatgttggtacggcatggaaatacgacctgtcaaagaaaaggaagagaatctagtaaagagcatggtaagtgctggctctggagaagtagactcgttctctctcggattattatgcatatcaataatgatagaagaggtaatgcgtagtagatggtcgagaaaaatgttgatgacggggactcttgcagcattctttctcctcattatgggacaacttacatggaatgacttaattcgcttatgtattatggttggcgcaaatgcttccgacaggatgggtatgggcactacatatttagcattaatggcaaccttcaaaatgagacctatgttcgctgttgggctgttatttcgaaggcttacatcgagggaagtactcttactcacaataggattgtctcttgttgcaagtgtggagctacccaactctttagaagaacttggagacggcttggcaatgggaataatgattttaaagttgttaacagattttcagtctcatcaattatgggccacattacttagcttaactttcataagaacaacttttagcctacactatgcatggaagactatggcgatggtactatcgattgtatcactctttccgctgtgtttaagcactacaagtcagaaaaccacatggctaccagttttattgggttcattaggatgcaaaccccttacaatgttcttgatcgccgagaataagatatggggaagaaagagctggcccttaaacgaaggtatcatggcggttggaattgtatctatcctcctatcttctctactaaagaatgatgttccattagcaggacctctaatcgcagggggaatgctcatagcctgttacgtaataagtggatcgtccgctgatctatcactagaaaaagctgctgttgtcagttgggaagaagaggcagaacacagtggcgctagtcacaatatacttgttgaagttcaggatgatggaacaatgaaaataaaggacgaggaaagggacgacacattgacaatcctcttaaaggctacgttacttgctgtaagcggtgtatatccattaagtattcccgccacactttttgtgtggtacttttggcagaagaagaaacaaagatctggcgtattgtgggatacaccttcgccacctgaagtagaaagagccgtactggatgatggtatatacagaattatgcaaagaggtctcctaggaagatcgcaggtcggggttggcgtgtttcaagagaacgtgtttcatacaatgtggcacgtgactagaggggccgttctaatgtatcagggaaaacgtttagaaccttcatgggctagtgtcaagaaagatttaatatcctatggaggcggctggcgtctacagggaagttggaacacgggggaggaagtgcaagtcatagcggtagagccgggcaaaaatcccaaaaacgtccagaccgcccctgggacatttaaaacgagcgaaggtgaagtaggtgctattgcgttagattttaaacctgggactagcggttcgccgatagtaaatcgtgaaggcaaaatcgtaggactatacggaaatggcgtagttacaacatcaggcacctatgtatcagctatagcgcaagcgaaagcgagccaagagggtcctttacctgaaattgaggacgaagtcttcaggaagcgaaatttaacaatcatggacctacacccgggatcgggaaaaacgcgaagatatctgccagcaatagtacgagaggctataaaaagaaaattacgaaccctaattcttgcgccgaccagagtggtagcgagtgaaatggcagaggcgctaaaaggtatgcccataagataccaaaccacagcggtaaagtccgagcatactggtaaagaaatagtagatttaatgtgccatgcaacgttcacaatgagattattatctccagttcgtgtcccgaactataatatgataattatggacgaagcccactttactgacccaagctcaatagcggcaagaggctatatttccacaagggtagggatgggagaagctgcagcgatatttatgacagcaacaccccctggtagtgtcgaggcatttccgcagtccaacgcagtaatccaagacgaagaaagagacataccggaaagaagttggaatagtggatacgagtggataacagatttccctgggaaaaccgtatggtttgtaccaagcataaaatcaggaaatgacatcgcaaactgcttaaggaaaaatggtaaaagagtaattcaactttcacgcaagacatttgacacggaatatcagaaaacgaaaaataatgactgggactacgtagtaacaacggacatttctgaaatgggtgcgaatttccgggcagatagagtcatcgatccacgaaggtgtctaaaacctgtcattttaaaagatggaccggagagagttatactcgcaggaccaatgccagtgacagtcgctagcgcagctcaaaggcgtggacgaataggaagaaatcataataaggagggtgaccaatatatttatatgggacaaccactaaacaacgatgaggatcatgcccattggacagaagcaaaaatgctcctggataatattaacaccccagagggtataatcccagcgctatttgaaccggaacgtgaaaagagtgccgctatcgatggagaataccggcttagaggtgaggcacgcaaaacatttgtagagcttatgagaaggggagacttaccagtctggctatcatataaagtagcgagtgaaggatttcaatatagtgaccgacgatggtgtttcgatggtgaacgtaataaccaggttttggaggaaaacatggacgtcgaaatttggacgaaagaaggtgagagaaagaaattaagaccaagatggttggacgcgagaacttacagtgacccacttgccctccgagagttcaaggaatttgctgcggggcgacgatcagtgtccggagatctcattctagaaatcggaaaactaccacaacatctaactcagagagctcaaaatgcattagataacttagttatgttacataattcagaacaaggtgggagggcatatagacatgctatggaagaacttcctgatacgatagaaacgctgatgctccttgcactcattgcggtattaaccggaggggtcaccttgttctttctgtcaggcaggggtctaggtaagacaagcatcggccttctgtgtgttatggcatcatctgttctgttatggatggcatccgtagaacctcactggattgctgcatcaatcattctcgagtttttcttaatggttctgctgatacctgaacctgaccgacaaagaaccccacaagacaatcaacttgcatatgtagttataggactgttattcatgattctcaccgttgcagcaaacgagatgggactactagaaactactaaaaaggatttgggaataggacatgtagcagtagaaaatcatcatcatgcggcgatgttagacgttgacctgcatccggcgagtgcatggactttgtatgctgtggctacaactattataactccaatgatgcggcatactatcgaaaatactaccgccaatatttcacttacagcaattgcgaaccaagcagctatcttgatgggcttggacaaaggatggcccatatcaaaaatggacataggggtgccactactcgcgctaggatgttactcacaagtaaatccattaacactcactgcagcagtactgatgcttgtggcacactatgcaataatcggacctggactgcaagcaaaagcaaccagagaggcacagaaaagaacggctgcgggaatcatgaaaaacccgacagtagacgggattgtggcaattgatttagacccagtggtatatgacgctaagttcgaaaagcaactgggtcaaataatgttactcatactttgtacaagccaaattctattgatgaggacaacatgggcactatgcgaatcgataacattagctactggtccgctaacaactctgtgggaaggaagtcctgggaaattttggaatacaacaatcgcagtctctatggcaaatattttcagaggttcttacttagctggagcaggtcttgcgttctcactgatgaaatcgttaggaggagggcgaagaggcactggagcacaaggggaaacacttggcgaaaagtggaagagacaactaaaccagcttagtaaaagcgaatttaatacgtataaaagaagtggcattatggaagtagaccgtagtgaagcaaaggagggcctaaaaaggggtgaaacaacaaagcatgctgttagtagaggtacagcgaaattaaggtggtttgttgaacgcaacttggtaaaacctgaaggcaaagtcattgatttgggctgtggtcgtggaggctggagttattattgtgcgggcctcaagaaagttacagaagttaagggttacaccaaaggagggcctgggcatgaggaacccataccgatggctacttacggatggaatctcgtaaaacttcatagcggcaaagatgtcttctttataccccctgagaaatgtgatacacttctatgcgatataggtgaatcatctcctaatccaacaatagaggaaggtcgaaccttgcgtgtcttgaaaatggtagaaccatggttacgtggtaaccaattctgtataaaaatcctcaacccctatatgccgagcgtagtggaaacgttagagcaaatgcaaagaaaacatggaggaatgttagtaaggaacccactttccagaaattccactcacgaaatgtattgggtatcatgcggcaccggcaatattgtgtcagcagtaaatatgacaagcaggatgctattaaatagattcactatggcccatcgaaaaccgacctatgagagagatgttgatcttggagcaggaactaggcacgttgcagtcgaaccggaagttgctaatctagatataatcggacagcgaattgagaatattaaacatgaacataaaagtacgtggcattatgatgaagataatccatacaaaacatgggcttaccatggcagttatgaagtcaaacccagtggttctgccagctcgatggtaaatggcgtcgtcaaactcctaactaaaccttgggatgtaattccaatggttactcaaatagcgatgaccgataccaccccatttggtcagcaaagagtatttaaagaaaaagttgatacccgtactccaaaggcaaagagaggtacggcacaaataatggaggtaacggcaaaatggctttggggctttctatcacgaaataagaaaccacgtatttgtactcgagaagaatttacaagaaaagtgagatctaacgcagccattggtgcagtttttgtggacgaaaatcaatggaacagtgcgaaggaggcagtggaggatgaacgcttttgggatcttgtgcaccgcgaaagggaattacataaacaagggaaatgtgcgacatgcgtatacaacatgatggggaaacgagaaaagaaactgggtgaatttggtaaagcgaaaggatcacgagctatttggtatatgtggctaggggcgaggtttttagagttcgaagcattaggttttatgaatgaagaccactggttcagtagagaaaactcactaagcggcgtagagggggaaggacttcacaagctaggctatatactcagggatatatctaaaattcctggaggaaatatgtacgccgatgatacagcaggttgggatacacgcataacagaagacgatttgcagaatgaagcaaaaattaccgacattatggaaccggaacacgcattacttgccaagtcaatatttaagctaacgtaccaaaataaagtcgttcgagtacaacgacctgccaaaaacgggactgtcatggacgtcattagtcgtcgagaccaaagaggatccggtcaagtggggacgtacggactaaatacatttactaatatggaagcacaacttatccgtcagatggagtccgagggaatttttagtccatcagaactcgaaacgccaaaccttgctggtagggtccttgattggttagaaaaacacggcgtagaaagacttaaaagaatggctataagtggagatgactgtgtagtaaaacccatagacgacagattcgctacagcactgacggcactgaatgacatggggaaagttcggaaggatatccctcaatgggagccgtcgaaaggatggaacgattggcaacaagtaccattctgctctcaccattttcaccagctcattatgaaggatgggcgcgaaatagtggtcccatgcagaaatcaagatgagttggtgggacgtgcgcgtgtatctcaaggagcaggttggtctctacgagagacggcatgtctaggaaaaagttacgctcaaatgtggcaattaatgtactttcatcgaagggatttaagacttgcagctaatgccatttgttcggccgtccccgttgattgggttccaacaagtagaacaacatggtcaatccatgctcatcatcaatggatgacgactgaggatatgttaagcgtgtggaatcgagtgtggattgaagaaaatccttggatggaagataaaacacatatcagcagttggggagatgttccatatctaggaaaaagggaagatcaatggtgtggaagcctcattggtctaacagcaagagcaacgtgggccaccaatatacaagttgcaattaatcaagtacgacgattattagggaatgagaattacctagattatatgacaagcatgaaaaggttcaaaaacgaaagtgacccagaaggagcgctatggtaa

SEQ ID NO: 21835 - RNA, 9879 nt, synthetic construct
  misc_feature 1..9879: note = derived and/or modified CDS sequence (opt6) from DENV-1__GU131758__SS-prME
  source 1..9879: mol_type = other RNA
agtgtaactatgctattaatgttaatgccaactgctctagcatttcatttaaccactcgagggggagaaccacatatgatagtatcaaaacaagaacgcggcaagagcttactatttaaaacatctgctggagtaaacatgtgtactctaatcgctatggaccttggcgaattttgcgaagatacaatgacttataaatgtccaagaattactgaagcagaaccggatgacgtcgactgttggtgtaacgcaacggatacttgggtaacttatggtacatgctctcaaactggtgaacatcgcagggataaaaggtctgtagcgttggcgccacatgtaggactaggattggaaaccagaactgaaacgtggatgagttcagaaggagcttggaaacaaatacaacgagttgaaacatgggcgcttagacatccgggtttcaccgtaatcgcattgttcttggcccatgcaattggaaccagtatcacgcaaaaaggaattatattcattcttctcatgttagtcactccgtccatggcaatgagatgtgttggtataggctcaagggattttgtagaaggattatcaggagcgacttgggtagacgtagtgttagaacatggatcttgtgtaactactatggcaaaagataaaccaacacttgacattgagctattaaaaaccgaggtgaccaaccctgccgtcctaagaaaattgtgtatagaagctaaaattagtaataccacaacagacagtagatgtccgacacagggcgaagccaccttggtagaagaacaggacgcgaattttgtatgcagaaggacatttgtcgatcgtggatggggcaacggttgtggactttttggcaaaggcagtttaataacatgtgccaaattcaaatgcgtcacaaaactagaaggaaaaacagtacaatacgaaaatctgaaatattcagtgattgtcactgtacacacgggagaccagcatcaagtaggaaacgaaagtactgaacacggaacgaccgctactataacacctcaggccccttcaacagaaatccaattaactgactacggcgctttaacccttgattgttcgccaagaactgggctggactttaatgaaatggtgctactaacaatgaaggaaaaatcttggttggtacataaacaatggtttttggatcttcctttaccgtggacatctggcgcctctacttcgcaagaaacatggaatcgtaaagatctgctagtaactttcaaaacagcgcacgctaagaaacaagaagtagtcgtattaggatcccaagaaggagctatgcacacagccttaacaggagcgacggaaattcaaacctccggaacaacaactatttttgctggccacctaaaatgtagacttaaaatggacaaactaacactgaaaggaatgagttatgttatgtgtacaggatccttcaaattggaaaaagaagtagcagaaacacaacatggaactgtcctagtgcaaataaagtacgaaggtacggacgttccatgcaaaatcccattctcaacgcaagatgagaagggagtaacacagaatggacgattaatcacagcaaatcctatagtaacagacaaagagaaacccgtaaatattgaagcagaaccgccctttggagagtcgtatattgtaataggtgctggagagaaagccttaaagttatcgtggtttaagaaagggtcgtccataggcaaaatgttcgaagccacagcacgtggggcaagaaggatggcaatacttggcgacacagcttgggactttggctccatcggaggagtctttacaagcgttggcaagctagttcaccaaatattcggaaccgcatacggtgtcttattctcaggagtttcatggaccatgaaaatagggattggtgtacttttaacttggctgggtttaaatagtagatcgacttcgttatcaatgacatgcatcgccgttggattagttactctgtatttaggggtaatggtacaagcagacagtggatgcgtgataaattggaaaggtagggagttaaagtgtggcagtggaatattcgtcacaaatgaagtacatacatggactgagcaatataagttccaagccgactcaccgaaacgactatctgcagctataggaaaggcttgggaggaaggggtctgtgggattcgctccgcgactagattagagaatataatgtggaagcagatttcaaacgagttaaatcacatcttattagaaaatgatatgaaatttactgtagtagttggagatgtcgcaggaatactcgctcaagggaagaaaatgatcaggccgcaaccgatggaatacaaatattcatggaaatcgtggggtaaggcgaaaatcattggtgcggacgtgcagaacactaccttcataatagacggtcccaatactcctgagtgtccagacgaccaacgggcctggaatatatgggaggtagaggactatggatttggaatttttacgacgaatatctggctgaaattacgagattcttacactcaagtgtgcgatcaccgactgatgagtgccgcgataaaagacagtaaagctgtacatgcagacatgggctattggatagaatcagagaaaaatgaaacgtggaaacttgctagggcatcctttatagaagtaaaaacgtgtatatggcctaaaagtcacaccttatggtcaaatggcgttcttgagagtgaaatgataattcccaaaatatacggcggacccatctcacaacataactacagacccgggtactttacacaaacggcagggccatggcatctgggtaagttggaactagattttgatctatgcgagggtacgaccgtcgtagtagatgaacactgcggcaacagaggaccatccttgcgaacaacaacagtaactggaaaaattattcatgaatggtgttgtcgcagctgtacactgcctccattacgatttaaaggggaagatggttgctggtacggtatggaaattcgccccgtcaaagaaaaggaagaaaatttggttaaatctatggtctcagcaggttcaggagaggtcgatagcttctcactggggttattgtgcatttcaattatgatcgaggaagtaatgcggagccggtggtcacgaaagatgttgatgacaggaactctagccgtctttttcttacttattatgggtcagcttacttggaatgatctgattagactttgcattatggtaggcgcgaacgcatcagatagaatggggatgggcaccacttaccttgcactgatggccacatttaaaatgcgaccaatgtttgcagttggcttactttttaggagattgacgtctagagaagtgttacttctgacaatcggtttatcgttagttgcttctgtagagcttccaaattctttagaagagttgggtgacgggctcgccatgggtataatgatccttaaacttcttacagattttcaatcccaccagttatgggctacattattgtctttcacttttattaaaacaaccttcagtttacactatgcttggaagaccatggcaatggtattaagcatcgtttccttattccccctttgtttaagtacaacatctcagaaaacgacttggctaccggtccttcttggctcacttggatgtaagccacttactatgtttctaattgcagagaataaagtatgggggcgcaagtcctggcctttgaacgaaggaataatggccgtagggatcgtctcaattctccttagtagtctgctcaaaaacgatgttcctctggctggaccgctgatagcagggggcatgttaatcgcatgttatgtgatttcaggaagttctgcagatttatctttagagaaagcggcagaagtctcatgggaagaagaagcagagcacagcggcgcatcccataatatactcgtagaagtgcaggacgatgggacgatgaaaatcaaagacgaagaacgagatgatacattaactatattactaaaagcaaccttgctagcggtatcaggtgtgtatccgttatcaattccagcaacactatttgtatggtatttttggcagaagaagaaacaaagatcaggggtactatgggacaccccctcaccccctgaagtagaacgtgctgtattggatgatggaatatataggatcatgcagcggggactcttagggcggtctcaggtcggcgttggagttttccaagagaacgtctttcacacgatgtggcatgttactagaggagcagttcttatgtatcaaggaaaacgattggaaccatcatgggcgtcagtaaagaaagacctaatctcgtatggtgggggttggcgtttacaaggtagctggaacacaggtgaagaagttcaagtaattgccgttgaacctggcaaaaatcccaaaaatgttcaaacagcccctgggacatttaagaccagtgaaggagaagttggcgcaattgctttagactttaaaccagggacctcgggctcaccaattgtcaatagagaaggaaaaatcgtgggcttatacggtaacggcgtagtcacaacttctggaacctatgtctcagcgatagcacaagctaaagcatcacaggaggggccattacccgaaatagaagatgaagtattcagaaaaagaaacctcacgatcatggatttgcaccctggttcaggaaaaaccagacgctacctaccggcgattgtccgtgaagcgataaaacgtaaattaaggaccctaattttggcacccactcgagtcgtcgcgtcggaaatggcagaggcactcaaaggaatgccaattcgttatcaaacgacggcagtaaaatctgaacataccggaaaagaaatagttgatcttatgtgtcatgcaacgttcactatgagactcttatcaccagttagagtgccaaattataatatgataataatggatgaggcccacttcactgatccaagttcaatagccgcgagaggttacatctcgacaagagtggggatgggagaggctgcagcaatatttatgacagctactcctcccggaagcgttgaagccttccctcaatcgaatgctgtaatacaagacgaagaaagagatataccagagcgatcctggaactcggggtatgaatggatcacagactttcctgggaaaactgtttggttcgttccatcaattaagtccggaaacgatatagcgaactgtctcaggaagaatggaaaacgggtgatacaactttcaagaaaaacttttgatacagaatatcagaaaactaaaaacaacgattgggattatgtcgtaacaacagacattagtgaaatgggcgcaaatttcagggcagacagagtgatagacccgcgtagatgtttaaaacccgttatactaaaagacggtcctgaaagagtaatattagcgggacctatgccagttactgtcgcaagtgcagctcagcggagaggacgtataggacgcaaccataataaagaaggtgaccaatacatctacatgggacaaccactgaataacgatgaagaccatgcacactggactgaagccaagatgttactagataatattaataccccagaaggaataatcccagcattattcgaacctgaacgagaaaaatcagctgcaatcgacggcgaatatcgattaagaggagaagctagaaaaacatttgtcgagttgatgaggagaggagatcttccagtctggttgtcgtataaagttgcgagcgagggattccagtattccgatcgaagatggtgctttgacggcgagaggaacaatcaagtcctcgaagagaacatggatgtagaaatatggactaaggaaggtgagaggaagaaattacgaccccgatggctagacgcaaggacctactcagatccgctagctttgcgagagttcaaggaatttgctgcaggaagaagatccgtaagcggggatttaatattagaaataggcaaattgcctcagcacctaacacagagagctcaaaacgcattagacaacctggtaatgttacataattccgaacagggaggccgagcatacaggcatgctatggaagaactacccgatacgattgaaacattaatgttgttggcactaattgcagtactcacagggggagtaacgttatttttcttgtcaggaaggggcttaggtaaaacgtcaataggattactttgtgtgatggcatctagtgttttactatggatggcctcagtagaaccccattggatagctgcctcaataattttagaatttttcctaatggtgcttctaatcccggaaccagacagacaaagaactccacaagataatcaattggcatatgtagtcattggacttttatttatgatattaacagttgccgcaaacgagatgggcttgctggaaaccacgaagaaagatcttggaattggacacgcagcagtagagaatcaccatcacgctgctatgctagatgttgatttacatcctgcttccgcatggactttatatgctgtagccacaaccataataacacccatgatgcggcataccattgagaatacaactgcaaacatctcactaacggctatcgctaatcaagccgccatactcatgggtttggataaaggctggccgatatccaaaatggacataggggtaccattactcgctctgggatgttacagtcaagtaaacccgcttaccttaacggcagccgttctcatgctggtggcgcattatgcaataattgggccaggtcttcaagccaaagctactcgagaagcgcaaaaacgaacagcagcaggtataatgaaaaacccgactgtggatggtatcgtcgcaatagacttagacccagtagtatatgatgcaaaattcgagaaacaattaggccaaatcatgttactgatattgtgcacaagtcaaatattgctaatgagaacaacatgggcactttgtgagtcgatcacgctcgcgactggtcctcttacaacactgtgggaaggaagcccaggaaaattctggaatacgactatcgcggtatcaatggcaaatatttttcggggatcgtatttagcaggcgctggactggcattttcccttatgaaatcactaggcggaggacgtaggggcacaggtgcacagggagaaaccctgggagaaaaatggaaaagacaactaaaccaactatcgaaaagcgagtttaatacatataaaagaagcggtatcatggaagtcgaccgaagcgaggcaaaagagggactgaaaagaggggaaactacaaagcacgcagtaagtcgagggacagccaaattaagatggttcgttgaacgaaatttagtcaaaccagaaggaaaagtcattgacttaggctgtggaagaggtgggtggtcatattattgcgcaggtttaaagaaagtaacggaagttaagggttatactaaaggaggacccggacatgaagaaccaattccaatggccacttatggatggaatctggtgaaattacatagcggaaaggatgttttcttcatacctccagagaaatgtgatactctattatgtgacattggagaaagtagtcccaatcctacgattgaggaggggcgtacattacgagttttaaaaatggtagaaccgtggctacgtggcaatcagttctgtataaagattctaaatccttatatgccttctgtagttgaaacattagaacaaatgcagagaaagcatggcggcatgcttgttcgaaaccctctatctagaaattcaacacacgaaatgtattgggtatcatgcggtacgggtaatatagtatcagctgtaaatatgacgtcaagaatgctactaaatagatttacaatggcgcaccgaaagcctacttatgaaagagatgtcgacttaggcgctgggacaagacatgtagcagttgaaccagaagtagcaaatttagacattatcggacagcgtatcgagaacataaagcatgaacataagtcaacatggcattatgacgaagataacccttacaaaacctgggcttatcatggctcgtatgaagtcaagccatcggggagcgcaagttccatggtaaatggtgtggtcaaacttcttacaaaaccgtgggacgtaatccctatggttacacaaatcgcaatgacggatacaaccccattcggtcagcaacgagtatttaaagaaaaagtagacacacggactcccaaggcaaaacgcgggacagctcaaataatggaggtcacagcaaaatggttgtggggattcttgtctagaaacaagaaacctaggatctgtactcgtgaggaatttactagaaaagtacgctcaaacgccgcaataggcgcagtctttgtagacgaaaaccaatggaactccgctaaggaagcagtagaagatgaacgtttttgggaccttgtacacagagaacgagagctccacaaacaaggcaaatgtgcgacctgtgtttataatatgatgggtaagagagagaagaaattaggcgagtttggcaaagccaaaggtagtagggcaatatggtatatgtggttgggggcacggtttctcgagttcgaagctctgggattcatgaacgaagaccattggttctctcgagagaactctctaagtggcgtcgagggagaaggactacataaattaggatacatactgagagatatctcaaaaatccccggaggaaacatgtatgcagatgatacggctgggtgggatacccgaatcacagaagatgacttacaaaatgaagcgaaaataacagacatcatggaacctgaacatgcactccttgctaaaagcatattcaagctaacatatcagaacaaggtagtacgggttcaacggccagccaaaaatggcacagtaatggatgtaatatcgcgtagagatcaacggggttcaggacaagtcgggacatatggtttgaacacattcactaatatggaggctcagttaattaggcaaatggaatctgaagggatctttagtccgagtgagttggaaacaccgaacttagctgggagagtattagattggttggaaaaacatggggtggaaagattaaaaagaatggcaatatcgggtgacgactgtgtcgtaaagccgatagacgacagatttgcgactgcgttaaccgccttaaacgatatgggtaaagttaggaaagatatacctcagtgggaacctagtaaaggctggaatgactggcaacaagtcccgttttgttcacatcattttcatcaattaattatgaaagatggtcgtgaaatagttgtcccctgcagaaatcaagatgaattagtaggcagagctcgagtcagccaaggagcagggtggtctttaagggaaactgcttgtttaggtaagagttacgcccagatgtggcaattgatgtactttcacaggagagacctacggctggctgccaacgctatttgttcagctgttccggtggactgggtccctaccagcaggacaacttggtccatccatgctcatcatcaatggatgacaacagaggatatgcttagcgtgtggaatagagtttggatagaagagaatccctggatggaggacaagacacacatatcatcatggggagacgtcccttatcttggcaaaagagaagatcaatggtgcgggagtcttatagggttaaccgctcgagcaacttgggctactaatattcaagtagcaataaatcaagtaagaagactaattggtaacgaaaactatctagactatatgacaagcatgaaacgctttaaaaatgaatctgacccagaaggagcgctatggtaa

SEQ ID NO: 21836 - RNA, 9879 nt, synthetic construct
  misc_feature 1..9879: note = derived and/or modified CDS sequence (opt6) from DENV-1__GU131759__SS-prME
  source 1..9879: mol_type = other RNA
tccgtaacaatgttattgatgttaatgccaacagcacttgcatttcatctaacaacgcggggaggagaaccgcacatgattgtctcaaaacaagaacgagggaaatctttactatttaaaacaagcgctggagttaatatgtgtactttaattgcaatggacctaggggaattttgcgaagatactatgacatataaatgccctagaataacggaagcagaaccagacgacgttgattgctggtgcaatgcgactgacacatgggtcacatacggtacctgttcacagacgggcgaacatcgtagagataaaagatccgtagcgcttgcaccacacgtgggattgggactggaaaccaggacagagacgtggatgtcaagcgaaggggcatggaaacaaatacagcgagtcgaaacttgggcgctcagacaccccggattcacagttatagcattattcctagctcatgcaattggtacgagtatcacccagaaaggcattatatttatattattaatgcttgtaactccttcaatggcaatgcggtgtgttgggattggatctagagactttgtagaggggttgtcaggtgccacgtgggtcgacgttgttttagaacatggctcatgtgttactacaatggccaaagacaaaccaactctagacattgaattattgaaaacggaagtaacaaacccggctgtattacgaaaactatgtatagaagccaaaatatccaatacaactacggacagtcgttgtcccacacaaggtgaagctacgttggtagaggagcaagatgcaaatttcgtttgcagacgaacctttgtggaccgtggatggggaaatggatgtggtttatttggaaaaggatctctcattacatgtgccaaattcaaatgtgtgacaaaattggaagggaagactgtacaatatgagaatttaaaatattcggtcatagtaacggtacatacaggtgaccagcaccaggtaggaaacgaatcaacggagcatggcacgacggcaacgatcacaccccaagctccatccacagagatacaattaaccgactatggtgcgctcactctagactgttctccgcgcacgggactcgattttaatgaaatggtattacttacgatgaaggaaaagtcttggctcgtccataagcaatggttcttagatctgccattgccatggacatcgggtgcatcaacttcgcaagagacttggaaccgaaaagacctattagtaacttttaaaacagcccacgcaaagaaacaagaagttgtggttttagggtcgcaagaaggagcaatgcatacagcccttacaggagcaacagaaatacaaaccagtggaacgaccactatatttgctggacatctaaaatgtcgactaaaaatggacaaattaacgctaaaagggatgagctacgtgatgtgcacgggtagctttaaactcgaaaaagaagtagcagaaacccaacatgggacagtcctagtccaaataaaatacgagggcactgatgccccatgcaaaatccctttcagtactcaagacgagaaaggtgtaacccagaatggccgattgataaccgcaaatcccatagtaactgataaagaaaaacctgtcaatatcgaagctgaacctccatttggagaatcctatattgttataggtgccggtgaaaaagcattaaaattaagttggttcaagaaagggtcgagcatcggtaaaatgtttgaggcaacagctagaggggcgagacgaatggcaattctcggggatacggcttgggattttggatcgattggcggagttttcactagcgtgggaaagctagtacaccagatttttggtactgcgtacggagttctcttttctggagttagttggacaatgaaaatcgggataggcgttctattaacgtggttaggtttaaactcaaggtccacatctctatccatgacatgtatcgccgttggattagttactctttatttaggagttatggtacaagctgattctggatgcgtaataaattggaaaggacgagaattaaaatgtggctccgggatctttgttacgaacgaagttcatacttggacagaacagtacaaatttcaagcagacagtccaaaaagattaagtgcagcaataggcaaggcctgggaagaaggggtctgtgggatacgtagcgcgacccgactcgagaatataatgtggaagcaaattagtaacgaattgaaccacattcttcttgaaaatgatatgaaatttactgtggtagtgggggatgtggcaggcattctcgcacaaggcaagaaaatgattcgaccacaaccgatggaatataaatactcttggaaaagttgggggaaagctaaaataattggcgctgatgtacagaatacaacctttatcatagatggacctaacactcctgaatgtccagacgaccaaagggcgtggaatatttgggaggtagaagattatgggttcggaatctttacaacgaacatatggctgaaactccgagatagctacacacaagtatgtgaccatagattaatgtcagcggcaataaaagacagtaaagcagtccatgcagatatgggttattggatagaatctgagaaaaatgagacctggaaacttgcacgggctagtttcatagaagttaagacgtgcatttggcccaaatcacacacattatggagcaacggagtcttggagtctgagatgattattcccaagatatatgggggacctatttcacagcacaattacagacccggctacttcacacaaactgcggggccatggcaccttggaaagttggaattagacttcgatctttgcgagggaacaactgtcgttgttgacgaacactgtggaaatagaggtccctcactacgaacaactactgtaaccggtaaaatcattcacgaatggtgttgcaggagttgtacactaccaccactccgatttaaaggagaggacggatgttggtacgggatggaaattaggcctgttaaggaaaaggaagaaaacctcgtgaaatctatggtttcagcagggagcggcgaggttgattcatttagcctaggactgctgtgtattagtataatgatagaagaagtgatgagatcccgttggtcacggaaaatgctcatgacaggcaccctcgcagtgtttttcttattaattatgggacaacttacttggaatgacttgatcagactttgcataatggtaggtgcaaatgctagcgaccgaatggggatggggaccacgtatttagctcttatggccacctttaaaatgcgtcccatgttcgcagttggactcttatttagacggttaactagccgtgaagtactattactcactataggattatctctagtagcatcagtagagcttccgaactcactggaagaactaggtgacggccttgcaatgggaatcatgatcctgaagctgttaacagactttcaatcacatcaattatgggccacactactatcttttacattcataaagacaacattttcattacattatgcatggaaaacaatggcaatggtcctaagcatagtgtcattattcccattatgtctaagtaccacaagtcaaaagactacatggttgccagttttgttaggcagtcttggatgcaagccactaactatgtttttaattgccgagaacaaggtatgggggaggaaaagttggccactaaatgaagggatcatggctgtaggtattgtaagcatactactttctagtctattgaaaaacgacgtgccactagcggggccactgatagctggtggaatgctaattgcatgctacgtaataagtgggagcagcgccgatctcagcctagaaaaggctgcagaagtatcgtgggaggaggaagctgaacactcaggagcttctcataatattctcgttgaggtgcaagacgatggcactatgaaaataaaggacgaagaaagagacgacacgcttacgatattgctaaaagcgaccctactagcggtatcgggtgtgtatcccctatcaataccggcgactctatttgtatggtacttctggcagaagaagaaacaaagaagcggtgttctatgggataccccgtccccgccggaagtcgaaagggcagtacttgacgatggtatctacagaattatgcagcgagggttattaggacgttcacaggttggggttggtgtatttcaagaaaatgttttccacactatgtggcatgttacaaggggtgcagtattgatgtatcagggaaaacgcttggaaccaagttgggcaagcgttaagaaagacttaataagctatggtggaggttggcgtctgcaagggtcatggaatacaggtgaggaggttcaagtaatagccgtggagccgggaaagaatcccaaaaatgtccagactgctcctggcacatttaaaacgagtgagggtgaagttggggctatagccctcgattttaaacctggcacatcgggtagcccaatcgtaaatcgagaggggaaaatagtaggcctttacggaaatggcgttgtgacgacatcaggaacatacgttagcgcaatcgcccaggcaaaagcaagccaagagggccctctaccagaaatagaagatgaagtattccgcaaaagaaacctaactatcatggatttacatccaggatctggtaaaacacgaagatatttgccagcaattgtccgtgaagcgataaagagaaaactcagaacactcattttagctccaaccagagtagtcgccagtgagatggccgaagctctaaagggaatgcccattcgatatcaaacgacggcggtaaaatcggaacacacaggaaaagaaatagttgatcttatgtgtcatgctacattcactatgcgattactctcacctgttcgtgtgcccaactacaatatgattattatggatgaagcccactttacagacccctcgtcaatcgcggcaaggggttacatctctaccagagtggggatgggagaagccgcagctatatttatgactgccacaccgccaggttcagtcgaggcattccctcaaagcaatgcggtgatacaagacgaagaaagagatattcctgaaagaagttggaactcaggatatgaatggattactgacttcccggggaaaacagtatggtttgttccatctattaaaagcggaaatgacatcgccaattgtttgcgtaagaatggaaaacgagtcattcaactaagtagaaaaacatttgatacagaataccaaaagactaaaaataatgattgggattacgttgtcacaacggatataagcgagatgggagccaattttcgagctgatcgggtaattgatccgagacgctgtcttaaaccagtaatcctaaaggatggccccgaaagagtaatactagccggcccaatgccagtgacagtagcgtcagccgcccaacgacgaggtcggataggcaggaatcacaacaaagagggtgatcaatacatttatatgggacaacccctcaataatgatgaagaccatgcacattggacagaagcaaagatgttattagataatatcaacacaccagaaggaatcattccagcattattcgagccagaacgcgaaaaatcagctgcaatagatggagagtaccgacttagaggagaagccaggaaaacattcgtagaactcatgaggagaggtgacttacccgtatggctctcacacaaggttgcttctgaaggttttcaatacagcgaccgaagatggtgtttcgacggcgaacggaacaatcaggtgttggaggaaaatatggatgtcgagatatggacaaaagaaggagaaaggaagaaattaagaccaaggtggctagacgcgcgaacctattcagatcccttagcactcagagaatttaaagaatttgcggcaggaagaagaagtgtttctggtgatcttattttagaaataggaaaattgccccaacatttaacccagcgggcacagaatgcattagataatcttgttatgttacataattcagaacaaggtggaagggcgtatagacacgcaatggaagaactacccgatacaatcgaaaccttgatgttacttgcactgattgcagtattaacaggaggagtcactctattctttttatcaggaagaggattggggaaaacatctattgggctattatgtgtaatggcatcttctgtgctattgtggatggcctcagtcgaaccgcactggatagcagcctctataatattagaatttttccttatggtactattaatacccgagccagatcgccaacgtacaccgcaagacaatcaactggcttatgttgttattggcttattgtttatgatactaacggttgccgcgaatgaaatgggcctgcttgaaactactaagaaggatctcggaattggccatgctgcggttgaaaaccaccatcatgctgctatgctggatgtagatctccatccggcttctgcgtggacattgtacgcagtcgcaaccacgattatcacacccatgatgcgacacacaattgagaacaccaccgctaacataagtttaacagcaatcgctaatcaagcggccatactaatgggtctagataaagggtggccaatctcaaaaatggatattggggttcccctgttagcacttggatgttatagtcaagtaaatccgttaacgctgactgcagcagtacttatgctggttgcacattatgctataattggaccgggattacaagcaaaagctacgcgtgaggcgcaaaagagaacagccgctggaatcatgaaaaaccctactgtagacggaattgtagccattgacctcgatcctgtagtatatgatgcgaaatttgagaaacaactaggacaaataatgttgctaatactatgtacctctcagatattactcatgagaacgacttgggcgctctgcgaatctattactttggcaacaggacctctaaccacattatgggaaggaagtccaggaaagttttggaatacgactatagcagtatctatggcaaacatatttcggggcagttacctagcaggcgcaggtttagccttttcacttatgaagtctttaggcggtggaaggagaggcactggtgcacagggggaaacgttaggtgagaagtggaaaaggcaactgaaccaactgtcgaaatctgaatttaacacttataagagaagcggtatcatggaagtagatcgctccgaagctaaagaagggctcaaaaggggcgaaactacaaagcatgcagtttccagaggtacagcgaaacttcgttggttcgtagaacgtaatctcgtaaaaccagaggggaaagtaatcgatttagggtgtggacgaggaggatggtcttattactgtgctggactcaagaaagtcacggaagtgaaaggatatacaaaagggggccctggccacgaggagcctatacctatggcaacatatggatggaatttggtaaaattacacagtggaaaagatgtattctttatcccaccagagaaatgtgacacactactatgtgatattggagagtcatcccctaatccaacaatagaagaaggtagaacgttacgtgtgttaaaaatggtagaaccatggttacgcgggaatcaattttgcattaaaatcctcaatccttatatgccctcagtcgtagaaacgctggaacaaatgcagcgaaaacatggtgggatgctagttcgcaatccgctatcgaggaacagtacccacgaaatgtactgggtatcctgtggaactggtaatatcgtttcagcagttaacatgacaagcaggatgttattgaaccgttttactatggcacatcgtaaacccacgtacgaacgggatgtagacttaggagctggcacaaggcatgtagcagtggagccagaagtagccaatcttgacataattggtcagagaatagagaatataaaacatgaacataaaagcacctggcattatgacgaggataatccctacaaaacgtgggcctatcacggctcttatgaagtaaaaccctcaggaagtgcctcatcaatggtaaatggagtggttaagttgttaacaaaaccttgggatgtaatacctatggtaacacaaatagcaatgactgacacaacaccattcggacaacaacgtgttttcaaagagaaagtagacacaagaacccctaaggcaaagagaggaactgctcaaatcatggaagttactgcaaaatggctgtggggttttctatctaggaataagaagccacgtatctgcactcgcgaggagttcactcgtaaagttagatcaaacgctgccattggagcggtatttgttgatgaaaaccagtggaatagcgccaaagaggccgtagaggacgaaagattttgggatttggtccatcgagaacgagagctccacaaacaaggaaaatgtgcaacctgcgtctataacatgatgggaaagagagaaaagaaattaggtgaatttggaaaagcaaaaggttctagagcgatctggtacatgtggcttggcgcaagattccttgaatttgaagcattgggatttatgaatgaagatcactggttttctcgggaaaattccctgagcggcgttgaaggcgagggcttacacaaattagggtacatattgagagatatatccaagatacctggaggtaacatgtacgcggatgatacagctggctgggataccagaattacagaagatgatttacagaatgaagccaaaattactgacataatggaaccggagcatgcactactcgcaaaatcaattttcaaattgacatatcagaataaagtcgtacgagtacaacgccccgcaaagaacggcacagtaatggacgtaatttcaaggagagatcaacgtggatccggacaagttggaacatacggcctaaatacgtttacaaatatggaagctcaattaatccgacaaatggaaagtgaaggtatattttctcccagcgaattagagacccctaatctcgctggtagagtactcgactggttggaaaaacacggagttgaaagattgaagagaatggccatttccggggatgattgcgtagtaaaacctattgacgataggttcgctacggcattgactgctcttaatgacatgggtaaagtaagaaaagatataccacaatgggaaccttcgaaagggtggaacgattggcagcaggttccgttctgtagtcaccattttcaccaattaataatgaaagacggcagagaaatagtagtaccttgtagaaaccaagatgagttggtagggagggcgagagtaagccagggtgcaggatggtcattacgagaaacggcatgtctcggtaaaagttacgcacaaatgtggcaattaatgtattttcatcgtagagacttgagacttgcggcaaatgcaatctgttcagccgttccagtggattgggttcctacaagtcgtacgacttggtcaatacacgcacaccatcaatggatgacaacagaagatatgctatctgtttggaatcgcgtatggatcgaagaaaacccttggatggaagataaaacccacatttcaagctggggagacgtaccgtatttaggaaagcgtgaagaccaatggtgtggctccctaatcggtttaacggcgagagccacatgggcaacaaacatacaagtcgccatcaatcaggtaagacgtttgataggtaacgagaactatcttgattacatgacaagtatgaagcgctttaagaatgaatcggatcctgaaggagctctgtggtaa

SEQ ID NO: 21837 - RNA, 9879 nt, synthetic construct
  misc_feature 1..9879: note = derived and/or modified CDS sequence (opt6) from DENV-1__GU131761__SS-prME
  source 1..9879: mol_type = other RNA
agtgttactatgttactcatgttaatgccgactgcccttgctttccatttgacaactagaggtggtgaaccccacatgatagtgtcaaaacaagaaaggggtaaatcactcctatttaaaacaagtgcgggagtaaatatgtgtaccctaatagcgatggatcttggagaactttgcgaagacacgatgacctataaatgccctagaattaccgaaacagagccagatgacgttgactgttggtgtaacgcaacagatacatgggttacatacggcacatgcagccaaactggagagcatcgcagagataaacgaagcgtcgccttagcaccccatgttggtttgggacttgagacaaggaccgaaacctggatgagctcagaaggagcatggaaacaaatacaaagagtagagacatgggccctcaggcatccaggtttcacagtaatcgcactctttctggcccacgctatcggcacatctattacgcaaaaaggcattatttttatcctcctaatgttagtaaccccatccatggccatgagatgtgttggaattggttcaagagacttcgttgaaggtctatcaggtgcaacatgggtggacgtggtgctggaacatgggtcgtgtgtaacaaccatggctaaagataaacctacattagacattgaattattaaaaaccgaagtaacaaacccagctgtgctaagaaaactatgtattgaggcaaaaatatctaacacaacaacggacagcagatgtccaacacaaggagaagcgaccttagtggaagaacaagatgccaatttcgtatgtcggagaacatttgtagaccgaggctgggggaatggttgtggtctgtttggcaaaggctcacttataacgtgcgcaaaatttaaatgcgtaactaaactggaaggtaaaattgttcagtatgaaaatttaaaatattccgtaatagttacggtacatactggagaccaacatcaggtaggcaatgaatcgacggaacatggtaccacagcgaccataacaccacaagctccgactacagaaatacaattaacagactatggagccctgactttagactgtagcccaagaactggtctggatttcaatgaaatggtattactaaccatgaaggagaagtcgtggttagtgcataaacaatggtttcttgaccttcccttgccctggacctcaggtgcgagtaccagccaagaaacttggaatagacaggatttacttgtaactttcaaaacagcacatgctaagaaacaagaagtcgttgtacttggatctcaagaaggggccatgcatactgcattgacgggggcaacagagattcaaacatcaggcactacaaccatattcgcgggtcaccttaagtgcaggctcaaaatggataaacttacactaaaaggaatgtcatatgttatgtgtactggaagttttaaactagaaaaggaattggctgaaactcaacatggaaccgtattagtgcaaataaaatatgagggtacagacgcaccctgcaaaataccatttagcacacaagacgaaaaaggcgtaacacaaaacggcagattaattacagcgaaccctatagtcaccgataaagaaaagcccgtaaacattgaagccgagccgcctttcggggaaagctatatagtaattggagccggcgaaaaagcgttaaaactatcctggttcaagaaagggagctcgatcgggaaaatgttcgaagctacagctaggggtgccagaaggatggctattttaggagacacagcatgggattttggtagtattggtggcgtatttacgagtgtcggaaagttggtccatcagatctttggaacggcgtacggggttttatttagtggcgtttcctggacaatgaagatcgggattggtgtgctattgacttggctaggacttaatagtcggtcaacgtcgttatcaatgacttgcatagcggttggcctagtgacgttataccttggcgtcatggtccaggcagattcaggttgcgtgattaactggaaaggtagagaactaaaatgtggtagtggaatttttgtgacaaatgaagttcatacctggaccgagcaatataaatttcaagcagattcgccaaagcgcttaagcgcagcaataggcaaagcatgggaagaaggggtttgtgggataaggtccgcgaccaggttagagaatatcatgtggaaacaaatcagtaacgaacttaatcatattttactagaaaatgatatgaaatttacagtagtagtaggggatgttgcaggtatactcgcgcaaggtaagaaaatgattcgtcctcagcctatggaatataaatactcctggaagtcatggggaaaagctaagataataggtgcagatgtacagaatacaacgtttataattgacggtccaaataccccagagtgtcccgacgatcaaagggcatggaacatatgggaagttgaagattatggtttcgggatatttaccactaatatatggttaaaactccgggactcgtacactcaagtatgcgatcaccgtctcatgtctgctgcaattaaggattccaaagcagtccatgcagatatgggttattggattgaaagcgagaaaaacgaaacatggaaacttgcaagagcgagctttatcgaggttaaaacgtgcatttggcctaaatcacatacgttatggagtaacggcgtactcgaaagcgaaatgattattccaaaaatatacggcgggcctataagtcaacataattacagaccaggatattttacacagacagccggtccatggcatttgggaaaattagaattagacttcgatttatgtgagggaacaacggtcgtagtagatgagcattgcgggaatagagggccctcactaagaacaacaacagtaacaggaaaaataatacatgaatggtgttgtcgaagttgcactttgccacctctaaggttcagaggcgaggatgggtgctggtatggcatggaaataagaccggtaaaagaaaaagaagaaaacctagtcaagtcgatggtcagcgctggatctggagaagttgactcattcagcctaggattattatgcataagcataatgattgaagaagttatgagatcaagatggtccagaaagatgttaatgaccggtacactagctgtcttcttcttactgataatgggacaacttacatggaatgacttgatacggctgtgtatcatggtaggagcgaatgcttcagatcgtatgggaatgggaacaacatacttagccttaatggcaacttttaaaatgcggccgatgtttgcagtggggctcctatttcgtcgattaacttcaagagaggttttgctattgacaatagggttgtcattggttgccagtgtggaactcccaaactctttggaagaactaggggacggtttagcgatggggattatgatcctaaaactactaactgattttcaaagccatcaattgtgggctacgttgctcagtctgacatttattaaaactacattcagtctccactatgcatggaaaacaatggcaatgattttatccatagtgtcattatttccactatgcttgtcaaccacatcacagaaaacaacatggctgcccgtactacttggatccctagggtgcaaaccgttaacaatgttcctcatagccgaaaacaagatttggggtagacgatcatggcctctaaacgaagggattatggcagttggaatagtatctatcctcctatctagtctacttaagaacgatgtaccactcgcaggacctcttatcgccggcggaatgttgatagcctgttatgtaatatctggatcgtcagcggaccttagccttgaaaaagcagcagaggtctcatgggaagaggaagcagagcactcaggtgcatcgcataacatcctagtagaggtgcaagatgacgggacaatgaaaatccaagacgaggaaagagatgacacgttaactattctgctgaaagcgacactgcttgcggtttcaggcgtttaccctctgagcataccggctacattattcgtttggtatttttggcagaaaaagaagcaacggtcaggagttttatgggacacacccagtccacccgaagttgagcgcgctgtccttgatgatggtatatacaggataatgcaaagaggcctattagggaggtcacaggtaggagttggtgtattccaagaaaatgtttttcatacgatgtggcacgtaactagaggcgcagtactgatgtatcagggaaaacgactagagccttcctgggcatctgtaaagaaagatttgatatcatatggaggaggctggagattgcaaggatcatggaacacaggtgaagaggtacaggtgatagcggtagagcccggtaaaaatcctaaaaacgtacaaacagcaccgggaacattcaaaactcctgagggagaagtaggagctatagccctagattttaaacccggaacgtcaggatctcctattgtaaatcgtgaaggaaaaatagtaggattatatggcaacggggttgtaacgacttccggaacttacgtaagtgcaattgcccaggcaaaggcttcacaagagggtcctcttccagaaatcgaagatgaggtctttagaaaaagaaatttaacaatcatggatctccacccaggatcgggtaaaacccgaaggtatctacctgcaattgttcgggaagcaataaagcgaaaacttagaacgttgatattagcaccaacaagagtagttgcatctgagatggctgaggcccttaaagggatgccaatcaggtatcagaccaccgccgtcaaatcagaacacactggtaaagaaattgtggacttgatgtgccacgccacatttactatgagattattaagtccagtccgtgttccaaactacaacatgataatcatggatgaagctcatttcacagatcccagttcaatagcggcaagaggctatatcagtaccagagtcggtatgggtgaagccgcagcaatttttatgactgcaacaccacctggcagtgtagaggcgttcccacaaagtaacgccgtgatacaagacgaggaaagggacatccctgagagatcgtggaactccggttacgaatggataacggattttccgggaaaaactgtatggtttgtgccaagcatcaaatcaggtaatgacatagccaattgcctacgtaagaatggaaaacgtgtaatacaattaagccgtaagacattcgatacggaataccagaaaactaagaataatgattgggattacgtagtcacaacggatatatcagagatgggagctaattttagggcagaccgagtcatagatcctcgacggtgcttaaaacctgtaatattgaaagacggaccagaacgggtaatacttgctgggccaatgcctgtaaccgttgcaagcgccgcgcaacgacgaggtcgaataggaaggaaccacaataaagagggtgaccaatacatatatatggggcagccgctaaacaacgacgaagatcatgcccactggacagaagcaaaaatgttactagacaatataaacacaccagaaggaataattccggcattgttcgaaccagagagagagaagagtgccgccatagatggcgaatacagattacgtggagaagctaggaaaacatttgtggagctaatgcgccgaggagatctaccagtatggttatcatacaaggttgctagtgaaggatttcaatactctgacaggcgatggtgcttcgacggagaacgaaataatcaagtcttagaagaaaacatggatgtagaaatttggacaaaagaaggagaacgtaaaaagctgagaccacgatggcttgatgcacggacatattccgacccattagccctacgagaatttaaagaatttgctgcgggtcgaagatctgtttcgggagacctaatactggaaattggaaaattaccccaacacctaactcaacgagcccagaacgccctggataatctcgtaatgttacacaattccgaacaaggaggtcgagcctacagacacgccatggaggaattgcctgacacaattgaaacactcatgctattagccctcatcgctgtattgacaggaggagtaactctcttcttccttagtggtagaggtttagggaaaacttccataggtttactatgtgtaatggcatccagcgtcctgttatggatggctagtgttgagccacactggatagccgcgtcaatcattttagagttctttctgatggtcttattaattcctgaaccggatcgtcaaagaacaccacaggacaatcaactagcgtatgttgtaattggactgttgtttatgattttaactgtagcagccaacgagatggggttattagaaactactaagaaagatctaggtattggtcacgtagccgtagaaaaccaccatcacgcggcaatgttagacgtggacctacatccggcatctgcctggacattgtatgccgttgctactaccataataactccaatgatgaggcacactatagaaaacaccacggcaaacatctctttaacagctatagcaaatcaagcggcgattttaatgggcctagataagggttggccaatttcaaaaatggatatcggagtaccgttattagctcttgggtgttactcacaagtaaatccgctaactctcacagctgctgtactcatgctcgtagcacattacgcgattattggaccaggcttacaagctaaagctacacgagaagcccagaaaagaacggcagcgggtatcatgaagaaccccacagtggacggaatagtagcgattgatttggatccagtggtctatgacgcaaagtttgaaaaacaattgggtcagataatgctattaattttatgcacgagccagattcttctgatgagaacaacatgggctttatgtgaaagtattacgttagcaactgggccgcttactactctgtgggagggatctcctggaaaattctggaacacgacgatagcagtgagtatggcgaatatatttaggggttcttaccttgccggagcaggtctagcatttagcctaatgaaatctctaggaggaggacggcgggggaccggtgctcaaggggagaccctcggggaaaaatggaaacgacagttaaatcaacttagcaagagtgaatttaatacctacaaacggtctggtataatggaagtagacagatcagaggcaaaagaaggattaaaaagaggcgaaaccacgaagcatgcggtctcgagaggtactgcaaaactgcgctggttcgtcgaaagaaacttagtaaaaccagaaggtaaagtaattgatctggggtgtggcagaggtgggtggagttactattgcgccggcttgaagaaagtcacagaagttaaagggtataccaagggagggccgggtcatgaggaacccataccaatggcaacctatggatggaacttggtgaaattgcactctggaaaagatgtattcttcattccaccagaaaaatgtgataccctgctttgcgatataggtgaaagttccccaaacccaactatagaggagggaagaactctacgtgttttgaaaatggttgaaccatggctccgtggtaaccagttttgtataaaaatattgaacccgtatatgccatctgttgttgaaacgctagagcaaatgcaaagaaagcacggtggcatgctcgttcggaaccccctatctagaaattcaacacacgagatgtattgggtaagttgcggaaccggcaatatagtatctgcagtcaatatgacgtctcgtatgttattgaatagattcacgatggctcaccgaaaaccaacatacgaaagggatgttgatttgggagcgggtacccgacatgtcgctgtggagcccgaagttgcaaatctggacatcattggacaaagaatagagaatataaaacacgagcataaatcaacttggcactatgatgaagataatccttacaaaacttgggcataccatggcagttacgaggtaaaaccttcggggagcgcaagttctatggttaatggagtagtaaaattattaaccaaaccctgggacgtcattccgatggttacacaaatagcaatgacagataccacgccatttggacaacaaagagtattcaaagaaaaagtagatactagaacccctaaggccaaaagagggacggcacaaataatggaagtaacggcaaaatggctttggggctttctgagtagaaataagaaacctcgaatttgcactcgagaagagttcacaaggaaagtgcgctcaaatgcagccattggcgccgtctttgtcgatgaaaatcaatggaacagtgcgaaagaagctgtggaagatgaaagattctgggatctagtgcatagagaaagagaattacataaacaagggaaatgtgctacatgtgtgtataacatgatgggaaaaagagagaagaaactcggtgaatttggaaaagcaaagggctctcgagccatatggtatatgtggttaggagcaagatttttggagtttgaagctcttggatttatgaatgaagatcactggttttcgagagaaaattcactttctggagtagagggcgaaggtctccataaattggggtatatattacgtgatatttcgaaaataccaggaggtaatatgtatgccgacgacacagccggctgggatacaagaataacggaggatgatctacagaacgaagcccgaataactgacataatggaacccgagcacgctcttttagctaaatcaatattcaaactaacctatcaaaataaagtagtacgagtacaaagaccagctaagaatggaacagtcatggacgtcatcagcaggagagaccagagaggtagtggacaagtgggcacgtacggattgaatactttcactaacatggaagcccaattaattcgccaaatggaatccgaggggatcttcagcccctcagaattggaaacaccgaacttggcagagagagtacttgattggttagagaaatacggtgtcgaacgtttaaaaagaatggccatctctggtgacgattgtgtagtaaaaccaatagacgataggtttgctacggcattaaccgcactaaatgacatggggaaagtaagaaaagacattcctcaatgggaaccatccaaaggatggaatgactggcaacaggtccctttttgtagtcaccattttcaccaattaattatgaaagatggaagagaaattgttgttccttgtcgcaaccaagatgaattagtaggtagagcaagggtaagtcaaggagcaggctggagtttaagggaaacagcatgcctaggaaaaagctatgcgcagatgtggcagttgatgtactttcacagaagagatctccgtctggcggccaacgcaatatgctctgcagtgccagtagattggataccaacgtcaagaacaacctggtcaatacacgctcatcaccagtggatgacaacagaggatatgctatctgtctggaatagagtttggatagaagaaaatccttggatggaagataaaacccatattagtagttggggagatgtaccttacctaggtaaacgagaagatcagtggtgcggctccttaataggtttaactgcaagagcgacatgggctaccaatatacaggtagccataaatcaggtgaggcgactcataggcaacgaaaattaccttgattatatgacaagtatgaaaagattcaagaacgagtccgatccagaaggcgcactatggtga

SEQ ID NO: 21838 - RNA, 9879 nt, synthetic construct
  misc_feature 1..9879: note = derived and/or modified CDS sequence (opt6) from DENV-1__GU131762__SS-prME
  source 1..9879: mol_type = other RNA
tccgtaacaatgctattaatgctaatgcccacagcgttagcttttcacctaactacgcgaggtggcgaaccccacatgatagtttcaaaacaagaaagaggtaaatctctcctcttcaaaacttcagcaggcgtgaacatgtgcacattgatagccatggacctgggagaattttgtgaagatacaatgacttataaatgtccgcgtataacagaagctgaaccggatgacgtagattgctggtgtaatgcaacagatacctgggtaacgtatggcacatgtagtcaaaccggagaacacagaagagataaaagaagcgtggcgctagctccccacgtaggattggggttagagacaagaacagaaacgtggatgtcaagtgagggagcatggaaacaaatacaacgagtagaaacatgggctttacgccaccctggcttcacagtaatagcattgtttttagcccatgccataggtacaagtataacacagaaaggcatcatatttatactattaatgctggtaactccctctatggcaatgcgatgcgttggaatagggtcaagggacttcgtcgaaggattaagcggggcaacttgggtggacgtcgttttagaacatggcagctgcgtgactacaatggctaaagataaaccaacgttagacatcgaactgcttaaaaccgaagtaacaaatccagcagtgctaaggaaactatgtatcgaagccaaaatatctaacactacaacagactcgagatgccctacccaaggggaagcaacattagtagaagaacaggacgcgaatttcgtttgcagacgcaccttcgtagatagaggttggggcaatggatgtggtctatttggcaaagggtcactcatcacatgcgccaaatttaaatgcgttacaaaattagaaggtaaaatagttcaatacgaaaatcttaaatactcagtgatagttactgtacacacgggcgaccaacaccaagtaggcaacgaaagtacagaacacggaacaaccgccacaataacacctcaagccccatcaacagaaattcaactaactgactatggcgcgctaactttagactgcagcccacgcaccggattagattttaacgaaatggtattattaactatgaaagagaaaagttggttagtacacaaacaatggtttttagatttacccttaccatggacctctggagcgtccacaagccaggaaacatggaatagacaggaccttctagtgacttttaaaactgctcacgctaagaaacaagaagtagttgtattaggttctcaggaaggcgcaatgcataccgcgctcacgggggccactgaaattcaaacaagtggtactactactatttttgcaggtcatttgaaatgccgattgaagatggataaattaacacttaagggtatgtcctacgtaatgtgtacgggctcttttaaattggaaaaagaggtcgcggaaactcaacatggtacagtcttagttcaaattaaatatgagggaacggacgccccatgtaaaataccattttcgacacaggatgaaaaaggggttacacagaatggtcgactcataacggcgaacccaattgtcacagacaaggaaaaacccgttaatattgaagcagaaccaccgtttggagaaagttatatagttattggagccggtgaaaaggccctgaaactgtcctggtttaagaagggatctagtataggaaaaatgtttgaagcgacagcaagaggggcccgtaggatggcaattctaggagatactgcgtgggatttcggtagtattggtggcgtatttacgagcgttggaaaacttgttcaccaaatctttggcactgcctatggggtgttattctcaggtgtaagttggacaatgaagatcgggataggagtgctcctaacatggctaggattaaacagccggtcaatgagtctatcgatgacttgcattgctgtaggcttagtaacactatacttaggagtaatggtacaagctgattccggttgcgtaataaattggaaaggacgggagcttaaatgcggaagtggaatatttgttaccaatgaagtccacacgtggacagaacaatataagtttcaagcagactcaccaaaacgactgtcggctgctataggaaaagcgtgggaagagggtgtttgcggaataaggagcgctacaaggttagaaaatatcatgtggaagcaaatttcgaacgagctaaaccatatcctattggaaaatgatatgaaattcactgtcgtagttggtgatgtagccggaatcttagcacaagggaagaaaatgatacgaccacagcctatggaatacaagtattcatggaaatcatgggggaaagcaaagataattggtgccgacgtccaaaatacaacatttataattgacgggccaaacacgccagaatgtccagacgaccaaagagcttggaatatatgggaagtcgaagattacggatttggtatatttactactaacatatggttaaaactcagagactcctacactcaagtatgtgaccatagattaatgtctgctgcgatcaaggacagtaaagctgtgcatgcagacatgggatattggatagaaagcgagaaaaatgaaacatggaaactcgcgcgtgcttcctttattgaagtcaaaacatgcatttggcccaaatcccatactttatggtcgaatggtgtattagaaagcgaaatgatcatacccaagatatatggaggtcccattagtcaacataactatagaccgggctatttcacacaaacggcgggaccttggcatttaggtaaacttgaattagactttgacctttgtgagggaactaccgtggtggttgatgagcactgtggaaatagaggtcctagtctgaggacaaccacggttactggaaaaataatacatgaatggtgctgtagatcatgtacactaccacctttgcgctttaaaggtgaagacggttgttggtatggaatggaaatcaggcctgtaaaggaaaaagaagagaacttagtaaaaagtatggtatcagcagggtctggagaagtggattcttttagtttgggtctattatgtataagcataatgatagaggaggtgatgagatcccgctggtcccgaaaaatgttaatgactggtactctagccgtgttcttcttgctgatcatggggcaattaacatggaatgatttaataagattatgtataatggtgggcgcgaacgcatctgaccgaatgggtatggggacaacatacttagcgttaatggctactttcaagatgcgacctatgttcgctgtcggtttacttttccggaggttaacctctagggaagtactgttattaactattggattatcgcttgttgcatcagttgaattacccaattcgttagaagaattgggcgatgggcttgcaatgggcattatgatattgaaattgttaacagattttcaaagtcatcaattgtgggccacacttttgtccttaacgttcattaaaacaacttttagcctccactacgcttggaaaactatggccatggtcttgagcatcgtaagcctatttcccctgtgcttaagcacgacatcacagaaaacaacatggttaccagttctgttggggtcattggggtgtaaaccactaacaatgtttttaatagctgaaaacaaaatttggggacgaaaatcttggccacttaacgagggaattatggcggtaggaatagtatctatactattatcatcgctactaaagaatgatgtacctctggcaggccctcttatagcagggggtatgctaatagcgtgttatgtcatatcggggagctcggcagatttaagcctagagaaagctgcagaagtctcttgggaagaagaagctgagcattctggggcaagtcataatatcctagttgaagtacaagatgacggtacaatgaaaataaaggatgaagaaagggatgacaccttaaccatccttcttaaagcaacacttttagcggtttcaggtgtttatccactttccattcccgctacactattcttatggtacttttggcagaaaaagaaacagcgatcaggcgttctttgggatacacccagcccacccgaagttgaacgagccgtcttagatgatggaatatatagaattatgcaacgaggcttgctaggaagaagtcaagtaggggttggggtatttcaagagaacgtatttcatacaatgtggcatgtgacaagaggtgctgtattgatgtatcaaggaaaacggcttgagccaagctgggcctcagtcaagaaagatctaataagttacggtggtggttggcgacttcaaggttcctggaatactggagaagaagtacaagttattgccgtcgaaccaggcaaaaatcccaaaaatgtacaaacagcgcctggcacttttaaaacttctgaaggtgaagtaggggcgattgcgcttgatttcaaacccggaaccagcggaagcccaatagtcaatcgcgagggtaagatcgtgggattatatggtaacggagtcgtcacaacatctggaacgtacgtaagcgcaatagcccaagcaaaggcatctcaagaaggacccttaccggagatagaggatgaagtatttagaaaaaggaacctaacgataatggatctccatcctggtagcggcaaaactcgtcgatacttgccggctatagttagagaagcaatcaagaggaaacttagaacgttaatattagcacctaccagggtggtagcatctgagatggcagaagcattgaaaggcatgcccattagatatcagactaccgccgtaaagagcgaacacactggtaaagaaatagtcgacttaatgtgtcacgcgacatttacaatgagactattgtcaccagtacgagttccgaactacaacatgatcataatggatgaggcgcactttacagatccttcttcgattgcagcgcgtggatacattagtacacgcgtaggaatgggagaggcagctgccattttcatgacagcaacaccacctggatctgtggaggcttttccccaatctaatgctgtcatccaagatgaagaacgagatattcctgaaagatcatggaatagcggctatgaatggattacagacttcccagggaaaactgtatggttcgtaccaagcataaaaagcggaaatgatattgctaattgtttgaggaaaaatggaaaacgagtaatacaattgagcaggaaaacattcgatacagaatatcagaaaaccaaaaataatgactgggactatgttgtaacaactgatatatctgaaatgggagcgaatttccgagcagatagggtcatagacccaagaagatgtctgaaaccggtaatactgaaagatggtccggagcgggtgatacttgccggtcctatgccagtaactgtagcatcagcggcacagagaagaggtagaataggaaggaatcataataaggagggcgatcagtatatatacatgggacaaccattaaacaacgacgaagaccatgcacattggacagaggcgaaaatgctcctagataatataaatacacctgaagggataataccagcactcttcgaaccagagagggagaaaagtgcagctatagatggagaataccgactgcgtggagaggctcgtaaaacgttcgtcgaacttatgagaagaggagacttgccggtatggctaagttacaaagtagcaagcgaaggatttcagtattccgatcgaagatggtgttttgacggtgaaagaaataatcaagtacttgaagaaaacatggatgttgaaatttggactaaagaaggggagcggaagaaattgcgtccccgctggcttgacgcaagggtatattctgatcctctcgccttaagggaatttaaagaatttgcggcggggcgacgaagtgtcagcggggatttgatactcgaaattggcaagttaccgcaacacttaacacaacgcgctcaaaatgccttagacaatcttgttatgttacataactctgagcaaggaggtagagcataccgacacgcaatggaagaacttcccgataccattgaaacgctaatgctactagccttaatagccgtattgactggcggggtcactttattctttttatcaggaagaggactaggtaagacttctattggtctcctttgtgtaatggcatcatcggtattactatggatggccagtgtagagcctcattggatagccgcatctatcatcttagagttctttttgatggtgcttctgattcccgaacccgacagacagaggacgccgcaagataaccaactcgcatatgtagtcataggattactatttatgatattgacagtagccgcgaatgaaatgggtttactagaaaccaccaagaaagatttgggtatagggcatgtcgccgtggaaaatcatcatcatgctgcaatgctcgatgtagacttacatcccgcgtctgcgtggaccctttacgcagttgccactactataatcacacctatgatgcgacacactatagagaacaccactgcaaacatatccctaacagcaatagctaaccaagcggcaatcctgatgggattggataaaggttggcccattagcaaaatggacatcggggtaccgttactagcattagggtgttattcacaagtaaatcctttaacattgacggcggctgtgcttatgttagttgcacattatgcaatcatcggaccaggactacaagcaaaagcaacaagagaagctcaaaagagaacagctgcaggtatcatgaagaaccccaccgtcgatggaattgtagcaatagacctagatccagtagtgtacgacgccaagttcgaaaaacaactaggacaaataatgttactaatattatgcacgagtcagatcctcttgatgagaacaacttgggccctttgtgaatctataactttagctacgggaccactaaccacgctctgggagggatcccctggaaagttctggaatacaacaattgcggttagtatggctaacatattccgaggtagctatttagctggggcagggctcgcgtttagcttaatgaaatcactgggtggaggaaggagaggaactggagcccaaggtgaaacactcggcgaaaaatggaaacgtcaactaaaccaattgagtaagagcgagtttaatacctataagcgatcagggataatggaagtggataggtcggaagcaaaggaaggactgaaacgaggcgaaacgacaaaacacgcagtcagtcggggtaccgccaaactaaggtggttcgttgaaagaaacctagttaaacccgaaggaaaggtcatagatttaggatgcggacgaggcggatggtcgtattactgtgcaggattaaagaaggtcacagaagtgaaaggatatactaaaggaggtccaggtcatgaggaacctatccctatggccacttatggatggaatctcgtcaaacttcacagtggtaaagacgtatttttcataccccctgaaaaatgcgatacgctcctttgtgacataggtgaatcgagcccaaaccctacaatagaggagggaagaactctaagagttttaaagatggtcgaaccttggttaagagggaaccaattttgtataaaaatactcaacccgtacatgccgtcagtagtagagacacttgaacagatgcaaaggaagcatggaggaatgctggtaagaaatccattatctagaaatagcacacatgaaatgtattgggtaagctgcggaacgggaaatatcgtctcagctgttaatatgaccagtcgtatgttgcttaaccgtttcacaatggcacacagaaaaccaacgtatgaaagggatgttgacttaggagcaggaactcgacacgtagctgtagaacccgaagtagctaacttagatataataggacagagaattgaaaatataaaacatgaacacaagagtacatggcattatgacgaagataacccatataaaacctgggcctatcatggcagttatgaagtgaagccgagcgggtcggcaagtagtatggtaaatggcgtggtaaaattattaactaaaccatgggatgttataccaatggtaactcagatcgctatgacagatactactccctttggacaacaacgtgtatttaaggaaaaagtggatactaggacccccaaggcaaaacgcggcactgcgcaaatcatggaggtaactgctaaatggttgtggggatttctaagtaggaataagaaacccaggatttgtacaagagaggaatttactagaaaagttaggagtaacgcagccataggagcagtttttgtagacgaaaatcagtggaatagtgcgaaagaagcggtagaagatgaacgtttctgggatctagttcatagggaacgagagttacacaaacaaggtaaatgtgctacttgtgtttacaatatgatgggtaaacgagagaagaaactaggcgagttcggaaaggccaaaggctctcgagcaatatggtatatgtggctaggcgccagatttttagaatttgaagcactgggttttatgaacgaagaccactggttctcccgggaaaatagcttatcgggagttgaaggagaaggcctccataaacttggctacatcctacgagatattagtaagatcccaggaggaaacatgtacgccgacgataccgctggatgggatacacgtataacagaagatgacctgcagaatgaggccaaaatcactgacataatggaacccgaacatgcattattggcaaagtcaatattcaagctgacatatcaaaataaagtagtgagagtacaacgacctgcaaagaacgggacagtaatggacgtcatatcgcgtagagaccaaagggggtctggtcaagttgggacctatgggttaaatacatttacgaatatggaagctcagttaattagacaaatggaaagcgaaggaatattttcgccgtcagaattggagacacccaacttagcgggtagagtactagattggttagagaaacatggggtcgaaagactcaagcgcatggccattagtggagacgactgcgtagttaagcccatagacgatagattcgccacagcgctaaccgcattaaatgacatgggaaaagtaagaaaagatatcccccaatgggaaccctctaaggggtggaatgattggcaacaggtccccttttgctcacaccatttccatcaactaataatgaaggatggcagagagatagtagtaccgtgccgcaaccaagatgaattagtgggacgtgcaagagtatctcaaggagctggatggtcgttgcgtgaaacagcttgtctgggtaaaagctacgcacaaatgtggcagttaatgtatttccatagacgagacctgaggcttgccgctaacgctatatgctctgctgttccagtggattgggtaccaaccagtagaactacatggagtatccatgcacatcatcaatggatgaccacagaggacatgctgagcgtgtggaatagggtgtggatagaagagaacccgtggatggaagataaaacccatatatcaagttggggagatgtaccttacctagggaagagggaagaccaatggtgtggttcactaatcggtctaacagccagagcaacttgggcaacaaatatacaagtagctatcaatcaagtaagaaggttaataggcaatgagaattatttagattatatgacatcgatgaaaagatttaaaaacgaaagcgatcctgaaggtgctttatggtaa

SEQ ID NO: 21839 - RNA, 9879 nt, synthetic construct
  misc_feature 1..9879: note = derived and/or modified CDS sequence (opt6) from DENV-1__GU131763__SS-prME
  source 1..9879: mol_type = other RNA
tcagtaaccatgctattaatgttgatgccgactgccttagcgttccatctaacgaccagaggtggtgaacctcacatgatagtcacaaaacaagaacgtggtaaatcactgttatttaaaacctccgctggtgtgaatatgtgtacgttaattgcaatggatttgggagaactatgcgaagataccatgacatacaaatgtccaagaataactgaggcggaaccagacgatgttgattgttggtgtaacgcaacggatacgtgggtaacatatggaacatgttcgcaaactggagaacatcgaagagataagagatccgtagccctggccccacacgtcgggttgggacttgaaacgcgcacagaaacatggatgtcttcagagggtgcatggaaacaaatacaaagagtggaaacctgggctttaagacaccctggatttacggtgatcgcactatttttggcacacgcaatagggacatcaatcacgcaaaaaggaatcatctttatcttactgatgttggttacgcccagtatggctatgcgttgtgttggcattggaagtagagatttcgtagaaggactaagtggagcgacatgggttgatgtagtactggagcatggatcgtgtgttactacaatggccaaggacaaaccaactttagatatcgaactgctaaaaacggaagtcaccaatccagccgtactaagaaaactttgtatagaagcaaaaattagtaacacaacaacggattctagatgtcccacgcaaggcgaagcaacgttgatggaagaacaagacgccaattttgtatgtcgtagaacttttgtagatcgtggatggggaaacgggtgtggcctatttggcaaaggttcattgattacatgtgccaagtttaaatgtgtcacaaaactagaaggaaaaattgtacaatacgaaaacttgaaatatagtgtcatagtgacagtgcatacaggtgatcaacatcaagtgggcaatgagagcacagaacatgggacaacggctacaataacgccccaagcgccaacctcagaaattcaattaaccgattatggtgcattgacattagattgctcgcctagaacagggttagatttcaacgaaatggttttgttgactatgaaagaaaaatcatggctcgtccacaaacaatggtttttggaccttcctctaccatggacctccggagctagcacaagtcaagagacatggaatcgccaagatttgcttgtaacttttaagacagcgcacgccaaaaagcaagaggtcgttgttctagggtcccaagaaggcgctatgcacaccgctttaacgggagctactgaaattcagactagcggaactactaccatattcgccgggcatctcaagtgtcgactaaagatggataaacttacactaaaaggaatgtcatacgtaatgtgtactggatcatttaaattagaaaaagaggtggctgagacgcagcatggaactgttctcgttcagataaaatacgagggtacagatgcaccctgcaaaatacccttttcaacacaagacgaaaaaggagtcactcaaaatggccggctcattacagccaatccaattgtaacagataaagaaaaacccgtcaatatagaagccgagcctccattcggggaaagttacatagtcataggcgcaggagaaaaagcgttaaaactttcatggtttaagaaaggcagcagtataggcaaaatgttcgaagctacagcacgaggtgcaaggcggatggcgatacttggagatacggcttgggattttggcagcataggaggagtattcacttctgtcggaaaacttgtacatcaaatctttggcacggcctacggtgtactgttttcaggagtttcatggacgatgaaaataggaatcggagttctattgacctggttaggtcttaattctaggagtacctcactaagtatgacatgtattgctgtgggcctggtaacattatatttaggagtcatggttcaagccgattctggttgtgtcataaactggaaaggtagagaactcaaatgcgggtcaggcatattcgttacaaatgaagtccacacttggacggaacaatacaagttccaagcggacagcccaaagaggcttagcgcagcgataggcaaggcttgggaagaaggggtgtgtggcatcagatcagctacaagactagaaaatataatgtggaaacaaatcagtaacgaattgaatcatatcttgctggaaaatgatatgaaattcaccgtagtcgtaggtgatgttgtcggcatattggcgcaggggaagaaaatgattcgccctcaaccaatggaacataaatattcatggaagtcatggggaaaagcgaaaattattggagcagacgttcagaacaccacatttataatagacggtccgaacactccggagtgcccagacgaccaacgagcttggaatatatgggaagtggaagactatggtttcgggatttttaccacaaatatttggttaaagctacgggatagctacactcaagtttgcgatcatcgactaatgagtgccgcgattaaagattcaaaagctgtacacgccgatatgggttactggatcgaatctgagaaaaatgaaacttggaaactcgccagagcctccttcatagaagtcaaaacttgcatctggcccaagagccatactttatggagtaatggtgttcttgaatcagaaatgataataccaaagatttatggaggacccatatcccaacacaattataggccaggctactttacacagacagccggcccctggcatttaggaaaactggaattagatttcgatctttgcgaaggcactacagtagttgttgacgagcactgtggaaataggggaccctctttaagaacaacgactgtgaccggtaagattattcacgaatggtgttgccgctcttgcacattacctcccttaaggttcaagggagaagacggttgttggtacggaatggagatccgtcctgtaaaagaaaaagaggagaatttagttaaaagtatggtaagcgcaggactcggtgaagtggattcttttagtcttggattgttatgcattagtattatgatagaagaagttatgcgcagtcgctggtcacgcaaaatgcttatggcaggtacactcgccgtatttttacttttaataatgggccaattaacttggaatgatttaataagattatgtataatggttggggcaaatgccagtgacagaatgggaatgggtactacatacctcgcgttaatggcaacttttaaaatgagacctatgtttgcagtaggactactattcagacgactaacttcgagagaagtcttacttctgacaatcggattatctctagtggcttcagtcgaactacccaactctcttgaggagttaggggatggcttagctatggggataatgatcctaaaacttctcacggattttcagagtcatcaactatgggctacactgctttctttaacatttattaaaactacattgagtctccactacgcgtggaagaccatggcaatggtgttaagtatcgtaagtttattccctctatgcctctctacaacaagtcagaaaaccacatggttacccgtactacttgggtcgttggggtgtaaacccttgacaatgtttctaatcgcagagaataaaatttggggtcgtaaatcgtggccgctaaacgagggcatcatggcagtaggtgtagtaagtatactcctttcttcactactaaagaacgatgtaccattagcaggtccacttatagcagggggaatgttgattgcatgctatgtaataagtggaagcagtgctgatttaagtcttgaaaaagcagcggaggtttcatgggaagaagaggctgaacactccggagcaagccacaatatattggtagaagtacaggatgacggcacaatgaaaatcaaagacgaagaaagagatgataccttaacaattttacttaaggcaacacttctagcaataagcggcgtgtatcctttatcaattccggcgactttatttgtttggtatttttggcagaagaaaaagcaacgatcaggagtactctgggacacgccgtcaccaccagaagtggaacgagctgttttagatgatggaatttatcggattatgcaacgtggtttgttgggtagatcacaagtaggagtgggtgtctttcaagaaaatgtattccatacaatgtggcacgtaactcggggagcagtccttatgtatcaaggaaaaaggcttgagcctagctgggcatctgtgaagaaagatttaattagctatgggggtggatggcggctgcaaggatcttggaacacaggggaggaagtgcaggtaatagcagttgagccaggcaaaaaccccaaaaatgtccaaactgcacctggcacttttaagacgcccgagggagaagttggtgcgattgcattagactttaaaccaggcacatcaggaagcccaattgtaaacagagagggcaaaattgttggtttatatggaaatggagtcgtaacaacttcaggaacatatgtaagtgcaatagcacaagcaaaagcgtcacaggaaggcccgctacccgaaattgaagatgaagtttttaggaagaggaatttgaccatcatggatttacaccctggatccggaaagacacgacgttacctacccgcaattgtaagagaagcaataaaacgcaagctgcgaacgttaatactagcgccaacaagagtggttgcgtctgaaatggctgaagcgctaaaaggaatgcctatacgatatcaaacaaccgctgtgaagagtgaacatactggaaaagagatagtcgatctaatgtgccacgctacattcactatgagactcttatcacctgtaagagtacctaattataatatgataataatggatgaagcgcactttacggatccgtcgagcattgccgccaggggatatataagcacgcgtgttggcatgggtgaagctgccgctatattcatgacagctactcccccggggtcggtcgaggctttcccccaaagcaatgcagttatacaagatgaagaacgagatattcctgaacgttcgtggaactccggttacgaatggataaccgacttcccgggcaaaaccgtatggttcgtacccagtatcaaatccggtaacgatattgctaattgtcttcggaaaaacggaaaaagggtaatccaactatcacgaaaaacattcgatacggaatatcaaaagactaaaaataacgactgggactatgtagtgactaccgatatctccgaaatgggagccaactttcgagctgatcgtgttattgatccgaggagatgcttgaaacctgtaatattaaaagatggtcccgagcgcgtcattctagctggaccaatgcctgtaacagttgccagtgcagcacagcgccggggacgcataggacggaatcacaataaagaaggcgaccagtacatatatatgggacagccactaaataatgacgaagaccacgctcattggactgaggcaaagatgttattagacaatataaatactcccgaaggcataatacctgcattatttgaacccgaaagggaaaaatcggcagcaattgatggtgaatataggttaagaggcgaggcaagaaaaacatttgttgaactaatgagaagaggagaccttccagtctggctgtcatataaagtagctagtgaaggttttcagtacagcgatcgccggtggtgtttcgacggagagcgaaacaatcaagtcttagaagaaaatatggatgtagaaatatggacaaaagagggcgaaagaaagaaattaagacctcgctggttagatgcaagaacgtattcggaccctctcgccttgcgtgaatttaaagagttcgcagcaggtcgtagaagtgtttcaggggaccttatcttggagatcggaaaattaccacaacatctaacacaacgagcccaaaatgctttggataacttagtaatgctgcataatagtgaacaaggaggtagagcgtaccgacatgctatggaagagttaccggatacaatagaaacacttatgctattagctttaatagctgtactaaccggaggtgttacattgttctttttaagcggtcgaggactaggaaaaacgagtataggactgctgtgtgttatggcatcaagcgtgctactatggatggcatctgtcgaaccacattggatagcagctagcattatactggaatttttcttaatggttctgttaataccggaaccagacagacagcgaacaccacaggacaatcaactcgcatacgtagtgataggacttttatttatgatattgacagtcgcagcgaatgaaatgggactgctagagacaactaagaaagatttaggtataggtcatgttgcggtagaaaatcaccaccatgctacaatgctcgatgttgatcttcatccagcgtcagcttggaccttatacgcggtagcaactacaatcattacgcctatgatgcgtcatacaatagaaaacaccactgcgaacatcagcttaacggctattgctaatcaagcagcgatacttatgggtttagacaaaggctggcccatcagcaaaatggacattggagtaccattacttgcactaggatgctattcacaagtgaatcccttaactctgaccgcagctgtattaatgctagtagcacattatgcaattattggtcctgggttacaagccaaagcaactcgtgaggctcaaaaacgaaccgcggcggggatcatgaaaaatccgacggtggacggaattgtagctatagatttagatccagtagtatatgacgctaaatttgagaaacagttaggtcaaattatgttacttatactttgtacatcacaaatattgctaatgaggacgacatgggcactatgtgagagtataacactagccacaggaccgctgacaactctgtgggaaggatcacccggtaagttttggaatacaacaatcgcagtaagcatggctaatatatttcgtgggtcgtacctggcaggagcaggcttagccttttcactaatgaagtcccttggaggaggacgaaggggaaccggagcgcaaggtgaaacattgggagaaaaatggaaacgacaactaaatcaattgtccaagagtgagtttaacatatacaagcgcagtggaattatggaagtggataggagtgaggccaaggaaggacttaaacgcggtgagactacacgtcacgcagtatctcgaggaacagcaaaactacgatggtttgtagaaaggaatttagttaaaccagaaggtaaagtgatcgatctaggttgcggaaggggtgggtggtcttattattgcgcagggctcaagaaagtcactgaagtcaaaggatataccaaaggaggaccaggacacgaggaaccaataccaatggcgacttacgggtggaatttagttaaattacacagcggaaaggacgttttcttcacaccacccgaacgatgcgatacattactttgtgatataggagaaagctcacccaatccaaccatagaggagggacgaacattgagagtactaaaaatggtagaaccatggctacgaggaaatcagttttgcataaaaattttaaacccgtatatgccttccgttgtagaaaccttagaacaaatgcaaagaaaacatgggggaatgctagttagaaacccgttaagcaggaacagcacacacgaaatgtactgggtctcgtgtggaacaggaaacatagtaagtgccgtaaacatgacttctagaatgctactgaatagatttactatggctcacagaaaacctacgtacgaaagagacgtggatctgggagcgggtactcgccacgtcgcagttgaaccagaagtagcgaacttagacataatagggcagagaattgaaaatataaaacatgaacataaatctacatggcattacgatgaagacaacccctataaaacatgggcatatcatgggtcatacgaagttaagccttcaggaagtgcaagctcgatggtaaatggtgtcgttaagctactcaccaaaccatgggacgtgataccgatggtaacccaaattgcaatgacggacacaacgcctttcggccaacaacgagtgttcaaagaaaaggtagatacgagaactccgaaggcgaaaagaggcactgcacaaataatggaagtgacagcgaggtggctgtggggattcttgagcagaaataagaaaccaaggatatgtacaagagaagagttcactcgaaaggtgagaagcaatgccgcaataggcgcggttttcgtagatgaaaaccaatggaactcggctaaagaagcggttgaagacgagcgattctgggatttagtgcaaaaagagcgagaattacacaagcaagggaagtgcgcaacttgtgtgtataacatgatgggaaaaagagagaagaagttaggagaatttggtaaagctaaaggtagcagggcaatctggtatatgtggttaggagctagattcctagagttcgaagcactaggctttatgaacgaggatcactggttttcaagagaaaatagtttgagtggcgtcgaaggcgaaggattacacaagctaggatacattctaagagatatatcgaagattccgggtggcaatatgtatgcggacgataccgcaggatgggataccaggataacagaagacgacttgcaaaacgaagcaaaaatcacagatatcatggaacctgaacacgcacttttagcaacgtcaatatttaaattaacataccaaaacaaagtagtgcgtgtacaacgacctgccaaaaatgggacggtcatggatgtcatatcgcgacgtgatcaacgcggtagtggacaggttggcacatacggattaaatacattcacaaatatggaagcacagctaatacggcaaatggaatccgagggaatatttctaccgagtgagctggagactcctaacctggccgaaagagtgttagattggctagaaaaacatggggtggaaaggcttaagagaatggcaatatcaggagacgattgcgtagtaaaacccatcgacgacagattcgcgacagcactaacagccctaaatgatatgggtaaggtgagaaaggacatacctcaatgggagccatcgaagggctggaacgactggcagcaggttccattttgttcccaccacttccaccagctaatcatgaaagatggacgggaaatagtagtaccatgcagaaatcaagacgaacttgttggtagggcaagggtatcccaaggcgcaggttggagcctgcgcgaaacggcatgtcttggtaaatcttatgctcaaatgtggcaattgatgtattttcataggcgtgatctgagattggccgcaaacgcaatatgctcagcggtaccggtcgattgggtgccaacgtcacgtactacttggtccatacacgcacatcatcaatggatgactacggaagatatgctatctgtttggaataaggtgtggatagaagaaaacccgtggatggaagacaaaacccatgtctcttcctggggagacgtaccgtacctcggcaagcgtgaagatcaatggtgtggcagccttatcggattgaccgctagagcgacatgggcgtctaatatccaggttgccattaaccaagtccgaaggttgataggtaatgagaactacctagactacatgacaagtatgaaacgctttaaaaacgaaggtgacccagaaggtgctttgtggtag

SEQ ID NO: 21840 - RNA, 9879 nt, synthetic construct
  misc_feature 1..9879: note = derived and/or modified CDS sequence (opt6) from DENV-1__GU131766__SS-prME
  source 1..9879: mol_type = other RNA
tcagtgacaatgcttttaatgcttatgcctacggctctggctttccacttaactacaagaggtggagaaccacacatgattgttacgaaacaagaaagagggaaatctttactattcaaaacgagtgcgggagtaaatatgtgcacattgatcgcaatggacttgggagaactctgtgaagacacaatgacatataaatgtccaagaataactgaagcagaaccagatgatgttgattgctggtgtaatgcgacagatacttgggtgacttacggtacgtgctcacaaacgggcgaacataggcgcgataaaagatcagttgcactagcacctcatgtaggattagggttagaaacgaggaccgaaacttggatgagcagcgaaggggcatggaaacaaatccaacgtgttgaaacatgggccctacgtcatccagggttcactgtaattgcgctctttttagctcacgctattggtacttccataactcaaaagggaataatctttatattgttaatgttagtaactccatctatggctatgagatgtgttggaatcgggagtagagattttgttgaaggccttagtggcgcaacatgggtggacgttgttttagaacacggatcgtgtgttactaccatggcaaaagataaaccaactctggacatagaactcctaaagaccgaagtcacaaatccagcggtcttacgaaaactgtgcatagaggctaaaatcagcaatacaacaacagattccagatgcccaactcaaggcgaggcgacacttatggaagaacaagacgcaaactttgtttgcaggcgcacgttcgtagacagaggatggggcaatggctgcggactgttcggaaaaggatccctcataacatgcgccaaatttaagtgcgtaacaaaattggaaggtaaaattgtacaatatgaaaacctgaaatattctgttatagtcactgtgcacacgggcgatcaacatcaagtgggaaatgaaagtattgaacacggtacaactgctactataacacctcaagctccaacctccgaaattcagttgactgattatggagcattaacgttagattgcagtccaaggacagggctagactttaacgaaatggtgctactaacgatgaaggagaaaagttggctggtgcataaacaatggttcttggatctcccactcccgtggacatcaggagcttcaacatcgcaagaaacttggaatcggcaagatctattagtaacatttaaaacagcccacgccaagaaacaggaggtagttgtcctcggctcccaagaaggcgcaatgcacacggcattgaccggagcaacagaaatacaaacatccggaacaacaactatttttgcaggccatttaaaatgtagactaaagatggataaactaacccttaaaggaatgagttatgtgatgtgtacaggaagtttcaaactggaaaaagaagtcgcagaaacccaacacgggacagtcctcgttcagattaaatatgaaggaacggatgcgccatgtaaaattccattttcaactcaagatgaaaaaggtgttacacaaaatggtagactaatcacggcaaatccgatcgttatagacaaagaaaagcctgtaaatatcgaagctgagccaccctttggagaatcatacatcgtaatcggagctggagaaaaggcattaaaactaagttggttcaagaaaggtagcagcattggtaagatgttcgaagcaacagcgagaggcgcaaggagaatggctatactgggcgacacagcatgggacttcggttccataggaggcgtttttacatctatagggaagctagtacatcagatctttgggacggcatacggggtgcttttctcaggagtaagctggaccatgaaaataggcattggtgtgttattaacatggttaggactaaactcaagaagcactagcttatctatgacatgcattgcagttggcttggtaactctatatcttggtgtaatggtacaagctgattcagggtgcgttattaattggaaaggtcgtgaattaaaatgcgggagtggaatttttgttacaaacgaggttcatacatggacagagcagtacaaatttcaagcggattcacccaaaagactatcagcagcaataggaaaagcgtgggaggaaggggtgtgtggcattagatcagcaacacgactagagaacataatgtggaaacaaataagtaacgagctaaatcacattcttttagaaaatgatatgaaattcacagtagttgtaggagatgtggtaggcatcctagctcaggggaagaaaatgatccgcccacagccaatggaacataaatattcttggaaatcgtggggaaaagcaaaaataatcggagcagatgtacaaaacacaacatttattattgatggcccgaatacacctgaatgtccagacgatcagagagcgtggaacatatgggaagtcgaagattatggctttggtatatttactacaaacatatggctcaaaatgcgggatagttatacacaagtatgtgatcaccgtttaatgtcggcggccataaaggattcgaaagctgtacacgccgatatgggatattggatcgagtcagaaaagaacgagacttggaaacttgcacgagcttcatttatagaagtaaaaacgtgtatatggcccaagtcgcacactctctggtctaatggagttttagaatcggaaatgataataccgaaaatatatgggggcccaatatcacaacacaactaccgaccgggatatttcacacagactgctgggccatggcacctaggcaagttagagctcgatttcgatttgtgcgaaggcaccacagtggtcgtagatgaacattgtgggaaccgtggaccctctctacgaacaacgacggtaactgggaaaataattcacgaatggtgctgccgatcttgtacattacctcctcttagattcaaaggtgaggatgggtgttggtatggaatggaaataagaccggtaaaagagaaagaagaaaacctagtaaaaagtatggtgagtgcaggatcaggagaggtagatagcttttccttgggtttgttatgcatctctataatgatagaagaagtgatgaggtctcgttggtctagaaaaatgctcatgacaggaaccctcgcagtattcctcttattaattatggggcaattaacttggaacgatttaataaggctgtgcattatggtcggcgctaacgcttcggacagaatgggaatggggacgacatatctagcgttaatggctacatttaaaatgagacctatgtttgccgttggactcctattcaggaggttgacgagtcgagaagtactactactaactataggactaagtttagtcgccagtgtagagctacctaactctcttgaagaattgggagacggattagcgatgggaattatgatattaaaacttctgacagacttccaatcgcaccagctgtgcgccacattattatccttaacatttataaaaacaacattgagcttacattatgcctggaaaacaatggctatggttctttcaatagtttctctcataccactttgcctaagtactacatcacagaaaactacgtggctgccagtactcttaggttcactcggatgtaaacccctaacaatgtttttaattgccgaaaataagatttggggcagaaaatcatggcccttaaatgaagggataatggccgtgggtgtagtaagcatcctactatctagcttactgaaaaacgatgttccacttgcgggcccgctaattgctggagggatgcttatagcatgttatgtaataagcgggagtagtgccgatctgtctctagaaaaagcggctgaagttagctgggaagaggaagcagagcacagcggggcgtcccataacatattagtagaagtacaagatgatggaacaatgaaaattaaggacgaagaaagagacgatacactaacaattctcctcaaggccactttgttagcagtctcgggagtttaccccctaagcattcctgcaaccctgttcgtgtggtatttttggcagaaaaagaaacaaagatccggcgttttatgggacacaccatcgccacctgaagttgaacgggcagtcttagatgatggaatatatagaataatgcaacgaggattattaggtcgtagccaagtaggggtaggggtattccaggagaatgtcttccacacaatgtggcatgtgacgaggggtgctgtcttgatgtatcaaggaaaaagattggaaccaagttgggcgtcggtgaagaaagacctcatttcatatggcggtgggtggcgcctccaaggctcttggaacacaggagaagaagttcaagtaattgctgtagaacctggcaaaaatcccaaaaatgtccaaacagcgccagggacttttaaaaccccagagggtgaagtaggtgcaatagcgttggacttcaaaccaggtacttccggatcccctatcgtaaacagagagggaaaaatcgtcggattatatggaaatggagtagtgaccacatcgggtacttatgtctctgcaattgctcaagcaaaagcctcacaagagggtccgttaccggagatagaagacgaggtttttcgcaagagaaatttgacgataatggatctacatcctggttcaggaaagacccgtcgttacttgccagccatagtccgggaggcaattaaaagaaagctaaggacattgatattggcacccacccgagtggtcgcgtccgagatggcagaagcactaaaagggatgccaatccgctatcaaacaacagccgtaaaatcagagcatactggtaaagaaatagtggatctaatgtgtcacgctacattcacaatgcgtctacttagcccagtaagagtgcccaattataatatgataataatggacgaagcccattttactgacccaagttcaattgctgctagagggtacattagtaccagagtcggaatgggagaagcagcagcaatatttatgacagccacgccacccggatccgttgaagcatttcctcaaagtaatgccgttatacaggatgaggaacgtgatatacccgaaagatcctggaatagtggatatgagtggattaccgattttccaggcaaaacagtgtggttcgttccctccataaaatcaggtaatgacatcgccaattgcttaagaaagaacggaaaacgagtgattcagttgtcccgaaagaccttcgataccgaatatcagaaaaccaaaaacaatgactgggactacgtagtaacgaccgacattagtgaaatgggggcaaactttagggctgatcgtgttatcgacccaagaagatgtctaaaaccggtaatattaaaggacggaccagaaagagtaatcctcgccggacccatgccagtgacggtagcgagtgcagctcagagaagaggcagaataggtaggaatcataataaagaaggcgatcaatatatctatatgggacaacccctcaataacgatgaagaccatgctcattggacagaagcaaaaatgcttctcgataatattaatactcctgaagggataattccagcgttatttgaacccgagcgagaaaaatcagcagcaattgatggagaatatagattacggggagaagctagaaaaacctttgtcgaacttatgcgaaggggcgatttgccagtttggttgtcctataaagtagcaagcgaaggttttcaatacagtgacaggcgatggtgttttgatggtgaaagaaacaatcaagttcttgaggaaaatatggatgttgaaatatggacaaaagagggtgaacgtaaaaagttaaggccaagatggttggacgcacgtacatacagcgacccactagctctaagggaatttaaagaatttgcagcaggtagacgtagtgtatcaggagatctaatactagaaataggtaaattgccacaacatcttactcaacgggctcaaaacgcactcgataatctggtaatgctacacaatagtgaacaaggaggacgtgcatacagacatgcaatggaagaactccctgataccatagagactttaatgcttctagccttaatcgccgttctaaccgggggagtaacgctctttttcctatcggggcgcggtcttgggaaaacctctattggattactatgcgtaatggcaagcagcgttcttctatggatggcgtctgtagaacctcattggatagcagcatcaatcatcttggaatttttcctgatggtcctattaattcctgaaccggatagacaacgtacgccccaagacaatcaacttgcgtacgtagtaataggcctcttattcatgattttgacagttgcagcaaacgaaatgggtttacttgaaactaccaagaaagacttaggaattggacacgttgcagtagaaaatcatcaccacgccaccatgctagatgtagatttgcacccggcatcagcgtggaccctatacgccgtagccacaacgataataactccaatgatgagacacacaattgaaaacaccacagccaacatttccttgacagcaatcgcaaatcaagcagctatattaatgggcctcgacaagggttggccaatttcaaaaatggacatcggggtccctttgctagctttgggctgttatagtcaagttaaccctttaacgttgacagcagcagtattaatgcttgttgcgcattatgctatcattggcccgggtttacaagccaaagccacacgagaagctcagaaaaggacagctgcaggaatcatgaaaaacccaactgtagatggcattgtagctatagatttggatccagttgtctacgacgctaagtttgagaaacaacttgggcaaattatgttactaatcctatgcacctctcaaatattactaatgcgtacaacatgggctttatgcgaaagtataacgctcgctacaggtccattgaccacattatgggaaggttctcctgggaaattttggaatacaacaatcgcagttagcatggctaatatttttcgtggaagttatctagccggagctggactcgccttcagtttaatgaaaagtctcggaggaggcaggagaggtacaggagctcaaggtgaaactttgggtgaaaagtggaaacgtcaactaaaccaattgtcaaaatccgagttcaatatatacaaacgaagcggcataatggaagtagacagaagtgaagcaaaggagggattaaagcgcggcgagaccacacgacatgccgtgtcacgcggtactgctaagttgcgttggttcgttgaaagaaatctagtcaaacctgaaggaaaggttattgatctagggtgtgggcggggtggctggtcttactattgtgcaggattaaagaaggtgacggaagtaaaaggatatacaaagggtggacccggtcatgaagaaccaataccaatggcaacatacggttggaacctcgtgaaacttcattcaggaaaagatgtatttttcacaccaccagaaaaatgtgacacacttttatgtgacatcggagaaagcagtccaaatcccacaatagaagaaggacgaacactcagggttttaaaaatggttgaaccttggctaagaggcaaccaattttgcataaaaattctcaacccttatatgccatccgttgttgaaaccttagaacaaatgcagagaaaacacggcggaatgctggtacgtaacccattaagccgcaatagtactcacgaaatgtattgggtaagctgtggcacggggaatatagtatccgccgtgaatatgaccagtaggatgctcctcaatagattcactatggcacataggaaaccaacttacgaaaaggatgttgatttaggtgctggaactcgtcatgtagcagttgaaccagaagtagcaaacttagacataattgggcagcgaatcgaaaatataaaacatgaacataaaagtacatggcactatgatgaggacaacccctataaaacatgggcctatcatgggtcttacgaagtgaaaccgtctggaagtgcatcatctatggtcaacggagttgtgaaattactaactaagccttgggatgtgatcccaatggtcacgcaaatcgccatgactgacactacaccatttgggcaacagagggtattcaaagaaaaagttgacacacgtacaccgaaagctaaacgcggaactgtacaaataatggaagtaacagcacgatggttatgggggttcttgtcacgaaataagaaacccagaatatgcactcgcgaagaatttactcgaaaagtgagaagcaacgcagcaataggggctgtttttgtcgacgaaaatcaatggaacagtgccaaagaagcagtagaagatgagcgtttttgggaccttgtcaagaaagaaagagagttacataagcaaggcaaatgcgctacctgtgtttacaatatgatgggtaaacgagagaaaaagttaggcgagttcggaaaggcaaaaggatctagagccatttggtatatgtggctaggagcaagattcttagaatttgaagctctgggctttatgaatgaagatcattggtttagcagagaaaactcgttatccggagtggaaggcgaaggtcttcataagctaggatacattttgcgtgatataagtaaaattccgggaggaaatatgtatgccgacgacactgcaggatgggacactagaataactgaagatgacctacaaaatgaagcaaagataactgatattatggaaccagagcacgcgctgttggctacttccattttcaaattaacttaccaaaacaaagtggtaagggtccaaagacctgcaaagaatggtacagttatggacgtaatcagtcgaagggaccaaagaggctctggacaagtaggaacttacggtttgaacacattcacgaacatggaggctcaactgattagacaaatggaaagtgaaggtatctttctgccgtcggaactagagactcctaacctagcagaacgggttctagattggctcgaaaaatacggtgtagaacgactaaagcgtatggcaattagtggtgatgattgtgttgttaaaccaattgacgaccgttttgcaactgctcttacggccttgaatgatatgggtaaggtccgtaaagacatacctcaatgggaaccatctaaaggatggaacgattggcaacaagtacccttttgttcgcatcacttccatcaactaatcatgaaagatggtcgcgaaatagtagtaccttgcagaaatcaagacgaactcgttgggagggcgcgcgtttctcagggtgcaggttggagtcttcgagaaacagcttgcttagggaagtcatacgctcaaatgtggcagcttatgtacttccacagacgggatttacgattagccgccaatgccatatgctcggccgtaccagtcgattgggtccctacatcgcgaactacatggtccattcatgcgcaccatcaatggatgacaacagaggacatgttaagcgtgtggaatagagtctggatcgaagagaacccttggatggaagataaaacccatgtatcgtcatggggagacgtaccatatcttggaaaacgagaagatcaatggtgcggttctttaattggactaactgcgagggccacatgggccagcaatattcaagtagcgataaaccaagttaggcgtctaataggtaatgaaaactatttagactatatgacatctatgaaacgattcaagaacgaaggagacccagagggggcgctttggtag

SEQ ID NO: 21841 - RNA, 9879 nt, synthetic construct
  misc_feature 1..9879: note = derived and/or modified CDS sequence (opt6) from DENV-1__GU131767__SS-prME
  source 1..9879: mol_type = other RNA
tcagtaactatgcttttaatgcttatgccaacagcgttagcatttcatttgactactagaggtggagaaccacacatgattgtaagtaaacaagaaaggggtaaatcactcctgttcaaaacaagtgttggagtaaatatgtgcactttaatcgctatggatttaggagaattttgtgaagatactatgacgtataaatgtccacgaataactgaagcagagccggatgacgttgactgctggtgtaatgctactgacacctgggtaacgtacggaacttgcagccaaactggagaacataggcgggacaaaagatcggtcgcattagcaccacatgtaggactaggtttagagacgagaactgaaacttggatgagctcagaaggagcttggaaacaaatacaaagagttgaaacgtgggcattaaggcaccctggctttactgtaatagccctctttctagcacatgctataggaacatcaattacacaaaaagggattatctttatacttctaatgctagtaaccccttctatggcgatgagatgtgtaggcatcggatccagggattttgtagaaggattgtcaggagcgacttgggtggatgtagtacttgaacatggaagttgcgtaacaactatggcaaaagacaaacctacactagatatcgaacttctaaaaactgaagttacaaatccagcagtgttaaggaaactctgtatagaagctaaaatatccaacacgactaccgatagtagatgtcctacacaaggagaagctactcttgtagaagaacaggatgctaatttcgtatgcagaagaacatttgtggaccgtggttggggtaatggctgcggacttttcggtaaaggtagcctcataacttgtgcaaaattcaaatgcgtaactaaactagaaggtaaaatagtacaatacgaaaacctgaaatattcagtcatcgtaacagttcacacaggagatcaacaccaagtaggaaatgaatcaacagaacatggaacaaccgcaaccataacaccacaggctccctcaactgaaattcaattaacagactacggggcactaacccttgactgctctcctagaaccggcctagacttcaacgaaatggtacttttaactatgaaagaaaagtcttggttagtacataagcagtggtttttagatttgccactgccatggacaagtggtgcttccacttcccaagagacatggaatagacaagacctattggtaacattcaagacggcccatgccaagaaacaggaggtagtcgtactgggcagtcaggagggtgccatgcacaccgctttaacaggagcaacggaaattcaaacaagtgggaccactacaattttcgcagggcaccttaaatgtcgattaaaaatggacaaacttacccttaagggcatgtcttatgtaatgtgtaccgggtcatttaagctagaaaaagaagtagcggagacacagcacggaaccgtgctagtacaaatcaagtatgagggcactgatgcgccatgtaagatcccattctcaacacaagatgaaaaaggagtcacacaaaatggaagactaattacagcgaacccgatagtaacagataaagaaaaacccgtaaatatcgaagctgagccaccattcggagagagttacatagttatcggagcgggagagaaagcgttaaagctgagttggttcaagaaaggaagctccataggtaaaatgtttgaggcaactgctagaggtgcacggcgcatggccatacttggtgacaccgcatgggacttcggaagtatcggaggagttttcacaagtgttggcaaacttgtccatcaaatattcggcaccgcgtatggtgtgctattttcaggtgtaagttggacgatgaagattggcattggagtcctattaacatggttgggattaaatagtaggagcacgagcttaagtatgacctgcattgcagttggtcttgtaaccttatatctcggtgtgatggtaagggcagattccggctgtgtaataaactggaaagggcgagagctaaagtgcggctcaggcatttttgtgacaaatgaagtacacacttggacggaacagtacaaatttcaggcagatagtcccaaaagacttagtgccgccattggaaaagcctgggaagaaggcgtatgtggtatccgatctgcaacaagactagaaaacataatgtggaagcaaatatccaatgagttaaatcatattcttcttgaaaatgatatgaaacttacggtcgtcgtaggcgacgtggcaggcattttagctcagggaaagaagatgatcagaccacaaccaatggaatacaaatatagttggaaaagctggggaaaagctaaaataattggggctgatgtgcaaaacacaacattcatcatagatggtccaaatacaccggaatgtcctgacgatcaaagagcctggaatatatgggaagttgaagactatggcttcggcatctttactacaaatatctggctcaaattaagagattcatatacgcaggtatgtgaccacagactaatgtcagcagcgattaaagactctaaagcagtccacgcagacatgggttactggatagaatcagagaaaaatgaaacctggaaacttgcgcgggccagttttatagaagtcaaaacatgtatatggcctaagtcgcataccctatggtcaaacggggtgctcgaaagtgaaatgatcatccctaagatatatggagggccaatcagtcaacataattaccggccaggatactttacccaaacagctggaccttggcacttgggcaaactcgagttggattttgacctatgtgaaggaacaacggtagtagtggacgagcattgtggaaatagggggcccagtttaagaactaccactgtaacaggaaagatcattcacgaatggtgctgccgctcgtgtacattgcctccactaagatttaaaggagaggatggctgttggtacggcatggagataaggccggtgaaagaaaaagaagaaaatttagttaaatccatggtgagcgccggatcaggtgaagtagattctttctccctaggattattatgcatatcaataatgatcgaagaagtaatgagatcaaggtggtcacgcaaaatgcttatgaccggaactctggctgtctttttcctattgataatgggccagctaacttggaatgatcttatcagactttgtataatggtcggcgctaacgctagtgacagaatgggcatgggtacgacctatttagctctgatggcaacttttaaaatgcgtccgatgttcgctgttgggcttctgtttcgaaggctaacaagtagagaagtactactactcaccattgggctttctctagtagcatctgtagaattaccaaatagccttgaagaattgggtgacggtctagccatgggaattatgatcctgaaactactgactgacttccaaagtcatcagttatgggcaacgttattaagcctaacgttcatacgaacgaccttttcgctacactacgcctggaagaccatggctatggttttatcaatcgtcagtctttttccactatgtctgtccacaacttctcagaaaacaacatggttacctgtgttacttggcagcttgggttgcaaaccattgacaatgtttctaatagcagagaacaagatatgggggaggaaatcctggccgctaaatgaaggtataatggcggtaggcatagtctcaatactcctatcaagtctccttaaaaatgacgttccactagcaggaccgctaattgcagggggtatgctcatagcttgttacgttatatctggcagctcggctgatctatcattggaaaaagccgcagtggtatcatgggaagaagaggcagaacactcaggagcatcacacaacatacttgtggaagttcaagacgatggtacgatgaaaataaaagacgaggaaagagatgatacattaacaatattattgaaagcaactttattagctgtttcaggggtatatccattgtctatacctgctacattatttgtttggtacttttggcagaagaagaaacagagaagcggtgtattgtgggatacaccttcaccaccagaagttgaaagagcggttttggacgacggtatatatcgaataatgcaacggggactacttggtagatcacaagttggggttggtgtctttcaagaaaatgtatttcatacgatgtggcacgtaacacgaggggcagttctaatgtaccaaggcaaacgattggaaccgagttgggcatctgtcaagaaagacctcatctcctacgggggaggctggaggctccaagggagttggaatactggagaggaggtacaggtcatagcggttgaaccaggtaaaaaccctaaaaatgtacaaactgctcccggaacatttaaaacttcagagggtgaagtcggtgcaatagctctcgattttaaaccggggactagcggcagtccaatcgtaaatagagaaggtaaaatagtaggattatatggaaatggagtagtaacaacgagcggaacatatgtaagtgcaatagcgcaagcgaaggctagtcaggaaggaccgctcccagaaattgaagatgaagttttcagaaaaagaaacttaactataatggacctacatcctggttcgggtaaaactaggagatatttgcctgcgatagtcagagaggcgattaaaaggaaacttagaacgctcatactagcaccaacacgcgtagtagcgagtgaaatggctgaggcactgaagggcatgcccatacgttatcagacgacggcagttaaatccgaacataccggtaaagagatagtggatctaatgtgtcatgcgacatttacgatgagactccttagtcccgtacgagttcctaattacaatatgattattatggacgaagctcactttacagatcctagctcaatagccgcaagagggtatatttccacaagagtgggcatgggtgaagcagctgctatctttatgactgcgacgcctcctggtagtgtagaagcctttccacaaagcaatgcggtcatacaagacgaagaaagagacataccagaacgaagttggaatagtggctacgaatggattacagacttcccgggcaaaacggtttggttcgttcccagcataaagagtggaaacgatatagctaactgcttaagaaagaatggcaaaagagtaatccaactcagccgcaagacatttgatacagaataccagaaaaccaaaaataatgactgggactatgtagtcacgaccgatatttctgagatgggtgctaacttcagggctgatcgtgtcatagatccacgtagatgcttaaagcctgttattctaaaagacggcccggaaagagtaattctggcaggaccaatgcctgtaaccgttgcatctgcagctcaacggagaggcaggattggtcggaatcacaacaaagagggagaccaatatatatatatgggccaacctcttaataatgacgaagaccatgcacattggacagaagccaaaatgctactagacaatattaatacacccgaaggaataataccagctcttttcgaaccagaaagggagaaatcggctgcaattgatggcgagtacagacttagaggagaagcaagaaaaactttcgttgaattgatgagacgaggagacctccctgtgtggttaagctacaaagtagcatcggaaggttttcaatactccgataggagatggtgttttgatggagaacgaaacaatcaagttttagaagagaacatggacgtagagatatggaccaaagaaggcgaaaggaagaaattgagacccagatggctggatgctcgtacgtattcagaccctttagccctccgagaatttaaagagttcgcagctggtcgtcgtagtgtatcgggagaccttatattagaaataggaaaactaccacaacacctaacacaacgtgcgcaaaatgcccttgataatctagtaatgctacacaatagtgaacaaggaggccgagcttaccgacacgccatggaagaattgccagatactatagagacgttaatgctactggctctcatagcggtcttaacagggggtgtcacactcttctttctctctgggagaggactaggcaagacttcgataggactactatgtgttatggcgtcttcggttctgctttggatggcatctgtagaaccccactggatcgcagccagtataatattagagtttttcctaatggtgctactaatacctgaaccggatagacaacgaaccccgcaagacaatcaactagcctacgtagtaatcggactattgttcatgatcctaacagtcgccgctaacgagatggggcttttagaaacaacaaagaaagatctcggcatcggccatgtggccgtagagaatcatcaccatgcagcaatgcttgacgtggatcttcatcccgcgagtgcttggacattatacgcagtcgctacaactataatcacccccatgatgagacatactatagaaaatacgacagcgaatatatcgcttacagcaatagctaaccaggctgcaatactaatggggttggataaaggatggccaatttctaagatggatatcggagtaccactactagcactagggtgttattcccaagtgaatcctcttacattgacagctgcagtattaatgctggttgcccactatgccattataggacctggactgcaagcgaaggcaacaagggaagcccagaaacgcacagcagcaggaataatgaagaatcctacagtggatggtatagttgcaatcgacctagatccagtagtgtatgacgcaaaatttgagaaacaattaggacaaatcatgctactaatactatgcacaagtcaaatactcttgatgcgtacgacttgggcattatgcgaatccattacgctagccacagggccgctaacaacattgtgggaaggttcaccaggcaaattttggaatactacaattgcggtaagtatggctaatattttcaggggatcttatctggctggagcaggactggcttttagtttaatgaaaagtttaggtggcggcagaaggggtaccggtgctcagggggaaactctgggcgaaaaatggaagaggcaactgaaccaattgtcaaagagcgagtttaacacctataaaagaagtggaatcatggaagttgacagatcagaagcaaaggaaggattaaaaagaggggaaaccactaaacatgccgttagtcgcggcacagctaagttacggtggtttgttgaaaggaacttggtgaaaccagagggtaaagttatagatttaggatgtggaaggggtgggtggtcttactattgtgcaggcctgaagaaagtaactgaagtaaaaggttatacgaagggagggcccggacatgaagaacccattcccatggcaacatatggatggaacttggttaagctacattcaggaaaggatgtattcttcatcccaccagaaaagtgtgacacattattatgcgatattggagaatcaagtcccaatccgacaatcgaagagggtcgcactttacgggtactcaaaatggtagaaccatggttaagaggtaatcaattctgtataaaaatccttaacccatatatgccaagcgtggtggaaacgctcgagcagatgcaacgtaaacacggaggtatgttggttcgtaatccattatcacgaaacagtacacatgaaatgtactgggtgtcttgcggaactgggaatatagtctccgccgtgaatatgacatctaggatgcttttaaaccgatttacaatggctcaccggaagcctacatacgaacgtgatgtagatttaggtgcaggtacacgacatgtagcagttgaaccagaagtagccaatctagatattattggtcaaaggatagaaaatataaaacatgaacataaaagcacttggcattatgacgaagataacccatataaaacttgggcataccacggaagttatgaggtaaaaccctctgggagcgcttcttcaatggttaatggagtagtcaaacttttgactaagccatgggacgtaattcctatggttacacaaatagcaatgacagatacaacaccgtttggacaacaacgtgtgttcaaagagaaagtagatactaggacacccaaggctaagcgaggcaccgcgcaaataatggaagtcacagcaaaatggttgtgggggttcctttcgaggaacaagaaacctagaatttgtacacgtgaagagtttacaagaaaggtcagaagcaacgccgcaataggggcggtttttgtagatgaaaaccaatggaactcagcaaaagaagcagttgaagacgaacggttctgggacctagtacatagggaaagagaactgcataaacagggaaaatgtgcgacatgcgtttacaatatgatggggaagcgagagaagaaattaggtgaatttgggaaggcaaaaggctcaagagcaatctggtacatgtggttaggggcgcgcttcctagagttcgaggcattgggtttcatgaacgaggaccattggttctcgcgtgaaaattcattgagcggggtagaaggggaaggtttacacaaactcggctacatacttagagatatctccaagatcccaggtgggaacatgtatgcagacgatacagctggttgggatacacgaataaccgaagatgatttacaaaacgaggcgaaaatcacagacattatggaacctgaacatgctttgctggcaaaatccattttcaaactaacctatcaaaacaaagtggtaagggttcaacgcccggccaaaaatgggacagtaatggatgttatctctagacgagaccaacgaggctcgggtcaagtgggcacatatggcttaaacacatttaccaacatggaagcacaactaattcgacagatggaatccgaaggaatcttcagtccgagcgagctagaaacgcctaatctagcaggtcgagtcttagactggctggaaaaacatggagtggaaagactaaaacgaatggcaatctctggggacgattgtgttgtaaagccaatagatgacaggtttgcaacagctttgactgcactaaacgacatgggaaaagtaagaaaagatataccccaatgggaaccatctaaagggtggaatgattggcagcaagtcccattctgttcgcatcactttcatcaactaatcatgaaagatgggcgtgaaattgtagttccttgcagaaatcaagacgaactggttggacgcgcacgcgtcagtcaaggtgcgggatggagtctccgtgaaactgcctgtctcggtaagtcgtatgcacaaatgtggcaacttatgtattttcaccgaagagatttacgtttggccgcgaatgcaatatgcagtgcagtacctgttgactgggtaccaacaagccgtacaacatggagcatacacgcacatcaccaatggatgacaacggaggacatgttatccgtttggaaccgcgtatggatagaggaaaacccttggatggaagataaaactcatatttccagttggggtgacgtcccgtatttaggaaaacgtgaagatcagtggtgcggatctctaattggcttaacagcacgggcaacatgggcaacgaacatccaggtcgcaatcaatcaagtacggcgtctccttggtaacgaaaattatctcgattacatgacctctatgaaacgttttaaaaacgaatcggatccagagggagcactatggtag

SEQ ID NO: 21842 - RNA, 9879 nt, synthetic construct
  misc_feature 1..9879: note = derived and/or modified CDS sequence (opt6) from DENV-1__HM181967__SS-prME
  source 1..9879: mol_type = other RNA
agcgttacaatgctcttaatgctcatgcctactgctcttgcttttcatctgaccaccagaggtggagaaccccacatgatagtatcgaaacaagaacgaggaaaatcattactttttaaaaccagtgctggtgtaaatatgtgcacattgatagctatggatctaggtgaactctgtgaagatactatgacttacaaatgcccgagaataacagaaacagaaccggatgatgtagactgctggtgtaacgccactgatacctgggtaacttatggaacctgctcgcaaacaggagaacatagaagagacaaacggagcgtggcccttgctccacacgtcggtctcggcctagaaactagaacagaaacctggatgtcatcagaaggagcctggaaacaaatacaaagggttgaaacctgggcccttaggcatcccggcttcacggtgatagcattatttttagctcacgcaataggcacttctataactcaaaaaggcataatctttattctactaatgctagtcacaccatcaatggcaatgcgttgtgtaggtataggaagccgtgacttcgtcgaaggcttgtcgggagccacatgggtggacgtagtattagaacatggctcctgtgtcacaactatggctaaagacaaaccaacattagacatcgaattactaaaaactgaagtaactaatcctgcagtacttagaaaactatgcatagaagccaaaatatcaaatacaaccactgatagtcgctgccctacacagggtgaagcaacactcgtagaagaacaagatgcaaactttgtctgcagaagaacttttgtagacagaggatggggtaacggatgtggtctttttggcaaaggaagtttaataacgtgcgcaaaatttaaatgtgtaacaaaattagaaggtaaaatagttcaatatgaaaacctcaaatattccgtcatagttacagtacatacaggtgatcaacaccaggtaggcaacgaaagcacggaacatggcacaaccgctactatcacaccacaagccccaacgactgaaattcaattaacagattacggcgctctgacattagactgttctcctcgtacgggactggattttaacgaaatggtactgctaacaatgaaagaaaaatcctggctagttcataaacaatggtttctagatctacccttgccatggacaagcggtgcttcaactagccaggaaacttggaatcgacaagacttattagtaacattcaaaacagcacatgcaaagaagcaggaagtagtagtacttggtagtcaagaaggtgctatgcacacagcactaacaggagctaccgaaatacaaaccagcggtactactacgatatttgcaggacacctaaagtgccggttaaaaatggataaactaacacttaaaggcatgtcttatgtcatgtgcacaggctccttcaagttggaaaaggaagtagctgagacccagcacggcacagtcctagttcaaattaagtatgaaggcacagacgccccttgcaaaataccatttagtactcaagatgagaagggtgtaacacagaacggaagattaattacggctaatccaattgtaaccgacaaagaaaagccggttaacatcgaggcagaaccgccattcggagaatcttatatagtaataggtgcgggagaaaaagccttaaaattatcctggtttaagaaaggatcatccataggtaagatgtttgaagcaacagctcgcggtgcgaggagaatggcaatacttggagatacagcttgggattttggttctattggtggggtgtttacgagcgtagggaagctcgtgcatcaaatattcggaacagcatatggagttttattctcgggcgtgagttggactatgaaaatcggaataggggtccttttaacctggctaggacttaacagccgatcaactagcctatccatgacatgcatagcagtggggctagtcacactttatctaggagttatggtgcaagcagatagtggatgtgttataaactggaagggccgtgaactcaaatgtggcagcggtatattcgttacaaatgaagtccatacttggacagaacaatataaattccaagcagacagtcctaaacgactttcggcggcgattggaaaagcatgggaagaaggagtatgcgggattagaagtgctacgagattagaaaacataatgtggaaacaaatctcaaatgaattgaatcacatactattggagaacgacatgaaatttacagtagttgtaggtgacgttgcgggcatattggcacagggtaagaaaatgatccgcccacagcctatggaatacaaatacagttggaaatcttggggaaaggctaagattatcggtgctgatgtccaaaataccacttttatcatagacggtcctaatacgccagagtgtccagacgatcaacgagcatggaatatatgggaagtagaagattacggattcggtattttcacgacaaatatatggttgaaattgagagattcgtatactcaagtctgtgatcatcgccttatgtcggcagcgatcaaagattcaaaagccgtacacgctgatatgggatattggatcgaatcggagaaaaacgaaacctggaaattagcaagagcttcgtttatagaggtaaagacatgcatttggcctaagtcacacacgctctggagcaacggcgtactggaaagtgaaatgataatacccaaaatatacggaggacccattagccaacataattatcgccctggttattttacacaagcagcagggccatggcacttgggcaaattagagttagattttgatctatgtgagggaacgaccgtagtggttgacgaacactgcggcaaccgaggaccttctttacgaacgactacagttaccggaaagatcatacacgagtggtgttgcaggagttgcacattacctcctctacggtttcgaggagaagatggatgttggtatgggatggaaattagaccagtcaaagaaaaggaagaaaatctcgtgaaaagtatggtatctgcgggtagtggagaagttgatagcttttcactaggattgctttgtattagtataatgatagaggaagtgatgagatcgagatggtcaaggaggatgctaatgacgggcacactagcagtattcttcctcttaataatgggccaattgacgtggaacgacctaatcagactgtgtatcatggtgggagccaacgctagtgatcgtatgggcatgggcacgacctatcttgccctaatggcgacttttaagatgagaccgatgtttgcagttggcctgcttttccgacggctgacgtcacgagaagtattattgctaacaataggtttgtcgttggtagccagtgtagaattacccaattcactagaagaactgggcgacggactagcaatgggtataatgatcttgaaactacttactgattttcaatcgcaccaactatgggctacacttctctcattaacttttattaaaactacatttagcttgcattacgcatggaagaccatggccatggttttatcaattgtctctttgtttccattgtgtttgtcaacaactagccagaaaacgacctggctgccagtattattaggaagtttaggatgtaaaccactgacaatgtttttaatagcagagaacaagatttggggacgacgatcatggcccttaaatgaaggaattatggcggtaggaatagtgagtatattactaagctcattgctaaagaatgatgtacctttagctgggcctctaatcgccggtggtatgttaattgcatgttatgtcatttcaggatcgagtgcagacctatcactagaaaaagcggcggaggtatcttgggaagaagaagccgaacattccggagccagtcataatatactggtggaggtccaggacgacggcacaatgaagataaaggacgaagagagagacgacacactaacgatattactcaaagctacactcttagcagtctcaggagtataccccctctcaataccagcaacgcttttcgtatggtacttttggcagaagaagaaacagagatctggggtgttgtgggacaccccatcaccaccggaggttgaacgtgccgtattagacgacggaatttatagaatcatgcaacgagggctgctcggaagaagccaagtcggtgtaggtgtatttcaagaaaacgtattccatacaatgtggcacgtgacacgcggagcggtgttaatgtaccagggtaagcgcctagagccgtcttgggcgtcagtcaagaaagatttaatatcatacggtggaggttggagactacaggggagctggaacacgggtgaagaggttcaagttattgcagtcgaaccaggaaagaatccaaagaatgttcaaaccgctccggggacatttaaaacaccagaaggtgaggtaggagcaatagcattagacttcaaaccaggtacgagcggatcaccaatcgttaatagagaagggaagatcgtgggtttatacggcaatggagttgtaacgacttctggaacctatgtaagcgcaatcgcccaggcaaaagcaagtcaggaaggaccactgccggagatcgaagacgaagtatttcgaaaaaggaatcttacgataatggatctacaccctggatctggaaaaacaagaaggtacctaccggcaattgtacgggaggctataaaaaggaaattaagaacattaatattggcgccaaccagggttgttgcaagcgaaatggcagaagctctaaagggtatgcctatacgataccaaaccacagcagtaaaaagtgagcatacgggtaaagaaatcgtagatctaatgtgccatgcaacttttaccatgagactgttgtctcccgtcagagtaccaaattataatatgataatcatggacgaggctcattttacagacccttcttctattgccgcaagggggtatatctcaacccgcgtcggtatgggagaggccgcggctatttttatgacagcgactccgccaggaagcgttgaagcattcccacaatcaaacgccgtgatacaggacgaggaaagagatatccccgaaagatcgtggaactcaggatatgaatggattaccgattttccaggtaaaactgtatggtttgtaccttcaataaaatccgggaacgacatagctaactgcttgcgcaaaaatgggaaaagagtcatccaactaagtaggaaaacattcgatacagaatatcagaaaacgaaaaataacgattgggattatgttgtaacgacggatatatcagaaatgggtgctaacttcagggcagatagagtaatagaccctaggaggtgcctcaaacctgttatcttaaaagatggcccggagagagtcatattagctggcccgatgcctgtcaccgtggcttcagcagctcaaagaaggggacgcattggaagaaatcataataaagaaggtgaccaatatatatatatggggcagccgttaaataatgacgaagatcatgcccattggactgaggcaaaaatgctactcgacaacattaatacacctgaaggcattatcccagccttgtttgaaccagaacgagagaaaagtgccgcaatagacggagagtacagattacgtggagaagcacgaaaaacatttgtagaattaatgagacgaggcgatttaccagtctggctgagctataaggtggcttcggagggcttccaatattctgatagaagatggtgtttcgacggcgaacgtaacaaccaggttctggaagaaaatatggacgtggaaatttggactaaagagggagaaaggaagaaactaagacccaggtggttagatgcgagaacatactcagatccgttagcattacgagaatttaaggaatttgcagcaggcaggcgatcggttagcggtgatttaatcttggaaattggaaagctaccccaacacctgacccaaagagcgcagaatgcccttgataaccttgtaatgcttcataactccgaacaaggcgggcgagcatatagacacgcaatggaagaactacccgatacgatagaaacactcatgttattggcactaattgctgtcctgactggaggagtgacactattctttttatcaggtagagggctgggaaaaacatccataggactactatgtgttatggcctcgtctgtactattatggatggcatcggtagaaccacattggatcgccgcatctataattttagagttctttttaatggttttacttataccagaacctgataggcagcgaacacctcaagataaccaactcgcgtatgtagtcatcggcttattatttatgatactaactgtagcggctaatgaaatggggcttttagaaactacaaagaaagatctgggaattggtcatatggcagtcgaaaatcatcatcacgcagcgatgctagacgttgatttgcacccagcaagcgcttggacactatacgctgtcgctactactataataacaccaatgatgagacatacaatcgaaaatacgacagcaaatattagtttaaccgctattgcgaatcaggctgcaatattaatgggactagataaaggatggccaatatcaaaaatggacattggtgtgccattactcgcattgggatgttattcccaagttaatcctttaactctaacggcagctgtattgatgcttgttgctcactacgctataatcggtcctggtctccaagcaaaagcaactcgcgaagcccaaaaacgcacagcagcaggaataatgaaaaatcccaccgtcgacggaattgtggcaatagatcttgatcctgttgtttacgacgctaagtttgagaaacagttaggacagataatgctactcatactatgtaccagtcagattttactaatgaggactacatgggcattgtgtgaaagtattaccctcgccacaggcccattaactaccttatgggagggtagtccagggaagttttggaacaccaccatagcggtatcaatggcaaatatttttagaggtagttatttagctggtgcaggattggcattttctctcatgaaatcactaggaggaggacggagaggaactggagcccagggagaaaccttaggtgaaaaatggaaacgacaacttaaccagctgtcaaaatccgaatttaatacttacaaacgaagcggcataatggaagtcgatcgtagtgaagcaaaggagggattaaaaaggggcgagactactaaacatgccgttagtcgagggaccgcaaaattaaggtggtttgtagaaagaaatttagtaaaacccgaaggcaaagtgattgatttaggttgcggacgtggtggatggtcttattactgtgcggggctcaagaaagttactgaggtaaaagggtacacgaagggtggacctggccacgaggaacccataccaatggctacatacggttggaaccttgtaaaactccacagtggaaaagacgtgttctttattccgccggagaagtgcgatacgttgctatgtgatataggggagtctagtccgaaccctaccatagaagaaggtagaacgttacgagttctcaaaatggtagaaccatggttgcgaggaaatcaattttgtatcaagatactcaacccatatatgccatctgtagttgaaaccttggaacagatgcaaagaaaacacgggggaatgctggtaagaaacccattaagtagaaatagcacacatgaaatgtactgggtatcatgtggaacgggaaacatagtatcagctgtaaatatgacaagcagaatgcttcttaatcgttttaccatggcgcatcggaagccaacatatgaaagggacgttgacttaggtgccggaacacgtcacgtagcagtggaaccggaagttgctaatctggatataatcggccagcgaatagaaaatataaaacacgaacataaatcaacttggcattatgacgaagataatccgtataaaacttgggcataccacggatcgtacgaagttaaaccaagtggaagcgcttccagcatggtgaacggagttgtcaaattgttaacaaagccgtgggatgtcatacccatggtaacacaaattgcgatgacggacacaacaccttttggacagcagagggtatttaaggagaaagtcgatacacggacacctaaggccaaacgtggcacggcacagataatggaagtcacggcgaaatggttatggggatttttgtcacgaaataagaaacccagaatatgtactagggaagagttcactagaaaggtcaggtcaaatgcggctataggtgcagttttcgtagatgagaatcaatggaatagcgcaaaagaagctgtggaggacgaacgattctgggacttagtgcatcgggaacgtgaactccataaacaaggaaaatgcgcaacatgtgtgtacaacatgatgggaaaaagagaaaagaaattaggagaatttggtaaagcaaaaggaagccgagcaatctggtacatgtggttaggcgccaggtttctggaatttgaagccttaggtttcatgaatgaagaccattggttctcccgcgaaaatagtttaagcggagttgaaggagaagggttgcataaactaggatacattctacgtgatatcagtaaaattcccggtggcaacatgtatgccgatgatacggctggatgggatacaagaataacagaagatgacttacaaaatgaggcgcgtataaccgatatcatggaaccggaacatgcactactagcaaagagcattttcaaactaacgtaccaaaataaagttgtgcgtgtccaacgtcccgccaagaacggcaccgtcatggatgtaatatcgaggcgcgatcaaaggggatctggccaagtcggaacgtatgggctcaatacattcacaaatatggaagcgcagctcattagacaaatggagagcgaaggcatcttctcaccttcagaattagaaacacccaacttggcagagcgtgtattggactggctagagaaatacggtgtagaaaggttaaagagaatggcaatatcaggagatgattgcgtggtaaaaccaatagatgacaggttcgcaacagctctgaccgcgctaaatgacatgggcaaggtaaggaaagatatacctcagtgggagcccagcaaaggttggaatgattggcagcaagtaccgttttgttcccatcactttcatcaattgataatgaaggacggacgtgaaatagtggtcccctgtaggaatcaagatgaactcgtcggacgtgcgagggtatctcaaggtgcaggatggtcattgcgagaaactgcatgcctaggaaaatcatatgcacaaatgtggcaactaatgtattttcataggcgtgacctacgattagctgcaaacgctatttgctcagcagttccagttgattggatacctaccagccgcactacgtggtccatccacgcgcatcatcaatggatgactacagaagatatgctatccgtgtggaatcgagtctggatagaggaaaatccatggatggaagataaaactcatatatcgtcctggggtgacgtaccatatttaggcaaaagagaagaccagtggtgtggtagtttaatagggctcacagcaagagcaacctgggcaacgaatattcaagtagcaataaaccaagtaagaagactgattgggaacgagaattatttagactatatgacatctatgaaaaggtttaagaatgaaagtgatccagagggagccttatggtaa

SEQ ID NO: 21843 - RNA, 9879 nt, synthetic construct
  misc_feature 1..9879: note = derived and/or modified CDS sequence (opt6) from DENV-1__GU131768__SS-prME
  source 1..9879: mol_type = other RNA
agtgtaacgatgctactcatgttaatgcccacggctctggcgttccatcttacaactcggggtggagaacctcacatgatagttacaaaacaagaaaggggaaaaagccttctattcaaaacctcagccggagttaatatgtgtactttgatagcaatggatctgggagaattgtgtgaagacacaatgacttacaaatgcccgcgaattacagaagctgaaccggatgatgtggactgctggtgcaatgcgaccgacacatgggtgacgtatggtacttgttcccaaacgggtgaacaccgaagggataaacgatcggtagcattagctccacatgttggtctgggactcgaaacgagaacggaaacatggatgagcagcgaaggtgcatggaaacaaatacaaagggtagaaacgtgggcgttgcgacatcccggatttacagtaatagcactatttctagctcacgcgattggtaccagtattacacaaaaaggaattatttttattttacttatgttagtaacacctagtatggcgatgaggtgcgtagggatcgggagcagagacttcgtagaaggattaagtggagcgacatgggtagacgtagtacttgaacacgggagctgcgttacgacgatggcaaaagataaacctactcttgatattgaactactaaaaacagaagtaactaatcccgcagtattaagaaaattatgcattgaagcaaaaatctcgaacacgacaacagactccaggtgccctacacaaggggaagcaacattgatggaagaacaggatgctaattttgtgtgtcgaagaacctttgtcgatcgcggatggggcaatggatgtggactgttcggtaaaggaagcctaatcacgtgcgcgaaatttaaatgcgtaacgaaacttgaaggaaaaattgtacagtatgaaaacttaaaatattcagtgatcgtaacagtacataccggagatcagcaccaagtgggtaacgaaagtacagaacatggtactacagctacgattacacctcaagccccaacatctgaaatccaactcacggattatggggctttaaccctagattgttcacctaggacggggctagactttaacgaaatggttctattaacaatgaaggaaaagtcatggctagtacataaacaatggttcctagatcttcctctcccctggacatccggtgcttctacatcacaagagacttggaatagacaagaccttctggtaacatttaaaacggcacatgccaagaaacaagaagtggtggttctagggtcccaagaaggagctatgcacacggccttaaccggagctactgaaatacaaacctcaggtacaacaactatatttgcaggacacttaaagtgtcgtttaaagatggacaagttaactctaaagggaatgtcatacgttatgtgtacaggcagttttaaattagaaaaggaagtggcagaaactcaacacggaactgtcttagtacaaattaaatatgagggtacagacgctccctgcaagatcccgtttagtactcaggacgaaaaaggcgtaacacagaatgggagattaataacggcaaatccgatagtcacagacaaagaaaaacccgttaatatagaggcagaaccgccatttggtgaatcttacatagtcataggagctggagaaaaagcattgaagttatcatggttcaaaaagggctcctcaatcggtaaaatgttcgaagccaccgcaagaggggcgagaagaatggcaattcttggagacacggcatgggatttcgggagcgtagggggcgtttttacatcagttggcaagctggtacaccagatatttggtacagcttatggagttctgttttcaggggtttcctggactatgaagatcggtataggcgttcttcttacctggctgggtttaaatagtcgcagtacaagtctaagtatgacgtgtatcgccgtaggactggttaccctctatttgggagtaatggtgcaggctgacagtggctgcgtgataaattggaaaggaagggaattgaaatgtggttcaggtatattcgttactaacgaagtacatacctggactgaacagtataaattccaagcagattcacccaaaagattaagtgcagctattgggaaagcgtgggaagaaggagtatgcggcatacgcagtgctacaaggcttgaaaatataatgtggaagcagataagtaatgagttaaaccatatactactagagaacgacatgaaatttaccgtcgtcgtcggtgacgtcgtagggattctagcgcagggcaagaaaatgatcaggccgcaaccgatggaacacaaatactcgtggaaatcttggggaaaagctaagataattggagccgatgtccaaaacactacatttattattgacggtcccaatacccctgagtgccccgatgaccaacgtgcatggaacatttgggaagttgaggattatggtttcggaatttttacaacaaacatatggttaaaattgagagatagttacacacaagtttgcgatcatagattgatgtccgctgctataaaagattctaaggctgtacatgctgacatgggttactggatagagagcgagaagaatgaaacatggaaactggcgagggcttcgtttatagaagttaagacatgtaattggcccaaatctcatacactgtggtctaatggggtactagaatctgagatgattataccaaaaatatatggcgggcccattagtcagcacaactatagacccggatatttcacacaaacagcaggtccatggcatctaggaaaactagaattagattttgacctatgcgaggggacgaccgttgtagtagatgaacattgtgggaacagaggtccatcacttcggacgacaacagtaacaggtaaaataatacatgaatggtgttgcagatcatgcacgttgcctcctttaagatttaaaggcgaggatggttgctggtatggaatggaaataagacccgttaaggaaaaagaagaaaacctcgttaaatccatggtatcagcagggtccggcgaagtagacagcttttcacttggtttgctgtgtatcagtataatgatagaagaggtaatgagatcacgatggagccgaaagatgttgatgacaggaacactcgcagtatttctcctactcataatgggacaattaacttggaatgacctaattagattgtgtataatggttggagcgaatgcatccgatcgcatgggaatgggaactacttatttagcattaatggccacattcaagatgcgtccaatgtttgcagtaggtctactattccgaagattgacctccagagaagttttgctattaactatcggcctatcattagtagcaagtgtcgaattaccaaattccctagaagagttaggcgatggtttggctatgggaattatgatcctaaagctgcttacagacttccaatctcaccaattgtgggcaacattactatcacttacattcataaaaactacattgtcgttacactatgcttggaagacaatggcgatggtcctctctatcgtatcgttgtttcctctctgcctaagtacaacgagtcagaaaactacttggctacctgtacttctggggagcttaggatgtaaaccactcacaatgttcctgataacagaaaacaaaatttggggcagaaaatcatggcccttaaatgagggtattatggcggtgggagtcgtttccattctcctctcgagtttactcaaaaatgatgtccccctagcaggacccctaatagccggaggaatgttaatagcctgctatgtcataagtggctctagcgcagatttatcactggaaaaagcggcagaggtgagctgggaagaagaagcggaacactccggggcaagtcacaacattttggttgaggtacaagatgacggaacaatgaaaatcaaagatgaagaaagagacgacaccttaactatactgcttaaagccacccttctcgcggtgtcaggcgtctatcccttgagcattccagccacactatttgtgtggtatttctggcaaaagaagaaacaacgttccggagtattatgggacacaccttctccgccagaagtcgaacgagctgtccttgacgacgggatctatcgtattatgcaaagaggccttctgggtagatcacaagtaggtgtaggagtgtttcaggaaaatgtatttcatacaatgtggcatgtgacacgaggcgcagttttaatgtaccaaggaaaaagattagaacctagttgggcgagcgtcaagaaagatttgatatcctatggtggagggtggaggctgcagggttcctggaatacgggagaggaagtacaagtaatcgcggttgaacccggcaaaaatcccaaaaacgtacagactgcccccgggacatttaaaacccccgagggtgaagtaggtgcgattgcgcttgattttaagccaggaacaagtggttcgccaattgtaaacagagagggtaaaatagtaggtttatacggtaatggtgtagtaacaacaagtggaacatacgtgagcgctatagctcaagctaaagcatcacaagagggcccattaccagaaatagaggatgaagtatttagaaaaagaaatctaacgataatggacttgcatcccggctcaggaaaaaccagacgctaccttccagcaatcgtcagagaagcaattaaaagaaaactcagaactttgatattagccccaacgcgcgtagtggcaagcgaaatggctgaggctttgaaaggcatgcctatccgttaccaaaccaccgcagtaaaaagtgaacacaccggaaaagaaatcgttgatctaatgtgccatgccacttttacgatgcgtctactcagtccggtacgagtgcctaattataacatgattattatggacgaggcacattttacagacccatcttctatagccgctagaggatatataagtacacgcgttggcatgggagaagctgcagctatattcatgactgccacaccaccgggatccgtggaggcttttccccaatcaaatgccgtgatacaagatgaagagagagacataccagagagatcgtggaactcaggatatgaatggattacggattttcctggcaaaactgtctggtttgtaccgagcatcaaaagcggaaacgacattgccaactgccttcgtaaaaatggaaagagagtcatccaattaagtcgaaaaacgttcgataccgaatatcagaaaactaaaaacaatgattgggactatgtagtaacaaccgatatctcagaaatgggggccaactttcgcgccgatagagtgatcgacccacgaagatgtctaaaacctgttatcctgaaggatggacccgaaagagttatccttgccgggccaatgccagtcactgtagcgagcgcagcacagagaagagggcgaataggccgcaaccataacaaagaaggagaccaatatatatatatgggccaaccattaaataacgatgaagaccatgcacactggaccgaagcaaaaatgcttcttgataatatcaatacccctgagggcatcatacctgccttgtttgaaccagaaagagaaaaatccgcagcaattgacggcgagtataggttgagaggggaagcgagaaagacttttgtagaattaatgagaagaggcgatttgccagtttggctcagctataaagtagcaagtgaaggattccaatatagtgacagaagatggtgctttgatggagagcggaataaccaagtattggaagaaaatatggacgtagaaatatggacaaaagaaggagagaggaagaaactgcgaccccgttggcttgatgccagaacatactccgaccctctggctcttagagagttcaaggagttcgcagctggaaggagatcagtgtctggagaccttatcctggaaataggtaaattacctcagcacctgacccagagggcgcaaaacgcgttagacaacctggtcatgttacataactctgaacaaggtggacgagcttacagacatgcaatggaagaactccctgacaccattgaaacgttaatgttattggctcttattgcagtgctaacaggaggagtaacattattctttctttcaggtcggggattgggaaagacaagtatcgggctactgtgtgtaatggcttcaagcgtattgctttggatggctagtgtagagcctcactggattgctgcatcaattattctggagttctttcttatggtcttgctgataccagaaccggatcgccaacgcacaccccaagataatcaattagcatacgtagtgataggactgttgtttatgatattgacggttgctgcaaatgaaatgggactgttagaaaccacaaagaaagacttaggtattggccatgttgccgtagagaaccatcatcacgcaactatgcttgatgtagatctccatccggcctctgcttggactttatatgcggttgcgacaacaataataacaccaatgatgagacacaccattgaaaataccacagcgaatataagtttaacagcaatagcaaatcaagctgcaattcttatgggactggataaaggatggcctatttccaaaatggatattggagtacccttacttgcccttggttgctactcacaagttaatcccctaacacttacagcggcggttctgatgcttgttgctcattacgcaattatcggtcccggtcttcaggctaaagctacacgtgaagctcaaaaacgaacagctgctggaattatgaaaaatcccacagtagatggtattgtagcgatagatttggatcccgtagtttatgacgcaaaattcgagaagcagttagggcaaattatgttattaattctatgtactagccaaatattactaatgagaactacctgggccttgtgtgaatctataacacttgctacagggcccctaaccaccctgtgggaaggatctccgggaaaattctggaatacaacaattgcagtatcaatggccaacatatttcggggttcatacctagcaggagcaggattagctttcagtttgatgaaatcgttgggcggtggtagaagagggacaggggctcaaggtgaaacgttaggagagaaatggaagcggcaattaaaccaattaagtaagagcgaatttaacatttataaaagatcaggcataatggaagttgatcggagcgaagctaaggaagggcttaaaagaggagagacgacacgacacgccgtgtctaggggaacagcaaaattgagatggtttgtagaaagaaatctagtaaaaccagaaggtaaagtcatcgatctaggatgcggtcgtggaggttggagttattattgcgcgggtcttaagaaagtaacagaagtcaaaggatatacgaaaggaggacctggccatgaagaaccaattcctatggcaacatacggctggaatttagttaagttacacagtggaaaagacgtgtttttcacaccacctgaaaaatgtgatacactattatgcgacataggagaatcgagcccaaatcccaccatcgaagaagggcgaacgttgcgagtattaaaaatggttgaaccttggctacgtggaaatcagttttgtataaaaatacttaatccatatatgccatctgtggtagagaccttagaacaaatgcaacgcaaacacgggggtatgctagtgaggaatccattaagtagaaattcgactcatgagatgtactgggtttcatgtggaacaggaaatatcgtatctgccgtcaatatgacaagtagaatgctcctgaatcgtttcactatggcacaccgcaaacctacgtacgaaagggatgtggatttaggagctggcactcgacatgtggccgtagaaccagaggtcgcaaacctagacataatcggacaaagaattgaaaatattaaacacgaacataaaagtacttggcattacgacgaagataatccttataaaacttgggcttatcatggatcttatgaagtaaaaccaagtggatctgcctcgtcaatggtaaatggagttgtgaaactattaaccaaaccatgggacgtgattccaatggtaacccagatcgctatgacagatacaacacccttcgggcaacaacgtgttttcaaagagaaagtggatacacgtacacctaaagcaaaaagaggcacagctcaaatcatggaagtaacagcaaggtggctttggggatttttgagcagaaacaaaaagccgaggatatgcacccgggaagaatttactcgcaaagtaagaagtaacgcggcgattggggcagtctttgtcgacgagaatcaatggaactcagcaaaagaggcagttgaagacgaaagattttgggatttggtcaagaaagaacgtgaattgcataaacagggcaaatgtgcaacatgcgtttataacatgatgggtaaaagggagaagaaattaggcgaatttggtaaagcaaaaggaagccgtgccatctggtacatgtggctaggtgcacgcttcctcgagttcgaggcgcttggtttcatgaatgaagaccattggttcagtcgagagaactctttatcaggtgtagaaggggagggacttcataaacttggctacatactcagagacattagtaaaataccaggtggtaatatgtatgcagatgatactgcagggtgggatacgagaataacggcggatgatttacaaaatgaagcaaaaatcacggatattatggaacctgaacacgcactattagctacatcaatattcaagctaacataccaaaacaaagtagtgagggtgcagcgaccagccaaaaatggaacagtaatggacgtaatatcccgtagagatcaaagaggatccggtcaggtcggaacctatggattaaacacgttcactaacatggaagctcaactaattagacaaatggaatcagaaggcatatttcttccatcagaacttgaaacacctaatctagctgaaagagtacttgactggctggaaaagtacggtgtcgaaagactaaaacgaatggcaataagcggcgatgattgtgtggtaaagccgatagatgatcgatttgctacagcgttgacagcattaaatgatatgggcaaagtccgaaaagatataccacaatgggagccctcaaaaggttggaatgattggcagcaagtcccattctgcagccatcactttcatcagctcataatgaaagacggacgagaaatagtagtgccgtgccgaaatcaggatgaattagtagggcgggcaagagtaagccagggagcagggtggtccttgagagagacggcatgcctcggaaaatcctacgcgcaaatgtggcagctcatgtattttcatagacgagatctacgactcgccgcaaacgccatttgctcagccgtaccagttgattgggtgccgacctccaggacaacgtggtcaattcatgcgcatcatcagtggatgacaacagaagatatgttgtctgtatggaaccgagtttggatagaagaaaacccatggatggaggataaaacacatgtctcaagctggggagatgttccatacttaggcaaaagggaagatcaatggtgcgggagtttaatcgggctaacagcacgcgcgacatgggcgtcaaacatacaagtcgcaatcaaccaagtacgtagactaattggaaacgaaaattacctagactatatgacgagcatgaaacgctttaagaatgagggcgacccagaaggagctttatggtaa

SEQ ID NO: 21844 - RNA, 9879 nt, synthetic construct
  misc_feature 1..9879: note = derived and/or modified CDS sequence (opt6) from DENV-1__GU131770__SS-prME
  source 1..9879: mol_type = other RNA
tccgtaacaatgttattgatgttaatgcctacggctttggcctttcacttaacaacacgcggaggagaaccacatatgatagtttcgaaacaagaaagaggtaaaagtcttttattcaaaacgagtgccggagtcaatatgtgcactttaatagccatggatttaggagaactgtgcgaagatacaatgacatataaatgtccaagaataacagaaacagaacctgatgatgttgactgttggtgcaatgctactgacacatgggtaacatatggaacatgctcgcaaacgggggaacatagacgcgacaaaagatcagtagcactagcaccccatgtcggtttgggtcttgaaacgagaacagagacttggatgtcttcggaaggggcctggaaacaaatacaaagagtcgaaacgtgggccctaagacatccaggatttactgtgattgcactctttttagcccatgcaatcggaacctctattacgcagaaagggatcatattcatattattaatgttagttacgccaagtatggcaatgcgatgcgtaggcataggcagtagggattttgtagaaggtttgtccggtgcaacttgggtagacgtcgtcctcgaacacggctcttgcgtaacaacaatggcaaaagacaaaccaacgttggacattgaattgctcaaaactgaagttacaaacccagcggttctgcggaaactatgcatagaagcgaaaatctcaaatacaacaacagatagtcgttgtcctacccaaggagaggcaacgttagtcgaggaacaagatgctaatttcgtatgcaggcggacttttgtggatcgtgggtggggaaatggctgcggcttatttgggaaaggaagtcttatcacatgcgccaaattcaaatgcgtcacaaaacttgaaggtaaaattgtgcaatacgagaacctaaagtattccgtaatagtaaccgttcacaccggagatcaacatcaagtaggaaacgaaagcacagagcatggaacaactgccacaataactccgcaagcgccgacaacagaaatccaattgactgactatggtgcattaacattagactgtagtcccagaacaggactagatttcaacgagatggtactactgacaatgaaagagaagtcatggttagttcataagcaatggtttctagaccttcccctgccctggacttctggtgcaagtacgtcacaagaaacgtggaacagacaagacctacttgtcacattcaagacagcacatgctaaaaagcaagaagtcgtggtattaggtagtcaggaaggcgccatgcacacggcactaacaggggcgaccgaaatacagacttctggaacaacaacaatttttgcaggacacctcaaatgtagattaaaaatggataagctgactctcagaggaatgagttatgtcatgtgcaccggaagttttaaacttgaaaaagaagtagcagaaacacagcatggtacagttttagtacaaattaaatatgaaggtactgacgcaccctgtaagattcccttttcgacacaagatgagaagggggtaactcaaaatgggcgtttgatcaccgccaatccaatagtcacagataaagagaaacctgtaaatatagaagcagagccaccatttggcgaaagttatatagtaattggtgcaggagaaaaagccttgaaattatcatggtttaaaaagggttcctcgatcggtaagatgtttgaggcaaccgcacggggagcaagacgtatggcaatattaggagatacggcttgggattttggatcgatagggggcgtgtttacaagtgtaggcaaattagtccatcagatatttggaactgcttacggagtactgtttagcggagtctcatggacaatgaaaattggtattggagtcttattaacatggctaggattaaactctcggtcaacaagcctgagtatgacttgtatagctgtaggcttagtcactttatacctaggcgtaatggtgcaagcagattctggttgtgtaattaactggaaaggaagagaactcaaatgtggatctggtatttttgtcactaatgaagtgcatacctggacagaacaatataaatttcaagcagattcgccgaagcgtttatcggccgcaattggaaaggcttgggaagaaggagtctgcgggatccgaagtgccacacgacttgagaatataatgtggaagcaaatatcaaacgaactaaatcatatcctactagaaaacgacatgaagtttaccgtagttgttggagacgtggctgggatcttagctcaaggcaagaaaatgataagaccgcagccaatggaatacaaatactcgtggaaatcttgggggaaagctaaaatcataggcgcagatgtgcaaaatacaacttttatcatagatggccctaatacccctgaatgcccggacgaccaaagggcttggaatatatgggaagttgaagattacggatttggaattttcactacgaacatttggctaaaattaagagattcctacacacaagtctgcgatcataggttgatgtctgccgcaataaaagacagcaaagctgtgcacgcagatatgggatactggattgagagtgaaaagaatgaaacttggaaactggccagggccagtttcatagaagtaaaaacctgcatttggccaaagtctcacactctctggagcaacggagtcttagaatccgaaatgattataccaaaaatctacgggggtcccatttcccaacataattataggccaggatattttacacagacagctggcccatggcaccttggtaaactagaactcgatttcgatttatgcgaaggaacgactgtagttgttgatgagcattgcggtaatagaggaccatcactcagaactacaactgtaacggggaaaatcattcatgaatggtgctgccgatcatgtactttaccaccgttacggtttcggggagaagatggttgctggtacggcatggaaataagacccgtaaaggaaaaagaagaaaacctagttaaatctatggtgagcgctggatccggcgaagtggactcattcagtctggggctattatgtatatccatcatgatcgaggaagtaatgcgaagtagatggagcagaaaaatgcttatgacaggaactttagcagtgttctttctactgataatgggacagctgacgtggaatgatctgatcaggctatgtattatggtaggcgcgaacgcttcagatagaatggggatgggcacaacatatctcgccttaatggcaacattcaagattcgaccaatgtttgcagtcggtctcttatttagaagattgacatcgcgggaagtactgttactaaccattggattatctttagtagcatcggtcgaattgcccaacagccttgaggaattgggagatgggctagcaatggggattatgatcctaaaactattgactgactttcagtcgcaccaactgtgggcaacattattatcattaacatttattaagaccactttcagcttacattgcgcttggaaaacgatggcaatggtattaagtatcgtgagtctatttccactatgtttatcgaccacatcacagaaaaccacgtggctcccagtattgttaggcagcctagggtgtaaaccattgaccatgtttctcatagccgaaaacaaaatatggggacgaaggtcatggcccttaaatgaaggtattatggcggtgggaattgttagcatacttttatcaagtttactgaaaaatgacgtgcccttagctggcccgttgatagcgggtgggatgctaatagcttgttatgtgatttccgggtccagcgcagatctctcactagagaaagcagcggaggtaagctgggaggaagaagctgagcacagcggtgccagtcacaatattttagtagaagtacaagatgacgggaccatgaagattaaagatgaagaacgagacgatactctaacaatactgctcaaagctactttactggctgtgtctggagtttatccactatcgatacccgccacgctctttgtttggtacttttggcagaagaagaaacagagatcaggcgttctttgggatacaccaagcccacctgaggttgagcgtgcagtcctggatgacggtatttatagaattatgcaaagaggactcttaggtcgatcacaagtaggcgttggtgtgtttcaagaaaatgtatttcatactatgtggcacgtaacaagaggagcagttttaatgtatcaagggaaaagattagagccaagttgggcatcagttaagaaagatctaattagttacggtggaggatggcgcttacaggggagctggaatacaggagaagaagtccaagtaatcgccgtcgaaccgggtaaaaatccaaagaacgtccaaacagctcccggaacatttaaaaccccggaaggagaagtaggcgcaatcgcccttgactttaaacccggaaccagtggtagcccgatcgtaaatcgagagggtaaaatagtaggcttatacggtaacggagttgttactacatcaggaacatacgtaagcgcaatcgcgcaagctaaggcaagccaagagggaccactacctgagattgaagacgaagtatttcgaaaacggaatcttacaataatggatttacaccctgggagtggtaaaactaggagataccttccagctatcgtcagagaagcgataaaacgcaaattgagaacattaattttagcacccacaagagtagttgcctctgaaatggctgaggcgctaaaaggcatgccaatacgatatcaaacaacagcagttaagtcggaacataccggaaaagaaattgtcgatttaatgtgtcacgcaacctttacgatgaggttattaagcccagtgcgggttcctaattataatatgattataatggatgaagctcactttacggatccaagctcaatagctgcaagaggatatatttcgacgagagtaggcatgggtgaggccgcggccatatttatgacagcaacaccaccaggtagtgttgaggcatttccacaaagcaatgctgtaatccaagatgaggagagggatatacctgaaaggtcatggaactctgggtacgagtggatcacagatttcccgggaaaaacagtttggttcgtaccttctataaagagcggaaatgacatagcaaattgcttaaggaaaaacgggaagcgagttatacaattatcaaggaagaccttcgataccgagtatcagaaaaccaagaataacgactgggactatgtagtgacaactgacatctccgaaatgggtgctaactttcgcgcagaccgagtaatcgatcctagacgttgtctaaagcccgtaatcctgaaagacggaccagaacgagttatcctcgcaggcccaatgcctgtaacagtggcatctgcagcccaacgacgagggagaattggaaggaaccataacaaggaaggagatcaatacatttatatgggtcagccactgaataatgatgaggatcatgcacattggacagaagcgaagatgttattagacaatatcaacacgccggaaggcatcataccagctctatttgaacctgaaagagaaaaatctgcggctattgatggagaatatagactaagaggagaagcacgaaaaacgttcgtcgagctaatgcgtagaggggacctaccggtatggttgtcgtataaggtagcgtcagaaggctttcagtactcagacagacgttggtgtttcgatggagaaagaaataatcaagtactagaagagaacatggacgtagaaatttggacaaaagagggtgaaaggaagaaactacggcctagatggttagatgctcgtacttattcagaccccttggcgctaagggaatttaaagaatttgctgccggtagaaggagtgtcagtggagacttaattttagaaataggtaaacttccgcaacatttaactcaaagagcccaaaatgctctagataatttggttatgttacacaactcagagcaaggtggccgagcctatagacatgcaatggaagaacttccagataccatagaaacattgatgttgttggcattgatagcagtactcaccgggggtgtaaccctattctttttgtctggacgaggtctaggtaagacgtcaataggactactctgtgtaatggcatcaagtgtcctattatggatggcgtcagtggagcctcactggattgctgcatctataatattagaatttttccttatggtcttattaataccagaaccggacaagcaacgtacacctcaagataaccaactcgcttatgtagtaataggtttattattcatgattttaacagtagcagctaacgaaatgggtctactagaaacaaccaagaaagatctcggaattggacatgtagcagtagagaatcatcatcacgctgccatgttagatgtagacctacacccggccagtgcatggacactatatgccgtagctaccacaataatcacaccaatgatgagacatacgattgaaaatacgacagcaaatattagtttgacagcaattgctaatcaagcggcaatcttgatgggattagataaaggatggccgatatcgaaaatggacataggtgtaccacttctagctttaggttgttactctcaagttaacccgttaacactcaccgctgcagtgctaatgctggttgcacattatgcgataataggaccgggtttacaagcaaaagcgacgcgcgaggcgcagaaaagaacagcagcaggaatcatgaaaaatcccacagtagacggaattgtagccatagatttagacccggtagtgtatgatgcaaaatttgaaaaacaactggggcaaatcatgcttctaatactttgtacatcacaaatactattaatgcgtacaacttgggcattatgtgaaagtataactctagctacaggaccactaacaaccttatgggaaggaagcccaggaaagttttggaatacaacaattgcagtatcaatggccaatatatttagaggtagttatctggcgggtgcagggttagcattttcactaatgaaaagtttaggagggggcagaagaggaactggagcacagggagaaactttaggagagaaatggaagaggcagttgaatcaactcagcaagagcgaatttaacacatataagcggagcggaataatggaggtggatagaagtgaagcaaaggaaggtttaaaaagaggcgaaacaaccaaacacgcagtttcaaggggaactgctaaattaagatggtttgtggaaaggaatctggtaaagccggaaggcaaagtgattgacttgggttgtggtagaggaggttggtcgtattattgtgcaggactaaagaaagtaactgaagtgaaaggatacaccaagggaggtccgggtcacgaagaaccgattccgatggctacatacggatggaatcttgttaaattacatagtggaaaagatgtatttttcatacctccggagaaatgtgacacgttactgtgtgatattggagaatcgtctccgaatcctactattgaagaaggtcgaactttacgagtactaaaaatggtagagccttggttaagaggaaatcaattttgtataaaaatattgaatccatatatgcctagtgtagtagagacactagaacaaatgcagagaaagcacggcggaatgctcgttcggaatccgttaagtcgaaattctactcatgaaatgtattgggtctcttgtggtacggggaatatagttagcgccgtgaatatgacgagtagaatgttactaaacagattcacaatggcacataggaagccaacatatgaaagggatgtagacctgggtgcaggaacccgacatgttgctgtagagcctgaagtcgccaacttggacatcataggtcaacgaatagaaaatataaaacatgagcataaatcaacgtggcactacgatgaggacaacccttacaaaacctgggcttaccatggaagttatgaagttaaaccgtctggatctgcttcatcaatggtaaacggcgttgtaaaattgctgactaaaccatgggatgttatacctatggttacacaaatcgctatgacagatacaactcctttcggtcagcaaagagtattcaaagagaaggtagacacacgaactcccaaagcgaaaagggggaccgcgcaaataatggaggttaccgcaaaatggttgtggggcttcttatcgagaaataaaaagccaagaatctgcaccagagaggaatttacacgaaaggtgcgttcaaacgcagcaattggcgcagtatttgtggacgaaaatcaatggaactccgctaaagaggccgtggaagatgagagattttgggacttagttcaccgggaaagagaactacacaagcagggtaagtgcgctacttgtgtctataacatgatgggaaaacgtgagaagaaactaggcgaatttggaaaagcaaaaggctcaagggcaatatggtacatgtggttgggcgcaagattcctagagttcgaagccttgggtttcatgaacgaagatcactggttctcacgagaaaacagtctctcaggagtagaaggagaaggactacataagctaggatacatcctccgagatatttcaaaaatacccggtggcaatatgtacgcagatgatactgcagggtgggatacaagaatcaccgaagatgatcttcaaaatgaagcacgtataaccgatatcatggagccagaacacgcattattggccaaatcaatatttaaactaacttatcagaataaagtagtccgagtccagcgcccggctaaaaatggtacagtgatggatgttatatcccgaagggaccagcggggaagtggtcaagttggaacttacggcctgaacaccttcacaaatatggaagcccaacttataagacaaatggagagtgagggaatttttagcccgtccgaactagaaacacccaatctagctgaacgggttttagattggctggagaagtatggagtagaacgtttaaaacgaatggctatatcaggtgatgattgtgtagtcaaacccattgacgacaggtttgcaacagcgctaaccgcacttaacgatatgggaaaagtaagaaaagacatacctcaatgggaaccatcgaagggctggaatgattggcagcaagttccgttttgttcacaccacttccatcaattaataatgaaggatggtagagaaatcgtagtaccctgtagaaatcaggatgagttggtaggacgtgctagagtgtcacaaggcgctggctggtcgttaagggaaactgcatgcctaggaaagagttacgcgcaaatgtggcaattaatgtattttcataggcgagatctgcgactagcagctaatgcaatatgctctgccgtgccagtagattggatacctacatcccgtaccacgtggtcaatccatgctcatcatcaatggatgacaacagaagatatgttatcggtgtggaatagagtttggattgaagagaatccatggatggaagataaaacgcatatctcatcttggggagatgtaccttacttgggaaaaagagaggatcaatggtgtgggagtctcataggacttactgcaagagctacttgggcaacaaacatacaagtcgcaataaaccaagttagacgattaataggaaatgaaaactatttagattatatgacatcaatgaaacggtttaaaaacgaatcggaccctgaaggagcactctggtag

SEQ ID NO: 21845 - RNA, 9879 nt, synthetic construct
  misc_feature 1..9879: note = derived and/or modified CDS sequence (opt6) from DENV-1__GU131773__SS-prME
  source 1..9879: mol_type = other RNA
tcagtaacaatgctacttatgttaatgccgacagcactagcattccacctaactacaagaggaggagagccgcacatgattgtttcaaaacaagaacgagggaaaagcctactatttaaaacatcagccggtgtaaatatgtgcacactaattgcaatggatttgggcgaactatgtgaagatacaatgacatacaagtgtcctcgaataacagaggcagagcctgatgatgtagactgttggtgtaacgcaacagatacatgggtaacttatggtacatgttcccaaactggcgaacatcgtcgtgagaaaagatcggttgctttagccccacacgtggggttgggtttagaaacacggacggaaacatggatgtcgtcagagggtgcatggaagcagattcaacgggttgaaacttgggcattaagacacccaggttttacagtcatagctcttttccttgcccatgctatcggtacgtctatcactcaaaaagggatcatattcatactgttaatgttagttacgccatctatggcgatgcggtgcgttgggataggttcacgagacttcgtagagggtttgtccggtgcaacatgggtcgatgttgtattagagcatggctcttgtgtcacgaccatggcaaaagataaaccaactttagatattgaactactaaaaacggaggtaacaaacccagcagttttaagaaaactttgtatagaagcgaaaatatcgaacacaactacggattcacggtgtcctactcaaggagaagctaccctagttgaagaacaagatgctaatttcgtatgtcgaagaacctttgtagaccgcgggtgggggaatggatgtggtctattcggaaaaggatcactactaacttgtgctaagtttaaatgcatgactaaactggaaggaaagattgtgcagtatgaaaatcttaaatactccgtaatagtaactgtacacacaggggatcaacaccaagttggcaacgaaagcaccgaacatggtacaacggccacaatcactccacaagcgcccacgactgaaatccaactaactgattacggagcgctcactttagattgttcacccagaacaggattagatttcaacgaaatggtcctgttaactatgaaggaaaaatcatggctggtacacaagcaatggtttctagatttacctcttccgtggacctcaggagcaagtacgtcacaagaaacatggaatcgacaagaccttttagtaacattcaaaactgcacacgcgaaaaagcaagaagtagtggttttaggaagccaagagggcgcaatgcacacagccttaaccggagcaaccgaaattcaaacaagcggcactactacaatcttcgctgggcatttaaaatgtcgtttaaaaatggacaagttgacactcaaaggtatgtcatatgtcatgtgcactggatcattcaaacttgaaaaggaggttgcagagacacagcacggaacagtgctagtacaaatcaaatatgaaggaaccgatgcaccctgcaaaattccattctctacccaagatgaaaaaggtgttacacagaatgggcgcctcataaccgcgaatccgatagtaaccgacaaagaaaaaccagttaacatcgaggcagaacccccgtttggagaaagttatattgttatcggagctggagaaaaagcactgaagctatcctggttcaagaagggttccagtataggaaaaatgttcgaggcaacagcaagaggagcgcgacgcatggcgatactcggtgataccgcatgggattttggaagtatagggggtgtgttcactagcgtgggtaagttggtccatcaaatttttgggaccgcgtacggggtcttgttcagtggggtatcgtggacaatgaaaataggaattggcgtcctactaacatggcttggtcttaattcccggagcacctcactctcgatgacttgtatagcagtaggtttggtgaccttatacctgggagtgatggtacaagctgactcaggttgcgtaatcaattggaaaggaagggaactaaaatgtggctcgggaattttcgttacaaatgaagtccacacatggacagaacaatacaaatttcaagctgactcccccaaaaggctctccgcggcgataggcaaagcatgggaagaaggtgtctgcgggataaggagtgcaacccgtctggaaaacataatgtggaaacagatctctaatgagttaaaccatatattgcttgaaaacgatatgaaatttactgtggtggtaggtgatgtcgcaggtattctagtccaggggaagaaaatgatacgaccgcaaccaatggaatataaatattcctggaaaagttggggaaaagctaaaataataggtgcagacgtacaaaactcaacctttataatagatggccctaacacaccggaatgcccagatgatcaaagagcttggaacatatgggaagttgaagattacggattcgggatatttactaccaacatatggctaaagctaagagatagctacacgcaggtttgtgaccatagattaatgtcagcggctataaaagattccaaagcagttcacgcagatatgggatactggattgaatcagagaagaacgagacgtggaaattagctagagcatcttttattgaagtcaaaacatgtatttggcctaaatcccacacactatggagtaatggtgttctagaaagcgaaatgatcatacctaaaatacatggcggacctattagtcaacacaactataggcctgggtactttactcaaaccgcaggaccatggcacttgggtaaattggaactagactttgatttatgcgaagggaccacagtcgtcgtagatgaacactgcggaaataggggtccgagcctacgaactacaaccgttaccggaaaaattatacatgaatggtgctgccggtcatgcacattaccaccacttcgatttcgaggtgaggatggatgctggtacgggatggaaattagacccgtaaaagaaaaagaagagaatctcgtaaaatctatggtaagtgcaggatccggagaagttgatagctttctgttaggattattatgtatatctataatgattgaagaagtaatgcgttctcgctggtctagaaaaatgctcatgacaggtacactcgctgtattctttttgcttataatggggcaactgacctggaatgatctaattagattatgcataatggtcggagccaatgcgtcagaccgaatggggatgggaacaacctatctggctttaatggcaacttttaaaatgcggcctatgttcgcggttgggttattgttcagacgcttaacaagtcgtgaagtattattgttaacaataggactctcccttgtagctagtgtagaattacctaatagtcttgaagagttaggagacggacttgcaatgggtattatgatattaaaactattaactgactttcagtcataccaactttgggcgacactattatccttaacgtttataaaaaccacatttagcttacattacgcatggaaaacgatggctatggttctgagtatcgtatccctatttccattatgcctcagtacaacttctcagaagacaacatggttaccagtgttgcttggctcactgggctgcaaaccactcactatgttcctgatagccgagaataaaatttggggccgaaaatcttggcctctaaatgagggaatcatggcggtgggaatagtgagtatcttattatcaagtttactcaaaaacgacgtaccacttgccggaccgttaattgctgggggaatgctaattgcctgctatgtaatttctggtagcagtgctgacctatcactcgaaaaagcggcggaagtatcatgggaggaagaggcagaacacagtggagcaagtcacaatatcttagtggaagtacaagatgacggtaccatgaaaataaaagatgaagaaagggacgatactctaactattttattgaaagctacgctgttggcggttagcggggtctacccattgtctatccctgcgactctgttcgtatggcatttctggcagaagaagaaacaaagaagtggtgtgttatgggatacaccttcacctccagaggtagaacgagctgttctagatgatggcatatatagaataatgcaaaggggtctactcggacgctcccaagtaggggttggtgttttccaagaaaatgtctttcacacaatgtggcatgtcacacggggagcagttctgatgtatcaaggaaaacgattagagcctagctgggctagcgtgaagaaagaccttatatcttacggagggggatggagatttcaaggctcgtggaacaccggcgaagaagttcaagtcattgcggtagaacccggcaaaaaccccaaaaacgtccaaaccgcaccaggcacctttaaaacacccgaaggtgaagtaggtgccatcgctttggactttaaaccagggacctctggtagccctatagtaaatagagagggtaaaatagtaggcctttatgggaacggagtggtaacgacaagcggcacatatgtctccgccattgcgcaagcaaaggcttctcaggagggccccttaccagaaatcgaagacgaagtatttcgtaaaaggaatttaacaataatggatctccacccaggtagtggaaaaacaaggagatatcttcctgccatcgtaagagaggcaattaagcgaaaacttaggacactcattctcgctcctacacgtgtagtagcttcagagatggcagaagcacttaaaggcatgccaattcggtaccaaacaaccgctgttaaatcagaacatacaggcaaagagatagtcgatctgatgtgtcatgcgaccttcactatgagactactcagccccgtaagagttcctaattataacatgataatcatggatgaagcacatttcaccgacccatcctcaattgctgcaagaggctatatctctacacgagtaggtatgggtgaagcagcagcaatatttatgactgcaacaccaccagggagtatggaagcattcccacagagtaacgcagtgattcaagatgaggaacgtgacatacctgagcgtagttggaatagcggctacgaatggatcaccgatttccccggaaaaacagtatggtttgttccaagcatcaaggcaggtaacgatattgcaaattgcttgagaaagaacggaaagagagtaatacagttgtcaagaaaaacgttcgacacagaatatcagaaaaccaaaaataatgactgggattacgtggttacaacagatatatctgaaatgggggctaactttagggctgacagagtcatagatcccagaaggtgcctaaaacccgtaatcttgaaagacggaccagaaagagtaatattggccggacctatgccagtaactgtagcctctgctgcacaaagacgaggacgcataggaagaaaccataacaaggaaggggaccaatacatttacatgggacagccactaaacaacgacgaggatcacgcccactggacggaagcaaaaatgctactagacaatataaatacgcccgaaggtattatccctgcgctctttgaacccgaaagagagaaaagcgcggccatagatggagaatatcggcttcggggcgaagcaagaaagacgttcgtagaattaatgagacgcggagatctgccggtctggctatcctacaaagttgcaagcgagggattccaatatagtgatcgtaggtggtgttttgatggagagcgtaacaatcaagtattggaggaaaatatggatgtcgaaatctggactaaagagggagaaaggaagaaattacggccgagatggctggacgcacgcacttactcggacccattagccctccgtgagtttaaagaatttgccgcaggacgccgctcagtgtcaggggacttaattttggagatcggcaagttaccacaacatctaactcagagagcacaaaacgccctagataatctagtaatgttacataattcagaacaaggagggagagcttataggcacgcaatggaagaactaccagacacaatagagactcttatgttattagctttgatcgcagtattaacaggaggagtaacacttttcttcttgagcggtaaagggttaggaaagacatcgatcggactgctatgcgttatggcttcgtcagtattgttatggatggctagcgtagagccacactggatcgccgcatcaatcattttagagttctttctgatggtgttactaatacctgaaccggaccgacaaagaaccccgcaagacaaccaactggcctatgtggtgatcggcttgttatttatgatactcacagtagcagcaaatgaaatgggactcttagaaactaccaagaaagatttgggaataggacatgtggcagtcgaaaaccaccaccatgcagccatgcttgatgtagacttacaccctgcttcagcgtggacattatatgcggtagccactacgattattacaccaatgatgaggcacactatagaaaatacaacagcaaatatttcattaacagcaatcgcaaatcaagcagcaattttaatgggtttggacaaaggttggcctatcagtaagatggatattggggtaccattattagcactaggatgttacagtcaggtaaaccctctcacattgacggccgcggttttaatgcttgtggcacactatgcgataataggcccaggattacaagctaaagctacgagagaagcgcagaagaggactgcggccggcataatgaaaaacccaacaatcgacggtatagtggctatcgatctcgatcctgttgtctacgatgcaaaatttgagaagcagttaggtcaaatcatgttgttaatactatgtacatctcaaatactattaatgagaacgacgtgggcattgtgcgaatcaataactttagcaactggaccccttacaaccctctgggaaggatcaccaggaaaattttggaatactaccatagcagtttctatggccaatatattccggggctcttatctagcaggcgcagggttagcgttcagcctaatgaagtcgctgggtggaggcagaagagggaccggagcccaaggagagacactaggggaaaaatggaagcggcaactaaaccaactatccaagtcagaatttaacacatacaaaaggagtggaattatggaagttgatagatcagaagctaaagagggactgaagcgaggagagacaactaagcacgcggtttctaggggaactgctaaattgaggtggtttgtcgagcgtaatttggtgaaacctgaaggcaaagtgatagacttaggatgtggaagaggcggatggtcttactattgtgctgggctcaagaaagtgactgaagtaaagggttatactaaaggagggcccggacacgaagaaccaatcccaatggctacctatggttggaatctggtaaaactacattccgggaaagacgtcttcttcataccaccagaaaaatgtgatacgttattgtgcgatattggagaaagcagccccaacccgacgatagaagaaggtcgaacactcagagtattaaagatggttgaaccatggttaaggggaaatcaattttgtatcaagatccttaatccatatatgccgagtgtagtagaaacactagaacaaatgcaacgcaagcatggagggatgttagtcagaaacccactatctagaaacagcacacatgaaatgtattgggtatcctgcgggaccggaaacatagtctcagcagtaaatatgaccagtcgtatgctattaaatcgattcacgatggctcacaggaaaccaacgtatgagcgagacgttgatttaggagcggggacgaggcacgtagcagtggaaccggaggtagcaaatttagatatcataggacagcgtatagaaaatatcaaacacgagcataagtctacatggcactatgatgaggacaacccttacaaaacatgggcgtatcatggctcatacgaagtaaaaccaagcgggtcggcgagcagtatggtaaacggtgtagtaaaacttctgacgaaaccatgggatgtaatacctatggtaacgcaaatagccatgacagacaccacaccattcggacaacaacgggttttcaaggaaaaagttgatacgaggacaccaaaagcgaagcgtggaacagcgcaaattatggaagtcacagctcgttggttatgggggtttctatctcgtaacaagaaaccaaggatatgtactagagaagaatttacacgcaaagttagatccaacgcagctataggagcggtatttgttgatgaaaatcagtggaactccgcgaaagaagcagtcgaagatgatagattttgggatctagtgcacagagaacgagaactacacaaacaagggaaatgcgcaacatgcgtatataatatgatgggaaaaagggagaagaaattgggagagtttggtaaggcaaaaggtagccgggcaatctggtacatgtggctaggtgcacgcttccttgaatttgaggctttgggatttatgaatgaagaccactggttcagcagagaaaattctctctccggagttgaaggagaagggttacacaagttgggatacatattacgagatatatcaaaaatccctggtggaaacatgtatgcagatgataccgcaggttgggacacaaggatcactgaagatgacctgcagaatgaagcaaaaataactgacattatggaaccagaacacgcactattagcaaaaagcattttcaaacttacctatcaaaataaagtagtaagagtgcagcgtccagcgaagaacggtacggtaatggatgttatatctagacgagatcaaagaggcagtggtcaagtgggaacttatggtttaaatacattcacaaatatggaagcccaacttatacgacagatggagtctgaaggaatttttctaccgaacgagttagaaacaccaaacctggcaggaagagttctggattggcttgaaaaatatggagtagaaagacttaaaagaatggctattagtggggacgactgtgtagtcaaaccaattgatgaccgtttcgcaacagccctaaccgcactcaacgacatgggtaaagttagaaaggatataccacaatgggaacccagtaaaggatggaatgactggcagcaagtcccgttctgcagtcatcatttccaccaactaattatgaaagacggacgagaaatagtagttccatgtagaaaccaggacgaacttgtggggagagctcgagttagccagggggctggatggtcactccgtgaaacagcttgcttgggaaaaagttatgcccaaatgtggcagttgatgtactttcatagaagggacctaagactagcagcaaacgctatatgctcagcagttcctgtagattgggttccaaccagtcggaccacctggtcaatacatgcacatcaccaatggatgactacggaggacatgttatcagtatggaatagagtttggattgaagaaaacccttggatggaagacaaaacccgcatttcttcgtgggaagacgtaccatacctaggaaagagagaagatcaatggtgtgggagtcttattggacttactgctagagcgacatgggcaactaatatacaagttgcaataaaccaagtacgtagactaatcgggaatgaaaattattcagattatatgacatctatgaaaagatttaaaaacgaatctgaaccagaaggagcactgtggtga

SEQ ID NO: 21846 - RNA, 9879 nt, synthetic construct
  misc_feature 1..9879: note = derived and/or modified CDS sequence (opt6) from DENV-1__GU131775__SS-prME
  source 1..9879: mol_type = other RNA
agcgtgaccatgcttcttatgctgatgccgactgcattagcatttcacctcactacacgcggtggggagccacacatgattgttacaaagcaagagagagggaaatcccttctcttcaaaacaagtgcgggtgtaaatatgtgcacactaatagcaatggaccttggagagttatgtgaagacaccatgacatataaatgccccagaataaccgaggcagaaccggacgatgttgattgctggtgtaacgctaccgacacatgggtgacctatggtacatgtagtcaaactggcgaacatcggagagacaagcgcagcgtagctttggcaccacacgtgggtttaggtctggagacacgaacagaaacttggatgtcaagtgaaggcgcttggaaacaaatacaacgagtcgaaacctgggcgcttcgacacccaggatttacggtgatagcactgtttctagctcatgcaattggaacaagtataactcaaaagggcataatctttatattattgatgttagtcaccccatctatggctatgagatgcgtcggcattggctcccgagattttgttgagggcttatcgggtgctacttgggtggacgtagttcttgaacatggatcatgtgtaactacaatggcaaaagataaaccaaccctagacattgaacttttaaaaacggaagttacaaacccagctgttctacgtaagctatgcatcgaagccaaaatcagtaacactacgacagattcaagatgccccacccaaggcgaagcaacactcatggaagaacaagacgccaattttgtgtgtagaagaacatttgtcgatcgaggttggggaaatggatgtggactatttggcaaaggcagtctcattacatgtgctaaattcaaatgtgtaactaaacttgaaggtaagatcgtacaatatgaaaacctaaaatattccgttgttgtaacagtccatacaggtgaccaacaccaagtcggcaacgagtcaacagagcacggcactacggcaacaataactccccaagcgcccacctctgaaatacaacttacggactacggtgcactgacattagactgctcgcctaggacaggcctagactttaacgaaatggttttattaacgatgaaagaaaagtcgtggcttgtgcacaaacaatggttcctagatctaccgctcccttggaccagtggggcatcaacaagtcaagagacatggaaccgacaagatttactcgttacttttaagacagcacacgccaagaaacaagaagtagttgttctcggatcacaggaaggagcaatgcacactgcactgacaggtgctaccgaaatacagaccagtggaacaacaacaatctttgcaggtcacctcaagtgtagacttaaaatggataaacttactttaaaggggatgagctacgttatgtgtaccggaagttttaaattagaaaaagaagttgccgagacccaacacggtacagttttggttcaaataaaatatgagggaacagacgcaccttgcaaaattcctttctcgacccaagacgaaaagggggtaacacagaacggcagactcataaccgcaaaccccatagtaacagacaaagaaaaaccagtcaacattgaggcagagcccccgtttggcgaatcttatatagtgattggggctgggggcaaagctctaaagttatcatggttcaagaaaggaagtagtataggcaaaatgttcgaggcaacggcacgaggcgctagaagaatggcaattctgggggatacagcctgggactttggaagtgttggcggtgtttttacctctgtaggaaagttagtacatcagatatttgggacagcctacggcgtattattcagtggagttagctggactatgaaaatcggaattggggttttattgacgtggctgggactaaattcaagatccacgagtctaagcatgacatgtatagcagttggcctagtaacactttacttgggtgttatggtccaagcggatagcgggtgcgtaataaattggaaaggtagagaattgaaatgtggatcgggtatatttgttacgaacgaagttcacacctggacagaacaatataagttccaagcagactcacccaagagactgtctgcagcaataggtaaagcatgggaagagggtgtatgtggaattagatctgccaccaggctagagaatattatgtggaaacagataagcaacgagttgaatcatatattattggaaaatgacatgaaatttacagtagttgtcggagatgtagtaggcatactcgcacaaggcaagaaaatgataaggcctcaaccaatggaacataagtacagctggaagtcatggggtaaagcaaaaatcattggggcagacgtgcagaacacaacttttataatagacggacctaacacacctgaatgtcccgatgatcaacgtgcttggaacatctgggaagtggaggactacggatttggtatattcacaacaaatatctggcttaaattgcgggactcttacacacaagtctgtgatcacaggttaatgagcgcggcaatcaaagacagcaaagcagtgcatgctgatatgggatattggatagaaagcgagaaaaatgagacctggaaattagctagagccagctttatcgaagtcaaaacttgcatctggcctaaaagccacacactttggagtaatggcgttttagaatcggaaatgattattccaaaaatatacggcggcccaatctctcaacataactaccgaccgggttactttacccaaacagcaggtccatggcatctaggcaagctcgagctagactttgatttgtgcgaagggactactgttgttgttgacgaacactgcggaaaccgcggaccgtcgttacgtactacaactgtaacgggaaaaataatacatgaatggtgctgtagaagttgtacactaccccctctaagattcaaaggggaagatggttgctggtatggtatggaaatacgaccagtaaaggagaaagaagaaaacttggtgaaatctatggtttctgcaggatcaggcgaagtggactcttttagtctcggtcttttatgcataagtatcatgatagaagaagtaatgcggagcagatggtcaagaaagatgttaatgacggggaccttagcagttttcctcctattaataatgggtcaactgacttggaacgatctaatacgattgtgcattatggtaggagcgaacgcgagcgacagaatgggtatgggaacaacatatctagcattgatggccacttttaaaatgagaccaatgtttgcggtagggctccttttcaggcgtctaacgagtagagaagtactattacttacaataggactttctttagtcgctagcgtagaattgccaaacagtctagaagaactcggtgacggcctagctatgggtattatgatcttgaagttactaacagattttcagagtcatcaactatgggcgactttattaagcctaacttttatcaaaacaacattatcattacactacgcttggaaaacaatggcaatggtacttagtatagtgagtctgtttccgttatgtctcagtacaacctcccagaaaacgacatggttaccggtactcctgggctctctgggatgcaagcctttaaccatgttcttgatcacagagaataaaatatggggccgtaaaagttggccactaaatgaggggatcatggctgtaggggttgtatcaatactgttaagttctcttctcaaaaatgacgtcccattagcaggacctttaatagcgggtggaatgctgattgcttgttatgtaataagtggatcgtccgcagatctatcattagaaaaggctgctgaagtcagttgggaagaggaggctgaacacagcggtgcctcccataatatccttgtcgaagtccaggatgacggaaccatgaagatcaaagatgaggaaagagatgacacactcacaatactactcaaagctactttattagctgtgtctggcgtctaccctctatccatacccgcaacattattcgtatggtacttctggcagaagaagaaacagcgaagcggcgttctatgggatacgccatctccccctgaggtggagagggctgttcttgatgacgggatctatagaataatgcagagaggactattagggcgatctcaagtaggggttggagtctttcaagaaaacgtattccatacaatgtggcatgtaactcgaggagctgtactaatgtatcaagggaaaagattagaaccatcatgggccagtgtgaaaaaggatctaatatcatatggtggtggttggcgacttcaagggtcatggaacacaggtgaagaagtccaagtgatagcagtcgaacctggaaagaaccctaaaaacgtacagacagctcctggaaccttcaaaacaccagagggtgaggttggggcaattgcgttggactttaagcctggaacgtctggttctccgatagtaaacagagaaggcaaaatagtcgggctatacggaaatggcgtagtgacaacatcaggaacttatgtatctgcgatcgcacaagcaaaagcaagccaagaaggaccattgcctgaaatagaagatgaagtgttcagaaaacgaaatctaactattatggacctccatccagggagtggaaagacacgacgatatttaccggctattgtcagagaggctataaaaagaaaacttagaaccttaatcctcgctcccacccgagtggtagcatccgaaatggctgaagcgctaaaagggatgccaattagatatcaaacaacagcagtaaaatcagaacatactggtaaagaaatagtcgatcttatgtgtcatgctacgttcacaatgagattgctaagcccagtaagagtccctaattataatatgataataatggatgaagctcattttacagatccttcatctatagcagctagaggctacatctcgactagagttggcatgggagaggcagccgctatatttatgacggcgacgccaccgggtagtgtagaagcatttccgcaatcaaacgcagtaatacaggacgaggaacgtgatatacctgaaagatcgtggaactcaggttatgaatggattaccgactttccaggtaagactgtatggttcgtaccatcaatcaaatcgggaaatgatatagctaattgcctaaggaaaaacggcaaacgagttattcaactaagtaggaaaacgttcgacacggaataccagaaaaccaaaaataatgattgggattacgtagttacgacagacatctccgagatgggcgctaattttcgtgcagacagagtcatcgatcccagacgttgcctaaagccagttatactcaaagacggaccggaaagagttatattagcaggacctatgcctgttacggtagcatcagctgcacaaagacgaggccgcattggaagaaatcacaataaagagggtgatcaatacatttatatgggacaacccctaaacaacgatgaagaccatgcacactggacagaagctaagatgcttctggataatattaatacaccagaaggcataattccggcattattcgaaccggaacgagaaaagtctgcggcaattgacggagaatataggcttagaggtgaagcacgtaaaactttcgttgaactaatgagaaggggtgatctgccagtttggctctcatacaaggttgcatcagaaggcttccaatattcggataggcgatggtgctttgatggtgaaaggaataatcaggtacttgaagaaaatatggatgtagaaatttggactaaggagggagaaaggaagaaactaagacctagatggctcgacgctagaacctactccgatccactagccctacgagaatttaaagaatttgctgcgggacgtagatcagtatcaggagatctgatactggaaattggaaaactcccccaacatttaacgcaacgtgctcaaaatgccctagacaaccttgtaatgttacataattcggaacagggcggtcgagcttacagacacgcaatggaagaattgccggatactatagagacattaatgttactagctttaatagcagttcttactggaggggtcaccttatttttcctgagtggacgtggcttaggtaaaaccagtataggcttactatgtgttatggcatctagcgtcttattgtggatggcgagtgtcgaaccacattggatagcagcctcaatcatcctagagttctttcttatggtccttctaattcccgaaccagacagacaaagaactccccaagataatcaattagcatacgtagtaattggacttctatttatgatcctaaccgtagcagccaacgaaatggggttattagaaacgactaagaaagatctcggtattggtcatgtagccgtagagaatcaccaccatgcaactatgttggatgttgacctacaccctgcaagcgcctggaccctttacgcagtagcaacaacgataattacaccgatgatgcgacatacaattgaaaataccacagcgaacataagtttgacagctatagcgaatcaggctgcaatattaatgggacttgataaaggttggccaatctcaaaaatggatataggagtaccattgttagcattaggttgctactcgcaagtaaatccactcacattaactgcagcggtattgatgttagtagcacattacgcgattatagggcctgggctgcaagcaaaagcaacgagggaagcacagaagcggaccgcagccggaatcatgaagaatccaacagtggatgggatagtagcgatagacctagacccagtcgtttacgatgcaaaatttgaaaaacaactgggacaaattatgcttcttatactttgcacctcgcaaattttgttaatgcgaacaacgtgggcgttgtgtgaatcaattacactagccactggacctttgacaacactatgggagggctcaccgggaaaattctggaatacgacaatagctgtgtctatggcaaacatatttagaggaagctatctagccggtgctggactcgcttttagtctgatgaagagtctaggcggcggaagacgaggcaccggcgctcaaggggaaactctgggtgagaaatggaagagacaactaaaccagctatcgaaatcagaatttaatatttataaaagatcaggtataatggaggtagatagatcagaagccaaagagggattaaaaagaggtgaaactacaagacacgcagtgagcaggggaacggcaaaacttcgatggtttgttgaaagaaatttagttaaacctgagggaaaagttatagatttgggatgcggaagaggaggatggtcgtattattgtgcgggtttgaagaaagtaaccgaagtaaaaggatatacaaaagggggaccaggtcatgaggaacccattccaatggcaacttacggatggaacctggttaaattacattctggcaaggatgtattctttacaccacccgaaaaatgtgacactctattatgtgacataggtgaaagttctccaaacccaacaatcgaggagggtagaacgttaagggtattgaaaatggtcgaaccgtggctacgcggaaatcaattttgtattaagatacttaacccttacatgccaagtgtggtggagacattagaacaaatgcagcgtaagcatggtggcatgttagtgaggaaccccctcagcaggaactccacccatgaaatgtattgggtcagttgtggaacgggaaatatagtatctgcagtaaatatgacgagcagaatgcttttgaatcgttttacaatggctcataggaaaccaacatacgaaagagacgtagatttgggagctggaactagacatgtcgccgtggaacctgaagttgctaacctggacattataggtcagcgtattgaaaacattaaacatgaacacaaaagcacttggcattatgatgaggacaatccatacaagacttgggcttaccacggatcatatgaggtaaagccaagtggatcggcaagttcaatggtaaatggagtcgttaaattactgacaaagccatgggatgtaatacccatggttacacagattgcaatgacagacacaacacccttcggacaacagagggtattcaaagaaaaagtagacactagaactccaaaagcaaaaaggggcactgctcaaattatggaggttacggctcgttggctatggggattccttagtcgtaataaaaagcctagaatatgcacacgtgaagagttcacacgtaaagttcgtagtaatgcagcaatcggagccgtattcgttgacgagaaccagtggaactccgctaaagaggctgtggaagatgagcgcttctgggacctggtacaaaaggaaagagagctacataaacaagggaaatgcgccacctgtgtctataatatgatgggtaagcgtgaaaagaagctcggggaatttggtaaggcgaaagggagtagagctatttggtatatgtggttaggggccagatttcttgaatttgaagctctgggtttcatgaatgaagatcactggttcagcagagaaaattcattatccggtgtcgagggagaagggttgcacaaacttggctacatacttagggacatatccaaaataccaggcggtaacatgtatgcagatgatactgcaggctgggatacacgtattactgaggacgacttacagaatgaagccaaaattaccgatattatggaacccgaacatgcactacttgctacaagtattttcaaattaacgtaccaaaataaagtagttagagtccagagacctgcgaagaatggtacggtaatggatgtgatatcaaggcgcgatcaaaggggaagcggtcaagtagggacttatgggttgaatacatttacaaatatggaagcccaattgatccgccaaatggaaagcgagggtatatttcttccatcagagttagaaactccgaatctagccgaacgagtgctggactggcttgagaaatatggtgtagagaggcttaaaagaatggcaatatcaggagatgattgtgttgtcaaaccaatagatgataggtttgcgaccgcattaaccgctctaaatgatatgggaaaagtaagaaaagatataccccagtgggaaccaagtaagggatggaatgactggcaacaggtacccttttgtagtcatcactttcaccagttaatcatgaaagacggacgagagatagttgtgccttgtaggaaccaagacgagttagttggtcgagctcgcgtaagccaaggggcgggatggagtctcagagaaactgcatgcttaggaaaaagttatgctcaaatgtggcaattaatgtactttcatagacgtgaccttaggctagccgcaaacgccatatgttctgccgtacctgtggactgggtacctacatcacgtactacatggtctatacatgctcatcaccaatggatgacgacagaagatatgctttcggtttggaaccgagtctggatcgaagaaaatccatggatggaagataaaacgcatgtgagcagttggggagatgtcccttatttgggcaaacgagaagaccaatggtgcggatctctaatcggccttacagcaagagctacctgggctagcaacatccaggtcgcgataaaccaagttaggcggctgataggaaacgaaaactatttagattacatgacatcaatgaaaaggttcaaaaacgaaggtgaccccgaaggtgctctttggtag

SEQ ID NO: 21847 - RNA, 9879 nt, synthetic construct
  misc_feature 1..9879: note = derived and/or modified CDS sequence (opt6) from DENV-1__GU131777__SS-prME
  source 1..9879: mol_type = other RNA
agtgtaacgatgctattgatgttaatgccaactgcactagcattccacttaactactcgaggaggggaaccacacatgattgtctctaaacaagaaagggggaaatctttgctattcaaaactagcgccggagttaacatgtgcactctaattgcaatggacctcggagaactttgcgaagacacaatgacttataaatgtcctaggataacagaaacggaacccgatgacgtcgattgttggtgtaacgcaacggacacctgggtgacttacggaacctgctcgcaaaccggcgaacatcgacgggataaacgatcagtagcacttgcaccccatgttggtctgggactggaaactagaactgaaacctggatgagttctgaaggggcatggaaacaaatacaaagagtagaaacctgggccttaaggcatcccggttttacggtaattgctctattcctagcgcatgcaataggaacgtcaatcacacaaaaaggaataatatttatcttattaatgttagttacgccatcgatggcgatgcgatgtgtaggaattggaagtcgagactttgtcgaaggtctcagtggggccacgtgggtcgatgttgttttagaacacgggagttgcgtaaccacgatggctaaagataaacccacacttgatatagaacttctaaaaacagaggttacaaatcccgcgattctaaggaaactgtgtattgaggccaaaataagcaatacaacgaccgatagccgctgtcctactcagggtgaggctactctcgtagaagaacaggatgcgaattttgtctgccgacgaacatttgtcgacagaggttggggtaacggatgtggattattcggaaaaggcagtttgataacctgtgcgaaattcaaatgtgtcacgaaactcgaaggcaaaattgtacaatatgaaaatctgaaatactccgtaatcgtgactgtacatacaggagaccaacatcaagtaggaaatgaaagtacggagcatggaacaactgcaacaataacaccgcaggcaccaactacagagatccaacttacagactatggtgctttaacgctggattgctcgccaaggactgggttagacttcaatgagatggttttactgactatgaaagaaaagtcatggttggtacacaaacagtggtttttagatctcccacttccttggacgagtggagcaagtacttctcaagaaacctggaataggcaagatctcctggtaacgtttaaaaccgcccatgctaagaaacaagaagtcgttgtattaggcagccaggaaggtgccatgcatacagcattaacaggtgccacagaaattcaaacatcagggacaacaactatattcgccggacatctaaaatgtcgtctcaaaatggataaattaacgcttaaaggaatgtcctacgttatgtgcaccggatcatttaaactcgaaaaggaagtggcagaaacacaacacgggacagtattggttcaaataaaatatgagggaactgatgccccatgtaaaattccattttctacacaagatgaaaaaggcgtaacacagaatgggcgtctaattacagcgaaccctattgtgacggacaaggaaaaaccagtaaacattgaggcggagccaccattcggagaatcgtatattgttatcggggccggtgaaaaagctcttaaactatcttggtttaaaaagggctcaagtatcggcaagatgttcgaagccacagcgcgtggagcacgaagaatggcgatcttaggtgacaccgcttgggatttcggaagtataggtggtgtcttcacttcggttggcaagttagttcaccagatattcggaactgcctacggagttttattcagtggtgtaagttggactatgaaaatcggaatcggagtcttattaacatggctaggcctaaattcaaggagcacttccctgagcatgacatgtatagcggttggacttgtaacgttgtatctaggggtaatggtgcaggccgacagcggatgcgttataaactggaaaggaagagaactgaaatgcggaagcggcatctttgttacaaacgaagttcacacttggacagagcagtacaaatttcaagcggattcgcctaagcgattgtccgccgctattgggaaagcatgggaagagggagtatgcggaatacggagcgccacaaggttggaaaacattatgtggaagcaaataagcaacgaactaaatcatatattattagaaaacgatatgaaattcacggtggtagtaggagatgttgcaggcatcctggcacaaggaaagaaaatgattagacctcagccaatggagtacaagtactcatggaaaagctggggtaaagcaaagatcattggcgcagacgttcagaacacgacattcataattgatggaccaaatacaccagaatgccccgacgatcagagagcttggaatatatgggaagtggaagattacggttttggtatttttaccacaaatatttggcttaaattacgtgattcatatacacaggtatgcgaccacaggttaatgtcggcagcgattaaagactcaaaagctgtgcacgccgacatgggatattggatagaatctgaaaagaatgaaacatggaagttagcacgggcttctttcattgaggtcaaaacttgtatatggccgaagtcacatactctatggtcaaacggagtgctcgaatctgagatgatcattcctaaaatatacggcggtccgatttcacaacacaattatagacctggatactttactcagacagccggcccgtggcatttaggcaaactagaattagattttgatttgtgcgagggcacgactgtggtggttgatgaacattgcgggaatcgaggaccatctttacggacaacaacagttaccggtaagataattcacgaatggtgctgtagatcctgtactcttccaccgttaagatttcgaggcgaggatggttgttggtatggtatggaaattcgacctgttaaagaaaaagaagaaaatcttgtcaaaagtatggtatcagccggttcaggagaagtcgacagctttagtttaggtctattatgtatctccattatgatagaagaggtaatgagatcacgctggtcgcggaaaatgttgatgacaggtactctggctgtatttttactactaataatggggcaactaacatggaatgatctaatccgtctctgtataatggtaggggcaaacgcgagtgatagaatgggaatgggcacaacatatctcgccttgatggctacgtttaaaatgaggccaatgtttgcagtaggcttattatttaggcgcttaacaagtcgagaagtcctacttttaacaattggtttaagtttggtagctagtgtagaattaccgaatagtttagaagagttaggggatggactcgcaatgggtataatgatactaaaactcttaacagatttccagagtcaccaattatgggccactcttctttctctgacattcattaagacaacgttttctctacattatgcctggaaaacgatggcaatggtcctatcgatcgtatccctttttcccctctgtctgtctacaacgtctcagaaaactacatggttgcctgtactattgggatcgttgggctgcaaaccactgacaatgtttttaatagcggagaataaaatatggggaagacgtagctggcctctaaacgaaggaattatggcagtaggcattgtaagcattctactctcaagcctattaaagaatgatgtacccctagcaggccctttaatcgcaggaggtatgttaatagcgtgctacgttataagtggatcaagcgcagatttgagcttagaaaaagcagctgaagtgtcgtgggaagaggaagctgaacactcaggagcatctcacaacatcctagtagaggttcaagatgatggaacaatgaaaataaaagatgaggaaagggatgataccctaaccatcctacttaaagctacattactagctataagtggtgtatacccactaagtatccctgcaacgctattcgtgtggtacttctggcaaaagaagaaacaacggagtggcgttttatgggacactccatcaccacccgaggtggaacgcgcagtcctagatgacggcatatatcggataatgcaacgaggactgttaggacgctcacaagtaggtgtaggggtcttccaagaaaacgtcttccatacaatgtggcacgtcacaaggggcgcagtacttatgtaccaaggtaagcgactcgaacccagctgggcgtctgtcaagaaagacctaattagctatggtggaggctggcgactacaaggatcatggaatactggggaagaggtccaagtgatcgccgtagaaccaggcaaaaaccccaaaaatgtccaaacaacaccaggaacctttaaaacccctgaaggtgaggtaggagctattgcactagatttcaaaccagggacatctggatccccgatagtaaacagagaaggaaaaatcgtaggattgtatggaaacggggtcgtaacaacctccggtacgtacgtgagtgccatcgcacaagccaaggcatctcaagagggcccgttacctgaaatagaggacgaagtttttagaaaaagaaatttaaccattatggaccttcatcctgggagcggtaagacaagaagatatttgccagctattgtaagagaagccattaaacgaaaactccgaacactaatcctcgctccaacaagagtagttgcaagtgaaatggcagaagccttaaaggggatgcccatccgttatcaaacaacagcagttaagagcgaacatacaggaaaagaaattgttgacctaatgtgccatgcaaccttcaccatgagactactgagccctgtccgtgtacctaattataacatgattatcatggatgaagctcatttcactgatccaagttctatagcagcacgaggctatatttcaactagggtagggatgggagaagctgcagcaatattcatgacagccactccacctggatcagttgaggcgtttccacaatcaaatgcagtcattcaagacgaggaacgagatataccggaaagatcatggaacagcggatacgagtggatcacagattttccgggcaaaacagtttggttcgtaccaagcattaaaagcggcaatgatattgcgaattgcctcagaaagaacggaaaaagggttatacaattaagtcggaaaacattcgacacggaatatcagaaaaccaaaaataacgactgggattacgtagttacgacagatatttctgaaatgggggctaacttccgagcagacagggttatagacccaagacgatgcttaaaaccagtaatactaaaagatgggcccgaaagagtcattcttgcaggtccgatgcctgtcacggtggcatccgctgcgcaacgaagaggacgaatcggtcgcaatcacaataaggaaggtgatcaatatatatacatgggccaaccgttaaacaacgatgaagatcatgcgcactggacggaagcaaaaatgctcttagataacatcaatacaccagagggaattatccctgcattatttgaaccagaaagggagaaaagcgctgctatagatggtgaatatagattacgcggtgaggctagaaagacgtttgtagaattaatgagaagaggggatctcccagtatggcttagctataaggtcgcctccgaaggattccagtattcggacaggcgatggtgtttcgatggcgaaaggaataatcaagtgctagaagaaaacatggacgtagagatatggaccaaggaaggcgaaaggaagaaattgcgcccacggtggctagacgcgaggacatacagtgacccactagcgcttagagaatttaaggagttcgccgcgggccgaagatcggtaagcggggacctaatcctagaaataggaaagctgccgcagcatttaacacagcgcgctcaaaatgcgttggataatctggtgatgcttcataattctgagcaagggggccgcgcataccggcacgccatggaagaactaccagatacaatcgaaacattgatgttacttgccctgatcgcagtattaacgggaggtgttacactattctttttaagcggaaggggtttggggaagactagcatcgggttactgtgtgttatggcatcctctgtgttactatggatggcaagcgtggaaccgcactggatagccgcctcaatcattcttgagttctttctaatggtgctactaatacctgaacctgacagacaacgcacgccccaagataatcaacttgcctatgttgtaattggtttactcttcatgattttgaccgtcgcagcaaatgaaatgggcctcctagaaacaactaagaaagacctagggatcggacatgttgccgtcggaaaccatcaccatgcagcaatgctagatgtagatttgcacccagccagtgcatggacgctctacgcagtagcaacaacgataatcactcccatgatgcgacatacgatcgagaatactaccgccaacatatcattgacggcaatagccaaccaagcagcaatattaatgggtctagataaagggtggccaatatcaaaaatggacattggagttcccctattggcactcggatgctattcacaagtcaatccactaacattaacggcggcagttctaatgctcgtcgcgcattacgcaatcatcggaccgggactccaagcaaaagcgactagagaagcacagaaaaggaccgccgcgggaataatgaagaaccctactgtagatggtatagtagcaattgatctagatccagttgtttatgatgctaaattcgagaagcagttagggcaaatcatgttattaatattatgcacgagtcaaatattattgatgaggaccacctgggcattatgtgagtcaataactcttgcaactggtcccctaacaactctctgggaaggtagccccgggaaattttggaatactactatagcagtatcaatggctaacatttttagaggttcatatctggcgggagcggggctagccttctcattaatgaagtccctgggtggcgggagaaggggaactggggcacaaggtgaaacgctaggcgaaaaatggaaacgacaactaaaccaattaagcaaaagtgagttcaatacgtacaaacgaagtggaatcatggaggtggacagaagcgaagctaaagaaggtctaaaaaggggagaaactactaaacatgcggtatcaagaggtactgcaaaactacgctggttcgtagaaagaaacctagtaaaacccgaaggtaaagtaatcgatctaggttgtggaagaggtggatggtcttattactgcgccgggttaaagaaagtcacagaagtaaaaggctataccaaaggtggacctggacatgaagaaccaattcctatggccacgtacggatggaatttagtgaaacttcatagtggtaaagacgtgtttttcattcctccagaaaaatgtgacacactattatgtgatatcggcgagtcctcacccaacccaacaattgaagaaggtagaacactaagagttttaaagatggtcgaaccttggctaaggggaaaccaattttgcataaagattttaaacccatatatgccaagcgttgtggagacactcgaacagatgcaaagaaaacatggagggatgctcgttagaaatccattatctcgaaattccacacacgaaatgtactgggtgtcttgtggaacaggtaatatagtaagtgcagtaaatatgactagccgcatgttactcaaccgatttacaatggcgcatcggaaacccacatacgaaagagacgtcgatctcggggcaggaactcgacacgtagcagtagagccagaagtcgcaaatttggatatcataggacaaaggattgaaaacataaagcatgaacataaatctacatggcattacgatgaagacaatccatacaaaacatgggcttatcatggatcatacgaagtgaaaccaagcggaagcgcgtcatcaatggtaaatggtgtagtaaagctattaactaagccatgggatgttatccctatggtgacccagatagcaatgacagataccacaccatttggtcaacagagagtcttcaaagaaaaggtagatactagaactcccaaagcgaagcgaggcactgcacagataatggaagtaacagcgaaatggctgtggggtttcctgtcacgtaataagaaaccaagaatatgtactagagaagagttcacccgaaaagtaagaagtaacgcggcaattggggcagtgtttgttgacgagaatcaatggaacagtgctaaagaggcagtggaggatgaaagattctgggacctggttcatcgagagagagaattacacaaacaagggaaatgcgcaacttgtgtatataatatgatgggtaagcgagagaagaaattgggagagttcggtaaagcaaaagggtcaagagccatatggtatatgtggttaggcgcaagatttttagagtttgaagcactaggtttcatgaacgaagaccattggttttcaagagaaaattctttaagtggagtggaaggtgaaggcttgcataagctgggctatatattacgcgacataagtaaaataccaggtggtaatatgtatgccgatgacacagcaggatgggatactagaataactgaagatgatttacagaacgaagcaagaatcaccgatattatggagccagagcatgcgttattagccaaatcgatattcaagttaacctatcaaaataaagtggtaagagtccagagaccggcaaagaacggaaccgttatggatgtaataagtaggagagatcaaagggggtcaggccaagttggtacctatggattgaatactttcacgaatatggaggcgcagttaataagacaaatggaatctgaaggaatattttcgccatcagaactagaaaccccgaatctcgctgagagagtgttagattggttggagaagtacggtgtagaaaggctgaagagaatggcgattagtggagacgattgcgtcgtgaaaccaatcgacgaccgattcgccacagcgctaacagcacttaacgatatgggaaaagttcgtaaagatatacctcaatgggaaccatcaaagggttggaatgattggcaacaagtcccattctgctctcaccattttcatcaattaattatgaaagacgggagggaaatagtggtgccatgtcgaaaccaagatgaattggtaggccgtgctcgagtaagccaaggtgcaggatggtccctaagagaaaccgcgtgcttaggcaagtcctacgcccaaatgtggcaactaatgtacttccataggagagacttaaggctggcagcgaatgccatatgtagcgctgtgccagtagattggataccgacaagtcgtaccacctggagcatacacgctcatcaccagtggatgactacggaagatatgctatcggtctggaatagggtatggatcgaagaaaatccttggatggaggataaaacccacatatcatcatggggagatgtaccatatttagggaagagagaagatcaatggtgtggtagcttaatcggcctaacagcaagagcaacttgggcaacaaacatacaagtagctatcaaccaagttagaaggttgattggtaatgagaactatttagattatatgacgtctatgaaaagatttaagaatgaatcagatccagaaggcgctttatggtaa

SEQ ID NO: 21848 - RNA, 9879 nt, synthetic construct
  misc_feature 1..9879: note = derived and/or modified CDS sequence (opt6) from DENV-1__GU131778__SS-prME
  source 1..9879: mol_type = other RNA
tcggttacgatgctcctgatgttaatgccaactgcgttagcgtttcacttaactactagaggaggtgaaccgcacatgatcgtctctaaacaggaacgaggaaagtctctattatttaagactagcgcaggagtcaatatgtgcactcttatagctatggatctaggcgaattttgtgaagatacaatgacttacaaatgtcccaggataacagaagcagaaccagatgacgtagactgctggtgcaatgcaacagatacgtgggttacctatggtacttgttctcagaccggtgaacacaggcgagataaacgatcagttgcgctcgcacctcatgtgggactcggactagagacacgtaccgaaacttggatgagttcggaaggagcatggaagcagatccagcgagtggagacctgggcactacgacaccctgggtttaccgtaatagctctatttttggcacatgccattggaacgtcaataacccaaaagggaatcatattcattttattaatgttagtcacccctagcatggcgatgcgttgtgtaggtatagggtcacgtgactttgtggagggattatcaggtgctacctgggtcgacgtagtgttagaacatggtagctgcgtgacaactatggcaaaagacaaaccaacattggatattgagttgctcaaaacagaagtgacaaatccagcagtactcagaaagttgtgtattgaagctaaaatatcaaacacaactacagattcacgatgtccaactcagggcgaagccacattagttgaagaacaagatgcaaactttgtttgcagaagaacctttgttgatcgaggttggggtaatggatgtggtttattcggaaaaggtagtttaataacctgtgcaaaatttaaatgtgtaacaaaactagaaggcaaaaccgtccaatacgaaaatttaaaatacagcgtcattgtaaccgtacacacgggagaccaacatcaagtaggcaacgagtccaccgaacatggtaccactgctacaataacaccgcaagcaccgagtactgaaatccaactaacagattacggggctttaaccttagattgtagcccacgaacgggattagactttaatgagatggtgctactgaccatgaaagagaaaagttggttggtacataaacaatggttcctcgacctgccattaccatggacaagtggtgcaagtacttctcaagaaacatggaaccgaaaagacttactcgtaacttttaaaacagcacatgctaaaaagcaagaagtagtagttctaggatctcaggaaggagccatgcatactgcattaacaggtgcaacagaaattcaaactagtgggactacgacaattttcgcagggcacttaaaatgtcgtcttaaaatggataaattaactctcaaaggaatgtcgtacgttatgtgcaccggcagttttaaattagaaaaggaagtcgcagaaacacaacatggaacggtactcgtgcagataaaatatgaaggtacagatgctccttgtaaaatcccattttcaacacaggacgaaaagggtgtcactcagaacgggagattgataacagcaaatcctatagtcacggataaagaaaagccggtgaacatagaagccgaaccacctttcggtgagagctacatagtgataggtgcgggagagaaagccctcaaactttcttggttcaaaaagggatcgagtatcggcaaaatgttcgaagctaccgcgcgtggagcccgtagaatggccatacttggcgatacagcctgggacttcgggtctatagggggtgtatttacctccgtagggaagctcgttcaccaaatattcgggacggcttatggggtcttattcagcggcgtttcttggacaatgaaaataggcataggagtattactaacgtggttaggcttaaactctaggtccacgtccttatcaatgacatgtatagcagttgggcttgtgacattatatttaggcgtaatggtacaagcggatagcgggtgcgttatcaattggaaaggaagagagcttaaatgtggtagcgggatatttgttactaatgaagtccacacctggaccgaacagtacaaattccaagcagatagcccaaaacgtctctccgctgcgatcggaaaagcgtgggaagaaggagtatgcggcatacgatctgccactcgattagaaaacatcatgtggaaacaaattagtaatgagcttaaccatatcctattagagaatgacatgaagtttacagtggtagtgggggatgtggcaggaatactagcgcagggaaaaaagatgataagaccgcaaccaatggaatataaatattcttggaagagttggggaaaagcaaagataataggagctgatgtgcaaaatacaacattcattatagacggacctaatacgccggaatgcccggatgatcaacgagcatggaatatatgggaagtagaggactatggatttggaatatttactacgaatatttggctaaagctccgagattcatacacgcaggtatgtgaccatcgtctgatgagtgcagctataaaagacagcaaagcagtacatgccgatatggggtactggatagagtcagaaaaaaacgaaacatggaaattagcgagagcgtcctttattgaagtgaaaacttgcatctggcccagaagccacaccttgtggtctaacggagtcctagaaagcgaaatgataataccaaaaatatatggcggccctattagtcaacacaattatagaccaggctatttcacacagaccgcagggccgtggcacctaggaaaattagaactagattttgatctttgtgaaggaaccacagtagttgtcgatgaacattgtggtaatcggggaccctcgctacggacgaccactgtaacaggtaaaattatccacgaatggtgttgccgttcgtgtacactacctcccttaaggtttaaaggtgaagacggctgctggtacgggatggagataagaccggtcaaggaaaaagaagaaaatcttgtcaaaagcatggtatctgcaggaagtggggaagtggacagtttttcgcttgggctactttgtataagcattatgatagaggaagttatgcgatccagatggtcccggaaaatgcttatgacaggtacacttgcagtgttttttttactaataatggggcaactaacttggaatgacctgatcaggttatgcataatggtgggcgcaaacgcctccgatcggatgggtatgggtacaacttacctagctttgatggcaacatttaaaatgaggccaatgtttgcggtaggcttacttttcaggaggcttacaagtagggaggtactattgcttacgatcggactatccttagtagcatcagttgaactacctaattcgcttgaagaactgggagatggacttgcaatgggtattatgatcttaaaattactaactgatttccaatctcaccagttgtgggcaactttactatcattaacgttcattaaaacaacattcagcctacattacgcatggaaaacaatggccatggtactaagtatagtctcactctttccattatgcttaagcacaacatcacaaaaaactacctggttacctgtcctcctgggaagcttaggatgtaagccactaacgatgtttctcatagcagaaaataaaatctggggaagaaagtcatggccattaaatgaaggaataatggcggtaggaatagtgagtatattacttagctccttgttaaaaaacgatgtaccgttagccggtccgcttattgctggaggaatgcttattgcgtgctatgtcatatccggatcatcggcagacctttccctagaaaaagctgccgaagtatcttgggaagaagaagcagaacacagtggtgcctcacacaatattctcgttgaagtacaagacgatggaacgatgaaaataaaagatgaagagagagatgacacactaacaatactcttaaaagccactttactagcagtaagcggagtgtacccactatccatacctgctactctcttcgtttggtatttttggcaaaaaaagaagcaacgttcaggagtactgtgggacataccatcaccccctgaagtcgaaagagcagtactagatgacgggatttatcgcattatgcaaagggggctcctagggcgatcccaagttggtgttggtgttttccaggagaacgttttccacaccatgtggcacgtcactagaggtgcagtactcatgtaccagggtaaaaggcttgaaccttcctgggcttcggtaaagaaagacctaatatcatacggaggtgggtggcgcttacaaggatcttggaatacaggagaagaagtacaggtaattgctgtggagcctggaaaaaacccaaagaacgtacaaacggcacctgggacttttaaaacgtcagagggagaagtgggcgctatcgctttggactttaaaccaggaacttccgggagtcctatagtaaatcgagaggggaaaattgttggtttatacggaaacggagtcgtaacaacaagtggtacgtatgtttcagcaatagcacaagctaaggctagtcaagagggaccactaccagaaatagaagatgaagtatttaggaagaggaatcttactatcatggacctacatcctggctccgggaaaacaaggagatatctaccagcaatagtaagggaagctatcaaaagaaaactcagaacattgatcttggcaccaactcgagtcgtagcctctgaaatggctgaagccttaaaaggaatgccaataaggtatcagaccacagctgttaaaagtgagcatacaggaaaagagatagtagatttaatgtgtcatgcaacttttacgatgaggttactcagtcctgttagagtcccaaactacaacatgataattatggacgaagcccactttacagacccatcatccattgcagctagaggttacataagcacaagagtgggtatgggagaagcagcagcaatttttatgactgcaactcctcccggttctgttgaggcttttcctcaaagtaatgccgtcattcaagacgaagagagagatatacctgaacgctcatggaatagcgggtatgaatggattacagattttccgggaaagactgtctggtttgtgccatcgataaagtcagggaatgatatagccaactgcctgagaaagaacggaaaaagagttatacaacttagtagaaaaacgttcgatacggaataccaaaagacgaagaataacgactgggattacgttgttacaacagatatatctgaaatgggtgcaaattttcgagctgacagagtcatagacccccgaaggtgtctaaagcctgtaatcttgaaggatggcccggaaagagttattctagctggtcccatgccagtaacggtagcttcagccgcgcagagacgaggcaggatagggaggaatcataataaagaaggagatcaatatatatatatgggtcaaccactgaacaatgacgaagaccatgcacactggacagaagctaagatgctcctagacaatattaacacacccgaagggataattcctgcgttattcgaaccagaacgggaaaagtctgccgcaatagatggagaatatagactcagaggagaagcgaggaagacgtttgtggaactaatgcgcagaggggacttacctgtctggctatcttacaaggtagcgtcggaaggattccaatattcggataggagatggtgcttcgatggggaaaggaataatcaagtgttggaagaaaacatggatgtagaaatttggaccaaagaaggggaacgtaaaaaactgaggcctaggtggctcgatgcaagaacatactccgatccattagccttaagggaatttaaggaatttgcagccggcagaagatcagtatcaggtgatctgatcttagaaataggtaagctgccccaacatttaacgcaaagagcacagaacgctctggataacttggtgatgttacataacagcgaacaagggggtcgagcctatagacacgcgatggaagaattaccagacacaatcgaaaccttgatgttactagcgctcatagccgtgttaacgggaggcgttacgttatttttcttgagcggaagaggcctgggaaaaacaagcataggtctattatgcgtaatggcaagtagcgtattattgtggatggcatctgttgaaccgcactggatcgcagcgtcaatcatattggaattttttttgatggtattgcttattccagaaccagataggcaaagaactccacaagataatcagctcgcttatgtcgtaataggattattattcatgattctgacagttgcggctaacgaaatgggcctactagaaacaacaaagaaagacttgggaatcggccatgtagcagtagaaaaccaccatcacgctgccatgctagatgttgatctacatccagcaagtgcatggactttgtatgctgtcgcaacaacaattatcacaccaatgatgaggcatacaatcgaaaataccaccgcaaacatatcactgacggcgatagctaatcaagcagctattctgatgggtttagacaagggatggccaattagcaaaatggacataggcgttccgctgttagcccttggatgttatagccaggtaaatccgttaacactaacggcagccgtcctcatgctagttgcccactacgcaataataggtccaggtttacaagcgaaagctacgcgagaggcccaaaaaagaacagccgcaggaataatgaaaaaccccaccgttgatggaatagtagccatagacctagatcctgtagtttacgatgctaaatttgaaaagcagttgggtcaaataatgttactgatcctgtgtacatctcagatcctattaatgagaacgacatgggcgttgtgcgaatcgatcacattagccaccggaccgctgacgacactttgggaggggtctccaggaaaattttggaatacaacaatagcggtctcaatggcgaatatattcaggggttcctatcttgcgggtgcaggactggctttttcgcttatgaaatcactcgggggtggtcgaaggggcacgggggcccaaggtgaaacattaggagaaaaatggaagcgtcaactcaatcagctatctaaaagcgaattcaatacatacaaaagaagtggtataatggaagtcgacaggagcgaagccaaggaagggttaaagaggggtgaaacgacgaaacatgcagtctccagaggaactgccaagttacgatggttcgtagagagaaacttagtaaaaccagaaggcaaagttatagatctgggttgtggaaggggtggttggagttattattgtgcaggcttgaaaaaagtaacggaagtgaaaggctacacgaaaggtggcccaggtcatgaggaaccaatccctatggcaacttacggttggaacctagtgaaactacattcaggcaaagacgttttttttatcccacccgagaaatgtgataccttgttgtgcgacataggggaatcatcccctaaccctactattgaagaaggacgtaccctaagagtcttaaaaatggttgaaccttggcttcgtgggaatcaattctgcataaaaattttgaacccttacatgccgtcagttgtagaaaccctagaacaaatgcaaaggaagcatgggggcatgttggtgcgaaaccctctttcgcgaaactcgactcacgaaatgtactgggtttcttgcgggacaggcaatattgtctctgcagtaaacatgacatcgagaatgctcctgaataggttcacgatggcacatagaaagccaacttacgaaagagacgttgaccttggcgcaggaacaagacatgtggcggtagaacctgaagttgccaacttagatataataggacaacgaatagaaaacataaagcacgaacacaagtccacatggcactatgatgaggataacccctataaaacttgggcctatcacggaagctacgaagtaaaaccttcaggatccgccagtagtatggtaaatggggtagtaaaactgctgacaaaaccctgggatgtaatacctatggtgacacaaatcgctatgactgatacaactccatttggacaacaaagagtattcaaagagaaagtagatacgagaacgcctaaagcaaagagaggcactgcgcaaataatggaagtcacggcgaagtggctgtggggattcctaagcaggaacaaaaaaccaagaatatgtacgagagaagaatttacacgaaaggtaagatcaaacgcagctataggtgcagtatttgtagacgagaatcaatggaattcagcaaaggaagcggttgaagatgagagattttgggatttagttcatagagaaagagaattgcataagcaaggaaagtgcgcaacctgtgtatataatatgatgggtaagcgagaaaaaaaattgggtgaatttgggaaagcaaaaggatcacgcgccatttggtacatgtggctcggagctagatttttggagtttgaggcgttaggctttatgaatgaggaccactggttttcacgagagaacagcctttcgggtgtagagggagaaggactacataagttaggctatatattaagagacatatcaagaatacctgggggaaacatgtacgctgatgataccgcaggatgggatactaggatcactgaggacgatctacagaacgaagctaaaattacggatataatggaacctgaacatgctttactagctaagtcaatttttaaactgacttaccagaacaaggtagtccgagtacagcgacctgcaaaaaatggaacagttatggacgtaatctctcgtagagatcagaggggatcaggtcaagtcggcacctatggactaaatacatttactaatatggaagcacaattaatacgacaaatggaatctgaaggaatctttagcccatcagaattagaaaccccaaacctcgccgggcgcgtattagattggttggaaaagcatggagttgaacgtctaaagagaatggcaataagtggtgacgattgtgttgtaaaacccattgacgacagatttgcaactgcactaacggccttaaacgacatgggaaaagtgcggaaggatattcctcaatgggaaccaagtaaagggtggaacgattggcaacaagttccattttgctcacatcactttcatcaactaataatgaaagacggaagagagatcgtagtaccgtgccgaaaccaagacgaactcgtcggaagggctagagtttcacaaggggccggatggagtctccgcgaaacagcttgcttaggaaagtcttacgcacaaatgtggcaactaatgtatttccatagaagagatctcagattggcagccaacgcaatatgctcagcggtaccagttgactgggttcctacaagcagaaccacatggtcaatacacgcgcaccatcaatggatgacgactgaagacatgctgtcggtatggaaccgagtatggatagaagagaatccatggatggaggataaaacccatattagctcctggggtgatgtcccttatttaggtaaaagggaagatcaatggtgtggatccctaatcggtctcactgcccgtgccacctgggccactaatatacaggtcgctattaaccaagtcagacgcctaataggaaatgagaattatcttgactatatgacatctatgaaacgattcaaaaacgaatcagatccggaaggggctctatggtaa

SEQ ID NO: 21849 - RNA, 9879 nt, synthetic construct
  misc_feature 1..9879: note = derived and/or modified CDS sequence (opt6) from DENV-1__GU131779__SS-prME
  source 1..9879: mol_type = other RNA
tccgtgacgatgttacttatgcttatgccaacggcactagcgttccacttaactactaggggaggagaaccacatatgatcgtttctaaacaagaacgaggaaagagcttattatttaaaacttctgcaggagttaacatgtgcaccttaatagctatggatttaggagaactatgcgaagatactatgacttacaaatgtccacggattacagaaaccgagccagacgacgtggattgttggtgcaacgcaacggatacgtgggtaacatacggtacttgttcacaaactggagaacaccgaagagataaacgatcagttgctttagctccacatgtaggtctcgggttggaaacaagaacagaaacctggatgtcatctgagggtgcttggaaacaaatccaaagggttgaaacatgggcgttaagacaccccggctttacagtaattgctttatttttagctcacgctataggcacgtccatcactcaaaaaggtatcatttttatcctcctaatgttggtgacaccatcgatggcaatgagatgtgttggaatcggttcacgtgattttgtcgagggattaagtggggcaacatgggtagatgttgtattagaacatggatcgtgcgtaactaccatggcaaaagacaaaccgacgctcgatatcgaattactcaaaactgaggtcactaatcctgccatactgagaaaattatgcatcgaagcaaaaatctcaaacaccacaaccgactcaaggtgtccaactcaaggcgaagccacgcttgtggaagaacaagatgctaactttgtctgcagacgtacatttgtagatcgaggttggggtaatggctgtggattattcggtaaaggaagcctgattacatgtgccaaattcaaatgtgtaacaaaattggaaggtaaaatcgtacaatatgagaatttaaagtatagcgtaatagttaccgtccatacaggagatcaacatcaagtagggaatgaaagtacagaacacggcactacagctacaatcacaccacaagcacccacaacagaaatacaattaaccgattatggggccctgacacttgactgttcccctagaaccggactagacttcaatgaaatggttttactaactatgaaagaaaaatcttggcttgttcacaagcagtggtttcttgacctgccactaccatggacctcgggtgcatccacttcccaggaaacatggaatcgacaagatctattagttacttttaaaaccgcacatgccaagaaacaggaagtagtggttctaggcagtcaagaaggagctatgcacaccgctctgactggagcgacagaaatacagacaagtggaacaaccacaatttttgcaggacatctaaagtgcagattgaaaatggataaattaacacttaaaggaatgagttatgtaatgtgcacgggttcttttaagctcgagaaagaagtcgctgaaactcaacatggcacagtcctagttcaaatcaagtatgaaggcacggatgctccctgcaaaataccattctctacgcaagacgaaaaaggtgttacgcaaaacggtcggttgattaccgcgaatccaatagttactgataaagaaaagccagtaaatatcgaagctgaaccaccatttggggagtcttatatcgtgatcggagcgggagagaaagccctcaaactttcctggttcaagaaaggtagtagcattggtaaaatgtttgaagctacggcgcgaggagcacgtagaatggccatactaggggacactgcttgggatttcggtagcatcggaggagttttcacgtcggtgggaaaactcgttcaccagatttttggcacagcatacggcgtattgttttcaggagtatcttggactatgaagattggaataggagttttgctaacttggcttggtttgaatagtaggtccacaagtttgagcatgacgtgtattgcagtaggtctggtaaccttatatctaggagtgatggttcaggccgatagtggatgcgttatcaattggaaaggaagagaactaaaatgtggaagtgggatatttgttacgaacgaagtccacacatggactgaacaatataagtttcaggccgactcacctaaaagacttagtgctgcgattggtaaggcttgggaggaaggggtttgtgggatacgatcagcaacaagactagaaaatattatgtggaagcaaattagtaatgaactaaatcacatcctactggaaaacgacatgaaatttacagtcgtagttggtgatgtagctggtatattggctcaaggtaagaaaatgatacgcccacaacccatggaatataaatatagctggaaaagttggggaaaagcaaaaataataggggcggatgttcaaaacaccacattcattatagatggaccaaatacacctgaatgtccagacgaccaacgagcgtggaatatctgggaggtagaagattatggattcggcatattcacgaccaacatatggctaaagctccgcgactcctacactcaagtctgcgatcatagattaatgtccgcggccataaaagattctaaagctgttcacgctgacatgggttattggatcgaatcagaaaagaatgaaacttggaaactcgcaagagcgtcatttattgaagttaagacatgcatatggccaaaaagtcatactttgtggagcaatggtgtattagaaagcgaaatgattattccgaagatctatggaggtccgatatcacaacacaattataggcctggttatttcacgcaaacagctgggccctggcatctgggtaaattagaacttgactttgatttgtgtgaaggcaccactgtagtagtagacgagcactgtggaaacaggggaccctcattacgaacaacaacagttacaggcaaaatcatccatgaatggtgctgcagaagctgtacattacctccattgcgctttcggggcgaagacggctgctggtatgggatggagataagaccagtaaaagagaaggaagaaaacttagtaaaaagcatggtgtcagcaggaagtggtgaggttgattcatttagtcttgggttattatgtatatcgattatgatagaagaagtaatgagaagtagatggagtagaaaaatgttgatgacaggtacgctggcagtatttttgctgttaataatgggccagctaacatggaatgacctaatacggctatgcataatggtaggcgcgaatgcctctgatcggatggggatgggcactacgtacctagcccttatggcaacattcaaaatgagaccaatgtttgctgttggtcttctatttagaaggcttacatcaagagaggtactgcttttaaccataggactatcactggttgtgagtgtagaattgcctaattcactagaagagttaggtgacggtttagctatgggaattatgattttaaaactattgactgattttcagtcgcatcaactttgggcgacattgttatcactcacgtttataaagaccacattctccttacattatgcatggaagacgatggcaatggttttaagcatcgtctcactattccctttgtgtctttccactacatcgcagaaaacaacctggctccctgtacttttaggtagccttggatgcaaacccctaactatgttcctgattgctgagaataaaatttgggggcgaaggtcttggccacttaacgaaggaattatggctgtcggaatcgtatcaattcttttgtctagtcttctaaagaatgacgtaccactagcgggtcctctaatagctggtggaatgttaatagcctgttatgtaattagtggaagttccgcggacctaagtttagaaaaagctgctgaggtctcgtgggaagaagaagcagaacactcgggagcatcgcacaatatcttggtcgaagtgcaagacgacgggacaatgaaaataaaagacgaggagagagatgataccttaaccattctcttaaaagcgactcttttggcagtttccggtgtgtatcctttaagtatccccgcaactctgtttgtatggtatttttggcagaaaaagaaacaaaggtcgggagtactatgggatactccttctcctccagaagttgaacgggctgtattagatgatggtatttaccgaataatgcaacgaggactattaggaagatctcaagtcggtgtcggggttttccaagaaaatgtcttccacacaatgtggcacgtaacacgcggcgcagtattgatgtatcaagggaagagattagagccatcttgggcctccgttaagaaagatcttatctcatacggtggcggatggagattgcagggatcgtggaatacaggagaagaggtacaagttatcgccgtggagcctggcaaaaatcccaagaacgttcaaacaacacccggcacattcaaaactcctgaaggtgaagtcggagcaatagcactggatttcaaaccaggaacgagtggtagtcctatagtaaatagggaaggaaaaatagtgggactatatggcaatggagtagtaacgactagcggcacctacgtatcagcaattgcccaagccaaagcgagtcaagagggacctttaccagagatagaagatgaagtctttaggaagagaaacttaacgattatggatctacatcccggcagcggaaaaacacgtagatatttaccagcaattgttcgagaagcaataaagcgtaagctacgaacgctcatcttagcaccgacacgcgtggtagcgtcggaaatggcggaggcacttaaaggcatgcctataagatatcaaaccacagccgtaaaatccgaacatacagggaaagagatagtagacctaatgtgccatgcaacgtttacaatgaggcttttatcgcctgtgagagtaccaaattacaatatgataataatggatgaagcacattttacagatccgagctcaatagcagctagagggtacatcagcacacgtgtcggaatgggtgaagcggccgcaattttcatgaccgcaacaccacccggatctgtagaggcattcccccagagcaatgcagtaatacaggacgaagaaagagacataccagaaaggtcttggaactctggttacgaatggatcacagactttcccggaaaaacagtatggtttgttccgtcaataaaatcaggaaatgatatagctaattgtttaaggaaaaatgggaagcgagtaattcagttaagccgaaaaacattcgatacagagtatcagaaaacgaaaaacaacgattgggactacgttgtaacaactgatatatctgaaatgggagcgaatttcagagcagatcgagttattgacccgcgccgatgtttgaagcctgtaatattaaaagacgggccggaacgtgttattttagccgggcctatgcccgtaacagtcgcatctgctgcccagcgacgtggcagaataggccgcaaccacaataaagaaggggaccaatatatatacatggggcaacctttaaataatgatgaagatcacgctcattggacagaagctaaaatgttgttagacaacataaacacacctgagggaattataccagcattattcgaaccagaaagagagaaaagtgcggctatagatggagaatacagattgagaggagaagcaagaaaaacattcgtcgaactaatgagacgcggagatttaccagtctggcttagctacaaagtcgcgtccgagggttttcaatattcggatcgacgatggtgctttgacggagaacgtaataatcaagtactagaggagaacatggacgttgaaatatggactaaagaaggagaaaggaagaaactaagaccacgatggttagacgcccgcacttattcagatccgttagcactgagagagtttaaagaatttgcagcagggcgcagaagcgtatcaggtgatttaatccttgaaatcggcaaactcccgcaacatttaacacaacgcgctcagaatgccttagataacctagtaatgctacacaattcggagcaaggaggtagggcatatcgacatgcgatggaagaattaccagatactatagaaactttgatgttgttagccctaattgctgtccttacgggtggggtaaccttattctttctcagtggaaggggcctgggcaaaacaagtattggactattatgtgtaatggctagcagtgtactactgtggatggcatcagtcgaaccacactggatagcagcttcgattatcctagaatttttcttgatggtcttactgatcccagaaccagacaggcaaagaacccctcaggataaccagttagcctatgtggttatcggtttactgtttatgatactcacggttgcggcaaatgaaatgggattacttgaaaccacgaagaaggatcttggcattggacacgttgcagtcggcaatcaccatcacgctgctatgcttgacgtagatttacatcccgcttccgcatggacattatatgcggttgctaccactatcattactccaatgatgagacataccatagaaaatacgacggctaatataagccttacggctattgcaaatcaagctgccatactaatgggactggataaaggttggcctatttctaaaatggacataggagttcctctacttgcattgggatgctactcacaagtcaatccacttacattaaccgccgcagtattaatgctagttgcgcattacgcaatcatcggtccaggacttcaagctaaggcaactcgggaggcacagaaaagaactgcagctggtattatgaaaaacccaaccgtagacggaatagtagccattgatttagacccagtagtatatgatgcaaaatttgaaaagcaattgggtcaaatcatgctattaattctgtgcaccagccaaatattattaatgagaactacttgggcattatgtgaatctataaccttggcgacgggtcccctcacaacattatgggagggtagtccaggaaagttttggaacaccactattgcggtgagtatggcgaatatcttccgaggcagttacttagcgggagcgggacttgctttcagtctaatgaagagtttgggtgggggacgtagaggtactggcgcacaaggcgaaacattaggggaaaagtggaagcgacaacttaatcaattaagcaaaagtgagttcaatacttataaaagaagcggtataatggaggtagatcgatcggaagcaaaagaaggactaaagcgcggcgaaactactaaacacgccgtatctcgcggaaccgctaaattaagatggttcgtggagcgtaacctagtgaagccagaaggaaaagtgatagatttgggttgtggacgtggaggatggtcatattattgcgcaggtcttaagaaagtaacagaagtaaaagggtatactaaaggtggacccggacacgaggagcctatacccatggctacctatggttggaatcttgttaaacttcactcaggaaaagatgtgtttttcataccccctgagaagtgcgatactttactatgtgacataggggagagcagtccgaatcccactattgaggaagggagaacacttcgtgtcctaaagatggtggaaccttggttacgcggaaatcaattttgcataaaaatcttaaacccatacatgccatccgtcgttgaaaccctagagcaaatgcaaaggaaacatggagggatgttagttcggaaccctttatcgagaaacagtacacacgaaatgtattgggttagctgtggtaccggaaatattgtttctgcagtaaatatgacatctagaatgctgcttaacagattcacaatggcccatcgtaagccgacttatgaacgtgatgttgatttaggcgccggaaccagacatgtggctgtagaaccagaagtggcgaacctagatatcataggacaacggatagagaatataaaacacgagcataaatctacttggcattatgatgaagataatccttataaaacttgggcttaccatggctcatatgaagtcaaaccaagcggttctgcaagttcaatggtcaatggtgtcgtcaaattactaacaaaaccatgggacgtcataccaatggtaacacagatagcgatgacagacactacaccttttggtcaacaaagagtattcaaagagaaagtagatacccgaacacctaaagcgaaacgaggcacagcccaaataatggaggtaacagcaaaatggttatggggatttttatctcgaaacaagaaaccccgaatatgtacccgtgaagaatttacacgcaaggtacggtctaacgcagcaatcggtgcggtatttgtcgacgaaaatcaatggaactcagccaaagaagccgttgaagacgaacgattctgggatcttgtacaccgtgagcgagaattacataaacaaggaaaatgtgcaacatgcgtctataatatgatgggcaaaagagagaagaaattaggagaatttggaaaagctaaaggatcacgggccatatggtatatgtggctcggagcacgtttcctagaatttgaggctttaggttttatgaatgaagatcattggttcagtcgagaaaattcactttccggagtagaaggtgaaggacttcacaaacttggttacatcttaagagacatatctaaaatacccggtgggaatatgtacgcagacgacactgcaggctgggacacgcgaattacagaggatgatttgcagaatgaagctcgtataacagatataatggaaccagaacacgcgctattagcaaaatcgatattcaaacttacttaccagaataaagtagtccgcgtacagcgcccggccaaaaatggtactgtcatggacgttatatcccgaagagaccaaaggggaagcggacaagtcggtacatatgggctaaacacctttacaaacatggaggcgcaattgatacgacaaatggagtcagaaggcatcttcagtccaagcgaactagaaactccaaatctagcagaaagagtactcgactggttagaaaagtatggagtagaaagactaaaacggatggcaataagtggcgatgattgcgtcgttaagccaattgacgataggttcgctaccgctctaacagcgctaaatgatatggggaaggtcaggaaagacataccccaatgggaaccgtctaaaggatggaatgattggcagcaggttccattctgcagccatcattttcatcagttaatcatgaaagatggaagagaaatagtcgtaccatgcagaaatcaagacgagctggttggtagagcccgagtcagtcaaggtgctggatggtccctcagagagacagcatgtttaggtaagtcgtatgcgcaaatgtggcagctgatgtactttcataggagagatctgagattagctgcgaatgcgatttgcagcgcagttcctgttgattggataccaacatcaaggacaacatggagtatccatgcccatcaccagtggatgacaactgaagatatgctatcggtctggaaccgagtctggatagaagaaaacccatggatggaagataaaacccatatatcgtcctggggagatgttccatatttaggaaagagggaagatcaatggtgtggcagtttaataggtcttacagcaagggctacctgggctacaaacatacaagttgcaataaaccaagtacggagattaattggcaatgaaaactatctagactacatgacatctatgaaacgcttcaagaatgagagcgacccagagggtgcattatggtga

SEQ ID NO: 21850 - RNA, 9879 nt, synthetic construct
  misc_feature 1..9879: note = derived and/or modified CDS sequence (opt6) from DENV-1__GU131780__SS-prME
  source 1..9879: mol_type = other RNA
agcgtaactatgttattaatgttgatgccaacggcacttgctttccatcttacaacaagagggggagaaccacacatgatagtctcgaaacaagaaagaggtaaaagtctactatttaaaacatcggcgggcgtaaatatgtgtacacttatagctatggacttaggggaattttgtgaagatacaatgacttacaaatgtccaagaataacggaagctgaaccagatgatgtcgattgttggtgtaatgcaacagatacttgggtgacatacggaacatgtagtcaaaccggagaacacagaagagataaaaggagcgtcgcgctggcgccacatgtaggcttagggttagagaccaggacagaaacctggatgtcgtcggagggcgcatggaaacaaattcaacgtgttgaaacatgggcacttaggcacccgggatttactgtaatagccctatttttagcacatgccataggaacttctataacacaaaaagggattatctttatacttctgatgctagtaacgccttcaatggcgatgcgttgcgtcggtataggttctagagactttgtcgaaggattatcaggcgcaacatgggtagatgtggtattagaacatggaagctgcgtcaccacgatggcaaaagataaacctacccttgacatcgaacttctcaagactgaggtcacaaatccagcggtattgaggaagttatgcatagaagctaaaatatcaaacactacaacagactcacgatgtccaacccaaggggaagccacactcgtggaagaacaagacgcaaattttgtttgcagacgaacgtttgtagatcgaggatggggcaatggctgcgggttgttcgggaaaggatcattaataacatgtgcgaaattcaaatgcgtgaccaaattagaaggaaaaacggtacaatatgaaaatctaaaatacagtgtgatagtaaccgttcacacaggagaccaacatcaggtcggtaatgaatcgacggagcatggtacaacggcgactattacgccacaagcgccaagtaccgaaatccaattaactgattatggggctctgactctagactgctctcctagaacaggactagattttaacgagatggtcctattaactatgaaagagaaaagctggcttgtgcataagcaatggttcctcgatcttccactaccatggacttcgggggcttcaacatcccaagaaacatggaatagaaaagatctattagttacatttaagactgcacacgcgaagaaacaagaagtagttgtgttaggtagtcaagaaggtgccatgcataccgcactaaccggagccaccgagatacaaaccagtggaacgacaacaatcttttctggccatttaaaatgtcgactaaaaatggacaagttaacgttaaaagggatgtcttatgtaatgtgcacgggatcttttaaattagagaaggaagttgcagagacacaacacggaacagtattagtccagatcaaatatgagggtacggatgcaccatgcaaaataccattcagcactcaagatgaaaaaggagttactcaaaatgggaggctaataactgccaacccgatagtaaccgataaggaaaaaccggtcaatatcgaggccgaacccccgtttggagaatcatatattgtgatcggagctggggaaaaggcactcaaactttcatggtttaagaaaggttcaagcatcggaaaaatgttcgaagctactgcaagaggcgcaagacgaatggcaatcttaggagacacagcctgggacttcgggagcataggtggggtctttacgtctgtaggtaaattagtgcatcaaatattcgggactgcctatggtgttttattttcaggcgttagttggactatgaagatagggattggggttctattaacttggttaggattgaactcaagatccacttccttatcaatgacctgcatagcagtgggtttggtcacgctatatttgggagtaatggttcaggctgacagcggatgcgtaattaactggaaaggccgggaactaaaatgtggttcagggatattcgttactaatgaggtccatacttggactgagcaatataaatttcaagccgacagccccaaaaggctctcagccgcaattgggaaggcttgggaagaaggtgtatgcggaatcagaagtgctacacgcttagagaatatcatgtggaaacaaatatcaaacgaactaaaccatatattactagaaaatgacatgaaatttacggtcgtggttggggacgtcgcaggaatattggcacaaggcaagaaaatgattcgaccacaaccaatggaatacaaatattcttggaaatcatggggaaaagcaaagataattggcgctgatgtacaaaatactacttttataatagacgggccaaacacacccgaatgccctgatgatcaaagagcttggaacatctgggaggtggaagactacggttttggcattttcactaccaacatatggttaaaactacgtgattcttacacccaagtatgtgaccacagactaatgtcagcagcaataaaagatagtaaagccgtacatgccgacatgggctactggatagaatcagagaaaaatgagacatggaaattagcgagagcatctttcatagaggtaaaaacatgtatctggcctaaatcacacaccctatggagcaacggtgttctggaatcagaaatgattataccaaaaatctacggtggccctatctcgcagcacaattatcgccccggctacttcacacaaacggcaggcccatggcatcttgggaagctagaattggacttcgatctttgcgaaggaaccactgttgtcgtggatgaacactgtggaaaccgaggaccgagcctacgaaccaccactgtaactggtaagataatacatgaatggtgttgcaggagttgtacactacctcctctcaggttcaagggcgaggacgggtgttggtatgggatggaaattagaccagtcaaagaaaaagaagaaaacttagttaaaagtatggtatcagccgggtcaggagaggttgattcgttcagtcttggcctcttatgtatcagtataatgatagaagaagttatgagatcgagatggtcgcgaaaaatgctaatgacgggaacactcgcagtatttttcttgctaattatggggcagctaacctggaatgatttgataaggttatgcataatggtgggtgctaacgccagtgacagaatgggcatgggcaccacatacctcgccctaatggctacttttaaaatgagacctatgtttgcagtaggattgctctttaggagactgacaagtagagaagtcctcttgcttaccattggcttatcattagttgcatctgtcgaattacccaatagtctagaagaactaggtgacggattagccatgggaattatgattttgaagctattaacagattttcaaagtcatcaattatgggccaccctgttaagtctcacttttattaaaacaaccttctcattgcattacgcatggaagacgatggccatggtattatcaatcgtgtctctctttccactttgcctgtcaacaacatcacaaaagacaacttggctccctgtcttactcggatcattaggttgtaagcctcttacaatgtttctaatcgccgaaaataaaatctggggaagaaaatcatggccattgaatgagggcattatggctgttggaatagtttcaatattattgagttctcttcttaaaaatgacgttccgcttgctggaccattgattgcaggcggaatgttaatcgcatgttacgtgatttctggctcgtcggccgatttgtcactagagaaagcagcagaggtatcatgggaagaagaagcagaacactctggtgcaagccacaatatcctagttgaggtacaagacgatggaacaatgaaaataaaagatgaagaaagagatgacacacttacaatacttctaaaagctacattactgactgtcagcggtgtgtatccgcttagtatcccagcaacattatttgtatggtacttttggcagaagaagaaacaaagaagtggagtactatgggatacgccctcaccacctaaagttgaacgagctgtacttgatgatggcatataccgaatcatgcaacgtggactactggggcgatcacaggtaggtgttggagtttttcaagagaatgtctttcatacgatgtggcacgttacaagaggagcggtattaatgtaccagggtaagagattagaaccatcatgggcaagtgtcaaaaaggacctaatctcctatggcggaggttggagactacaaggttcttggaacacaggagaagaagtacaagtaatagcagtagaacccggcaaaaatcccaaaaacgtacaaacagctccaggcacatttaagacaagtgaaggagaagttggtgcaatagccttagattttaaaccgggtaccagtggaagccctatagtaaatcgtgaaggtaagattgttggattatacggaaacggcgtagtaaccacttctggcacttacgtaagcgctatagcccaagcaaaagctagccaggaaggcccgttaccagaaatagaggacgaagtattccgtaaaaggaacttaaccattatggatttacatcccggcagtggcaaaaccagaaggtacctaccagcgatcgtacgagaagccatcaagagaaaattaagaacattgatcttagcaccgacacgtgtagtagcgtctgaaatggcggaagctctaaagggtatgcctataaggtatcaaacaactgctgtaaagtcagaacacacgggaaaagagatcgttgatctaatgtgccatgcgacattcactatgagattactatcaccagtaagagtaccgaattataatatgattataatggatgaagcgcatttcacggatcctagttcgattgcagcaagaggatacataagcacacgcgtcgggatgggggaggcggccgctatatttatgacagcaacgcccccagggtctgtagaggcattccctcaaagcaacgcagtaatacaagacgaagaaagagatatccctgaaagaagttggaactctggatacgaatggataacggatttccctgggaaaactgtatggttcgtaccgagtataaaatcagggaatgatattgctaattgtctaaggaaaaatggtaaaagagtaattcaactttctcgaaaaacattcgatactgagtaccagaaaactaagaacaacgattgggactatgttgtcactacagatatatcggagatgggagccaatttcagagctgatcgtgtaattgatcctcgtagatgcctaaagccagtcatattaaaagatggacctgaacgtgttatattagccggaccgatgccagttacagttgcatcagcggcacaaaggagaggtagaataggcagaaaccataataaagaaggggaccagtacatttacatgggccaaccattaaacaacgatgaagaccatgcacactggaccgaagctaaaatgttactagataatataaacacgccagaagggattataccagctctgtttgagccagaaagagagaaatccgcggcaatcgatggtgaatatcgtttgagaggcgaagcgaggaaaacattcgtagagctaatgcgaaggggagatttaccagtatggttatcctataaagtagctagtgaaggctttcagtactctgacaggaggtggtgtttcgatggggaacggaataaccaggtacttgaggagaatatggacgttgaaatatggacgaaggaaggggaacggaagaaattgaggcctaggtggttagatgctagaacctactctgatccgctggccctaagagaatttaaagaatttgcagcgggccgacgtagcgtctccggtgaccttatcctagagataggtaaattacctcaacatcttacacaacgagcccaaaatgcactagacaacttggtaatgctgcataactcggaacagggaggcagagcatataggcacgctatggaggaattgccagatactatcgaaacaatgatgttgttagcccttatagcagtattaacaggcggggtaactttgttctttttgagcggtaggggacttggaaagacaagtataggcctactatgtgttatggcatctagtgtgctcctatggatggcaagcgtcgaaccgcactggatagcagcttctataatcttagagtttttccttatggttctcttaattccagaacctgatcgacagcgaacaccacaagacaaccagctcgcatatgtcgtgattggtttattgttcatgattctcactgtagcagctaatgaaatggggcttctagaaacaacgaagaaggacctaggtataggacatgtagctgttgaaaaccatcatcatgctgcaatgttagatgttgacctccatccagccagtgcatggaccctgtatgcggtggctactactataattaccccaatgatgaggcatacaatagagaatacaaccgccaatattagcttgaccgctatagcgaatcaggccgccattttaatgggtctagacaaagggtggccaatttcaaagatggatattggagtcccactacttgctttaggctgttacagccaggtaaatcctttaactttaaccgcagcggtattgatgttggtagcacattacgcgataatcggtccaggattacaagcaaaagcgacgcgggaggcgcagaaaagaacggctgcagggataatgaaaaacccaactgtcgacggcattgtagccatagacctcgatccagtggtatatgatgccaaatttgaaaaacaattgggacaaataatgttattgatattatgtacaagccaaatactgttgatgcgtacgacatgggcattatgtgaaagtatcacactagccaccggtcctttaacaactctttgggaaggttcgccaggaaaattctggaacacgacaattgcagtaagtatggcaaacatcttcagaggatcgtacttagcaggcgcaggactcgccttttcattaatgaaatcattagggggcggaaggcgcggcaccggagcacaaggagaaactcttggggagaaatggaagagacagcttaaccaattaagtaagtcagaatttaacacctataaaagaagtggcattatggaagtcgatagatcagaggcaaaagaaggcctaaaaagaggtgagactaccaaacatgccgtcagccgaggaactgcaaaattacgttggtttgttgagagaaatctagtcaaaccagaaggaaaagtgatagacctaggatgtggtagaggaggttggtcatattactgtgcagggctcaagaaagttacagaagttaaaggatacacaaaaggaggtcctggacatgaggaacccatacctatggcgacctacggatggaacttagtcaaactacacagtggaaaggatgtattctttattccaccagaaaaatgtgatacattgttatgcgacataggtgagtcatcgccaaatccgacaatagaagaaggacgaacattaagggtgctcaaaatggtagagccctggttaagagggaaccagttttgcataaaaatattaaacccctacatgccctccgttgtggaaaccttagaacaaatgcaacgaaaacatggaggaatgctagtaagaaatccattgtcaagaaattcaacccatgaaatgtattgggtaagttgcgggacaggaaatatagtcagtgctgtaaatatgacttctcgcatgctgttaaatcgattcaccatggcgcataggaaaccaacctatgaaagggacgttgatctgggagccgggacacgacacgtggctgtagagccggaagttgccaatttagacataatcggacaaagaatcgagaatatcaaacatgagcataaaagcacttggcattatgatgaagataacccatataaaacgtgggcatatcatggatcatatgaggtcaaaccatcaggatcagcgagtagtatggtaaacggtgtagtaaaacttctcacaaagccctgggacgtaataccgatggtcacacagatcgcgatgaccgacaccacgccttttggccaacaacgagtattcaaggagaaagttgatacgagaacaccgaaagcaaagcgaggaacagcacagataatggaagttacggcgaaatggctttggggatttttatcccgtaataagaaaccacgaatctgtactagagaagaatttacgcgaaaggtgagaagtaacgcagcgataggcgccgtatttgtggacgaaaatcaatggaatagtgctaaagaggcagtcgaagatgagagattctgggacctagtacaccgagaacgagaattacataaacaaggaaagtgtgcaacttgtgtatacaatatgatgggaaaaagagagaagaaactaggagaatttggcaaagccaaaggctcaagggcaatatggtatatgtggctgggggctagattcttagaatttgaagcccttgggtttatgaacgaggaccactggttttctcgcgaaaattcattatcaggtgtcgaaggagaaggattgcacaagctcggatatatcttgagagatatatcgaaaataccaggcgggaatatgtatgccgatgacacagcagggtgggacacacgcataacagaagatgacttacaaaatgaagcaaaaataactgacataatggaaccagaacatgcccttcttgcgaagagtatatttaaactcacatatcaaaataaagtggttcgtgtacaacgtccagccaaaaacggtaccgtcatggacgttatctctagacgagaccagagaggatcaggccaagtaggtacctacggtttaaacacatttactaacatggaagcacaattgatacgtcagatggaatccgagggtatcttcagtccatccgaactcgaaacccccaatttagcaaggagggttttggattggttggagaagcatggagttgagcgacttaaacgtatggctataagtggggatgattgtgttgttaaaccaatagacgataggttcgcgactgcccttacggctcttaatgatatggggaaagttaggaaagatataccacagtgggaaccgtcaaaaggatggaatgattggcaacaggttccgttttgtagccaccacttccatcaactaatcatgaaggatggtagagaaatcgtcgtcccgtgccgcaatcaagacgagcttgttggaagggcaagggtcagccagggtgccgggtggagcttaagggaaacggcatgcctaggaaaaagttatgcacagatgtggcagttaatgtattttcatcgccgggatttacgcctagctgccaacgcgatatgtagtgccgtcccggtagactgggtgccaacatccaggacgacttggtcaatccacgcacaccaccaatggatgactacagaagacatgctttctgtatggaatagagtatggattgaggaaaacccatggatggaagacaaaacacacatttcttcctggggagacgtaccatatctaggcaaacgtgaagatcaatggtgtgggagtttgattggactcacagcacgtgcgacatgggcaaccaatatccaagtggccattaaccaagtgagacgactaatcggaaacgagaactatttagattacatgacctctatgaaaaggtttaaaaatgaaagtgatcctgaaggagcgctatggtag

SEQ ID NO: 21851 - RNA, 9879 nt, synthetic construct
  misc_feature 1..9879: note = derived and/or modified CDS sequence (opt6) from DENV-1__GU131781__SS-prME
  source 1..9879: mol_type = other RNA
tcagtcactatgcttttgatgttaatgcctacagcattggcctttcacctcacaactcgcggaggtgaacctcacatgattgtatctaaacaagaacgcggcaaatctctcctatttaaaacgagtgccggcgttaacatgtgcactctaatagctatggaccttggcgaattttgtgaagatacaatgacttataaatgtccgcgaattactgaagcagaacctgatgatgtcgactgttggtgtaacgcaactgatacatgggtaacttatgggacatgtagccaaaccggagaacaccggcgcgataaaagatcagtggctctcgcaccacacgtgggactaggcctggaaacacgaactgaaacgtggatgtcgtcagaaggagcatggaaacaaattcaaagggtggaaacatgggcattgcgccatccaggatttacggtaatagcattatttttagctcatgcaattgggacttcaatcacgcagaaaggaataatctttatactcttaatgcttgtgaccccttctatggcaatgagatgcgtcggtatcggaagtagagactttgtagaaggtctaagtggtgccacatgggtcgacgtggtcttggagcacggctcctgcgttacaactatggcgaaagataaaccaacgcttgatattgaactactaaaaactgaagtaacaaatccggcggttcttagaaaactatgtatcgaagcgaaaataagcaatacaactaccgatagtagatgtcccacacaaggagaggcgacgcttgttgaagaacaagatgcaaattttgtttgtaggaggacattcgtagatcgggggtggggaaatggctgtggactcttcggaaaagggtcactaataacatgtgccaaattcaaatgtgtaactaaattagagggcaaaattgtccaatacgaaaacttgaaatatagcgtaatagttactgtccatacaggagatcaacaccaagtgggaaacgaaagcacagagcacggaacaacagctacaattacacctcaagcgcccagtacggaaattcaactcacggactacggggcgctaaccctagattgctcgccacggacaggacttgattttaatgaaatggtactattgactatgaaagagaaaagctggcttgttcacaaacagtggttcctagaccttccgttgccctggacaagtggtgcgtccacaagtcaagagacatggaatcgtcaagaccttctcgtaacatttaaaacggcccatgccaagaaacaagaggttgttgtcttaggatcccaagaaggtgcaatgcatactgcgctaaccggggccacagaaatccaaacatccggtacgactacaatattcgctggacatttaaaatgtagattaaagatggacaaattaacccttaagggaatgagttatgtaatgtgtactggctcatttaagctagaaaaagaagtagctgagacgcaacatgggacagtactcgttcaaattaaatatgaaggtacagacgcgccatgtaaaatacccttttccacccaggatgaaaaaggtgtcacccaaaacgggagactaattactgccaatccaatagtaacagacaaggacaaacccgtaaacattgaagctgaaccaccttttggcgaaagctatatagtgataggcgctggagagaaagcattgaaactctcttggttcaagaaaggcagctcaattggaaaaatgtttgaggcgacagcaagaggcgccagacgaatggcaatactcggcgacactgcttgggattttggatcaattggtggcgtgttcacgtctgttggtaaacttgtgcatcaaatatttggaacagcttatggagtactgttttcaggagtctcatggacaatgaaaataggaataggagttctcttaacatggttaggtttaaattctcgatcaacttcattaagtatgacgtgtattgcagtaggtttagtaacactatatttgggggtcatggtccaagcagactctggatgtgtagtgaattggaaaggacgggagttaaaatgtggatccggaatatttgtcactaacgaagtccatacatggactgaacaatacaaatttcaagcagatagtcctaaacggttatcggcagcaattggaaaggcatgggaagaaggagtatgcggaatcaggagcgctacccgtttagaaaatattatgtggaagcagataagcaacgaacttaatcatatacttctggaaaacgatatgaagttcactgtagtggtcggtgacgtggcaggtatattagctcaagggaagaaaatgatacggccccaacccatggaatacaaatacagttggaaatcatggggaaaggctaaaatcataggagccgatgtacaaaacactactttcattatagacgggccaaatacccctgaatgtccagacgaccaaagggcgtggaatatatgggaagtggaagattatggatttggaatttttacaaccaacatatggctaaaactgcgagactcatacacccaagtatgtgatcataggctaatgagcgcagcaatcaaagattcaaaagcagtacacgcggatatgggatactggatagaaagtgagaaaaatgaaacttggaaattagctagggcaagtttcatcgaagtgaaaacgtgtatttggcccaagtcacacactttgtggagtaatggagtactagagagcgaaatgataatacccaaaatatatggtggaccaatttcccaacacaattatcgcccaggctattttacccagacggcaggtccgtggcacctcggaaaacttgaactagacttcgatttgtgcgaagggactactgtagtggttgatgaacactgtggaaaccgcggtccatcattaaggaccacaacagtaactggaaaaataattcatgaatggtgttgtcgttcatgcactttaccgccacttcgattcaaaggcgaagatggatgctggtacggcatggagataaggccggtaaaagagaaggaagaaaatctagtaaaaagtatggtaagcgcgggctccggggaggttgatagttttagtctaggtctcctatgtataagcataatgatagaagaggtaatgaggtcaagatggagtagaaaaatgctgatgacaggaacattagccgtattcttcttactgataatgggtcaattaacttggaatgatctaatacgattatgcatcatggtgggtgcaaatgcatcagatagaatgggtatgggcaccacatacttagctctgatggcaacttttaaaatgcgaccaatgttcgctgtcgggcttctatttcgcagacttacttctcgagaagttcttttattaacgattggactcagcctggttgcaagtgtggaattaccaaattcactcgaagaattaggagatggcctagcaatggggataatgatactcaaattactcacggattttcaaagccaccaactatgggcgactttgctgtcacttacgttcattaagacaacgttttcactacattacgcctggaagacaatggctatggttctatcaatagtatcgctgttcccgttatgcatgagtactacgagccaaaagacaacctggttgcccgtcctgttaggttcactaggatgcaaaccccttacaatgtttttaattgctgagaataaaatatgggggcggaaatcatggccactaaacgaaggcataatggctgtaggaatagttagtatacttttaagttccctactaaagaacgatgtaccattagcaggacctctaatagcaggaggtatgctgatagcatgttatgtcataagcggaagtagtgcggacctttctctcgaaaaagcggcagaggtatcatgggaagaagaagctgaacattctggagcgtctcacaacatattagttgaagtacaagatgacggaacgatgaaaataaaagatgaagagagggatgatacactgactatcctacttaaagcaactttgttagcagtttccggtgtctatcccttatcgatccccgcaacgttattcgtatggtatttctggcagaaaaagaaacaaagaagcggtgtattatgggatacgccaagcccacctgaggttgaacgagctgtactagatgatgggatatataggatcatgcaaaggggcttactaggtcggtctcaggtaggcgttggagtattccaagagaacgtctttcatactatgtggcatgtaacgagaggggccgtattaatgtaccaaggaaaaagattggaaccgtcatgggcgtcggtaaagaaggatttaatatcctatggaggtggttggcgtttacaaggcagctggaatacaggcgaggaagtgcaagtaatcgcagtggaaccaggaaagaatcccaaaaatgttcaaacagcaccaggtacctttaaaacaagtgaaggagaagtgggggcaatagcattggactttaagccaggtacttctgggtcaccgatagttaaccgcgaaggtaaaattgtaggactttacggaaacggagtggttacaacatcaggcacttatgtaagtgcgatagcacaagctaaggcctcacaggaaggaccattaccagaaattgaagacgaggtgtttagaaaaagaaacttaactataatggatctgcatccggggagcggtaagaccaggagatacttaccggcaattgtgagagaagcaataaaaaggaaattaagaacattaatcttagctccaacacgagtagtagcgagcgagatggcggaagcacttaaagggatgccaatacgctatcaaacaacggccgtaaaatcagaacatacaggcaaggaaatcgtcgacttaatgtgtcatgctacatttaccatgcgattgctatccccagtacgcgtcccaaattacaatatgattataatggacgaggcacactttacagacccatcttcaatagccgcaagaggttatatatcgacaagggtaggtatgggagaggcagcggcgatattcatgactgcgacgcctccaggcagcgtagaagccttcccacaatcaaacgctgtaattcaagatgaagaacgagatattccagaaaggagctggaactcaggttacgagtggattaccgattttccaggtaagactgtgtggttcgtaccatcgattaaaagtggaaatgacattgcaaactgtttaaggaaaaatggcaaacgagtaatccaactgtcaagaaagactttcgatacagaataccagaaaactaaaaacaatgactgggactatgtcgtgacaactgatatctcagaaatgggtgcgaattttcgcgccgatcgtgtaatcgacccaagaaggtgcttaaagcccgtcattttaaaggacggaccagaaagggtaatattggcgggacctatgccggtgactgtcgcttccgcagcacaacggcgtggaaggattggtcggaatcacaataaagaaggggatcagtacgtatatatggggcaacccctcaacaacgatgaagatcacgctcactggactgaagcaaaaatgcttcttgacaatataaatacacctgaaggaataattcccgctttatttgaacctgagagagagaaaagtgccgcaatcgatggcgaatatagacttcgaggcgaagcaagaaaaacatttgtagaacttatgcgtagaggagatctaccagtatggttatcctataaagtggcttctgaaggtttccaatactcagatagaagatggtgcttcgatggagaaagaaacaatcaagttctggaggaaaacatggatgttgagatatggaccaaggaaggagagcgaaagaaacttagaccgcgttggctagacgcaagaacatactcggatcccctagctctccgagagtttaaagaatttgcagctggtaggcgcagtgtcagtggagatttgatactggaaattgggaaactaccccaacacctaactcagcgagcacaaaatgctctcgataatctcgttatgttgcataattcagaacaaggtggccgagcctacaggcatgcgatggaggaactaccggatacaattgagacgctaatgttactagctttaatagcggtcctcacaggcggtgttacattattctttctgtcaggcaggggtctcgggaagacttcaatcggattactatgtgtcatggcgagttccgtactcttgtggatggcttccgtcgaacctcattggatagctgctagcattattttagaatttttcctaatggtactattaataccagaaccagacaggcaacgaaccccgcaagataaccaattggcatacgtagtcataggactcctatttatgatactcacagttgcggctaacgaaatgggtctattagaaacaaccaagaaagacctcggaatcggacacgtagctgtagaaaaccatcatcatgctgcaatgttagatgttgatctgcacccagcttcagcttggacattatacgcagtagcgacgactattattactccaatgatgagacacactattgagaatactacagcgaacatatccctaacagcaatcgctaaccaggcggcaattttaatgggtttagacaaaggctggccaattagcaaaatggatattggtgtgccactactagcgttaggttgctactctcaggtgaatccactaactttaaccgctgcagtcctaatgctggttgctcactatgctataattgggccgggattacaggccaaagccacaagagaagcccaaaaacgaactgcagcagggataatgaaaaatcccaccgttgatggcatagtagcaatagaccttgacccagttgtctatgacgcaaaatttgaaaaacaacttggacagataatgctattgatactatgtacttctcaaattctacttatgagaacgacgtgggcgctatgtgaatctattactttagctacgggaccactgacgacactctgggaagggagtccaggcaaattttggaatacaaccatagcagtgtcaatggcaaatatattccgaggctcatacctggctggtgcagggctagctttttctttaatgaaaagtctgggtggcggccgacgcggtacaggtgcacaaggcgaaacactaggagagaaatggaagcggcaactaaaccaattaagtaaatcagagtttaacacatataaaagatcagggataatggaagtagatagaagtgaagctaaagaaggcttgaagcggggtgaaacaaccaaacatgcagtctcgagaggaaccgcgaaactgcgatggtttgtagaaagaaacctggttaaaccagagggcaaggttattgatcttggttgcggacgtggagggtggagttattactgtgcaggattgaagaaagtcaccgaggtcaaaggttataccaagggaggacctgggcacgaagaacctatacctatggcaacgtacgggtggaatctagttaaactacattcggggaaggatgtcttctttataccaccagagaaatgtgatactcttttgtgcgatataggtgaatcaagcccaaatccaaccattgaagaaggaaggacactacgagttcttaaaatggtagagccatggttaagagggaatcagttttgcattaagatactaaatccatacatgccgtcggtggtagaaacactagaacaaatgcaacgaaaacacggaggaatgttagtacgcaaccccttaagcagaaattccacacatgagatgtattgggtatcgtgcggtacaggaaatatagtaagtgcagtaaatatgacatctcgcatgttactcaaccgattcaccatggcgcataggaagccaacgtatgaacgagatgtagacttgggagcgggaaccaggcacgtagccgtagaaccggaagtagccaatctcgacataataggacaaaggatagagaacattaaacatgagcataaatcaacgtggcattatgatgaagataacccctataagacatgggcgtatcatggaagttacgaagtaaaaccatccgggtctgcgtcttctatggttaacggtgttgtaaaattactgacaaaaccttgggacgtaattccaatggtcacacagattgctatgacagatactactccgtttggacaacagagagtgtttaaggaaaaggtggatacaagaacaccaaaagcgaaacgtggtacagctcaaataatggaagtaaccgccaaatggttatgggggttcctatcgaggaataagaaaccacgcatatgcacacgtgaagagttcacacgcaaagtacggagcaatgcagcaattggagcagtcttcgtggatgagaaccagtggaacagtgcgaaggaagcagtagaagatgaaaggttctgggacttagtacacagagaacgagaattacataaacaaggtaaatgcgccacttgtgtatataacatgatgggtaaaagggagaagaaattgggagagttcggtaaggcaaagggctcaagagcaatatggtatatgtggttgggtgctaggttcttagaatttgaagcattaggatttatgaatgaggatcactggttttcgagagaaaacagcctatccggggtggaaggcgaaggcttacataaacttggatatatcctaagagatattagtaagatcccgggaggaaatatgtatgcagacgatacagctggctgggatacaaggataacagaagacgacctacaaaatgaagcgaagataacagatataatggaaccagagcatgcacttcttgcgagatcaatatttaaattgacgtaccaaaataaagtggttcgcgtacagcggccggctaaaaatggtacagtcatggacgtgataagtaggagagatcaaagggggtcaggtcaagtgggaacttacggactaaatacgtttacaaatatggaagctcaactaatacgccaaatggaaagcgagggaatcttcagcccatcagaacttgagacaccaaatcttgcgggcagagtcctagattggcttgagaaacacggagtcgagagattgaagaggatggcaatatctggagatgattgcgtggttaaaccaatagacgatagatttgcaacagcgttgacggctctcaatgatatgggaaaagtgaggaaagacataccccagtgggaaccgagtaagggatggaacgattggcaacaagtccctttttgtagtcatcactttcaccaattaattatgaaagatggaagagaaatagtcgtaccctgtagaaaccaagatgaattagtcggccgcgcacgggtatcacaaggagctggatggtctctaagggaaacagcttgcctaggaaagtcatacgcgcagatgtggcaattaatgtatttccatagacgggatttacgcctagcagcaaacgcgatatgttcggccgtccccgtggattgggtacctactagccgaacgacctggtctattcacgctcaccatcaatggatgacgactgaagatatgctcagtgtttggaatagagtatggatcgaggaaaacccatggatggaagacaagacgcacatttcatcgtggggagacgttccatatctggggaaaagagaagatcaatggtgtggcagccttataggattaaccgcaagggcgacctgggcgactaatatacaagttgctataaatcaagtgagaagattaattgggaatgaaaattatctagattatatgactagcatgaaaaggttcaagaacgagtcagatccggaaggtgccttatggtaa

SEQ ID NO: 21852 - RNA, 9879 nt, synthetic construct
  misc_feature 1..9879: note = derived and/or modified CDS sequence (opt6) from DENV-1__GU131782__SS-prME
  source 1..9879: mol_type = other RNA
tcggtaacaatgttactcatgttgatgcctacagctctagcctttcacttgacaacaagaggaggagaaccacacatgatagtgacaaaacaagaaagaggtaaatcgttgctttttaaaacatcagcaggagtaaacatgtgtacccttattgctatggaccttggagagttatgcgaagacaccatgacatacaaatgtccaaggataactgaggctgaacctgatgacgtggattgttggtgcaacgcaacggacacatgggtaacatacggaacgtgtagtcaaacaggcgaacatagacgcgataaaagatcagttgccctcgcacctcacgtaggcctaggtcttgaaactagaactgaaacttggatgtcaagcgagggagcttggaaacaaatacaaagagttgaaacatgggcactgcgccatcctggattcactgttatagctctcttcctcgcacacgccatagggactagcattacacaaaaaggcataatctttatactgctgatgttagttaccccttctatggctatgcgatgtgttggcattggatcccgtgactttgttgaaggcctctctggggccacctgggtcgacgtagtacttgaacatggaagctgtgttacaacaatggccaaagacaaaccaacactcgacattgaattgttaaaaacagaagttactaatcctgcggtgttaagaaaattatgcattgaagcaaaaatatcaaataccacaacggattcgcggtgcccgacccaaggcgaagcaacactgatggaagaacaagatgcaaacttcgtttgtagaaggacgtttgttgatagaggttggggcaacggttgcgggttattcggaaaaggcagcctaattacctgcgcgaaatttaaatgtgtgaccaaattggaaggtaaaatagtacagtatgaaaatctgaagtatagtgtcattgtaaccgtacatactggggaccaacatcaggtaggaaacgagagcaccgaacatgggactacggcaacaatcacaccgcaagcgcctactagcgaaattcaattaactgattatggagcgctaaccctagactgtagccctcgaacgggtcttgactttaacgaaatggttttattaacaatgaaggaaaaatcttggctagtgcataaacagtggtttctagatctaccattaccttggacgtcaggcgcatcgacatctcaggaaacttggaacaggcaagatttgttagtaacattcaaaactgcccatgctaagaaacaggaagtagttgtattaggaagccaagagggagccatgcatacagcactaacaggagcgacagaaatccagacatcaggaactacaaccatcttcgcagggcacctaaaatgtagattaaaaatggataaactcacattgaaaggaatgagctatgtgatgtgtacaggatcttttaaactagaaaaagaagtagctgaaactcaacatggaacagtcctagttcaaataaaatatgaaggaacggacgccccatgtaagatcccattcagcacacaagacgagaaaggcgtgactcagaacggacgactaataacagcgaaccccatagtaactgacaaagagaaaccagtcaatatagaagctgaaccaccgttcggagagagttatattgtaattggagccggcgaaaaagcattaaagctcagttggtttaagaaagggtcctctataggaaagatgtttgaagcaactgccaggggagcacgcagaatggcgatcctaggagacactgcatgggattttggaagcattggaggagtattcacatcagtcggaaaacttgttcatcaaatatttgggactgcttacggagttcttttctcaggagtttcatggacaatgaaaataggaattggggtgctattaacatggctaggtctcaactcaaggtctacaagtctatctatgacctgtatagcggtaggcctagtaacattatatctaggtgtaatggtccaagccgactctgggtgcgtcataaactggaaagggagagaattaaaatgtggatcaggtatctttgttacgaacgaagttcacacatggacagagcaatataaattccaggccgatagtcctaaaagactatcagcagcaataggaaaagcctgggaagagggcgtttgcggcatacgctcagcaaccagactagagaatataatgtggaagcagattagcaacgagttaaatcatatacttctagaaaatgacatgaaatttaccgtcgtagtgggagatgtggtaggaatccttgcacagggtaagaaaatgattaggccacaaccaatggaacacaaatatagttggaaaagctggggtaaagcaaagataataggcgctgatgtacaaaacacaacattcattatagatggtcctaatactccagagtgtccggatgatcaaagagcttggaatatttgggaagttgaggactatggtttcggaatatttacaacgaacatatggctcaagctccgggactcatatactcaggtatgcgaccacaggttaatgtcagccgccatcaaggactcgaaagccgtacatgctgacatgggctattggatagaatctgaaaagaacgagacctggaaactagctagggccagtttcatcgaagttaaaacttgtatctggccaaagtctcatacactgtggtcaaatggcgttttagagagtgaaatgataattcctaagatatatgggggcccgataagtcaacataattatagacccggttactttacacaaacagcgggcccatggcacttgggcaagctagaactggactttgatttatgtgagggaactacagttgtagttgacgagcactgtggtaatagaggaccatcactgaggacaacaacagtgacaggaaaaataatacatgaatggtgctgcagaagttgtacattgcctccactccggtttaagggtgaagatggatgttggtatggaatggagattagaccggtaaaggaaaaagaggaaaatttagtaaaaagcatggtttctgcaggtttaggagaggtagacagtttttcactaggactgctctgcatatccataatgatagaggaagtcatgcgctcgagatggagtaggaaaatgttaatggcagggacgctagctgtttttctcttgctaataatgggtcaactcacatggaatgatttaatcagactatgcataatggtaggagcaaatgcatcggaccgaatgggaatggggacgacatacttggcactaatggctacgtttaagatgagacctatgtttgcagtgggattattatttagaagactgacatcacgagaagtattacttctgactataggattatcattagtggcaagtgtagaacttcctaattccctagaggagcttggtgatggactggcgatgggaatcatgatactcaaattactaacagattttcagccacaccaattgtgggcaaccttgttatccttaacttttattaaaacaaccttatcattgcattatgcatggaaaaccatggcaatggttctgtctatagtctcattatttcctttatgcctatcaacaaccagtcaaaagacaacatggctgccggtactactgggatctttaggctgtaagccgctgacaatgttcttaatagcagaaaacaaaatatggggcaggaaaagttggcccctaaatgaggggatcatggctgttggcgttgtaagtatattattatcgtcacttctcaaaaatgatgtcccgcttgccggtccattgatcgcgggaggcatgctaattgcctgttatgttattagcggaagtagtgcggatctaagcctggagaaagccgccgaagtgtcatgggaagaagaagccgaacactctggagctagccacaacatcctcgtggaagttcaggatgacgggactatgaaaataaaagacgaggaacgcgacgatacgctaacaattttacttaaagctacgttgttagcaataagtggagtatatcctttatcaattcctgccaccttgtttgtatggtatttttggcagaagaagaaacaaagaagtggggttttgtgggatacaccgtccccgcccgaagtggaacgagcagttctggatgacggcatatatagaattatgcagagaggactcttaggtcgaagccaagtaggagtaggggtcttccaagaaaatgtattccacactatgtggcatgttactaggggagcggtccttatgtatcaaggaaaacggctagaacccagttgggccagtgtaaagaaagatctgataagttatggaggtggttggagactccagggatcatggaataccggagaagaggttcaagtaatagctgtagaaccaggcaaaaaccccaaaaatgttcaaactgcacccggaacatttaaaacgcctgaaggggaggtgggcgcgatagccctagacttcaaaccaggtactagcgggagtccgatcgttaaccgtgaaggaaaaatagtaggtttgtatggaaacggtgtagtaacaacaagtggaacatatgtgagcgcaatagctcaggccaaagcctcacaagaagggcctctgcctgaaatagaagatgaagtattcagaaaacgcaatctaacaataatggatctacatccagggtcaggaaaaacaagaagatacttacccgcgatagtgagagaggcaataaagaggaaattgagaactttgatattggcgccaaccagagttgtagcctccgaaatggctgaggcattaaaaggtatgccaatacgttatcaaaccacggccgtgaaaagcgaacatacaggaaaagaaatagtggacctgatgtgccatgcaactttcacaatgagactcttatcacctgtgcgtgttccaaactataatatgattatcatggacgaggcccatttcacggatccctcatccatcgcagcaaggggatacatttcgacgagagtcgggatgggagaggccgcggcaatatttatgacagccactccccctggttccgtagaagcgtttccccaatcgaatgctgtcattcaggatgaagagagagatataccagaaagaagttggaactccgggtatgaatggataacagactttccaggaaaaacagtgtggtttgtgccctcgataaagtcagggaatgatatagcaaattgtttacggaagaacggaaaacgagtaattcaattgtcacgaaaaaccttcgacacagaatatcagaaaacgaaaaataatgactgggactatgtagtgactactgacatatcagaaatgggcgccaattttcgggcagaccgagtgatagatccgagaaggtgtttaaagccagtaatactcaaggacggcccagaacgagttattcttgctggtccaatgccagtgactgttgcttccgccgctcaaagaagaggtcgaatcggtcgaaatcataacaaagagggggaccaatatatatatatgggccaaccactaaataatgatgaagaccatgcccattggactgaggcgaaaatgttgctcgataatataaatacccctgaaggaataatacccgcacttttcgaaccagaacgagaaaaatcagcagctatcgatggagaatatagactcagaggagaagcaagaaaaactttcgttgaactaatgagaagaggcgatctacctgtttggttgtcgtataaagtcgctagtgagggtttccagtattcagatcgaaggtggtgtttcgacggcgagaggaacaaccaagtattggaagaaaatatggacgtagaaatatggaccaaagagggtgagcggaagaaacttaggccgcgatggctagacgctcgcacatattcggacccactagcactaagagaatttaaagagttcgctgcaggaagaaggagcgtgtcaggcgatttaattttagaaatcggaaagttgccacaacacttaacccaaagagcacagaatgcattggataacttagtaatgctacataactccgaacaaggagggagagcatacaggcatgcaatggaggaactaccagacactatagaaacactgatgctacttgcactgatagccgtattaacaggaggcgtaaccctattcttcttgtcaggaagaggattaggtaaaacatctataggactactttgtgtgatggcatcctctgtgctactttggatggcttcagtcgaaccacactggatagccgcctctataatattggagttctttttaatggtattgcttatcccagaacctgaccgacaacgcacaccccaagacaatcaattagcatacgttgtaataggtcttttatttatgatattaacagtggctgcaaacgaaatgggtctacttgaaacgactaagaaagatctgggcataggacatgtagcagttgaaaatcatcaccatgctactatgctcgatgtagacctccatcccgcgagtgcctggactctctatgctgttgccacaaccataattactcccatgatgcgccatacaatagagaacactacagcaaatatttctttgacagcaatcgcaaatcaagcagctattttaatgggtttagataaaggatggccaatatcgaaaatggacataggcgttccattgctagctttaggttgttattcacaagttaatcctcttaccttaaccgcagcagtattaatgttagtagctcattatgccatcatcgggccagggctacaagccaaggccacaagagaggctcagaaaagaacagcagcaggtatcatgaaaaacccaacagtcgatgggattgtcgcaatagatttagatcctgttgtatatgacgcgaaatttgaaaagcagctaggacaaatcatgttactcatactctgcacgagtcaaatattactaatgagaactacgtgggcattatgcgagtctataacgctggcgactggaccactaactaccttgtgggagggatcccctggcaagttctggaatactacaatagccgtttcgatggcaaacatctttagaggcagttacttggcgggcgcggggttagcattctcactcatgaaaagtttaggcggagggagacgaggtacgggggcgcaaggagaaacgttaggagaaaaatggaagcggcaattaaaccaactatcaaaatccgagtttaacatctataagagatctgggataatggaggttgatagatcggaagcaaaggaaggattgaagagaggcgaaacaacacgacatgcagtttctagaggtacagctaagctgagatggtttgtagaacgcaacctcgttaaacccgagggtaaagtcatagatttaggatgcgggcgtgggggatggtcgtattattgcgcaggacttaagaaagtaacggaagtcaaaggatatacgaaaggaggaccaggacatgaagaaccaattccgatggcaacatacgggtggaaccttgtgaagctacactcgggaaaagatgtgtttttcacgccaccagaaaggtgcgatacgttactatgtgatattggagaatcaagtcctaaccccacaatagaagagggtcgtaccctgagagttttaaagatggtggaaccctggttacgggggaatcaattttgcatcaaaatcttaaatccttatatgccgagtgtagtcgaaacactagaacaaatgcaaaggaaacatggagggatgcttgtaaggaatccactttcccgtaacagtacacacgaaatgtattgggtgtcgtgcggcactggaaatattgtatctgcagtaaacatgactagcagaatgctgctgaatcgatttactatggctcatagaaaaccaacatatgagcgagatgttgacctaggagcaggaacaagacatgtagcggtggaaccggaggttgctaacctggacataataggacagagaattgaaaacattaaacacgagcataagtccacctggcattatgatgaagacaatccttataaaacatgggcttatcacggatcctacgaagtgaagcctagcggttcagctagtagcatggtaaatggcgtggtgaagctattgaccaaaccctgggatgtaatcccaatggtgacgcaaatagcaatgacagacaccaccccctttggccaacaacgagtatttaaagaaaaagtggatactcgaactccaaaagctaaaagaggcacagctcaaataatggaagttaccgcacgatggttgtggggattcttatcacgaaacaagaaacctaggatatgtacgcgagaagagttcactcggaaagtaaggagtaacgcagctataggagcggtatttgtagatgagaatcagtggaatagtgcaaaagaagcggtggaagacgaaaggttttgggacttggtgcaaaaagaaagagaactccataaacaggggaagtgcgctacgtgcgtgtataacatgatgggaaaaagagaaaagaaactcggagaatttggaaaggcaaaaggctctcgtgccatctggtacatgtggttgggagcccgatttctcgagttcgaggctttggggtttatgaatgaagaccattggtttagcagagaaaatagtttaagtggagtcgagggggaagggttacataaacttggttatatattgcgcgatataagcaaaataccaggtggtaatatgtatgcagatgatactgcaggttgggatacgaggataacagaagacgacttacaaaatgaagcaaagataacggatataatggagccggagcatgctttgcttgccacaagtatctttaaacttacataccaaaacaaagtggtgagagtccaaaggcctgcaaagaatggaactgtaatggatgtgataagcaggagagatcaacgtggaagcggacaagtgggaacttatggattaaatacctttacaaatatggaggcccaactaataagacaaatggaaagcgaagggatattcttgccgtcagaactcgaaactccgaatctagccgaaagagtcttggactggctggaaaaacatggcgtagagagattgaaaaggatggcgatctcgggagatgattgtgtagtaaaacccattgatgacaggttcgcaacagcgttaacagcactaaacgacatgggtaaagtaaggaaagatattccgcaatgggaaccatcaaagggatggaatgattggcagcaggtaccattctgttcacatcattttcatcaactcataatgaaagatggccgtgagatagtagtaccctgtaggaatcaagatgaattggtcggaagggctcgcgtatctcaaggcgcaggatggtcactccgagagaccgcttgcctaggcaaatcttatgcacagatgtggcaattgatgtacttccatagacgtgacttgagattggccgcgaatgcaatctgctcagctgtaccagtagattgggtaccaacatctcgcactacatggagtatacacgctcatcaccagtggatgactacagaagacatgctttcagtctggaacagagtgtggattgaggaaaatccgtggatggaagataagactcatgtttcaagttggggagacgtaccataccttggtaaaagagaggatcaatggtgtggaagtctgataggtctaactgcaagagctacatgggccagtaacatccaagtggctataaaccaagtaagaaggttgataggcaatgaaaactacctggactatatgacgtccatgaaacgttttaagaatgaaggagatccagaaggagctttatggtag

SEQ ID NO: 21853 - RNA, 9879 nt, synthetic construct
  misc_feature 1..9879: note = derived and/or modified CDS sequence (opt6) from DENV-1__GU131784__SS-prME
  source 1..9879: mol_type = other RNA
agcgtaactatgctactaatgctaatgccaaccgcgctcgcatttcatctaacaaccagaggtggcgaacctcatatgatcgtaagcaaacaagaaaggggaaaaagtctactatttaaaacaagtgccggtgtaaacatgtgcacgttgattgctatggatttaggagagttctgtgaagatacgatgacgtacaaatgtccacgaataacagaagcagaaccagatgacgtggactgctggtgcaatgcaacagatacttgggttacttatggtacctgctcacaaaccggtgaacataggcgcgataaaagatcggttgcccttgcacctcatgtaggtctcggcttagaaacgaggacggaaacttggatgagtagcgaaggtgcgtggaaacaaattcaaagggtagaaacttgggcgctaaggcacccaggatttaccgttatcgcgctttttcttgcccatgcaataggcaccagtatcactcaaaaagggattatattcatcctcctaatgcttgtaacacctagtatggctatgagatgcgttggtatcggatctagagatttcgttgaaggattatccggagcaacctgggtagacgtggttctagaacatggttcttgtgtgacgacaatggccaaagataaacccactttggatatagaactacttaaaacagaagtaacgaacccagcagtactccgaaaattatgtatcgaagcaaaaatatctaatacaacgacagattcacgttgccccactcaaggcgaagcgacacttgtggaagaacaagacgccaactttgtatgtagaagaacttttgtggaccgaggttggggaaatggttgcggactatttggaaaagggtctttgattacttgcgctaaatttaagtgtgtcacaaaattggaaggtaaaactgtacagtacgaaaatctcaagtattcagtcatagttactgttcacacgggagaccaacatcaggtgggtaatgagagtaccgaacacggcaccaccgctaccataacacctcaagcaccaagtacagaaattcaactgacagattacggagcactaactctcgactgctcaccgagaacgggtttagactttaacgaaatggtattactaactatgaaggaaaaatcatggcttgttcataaacaatggtttcttgatttgccattaccatggacgtcaggagcaagtacttcacaagaaacttggaatcgaaaagaccttctagttacctttaaaacagcacacgccaagaaacaggaagtagttgttttaggctcacaggaaggagccatgcatacagcacttacaggagcaacagaaatacaaacgtcgggcaccactactatttttgccggacacttaaagtgccgattaaagatggataagctaacattaaaaggcatgtcttatgttatgtgtacaggtagtttcaaattggaaaaagaagtcgctgaaacccaacatggaacagtcctagtgcaaattaaatacgaagggactgacgccccctgcaagattccattttcaacgcaagacgaaaaaggtgtaacacaaaacggtcgcctgataacagccaatcctatagtgacagacaaagaaaaaccagtaaatattgaagcagaacccccgttcggcgagagctatatagtaataggggccggtgaaaaagctctcaaattatcctggtttaagaagggctctagcatcgggaagatgtttgaagcaacagcccgaggggcaagacgaatggcaattttgggagatacggcatgggatttcggcagtattggtggggttttcacgtcagtgggtaaactggttcaccaaatattcggtaccgcgtatggtgttttatttagcggagttagttggactatgaaaataggaattggtgtattacttacgtggcttggcttaaattcgagatctacctcattaagtatgacgtgcatagcagtaggcttagtgacattatatctcggtgttatggtacaggcggactccggctgtgttataaactggaaaggtcgagagttgaaatgtggatccggtatttttgttactaatgaggttcatacctggactgaacaatacaaattccaagcagactcaccgaaaagactatctgcggcgattggaaaggcttgggaagaaggggtgtgcggtataaggtcagccacccgactagagaacattatgtggaaacagatatctaatgaattgaatcatatactgctcgaaaatgacatgaagtttacggtggtcgtgggtgacgttgcgggtatcttggcacagggaaagaaaatgattcggccacaaccaatggagtacaaatactcctggaagtcctggggtaaagcaaaaattataggtgcagatgtacaaaacactacatttataatcgacggaccaaatactccagaatgtcccgatgaccagagagcatggaatatttgggaggtagaggattatgggtttgggatatttaccacgaacatatggctcaaattgagagattcatacactcaagtatgcgatcacagactgatgagtgcagcaattaaggacagcaaagctgttcatgccgacatgggatactggatcgaatcagagaaaaatgaaacatggaaacttgccagggcctcgttcattgaagtcaaaacctgcatttggccaaagagtcacacattatggtcaaatggtgtactagaaagtgaaatgataataccgaagatatatgggggtcccatcagtcaacacaattacaggcctgggtactttactcaaacagcaggaccgtggcatctgggcaaattagaactcgatttcgacttgtgcgaggggactacggtagtcgttgacgaacattgcgggaataggggaccctcacttaggacaaccactgtaaccgggaagatcattcatgaatggtgctgcaggtcgtgtactcttcccccactacggtttaaaggagaagatggatgttggtatggaatggaaattcgccctgtgaaggaaaaggaagaaaatttagtaaagagtatggtaagcgcaggttcgggtgaagtagacagtttttcactaggcttactatgtataagtataatgatcgaagaggtaatgcgatcgaggtggagtcggaaaatgttaatgaccggcacattagctgtattcttcctactgataatgggacaactaacttggaatgatctgataagattatgcattatggtgggagctaatgcttccgatcgaatgggaatgggtacaacttatctagccttaatggcgacttttaaaatgagaccgatgtttgctgtaggattgctgtttcgcaggttaacatccagagaagtattgttactaacgatcggcttgagtcttgtggcatcagtagaactacctaatagccttgaagaattgggagatggcttagcaatgggaataatgatcttaaaacttctaacagattttcaatcgcaccaactatgggctacgttattaagtctcaccttcatcaaaacaacatttagtcttcatcacgcatggaagacaatggccatggttctttcaatagtaagcctctttcccctgtgtcttagtacaaccagccaaaagaccacatggttacccgtattactgggctctttgggatgcaaaccacttacaatgtttttaatagcagagaacaaaatctggggaagaaaatcgtggcctctaaatgagggcataatggctgttggtattgtcagtatactgcttagttccttgttaaagaacgatgtacctctagccggacccctgatcgctggaggcatgttaatcgcatgttatgtcatttctggcagtagcgcagatctaagtttggaaaaagcggcagaagtttcgtgggaagaggaggcagagcatagtggcgcctctcacaacatattagtagaagtacaagacgacggtacgatgaaaataaaggacgaggaaagagacgatacgttaactatactattaaaagcgactctattggcggtaagcggtgtatatcccttatccattcctgctactttatttgtatggtatttctggcagaaaaagaaacaaagatctggcgtgctttgggatacacctagtccacccgaagtggagcgtgcagtgctagacgacggtatatataggattatgcaacgtggactcttggggagatcacaagtaggagtaggtgtattccaggaaaatgtatttcacacaatgtggcatgtaacccggggtgcggtacttatgtaccaagggaagcgtttagaacctagttgggcatccgttaagaaagatcttattagctacggcggtggatggaggttacagggtagttggaatacaggagaagaagtacaagttatcgctgtcgaacccggtaaaaatcccaaaaatgttcaaacagctccaggaacctttaaaacctccgaaggagaggttggcgcaatagcactagactttaaacccggtacctctggatcaccgatcgttaacagagaaggaaaaatagtaggtctatatggaaacggagtagttacgacaagcggcacttacgtttcggctattgcacaagcaaaggcatcccaagagggacctttaccggaaatagaggatgaagtgttccgaaagaggaacctcacaatcatggacttgcacccgggatccggaaaaactaggcggtatttacccgcaattgtcagagaagctataaaaaggaaattgcgaacactgatacttgctccgacaagagtagtcgcttctgagatggcagaagcattaaaaggtatgcccataagatatcaaacaacagccgttaaatctgaacacacgggtaaagaaatcgtagatctcatgtgccacgccacttttacaatgagactattatcgccagtcagagttcctaattataacatgataattatggatgaagcacattttaccgatccgtcttcaatagcggcaaggggttacatatctactagagtcggtatgggtgaagccgcagctattttcatgaccgctacgccaccaggaagcgtcgaggcattccctcagagtaacgcagttatacaagacgaagaaagagatataccagagcgctcctggaactcaggttacgaatggattacggacttccccggaaaaacagtatggttcgttccctcaataaagtctggcaacgacattgcaaattgcttacgaaagaatgggaagagagttatacaattaagtcgaaagactttcgatacggaatatcagaaaaccaaaaataacgattgggactatgtagttacaaccgatatcagcgagatgggagcaaattttcgagctgatagagttattgatccaagaagatgcctgaagcctgtaattttaaaagatggacctgagcgtgttatattggctgggcctatgcccgttaccgttgcctccgctgcacaaagaagaggacggataggaagaaaccataataaagaaggtgatcaatatatatacatggggcaaccactaaataatgacgaagatcacgctcactggaccgaagcaaaaatgctactcgataatattaacacaccggagggaatcattcctgcactatttgaacctgaaagggagaaaagcgctgccatagacggggaatacagattaagaggtgaagcaaggaaaacattcgttgagttaatgcgaagaggggatctgcctgtttggttgtcatataaagttgcctccgaaggatttcaatattcagacagaagatggtgcttcgacggtgaacgaaataatcaggtattagaggaaaatatggacgtcgaaatttggacaaaggaaggtgaacgcaagaaacttaggccaagatggttagacgcgagaacatattcggatcctcttgcattaagagaatttaaagaatttgctgccggccgaagaagtgtctcaggtgacttaatactagaaatcggtaaactaccgcaacaccttacacagagagcccaaaatgcattggataatctagtcatgctacataattctgaacaaggaggacgagcgtatagacatgccatggaagaattgcctgataccatcgagacactaatgctcttagcactcatcgcagtattaacaggcggagttacactattctttttatcaggacgaggactaggaaaaacatcaataggactgctgtgtgtaatggcgtcgagtgttttgctgtggatggcaagtgttgaaccacattggatagcggcttcaatcatacttgagttctttttaatggtgcttttaatacctgaaccagatagacaaagaacccctcaagataaccaattggcgtatgtcgttataggtttattattcatgatccttacagtagcagcaaacgaaatggggctactcgaaaccactaagaaagacttgggtataggacatgcagcagttgaaaaccatcatcacgctgcaatgttagacgttgatttacatcctgcatctgcctggacattgtatgcagttgctaccacgataataactccgatgatgagacacacaatagaaaacactacagcgaatatatcgctaacagctatagcaaatcaggctgcgatattaatgggcttagataaaggttggccgatatcgaaaatggacattggagtaccgctactagcactagggtgttatagtcaagttaatcccctaactcttacggcggcggtgcttatgctggtagcacactatgcaatcattggacccggccttcaagcaaaagctacacgggaagcccagaaaaggactgcggccggcataatgaagaatccaacagttgatggaatagtagcaatagatctggatcctgtcgtctatgacgcaaaattcgaaaagcaacttgggcaaataatgcttcttatcctttgcacttcacaaattttactgatgaggacaacttgggcattgtgcgaaagtataacgctcgcaactgggccacttaccacactgtgggaaggttcgccagggaagttttggaataccaccatagccgttagtatggccaacatattcagaggtagttatcttgcaggagccggcttagcttttagtctcatgaagtcgttaggaggaggaagaagagggactggtgcacaaggtgaaacactaggcgagaaatggaaaagacaacttaaccaattatctaaaagtgaatttaatacttacaaaagatcaggtattatggaagtagacagatcggaagctaaagaagggttgaaaagaggtgaaactactaaacacgcggtgagtcgtggtaccgccaaattgcgctggttcgttgaaaggaatttagtaaaaccagaaggcaaagttattgatttaggatgtgggaggggagggtggtcctactattgtgcaggacttaagaaagttacagaagtaaaaggctatacaaaaggaggacccgggcacgaggagcctattccaatggcaacttatggttggaatctagtaaaattacattcgggaaaggatgtcttcttcatcccaccagaaaaatgcgatacactcttgtgtgacataggcgaatcatctcctaatccaacaatagaagaaggaaggacactcagagtcttgaagatggttgagccttggttgcgaggtaaccagttttgcataaaaatactaaacccttatatgccaagtgtagtagaaaccttagaacaaatgcagcgtaaacatggagggatgcttgtacgtaaccccttatcaagaaactcaacacacgaaatgtattgggtctcgtgcggaacaggaaacatcgtatcagccgtcaacatgacaagtaggatgctacttaacaggtttacaatggcacaccgaaaaccgacatacgaaagagacgtagacttaggagctggcactaggcacgttgcggtagaacctgaagtggcaaacctagatataataggccaaaggatcgagaacataaaacatgaacataagagtacgtggcactatgatgaagacaatccgtataagacatgggcatatcatggatcttatgaggtcaaaccatcaggttctgcaagttctatggtaaatggggttgtaaagttgttgacaaaaccctgggacgttattcctatggtcactcagattgcaatgacggacacaacgccgtttggacaacaaagagtattcaaagagaaggtggacactcgcacaccaaaagcaaagcggggtacagctcagataatggaagttaccgcaaaatggctttggggttttctttcgaggaacaagaaaccacgaatctgcacgagagaagaatttacaagaaaggtgcgatccaacgcagcgattggtgccgtattcgttgacgagaaccagtggaacagtgcaaaagaagcggttgaagacgaacgattttgggatctagtgcaccgagaacgtgaattgcataaacaagggaaatgtgcaacatgcgtctataacatgatgggtaaacgggagaagaaactaggggagtttggaaaggcaaaaggttctagagcaatatggtacatgtggctaggtgcgcgattcttagaatttgaggctttaggattcatgaatgaagatcattggtttagcagagaaaactctttaagtggcgtagaaggagagggactgcacaaactaggatacatattaagagacatatcaaaaataccgggtggcaatatgtatgccgacgacactgcgggatgggacacacggataaccgaagatgatttacaaaacgaggcaaaaattactgatatcatggaaccagaacatgccctactagctaaatcgatattcaaattaacttaccagaacaaagtcgttcgcgttcagagacccgcaaagaacgggacagtaatggatgtaattagtagaagagatcaacggggatccggtcaggtcggcacctacggattaaacacattcacgaacatggaagcccaattaataagacaaatggaatcagaaggcatattttctccctccgaattggaaactccgaacttagcaaggcgcgttttggattggttagagaagcatggtgtagagagactcaaacgaatggccataagtggagatgactgtgtcgtcaaaccgattgacgaccgattcgccacagcactaacggcactgaatgacatgggcaaagtcaggaaagacatacctcagtgggaaccttcgaaaggatggaacgattggcaacaggtccctttttgctcacatcactttcatcaattaatcatgaaagatggcagagaaattgtagtcccatgtagaaatcaggacgagctagtcggaagggctagggtttctcaaggagctgggtggtcattaagagaaaccgcttgtctcgggaaatcttatgcacaaatgtggcagcttatgtattttcatagacgcgatttgagattagcagccaatgcaatatgcagtgcagtacctgtagattgggtccccacaagccgcaccacctggagtatccacgcacatcaccaatggatgactacagaagatatgttatctgtgtggaacagagtgtggatcgaagaaaatccctggatggaagacaaaactcatatatcatcgtggggtgacgtaccatacctagggaagcgagaagaccaatggtgcggttctcttatagggttgacggcgcgagcgacttgggccactaacatccaagtcgccataaatcaagtaaggagactcattggtaatgaaaattatctagattacatgacaagtatgaaaagatttaagaatgaaagtgatccagaaggagcgctttggtaa

SEQ ID NO: 21854 - RNA, 9879 nt, synthetic construct
  misc_feature 1..9879: note = derived and/or modified CDS sequence (opt6) from DENV-1__JF937612__SS-prME
  source 1..9879: mol_type = other RNA
agtgttacaatgttattaatgctcatgcctactgcactagcttttcacttaacaacacgaggtggtgaaccacacatgatcgtctcgaaacaagaacgaggtaaatccttactctttaaaacatcagcaggggtaaatatgtgtactctaatagctatggatctaggtgaattatgtgaagataccatgacttataaatgtccaagaattaccgagactgaaccagatgatgttgactgctggtgcaatgctactgatacatgggtaacatacggaacttgcagccaaactggagaacaccgaagagacaaaaggtcagttgcattagcaccccatgtgggattaggcttagagacgagaaccgaaacatggatgagtagcgaaggtgcgtggaaacaaattcaaagggtggaaacttgggcactacgtcatcccggcttcaccgtgattgcactattcctagcccacgccattggtacaagtattacacaaaaaggaataatttttatattattgatgcttgtaacgccttctatggccatgcggtgcgttggaattggaagtcgagacttcgtggaaggtttatcaggggcgacctgggtcgacgtggtactagaacatggttcatgtgtgaccacgatggccaaagataaaccgaccttagacatcgaactattaaaaactgaagttacaaatccggcagtccttcgaaaattatgcatcgaggcaaaaatttcgaacactactaccgactcgaggtgcccgacccaaggagaggcgacattagtagaagaacaagatgcaaattttgtttgtcgtagaaccttcgtcgacaggggatggggaaacgggtgcggattgtttgggaaagggtccttgattacttgcgcaaaatttaaatgcgtaacaaaattggaaggaaaaattgtgcaatatgagaatctaaaatattctgtgattgtaactgttcatacaggtgatcaacatcaagtgggaaacgagtcaaccgaacatggaaccacagctactataacacctcaagctccgacgacggagatccagcttacagattatggagccctaacgttagattgttcacctcgaacaggattagacttcaacgagatggtactattaacaatgaaagagaaaagctggctagtgcataaacaatggttcctggacttacctctaccatggacctcgggagcgtcaacctcgcaagaaacgtggaataggcaagatttgctagtgacgttcaaaactgcacacgccaaaaagcaagaagtagtggtacttggcagccaggagggagccatgcacacggcattaactggagctacagaaatccaaacttcgggaacgacaacgatcttcgccggccacttaaaatgtagactaaagatggataaacttacccttaagggcatgagctatgtaatgtgcacagggagctttaagttagaaaaagaagtagcagaaacacaacatggtacggttctcgtccagataaaatacgagggaacagatgccccttgtaaaattcctttctcaacccaggatgaaaagggtgtcacccaaaatggtagactcatcaccgcgaatccaattgtcacagataaagaaaaacccgttaatattgaagctgagcctccattcggagaatcttacattgtaattggcgcgggtgaaaaggcactaaaactgtcctggtttaagaaaggttcctcaattggaaagatgttcgaagcaaccgctagaggcgcacggagaatggcaatattaggtgacacagcatgggattttggctcaattggcggtgtgtttacgagtgtcggaaagctagtacatcaaatattcggaacagcttatggagtattattttccggtgtttcttggacaatgaaaatagggataggagtattattaacgtggctaggtttgaactctaggagtacaagtctgagcatgacttgtatagctgttggattagtaacactgtacttaggcgttatggtccaggcagacagtggatgcgtaattaattggaaaggcagagaactcaagtgcggctctgggatattcgttacaaatgaagtacacacttggacagaacaatacaagttccaagcggacagcccaaaacgtttgtctgcagctattgggaaagcatgggaggaaggtgtatgtgggatacgctccgctacacggttggaaaatataatgtggaaacaaataagtaatgagttgaaccatatactcctagaaaatgatatgaagtttactgtcgttgtaggtgatgtagcaggaatactagcacagggcaagaaaatgatccgcccccaacctatggaatataaatactcatggaaatcatggggtaaggccaaaataatcggtgctgatgtacagaatgcaacattcattatagatggacctaatacgccggaatgtccagacgatcaacgcgcatggaatatatgggaagtcgaggattatgggtttggtatatttacaacgaacatatggttgaaacttagagatagttatacgcaagtatgcgatcatcgtctgatgtctgcggctatcagagattcgaaagcagttcatgcagacatgggatattggattgaatctgagaaaaacgaaacgtggaaattagcccgtgccagtttcatagaagttaaaacttgtatatggcctaagtcacatacgctttggagtaatggtgttcttgaaagtgagatgatcattccaaaaatatatggagggccaattagccagcacaactaccgcccgggatactttacacaagcagctggaccttggcaccttggcaaattagaacttgacttcgatctttgcgaaggtactaccgttgtcgtcgatgagcattgcggaaatcgtggcccttctttaagaactacgactgttacaggaaaaattattcacgaatggtgttgcagaagctgtactctaccacctctacgatttcgaggtgaagacggctgttggtatggaatggagataaggccggtaaaagaaaaggaagaaaacttggttaaatcaatggtatcggctggttcaggagaggtagattcgtttagcttgggtttattatgtatttctataatgatagaagaggtcatgagatccagatggagtagaagaatgctgatgaccggcacactggcagtcttctttctcctaatcatgggacagctaacgtggaacgatcttattagattatgcattatggtaggtgccaacgcgtctgacagaatgggcatgggtacaacctacttagcgttgatggcaacttttaagatgaggccaatgtttgccgtgggtttactattccgcagacttacgagcagggaagtcttgttattaacaataggtctaagccttgttgcaagtgtagaacttcctaattcactggaagaattaggagatggattggcgatgggaattatgatattaaaactactaacggattttcagtcccatcagttgtgggctactctattgagtttgacatttattaagacaactttttccttacactatgcatggaaaacaatggcgatggtgttgtccatagtatcattgtttcctctatgtctatccaccacctcacagaaaactacctggctgcccgttctattagggtctctgggatgtaaacccttaacaatgtttttaattgccgagaacaaaatctggggaaggcgatcctggcctttaaacgaaggcataatggccgtgggaatagtctcaattctattatcttccttacttaagaatgatgtaccgcttgcagggccactaatagccggaggcatgctcatagcttgttatgtaatttcaggctcaagtgctgacttgagcctggaaaaggctgccgaagtgtcttgggaagaggaggcagaacattcgggagcgtcccataatattttagttgaagtgcaagacgacggcacaatgaaaataaaagatgaagaaagagacgataccctcacaatcttattaaaggcaacgctactagctgtcagtggagtttaccccctctctatccccgcaacattatttgtctggtatttttggcagaagaagaaacaacgatctggggtcttatgggacacacctagtccacctgaagtagaacgtgcagtactcgatgatggcatttatagaataatgcagcgcggattactaggtcgatcgcaagttggcgtgggcgtattccaagaaaatgtattccatacaatgtggcatgtaacgagaggcgccgtcttgatgtatcaggggaaacgattagagccatcatgggcaagtgttaagaaggatcttataagctatggaggaggttggaggctccagggatcttggaacacgggagaggaagtacaagtaatagccgttgaaccaggtaaaaaccctaagaatgtacaaactgccccaggcacattcaaaacaccagagggggaagttggcgcaattgccctagactttaagcctgggacatctggcagccccatagtcaacagagaaggaaaaatagttggcctttatggaaatggagttgtaacaactagcggaacttatgtcagtgcgatcgcacaagcaaaagcgtcacaagaaggacccctgccggaaatagaagacgaagtctttcgtaaaagaaacttaacaatcatggacttacacccgggaagtggaaaaacaagaagatatctaccagctatagtccgggaagctatcaaacgaaaattacggactctcatactagctccgactcgggttgtagcatcagaaatggcagaggcacttaagggtatgccaatccgatatcagacaactgcagttaaaagcgaacataccggaaaggaaatagttgatttgatgtgccacgcaacgtttaccatgagactactcagccctgtaagagttccaaattacaacatgataatcatggacgaagcacattttacagatccaagtagcatcgcagcaagaggatacataagcacacgtgtaggaatgggggaagctgcggccatctttatgacagcaactccgcctggcagcgtggaagcattcccgcaatccaacgctgtgatacaagacgaagaacgagatatccccgagaggtcatggaactctggatacgaatggataacggactttcccggaaaaactgtttggttcgtaccctcaataaaatccggaaacgacatagctaattgcctgaggaaaaatggtaagcgagtaattcaacttagtagaaaaacttttgatacagaatatcaaaagactaaaaacaatgattgggactacgtggtaacaactgatatatctgaaatgggtgctaattttagggccgatcgagtaatagaccctaggcgatgtctaaaacctgttatactaaaagacggcccagagcgagtaattttagctggtccaatgccagtaacggttgcatcagctgcacaaagaagagggaggataggtcgtaatcataacaaagagggggatcagtatatatatatggggcaaccccttaacaatgatgaagaccatgcccactggacagaggccaaaatgctattagataatataaacacaccggaaggaattatacctgcacttttcgagccagaaagggaaaagtccgccgcaatagacggagaatataggttacgcggagaggcccgcaaaacttttgttgagctaatgagaaggggagacttacccgtatggctaagttataaagtagcgtcagagggatttcagtattctgaccgaaggtggtgtttcgatggtgagcgaaacaatcaggtacttgaggaaaatatggatgtggaaatatggactaaagaaggtgaaagaaagaaattaagaccaaggtggttagacgctagaacttacagcgaccctcttgcacttagagagttcaaggaatttgctgcaggtcgaagaagtgtaagtggcgacttaatcctagaaatcggcaaactgccccagcacttgacccaacgtgcacaaaatgcattagacaatcttgtaatgcttcacaattcagaacaaggagggcgagcttatagacacgctatggaggaacttccagatacaatagaaaccctaatgctcttagctctaatagcagttttaacaggaggcgtcacactgtttttcttgtcaggacgaggtttgggaaaaacatccataggattattatgcgtaatggcatccagcgttctcttgtggatggcctcagtcgaaccacactggatagcagcaagcatcatattagaatttttcttaatggttcttttgatacccgagccagaccgtcaacgaactccacaagacaaccaattagcatatgtagtgataggactgctttttatgatactaacagtcgcagctaatgagatgggattacttgaaacaactaagaaagacttaggcataggacacgtagcggtcgaaaatcatcatcacgccgctatgttagacgtagatttacatcccgcctcggcgtggacactctacgcggtggcaactactattatcactccaatgatgagacacactatcgaaaatacaacagcaaacattagcttaacagcgattgctaatcaagcagcgatactaatgggattggacaagggatggcccattagcaaaatggacataggagttccattattagctttaggttgttactctcaagtaaaccccctgacccttaccgcagcagtacttatgctcgttgcacactatgcgataataggtccaggacttcaagcaaaagccactcgggaagcacagaaaagaacagccgcagggattatgaaaaatcctactgtagacgggatagtagcaatagacttagatcccgtagtgtatgatgcgaaatttgaaaaacaattaggacaaataatgcttttaatattatgtacatctcaaatactactaatgcgtacgacttgggccttgtgtgaatctattactttggctactgggccattaacgacgctctgggaaggaagtcctgggaaattttggaacacaacgattgcggtctcaatggcaaatatttttcgtggttcgtatttagcaggagccggactagcattttcgttaatgaagtctcttgggggaggacgtagaggaactggagcgcaaggtgaaaccttgggagaaaaatggaagcgtcagctcaatcaactgtcaaaatcagagttcaacacatataaacggtcaggtatcatggaagtcgatcgcagtgaagcaaaagaagggctcaagagaggagagacgacaaaacacgccgtaagtagggggacggcaaaattacgatggtttgttgaaagaaatctagtcaaaccagaaggaaaagttatagacttagggtgtggacgcggcggctggtcgtactattgtgccggcttaaagaaagtaaccgaagtgaaaggatacactaaagggggtccaggacatgaggaaccaatacctatggcaacctatgggtggaacttggtaaagttgcatagtggaaaagacgtattctttataccgcccgaaaaatgcgatacgcttttatgtgacatcggggaaagtagtccgaaccccaccatcgaagaaggtcggacactacgagtactcaagatggtcgaaccatggttacgaggtaatcaattttgcataaaaattctcaatccttacatgccgtctgttgtggaaactcttgagcagatgcaacgaaaacacggaggaatgctagtaaggaatcccttaagtcgcaattccacacatgaaatgtactgggtatcttgtggcacaggaaatatagtatcagccgtcaacatgacatcgcgaatgcttctaaacagattcacaatggcacatagaaaaccaacttatgaaagagatgtagatcttggggcagggacgcgacatgttgcagtagagccagaagtcgcaaatctagacatcataggtcaaagaattgaaaatataaagcatgaacataagtcaacatggcactatgatgaagacaacccgtacaaaacatgggcgtaccacggctcatatgaagtcaaaccgagcggcagtgcgtcttcgatggtaaatggagtagtaaaattattaacaaaaccatgggatgtgatacctatggtaacacaaatcgccatgacagatacaacgccttttggtcaacaaagagttttcaaggaaaaagttgatactcgaacgccaaaagcaaaaagaggaaccgcgcaaataatggaagtgaccgcaaaatggttatggggtttcctaagtagaaataaaaagccacggatatgcacccgtgaagaatttacgcgcaaagttcgcagtaatgccgcaatcggagcagtttttgtagatgagaatcaatggaactcagccaaagaagccgtagaagacgagagattttgggatctggtgcacagggaaagagaattacataaacaagggaaatgcgcaacgtgcgtctataacatgatgggtaaaagggagaagaaattaggagagtttgggaaggccaaaggatcaagggctatctggtacatgtggctcggggcaagatttctagaatttgaggctttgggcttcatgaacgaagaccactggttttctcgggaaaatagcttaagtggagtcgaaggagagggattgcataaactaggatatatcctgagggatatctcgaaaataccaggcggaaatatgtatgcagatgacactgctggatgggatactaggattactgaagacgatttacaaaatgaggctcgtattacagatataatggaaccggaacacgctcttttggcaaagtcaatattcaaactaacatatcaaaataaagtagtacgtgtgcaacgaccagcgaaaaacggtacggttatggacgttatatctcgaagagaccagaggggttcaggtcaagtcggcacatatggattaaatacttttactaatatggaagcacaactgataagacaaatggagtctgaaggtattttctcaccaagcgagctggaaacacccaatttggccgaaagagtactagattggttagagaagtacggtgtagaaaggttaaagcgaatggcgatttccggcgatgattgtgtagtaaaaccaatagatgaccgcttcgcaacagccctaactgcgctcaacgacatgggtaaagtaagaaaagatatccctcaatgggagccatcaaagggatggaatgattggcaacaggtccccttctgctcccatcattttcatcaattaataatgaaagacggaagagaaattgttgttccttgtagaaatcaggatgagttagtcggcagagctagagtatcacagggggcgggctggtcactaagggagacggcttgcctaggaaagtcatacgctcaaatgtggcaactaatgtactttcatcggcgcgacctccgcctcgcggccaacgcaatttgtagcgcggttccagtagattggatacctacaagtcgcactacatggagtatacatgcccaccatcaatggatgacgaccgaggacatgctatctgtgtggaatcgagtttggatagaagagaatccctggatggaagacaagacacatatttcatcatggggcgacgttccttatttgggaaaaagagaagatcagtggtgtggcagcctgataggactaacggcccgggcgacgtgggctactaatattcaagtcgcaataaatcaagtacgtcgattaatcggcaacgagaattatttagactacatgactagcatgaagagatttaagaatgaaagcgatccggaaggagctttatggtaa

SEQ ID NO: 21855 - RNA, 9879 nt, synthetic construct
  misc_feature 1..9879: note = derived and/or modified CDS sequence (opt6) from DENV-1__GU131786__SS-prME
  source 1..9879: mol_type = other RNA
tcagttacaatgctattaatgttgatgcctacagcactcgcttttcatcttactactaggggtggagaaccgcatatgattgtaagtaaacaagaacggggcaaatctctgctattcaaaacatccgccggtgttaatatgtgtacactaatcgcaatggatttgggagaattttgtgaagatacgatgacgtataaatgcccaaggataacagaagcagaaccagatgatgttgactgctggtgcaatgcaactgatacatgggtcacttatggtacgtgtagccaaacaggagaacacagacgtgataaacgatccgtagcgctagcaccacatgttggccttggattagaaactagaacagaaacatggatgagtagtgaaggtgcttggaagcagatacaacgagtagaaacatgggctctgaggcatccaggatttacagtaatcgcattatttcttgcgcacgcaataggtacaagcataacgcaaaaagggatcattttcattctcctaatgctcgtcacaccatcgatggctatgaggtgcgtggggataggatcacgggatttcgtagaagggttaagcggagcaacctgggttgatgtcgtactggaacatggatcttgcgttacaacaatggcaaaagataaacctacgctcgatatagaattacttaaaacggaagtaacaaatcccgcggtgctgcgaaaattatgtatagaagcaaaaatatctaacaccacaacggactccagatgccctacacaaggagaagctaccctagtggaggaacaagatgcaaactttgtgtgtaggaggacatttgttgatagaggatggggcaacggttgcggcctttttggtaaaggttcattaataacatgtgcgaaatttaagtgtgtcacgaaattggagggcaaaattgtgcaatatgagaacctaaaatactcagtaatagtgaccgttcatacgggtgatcaacatcaagtaggcaacgagtccacggagcatggaacaactgctacgataacaccacaagctccaagtaccgaaattcaactgactgattatggtgcacttacattggattgcagtccaagaaccggcctagacttcaacgagatggtattactaaccatgaaagagaaaagttggttagttcataagcaatggttcctggacctacctctaccgtggacgtccggggcttcaacatcgcaagaaacatggaacagacaggatttgctagtaacttttaaaacggctcatgccaagaaacaggaggtagtagtcttgggatcacaagaaggcgcaatgcatacagctttaacaggagcgacagagattcagacatcaggaaccacaacaattttcgcggggcacttaaaatgcagactaaaaatggacaaacttacactaaaaggtatgagttatgtgatgtgtactgggagtttcaagctagaaaaagaagttgctgaaactcaacatggaactgtattagtacagattaaatatgaaggcacagacgcgccatgtaaaatcccgtttagtacccaagacgagaaaggtgttactcaaaatggtcgtttgataaccgcaaatccaattgttacagataaagaaaaaccggtaaacatagaagccgagccacctttcggcgaatcgtacatagtaattggtgctggagagaaagcattaaaactttcgtggttcaagaaaggctcaagcataggcaaaatgttcgaagccccagcaagaggcgccagaagaatggcaatcctaggggcgacagcatgggattttggatctatcggcggggtattcccaagtgttggcaaacttgtacaccaaatattcggtactgcgtatggagtgcttttcagtggagtaagttggacaatgaaaattggaataggtgttctattgacatggctaggtctaaactcaagaagcacatcattatctatgacgtgtatcgcagtggggttagtaacgttatatctgggtgtaatggtcagggcggacagtgggtgtgttataaattggaaaggccgagaattaaagtgcggatcaggcatatttgtgacgaacgaggttcatacatggacagaacaatataaatttcaagcagattcccctaaaagactttcggctgcaataggcaaggcttgggaagagggtgtatgtggcatcaggtcggccactcgtctcgaaaatataatgtggaaacagattagtaacgaactaaatcatatcctattggaaaacgacatgaaattaacagtagtggtaggggatgtggcagggatattggcccaagggaaaaagatgatacgtccacaaccaatggaatacaaatactcctggaaaagctggggaaaggccaaaataataggagcagatgttcagaacacaacattcattatagatggaccaaatacaccagaatgtcctgatgatcagagggcttggaatatctgggaagtagaagattacggcttcgggatttttactaccaatatatggcttaaattgagagacagttatacacaagtatgtgaccacagattgatgtcagccgctattaaggatagtaaagcggtccatgcagatatgggctactggattgaatcagagaagaatgaaacttggaaattggcaagagcatcctttatcgaagtaaaaacttgtatatggccaaagtcccataccctttggtccaacggagtcttggaaagcgaaatgatcattccgaaaatatatggaggaccgattagtcaacataattatcggccagggtatttcacccagactgccggaccatggcatttagggaaattagaactggatttcgacttatgcgaaggaacgacggtagtggttgacgaacattgtggtaaccgtggaccgagcctcagaactacaacagtaactggaaagataattcatgaatggtgttgcaggtcttgcacattgccgccacttaggtttaaaggagaagacggatgttggtatggcatggaaatacgcccagttaaagaaaaagaagaaaatctcgtcaaatctatggtttcggcagggtccggagaagtagattccttctctttaggtttgctttgtatttcgatcatgattgaagaggtaatgagaagtcgatggtcgagaaaaatgctaatgacaggaaccttagcagtattctttttgttaataatgggccagctaacctggaacgacttgataagactatgcattatggtaggtgcaaatgcatctgaccgcatgggaatgggtaccacctatctggcattaatggcgacattcaagatgcgccctatgtttgctgtaggtctcttattccgtaggctgacaagcagagaggtattattactgaccattggattgagcctagtagcgtcggtagaattaccgaactccctagaagagttgggagacggattggccatgggcattatgatattaaaattattaactgacttccaaagccatcaactatgggcgacactattgtctctaacatttattagaactactttttcattgcattacgcttggaaaactatggcaatggtcttatcgattgtaagtttatttcccttgtgcctatcaacaacatcccagaaaacgacatggctcccagttcttttgggaagtctgggatgcaaacccctgacaatgtttctaatagccgagaataagatttggggacgaaaatcttggcctcttaacgaaggaataatggcagtaggaatagtatcaatacttttaagctctcttctcaaaaacgatgtacccctcgcaggaccgttaatagcgggcggtatgttgatagcttgttacgtaatatcggggagttcggcagatttgagcttagaaaaagcagcagtggtaagctgggaagaagaagcagaacatagcggtgctagccataatattctagtagaagtgcaagacgatggaacgatgaagatcaaagacgaggagagagacgatacactaaccattttgctgaaagcaacactattagcagtatcaggagtctaccctctaagtattccagcgacactatttgtatggtacttttggcagaaaaagaaacaacgaagcggagtgctatgggacaccccgagtcccccagaagtcgaaagggcagtcctcgacgacggcatctatcggatcatgcaaagaggactattaggaagatctcaagtaggtgtaggagtgtttcaggaaaatgtgttccatacaatgtggcatgtaacgagaggcgcggtccttatgtatcaaggcaaaaggctggaaccgtcatgggcgagtgttaaaaaggacttaatttcctacggaggaggttggagattacaaggatcatggaacacgggcgaagaagtacaagtaattgctgttgaacctgggaaaaaccctaaaaacgtacagacggctcctggaacatttaaaactagcgaaggagaagtaggagctatagccctcgacttcaaacctggaacttcgggtagcccaatcgtcaatcgagaggggaagatagtcggtttgtacggaaacggggtggttacaacttcgggtacatatgtttcggcaatagcacaagccaaggcttctcaagagggaccactccctgagatagaggatgaggttttcagaaaaaggaatctaacaattatggacttacatccaggttctggtaaaaccaggcggtatcttccggctattgtacgagaggcaatcaaaagaaaactaagaacactgatattggctccaacaagagtagtagctagcgagatggctgaagctcttaagggaatgcccatcagatatcaaacaacggcagttaaatcggaacatacaggaaaggaaattgtagacttaatgtgtcatgctaccttcaccatgcgactattaagccccgtcagagtacccaactataacatgataatcatggatgaagcacactttacagatccgtcatcaatagccgctcgcggctacatatcaaccagagtaggtatgggcgaggcggcggcaatcttcatgacggccacaccaccaggatcagtagaagcatttccgcaaagtaatgctgttattcaggatgaggaaagagacataccagaacgatcatggaactccggatatgaatggattacagactttcccggaaaaactgtttggtttgtgccgtcgataaaaagtggaaatgacatagccaattgcctgcgtaaaaacggtaaacgcgtaatacagctatcccggaaaacttttgatacggagtatcagaaaaccaaaaataacgattgggactacgtagtaacaacagacataagtgaaatgggcgcaaatttccgagcggatcgtgtcattgacccaagacgatgtttaaaacccgttattttaaaagatggacccgaacgagtaatacttgcaggtccgatgccagtgacagttgcgtcagcggcccaacgacgaggacgaattgggagaaatcataataaagaaggtgatcaatatatttatatgggacaaccgttaaacaatgatgaagatcacgcgcattggacagaggctaaaatgcttctagacaacataaacaccccggaaggaataatacctgcactattcgaaccagagagagaaaagagcgcagcgattgatggagaatacagactacgaggtgaggcacgtaaaacttttgtagaattgatgagacgcggcgacttacctgtctggctttcgtataaagtcgcgtccgaaggattccaatactcagaccggagatggtgttttgatggtgaacgcaataaccaagtattagaagagaatatggacgtagagatttggaccaaagaaggcgagaggaagaaactacgcccgagatggcttgatgcaaggacatattccgatcctctagcactgagggagttcaaagaatttgcagcaggtcgcagaagtgttagtggcgatcttatcctagaaatcgggaagttaccccaacacttaacacaacgtgcgcagaatgctttagataatctagtaatgttgcataactctgaacaaggaggaagggcgtaccgccacgctatggaagaacttccagatacgattgaaacactaatgctattagccctaatcgcagtattaacaggtggggtaactctcttctttctcagtggacgagggttggggaaaacatctatagggctcctctgtgttatggcgtcgtccgtactactatggatggcaagtgtagagccacactggatagcagcttcgattatactggagttctttttgatggttttactaataccagaaccagatagacagagaacgccacaagataaccagctggcttatgtagtgatcgggctactcttcatgattctaactgtagcagccaacgaaatgggattgctagaaacgaccaagaaagatctaggaattggtcatgttgcagttgagaatcatcaccatgcagcaatgttagacgttgacttacatccggcaagcgcgtggaccctgtacgcagtagcgaccaccataatcacgccaatgatgcgtcacactatagagaatactacagcaaatatatcattaacggcaattgcgaatcaggcggccattcttatgggattagacaaaggatggccgatatccaaaatggatataggagtaccattgctagccttaggctgttacagccaggtcaatcctttgacccttacagcagcagttctaatgctagtcgcacactatgctattataggtcctgggcttcaagcaaaagcaacgagggaggcgcagaaaaggacagctgctggtatcatgaagaaccctacggttgatggtatagtagcaatcgatcttgaccccgtcgtgtatgatgcaaaattcgaaaaacaattgggacaaattatgcttcttatattgtgtacatcacaaatcttactgatgcggactacatgggctctatgtgagagcataaccctagctaccggacctctaaccaccttatgggaggggtcaccaggaaaattttggaatacaacaatagcagtgagcatggctaatatttttcgtggctcttatctagcaggagcaggtttagcgtttagcttaatgaaatcattaggtggaggtagacggggaacaggagcgcagggagagacactcggggaaaaatggaaacggcaacttaatcagctatctaaatcagagttcaatacttataaacgatctgggatcatggaagtagatagatcagaggcaaaggaaggattaaaacgaggagaaacgactaaacatgccgtaagcagaggaacggcaaaacttaggtggtttgtggagagaaatctagtaaaaccagaagggaaagtcatcgacttaggctgtggaagaggagggtggagttattattgcgcaggattaaagaaagttacagaagtcaaaggatacacaaaaggaggtcctggacacgaggaacctatacctatggcgacatacggatggaaccttgtcaaacttcactctggtaaagatgtatttttcattcctccagagaagtgtgacactctattatgtgacataggagaatcaagtccaaatcccaccatagaagaaggacgaacgctaagggtactaaaaatggtagaaccatggctcaggggaaatcaattttgcatcaagatcttaaacccttatatgccttctgttgtcgaaaccctagaacaaatgcaaagaaaacatggcggcatgttagtgcggaatccgttgagtagaaatagcactcacgaaatgtactgggttagttgtggaacaggtaacatagtttctgccgttaatatgactagcagaatgttactcaacagattcactatggcacacagaaaaccgacatatgagagggatgttgaccttggtgcgggtacacgacatgtcgcagtagagccggaagttgcaaatcttgatattattggtcaaagaattgaaaatataaaacatgaacacaaatcgacttggcactatgatgaagataacccgtataaaacgtgggcttatcatggctcgtatgaagtcaaaccctctggttcagcgtccagcatggtaaatggtgtagtcaaattgttgacaaaaccttgggatgtaatcccaatggtaacacaaatagctatgactgacactacaccttttggacagcaacgagtattcaaagaaaaggtagatacacgaactccaaaagcaaaacggggaactgcccagatcatggaagtgaccgccaagtggttatggggatttttatcgcgcaataagaaacctagaatttgcacacgagaagagttcacgcgtaaagtaagatcaaacgccgcaataggggcggtttttgttgatgagaaccaatggaactcagctaaagaggccgtagaagacgaaagattttgggatttagttcacagggaacgggaactacataaacaaggtaaatgtgctacgtgtgtttacaacatgatggggaagcgggagaagaaactcggagaatttggcaaagcaaaaggaagtagagcaatttggtatatgtggctaggggctagattcctggaatttgaagcactaggatttatgaatgaagaccactggtttagtcgagaaaactctctatcaggagtcgaaggagaaggcttacacaagttaggctatattctaagggacatatcaaaaattccagggggcaacatgtatgctgatgacactgctggatgggacacaaggattacagaagatgacctacagaacgaagcaaagatcacagacataatggagccagaacacgctttattagccaaatctatttttaaacttacttaccagaataaagtagtacgtgtgcagagaccagcaaagaacggaacggtgatggacgtgataagccgcagagaccaaagaggcagcggccaagtggggacatacggacttaacacctttacgaatatggaagcacaactaatacgacaaatggaatccgaaggtatattctccccgtctgaactggaaacacccaacctagctggtcgggttttagattggctggaaaagcacggtgtggagaggctaaaaaggatggcaataagtggagatgactgcgtcgtcaaacccatagatgacaggtttgcaacggcactaaccgcattaaatgatatgggaaaggtcagaaaagatatacctcaatgggaaccttcaaagggatggaacgactggcagcaagtccctttttgctctcaccattttcatcagttgattatgaaagacgggcgggaaatagttgtaccctgtcgaaatcaggatgagttagttggaagggcaagggttagccaaggcgcaggctggagcctccgggaaacggcttgtctgggaaagtcctacgctcaaatgtggcaattaatgtacttccacaggagagatcttcgactagctgcaaatgcgatttgtagtgcagttccggttgactgggttccgacttccaggaccacttggtcgattcatgcgcaccaccaatggatgactacagaggatatgctatctgtatggaatcgagtttggatagaagaaaacccatggatggaagacaaaacacatatatctagctggggcgatgttccctatctgggtaagcgtgaagaccaatggtgcggatcattaatagggctgacagcacgagctacatgggccacgaatattcaggtagcaataaatcaagttcgtcggctcctgggaaatgaaaactatttagactatatgacatctatgaaaagatttaaaaatgaatccgaccctgagggagcgttgtggtga

SEQ ID NO: 21856 - RNA, 9879 nt, synthetic construct
  misc_feature 1..9879: note = derived and/or modified CDS sequence (opt6) from DENV-1__GU131787__SS-prME
  source 1..9879: mol_type = other RNA
tcagtgacaatgctattaatgttaatgccaaccgccttggctttccacctgacgacaagaggtggggaaccacacatgattgtcagtaaacaagaaagagggaaatcactgttattcaaaacaagtgcaggagtaaacatgtgtactcttatagcaatggacctgggagaactgtgcgaagacactatgacgtataaatgccctagaataaccgaaacagaaccggatgatgtggactgttggtgtaacgcaacagatacatgggtaacatacgggacctgttcacaaaccggagaacatcgtagagataaaagatctgtcgctttggcgccacatgtaggtttaggcttagagacacggacagaaacgtggatgtcgtcagaaggagcatggaaacaaattcagcgagtggaaacatgggctttgcggcatcctggcttcacagtaatcgcactatttttagcacatgcaatcggaacttcaatcacccaaaaaggaattatattcattctactcatgttagtaacaccttcgatggcaatgcggtgtgtcggcattggttctcgtgacttcgtcgaaggcctcagtggagcaacatgggttgatgttgttctggaacatggatcatgtgtgaccactatggcaaaagacaaaccaacattagacattgaactgttaaaaacagaagtaacaaatcctgcggtattaagaaaactgtgtatagaagccaaaataagtaatactacaactgactctagatgtcctactcaaggtgaggccacgctagtagaagaacaagatgctaactttgtatgtagacgaacgtttgtagatcgaggctggggtaacggctgtggactgttcggaaaagggtcattgatcacctgtgccaaatttaaatgtgtaacaaaattggaaggcaaaatagtccaatatgaaaatttaaaatatagtgtcattgttacagtgcacactggagatcaacaccaagtaggtaacgaatccactgaacatggcactacagcaacaatcacaccacaagctccaactactgagattcaacttactgactatggagctttaacattagattgcagtccaagaacaggtctggattttaatgaaatggttttactaacgatgaaagagaaaagttggctggtacataaacagtggtttttagatttacccctcccgtggacctccggagcgagcacatctcaagaaacttggaataggcaggatttgctagtaacgttcaaaaccgcacacgccaagaaacaggaagtagtagtactcggcagccaggaaggcgcaatgcacacagcccttaccggggcgacagaaatacaaacgagtgggacgactacgatttttgcaggtcacttgaaatgtcgcttgaaaatggacaaacttacattaaaaggaatgtcctacgtaatgtgtactggttcatttaaattggaaaaagaagtagccgaaacccagcatggcactgttttagtccaaataaagtacgagggtaccgatgcaccatgtaaaataccctttagtacgcaagatgagaaaggagtaacccagaacggcagattaattacggcaaatccaattgtcaccgataaagaaaaacccgtaaacatagaagctgaaccaccattcggcgaatcgtatatcgtaattggagctggagaaaaggcattgaagctatcatggtttaagaagggaagtagtataggaaaaatgtttgaggctacagccaggggcgctcgaagaatggccatcctaggcgatacagcatgggacttcggtagcataggcggtgtgttcactagcgttggaaagctagtacatcaaatattcggaaccgcatatggagtattattttcgggcgtctcctggacaatgaagattggaataggtgtattacttacatggctgggactaaacagccgtagcacgtcattgagcatgacatgcatagccgtcgggttagttactttatatttaggagtcatggtacaagctgactccggatgtgtaattaattggaaaggccgtgaattaaaatgtgggagcggtatctttgttacaaatgaggttcatacatggacagaacaatataaatttcaagcagactcccctaaaagactaagtgcggcaataggtaaggcttgggaagagggagtatgtgggataagatcagcaacaagactagaaaatataatgtggaaacaaatatcaaacgaattaaaccacattttactagaaaatgggatgaaattcacagttgtagtgggtgatgtcgcaggtatactcgcccaaggcaagaaaatgatcagacctcagcctatggaatataaatacagctggaagtcttggggtaaagcaaaaatcattggagctgatgtgcaaaatacaacatttatcattgacggcccaaacacgccagaatgcccggatgatcaaagggcttggaatatatgggaagtagaagattatggctttgggatatttacaactaatatatggctaaaacttcgtgactcctacacgcaagtatgtgatcataggttaatgagtgctgcaataaaagacagtaaagcagtacacgctgatatggggtattggatcgagagtgagaaaaacgaaacatggaaacttgctagagctagctttatagaagtcaaaacgtgtatatggcctaagtcccatacattgtggtctaacggcgtactcgaaagtgagatgattattccaaagatttacggtgggccaatcagccaacataattatcgtccaggatatttcacacaaacagctggaccatggcatctcggaaagctagaactagacttcgatttatgcgagggaacaacggttgtagtagatgaacattgtggcaatcgtggcccgtctttacgtacaacaactgtaacaggtaaaattattcacgagtggtgctgccgctcttgcactctgccaccactacgatttcgtggggaagatggatgttggtacggaatggaaatcagaccggtaaaagagaaagaagaaaatttggtaaagagcatggtgtcggctgggtcaggcgaagtcgacagcttttctctaggactcctgtgtatttcaataatgatagaagaagtcatgagatcaagatggagtagaaagatgttaatgacaggaacgctcgctgtcttctttcttttgattatggggcaactaacatggaatgatctaattcgcctatgtataatggtaggcgccaacgctagtgatcgtatgggaatgggcacaacgtatcttgcgttaatggctacatttaagatgagacctatgtttgcggtaggactactctttagacgattaacaagtcgagaagtgttgctactaaccataggtctgagtctggtcgcgtctgtggaacttcctaactccttagaggagctcggagacgggctagccatgggtataatgatattaaaattgctgacagacttccaatctcatcaactttgggctacactattgtctctgacgtttatcaaaacaacattttcactgcactatgcgtggaaaactatggctatggtcctatctatagtaagcctctttccattatgcttatccacaacctcacaaaagaccacatggctcccagtacttcttggaagtctggggtgtaaaccgctaacaatgtttttaatagcggaaaataagatctggggaagaagatcttggccattaaatgagggcattatggcggtaggaatagtgagcatactactaagttcattactaaagaatgacgtcccattagcaggcccattaatcgccggagggatgttaattgcttgctatgtaataagtgggtccagtgcagatctctcactcgaaaaagcagcagaagtaagttgggaagaagaagcagaacattcaggcgcttctcacaatattcttgttgaagtacaggatgatggtaccatgaagatcaaggatgaagaacgagacgatacattaacaattttgctgaaagccaccctgttagcagtatcgggggtctatccattatcgatcccagccacactcttcgtatggtacttctggcagaagaagaaacaacggagcggcgtgctatgggatacaccaagtcctccggaagttgaacgagccgttttagatgacggtatataccgcattatgcaacgagggttgttaggtcgtagtcaagtgggggtaggcgtgtttcaagaaaatgtgttccacaccatgtggcatgtaactagaggagcagtattgatgtaccaaggtaaacgtctagaacccagctgggcaagcgtaaagaaggacttaatatcttatggtggcggttggcgtttgcaaggcagctggaacacaggcgaggaagtacaagttatagctgtggaacctggcaagaatcccaaaaatgtacaaacagcaccaggcactttcaagacacccgagggtgaagtgggagcgatcgcactggactttaagccgggaacgtccggatcgcctatagtaaatagagaagggaaaatagtaggtttgtacggaaatggggtcgttacaacgtctggcacttatgtttcagcgatagcacaggccaaagctagtcaagaaggaccgttgcctgaaatagaagatgaagtctttagaaagaggaatttaacgatcatggatctacatccaggatcgggaaagacccgacgttatctaccagccatagtgagagaagccataaaaagaaaactgagaacattgattcttgcacccactcgcgtcgtggcatcagagatggcagaggcactaaaaggcatgccaatcagatatcaaacaacggccgtaaagagcgaacatactggaaaagaaatagtagaccttatgtgtcacgcgaccttcacaatgcgattattatctccagtacgtgtcccaaattataacatgattataatggatgaagcgcatttcactgatcccagctcgattgcagctagaggttacataagtacgagggtagggatgggggaagccgctgcgatctttatgactgctacaccaccaggtagcgttgaagcatttccccaatctaacgcggtaattcaagatgaagagagagacatacctgagagatcctggaacagtgggtacgaatggataaccgattttcccggtaaaacagtctggttcgttccaagcataaaaagcggaaacgatattgctaactgtctcaggaagaacggtaaacgcgtcatccaattaagtcggaagacgttcgatacggagtatcagaaaactaaaaataacgactgggactacgtagtgaccacagatatcagtgaaatgggagcaaacttcagagcagatagagttattgatcctaggcgatgcttgaaacctgttatcctaaaagatggacccgagagagtcatcttagcaggtcctatgcccgttactgtcgctagtgcagcccaaaggagaggacgcataggtcgaaatcataataaagagggagaccagtacatttatatggggcaacctttaaataatgatgaagaccacgcacactggactgaagccaaaatgctgctagacaacattaacacccccgagggaataattcctgcccttttcgaacctgaaagggaaaagtctgcagcgattgacggagaatataggttgagaggcgaagcaagaaaaacattcgtggaattaatgagacgcggcgatctaccagtatggttatcatacaaagtcgcatcggagggatttcagtattcagatcgcagatggtgtttcgatggcgagcgaaataaccaggtactggaggaaaacatggatgtagaaatatggacaaaagaaggagaaaggaagaaactgcgtccacgttggctagatgccagaacatatagcgatccgctagcattacgagaatttaaggaatttgcagctggaaggaggtccgtaagtggagatctaatattagaaattggtaaattgccccagcatctaactcaacgtgcccaaaacgctttagacaaccttgtaatgcttcacaattcggaacaaggaggtagagcatatcgccatgcaatggaagaattaccggacactatcgaaacccttatgttactggctttaatagcagtactaaccggtggcgtaacattattctttttaagtgggaggggactaggcaaaacgtcgataggacttctatgtgtcatggctagtagcgtattgctatggatggctagcgtagaacctcactggattgctgcatcaatcattttagaatttttcttaatggtgttactaattccggaacctgacagacagaggacgccgcaagataatcaacttgcgtacgtcgtaataggattgctttttatgatactaaccgttgctgcaaatgaaatgggactattggaaacaaccaagaaagatttgggaattggccacgtagccgtggaaaatcaccaccatgctgcgatgttagacgtcgatctacatccagcatctgcctggacattgtatgccgtcgcaactactataataacaccaatgatgaggcacacaatagaaaatactaccgccaatatttcgctaacggcgattgcaaatcaagcagcaatactcatgggcttggataagggatggcctatttccaaaatggatataggtgtaccgctattggcgctcggctgttactcgcaagttaaccccctgacattgacagctgcagttttgatgcttgtagcccattatgcaataataggtccgggccttcaggcgaaagccacaagagaagcccagaaaagaacagcggcaggaataatgaagaatccgacggtggatggaatagtcgcaattgatcttgatcctgtggtatatgacgcaaaatttgagaaacaattgggacaaataatgcttttgatattgtgcacctctcaaattcttttaatgagaacaacatgggcactctgtgagagtataaccttagcgactggccctttaactacattatgggagggaagccccggaaaattttggaacaccacgatagcagtttcgatggcaaatatctttagaggtagttatttagcaggagccggtctagcattcagtttaatgaagtctctaggcggtggtagaaggggtaccggagcacaaggcgaaactctgggtgagaaatggaaacgtcagttaaatcaacttagcaaaagtgagtttaacacatacaaacgtagtggtattatggaggtcgaccgaagcgaagctaaagaaggcttgaaaagaggagaaacaacaaagcacgctgtgtctcgtgggactgccaagctaagatggtttgttgaaagaaacttagttaaacctgaaggaaaagttatagatttaggttgtgggcgaggaggttggagctactattgcgccggtttaaagaaagtaaccgaggtaaaaggctacactaaaggtggtccagggcacgaagaaccaatccctatggcaacttacggatggaatttggtcaagctacatagtggaaaagatgtatttttcataccacccgagaaatgcgatactcttctatgtgatataggtgaatctagcccgaacccaacgatcgaagaggggagaacactaagagtactgaaaatggtagaaccttggctacgcggtaatcagttttgtataaaaatacttaacccatatatgccgagtgtagttgaaacacttgaacaaatgcaaagaaaacatggtggaatgctggtacgtaacccgctatctaggaacagtacccacgaaatgtactgggtgtcatgcggcacagggaatatcgtgtccgcagttaatatgacatctcgtatgctgcttaaccgatttacgatggcccatagaaaacccacgtatgaaagggacgtagatttgggtgcgggtaccagacatgtggccgtagaacctgaagtcgcgaacttggatatcattggtcagagaatagaaaacataaaacacgagcataaatccacgtggcattacgatgaagacaatccatataagacgtgggcctaccatggatcgtatgaggttaaaccgagcgggtccgcttcctcaatggtaaatggagtcgtgaaattactgactaaaccttgggatgtaataccgatggtaactcaaattgcaatgacagacaccactccattcggacaacaaagggttttcaaagaaaaggtagatacaagaacgccaaaagcaaaacgaggaacagcgcaaataatggaggttacggccaaatggctttggggtttcttatcacgaaacaagaaaccaagaatatgcacaagagaggaatttacacggaaggtacgatccaatgcagcaataggtgcagttttcgtggatgaaaaccagtggaactcagcaaaagaggcggtagaagatgaaagattttgggacctcgtccatcgtgaaagggaattgcacaaacaaggtaagtgcgccacgtgtgtatacaatatgatgggaaaaagggagaagaaacttggagagttcggaaaggcaaaagggagccgtgcaatttggtatatgtggcttggagctaggttcttagaatttgaagccctgggatttatgaatgaagatcattggtttagtagagaaaatagtctgtccggagtagagggtgagggattgcataaattggggtacatcctgagagatattagtaaaataccaggagggaatatgtatgccgatgatacagcaggctgggatacgaggattacagaagacgatctccaaaacgaagctcgaataacagatataatggaacctgaacacgcattgctagcacgctctatattcaaattaacgtaccaaaataaggtcgtccgtgttcaaagacccgcaaagaatggaacagtaatggacgtgatatcacgacgagatcaaagaggttccggtcaggttggaacgtacggattgaatacattcactaatatggaagcccaactaatcagacaaatggaatccgaaggtatcttcagtccttctgagttagaaaccccaaacttagcggaacgtgtcctcgattggctagaaaaatatggtgtagaacgcctcaaaaggatggcaataagcggagatgattgcgtcgtcaaaccgatagatgatagatttgcaaccgcactcacggcattgaatgatatggggaaagtaagaaaagatattccacaatgggaaccatctaaaggctggaacgattggcaacaagtaccgttttgttcacatcattttcaccagttaataatgaaagacggaagagaaatcgtagtaccttgtaggaaccaggacgaattagttggacgggcgcgagttagccagggagcaggatggtctttaagggagaccgcgtgcctgggtaagagttatgctcagatgtggcaattgatgtattttcataggagagatctgcggctcgccgcaaacgcaatttgtagtgcagtaccagtcgattggataccaacatcacgtacgacatggagcatccatgcacatcatcaatggatgaccacagaggacatgctaagcgtatggaatcgagtatggatagaagaaaatccatggatggaagataaaacacatatttcaagttggggagatgtcccatatcttggcaaaagggaggaccaatggtgtggatcattgattggattaacagctcgggctacctgggctaccaacatacaggttgccatcaaccaggtgagaagattaattggaaacgaaaactatctggattacatgacatcgatgaaaagatttaaaaatgagtcagatcctgaaggagccctatggtag

SEQ ID NO: 21857 - RNA, 9879 nt, synthetic construct
  misc_feature 1..9879: note = derived and/or modified CDS sequence (opt6) from DENV-1__HM181968__SS-prME
  source 1..9879: mol_type = other RNA
tcggtaacaatgctgttgatgttaatgccaacagcattggcgtttcatttaactacacgcgggggagaaccccacatgatagtgacgaaacaagaaaggggaaaaagtttactattcaagacatccgcgggcgttaatatgtgtacgctgattgcaatggatctaggggaattgtgtgaagatacaatgacgtataaatgccccagaataaccgaagctgaaccggatgatgttgattgttggtgtaacgcaacagatacttgggtgacgtatggtacctgctcccaaactggagaacatcgtcgtgacaaaagaagtgttgcactggctccacatgttggactgggattggaaacaagaactgaaacctggatgtcatcagaaggcgcatggaaacaaatccaacgagttgaaacttgggcacttaggcacccaggttttacagtaatcgccttgtttctagcacatgcaataggtactagcattactcaaaagggaataatcttcattctcttaatgctagttacacctagcatggcaatgcggtgtgttggcataggaagtagagatttcgttgaaggcctgtcaggagcaacatgggtagacgttgttctagaacatggctcgtgtgtaacaacaatggcaaaagacaagccaacactagacatagaattgttgaaaacagaagtgacaaatccagctgttttaagaaagctatgtatagaagcaaagatttcgaatacaacgacggacagccggtgcccaacccaaggtgaagctacgttaatggaggaacaagacgcaaattttgtgtgccgtcgcacattcgttgatcgcggctggggtaacggatgtggtttgtttggaaaaggtagtttaataacgtgtgcaaaattcaaatgtgtaactaagctggaaggaaaaatagtgcaatacgaaaatttaaaatattcggtaatagtaacggttcacactggcgatcaacatcaagttgggaatgaatcgaccgagcacggcacaacagctacaataacaccccaagctcctacaagtgaaattcaactaactgattacggagcattaaccctcgattgtagcccaagaacaggattagacttcaacgaaatggttctactaacgatgaaggaaaaatcatggttagtacataagcaatggttcctagatctgcccctaccatggacttcaggtgctagtacgtcacaggaaacatggaatagacaggaccttcttgttacgtttaaaacagcacacgccaagaaacaagaagtggtagtactcggatcacaggaaggagccatgcacactgcactgactggagctacagaaatacagacatctggtacgacaacgatttttgcaggacacctaaaatgtaggttaaaaatggataagttaacacttaaaggaatgtcctacgtgatgtgtacagggtcttttaagctggagaaagaagttgcagaaacgcaacatggtactgtattagtgcaaatcaagtatgaaggaacagacgctccttgtaaaataccattctcaacacaagacgaaaagggagcgacacaaaatggacggttaatcactgcaaaccccatagtaaccgacaaagaaaagccagtcaacatagaagcggaaccaccttttggagagtcatatatcgttataggggcaggagaaaaagcattaaaactttcctggttcaagaaaggtagttcgataggaaaaatgtttgaggcgacagcacgtggcgctcgaagaatggctatactaggcgatacagcatgggattttggctccgttggtggggtattcactagcgtcgggaaattagttcatcaaattttcggtaccgcttacggggtattattttccggtgtaagctggaccatgaaaattggtatcggagtactccttacctggctaggtcttaattcaagatctacctcactatctatgacatgtatagcagtaggattagtaacactatatttaggagtaatggtccaagccgacagtggttgtgtaattaactggaaaggacgagagttaaaatgcggcagtggaatatttgtgactaacgaggtacacacttggaccgaacagtataaattccaagcagattctcctaaaaggctatcagctgcaattggtaaggcatgggaagaaggtgtgtgcggaatacggtcagcaaccagacttgaaaacatcatgtggaaacaaatttcaaatgagttaaaccacatactcttagaaaacgatatgaaatttacagttgtagttggtgacgtagttggtatattagcacaaggaaagaaaatgattaggccccagcctatggaacacaaatattcttggaaatcatggggaaaagctaaaataataggagcggacgttcagaacactacttttataatagatggcccaaatacaccggaatgtcctgatgatcagagagcctggaatatatgggaggtagaagactacggattcggtatattcgcaaccaacatatggttgaaattacgagattcgtacacacaagtgtgcgaccatcgattaatgagcgcggccataaaggatagtaaagctgtgcatgccgatatgggctactggattgaaagtgagaaaaacgaaacatggaaattggcaagagctagttttatagaagttaaaacttgcatatggccaaaatctcacactttatggtcgaacggtgtgttagaatcagaaatgattattcctaaaatatatggaggtcccataagccaacataattataggcccgggtacttcacgcaaacagcagggccatggcacttaggtaaattggagctagattttgacctatgcgaagggactacagtagttgtcgacgaacattgtggcaatcgtggtccgtcattaaggacgactaccgttacaggcaaaataatacacgagtggtgttgtaggtcctgtacactacctccgctccgattcaaaggagaggacggttgttggtatgggatggaaattaggcctgtgaaagaaaaggaagaaaatctggttaagtcgatggtaagcgcgggatccggagaagtagattcattctctttagggcttttatgcatatcaataatgatagaagaagttatgcgaagcagatggtctagaaaaatgttaatgacgggcaccttagcggtcttcctattactcataatgggacagttgacttggaacgaccttatacgtttatgcatcatggtgggcgcaaacgccagcgatcgcatgggtatgggtacgacatatttggcattaatggctacattcaagatgcgtcctatgttcgccgtaggacttctattaagacggttgacatcacgtgaagtattactattaaccatagggttatccctggtcgcctccgttgaattgccaaactctttggaagaattaggcgacgggcttgccatgggaatcatgatcctcaaattattaaccgatttccaaagccaccagttatgggcaacattattgagcctaactttcataaagactacactaagtcttcactacgcctggaaaaccatggcgatggttttgagcattgtatcactttttccgctgtgcttatctaccacaagtcagaaaaccacatggttacctgttcttctaggaagttttggctgcaaacctctgactatgtttttgatcacagaaaacaagatttggggacgcaaatcatggcccttaaatgaaggaataatggcggtaggggttgtcagtattttattgagctctttactaaagaatgacgttccattggccggtccgttaatagccgggggtatgctaatcgcatgctatgtaattagtggatcatcggcagacctgtccctcgaaaaggctgctgaagtatcatgggaagaggaagcagaacatagcggggccagccacaacattttagtggaagtgcaagacgatggaacaatgaaaatcaaagacgaagaacgtgatgacacgctgacaatccttctgaaagccacccttctagctgtatcaggtgtctatcccctatctatcccagccacattatttgtgtggtatttttggcaaaagaaaaagcaacggagcggtgtattatgggacacacctagccctcctgaagtagaaagagctgtgttagacgacgggatctacaggatcatgcagaggggattgctggggaggtctcaagttggagtaggcgtattccaagagaatgtttttcataccatgtggcatgtaacaagaggggctgtactcatgtaccaaggtaaaaggttggaaccatcttgggcgagtgtcaagaaagacttgataagttacggcggagggtggaggctacagggatcgtggaatacaggagaagaagtacaagtaattgcagtagaaccaggtaaaaaccctaagaatgttcaaaccgccccaggtacatttaaaacgccggaaggagaagttggagccatagctctagattttaaacccggcacatcaggttcacctatcgtaaacagagaaggtaaaattgtaggtctgtatggaaatggtgtggtaactacttctggaacatacgtaagtgcaattgctcaagcaaaagcatcccaagaagggcctttgccagaaattgaagatgaagtctttagaaaaagaaacctaactattatggatcttcaccctggcagcggtaaaactagacggtaccttcctgcaatcgtaagggaagcgattaaaagaaagttgcgaacacttattcttgcaccaacacgtgtagtagccagtgagatggcagaggcattaaagggtatgcccataagatatcaaacgaccgctgtgaaaagcgaacatactggtaaagaaattgtcgacctgatgtgccatgcaacatttacgatgagacttctatcaccagtacgcgtgccgaattataatatgataattatggacgaggcccactttactgacccgagctcaattgcagcaagaggatatatatcgacacgggttggtatgggtgaggcagcggcaatttttatgacagcgacgcctccaggctcggtggaggcttttcctcaatcaaatgccgtgatacaggacgaagagagagatataccggagcgttcctggaatagtggatatgaatggataacagattttcccggcaagacagtttggtttgtaccatcaattaaatcaggcaatgatatcgcgaattgcctgcgcaaaaacggcaaacgcgtgatacagctatcaagaaaaacgtttgatacagagtatcagaaaaccaaaaacaacgactgggattacgttgtaacgaccgacatatccgaaatgggtgcaaactttagagctgatagagttattgaccctcgaagatgtcttaaacctgtaatcctcaaagatgggcctgagagggtaattctggcaggtccgatgcctgtgactgttgcgtctgctgctcaaaggcgagggagaataggtagaaaccacaacaaagagggtgatcaatatatatatatggggcaacctttaaacaacgacgaagatcacgcgcattggaccgaagcaaagatgctattagacaacataaacacacctgaagggataattcccgcattatttgaaccagaaagggagaaaagcgcagcaatcgatggagaataccgactacgtggggaggctaggaagacgtttgtagaactaatgcgacgcggagatttaccagtatggttgagttacaaggtcgcctcagaaggattccaatattcagatagacgttggtgctttgacggagagagaaataatcaagttttagaagaaaacatggatgttgagatatggacaaaagagggtgaacgaaagaaattaagacctagatggcttgacgcccgaacatattcagatccactggcactacgtgagttcaaagaatttgctgcgggtagacgttccgtatctggtgatctaatactggagattggcaagttgccacagcatctaacacaaagagctcaaaacgccctagataatttagttatgctccataattctgaacaaggaggacgagcttacagacacgcaatggaggaattaccagacactatagaaactttaatgcttttagctttgattgcagttctgactggtggtgtaacactattctttctgagtggaagaggtcttggtaaaacatcaataggattgttatgcgtcatggcatcgtccgttttattgtggatggcctcagtggaaccacactggattgcagcatcaattatactcgagttctttctgatggtattgcttatcccagaaccagatagacaaagaactccgcaagataaccaactagcgtatgtagtaatcggcctactatttatgatactaacagtcgcagccaacgaaatgggactcttagaaacaaccaagaaagacctaggaataggacatgttgcagttgaaaaccaccatcacgccacaatgttagacgtggatcttcatcctgctagcgcatggactctatatgccgtagcgactacaataataactccaatgatgcggcacacaatagaaaatactaccgcaaacatttcattaactgcaatagccaatcaagctgcaatccttatgggattagataagggttggccaatctcaaaaatggacattggagtacccttattggcccttggatgttattcacaagtcaatcccttaacattgactgccgctgttttaatgttagtcgcacattatgccataatcgggccaggactacaggcgaaagcaactagggaagctcagaaacgaacggcggcaggaattatgaagaatccaacggtggacggtattgtagccatagacctggatccagtagtatacgacgcaaaatttgaaaaacagttggggcaaatcatgctattaatactctgtacttcacaaatactactgatgcgtaccacgtgggccttatgtgaatctatcacccttgcaacaggccctttaacaaccctctgggaaggatcccccgggaaattctggaatacaacaattgccgttagtatggcaaacattttcaggggttcatacttagccggagctggcttagcattttcgctaatgaaatctttgggaggtggtagaagaggaacaggggcacaaggagagacgctgggcgaaaagtggaaaaggcaattaaaccaactctcgaaaagcgaatttaatatttacaaaaggtcaggtataatggaagtggatagatcggaagcaaaagagggactcaagcgtggagaaacaacaagacatgccgtgagccgaggaaccgcaaaactacgatggtttgtagaaaggaacctagttaaacctgaagggaaagtaatagatttgggctgtggaaggggagggtggtcatactattgcgccgggctaaagaaagtaacagaagtcaagggatatactaaaggagggccgggacatgaggaacctattccaatggccacctatggctggaacttagtaaaactgcacagcgggaaggacgtctttttcacaccgcctgagaagtgcgatacactgctttgcgatatcggagaaagctcacctaacccgacaattgaagaaggaaggactcttcgagttctaaaaatggtagagccctggctaagaggcaatcaattctgcattaaaatcttaaatccatatatgccgtcagtcgtggagactctagagcaaatgcaacgcaaacatgggggaatgctagtacggaatcctctcagtcgtaatagtactcatgaaatgtattgggtaagttgcggcacaggaaatattgtctcagcagttaatatgacaagcaggatgttactaaatagatttacgatggcacatcgaaaaccaacgtatgaacgagacgttgatttaggggcgggaacccgacatgtagcagttgaacctgaagtagcgaatctcgacattattggtcaacgaatagagaatattaaacatgaacataaatctacatggcactatgatgaggataatccgtacaaaacatgggcctaccacggctcatatgaagtgaaaccaagcgggtcagcatcttctatggtaaacggtgtcgtcaaactgttaaccaaaccgtgggatgtgattcccatggttacacaaattgctatgacagacacaacaccatttggtcaacaaagggtatttaaggagaaagttgacaccagaacgccaaaggctaaacgaggcaccgcgcagatcatggaagttacagcaagatggctctggggatttttatcccgcaataagaaaccacgaatctgtacgcgggaggagttcaccagaaaagtgcgcagtaatgcagcaataggagcagtatttgttgatgaaaatcagtggaactccgctaaagaggccgtcgaggacgagagattttgggatctagtacaaaaagagcgtgaattacacaagcaaggaaaatgcgcaacatgcgtctacaatatgatgggaaaacgggagaaaaagctgggtgaatttggtaaagcaaaaggcagtcgagccatatggtatatgtggctcggagctaggttcctcgagtttgaagcactaggctttatgaacgaagatcactggttttcaagagaaaattcattatcaggtgtagaaggcgagggacttcataaattaggatatatactaagagatatatctaaaatacctggtggtaacatgtatgctgacgacactgcagggtgggatacgcgtataacggaagacgatctgcagaatgaagctaaaataaccgacataatggagccagaacatgcactattagctacatctattttcaaactcacatatcaaaacaaagtcgtaagagtacagagaccagccaaaaatggcaccgtgatggacgtaatcagtcgtagagaccaaaggggttcaggacaagtgggcacttatggcttaaatactttcactaatatggaagcacaactaatccggcagatggagtctgaaggaattttcttgcccagtgagctagaaacacctaatttagcagagagggtgctggactggctcgaaaagtacggagtggagcgcttaaaacgtatggcaataagcggggatgactgtgtagttaaacctatagatgaccgattcgcaacggctctaacagccctaaatgatatgggtaaagtaaggaaagatattccacagtgggaaccgagcaaaggttggaacgattggcaacaggttcctttctgcagccaccatttccatcaactaataatgaaagacggaagagagattgtggttccatgtcggaatcaagatgaattagtggggcgggcccgtgttagtcaaggagctggatggagtcttagagaaactgcttgtttaggcaagtcatatgcccagatgtggcagttaatgtattttcatagaagggatctaaggctggcggcaaacgcaatctgtagcgctgttcctatagattgggtgcctacatctagaacaacttggtctattcacgcacaccatcaatggatgacaacggaagacatgctgtcagtttggaacagagtatggatagaggagaacccgtggatggaagataaaactcacgtgtcatcttggggcgacgtgccatatctgggaaaacgtgaggatcaatggtgcggatcgttaataggattaacagcccgtgctacatgggctagcaatattcaggttgcaataaatcaagtacggagattaattgggaacgaaaattatttagactacatgaccagtatgaagagattcaaaaatgagggagatccggagggtgcgctttggtaa

SEQ ID NO: 21858 - RNA, 9879 nt, synthetic construct
  misc_feature 1..9879: note = derived and/or modified CDS sequence (opt6) from DENV-1__GU131789__SS-prME
  source 1..9879: mol_type = other RNA
agtgttactatgcttcttatgttaatgccgacagcactagcatttcacctaacaacccggggtggggaaccacacatgatcgtttctaaacaagaaagggggaaaagtttattatttaaaacttccgccggtgtaaatatgtgcacattgatagcaatggacttaggggaactttgtgaagatacaatgacgtacaaatgccccaggatcaccgaaacagaaccggatgacgtcgattgttggtgcaacgcaacagacacatgggttacttacggtacctgttcacaaacaggagaacacaggagagataaaagaagtgtagctttagcgccacatgtcggtctagggctagaaacccgaacagaaacttggatgtctagcgaaggggcatggaaacagatccaaagggtagaaacttgggcacttagacacccaggatttacggtcatagcgctattcctagctcatgcgataggaacaagtataactcaaaaaggaatcatatttatactactaatgttagttacaccgagcatggcaatgcggtgtgtaggaattggctccagggactttgttgaagggttaagtggtgcaacgtgggttgatgtggtactagaacatggctcatgtgttacaacaatggctaaagacaagccgacattagatatagaactcctaaaaacagaagtaaccaatccagcaatactgaggaaactttgtattgaagctaaaatttcaaatacaactacagatagtcgttgtccaacacaaggagaagctaccctagtagaagaacaagacgcaaacttcgtctgccgtaggacgttcgtagatagaggctggggaaatggctgtggactcttcggtaagggtagccttatcacatgtgcgaaattcaaatgtgtgacaaagctagaagggaaaatagttcaatacgaaaatctcaaatattcggtaatagttactgtgcatacgggagatcaacatcaagtaggtaatgaatctacagaacacggtacgacggcaacaataacaccacaagcacctacaactgaaattcaacttacagactatggagcattaacattagattgtagtccaagaacaggattagactttaatgaaatggtattactcacaatgaaggaaaaatcatggctagtacataaacaatggttcctagatcttccgcttccatggacgagtggggcatctactagccaagaaacgtggaacagacaagacctgctggtaacttttaaaactgcacacgccaagaaacaagaagtagtggtactgggttctcaagaaggagcaatgcacaccgcactaactggagctacagaaatacaaacatcaggcacaaccaccattttcgctggacatttgaaatgccgattgaagatggacaaacttacgctaaagggaatgtcatacgtcatgtgtacgggatccttcaaattagaaaaagaagtagcagaaacacagcacggtaccgtcctagtgcagattaaatatgaaggtactgatgcaccttgtaagataccgttttcaacccaggacgaaaaaggagtcacacagaacgggcggcttataacggcaaatcctatagtcacggacaaagagaaaccagtaaatattgaagcagagccgccgttcggggagtcatacatagtcatcggagccggagaaaaagcgctcaagctaagttggtttaaaaagggttcatccattggaaaaatgttcgaagctacggctcggggtgcaagacgaatggctatactaggggataccgcctgggacttcggcagtattggaggagtatttacatcagtcggtaaacttgtacatcaaatttttggaacggcctatggggtcttatttagcggagtgtcttggacaatgaaaattggcataggcgtgttattaacttggctgggattaaattctcggtcaacttctttgtcaatgacatgcatagctgtaggactcgttaccttgtacctaggagtaatggtacaagctgacagcgggtgtgttattaattggaaaggacgagaactaaaatgtgggtcaggaatattcgtaacaaatgaagtacatacctggacggaacaatataaattccaagcggattcaccgaagcgcttatccgccgcaataggaaaagcatgggaagaaggagtatgtgggataaggtccgcaactcgtctagaaaacattatgtggaagcaaatctcaaacgaattgaatcacattctattagaaaacgacatgaaattcactgtagttgtaggcgatgtagcaggaattttggcacaagggaagaaaatgataagacctcaaccaatggaatataaatactcttggaagtcttgggggaaggctaaaatcataggcgctgatgttcagaatacaacattcataattgatgggcccaatacaccagaatgtccggacgatcaacgagcatggaatatctgggaggtggaagattatggcttcggtattttcaccacaaatatctggctaaaattgcgtgacagttatacacaagtatgcgatcatagattaatgtctgcagcgatcaaagacagcaaagcagtccacgctgatatgggatactggattgaaagtgagaaaaatgaaacgtggaaattagcccgtgcgtctttcatagaagttaagacgtgtatttggccaaaaagtcacacgctctggtctaatggtgtccttgaaagtgaaatgataatccccaaaatttatggaggacctattagccaacacaattatagaccaggatactttactcaaacagctggcccgtggcatttgggaaaattagaactagattttgatctatgcgaagggacaacagtagtagtagacgagcattgcggcaatcgtgggccgtccttaagaactacaacagtaactggaaaaatcatacatgaatggtgttgccgaagttgcacacttccgccgttgcgattccggggtgaggacggatgctggtatggaatggaaatacgaccagttaaagaaaaagaagaaaatctagtgaaatctatggttagcgccggatcaggggaagtggatagtttctctttgggattgttatgcatatccataatgatagaggaagtaatgaggtcccgttggagtaggaaaatgcttatgacaggaacactagctgtgtttctactattaattatgggacaactgacttggaacgatttaatacgcctgtgcatcatggtaggcgcaaatgccagtgataggatgggaatgggcactacttatcttgcgttaatggctacatttaaaatgagacctatgttcgctgtgggactgctatttcgtagattaacatcaagagaagtcctgctactcacaattggactgagcctggtagcgtcggtagaactgccaaacagcttagaggaactaggagatggtttagcaatgggaataatgattctcaaacttctcacagactttcaatcacatcaattatgggcaactctactttcactgacattcattaaaacaactttttctttacactatgcatggaagacaatggctatggtacttagcatagtatcactctttcctttatgtttatcgacaacaagtcaaaagacaacttggctacctgtattattgggaagtttaggctgtaagcccttgacaatgtttttaattgcggaaaataaaatttggggacgccgatcttggccgctaaacgaaggtatcatggcagtggggatagtcagtatacttctcagcagtttattgaaaaatgacgtaccattagccggaccgttgatagcaggaggcatgttgatcgcatgttatgtcatctcgggttccagtgcagatctttccttggaaaaagcagcagaagtcagctgggaagaggaagcagaacacagtggtgcttcccacaatatacttgtggaagtacaagacgatggaaccatgaaaatcaaagatgaagagagagacgacacgttaacgatcctcctaaaagctacgttattagccgtgtctggagtgtacccattgagcatccctgcaacattgtttgtttggtatttctggcagaaaaagaaacaacgttccggagtactatgggacaccccatcaccaccagaagttgaaagggctgttcttgatgatggtatttatcgaataatgcaacgaggtttgcttggacgatcacaagtaggtgtaggagtatttcaagaaaatgtttttcatactatgtggcacgttacccgaggagcagtcttgatgtatcagggcaaacgcctagaaccatcatgggcatcagtgaagaaagatttgatctcttatggaggcgggtggagactgcagggatcttggaacacgggtgaggaagtccaggttattgcggtagagccaggcaaaaacccgaaaaatgtacaaacaacacctggtacgttcaaaacaccagaaggagaggttggagcaattgcactcgactttaaacctggaaccagtggaagtcccatcgtaaatagagaaggaaaaatagtcggattatatggaaatggagtagttacaacaagtggaacatacgtatccgccatcgcacaagcgaaagcctcacaggaaggaccgcttcctgaaatcgaggacgaagtatttcgaaaaaggaatcttacaatcatggatttacatccaggctccggaaagactagaagatatctcccagcaatagtccgcgaagcaattaaacgtaaattacggacccttattttggcacccactagagtagttgccagtgaaatggccgaagcattgaagggtatgcccataagataccagacaacagcggtaaaatcagaacacacgggcaaagaaattgtagatctaatgtgtcatgcaacattcacgatgaggctgttaagtccggtacgagtaccaaattacaatatgataataatggacgaagcacattttaccgatccatctagtattgccgctagaggatatatttcgacgagggtagggatgggcgaggcagcagcaatattcatgacagcgacacctccaggaagtgtagaagcatttccacaaagtaatgcagtaatacaggacgaagagagagacattcctgagagaagttggaactccggctacgaatggataacagacttccctggcaagactgtttggtttgttccgagtataaagtcaggcaatgatatagctaattgcctaaggaaaaatgggaaacgggtaatacaactaagtcgaaaaacttttgacacagagtatcagaaaactaaaaataatgactgggattatgtggtaacaactgatataagtgaaatgggtgcgaactttcgagctgatagagttattgacccaaggagatgtctaaaacccgttatacttaaggacggacctgagcgagtaatactagcaggacctatgccagttacagtagcttctgcagctcaaaggaggggtaggattggaaggaaccataacaaagaaggagatcagtacatatacatggggcaacctcttaataacgatgaagatcatgcgcattggacagaagcaaaaatgctcctagataacattaatactccagaaggaattataccagctctgttcgaaccagaaagggagaaaagtgcggcgattgatggtgagtaccgactacgtggtgaggcacgaaaaacattcgtggaattaatgcgaaggggcgatctcccggtgtggctaagttataaagttgcatcggaaggctttcagtactctgatagaagatggtgctttgatggagagaggaacaaccaagttttagaggaaaatatggacgttgaaatctggactaaggaaggggagaggaagaaactgaggccgagatggttagatgctcgaacatactcagacccgctagcgttaagagagttcaaggagttcgcagcgggaagaaggagtgtaagtggagatttaatcctagaaatcggcaaacttccacagcacctgacgcagagggcgcagaatgccctggataatctagtgatgttgcataattccgaacaagggggcagggcatacagacacgcaatggaagaattacctgacaccattgagacacttatgctactagcgctaattgccgtgcttactgggggcgtaacgctatttttcctatctggtagaggattgggaaagaccagcattggcttattatgtgtgatggcttcgagcgttttactatggatggcctctgtagaaccccactggatagctgcttcaataattctagagttctttctaatggtactattaataccagaaccagaccggcagaggactccccaagataatcaattagcatatgttgtaataggtttattatttatgatattgacagtagcagcaaatgaaatgggcctacttgagaccaccaagaaagatcttgggataggccacgtggctgtaggtaaccatcaccatgcagcaatgttggacgttgatttacacccggcctcagcttggacattgtacgcggttgccacaaccataatcaccccaatgatgagacacaccattgaaaacacgacagcaaacatttctcttacggcaatagccaaccaggcggctatcctaatgggattggacaagggatggcccatatccaaaatggacattggcgtcccgcttttagctctaggttgttattctcaagtaaatcccttgacacttacagcagctgtattgatgttagtagcacattatgcaataataggaccagggttacaggcgaaggcaacacgtgaggcacaaaaacgtactgcggcagggataatgaagaatccaactgttgacggaatagtcgccatagatttggacccagtcgtctacgatgcgaaatttgaaaaacaattaggacaaattatgttgttaatattgtgtacaagtcagattttgctaatgcgaacaacttgggcactctgtgaatccataaccttagctaccggtccactgacaactttatgggagggtagcccgggtaagttctggaatactacaattgcggtctctatggcaaatatttttcgaggttcgtacctcgcgggagctggcctcgcgttctccttaatgaaatctctaggcggagggcgtagaggaacaggggcgcaaggtgagacactgggggagaagtggaaaagacaactaaaccaattatcaaaatctgagttcaatacttataaaagaagcggaataatggaagtagaccgatcagaggccaaggagggtctaaaaagaggagaaacaactaaacatgctgtctccagaggaacagccaaacttcgctggtttgttgaaagaaatctagtcaaaccagaaggaaaagtaatagaccttgggtgcggtagagggggttggtcgtactattgcgcaggccttaagaaggtaacagaagtgaaaggctatacaaaaggcggaccaggacatgaagaacccattccaatggcaacttatgggtggaacttagtaaagctgcacagtgggaaagacgtattctttataccaccagaaaaatgcgacacacttctatgtgacattggtgagtcctcaccaaacccaactatagaagagggcagaacgcttagagtgttaaaaatggtagaaccatggcttaggggtaatcagttttgcataaaaatactaaacccctacatgccttcagttgtcgaaactttggaacagatgcaacgtaaacacggaggcatgctggtgagaaatccgctaagtaggaatagcacacacgaaatgtattgggtttcctgtggaaccggaaacatagtttctgctgttaatatgacgtcacgaatgctattaaataggttcaccatggcacatcgaaaaccaacttacgagagagacgttgatctgggtgcaggtacccgtcatgtcgctgtcgaaccagaagtcgcaaatctagacataataggacaaaggattgagaatattaaacacgaacataaaagtacatggcactatgatgaagataacccatacaaaacgtgggcttatcatggaagctatgaggtcaaaccgtctggcagtgcgagttctatggtgaatggtgtcgtaaaacttctgactaaaccctgggatgtaatacctatggtaacacaaatagcaatgacggatacaacgccctttggacaacaacgagtatttaaggaaaaagtcgacactagaacaccaaaggccaaaagaggaactgcacaaataatggaagttacagctaagtggttatgggggtttctatctcgtaataagaagccaagaatatgtacaagggaagagtttacaagaaaagtacgatcaaatgcagcaataggtgcggtatttgtggatgaaaatcaatggaatagtgccaaagaggctgttgaggacgagcgcttctgggacctagtgcacagggagagagagcttcacaagcaaggtaagtgtgcaacatgcgtatacaatatgatgggaaaaagagagaaaaagctcggtgaatttgggaaggcaaagggttccagagcaatatggtatatgtggttgggggctagatttttggagttcgaggcattagggtttatgaatgaggaccactggttctcgagggaaaacagtcttagtggtgttgagggtgagggccttcataaactagggtatatacttagagatatttccaaaatacccggaggcaacatgtatgcagatgataccgccggttgggatactagaatcactgaagacgacttacaaaacgaagctaggataacagacattatggaaccagaacatgctttactagcaaaaagcatttttaagctaacgtatcaaaataaagtagtaagagtgcaaagaccggctaagaatggaacagtgatggatgtaatttctagacgagatcaaagagggagtggtcaggttggcacatatggcttgaatacatttactaatatggaagcacagttaataaggcaaatggagtcagagggtatattctcaccttccgaactagaaacaccaatccttgccgaacgagtactagattggttagagaaatacggggtagaacgtttaaaacgcatggcgatatcgggtgacgattgtgtggttaaaccaatagatgatagatttgctactgctttgactgcattgaatgatatgggaaaagtaagaaaagacataccacaatgggaaccttcaaaaggatggaatgattggcagcaggttcctttttgttctcaccacttccatcagttaattatgaaggatggcagagaaattgtggtcccttgtagaaaccaagatgaactcgtcgggcgcgcccgcgtttcacagggagcggggtggagcctgagggaaacagcatgcctaggtaagtcatacgcccaaatgtggcaactaatgtattttcaccgaagggacttgagattagcagcaaatgcgatatgtagcgccgtaccagtcgattggattccaactagcagaacaacatggtcaatccatgcacatcaccaatggatgacgacagaggatatgttatccgtctggaatagagtttggattgaggaaaatccctggatggaagataagacacatatatccagctggggtgacgtaccgtacttgggtaaaagagaggatcaatggtgtggaagcctaataggcttgactgcacgtgcaacgtgggctaccaacatacaagtagccataaatcaagtaagaaggcttattggtaatgagaactacctagattatatgacgtctatgaaacggttcaagaatgagtcagacccagaaggtgcactatggtga

SEQ ID NO: 21859 - RNA, 9879 nt, synthetic construct
  misc_feature 1..9879: note = derived and/or modified CDS sequence (opt6) from DENV-1__GU131790__SS-prME
  source 1..9879: mol_type = other RNA
agtgtaacaatgttattgatgctagtgcctaccgcacttgcatttcatctaacaacaaggggtggagaacctcatatgattgtaagtaagcaggagagagggaaatctttgctcttcaaaacaagtgcgggagtaaatatgtgtacattgatagcaatggatttaggggaactttgtgaagataccatgacgtataaatgtcctagaataactgagacggaacctgacgacgtcgattgctggtgcaatgccactgacacttgggtgacttatggaacgtgcagccaaacaggcgaacaccgtcgtgacaagagatccgtagcccttgctccacacgtgggcctcggacttgaaacaagaacagaaacatggatgagtagtgaaggtgcatggaagcaaatccaacgagtagaaacatgggcattacgtcatcctggattcacagtaatcgcactattcttagctcatgcaatcggtacatccataacacagaaaggtataattttcatcttattaatgcttgttactccctcgatggctatgaggtgcgtgggaataggttctagagacttcgtcgaagggttaagtggtgccacgtgggtcgatgttgttttggagcacggaagctgcgtaactacgatggccaaagataaaccaactctagacattgaactactaaaaacagaagtaacaaatcccgccgtcttaagaaaactttgtatagaagcaaaaattagtaacacgacgacagactcacgctgcccaacgcaaggtgaggcaaccttggtagaagagcaagatgcaaattttgtatgccgaaggacgtttgtagatagaggctggggtaatggatgcggactattcggaaagggttctctaataacatgtgccaagtttaaatgcgttacaaaactagaaggaaaaatagttcaatacgaaaatcttaagtatagcgtaatcgtaacagtgcatactggcgaccaacatcaggtaggaaatgaatcaacggaacacgggacaactgctactataacaccacaagccccaacaaccgaaatacaactcacagattacggagcacttactttagattgctcccctcgtacaggacttgacttcaatgaaatggtactactgacaatgaaagaaaaatcatggctagtacataaacaatggtttttggacttaccgttaccatggacaagcggtgcttccaccagtcaggagacgtggaaccgacaggacttgctagtaacatttaaaaccgctcatgccaaaaagcaagaggtggtagtacttggctctcaggagggagctatgcacacagctttaaccggggctacagaaattcaaactagcgggacaacgaccatttttgcaggtcacttaaaatgtcggctaaaaatggataaactaacgttaaaaggtatgagttatgtcatgtgcacaggctcatttaaacttgaaaaggaggtagctgaaacgcagcacggaaccgtcttagtgcaaataaaatacgaaggaaccgatgcgccttgtaaaattccgttcagtacacaggatgaaaagggagtcacgcagaacggtagattaattacagcaaatccaatcgtcaccgacaaagagaaacccgtcaacatcgaagcggagccgccctttggagaatcatacatagttattggagctggagaaaaagcccttaaattatcttggttcaaaaagggtagttctattggaaaaatgttcgaagcaacagcaagaggcgcaagaagaatggcgatattaggggatacggcgtgggattttggatcgatcggcggtgtattcacttccgtcggcaagctagtacatcaaatcttcggcacagcgtatggggtactcttctcgggtgtcagctggacgatgaaaattgggattggcgtgctcctaacctggctagggctaaatagtcgaagcacctcgctgagcatgacctgtattgcagtagggttagtaactctatatctaggtgtgatggtacaagccgattcaggatgtgtaattaattggaaaggacgtgagttaaaatgcggtagcggaatattcgttactaacgaagtccatacatggacagaacaatataaattccaggcagacagccccaaaagactttctgccgcgatcggcaaggcctgggaagaaggtgtatgcggcattcgtagcgctaccagattagaaaatataatgtggaagcaaatttcgaatgaattaaatcatatacttctagaaaatgacatgaaatttacagtagtagtaggagacgtagcaggtattttagctcaagggaaaaaaatgatacgtccccagcccatggaatacaaatattcttggaaaagttggggcaaggcaaaactcataggcgctgatgtacaaaatacaactttcattatagatggccccaatacgcctgaatgccctgacgaccaaagagcatggaacatatgggaagtagaagactacgggtttggaatctttactacaaatatttggctaaaactgagggattcctacactcaggtgtgtgatcacaggttaatgtcagctgccatcaaagactctaaagccgtccatgccgatatggggtactggatcgaatcagagaaaaatgaaacttggaaactagcgagagcatcgttcattgaagtaaagacttgtatatggccgaagtcacataccctttggtctaatggagtactcgaatccgaaatgataataccaaaaatctatggcggtccaatctcacagcacaattacaggcctgggtatttcactcaaactgcagggccctggcacctaggaaaattggaattagattttgatctttgtgaaggtactaccgtagtggtggacgaacattgtggtaataggggacctagtctccggacaacaactgtgacgggtaaaataatccatgagtggtgttgtcgcagttgtacccttcctccgctaagatttcggggagaagatggttgctggtatggtatggagatacgaccagtcaaggagaaggaagaaaacttggtaaaatctatggtctcagcgggatcaggtgaggtcgattcttttagcttaggactcctctgtatctcaataatgattgaagaagtcatgcgtagtagatggtcaagaaaaatgcttatgaccggaaccctggccgtgttttttttgttaatcatgggccaactaacatggaatgatttaattcgattatgcattatggtaggcgccaatgcgtccgatcgtatgggtatgggcacaacgtatttggcccttatggcaacattcaaaatgagacctatgttcgccgtgggtctactatttagacggcttacatctcgtgaagtccttctcctgacaataggtctctccctagttgcttcggtagagcttccaaacagcttggaagaattgggagacggactggcaatgggcataatgattctcaaattgttgacagacttccaaagccatcaactttgggccacacttctgtcgcttaccttcatcaagacaacatttagcctccactatgcatggaagacaatggcaatggtattgtctatcgtaagtttatttcctttatgcttaagtactacgagtcagaaaacaacgtggctcccagtacttctaggcagcctaggttgcaagccattaactatgtttctaatagctgaaaacaagatatggggccgaagatcttggcctttaaatgaagggataatggccgtaggtatcgtttcaatcttactatctagtctattgaagaacgatgtaccattagcaggcccactaatagcgggcggaatgcttatagcatgttacgtcatatcaggtagtagtgccgatctgtcattagaaaaggcggcggaagtatcttgggaggaagaagcagagcatagtggagcaagtcacaatattctagtagaggttcaggatgatggtaccatgaaaatcaaagacgaagaaagagatgacaccttaactatattactgaaagcaacgttgcttgcagtatctggtgtttaccccctatcaataccggccacattatttgtctggtatttttggcaaaagaaaaaacaaagatcaggagtcctatgggacactccgagccctccagaagtagagcgtgcagtgttagatgatggtatttatcgaattatgcaaaggggcttacttggtcgaagccaagtaggtgtgggtgttttccaagaaaacgtctttcacaccatgtggcatgtaacaagaggggcagtcttaatgtatcaaggcaagaggctggaacctagctgggctagtgtaaagaaagatttaatcagctatggcgggggatggagattacaaggtagttggaacacaggagaggaggtgcaggtcatcgcagtcgaaccagggaaaaaccccaaaaatgttcaaacagccccgggaacattcaagacaccagaaggcgaagtaggggcgatcgcactagatttcaagcctggaacctcaggatcaccaatagtaaaccgagaaggtaaaatagttgggctatacggtaatggagtcgtaactacgagcggcacttatgtatcagcaatcgctcaagctaaagcttctcaggaaggcccactacccgaaattgaagacgaagtcttccgtaaacgaaacctgactattatggacttgcacccaggttctgggaaaacgcgtcgttacttacccgctattgtgagagaagcaatcaaaagaaaactaagaactctaatactggctcccactcgcgttgtagcaagtgaaatggcagaagccttaaagggtatgccgatacggtatcaaactacagcagtgaaatcagaacatactggaaaggaaattgttgacctaatgtgtcatgctacattcaccatgcgattgctaagccccgtacgagtcccgaattataacatgataatcatggacgaagcgcattttactgatccctcaagtattgcagcacgagggtacataagcactagagtaggaatgggagaagcagcggcgattttcatgactgctaccccacccggctcagtggaagccttcccgcaatctaatgccgtgatacaagacgaagaaagagatataccagaacgaagctggaattctggttatgaatggataacggatttcccaggtaaaactgtatggttcgtaccatcaatcaaatcaggcaacgacatcgcgaactgcttaagaaaaaacgggaaacgagtaattcaactcagtagaaaaacatttgacacagaatatcaaaaaacaaaaaacaacgattgggattacgtagtgacaacagatatcagtgaaatgggagcaaactttagagctgatagggtaatagatccacgacgctgcttaaaaccggtgatacttaaagacggtcctgagagagtcatactagcagggcctatgccagtgactgtagctagcgcagcacaaagaagaggacgaatagggagaaatcataataaggagggagaccagtatatttatatgggtcaaccactaaacaatgatgaagatcatgcacattggactgaggcgaaaatgctattagacaatataaatacgccagagggaatcatcccggcattatttgaaccagaaagagaaaaatcggctgcaatagatggtgaatatagattgcgaggagaagcacgaaaaacatttgtagagttaatgcgcagaggagacttacccgtttggctatcttacaaagtcgcttctgaagggtttcaatattcagatagaagatggtgttttgatggtgaacgaaacaatcaggtgttagaagaaaacatggacgttgaaatttggactaaagaaggtgaacgcaagaagctaagaccccgttggctcgatgctagaacatatagcgacccattagcattacgggaattcaaagaattcgctgcaggtcgccgttctgtctccggagatctaattctcgaaataggtaaattaccacaacacctaacacaaagagcccaaaatgcccttgacaatttggtaatgcttcataactcagaacagggaggaagggcttacaggcatgccatggaggaattgcccgatacaatagaaaccctgatgttactcgcactaatcgcagtgttgactggcggagtaacactcttctttttaagtggtcgtggactaggcaaaaccagtataggcttgttgtgcgtaatggcttcatccgtattgctatggatggctagcgttgaaccacattggatagcagccagcataatactggaattctttctaatggtcctactcataccggaaccggatagacaaagaacacctcaagataaccaattagcctatgtagtaatcggactactttttatgatattaactgtggcagccaatgagatggggctactcgaaacgacaaaaaaagatctcggcattggacatgttgctgtggaaaaccaccaccacgcggctatgctcgacgtggacctacatcctgcgtccgcctggacactctacgctgtagcgacgacaataattacgccaatgatgcgacacacaatcgaaaatacaactgcaaatattagcttaactgccatagcgaaccaagctgctatcctgatgggactagacaaagggtggccaataagtaaaatggatattggcgtaccactactagctttaggatgttattcccaagtaaatccattaaccttaacggctgcagttttgatgttagtagcgcattatgcaattataggaccgggactacaagccaaggctactagagaggcacaaaaaagaactgctgccggtatcatgaaaaatcccacggtggatggaatagtagccatagacttagatcctgtggtgtacgatgcaaaattcgagaaacaattaggacagataatgttgttaattctatgtacaagtcagattcttttaatgagaacgacgtgggcattatgcgagagcattacactcgcaacaggtccgttaactactttatgggagggttcgccaggaaaattctggaatactacaattgccgtttcgatggctaatatttttcgtggtagctatcttgctggtgcaggcttagcattctcactaatgaagagccttgggggtggtagacgtggaactggcgcccaaggagaaacattaggagaaaagtggaagcggcaattgaaccaattaagcaaatccgaatttaatacctacaaaagatctggtatcatggaggtagatagaagtgaagctaaagaaggactaaaacgtggtgagacaactaaacatgcagtgtcacgaggaaccgctaaactaagatggttcgtagaaagaaacctagttaaacccgagggaaaagtaattgacctaggatgcgggagaggaggatggtcttactattgtgctggacttaaaaaggtgacggaagtaaagggatacacaaaaggaggaccgggacatgaggagccaataccaatggcaacatatggttggaatcttgttaaacttcatagcggcaaagatgtcttttttattccacctgaaaaatgcgacactctattatgcgacataggggaaagtagccctaaccctacgattgaagaaggaagaactttaagagtattaaagatggtagagccgtggctgagaggaaatcagttctgtataaaaattttgaacccatatatgccctctgttgtcgaaactctcgaacaaatgcaacgaaaacatggaggaatgttagtgagaaacccattatcaagaaacagtacccatgaaatgtattgggtaagttgtggcactggaaacattgtctcagccgttaacatgacaagccgaatgttacttaacaggttcactatggcgcatcgaaaacctacatacgaaagagatgttgatctaggagcgggtacaagacacgttgccgttgaacccgaagttgcaaacctagatattatcggacaacgaatagagaacataaaacatgaacataagtcgacatggcactacgatgaagacaatccatataaaacgtgggcataccacgggtcctacgaagtaaaaccctcaggctctgcgtcatcgatggtaaacggtgttgtgaaactgctaaccaaaccatgggacgtaattccaatggttacccaaattgcaatgaccgatactaccccgtttggacaacaaagagtattcaaggaaaaagtggatactaggacaccaaaagcgaaacgagggacagcccagataatggaagtaacagcgaaatggttatggggcttcctaagccggaataaaaagccaaggatatgcacgcgggaagagtttacacgaaaagtgaggagcaatgcagccatcggagccgtctttgtcgacgagaaccagtggaatagcgccaaagaggcagtcgaagacgagcgtttttgggaccttgttcacagggaaagggaattacataaacaaggaaagtgtgccacttgcgtgtataacatgatgggtaaaagggagaaaaaattgggtgaatttggaaaagcaaaaggatccagagcaatttggtatatgtggttaggagcacgttttctggagtttgaagccttgggatttatgaatgaggaccattggttctcacgagaaaactccctttctggagtagaaggagaggggttgcacaagctcggttatatattacgagatatatcaaaaattcccggaggaaatatgtacgctgacgatactgcaggttgggacacacgaataacagaagacgatctacaaaacgaagcaagaataacagatattatggaaccggaacacgcactcttagctaagagcatttttaagttgacttatcagaacaaagtagtgagagtccaacgtcctgcaaaaaatggaactgttatggatgtgatttcacgtagagatcaaagaggaagtggacaagtaggtacctatggcttaaacacatttacaaacatggaagcacaattaatacgacaaatggagtcagaaggaatcttctcgccttctgaattagagacacccaacctggcagaacgagtgttagactggctagaaaaatacggcgtgaaacggttaaaacgaatggcaatatcaggagacgattgcgtggttaagcccatagacgatagatttgcaactgctctaacagcattgaacgatatgggcaaggtaaggaaggatataccacaatgggaaccctccaagggctggaacgattggcagcaagtcccattctgctcgcatcatttccaccaactaatcatgaaagatggacgagagatagtagtaccgtgccgtaatcaggacgaattggttggtcgcgcccgagtttcgcagggggcaggctggtcactaagggaaacagcatgcctagggaaatcatacgcacagatgtggcaactaatgtacttccataggcgggacctgagattagcggcaaatgcaatttgcagcgcagtaccagtcgattggatacccacatcgcgaacaacctggtctattcatgcgcatcatcagtggatgaccacggaagatatgctaagcgtttggaatagggtatggatcgaagagaacccctggatggaggataaaacacatatatcatcatggggggacgtgccatatttgggaaaacgagaagatcaatggtgcgggtccttaattggtcttaccgcacgtgccacgtgggcaacaaatattcaagtagcaataaaccaagttcgaagactgataggcaatgaaaactacctcgactatatgacgagcatgaaaagattcaaaaacgaatccgaccctgaaggtgccctgtggtag

SEQ ID NO: 21860 - RNA, 9879 nt, synthetic construct
  misc_feature 1..9879: note = derived and/or modified CDS sequence (opt6) from DENV-1__GU131791__SS-prME
  source 1..9879: mol_type = other RNA
tcagtaacaatgttacttatgttaatgccaaccgctctagcttttcatctgactactagaggaggagaaccacatatgatagtaagtaaacaagaaagaggaaaatcgcttctatttaaaacatcggctggcgtaaatatgtgtacccttattgcaatggaccttggagaactatgtgaagacacaatgacctataaatgtccaaggattactgaaactgagccggatgatgtagactgttggtgcaacgctacagacacgtgggtcacgtacggtacctgttctcaaactggagaacatcgcagagataaacgctctgttgcattggctccacacgtgggcctcggtttagagaccagaacagaaacatggatgtccagtgagggagcatggaaacaaatacaacgggtagaaacgtgggcattgcggcatccgggatttaccgtcatcgccttattcctggcccatgcaataggcacatctataacacaaaaaggaataattttcattttgttaatgttggtaactccttccatggcaatgagatgcgtcgggataggttctagagatttcgttgaaggattatcaggggcaacatgggtagatgtcgttctggagcacgggagttgcgtaacaacaatggcaaaagacaagccaacgcttgatatagaacttttaaaaacagaagtcactaatcctgctgtcctacgaaaattatgtatagaggccaaaatatctaatacgacgactgacagcagatgtccaacacaaggtgaagcaacattagtggaagaacaagatgcaaacttcgtatgccggcgaactttcgttgatcgaggatggggaaacggttgtggactgtttggaaaaggatcattaatcacatgtgcgaaattcaagtgcgttaccaagctggagggtaagatagtccaatatgaaaacctaaaatacagcgtgattgtgacggtacatacaggtgatcagcatcaggtcggtaatgaatctacagaacatggtactacagccacaatcacaccacaagcacccactactgaaatacaattgacagattacggtgccttaacactggattgttcacccagaacaggcctggactttaatgaaatggtattattaactatgaaagagaagagttggctagtacataaacaatggtttctagatttaccactaccatggacgtcaggagcatcaacatcacaagaaacctggaacagacaagatctacttgtcacatttaaaactgcacacgcaaagaaacaagaagttgttgtattgggaagtcaagaaggagccatgcatacagcgttaactggcgctacagaaattcagacatcgggaactacaactatctttgcaggacatctaaagtgcagactgaaaatggataaactaacgttaaaaggaatgtcatacgttatgtgcacaggatcttttaaattagagaaagaagttgcagaaacccaacatggaacagtgttagtacagattaagtatgaaggaacagacgctccatgtaaaatcccgttctcaacacaagatgaaaaaggggtaacacaaaacgggcgcttgattactgcaaacccgattgtaactgataaagaaaaaccagtgaatatcgaagctgaaccacctttcggagaatcctacatagttatcggtgctggcgagaaagctctaaaactatcctggttcaagaaaggttcatctattggtaagatgttcgaagctactgccagaggtgcgcgcaggatggcgatactaggagacaccgcttgggattttggcagtataggaggagttttcacttcagttggaaaactggtacatcaaatatttgggacagcatacggcgtgctatttagcggagtatcatggacaatgaaaataggaattggagtcctcttaacatggttgggtttaaattcgagatcaacatcattaagcatgacctgcattgcggttggattagtgaccttatatttaggggtaatggtgcaagcggactcaggctgcgtaataaattggaagggacgtgagctgaaatgtgggagtggaatttttgttactaatgaagtacatacttggacagaacaatacaaattccaagcagattcaccaaaaagacttagtgccgccataggtaaagcatgggaagaaggagtatgtggaataaggagcgcaaccagattggaaaatatcatgtggaagcaaatatccaatgagctaaaccatattctattggaaaatgatatgaaatttacagtagtcgtaggggatgttgcagggatattagcacaagggaagaaaatgatcagaccgcagccaatggaatataagtactcatggaaaagctggggcaaagcaaaaataataggggccgacgtccaaaacaccacctttattattgatggaccaaatacaccagaatgcccagatgaccaacgcgcttggaatatctgggaagtggaggactatggctttgggatttttactacaaatatctggctcaaactaagagattcttatacacaagtatgtgatcaccggttaatgtcagcagctatcaaggacagtaaggctgtacacgcagacatggggtattggatagaatccgagaaaaacgagacatggaaacttgcgagagcctcttttattgaagttaaaacttgtatttggccaaaaagccatacactttggagtaatggggttctagaatctgagatgattatcccaaagatctacggaggaccgatctctcaacataactacagaccaggttacttcacgcaagctgcaggtccatggcacttagggaaacttgaactagattttgacttatgtgaaggaactacggttgttgtagatgaacactgcggaaatagaggcccaagtttgaggaccactacagtcactggaaaaataattcacgaatggtgctgcaggagttgtactttaccgccacttcgctttagaggcgaagacggatgttggtatggtatggagatacgtccagtaaaggaaaaggaagaaaatctagtgaagtctatggtttctgcagggtctggagaagtagattcattctcactgggactattatgtatttcaataatgattgaagaagtaatgagatctaggtggtcacgaagaatgttaatgactggaacactagcagtattctttcttttaattatgggacagctgacctggaatgatttaattagactatgtattatggtgggagcgaatgcatcagaccgtatgggcatgggaacaacgtatttagcgttgatggctacttttaagatgaggccaatgttcgcggtcggtctcctttttcgaagactaacctctagggaagtattattactgacaatcggtctttcattagttgcatcagtcgaattgcccaattctttagaagaattaggtgatggccttgcaatgggaatcatgattctgaaacttttgactgactttcagtcgcatcagctttgggcaacactgctgagtctaacatttatcaaaacaacgttctcactacattatgcttggaagactatggcaatggtgctttcaattgtatcactgtttccgttatgtctaagtacaacgtctcagaaaaccacatggcttccagtactactaggctctcttggatgcaaacccttaacaatgttcttgatagcagaaaataagatatgggggaggagatcctggccgctaaatgaaggtattatggctgttggaatagttagcatactactatcctccctactcaaaaatgacgttccactagcaggtcctttaatagcgggaggaatgcttattgcatgttacgtaatttcaggttctagtgcagatttatcattggaaaaagcagcagaggtgagctgggaggaagaagcagagcacagtggtgcctcacataatatattggtagaagttcaagatgacggacctatgaaaataaaagatgaagagagagacgatacgttgacgatactactaaaggccacattgctcgctgtgtccggtgtatatcctctcagtattcccgctacccttttcgtttggtatttctggcaaaagaagaaacaaagaagtggagtattatgggacacaccctcaccgcccgaagttgaacgtgctgttctagacgatggcatttatagaatcatgcaacggggtctacttgggagaagtcaggtaggagtaggagttttccaagaaaacgtatttcacaccatgtggcacgttacaagaggtgccgtgttaatgtatcaaggtaaaagactagaaccttcttgggcttcagttaagaaagacctaatttcatacggcgggggatggcgtttacaaggaagctggaataccggagaagaggttcaggtgatcgctgttgagccaggcaaaaaccctaaaaatgtgcaaactgctccgggcacctttaagactccagaaggcgaggttggtgctatagctctagactttaaacctggtacctcgggtagtcctattgtaaacagagaagggaaaatagtaggattatatgggaacggggtagttactacgtcaggcacttacgtatcagccatagcccaagcaaaagcaagccaagagggaccactgccagaaatcgaggacgaagtattccggaaacgtaacttgactataatggatttgcatccaggcagtggaaaaaccaggagatacttacccgccatagtacgtgaagcaataaaaaggaaactaagaacactcatactggcaccgacacgcgtagtagcctcagagatggccgaagctctgaagggtatgcctataagatatcaaacaacagcagttaaatcagaacatacaggcaaagagatagtggatttaatgtgccatgcaacgtttacaatgaggcttttatctcccgtgagggttccaaattataacatgatcataatggacgaagcgcattttaccgatccatcaagcatagccgcacgcggatatatcagcacgagagtaggcatgggcgaagcggcagcgatattcatgacggcaactcctcccgggagtgtagaagcgttccctcaaagtaatgcggtaatccaagatgaagaaagagatataccagagaggtcatggaacagtggctatgaatggataacagactttccaggtaaaacagtatggtttgttccctctatcaagtcaggaaacgatatcgcgaattgtctaaggaaaaacggaaagagggtaatacaactaagtagaaaaactttcgataccgaataccagaaaactaaaaataatgactgggactatgtagtgactacagacatatctgaaatgggcgctaattttcgagccgaccgggtgatagacccccgaagatgtttaaagccggtcatattaaaagacggtcctgaacgagtcattctggcaggtccaatgccagtaacagtggccagtgcagctcaaagacgtggacgtatcgggagaaaccataataaagaaggcgaccaatacatatatatgggacagccgcttaacaacgatgaagaccatgcccactggactgaagcaaaaatgctgctggataatatcaatactccagaaggaattataccagcactttttgaacctgaacgagagaaaagtgcggctattgacggagagtaccgtttgagaggtgaagctagaaaaacttttgtagaattaatgaggagaggggacctgccagtgtggctgtcgtacaaagtcgccagcgagggctttcagtactcagaccgtaggtggtgtttcgacggggaacgtaacaaccaggtactggaagaaaatatggacgttgagatatggaccaaagagggagagaggaagaaactgcgaccaagatggctcgatgcacgcacttatagtgacccgctcgcactgagagaatttaaagagttcgcagcagggagaagaagcgtatctggggatctaatccttgaaatcgggaagttaccacaacatcttacacagagagcacaaaacgcgttagacaacttagttatacttcataattccgagcagggtggtagagcttaccggcacgccatggaagaattacctgatacaatagaaacactaatgcttctagccctcatagccgtactaaccggtggagtcacactattctttctaagtgggagaggtctgggaaaaacgtcaataggtctattatgtgtaatggcgtcatcagtactcttgtggatggcctcagtcgaaccgcattggatagccgcctctatcattctggagttctttttaatggtcctattaataccagaaccggacagacaacgtactccacaagacaaccagcttgcctacgtggtgataggtcttttatttatgatcttgaccgtagccgctaacgaaatgggtttgcttgaaacaacaaagaaagaccttggaatcggtcatgttgcagtggaaaaccaccaccatgccgcaatgttagatgtcgatctgcatccagcctcagcatggactctatacgcagtagcaacaactattattactcctatgatgagacataccatagaaaacacgaccgcaaatatatcgcttacagcgattgctaatcaagcagctattctaatgggactagataaaggatggccaatatcaaagatggatataggggtccccctcctagctttaggttgttacagccaagtgaatcctttgacccttactgcagctgttctaatgttagtcgcacattacgccataattggacctggattacaagcaaaggctacccgcgaggcacagaaaagaacggcggccgggataatgaaaaacccaacagtagacggaatagtagctatcgatttagatcctgtagtatatgacgcaaagtttgaaaaacaattgggacaaatcatgctattgatattatgcacaagtcaaatattactcatgaggacaacatgggcgttatgtgaatcaataacattagccactggacccctaactacattatgggagggatccccaggaaaattctggaatacaactatagcagttagtatggcaaatatattccgcggatcatatctagcaggggcgggtttagcgtttagtttaatgaagtctttagggggcggtagaaggggtacaggagcacaaggagaaaccttaggggagaaatggaaacgtcaattgaatcaattgagtaaatctgaatttaatacctacaaacgaagtggcataatggaagtggacaggagtgaggctaaagaggggctcaaaagaggagagactacgaagcatgctgtatctagaggaaccgcaaaattaagatggttcgtagaaaggaacttggtcaagccagaaggaaaagttattgatttaggatgcggaaggggtggatggagttactactgtgcggggttgaaaaaggtcacagaagtcaagggctatactaagggtggacctggacacgaagaaccaataccaatggccacctacggttggaaccttgtaaagttgcattcaggaaaggatgtattcttcattcccccggagaaatgtgatacgttactctgtgatataggcgaaagttctcctaatccaaccattgaggaaggaaggacacttcgcgtactaaagatggttgaaccgtggctacgagggaaccagttctgtataaaaattctcaacccatacatgccctcagttgtcgaaacgttagaacaaatgcaaaggaagcatggtggtatgctggtgcgtaacccattgtctaggaactccacacacgaaatgtattgggtttcatgtggaacaggaaatattgtgtcggccgtaaacatgacttcaaggatgcttttaaataggtttacgatggcccatcgtaaacctacatatgaaagagatgtagatctaggcgcgggtacccgacatgtagccgtggaacccgaagtcgctaatcttgatatcattggacagcgaatagaaaatattaaacatgagcacaagagtacatggcactatgacgaagacaatccatataaaacctgggcatatcacggttcgtatgaggtaaaacctagtggaagtgcgtcaagtatggtcaatggcgtggtaaaacttctaacgaaaccgtgggatgtaatcccaatggtaacacaaatagccatgacggatacaacgccatttggacagcaaagagtattcaaagaaaaagtagatacccgaacacctaaggcaaagagaggtacagcacaaataatggaggtgacagcaaaatggctatggggatttttatccaggaacaagaagcctcgcatctgtacccgagaagagttcacacgtaaagttcgttctaatgccgctataggcgctgtattcgtagatgaaaaccaatggaactctgctaaagaagcagttgaagatgaaagattctgggacctggtacaccgagaaagagaactacacaaacaaggaaaatgcgcgacctgcgtttacaatatgatgggaaaaagagagaagaaactaggggaatttggtaaggctaaaggatcacgtgcaatttggtatatgtggcttggtgcacgattcctggaatttgaagctctaggatttatgaatgaggatcattggttctctcgggaaaatagtttatcaggtgtggaaggagaaggattacataaacttggttatatattaagggacatttcaaaaatacctggcggtaacatgtacgcagatgacacggcaggatgggacacgcgaattacagaagatgatttacaaaacgaagcaaggataaccgatataatggaacccgaacatgcgctattagcaaagtccatatttaagctcacgtaccaaaataaggtggtccgggtacaaaggcccgccaaaaatggtacagttatggacgtgatcagtcgacgagatcaacgcggcagcggacaagtagggacttatgggttaaacacattcactaacatggaagctcaactaattcgacaaatggaatcagagggaatcttctcaccaagtgagctagaaactcctaacctcgcagaacgggtcttggactggttagaaaagtatggggtagaacgtctaaagcgaatggctatatctggagacgattgcgtcgttaaacccattgatgaccgatttgcaacagccttaacagcgttaaatgatatggggaaagtacgaaaagacattcctcaatgggaacccagtaaaggatggaacgactggcaacaagtccccttttgtagccatcacttccatcagttaatcatgaaggacggaagagagatcgtagtgccttgccgcaatcaggacgaattagtagggagagcaagagtaagccaaggtgcaggatggagtttgcgagaaacggcttgccttggcaaatcctacgctcaaatgtggcaactcatgtattttcataggagagacttaaggctagctgcgaatgccatttgctccgctgtgccagtggattggatccccacgtcacgtacaacctggtcaattcatgcgcaccaccaatggatgactaccgaagacatgctatcggtttggaatcgagtatggattgaggagaacccatggatggaggataaaacgcatatatccagctggggagatgtaccatacttagggaagcgtgaagaccaatggtgcggctctttgataggtctaactgcgagagcaacgtgggcgacaaatatacaagttgctatcaaccaagtccgtcgactcatcggcaatgaaaattatctagattacatgacatcgatgaaaagatttaaaaacgagagtgatccggagggggctttatggtaa

SEQ ID NO: 21861 - RNA, 9879 nt, synthetic construct
  misc_feature 1..9879: note = derived and/or modified CDS sequence (opt6) from DENV-1__GU131792__SS-prME
  source 1..9879: mol_type = other RNA
tcagtaactatgcttctaatgcttatgccaactgctctggcctttcatttaacgactagaggtggggaaccccatatgatagtaactaaacaagaacggggaaaatcactacttttcaaaacaagcgccggagtaaacatgtgtactttaattgcaatggacctgggagaactgtgcgaagacactatgacatataaatgtccaagaataacagaagccgaaccagatgatgtggattgttggtgtaacgcgacggatacatgggtaacttacgggacgtgcagccaaaccggggaacaccgcagagataaacgatcagtggcattagcgccacacgtaggactaggattagaaacaagaaccgaaacttggatgtcatcggaaggagcttggaaacaaatacaaagagttgagccctgggctcttagacatccaggatttacggtgattgcgttatttttggcacatgctattggtacctcgataacacaaaagggtatcattttcatacttctaatgttagtaacaccatcgatggctatgcgctgcgtaggaataggcagccgagcttttgttgaagggcttagtggagcgacttgggtagacgtagtactagaacacgggagttgtgttaccacaatggccaaagacaaaccgacgcttgatatagagttgctaaaaactgaggtaacaaatcccgcagtcttaagaaaattatgtatagaagcaaaaataagtaatacgacaacagattctcgctgtcccacccaaggggaagctacattaatggaggaacaagatgcgacgtttgtatgtagaaggaccttcgtcgaccgaggttggggaaatggatgtggtctattcggaaaaggcagcttaataacatgcgcaaaatttaaatgtgtaacgaaactagaaggaaagatagttcaatacgaaaatctcaaatattccgtcatagtaaccgtccatactggtgatcaacatcaagtgggtaatgaatcgacagagcatggcaccacggcgaccataactcctcaagcacccacgtcagaaatacaattaccggattacggagcactcaccttggattgttccccaagaacaggtctggactttaatgaaatggttctattgacaatgaaagagaaaagctggcttgtacacaaacaatggttcttagatctaccgcttccctggacgtcaggagcaagcacatcacaagaaacctggaataggcaagatctgttagttaccttcaaaactgcacacgctaagaagcaggaggtcgtggtactcggatctcaagagggggcaatgcatacaggactcacaggcgccacagaaatacagacaagtggaacaacgacaatatttgcaggacatttaaagtgtagacttaaaatggacaaattgactttaaaaggtatgtcttatgtaatgtgtacaggctctttcaagctggaaaaagaagttgctgaaacgcaacacgggaccgtcttagtccaaataaaatacgagggtacagatgcaccatgcaaaattcctttcagtactcaggacgaaaaaggggtaactcagaacggtagacttatcaccgctaatccgatagtaacagataaagaaaaaccggtgaatatagaagccgaacccccattcggtgaatcgtacatagttattggagctggtgaaaaagcgctaaagttaagctggtttaagaaagggtctagtataggaaaaatgtttgaagctaccgctcgcggtgcacgacgcatggcaatattgggcgacacagcctgggattttgggtctgtaggaggggtatttacatcagtaggtaaactggtccatcaaatatttggaacagcatacggagtattatttagcggcgtatcatggacaatgaaaatagggataggagtgttactcacttggttaggattaaattcacgatcgacctctctgtcaatgacttgcatcgcggtaggtttggtgacgttatatctcggtgtaatggttcaagctgatagcggatgtgtgataaactggaaaggaagagagttaaagtgtggtagtggaatcttcgggaccaatgaggtacatacctggacggaacagtacaagttccaagcagattcccctaaaagactatctgctgcaattggcaaaccttgggaggaaggagtatgcggtatacgatcagcaacaagattagaaaatataatgtggaaacaaatatcaaacgaattaaatcatatcctcctagagaacgatatgaagttcacagtggttgtcggcgacgtagtaggaatactagctcaaggcaagaaaatgatccggccgcaaccaatggagcacaaatattcatggaaaagctggggaaaagcaaagataataggtgcggacgtgcaaaatacaacatttataatcgacggaccgaataccccagaatgtcctgacgaccagagagcgtggaacatatgggaggtggaagattacggcttcggaatttttacaacaaacatatggttaaaactcagagactcacacacacaggtgtgtgatcacaggctaatggccgcagctataaaagatagaaaggcagtccatgctgatatgggatattggatagaaagcgagaaaaatgagccatggaaacttgctcgtgctagctttatagaagttaagacatgtatatggccaaagtctcatacattatggagtaatggagtgctagagtcggaaatgattataccgaagatatacggtggtccaattagtcagcacaattatcgtcctggatattttacccaaactgccggaccatggcatctaggaaaattagagttagacttcgatctttgtgaaggtacgaccgtggttgtagatgagcactgtgggaaccgaggaccttcgctaagaacaacaacggttaccggcaaaattattcacgaatggtgctgtagaagctgtacactccctcccttaagattcaagggagaagatgggtgctggtatggaatggaaataaggccggtaaaagagaaagaggaaaatctcgtcaaaagcatggtcagtgcaggcagtggggaggttgactccttcagtttgggtcttctatgtatatctataatgatagaagaagtaatgagaagtcgatggagcaggaaaatgctaatgaccggtactctagcggtttttcttctcttaatcatgggccaactaacgtggaacgacttaatacgattgtgtataatggttggtgccaacgcaagtgatcgcatgggaatggggacaacttacttggctttaatggctactttcaagatgcgaccgatgttcgcagttggtctcctatttcgcagattgacttcaagagaagttttacttcttactataggcctgtcacttgtagcatctgttgaattaccaaactcgctagaggaacttggagatggacttgcaatgggcataatgattctgaaactgttgactgattttcaatctcatcaactttgggcaacattgctatctcttacatttataaaaacaactctatccttacactacgcctggaaaacgatggcaatggtccttagtatagtcagtctttttccattgtgtctaagtaccacaagtcagaaaactacatggctgccagtacttttaggaagtttaggatgtaagcccttaaccatgtttctgattacagaaaataaaatctggggtcgtaaatcctggcctctgaatgaaggaataatggcagtgggagtagtgtcgattctactttcttcgcttctcaaaaatgacgtaccactagcaggtcctctcatcgcaggaggaatgctcatagcatgctatgtgatcagtggatcctcagcagatcttagtttagaaaaggcagcagaagtatcatgggaagaagaagctgaacactccggagcaagccataatattctcgtagaagtacaggacgacgggacgatgaaaataaaagatgaagaaagggatgacaccctaactatattgttgaaagctacactcctcgctgtatccggggtgtatcctctatcgatcccagcaactttatttgtctggtatttctggcagaaaaagaaacagagaagcggtgttctttgggatacacctagtccccctgaagtcgagagagccgttctagatgatgggatttataggattatgcaaagaggccttctagcaaggtcgcaagtaggagtaggcgtatttcaggaaaatgtctttcatacaatgtggcacgttacccggggagcggttttaatgtatcagggaaaaagattggaaccatcttgggcctccgtcaagaaagatctaatttcctacggcggaggatggcgactacaaggctcttggaataccggagaagaagtgcaagtcattgccgtggaacctggcaaaaatcctaaaaacgtgcagactgcgcctggcacattcaaaacgccagaaggtgaggtaggtgctatagcactagatttcaaacccggaacatcggggagtcctatagtaaatcgagagggtaaaatagtcggattatatggcaacggagtcgttacgacatcaggaacttatgtaagtgccatcgcacaggctaaagcctcacaagaaggaccccttccagaaatcgaagatgaagtctttaggaaaaggaacctcacaatcatggatctacacccgggttcgggaaaaactagaaggtatctccccgccattgtaagagaggcaataaaaagaaaattacgaactttaatacttgctccaacacgagtggtggcatcagaaatggcagaagctctcaaaggtatgcccatacggtatcaaacaaccgcggttaagagtgagcatacagggaaagaaatcgtcgacttaatgtgccacgcaacatttacgatgcggctacttagcccagttagagtacccaactataacatgatcattatggatgaagcacatttcaccgacccatcgtctatcgctgcaagaggttacattagcactagagtgggtatgggagaagcagcggccatttttatgactgctacacccccaggctctgtagaagcctttccgcagtcaaacgcagtaatccaagatgaagaaagggatatacctgaaagaagctggaatagtggatatgaatggataacagactttccgggaaagacggtatggtttgttccatctataaaaagtggtaatgatatcgcaaactgtttaaggaaaaacggtaaacgtgtaattcaattatcacgaaaaacgttcgatacagaatatcaaaagactaaaaacaatgactgggactatgtcgtaaccactgatatttcggaaatgggtgcaaatttccgcgcggatcgagtaattgatccgcgccgctgcctgaaacctgtaatactaaaagatggccctgaaagagtaatattagctggaccaatgccagttacagtcgcaagcgcggctcagcgaagaggacgaatcggtcgcaatcataataaggaaggcgaccagtacatatatatgggacaacctcttaataacgatgaggatcatgcacattggacggaagcaaagatgctcttagacaacataaacacgccagaaggtataatacccgctctattcgaaccagaacgagagaaaagcgcagcgatagacggtgaatacagattacgtggcgaagcgcgtaaaacttttgtagaattaatgcgacgtggtgatcttcctgtttggttatcgtataaagtcgccagcgaaggatttcaatactcagacagaagatggtgtttcgacggagagcgcaacaatcaagttcttgaagaaaatatggatgtcgaaatttggacaaaagagggagaacgaaagaaactgcggccacggtggctagacgccagaacatattcggatccgttggccttacgagaatttaaagaatttgcagcagggaggagatctgtctcaggagacttaatacttgaaattggtaaactgccgcaacacttaactcaaagagcccaaaatgcgttagacaatttggttatgctacacaactccgagcagggcggacgagcatatcgacacgcaatggaagaactgcctgacacaatagaaactttaatgttattagcacttatcgcggtcttaacaggcggtgtaaccctattctttttgtcgggacgaggattaggaaaaacatccataggtttactatgcgtgatggcatcatcggttttattatggatggccagtgtcgaaccacactggatcgctgccagtatcatattggagtttttcttaatggtactactgattccagaacctgaccgacaaaggacgccccaagataaccaattggcttatgtagtaatcggtctcttattcatgatacttaccgtggcagccaatgaaatgggattgctggaaacaaccaaaaaggatctaggaataggtcatgtggcggtagagaatcaccatcatgcgaccatgttggatgtagatttgcaccctgcgtccgcgtggaccctctatgcagttgctacaactataataactccaatgatgagacacacaatagaaaacactaccgctaatatatccctgactgctattgctaatcaagcagcaatcctaatgggtctggacaaagggtggccaattagcaaaatggacattggagtccccttactagcactagggtgttactctcaagttaatcccttaaccttgacagctgctgtactaatgcttgttgcacactacgcgataattgggccaggactacaagctaaagccacaagagaagcccagaaaagaacagcagcaggcatcatgaaaaaccccaccgtggacggcatagtcgctatagaccttgaccctgttgtttatgacgccaaatttgaaaaacaactgggacaaataatgttgctaatactgtgcacttcccaaattcttttgatgaggaccacttgggcactctgtgagtctataactttggccacaggaccgttaacaactctttgggaagggagtccaggaaagttttggaatactaccatcgcagtctcaatggcaaatatattccgtgggagttatctcgccggagctggtctcgccttctctctaatgaaaagcctaggaggcggtcgacgagggactggagctcaaggagagacattaggagagaaatggaaaagacaactaaatcagctaagcaaaagtgagtttaacatttacaaacgttccgggataatggaggtagataggagcgaagctaaggaaggtttgaagagaggggagacaacacgacatgccgtctcaagaggaactgctaagctacgctggtttgttgaaaggaatttagtaaaaccagaaggaaaggtcatagacctgggatgtgggcgaggaggatggtcttattattgtgctggtctaaagaaagttacagaagttaagggttataccaaaggaggaccaggtcatgaggaacctattcctatggccacctatggatggaatttagtaaaattacatagtgggaaggatgtctttttcaccccacctgaaaagtgcgacactctattgtgcgacattggcgagagttccccaaacccaaccatagaagaaggaagaacactgagggttttaaaaatggtcgagccttggctgagggggaatcaattttgcataaaaatcctaaacccttatatgcccagcgttgtcgaaaccctagagcaaatgcaaagaaaacacgggggaatgcttgtgaggaacccactaagtcgaaattcgactcatgaaatgtattgggtgtcctgtggtacaggaaacatagtatcagcagttaatatgacatccagaatgcttctgaatagatttactatggcccataggaaaccgacgtacgaacgtgacgttgatcttggagctggtacgcgacatgtggcggttgaaccggaagttgcgaaccttgacattattggacaaagaatagaaaacatcaaacacgaacataagtccacatggcactatgatgaagacaatccgtacaaaacttgggcatatcacggtagctatgaggtaaaaccaagtggaagtgcatcatcaatggttaacggagtagtaaaacttctaacgaaaccatgggacgtcataccgatggtcacacagatagccatgacagacacaactcctttcggacagcaaagagtgtttaaagaaaaggtggatacccgtactccaaaagcgaagagaggaaccgcccaaataatggaggtcacggctagatggctatggggattcctatcaagaaataagaaaccgcgcatatgtacacgtgaggagttcacccgaaaagtacgttcgaatgcagctatcggcgctgtttttgttgacgaaaaccaatggaactctgcaaaagaagccgtcgaagacgagagattttgggatttagttcaaaaagaacgcgaattacacaagcaaggaaaatgcgcgacctgtgtgtataatatgatgggaaaaagggaaaagaaactaggagagttcggaaaagctaaaggttcaagagcaatctggtatatgtggttaggcgccagattcctagaatttgaagcattaggattcatgaatgaggatcattggttctctagagaaaatagcctaagtggagttgaaggtgaaggtctacataagctaggctatatacttcgcgatatcagcaagataccgggagggaacatgtatgccgacgatacagcaggatgggatacgaggattaccgaggatgatttacaaaatgaagcaaaaatcaccgatattatggaaccggaacatgcactccttgctacatcaatatttaaattaacatatcaaaataaggtagtacgtgtccaaaggccagctaaaaacggtactgttatggacgttataagcaggcgagatcaacggggctcaggtcaagtcggtacgtacggattgaatacattcacgaatatggaggctcagctaatacgccagatggaatcagaagggatctttcttcctagcgagttagaaacgccaaacctagctgaacgagtgttagattggttagaaaaatatggagtcgaaagattaaaaaggatggcaatctcaggtgatgattgtgttgttaaacctatcgatgatcgatttgcaacagcactcacagcattaaacgatatgggaaaggtaagaaaagacataccacagtgggaaccgagcaaaggttggaatgattggcagcaagtgccattctgttcacaccacttccaccaattaataatgaaagatggccgagaaattgttgtaccttgtcgtaatcaagatgagttagtaggcagagcgcgtgtgagtcaaggcgcaggatggtcgttacgagaaaccgcgtgcttggggaaaagttatgcgcagatgtggcaattaatgtactttcaccgtcgagatttaagattagcagctaatgccatctgtagtgcggtccccgtggattgggtaccgacaagtcggacaacgtggtcaattcatgcacaccatcaatggatgacaactgaagacatgctatcagtctggaatcgagtatggatagaggagaatccttggatggaagataagacgcatgtgtcatcctggggagatgtgccgtatctcggaaaaagagaagaccaatggtgcggttcattaataggactaacggcgagagcaacatgggcaagtaatattcaagttgcgataaatcaagtaagaagattaatcggaaacgagaattatttagattacatgacatcgatgaagagatttaagaacgaaggtgatccagaaggtgctctatggtaa

SEQ ID NO: 21862 - RNA, 9879 nt, synthetic construct
  misc_feature 1..9879: note = derived and/or modified CDS sequence (opt6) from DENV-1__HM488256__SS-prME
  source 1..9879: mol_type = other RNA
tcagtcactatgttattaatgttaatgccaacagcccttgcattccacttaactacgcgcgggggtgaaccgcacatgatagtaagtaaacaggaaagaggaaaatctttattattcaaaacatcagcaggagtcaacatgtgtactttaatagctatggatctaggagaattatgtgaagatactatgacctataaatgcccaagaattacggaaacggaaccagatgatgtggactgttggtgtaacgctacggatacatgggtgacgtatggaacttgcagccaaacaggtgaacaccgtcgcgataaacgatcagttgccctagcaccacatgtagggttaggactagaaacgcgaacagaaacatggatgagctccgaaggggcatggaaacaaattcaacgtgtcgaaacatgggccctgaggcaccctggatttactgttattgcgttatttctggcccatgccattggaacaagtataacccaaaaaggtataatttttattctattaatgttagtaacaccttcaatggcaatgagatgtgtcggcattggctcaagagattttgtagaaggtttgtcaggagcaacttgggttgacgttgtactcgaacacggatcctgtgttactacaatggcgaaagacaaaccaaccctggatatagaacttttaaaaacagaagtaactaatccggccgtgctacggaaattatgcattgaagcgaaaatttcgaacactacgactgactcgagatgtcccacacagggcgaagcgactctagtagaagaacaagacgcaaatttcgtatgtaggcgaactttcgtagatagaggctggggcaatggttgcgggttatttggaaagggtagtttgattacatgtgcaaagttcaaatgcgttacgaagttagagggaaagatcgttcagtatgagaatttaaaatattctgtgatagtaacagtacatacaggagaccaacatcaagtaggaaacgaaagcaccgaacatggtacaacagcaacaataactcctcaagccccaactacagaaatccaattgccggattatggagctttgacgttagattgttcaccaagaactggacttgacttcaatgaaatggtattattaacaatgaaagaaaaatcttggttagtacacaaacagtggtttttagacctgccattaccgtggacgtcaggtgcctcaacgtctcaagaaacatggaaccgtcaagatctccttgtgacatttaaaacagcgcatgcaaagaagcaagaagtggtagtattaggatcgcaagagggagcaatgcacactgccttaacaggagctacggaaatccaaacgagcggaactactactatattcgcgggccatctcaaatgtcgattgaaaatggataagctaactttaaagggtatgagctatgttatgtgtacagggagctttaaattggaaaaagaactggccgaaacccaacacgggacggtgctagtgcaaataaaatacgagggtacagatgcaccgtgcaaaatcccgttctcaacgcaggatgaaaaaggcgttacacagaatggaaggttgataactgctaatcctatcgttactgataaagagaagcccgtaaatatagaagctgaaccaccgttcggagagagttatatagtcattggtgcaggcgaaaaggcgttaaagttatcctggtttaagaaaggatcatctataggaaaaatgttcgaagctacggccagaggggcacggagaatggcgatactaggtgcccctgcatgggactttggatcaattggaggagtatttacaagcgttggaaaactggtacatcaaatatttggaactgcatacggagtactattttctggtgtatcgtggacaatgaaaatagggataggagtgctcctaacctggctcggactcaatagtaggtctacctccctatcgatgacatgtatcgcagtaggcctagtaactttatatttaggcgtaatggtgcaagcagattcaggctgcgtaataaactggaaaggaagagaactaaaatgtggttcagggatattcgtaactaacgaagtgcatacgtggaccgaacaatacaagttccaggctgattcgcctaagcgtctgagcgcagcgataggtaaagcatgggaagaaggagtatgcggcattcgaagtgccactaggttagaaaacataatgtggaagcaaataagtaatgaacttaaccatattctactagagaatgatatgaaatttacggtggtggtaggcgatgtagctggcatactcgctcaaggcaaaaagatgataagaccccaaccaatggaacataagtactcatggaagtcatggggaaaagccaaaataattggggcggacgttcaaaataccacattcattatagacggacctaataccccggaatgtcctgacgatcaaagagcatggaacatatgggaagttgaagactacggctttggcatattcacaacaaacatatggttgaaattgagggacagttacacacaagtttgcgatcaccggctaatgagtgcagctattaaggattcgaaagcagtacacgctgatatggggtactggatagaatctgaaaagaatgaaacatggaaattagcaagagcctcgttcatagaagttaagacatgtatatgggcaaaaagtcacacactttggagtaatggggtattggaatcagaaatgattatacctaaaatctatggcggaccaatttcgcaacataactacagacccggttatttcacgcaaaccgccgggccttggcatcttggaaaacttgaactagattttgatttatgcgaaggcacaacagtagtagtagacgaacattgcggaaataggggcccatcgcttcggacaactacagtaacggggaaaataattcatgaatggtgttgtaggtcctgtactctaccccctctgagatttagaggtgaggacggatgttggtacggaatggagataagccctgtcaaagagaaagaggaaaatctggtgaaatcaatggttagcgctggaagtggtgaggtagattccttttctctcggccttctttgtatctccattatgattgaagaagttatgcgatcgagatggtcccgtaaaatgttaatgacgggaacactagctgtgtttttcctacttattgtcggacagctcccgtggaacgatctcataagactatgtataatggtgggggccacagcatcggcaaggatgggaatgggcacaacaagtcttgcgctcatggctacctttaaaatgcgccccatgttcgcagtaggtttattattccgacgtctaacatcaagggaagtactattgttgacaattggactttcgctagtggcttcagtcgaattgccaaattcattagaggaactgggtgacggcttggcaatggggataatgatattaaaactacttaccgatttccagtcacatcaactttgggcaactttattgagtcttacgttcataaaaacgacattcagtcttcactatgcttggaaaaccatggcaatgggtttaagtgtcgttagtttgttcccattatgcttgtctacaacatcacaaaagaccacatggctgccagttttactagggtcattaggttgtaagccactcacaatgttcttaatagcagaaaataaaatatggggacgacggagttggccgttaaatgaaggaataatggcggtagggatagtaagtattctactatcctccctcctaaagaatgatgtaccactagcaggtccattaatagcaggcggaatgctaatagcatgttatgtcatttcagggtcatcggcagacttgagcttggaaaaggctgcagaagtgagctgggaagaagaagctgaacatagcggtgcttcacacaatattctcgttgaggtccaagacgatgggaccatgaaaatcaaggatgaggagcgagacgatacacttacgattttattaaaagcaacattactcgcagtgtccggggtgtatcctttatctataccagcaaccctatttgtttggtatttctggcagaagaagaaacaacgttcgggagtcttatgggacacgccatcgccaccggaagtagagcgcgcggtcttagacgacggcatttatagaataatgcagcgtggtctcctaggcagaagtcaagtaggggtgggtgtatttcaagaaaacgtcttccatacaatgtggcacgtaacccgaggagcagtcttgatgtaccaaggtaaacgactcgagccttcatgggcatcagttaagaaagatctaataagttacggagggggctggagacttcaaggatcatggaatacaggtgaggaagtacaggttatagcagtagaaccaggcaaaaatcccaaaaatgttcaaacggcaccgggcacgtttaaaactcctgaaggcgaagtaggagcaattgcgttagactttaaaccaggaacatccggtagtcctattgtaaacagagaaggaaaaattgtaggactttacggaaacggagttgtcacaacctcaggtacctatgtatctgccatcgcccaagcgaaagctagccaggaaggcccattgcccgaaattgaggatgaggtctttcgtaagagaaacctcaccatcatggacctacacccaggaagtggaaaaaccaggagatatttgccggccatcgtaagggaagcgattaaaagaaagctaaggacgttgatactagctccaacccgagttgtagcgtcagaaatggctgaagctctcaaaggtatgccaataagataccagactacggctgtaaaaagcgaacacacaggaaaagagattgtagatctcatgtgccatgctacgtttacaatgcggttgttatctccagtaagagttccaaattacaatatgataataatggacgaagcacacttcacagaccctagctcaattgcagcgagaggatacattagtacaagggttggaatgggcgaagcagctgctatattcatgacagcgaccccaccaggttctgtagaagcatttccacaatctaatgctgttattcaagatgaagaacgtgacattccagaaaggagctggaactcagggtatgaatggatcaccgattttcccggaaagactgtgtggtttgtcccatctataaaatctggcaacgatattgctaattgtttacgtaaaaatggaaagagagtaatacagttaagtagaaagacgtttgataccgagtatcagaaaactaaaaacaatgactgggattatgttgttaccacagatataagcgagatgggtgcaaattttcgcgctgacagagtaatagatccaagaaggtgtttaaaaccagtaattcttaaagatggaccagaaagagtgatcttagcgggacccatgcctgtcacagtagcttcagcagcacaacgcagaggcagaatcggcagaaaccataacaaagaaggggatcaatatatatacatgggccagccgcttaataatgatgaagaccacgcgcattggactgaggcaaaaatgcttttagataacataaatactcccgaaggaataatcccagcattattcgaacctgagcgggaaaaatctgcagcaatagatggagaatatcggttgagaggggaggccagaaaaacatttgtagaactcatgcgtagaggagatcttcccgtatggcttagctataaggtcgccagcgaaggttttcaatatagtgatcgaagatggtgctttgatggggaacgtaataatcaagtgctagaggaaaatatggacgtagaaatatggacaaaggaaggagaaagaaagaaattaagacctaggtggttagacgctagaacatatagtgatccacttgcactccgcgagttcaaggaatttgccgcaggaagacgaagtgtgagtggagacctaatactagaaataggtaaattgccgcagcacctcactcagcgtgcgcagaacgcattagataacctagtaatgttacacaatagtgaacaaggtggccgagcttatcgtcacgcaatggaggagttgcctgacactattgaaacactaatgctcttagccttaatcgctgttttaacgggaggtgtgaccctattctttttaagtggcagaggactaggaaaaaccagcattgggttattatgcgttatggctagtagtgtgctcctatggatggctagcgttgaacctcactggatagcagcttcaataattttagaatttttcctcatggttttattaataccagaacctgatagacagagaactccgcaagacaatcagttagcctatgtcgttatcggtttactgtttatgattttgaccgttgctgcgaatgaaatggggttgctagaaacaacaaagaaagacctaggcataggtcatgttgccgttgagaatcaccatcacgccgctatgctagacgtagacctccacccagcctcagcatggactctctatgctgtggcaaccactattataactcccatgatgagacataccatcgaaaacactactgcgaatataagtctaacggctattgccaatcaggcagcaatactaatgggcctagacaaaggatggccaatatctaaaatggatattggagtccccttgctagcgttaggatgctactcccaagtaaacccgctaactctaactgccgctgtactgatgctggttgcccattacgcaatcatcggaccagggttacaggctaaagcaacaagagaggcgcaaaagagaaccgccgctggcataatgaaaaacccgaccgtagatggtatagttgctatagacctcgatccagtcgtttatgatgcaaaatttgagaaacaactgggtcagataatgctgttgatattatgcacatcccaaatattactgatgaggactacttgggctctctgcgagagcattactttagcaaccgggccactaaccactctatgggagggatctccaggaaagttttggaatacaacaattgcagttagtatggcaaatatattccggggcagttatttagctggggcaggattagcgttttcattgatgaagtccttaggtgggggtagacgaggtacaggggcacagggtgaaaccttgggagagaaatggaagagacaactaaaccaactatcgaagtcagagttcaacacttacaagaggagcggcattatggaagttgataggtcagaagcaaaagagggattaaaaaggggagaaacaactaaacacgcggtatctcgagggacggcaaagttaaggtggttcgttgagaggaatttggttaagccagaagggaaagttatagacttaggttgcggccgaggaggctggtcctactattgtgcagggctgaagaaagtaacagaggtcaaaggatataccaagggaggacccggtcatgaagaaccaatcccaatggccacttacggctggaatcttgtaaagttacatagcggcaaagatgtattctttatcccgcctgaaaaatgcgatacattattatgtgacataggtgagtcaagcccgaacccaacaatcgaagaaggcagaaccttaagagtcttaaaaatggtagaaccatggcttcgaggaaatcagttttgcatcaagatacttaatccgtatatgcctagtgtggtagaaactctagaacaaatgcaaagaaaacatggcggtatgttagtacgtaacccattaagccgaaactccacacacgaaatgtactgggtatcatgcgggaccggcaatatcgtttcagccgtgaatatgacttcacgaatgttgctcaatagatttactatggctcataggaaaccaacatacgagcgggatgtggatctaggtgcgggaacacgacacgtagccgtagaacccgaagtcgctaatttagacattataggccaaagaatagaaaatattaaacacgaacacaaatccacatggcattacgatgaggataatccatacaaaacatgggcatatcacggatcatacgaagtgaaaccatcgggttcggcctcaagcatggttaatggcgtagtaaaattactaaccaaaccgtgggacgttattccaatggtgacccaaatagcgatgacagatactaccccctttggacaacaaagagtattcaaagaaaaagtggatacaaggacgcccaaagcgaaaagaggaacagcccaaatcatggaagtaaccgcaaagtggttatgggggttcttatcacgtaacaagaaaccaagaatttgtacgcgagaggaatttactagaaaagtacgtagtaatgccgcgattggagctgtctttgtagatgagaatcaatggaactcagctaaagaagcagtcgaagatgaaagattttgggacctggttcaccgggaacgcgaattgcataaacaaggaaagtgcgcaacatgtgtttataatatgatgggaaagagagagaagaaattaggagagttcggcaaagctaaagggtcaagagccatatggtatatgtggctaggagcaagatttctagaatttgaagcactaggtttcatgaatgaagaccactggttttcacgtgaaaacagtctaagtggagtagaaggagaaggacttcataaactaggctatatattaagagatatttccaaaataccaggagggaatatgtacgctgatgatacagcggggtgggatacacgtattactgaagacgatctacagaacgaagcacggataaccgatattatggagccagaacatgccttactagccaagagtatattcaaactgacatatcagaacaaggtagtcagggtacagcgtccagcgaaaaatgggactgtaatggatgtcatttcaagacgtgatcagagaggaagcgggcaggttggtacctacggattaaatacatttaccaatatggaagctcaattaataagacaaatggagtctgaggggatattctcacctagcgaactcgaaacacctaatttagccgaaagggttttagattggctagaaaagtatggtgtcgagaggctgaaacgaatggcgatttcgggagatgactgtgtcgtcaagccaattgacgataggttcgccactgcgctaacggctttgaacgatatgggtaaagtccgtaaagatataccgcagtgggaaccaagcaaaggttggaatgattggcaacaagtaccattttgctcgcaccattttcaccagctaataatgaaagatggtcgggaaatagtagtaccttgcaggaaccaagacgaactggtcggcagagctagagtatcacaaggggctggatggtccttacgggaaacggcttgcttgggaaaatcatatgcgcagatgtggcaactaatgtacttccatcgcagggatctacgtttggctgccaatgcgatctgttcagctgttccagtagactggattccgacaagtcgaactacctggtccatacatgcacatcatcaatggatgacgacggaggatatgctctcagtatggaaccgtgtatggatagaagagaacccatggatggaagataagacacatattagttcatggggagacgtcccatacctgggtaaacgtgaagatcaatggtgcggttcattaataggtttgactgctagggctacctgggccaccaatatacaggtggctataaaccaagttagaagattaataggaaatgaaaattacctcgattatatgacgagtatgaaacgtttcaaaaacgaatctgatcctgaaggagcactgtggtaa

SEQ ID NO: 21863 - RNA, 9879 nt, synthetic construct
  misc_feature 1..9879: note = derived and/or modified CDS sequence (opt6) from DENV-1__GU131793__SS-prME
  source 1..9879: mol_type = other RNA
tcggtgacgatgctcctgatgttaatgccaaccgctttagcatttcacctcaccactagaggaggtgaaccacatatgatcgtgtcaaaacaagaaagagggaaatcattgctatttaaaactagcgctggggtaaatatgtgtactctaatcgctatggatctaggtgaattatgcgaggatactatgacttacaaatgtccgaggattactgagacagaaccggacgatgtagactgctggtgtaatgcaacagacacctgggttacatatggaacatgctctcaaacgggagaacataggcgagataaaagaagcgtagcactggcaccacacgtagggttaggcctggagacccgaacagaaacttggatgtcaagtgaaggcgcttggaaacagatccagagggttgagacctgggcgctgcgacaccctgggttcacagtaatcgcacttttcttagctcatgcaataggcaccagtacaactcaaaaaggtataatctttatactacttatgctggtaacaccatcaatggctatgagatgtgtcggaatagggtctagggatttcgttgaaggtttgtctggagcaacttgggtagacgtcgtccttgagcatgggagttgtgtcacaactatggcaaaagataaaccgaccctagatatcgaactgttgaaaactgaagtaaccaatccggcagtgctacgtaaactatgtatagaggcaaaaataagcaatacaacaaccgactcccgatgtcctacgcaaggggaggctaccctagtagaagaacaagacgcaaactttgtctgtcgcaggacattcgtagatagaggatggggtaatgggtgcggactcttcgggaaagggagtcttataacctgcgcaaaatttaagtgtgttactaaactcgaaggaaagattgtgcaatacgagaatcttaaatactctgttatagtaacagtacatacaggtgatcaacatcaggtaggtaacgagtctacagaacacggaacaacggctaccattacgccgcaagcgccaacaacagaaatacagttaacagattatggtgcactaacacttgattgtagccctcgaactggtctagattttaatgaaatggtcctacttacaatgaaggaaaaatcttggctcgtccacaaacaatggtttttagacctacccttaccttggacaagcggtgcatcaacgtcacaggaaacctggaatcgacaagatttacttgtaacatttaagaccgcacatgccaagaaacaagaagtagtcgtattaggatcgcaggagggtgcaatgcataccgcattgacaggagctactgaaattcagacatcgggtacaactactatcttcgcaggccacctcaagtgcagattaaaaatggacaagttgaccttacgtggtatgagttatgtaatgtgcacaggcagttttaaattggaaaaagaagtcgcagagacacaacacggtacagtattagttcaaataaaatatgaaggtacagatgctccttgcaagataccttttagtacgcaagacgaaaaaggcgtaactcagaatggaagactcattacggcaaatcccatcgtaacagataaagaaaagcctgtaaatattgaagcagagccaccgttcggagaaagctacatcgtaataggagcaggggaaaaggccctaaagctaagctggtttaaaaaggggtcaagtataggaaagatgttcgaagccacggcacggggagctagacgtatggccatcttgggggacacagcatgggacttcggaagtatcgggggtgtcttcacaagtgtcgggaagttagtgcatcagatcttcggaactgcatatggagtacttttcagtggagttagttggacaatgaaaatcggaataggtgtgcttctaacttggcttggactaaattctaggtctacatcattatctatgacatgtatagccgtaggcttagtcacattatatctgggagttatggtgcaggcagatagtggatgtgtcattaactggaaaggtcgcgaactgaaatgtgggtcagggatatttgtcacaaacgaagtacatacatggacagagcaatataaatttcaagctgacagtcccaaacgactctcagctgcaatcggtaaagcatgggaagaaggggtatgcgggattcgaagtgctactaggcttgagaatattatgtggaagcaaatatctaacgaactaaaccacatactactcgaaaacgacatgaagtttacggtagttgtcggcgacgtagcggggatccttgcacaagggaaaaagatgataagaccacaacctatggaatataaatatagctggaagtcgtggggcaaagcgaaaataataggcgctgatgtgcagaatacaacatttattatagacggtccaaacacgcccgaatgtcccgacgatcaaagagcttggaatatatgggaagtggaagattacggttttggaattttcaccaccaatatatggctaaaattgagggatagttatactcaagtctgtgaccaccgtttaatgagtgccgccataaaagactcaaaagctgtgcatgcggatatgggatattggattgaaagcgagaaaaatgaaacttggaaactcgctagggctagttttattgaagtaaaaacatgtatatggcctaaatcccataccctgtggtcaaatggagttttagaaagtgagatgataatcccaaaaatatacggaggtccaatttcccaacataactatagacctggatactttacacaaacggcaggaccttggcacttaggcaaattagaacttgacttcgatctgtgcgaggggacgacggtagtagtagacgagcattgcggtaacagaggcccgtcattgcggacgacaactgtaacaggtaagattatacacgaatggtgctgccggtcatgtacactacccccattacgctttcgcggagaagacggatgctggtatggtatggaaataagacctgtcaaagaaaaagaagaaaatttagttaagagtatggtatcggctggatcaggtgaggttgattccttctccttagggttactttgtatatcgattatgatagaagaggttatgcgaagtagatggagtagaaaaatgctcatgacgggaacactcgctgtatttttcttgcttataatgggtcagttaacatggaacgacttaataagactttgtatcatggtaggtgccaatgcaagtgatcgaatgggcatgggtacgacctatttggctttgatggctaccttcaaaatgaggccgatgttcgcagtgggactacttttcagaagattaacttcacgggaggtgctacttctcacaataggtttaagtctggtagcaagtgtagaactccccaatagcctggaagaattaggagacggtctagcaatgggaattatgattttaaagttgctgacggatttccaaagccaccaactctgggcaactcttttgtcactaacatttatcaaaacaacattctcacttcattgtgcgtggaaaactatggccatggttcttagcatagtatctttatttcccctatgcttatcaactactagccagaaaaccacttggcttccggttttgttgggatctttaggatgcaaacctttaacaatgtttctaatcgctgaaaataaaatatggggccgacgatcatggcctttgaacgaaggtataatggcggtaggtatagttagcattcttttgtcatcgctattgaaaaatgatgtcccactagcagggccgttgatagcaggagggatgttaatcgcctgttacgttatatcaggatcgtcagctgatttatctctagaaaaagctgcagaagtgtcttgggaagaagaagcagaacacagtggcgccagtcataacatccttgttgaggttcaagatgatgggactatgaaaataaaagacgaagaaagagacgacactttaacaatattactaaaagcaacattattggcagtgagcggtgtttacccgctatcaataccagcgacattatttgtatggtatttctggcagaagaagaaacaacgaagcggtgttctttgggacacgccatctccaccagaagtcgaacgtgcagttttggacgacgggatatatcgtattatgcaacgcgggcttctaggtcgcagtcaagttggtgtcggcgtttttcaagaaaacgtattccacaccatgtggcatgtaactcgaggagccgtattaatgtatcaaggaaaacgcttagaaccttcatgggcaagtgtcaagaaagacttaatctcttatggtggtgggtggcgattgcaaggatcttggaatacaggagaagaagtgcaagtaatagccgtcgagccaggcaaaaatcctaaaaatgtccaaacggcaccaggtacattcaaaacaccggagggtgaagtcggtgcaatagcattagacttcaaacccggaacaagtggatcccctattgtaaacagagaaggaaagatagttggactatacggaaacggcgtcgtcacaacaagtggaacttatgtttcagctatagcacaagcaaaagcaagtcaggaaggtcctcttccagaaatagaggacgaagtttttagaaagagaaatttaactataatggatctacacccgggaagcggaaaaacacgcagatatctacctgcaatagtgcgcgaagctataaagcgaaaattaagaacactcatacttgctccaactagagtggtagccagcgaaatggcagaggcattaaaaggtatgccgattcgctatcaaacaactgctgtgaaatctgaacataccggcaaggaaatagtcgacttgatgtgtcacgctactttcacgatgcgattattaagtccggtacgagttcctaactataatatgatcattatggatgaagcacactttacagacccgagttcaatagcagccagaggttatatctcaacaagagtgggaatgggtgaagcagcagcaatattcatgacagcaacaccaccgggaagcgtggaagcgtttccccaatcaaacgccgtcattcaagatgaagaacgagacattccggagcgatcttggaacagcggttacgagtggataacggatttcccggggaagacagtctggttcgtaccttctataaaaagtggaaatgatattgcaaattgtctccgtaaaaacggaaagagagtaattcagctttctagaaaaacgtttgacactgaataccagaaaaccaaaaataacgactgggactatgttgtaaccactgatatttcagaaatgggcgcgaattttcgggcggatagggtaattgatcctagaaggtgtttaaaacccgtgatactgaaagatggtccagaaagagtgattctagctggaccgatgcccgtaactgtagcctcagcggcacaaagaaggggacgtataggtagaaatcacaacaaagaaggggatcaatacatctacatgggacagccgctcaataatgacgaggaccatgcgcactggaccgaagctaaaatgctcctggacaatattaacacaccagaaggaattataccagcgttatttgagccagaaagagaaaaatcagcggctatcgacggggagtacaggctacgtggtgaagcgaggaaaacattcgtcgagttaatgaggcgcggtgatcttcccgtatggctatcatataaagtagcatcggaaggattccaatactctgatcgtaggtggtgcttcgatggagaaagaaataaccaggtactcgaagaaaatatggacgttgaaatttggacaaaagagggggagaggaagaaattgaggcctcgctggttagatgctagaacttatagtgaccccttggctttacgagaatttaaggagttcgcagcaggtagacgatccgtaagtggagatttgatattggaaataggaaaattacctcaacatttgacacaacgagcgcagaacgctttagataatctcgtaatgctgcataactcagaacaaggaggacgagcatatcgtcatgcaatggaagaacttccggatacaatagaaacattaatgttacttgccctaatagctgtactaacaggcggagtaactctctttttcttaagcggacgaggtttaggcaaaacatcaataggattattatgtgtaatggcgtccagtgtattactttggatggcaagcgttgaaccccactggattgctgcaagcataattctggagttctttttgatggtattactaatacctgaacctgacaaacaacgaactcctcaagacaaccaattagcctatgttgtaatcggtcttctattcatgatactaactgttgcagcaaatgaaatgggactactagaaaccaccaagaaggacttaggtatagggcacgtagccgtcgaaaatcatcaccatgcagccatgctcgacgtagatctacatccggcaagcgcttggacgttatatgctgtagctaccacaattataacaccaatgatgcgacatacaatagaaaatactacagctaacattagtctaactgcaatagcaaatcaagctgcgattttgatgggactagataagggctggccaattagcaaaatggatatcggcgtgcccctattagccttagggtgctattcacaagtaaatccattaaccttaacagcagcagttctcatgctagtggcccactacgctatcatcggaccaggtctgcaggcaaaagctacaagagaagcacaaaagaggactgctgctggcataatgaaaaatcccaccgtagatggcattgtggcaattgacctagacccggttgtgtacgatgcgaaattcgaaaaacagctaggacagattatgttactcatattatgtacttctcaaatcttactaatgcgaacaacatgggcactgtgtgaaagcattactcttgcaacgggtccacttaccacactgtgggaaggcagcccgggcaagttttggaacacaacaattgcagtatcaatggccaacatatttagaggaagttacctcgccggtgcagggctagcatttagtctaatgaaaagcctaggaggaggtagaaggggtacaggcgctcaaggagaaacccttggcgaaaagtggaagagacaacttaaccaactgagcaagagtgagttcaacacttacaaaagaagcggaattatggaggtcgataggagcgaagcgaaagaaggcctgaaacggggagaaactactaagcatgctgtttctagagggactgcaaagctacgttggttcgtagaaagaaatttagtaaaaccggagggaaaagtcatagatctaggttgtggacgaggagggtggtcatattattgcgcaggactaaagaaagtaacagaagttaaggggtacacaaaagggggtcctggacacgaagaacctataccaatggcgacatacgggtggaatcttgtgaaactacattcaggaaaagatgtcttcttcatcccaccagaaaagtgcgacactctgctgtgtgatattggagaatcttctccaaaccctactattgaagaaggacgaactctacgtgtactcaaaatggtagaaccttggctacgaggtaaccaattctgtatcaaaatattaaacccatatatgccatcggtagtagaaacgctggaacagatgcaaaggaaacatggtgggatgcttgttagaaatccattaagtagaaactcaacccacgaaatgtactgggtctcatgtggtactggcaacatagtatccgcagttaatatgacctctagaatgttattgaatcgatttactatggcacacaggaaacccacttatgaacgagatgttgacttaggtgctggtacaagacatgtagcagtagaaccagaagtagcaaatctagatataataggacagaggatagaaaacattaagcatgagcataaatctacttggcactacgatgaggacaatccatacaaaacttgggcgtatcatggctcttacgaggtgaaaccatctggatctgcatctagtatggtcaacggcgttgtcaaactccttactaaaccatgggatgtgatacccatggtaacgcagatagccatgacggatactacacctttcggtcagcagagagtctttaaagaaaaggtggatacgaggactccaaaagcaaaaagaggaacggcacaaattatggaagtcacagccaagtggctttggggatttctctctcgtaacaagaaaccacgaatatgcacgcgtgaggagttcacgagaaaggtcagatcgaatgcagcaatcggtgcggtgttcgtcgacgagaaccaatggaactcagcgaaagaagcagtagaggacgaacgcttttgggacttagttcaccgtgaacgagaacttcataagcaaggaaaatgtgcgacatgtgtatacaatatgatgggcaaaagagagaagaaattaggtgaatttggtaaagccaaaggttctcgggccatttggtatatgtggttgggagcaagatttttggaatttgaggctttgggattcatgaatgaagaccattggttttcgcgtgaaaatagtttatcaggagtagaaggagaaggattgcataaattaggatacatattacgcgatatatctaagattcctggtggcaatatgtacgcagatgatacagctggatgggatactcgtatcacggaagatgacctgcaaaatgaggcaaggattacagacatcatggaacccgaacacgcactacttgctaagtctatatttaaattaacttatcaaaataaagttgttagagtgcaaagacctgctaaaaacggaacagttatggatgtaataagtcggcgtgatcagcgtggaagtggacaagtgggaacctacggcttaaataccttcactaatatggaagctcagttaataagacaaatggaatctgaagggatattctccccctcggaacttgagacgcccaacttagctgagagggtcctcgattggctggaaaaatatggagtcgaacgactaaaaagaatggcaatatctggtgacgattgtgtcgttaaaccgatagatgataggttcgccactgcgctgactgcactgaatgacatgggaaaggtaagaaaagatataccacagtgggaaccatctaaaggatggaacgattggcaacaagtaccattttgttcccaccattttcatcaacttataatgaaagatggaagggaaatagtagtaccttgtcggaatcaggacgaattagtagggagggctagagtgtcacaaggtgcaggatggagcctcagagagacagcatgcctgggaaaatcttacgctcaaatgtggcagttgatgtattttcataggcgtgatctaagattagccgcaaacgcaatatgcagcgcggtgcccgtagactggattcctacatcgagaacgacatggagcatacatgctcatcaccaatggatgaccacggaagatatgttaagtgtctggaaccgagtctggatagaggaaaatccctggatggaagacaagacacacatcagcagttggggagacgttccgtaccttggtaaacgtgaagatcaatggtgcgggtcattgattgggctcaccgcgagagctacgtgggctactaatatccaagtagcaatcaaccaagtacgtcgacttatagggaatgaaaactaccttgactatatgacttcaatgaagcgttttaaaaatgaaagtgaccccgaaggagccctatggtag

SEQ ID NO: 21864 - RNA, 9879 nt, synthetic construct
  misc_feature 1..9879: note = derived and/or modified CDS sequence (opt6) from DENV-1__GU131794__SS-prME
  source 1..9879: mol_type = other RNA
tcagttactatgctgcttatgcttatgcctacggcgcttgcattccacctgacaacgaggggcggagagccgcacatgatagtatccaaacaagaacggggaaaaagtttattattcaaaacatccgctggagtaaacatgtgtacactaatcgcaatggatctaggagaattttgtgaggatacaatgacatataaatgtccaaggataacggaagccgaaccggacgatgtagattgttggtgcaatgctactgatacatgggttacatatggtacgtgcagtcaaacaggagaacaccgacgcgataaaagatcagtcgctctagcacctcatgtaggcttaggacttgagacgcgtacagaaacctggatgagttcagaaggtgcttggaaacaaatccaaagggttgaaacttgggcactaagacatcccggttttacagtcatagcattgtttcttgctcatgctatagggacatctataactcagaaaggaattatattcatactacttatgttagtaaccccaagcatggccatgagatgcgttggcatcggcagtcgtgattttgttgagggtttgtcaggagccacatgggtggacgtggtgttggaacacggctcatgcgtgacaaccatggcaaaagataaacccacgctcgacatagaactgctcaaaacagaagttacaaatccagcagtcctaaggaaattatgtatagaagcaaaaatatctaacaccactacagacagtcggtgtcctacacaaggtgaagcaacattagtagaggaacaagacgccaatttcgtctgccgaagaacattcgtggaccgcggatggggaaatggctgtggcctattcggaaaaggatcactaataacttgcgccaaattcaaatgtgtcactaaattagaaggaaaaatcgtccaatatgaaaatcttaaatattcagtaatcgtaacggtgcacacgggtgaccagcatcaggttggtaacgagtcgacagagcatggcacaacagccacgataacgccacaagcaccttcgaccgaaattcagctaacagattatggcgccttaacattagattgttcgcctaggacgggactcgacttcaacgaaatggttcttttaactatgaaggaaaagtcatggctagttcataaacaatggttcttagacctaccccttccctggacatcgggagccagtacttcccaagagacatggaatcgacaggaccttttagtaacatttaagaccgcacacgccaaaaagcaagaagttgtagtactcgggtcccaggaaggcgcaatgcatactgctttaactggggctacagaaattcagacaagcggcacaacgacaatatttgctggtcatctcaagtgtaggttaaagatggacaaactcactttaaaagggatgtcctacgtcatgtgtacaggctcctttaagctagagaaagaagttgccgaaactcaacacggtacggtattagtacagattaaatatgaaggtacagacgcaccgtgtaaaataccgttcagcactcaggatgaaaagggcgttacccaaaatgggcgtttaatcaccgctaatccgatagttaccgacaaagaaaaaccagtcaatatcgaagcagaaccaccttttggtgaatcatatatcgtcatcggagcgggagaaaaagcgttaaaactatcatggtttaagaaaggttcttcaataggaaaaatgtttgaagcaacagctcgaggtgcacgaagaatggctatactcggagacactgcatgggatttcgggagtatcggcggcgttttcacctctgtcggaaaactcgtccatcaaatatttgggacagcctatggtgtgctgttttcgggagtctcctggacgatgaagataggtatcggagtattactaacctggttaggactaaattcacggagtacttcattgagtatgacatgtatagctgtaggacttgtcacattatatcttggagtgatggttcaggcagatagtggatgcgttataaattggaaagggagagaattgaaatgtggttctggtatatttgtaaccaatgaagtacatacctggacagaacaatataaatttcaagcagactcacccaaacgcttatctgcagcaataggcaaggcttgggaagaaggcgtatgcggcatacgatcggcgactagactagaaaatataatgtggaaacaaattagcaatgaacttaaccacatattattggaaaatgatatgaaactaacagtcgttgttggagatgtagccggcatactagcacaaggcaaaaagatgatacgaccacaaccaatggaatacaaatatagctggaagtcttggggtaaagcaaaaattattggtgccgatgtacaaaatacaactttcataatagatggaccaaacacacccgaatgtccggacgaccaaagggcttggaacatatgggaagtcgaagattacggatttggcatattcaccacgaatatatggttaaagctaagagacagctacacacaagtatgtgatcataggttaatgtcagcggccataaaagacagcaaggctgtgcatgcagacatgggttattggatagaatctgagaagaatgaaacatggaagttggcacgagcatcattcatagaagtaaaaacttgcatctggccgaaaagtcatactttatggagtaatggagtattagaatctgaaatgatcataccgaaaatctatggtggaccaatatcccaacacaattatcgccctggatactttacacaaacagcaggtccatggcacttgggaaaattagaacttgatttcgatttgtgcgagggtacgacggttgtagtggatgagcactgcggtaacagagggccaagcctacgtacgaccacagttactggaaaaattattcatgagtggtgttgccggagttgtacacttccaccacttagatttaaaggagaggatggatgttggtatgggatggaaataagacccgtaaaagaaaaggaagaaaacttggtaaaatccatggtatccgccgggtcgggggaagtagatagtttttcattaggtctactgtgcatatcaataatgatcgaagaagtaatgcggagccgatggagtaggaaaatgttaatgacgggtactctcgcagtgtttttcttattaataatgggtcaactcacttggaatgatctgataagattgtgcataatggtaggagcaaatgcatctgatcgtatgggtatgggcacgacatacttagcattaatggcaacattcaaaatgcgaccaatgtttgcagtaggactcctatttaggagacttacaagcagagaggtgctattattaacaataggactgtcattagtagccagtgtcgagcttcctaacagtttggaagaactgggcgacggcctcgctatgggaattatgatcctaaaactattaactgatttccagagtcaccaattatgggcaacattactaagccttacatttattcgcacaacattctcgcttcattacgcatggaaaacaatggcgatggtcctttccatagtatccttatttcctctgtgtttaagtactacaagccagaaaaccacctggcttccggtcctacttggctccctaggatgtaaacctctcacaatgtttttaatcgcggaaaacaagatatggggccgaaagagttggccgctaaatgaagggataatggcagtaggaatagtgtctatcctcctttcttcccttctgaaaaatgatgtcccactcgcgggacctctgattgcgggagggatgttaatagcttgctatgtaataagtggaagttctgctgatctaagtctggaaaaggccgctgtagtgtcttgggaagaagaagccgaacactcaggtgccagtcataatatacttgttgaagttcaagacgacgggaccatgaaaatcaaagacgaagagagagatgacactttaaccatattgctgaaagcgacattgttagcagtgtcgggagtgtatccgctttcaatacccgctactctatttgtatggtatttttggcagaagaagaaacaaagatctggcgttctttgggataccccatcaccaccagaggtcgaaagggcagtgctagatgatggaatatataggataatgcaacgaggtctcctaggaagaagccaggtaggagtaggagtattccaagaaaacgtgtttcatacgatgtggcatgtaacgcgtggcgcagttttaatgtatcaaggtaagcgtttggaacctagttgggcatctgtcaagaaagatttgatatcatatggaggtggatggcgacttcaaggatcttggaacaccggcgaagaagtacaggtaatagctgtcgagcctggcaaaaatcccaaaaatgtacaaacagctccaggtacttttaagacatctgagggagaggtcggagccatagcattggacttcaagcctggaacgtctgggtcccctatagtgaatagagaaggaaaaattgtgggattatatgggaacggagttgtaaccacatctgggacatacgttagcgccattgctcaagcaaaagcaagccaggaaggaccactaccagaaattgaagatgaggtctttcgtaaacgcaatctgactataatggatttacatccaggaagtggcaaaacacggaggtacctgccagcaatagtcagggaagcaataaaaagaaaattacgaacattaatattagctccaacgagagtcgttgctagtgaaatggcggaggccttaaaaggcatgcctattagataccaaacaacagccgtaaaatcagaacacacaggcaaagaaattgtagacctaatgtgtcacgctacatttacaatgagattgctatcccctgtccgcgtgccaaactataacatgataataatggatgaagcgcattttactgatccctcctctatcgcggcaagaggctatataagtacccgagtgggtatgggagaagctgcagccatttttatgactgcgacacccccgggatcagtcgaggcctttccacaaagcaatgcagttatccaagacgaggaacgcgatataccagaacgttcatggaacagtggatacgaatggattacagacttcccaggcaaaactgtatggtttgtacctagtatcaagagcggcaatgacatagcaaattgtctccggaaaaacggtaaaagagtgattcaactctcaagaaagacttttgatactgagtaccagaaaactaaaaataatgactgggattatgtggtgacgacggatattagtgaaatgggtgcaaacttccgcgctgacagggtaattgacccaagacgatgcctgaaaccagtaattttaaaagatgggcctgagagagtaattttagcgggccctatgcctgtaacggtcgcgagtgctgctcaaaggcgcgggcgtatcggaagaaatcacaacaaggaaggagatcaatatatctacatgggacaaccgctgaacaatgatgaagaccatgctcactggactgaagcgaaaatgcttctagacaatataaatactccagagggcatcataccagccctctttgaacctgagcgggagaaatctgcggccatcgacggagagtatcgtctacgcggagaagcaagaaagacattcgttgaacttatgcgtcgtggcgatttaccagtatggttatcttacaaagttgcttcagagggttttcagtattccgacagaagatggtgttttgatggggaaagaaacaatcaagtgctagaagaaaatatggacgtagagatctggacaaaagagggagaaaggaagaaactaaggcctagatggctggacgcccgtacgtactccgatcctctggcactacgagaatttaaagagtttgcagccggtcgaagaagtataagtggcgatctgatacttgagataggtaagttaccgcagcatcttacacagcgagcgcaaaatgctttggacaacttggttatgttacataactcagaacaaggaggaagggcatacagacatgccatggaagagttaccagatacaatagaaaccttaatgttgctagcattgatagcagtcttgaccggaggtgttactcttttctttctaagtggcagaggtttaggtaagacgagtataggactactatgtgtaatggcgtcgagtgtgcttctgtggatggcttctgtagaaccacactggatagcagcaagcatcatccttgagttcttcttaatggtactacttataccagaacctgatagacaaagaacaccacaggataaccaactagcatatgtagtcataggactactcttcatgatcttaactgtagcggcaaatgagatgggactactggaaactacaaagaaggatctgggtattggccacgtggcagtggaaaatcaccaccatgctgccatgttagacgtcgatctacacccagcgagcgcatggaccttatatgcggttgcgactacaattataacaccaatgatgagacataccatagaaaatacaacagctaatatatcattgaccgcaattgcaaatcaagcagcaatcctgatgggacttgacaaaggatggccaataagtaagatggatataggggtaccattattagcactcggctgctatagtcaggtaaatcccttaaccctcacagctgcagtcctaatgttagtggcacactacgcgataataggaccaggcctacaagccaaagcgacaagggaagcacaaaagcggacagctgctggaataatgaagaacccgaccgtagatggcatcgtagcaattgatctagaccctgttgtttacgacgcaaaatttgaaaagcaattagggcaaatcatgttacttatattgtgcacaagtcagattctactcatgagaacgacttgggctttatgtgaaagcatcacactagctacaggaccccttacaactctctgggaaggctcaccaggaaaattctggaatactacgatagcagtttccatggctaatatattcagaggatcctatttagccggtgcaggacttgcattctctcttatgaaatcgctgggaggcggaagaagaggtacaggtgcacagggagagactttaggagaaaaatggaaacgtcagctaaatcagctatctaaatctgaatttaacacctacaagagatcagggataatggaagttgatagatccgaagcgaaagaaggtttaaaaagaggtgaaactacaaaacacgcagtctcgcgcgggacagcaaagctaagatggttcgttgaaagaaatctagtaaaaccggaaggaaaagtcatagacttaggatgcggtcgtgggggatggtcctactattgcgctgggctcaagaaagtcacagaagttaagggatacacaaagggaggacccggtcacgaagaacctatacccatggcaacatatggctggaatcttgtcaagttgcattcaggaaaagacgttttcttcataccacccgaaaagtgtgacaccttattatgcgacatcggtgagagtagcccaaatccaactatagaggaggggagaacgttaagggttctcaaaatggtcgagccctggctaagaggaaaccaattctgtataaagatcttgaatccgtacatgccatccgtagtggagacgctagaacagatgcagcgaaaacacggagggatgttagttcgaaatccgttaagcagaaattcaacccacgaaatgtattgggtgtcgtgtggaacaggaaatatagtatcagcagtaaatatgacgtctagaatgctattaaatcgatttacaatggcccacaggaaaccaacttacgaaagagacgtcgacttaggggcagggactagacatgtagcggtagagcctgaggtagcaaacttagatattatcggacagagaatagaaaacattaaacacgagcataagtcaacgtggcattacgacgaagacaacccgtataaaacctgggcgtaccatggttcatacgaggttaagcctagtggcagtgcaagttccatggttaatggtgtggtaaaattattaactaaaccatgggatgttataccaatggtaactcagatcgctatgacagacacaacacccttcggacaacaaagagtttttaaagaaaaagtagatactaggacaccaaaggctaaaagagggactgctcaaatcatggaggttacagcaaaatggctatgggggtttctctctagaaataagaaacccagaatttgtacgagagaagagttcaccaggaaagtacgaagcaacgcggcaattggagcagtattcgtagatgaaaaccaatggaactcggccaaggaagctgtggaagatgaacggttctgggatttagttcatagggaaagagaactacacaagcaaggaaaatgtgcgacatgtgtatacaatatgatgggtaaacgagaaaagaaattaggtgagttcggaaaagctaagggttccagagccatctggtatatgtggttaggtgcaagattcttagagtttgaagcactaggttttatgaatgaagaccattggttttcgagggaaaatagcctatcaggtgttgaaggggagggtttacataaattgggctacattttgagggacatatcaaaaattccaggtggaaatatgtatgcggacgacaccgctggatgggacacaagaatcaccgaagatgatctacaaaacgaggcaaagatcaccgatataatggagccagaacatgcactattagccaaatccatattcaaattaacttatcaaaataaagtggtgcgcgtccaacgtcccgccaaaaacggaactgtaatggatgtaataagtaggcgagatcaacgtgggagtggacaagttggaacatacggcttaaatacttttactaacatggaagcccaactgataagacagatggagagtgagggcatattcagtccttcagagcttgaaaccccaaacctagccggccgagtgttggattggctagaaaaacacggtgttgagaggttaaaacgaatggcaataagtggcgatgattgtgtagtaaaacctatcgatgatcgttttgctacggcactaactgccctaaatgatatgggaaaagtaaggaaggatatccctcagtgggaaccatctaaaggatggaacgattggcagcaagttccattctgcagccatcattttcatcaattaatcatgaaggatggaagagagattgtggtaccatgcagaaaccaagacgagttggtaggtagggccagagtatcgcaaggagcgggttggtccttacgtgaaactgcgtgcctaggcaaatcatacgctcaaatgtggcaattgatgtatttccacagaagggatctaaggctagctgcaaacgcaatttgttcggcggtcccagtggattgggttcctacatctcgaacgacatggtcaatacatgcgcatcatcaatggatgacaactgaagatatgttatccgtctggaatagggtctggattgaagagaatccttggatggaagacaagacccacatctcatcttggggtgacgttccctatctaggcaagagggaagaccaatggtgcggatcgcttattggcttaaccgcgagagctacatgggcaacaaatatacaagtcgcaatcaaccaagtacgcagactgctaggtaatgaaaactatcttgattacatgaccagtatgaaaagatttaaaaacgaatcggatcccgaaggagcattatggtga

SEQ ID NO: 21865 - RNA, 9879 nt, synthetic construct
  misc_feature 1..9879: note = derived and/or modified CDS sequence (opt6) from DENV-1__GU131796__SS-prME
  source 1..9879: mol_type = other RNA
agcgtaactatgttactgatgctaatgcctactgcccttgcattccatctgacaacacgtggaggggaaccacacatgatagttagcaaacaagaacgaggaaagagcttactatttaaaacaagtgctggcgtgaacatgtgcactcttatcgcaatggaccttggagaattttgtgaagatacaatgacatacaaatgtcctagaataacagaagcagaacccgacgatgtagattgttggtgtaacgcgactgacacatgggtaacatacggaacatgttcgcaaactggggaacatcggagagataaaagatctgttgctttagcaccgcatgtaggattagggcttgaaacacgtacagagacatggatgtcaagcgaaggagcatggaaacaaattcaaagggtagaaacgtgggctttgcgccacccaggatttacagtaatagcattatttttagcccacgcaataggtacaagtatcacacaaaaaggaataatatttatcctattaatgctcgttaccccttctatggccatgcgctgtgttggtatcgggtcgcgagacttcgtagaggggttgtccggcgcaacgtgggtagacgtggttctagaacatgggtcgtgtgtgacaactatggcgaaagacaaacccacacttgatatagaactactcaaaactgaggtcacggaccccgccgtgttgcgcaaactatgcgtcgaagctaagataagcaatacaacaacagatagtcgatgcccaacgcaaggagaagccaccctagttgaagaacaagatgcaaatttcgtatgtcgtagaacttttgtagatagaggctggggcaatggttgcgggctttttggaaaaggttcactaatgacatgcgcaaaatttaaatgtgtgacaaaactagaaggaaaaattgtgcaatacgaaaatctaaaatacagcgtaattgttacggtacatactggtgaccagcatcaggtggggaatgaatcaacagaacatgggacaacagcaacaattactccacaagctccgtcgacggaaattcaattaaccgactacggagcactaacattagactgctcaccacgtaccggattggattttaatgagatggtcttactaacaatgaaagagaaatcatggttagtgcacaaacaatggtttttagacctgcccctgccgtggactagcggagcgtccacttcacaagagacatggaacagaaaagatctacttgtcacgttcaaaacagctcacgcaaagaaacaagaagttgtagtactgggaagtcaagaaggagctatgcacacagccctaacaggtgcaactgagatacagacttcaggtactacaactattttcgctggtcacttaaaatgtcgtttaaaaatggacaaattaacgctgaaggggatgtcatacgtcatgtgtacaggtagctttaaactggaaaaagaagtagctgaaacccaacacgggacagtcttggttcagattaaatatgaaggaactgacgcaccgtgcaaaataccattttcaacgcaagatgagaaaggagtcacgcaaaacggacgactaataacagccaacccaatagtaacagataaagagaaaccagtaaacattgaagcagaacctccatttggtgagtcctacatagttataggggctggtgagaaagcgttaaaactatcctggtttaagaaagggtcgagtattggaaaaatgttcgaagcaacggcacgtggggcacggagaatggcaattctcggagatactgcgtgggatttcggaagtatcggaggcgtttttacctcggtagggaagctagtgcaccaaatattcggcactgcatacggagttctcttcagtggcgtttcttggacgatgaagataggcatcggagtattgttaacgtggctagggttaaattcaagatcaacctctttatcaatgacttgtatcgcagttggtttagtcactctctatttaggtgtgatggttcaagctgactcgggatgtgtaataaattggaaagggagggaactgaaatgtggatccggtatttttgtaacaaatgaggtacatacatggacagaacaatacaaattccaagcagatagtcctaaaagattatctgcagcgatagggaaggcgtgggaagaaggggtttgcggaattagaagtgcaactcgattagaaaatatcatgtggaaacaaatatcaaatgagttgaaccatatattactagagaatgacatgaaactaactgtcgttgtaggagatgtagccggaatcctagcgcaaggcaagaaaatgatcagaccacaacctatggaatataaatattcttggaaatcatggggaaaagccaaaatcattggagcagacgtacaaaatacaacattcattatagatggccccaataccccagagtgtccagacgatcaaagagcatggaacatctgggaagtggaagattatggttttggaatcttcacaacaaatatatggttaaaacttagagattcctatacccaagtctgtgatcatcgtctcatgtctgcagctatcaaggatagtaaagcggtacatgcagacatgggatattggattgaatctgagaagaatgaaacctggaaattagctagagccagcttcatagaagtgaaaacatgtatatggcccaaatctcatacactatggagtaatggagttttagaatccgagatgataatacctaaaatatacggagggcctattagccaacataattatcgtccgggatattttacgcagacagccggtccctggcatttaggtaaactagaactggacttcgatctttgcgagggcacaacagtagtggtagacgaacactgcggtaatcgaggaccatccctccgtacaactacagtaactggaaaaatcatacatgaatggtgttgtcgcagctgtacgttgcctccacttagatttaaaggggaagacggatgttggtacggtatggaaatacgaccagtcaaagagaaggaggaaaacctagtaaaatcaatggttagtgcaggttccggagaagtagattctttcagtctaggtttattatgtatatcgattatgattgaagaggttatgaggagtagatggagcagaaaaatgttgatgacaggaacactggccgtcttctttcttttaataatgggtcaattgacatggaacgatctgataaggttatgtataatggtcggtgcaaatgcctcagacagaatgggcatgggaacaacctatcttgcactgatggcaactttcaagatgaggccaatgtttgctgttggcttgctgtttcgcagactcacttcaagagaagtattgctgctaacaattggcttgtcgcttgtagcctccgtggaattgccgaactctcttgaggaactaggtgatggactagcaatggggataatgattctaaagttgttaactgatttccaatcacatcaactatgggcgacattactttctttaacatttataaaaacgacctcatctttgcactacgcttggaagacgatggccatggtactatcaatagtctccctatttccactatgtctatcaactacgagtcagaaaacgacttggttaccggtattacttggaagtttaggatgtaagccactaactatgttcctcatagcagaaaataaaatttggggtagaaagtcgtggcctttaaacgaaggcatcatggcagtaggaatagtatctatactattatcggcactcctgaagaatgatgtaccacttgccggacccctaatagcgggaggaatgctcattgcatgctatgttatatcgggatcctccgcggatttatccctcgaaaaggcagcagaggtaagctgggaagaagaagccgaacattcaggcgctagtcataacattttagtagaggtccaagacgatggcacgatgaaaataaaggacgaagaaagagatgacacacttacaatactcttgaaagcgactctattagctgtatcaggtgtatatcccttaagtatcccggcgactttgtttgtttggtacttttggcagaaaaagaaacaaagatcaggtgttttatgggacactccatcaccgcccgaagttgaaagagcagttttagatgacggtatttatagaatcatgcagagagggttactcggtaggtcacaagtgggcgtgggtgtcttccaagaaaatgtatttcacactatgtggcatgtaacacgtggtgcagttcttatgtatcaaggcaaacgcttggaaccatcctgggctagtgtaaagaaagatttaataagttacggaggtggatggagattacagggttcctggaatacaggagaagaagtccaagttatagcagtcgagccaggcaaaaatcctaaaaatgtgcagactgccccaggcacttttaaaacgagtgagggtgaggtcggagcgatagctctggattttaaacccggaacttcaggatcacccatagtaaatcgcgaaggaaaaatagttggactatatggaaacggtgtagttacaacttcagggacatatgtgtcagcaattgcgcaagcaaaggcttcacaagaaggaccattacccgaaatcgaagatgaagttttccgaaaaagaaatcttacaatcatggacttgcatccgggtagcgggaaaacaaggaggtacttaccagcgatagtcagggaagccattaaaaggaaacttagaactttaatacttgctcctaccagagtggtggccagcgaaatggctgaagctctaaaaggaatgccaattcgctatcagaccacggcagttaaatcggagcacactggaaaagaaatcgtcgatttaatgtgtcacgctacttttacaatgcgccttttatctcccgtaagggtgccgaactacaatatgataattatggatgaagcccactttacagacccatcaagtattgcggcccgaggatatattagtacaagagtggggatgggagaagcagccgctatctttatgacagcaacacccccaggctcagttgaggccttcccccagtcgaacgcggtaatacaagacgaagaacgagatatacctgagagaagctggaatagtgggtatgaatggattactgactttccaggcaaaactgtttggtttgtgccgtctatcaagtcgggaaacgacattgcgaactgtctcaggaaaaacggaaaaagagtgatacagctttcgcggaagacattcgacacggaataccagaaaacgaagaataacgattgggactatgttgtaacaactgacattagtgaaatgggagcgaattttcgagcagaccgagtaattgatccgagaaggtgtcttaaaccagtaatcttgaaagatggaccagagagagtaatactagcaggacctatgccagtaaccgttgcatctgccgcccaaaggagaggacgtataggccggaaccacaacaaggaaggagatcaatatatatacatgggacaaccactaaataatgatgaagaccatgctcattggacagaagcaaaaatgttattggacaacataaacacacctgaaggaataatcccggccctttttgagccagaacgggagaagagtgcagcgatagacggtgaatatcgtttgcgtggcgaagcaagaaaaacgtttgtagaattaatgcgcagaggagacctgccggtatggctatcatataaagtagccagcgaaggatttcagtatagcgatcgacgatggtgtttcgatggagaaaggaataatcaagtgttagaagaaaatatggacgtggaaatatggaccaaagaaggcgaaaggaaaaagttaaggcctcgttggttagatgctagaacatactcggatcctctggctctacgagaatttaaggaatttgctgccggaagaagatctgtcagtggagaccttatcttagaaataggtaaattaccccaacatcttacccagcgtgcacaaaatgcactcgacaacctagtaatgctacataatagcgaacaaggaggccgagcttaccgccacgctatggaagaattgcccgacacaatagagactcttatgctgttagccctcatcgcggtcctaactggcggagtaactttattctttctatcaggtagggggctaggaaaaacatctattggtctactatgcgtaatggctagctcggtattattatggatggcctccgtcgagccacactggatcgcagccagtataattttagagttctttttaatggtgctattgatcccagagcctgatcgacaaagaacaccgcaagataaccagctcgcatacgtagttattggccttctgtttatgatccttaccgttgctgcaaacgaaatgggattacttgaaacgaccaagaaagatttagggataggtcatgtagcagtagaaaatcaccatcacgcggctatgttagacgttgacctacatcccgcatcagcctggactttatacgctgttgcaacaactatcataacgccaatgatgcggcacactatagaaaatacaaccgcaaatataagtctcaccgcgattgcaaaccaagctgctatattaatgggattagataaaggatggccaatatccaaaatggatataggagtgcccttgctcgcactagggtgctacagtcaagtaaatcctttaacactgacagcagcagtactcatgctcgtggcacactatgcgattataggaccgggactacaagccaaagcaactagggaagcacaaaaacgaacagccgcaggcattatgaaaaatccgacagtggatggtattgtagctattgatctggatccagtagtatacgacgctaaattcgagaaacaattaggacagatcatgctcctgatcttgtgcacgtcacagatactgctaatgagaactacttgggcattgtgcgagagcataactttagctacaggaccattaactacgttatgggaaggatcacccggaaagttctggaatactacaatcgctgttagtatggccaatatctttcgaggaagttaccttgcaggagcagggttggcattcagtttaatgaaatcactcggtggcgggagaagaggaacaggggcacaaggcgagacactcggagaaaagtggaaaagacaacttaatcaattgagtaaatctgaatttaacacatataagaggtcggggataatggaagtggatcgttcggaagccaaagagggattgaaacgtggtgaaacgacaaagcatgctgtatcgagaggcacagctaaattacgctggtttgttgaaagaaatttagtaaaacccgaaggtaaggtgatagacttaggttgtggcagaggaggctggagctattactgcgccgggctaaagaaagtaacagaagtgaaaggctatacgaaaggagggcccggacacgaggagccaataccaatggctacatacggctggaatctggtaaaattacactcaggaaaagatgtattctttataccgccagagaagtgtgacaccctactctgcgatatcggcgagagctcacccaatcctacaatagaagagggacgtactttgcgagttctaaaaatggtagaaccttggttgagaggcaatcaattctgcattaaaatattaaatccatacatgccctctgttgtagaaacattagaacagatgcaaaggaaacatggaggaatgttggtcagaaatccattatcgcgaaactccactcatgaaatgtactgggtatcatgcggaacaggtaacatagttagcgcggtaaacatgacatctcgaatgttattgaatcgcttcacaatggcccatcgtaagcccacgtacgagagagatgtggatcttggtgctggtacgcggcatgtcgcagttgaacccgaagtagcaaatcttgacatcatcggtcagcgtattgaaaatatcaaacatgaacacaaaagcacatggcactacgatgaagataatccatacaaaacatgggcgtatcatggcagctatgaagtaaaacctagtgggtcagcatcctcgatggtaaacggagtagtaaaactcctgacaaaaccgtgggacgtaattccaatggtaactcaaattgccatgacggatacaacgccgtttggacagcaaagagtattcaaagaaaaagttgacactaggactccgaaagcaaagagagggacggctcagatcatggaagtgactgcgaaatggttatggggatttttatctagaaacaagaaaccccgcatttgtacgagggaagaatttacacgcaaggtaagatccaatgccgcgataggcgctgtcttcgttgatgagaatcaatggaactcagctaaagaggcagtcgaggatgaaagattctgggacctcgtccaccgcgagagggagttacataaacagggtaaatgtgctacatgcgtctacaacatgatgggaaaaagggagaagaaactaggtgagttcggcaaagcaaaaggaagtcgagcaatctggtatatgtggctaggggcgcgatttctcgagttcgaggcactaggatttatgaatgaagaccattggttctcgcgtgaaaattcccttagtggagtagaaggcgagggattacataagctaggttatatactacgagatatctctaagattcctggagggaatatgtatgcagacgacacagccggatgggatacacgaataacagaagatgatttgcagaatgaagctaaaataacagacataatggagccagagcatgcactattagccaagtcaatttttaaactaacatatcaaaacaaggtagtaagagttcaacgaccggcaaagaatggtacagttatggacgtgatcagtcgacgagatcaaagaggctcaggacaagtcggcacatatggtcttaatactttcaccaacatggaggcgcaactaattagacaaatggaaagtgaaggcatattctcacctagcgaacttgaaacaccaaacttagcagggagagtattggattggctagaaaagcacggagtagaaaggttgaagcgaatggcaataagcggggatgactgcgtagtgaaaccaatagacgacagatttgcagcggcattgacagccctaaatgatatgggtaaagtgaggaaagacataccacaatgggaaccttcaaaagggtggaatgattggcagcaagtgcccttttgcagtcaccattttcatcaacttatcatgaaagatggtagagaaattgtggtgccatgccgaaatcaagacgaattagtcggtagagctagagtgtcccaaggagctggatggtccctgagagaaactgcatgccttggaaaatcatacgcccagatgtggcagctgatgtattttcacaggagagatttgcgattagctgcaaatgccatatgtagtgcagttccggtagactgggtacccacaagtcggacaacttggagtattcatgcacaccaccaatggatgacaacagaggatatgctatcagtctggaaccgagtatggatagaagaaaatccttggatggaagataaaacgcatatatcctcttggggagatgttccatatctaggaaaaagagaggaccaatggtgtggctcactcattggtctaactgctagagctacctgggcaacaaatattcaagtggcaataaatcaggtaagacggcttataggcaatgaaaattatttagattatatgacctcaatgaaaagattcaaaaatgaatcagatcccgagggtgccctatggtaa

SEQ ID NO: 21866 - RNA, 9879 nt, synthetic construct
  misc_feature 1..9879: note = derived and/or modified CDS sequence (opt6) from DENV-1__GU131797__SS-prME
  source 1..9879: mol_type = other RNA
tccgtgacgatgttattgatgctcatgcctaccgcattagcattccacttgacgacgagaggaggggaacctcatatgattgtatcaaaacaagaaagagggaaatccttactgtttaaaacttcagcgggtgtgaatatgtgtacgttaatagcaatggacttgggagaactctgtgaagacacgatgacttacaaatgtccaagaattactgaaactgaaccagatgatgtagactgctggtgcaacgccacagacacgtgggttacttatggtacgtgtagccaaactggtgaacatcggagggacaaacggtccgtagctttagcccctcatgtaggtctaggtttagaaacacgaacggaaacgtggatgagcagtgagggagcttggaaacaaattcaaagggttgaaacgtgggcccttaggcatccgggctttacggtaatagccttatttctcgctcacgctataggtacatctataacacaaaaaggtataatattcatcctattaatgttagtcacgccgtcgatggctatgcgatgcgtaggaattgggtctagggatttcgtggaaggtctcagcggggccacttgggttgatgtggtactagaacacggatcctgcgtgacgacaatggcgaaagacaaaccaacgcttgatattgaactattgaaaaccgaagtgactaatccagcagtactacgaaaattatgtatagaagcaaaaatctccaatacaaccactgatagccgttgtcccactcaaggcgaagctacacttgtagaagaacaagacgcaaatttcgtttgtcgaagaacatttgtcgatcgtggttggggtaatggatgcggactatttggcaaaggatccttaattacatgtgcaaaattcaaatgcgtaacaaaacttgagggtaaaatagtccaatacgagaacttaaaatattcggtgatagttactgtacatacgggtgatcaacatcaagtaggaaatgaaagcacggaacatggtacaactgcaaccatcacaccacaagcaccaactactgaaatacaattaacagactatggtgctcttaccttggattgttcaccgcgaaccggattagatttcaatgagatggtactcttaacgatgaaagagaaatcgtggttggtacacaaacaatggttccttgacttgcccctcccatggacttcgggagctagtacctctcaagaaacttggaataggcaagacttgctggtcacctttaaaacagcacatgcaaagaagcaagaagtagtagtactaggatcacaagaaggtgctatgcataccgccttaaccggggcaacagagattcaaaccagcggaacgacaacgattttcgccggccaccttaaatgtaggttaaaaatggataaattaactttacgcgggatgagttacgtcatgtgcaccggcagcttcaaactcgagaaagaggtagcagaaactcaacacgggacagtcctagttcaaataaaatacgaaggtactgacgcaccatgtaaaataccattctcaacccaagatgagaaaggggtgacgcaaaatggacggcttatcactgcaaatccaattgtaacagacaaggaaaaacctgtgaatatagaggcagaacctccattcggagagtcttacatagttatcggtgcaggcgagaaagctctcaaactctcatggttcaagaaagggagttcaatcggtaaaatgttcgaagcaacagcacgtggcgctagacgaatggctatactaggagacactgcatgggactttggcagtataggtggtgtttttacctcagtggggaagctagtacatcaaattttcggaacagcttatggggtgctatttagtggagtatcttggacaatgaaaataggaataggagtgttattaacatggcttggtctaaattctaggtccacatcattatccatgacttgtatagccgtaggcctagttacattatatctcggcgttatggtacaagctgacagcgggtgtgtgataaactggaaaggtagagaacttaaatgcgggtcaggtattttcgttacaaacgaagtacatacatggacagaacaatacaaattccaagccgacagcccaaaacgattgagtgctgcaataggaaaagcatgggaagagggcgtatgtgggattcgtagcgctactcgattagaaaatattatgtggaaacaaatctccaacgagttaaatcatattttactagaaaatgacatgaagtttactgttgtagtaggagatgtagctgggatactagctcaagggaaaaagatgatccgaccgcagccaatggaatacaagtactcatggaaatcttggggcaaagctaaaataatcggagcagacgtacaaaataccactttcatcatagacggtccgaatacaccggagtgtccggatgatcaaagagcttggaatatatgggaagtagaagattacggttttggtatatttacaacaaatatatggctaaaacttagagactcatatactcaagtctgtgatcaccgacttatgtcagcagcaataaaagactcgaaagcggtacatgcagacatgggatattggatagaaagtgagaaaaatgaaacttggaagttagcaagagcctcatttatagaagtaaaaacttgcatatggccaaaatcccatacgttgtggagcaatggagtattagaatcagaaatgataattcccaagatatacggaggcccaatcagccaacacaattatcgacctggatatttcacacaaactgcaggtccctggcatttaggaaaattggagttggactttgatttatgcgaaggtactacggttgttgtcgatgaacactgcggaaatagaggacccagtttaagaacaacaactgtaacaggaaaaataatacacgagtggtgctgtagatcttgtactttaccgcccctcagatttcgtggagaggatggctgttggtacggaatggagattcgcccagtcaaggaaaaagaagaaaaccttgttaaatctatggtatcagcgggcagtggagaggtagattcattttctctcggtttattgtgcatcagtataatgatagaagaagtaatgcgatcacgatggtcacgaaaaatgttgatgactggaacactggctgtcttctttcttctaatcatggggcaactaacttggaatgacctaattcgtttatgtatcatggttggcgcaaacgcgagcgacagaatgggaatggggacaacttatttggcgttgatggcaacctttaaaatgcgacctatgtttgccgtcggactattattcaggcgcttaacgtcaagggaagtccttttactaaccatcggcttatcattagtagcgagcgtcgaactacctaactcgctagaggaactaggtgatggacttgcaatgggtatcatgatattgaaactgctaacggacttccagtctcaccaactgtgggcgaccttactaagcctgacatttataaaaacaactttctcgctacattgtgcctggaaaacaatggcgatggtcttgtctatcgtttctttattcccgctatgcctgagtacgacaagtcagaaaactacatggttgcctgttttactaggaagtctcggatgtaaaccattgaccatgttcctaatagccgagaataagatatgggggagacgaagttggccgctaaatgagggtattatggcggtaggaatagtttcgatacttttaagctctttattgaaaaatgatgttcctcttgctggtcccttaattgcgggagggatgctcatcgcttgttacgttatatcaggttcgtccgcagacttatctcttgaaaaagccgcagaagtttcctgggaagaagaagcagaacactctggcgcaagtcacaacatccttgtagaggtgcaggacgacgggactatgaaaatcaaggacgaagaacgcgatgataccttgacaatcttattaaaagcaactctcttagccgttagtggggtttatccactaagtataccagcgaccttattcgtttggtacttctggcagaagaagaaacaacggagcggagtcctatgggatacgccgtccccacctgaagtagaaagagcagttctcgacgatggaatatacaggataatgcaaagggggttattaggcaggtctcaagtgggcgtgggggtctttcaagaaaatgttttccacactatgtggcatgtaacacgcggagcggtactcatgtaccaagggaagagactggagccctcctgggccagtgtgaagaaagacctgatatcatatggcggcggctggagactacaaggaagttggaatacgggagaagaagtacaggtgatcgctgtagagccaggcaaaaaccccaaaaatgtacaaactgcacccgggacatttaagacgcccgagggagaggtgggggctattgccttggactttaaacccggaacatcgggtagtcctatcgtaaatagggaagggaaaatagtgggcttatatgggaatggtgttgtaacaacatccggcacgtatgtatcagcaattgctcaagcaaaggcatcacaagaagggcccttaccagaaatagaagatgaagtattccgcaaaaggaatctaaccattatggacctacaccccgggtcgggcaaaacgagaagatatctaccggcaattgtaagagaagcgataaaaaggaagttgcggacactaatactggcacccacccgggtcgttgcctcggaaatggcagaggcgttaaaaggaatgcctatcagatatcaaaccacagcagtgaaatcagaacatacaggaaaagaaatcgtagacttaatgtgtcatgcaacttttacaatgagattattatcgcccgtacgtgtaccaaattataatatgataatcatggatgaagcccattttacagatcctagctcaatagctgcgaggggatacatttcgacaagagtaggcatgggggaggccgctgcaatatttatgaccgcaacgcccccgggaagtgttgaggcgtttccacaatctaacgccgttatccaagatgaggaaagggatattcccgaacgtagttggaatagcggatatgaatggataactgactttcccggaaaaacagtttggttcgtaccttcaataaaatcaggaaacgacatagctaattgtttgcgtaagaatggaaaaagggtaatacaactatctagaaaaactttcgatacagagtaccagaaaaccaaaaataatgactgggattacgtcgtaacaacagacatatctgaaatgggggctaactttcgagcagatcgtgtaatcgacccacgaaggtgcttaaaaccagtaattctgaaggatggaccagaaagagttatcctagccggacccatgccagtaacagttgctagtgcggcacaacgtaggggcagaataggtaggaaccataataaagagggtgatcaatatatatacatggggcaaccacttaacaatgatgaagaccatgcacattggacagaagcaaaaatgttattagataacattaatacacctgagggaataattccagcactttttgagccagaaagagaaaaatcggcagctatcgacggtgagtatcgattgcgcggtgaagcccgtaaaacattcgtggaactaatgcgaaggggtgatctgcccgtctggctatcatataaagttgcctcggagggttttcaatattcggatagaaggtggtgcttcgacggagaaaggaataaccaagtgctggaggagaatatggacgtagaaatttggacaaaagaaggagaaaggaagaaactaaggccaagatggcttgatgccagaacatattcggaccctctcgcgttacgtgaatttaaggaatttgcagcaggaagacgatcagtttccggagacttaattcttgagataggtaaacttccacagcaccttacacaaagggcacaaaatgcgttagacaacttagtaatgctacacaatagcgaacaaggagggcgagcatacaggcacgccatggaagaactgccagatacaatcgaaactctaatgcttttagcattaatagctgtattaacaggaggggtaacgttattctttctaagcggacgtgggttaggcaaaacgtcaataggattactatgcgtaatggcttctagcgtactcctatggatggcatcggtagaaccccattggatagcagcaagtatcattcttgaatttttcctgatggtattattgatacctgagcccgataaacaaaggacaccccaagacaaccaactagcatacgttgtcatcggattgctgttcatgatactgactgtagctgctaatgaaatgggattgcttgagactactaagaaagacctagggataggacacgttgccgttgaaaatcaccaccatgctgctatgctggatgtcgatttgcacccagcctcggcctggacactatatgcagttgcgactaccataattacccccatgatgcgccatacgatagagaatactacagcaaatatatcgttaacagcgatcgctaaccaagctgcaatactgatgggactggacaaagggtggccgatctctaaaatggatataggtgtcccattacttgcgttaggctgctatagccaggtaaaccctttgacacttacagcagccgttctaatgctggtagcgcactacgcaattataggtcctggcttacaagcaaaagcaacaagggaagcgcagaaaagaacagcagcgggaattatgaaaaaccccacggttgatggtattgtagcgatcgaccttgatcccgttgtatatgacgcaaaatttgagaaacaactaggccaaatcatgctacttatactgtgcacgtctcaaatattacttatgcgaacaacttgggctctttgcgagagcattacattggcaacaggcccactaactaccctatgggagggaagtccgggaaagttctggaatacaaccattgcagtgtcgatggcaaatatatttagaggatcctatttagcaggagcggggctagctttctccttgatgaaatcattaggtggcggaaggcggggaacaggtgctcagggtgaaactctaggagaaaaatggaaacgacaacttaatcaattatcaaaatcggagtttaacacctataagcgaagcgggataatggaagttgatcgatctgaagcaaaggaaggcttaaaaagaggggagactacgaaacatgccgtgtcacgtggaactgccaaattacggtggtttgtcgaaaggaacctggtcaaaccagaagggaaagtaattgatttaggttgtgggagaggaggctggagctattattgcgcaggtttaaagaaagttacagaagtaaaaggatacactaaagggggaccaggacatgaggaaccgataccaatggctacttatggttggaatttagttaaactacactcaggaaaagacgtattcttcattccccctgaaaaatgtgacacactcctctgcgatattggagaatctagtccaaatccaaccatagaagaaggtcgaacattaagagtcttgaaaatggtggaaccatggctacgtggcaaccaattctgcattaagatccttaatccttatatgcctagcgtagtagagacactagagcaaatgcaaagaaaacatggaggtatgctagtaaggaatcccttatctcggaatagtacgcacgaaatgtattgggtgagttgtggaacaggaaatatagtatctgctgtaaatatgactagcagaatgttattgaatagatttactatggctcaccgaaaaccaacgtatgaaagagatgtcgatttaggggcaggaactaggcatgttgccgtggaaccagaggtagcaaatctagatataatcgggcagcgcatagagaatattaagcacgagcataaaagcacttggcattacgacgaagataacccgtacaaaacatgggcgtaccatggcagctacgaggtaaaaccctcgggaagtgcatcatctatggttaacggcgtggtaaaacttttgaccaaaccatgggacgttatacctatggtcacgcaaatcgcaatgaccgacacaacaccgttcggacaacaaagggtatttaaggaaaaagtagatactaggactccaaaggcaaaacggggtactgcacaaattatggaagtaactgccaagtggttatggggatttttatctcgtaacaagaaaccccgcatatgcacaagggaagaatttactagaaaagtacgatcgaacgcagctattggggcggtcttcgtcgatgaaaatcagtggaactcagcgaaagaagcagtagaagatgaacggttttgggatttagtacatagggagagagaactccataaacaaggtaaatgtgctacatgcgtttacaatatgatgggtaaaagggagaagaaattaggagaatttggcaaagctaaaggatcccgagccatctggtatatgtggctaggagccagattcttagaatttgaagcattagggttcatgaacgaagatcattggttttcacgggaaaatagtctttcaggtgtagaaggagagggattacacaaacttggatatatattgcgagatatatcaaagattccaggcggaaacatgtacgcagatgacacggccggttgggatacacgaataacggaagacgatctacaaaacgaagcgcgtataaccgatatcatggaaccagaacatgcactactagctaaaagtatatttaaattaacgtaccagaataaagtggtaagggttcaaagaccggcaaagaatgggactgttatggacgtaatttcacgaagagatcaacggggatctggacaagttggaacttatgggttaaataccttcaccaatatggaggcacaattaattaggcagatggaatcagaaggcatattttcgccatctgaacttgaaaccccaaatttagcagagagagtattagattggctcgaaaaatatggtgtggagcgacttaaacgaatggcaataagcggcgacgattgtgtcgtgaaacccattgatgatagatttgcaacagctctgacggcactgaacgatatgggaaaagtaagaaaagatattccccaatgggaaccgtctaaaggttggaacgactggcagcaggtaccattttgttctcaccattttcatcagctcattatgaaagacggacgggaaatagttgtaccatgcagaaaccaggatgaattagtaggacgagcacgcgtaagccaaggagccggttggagtcttagagaaacggcttgcctggggaagtcgtacgcacaaatgtggcaattgatgtactttcatcgaagggatcttcgtctagccgccaacgctatatgcagcgcggtgccagtcgattggattccaacaagtagaactacttggagcatacacgcgcatcatcaatggatgaccactgaagatatgttatcggtatggaatagagtatggatagaagagaacccctggatggaagataaaactcacatttcttcatggggcgatgttccatacttaggaaagcgtgaggatcaatggtgcggatctcttataggattaacagctagagcaacttgggctactaacatacaagtggcaattaatcaggttcgacgtctaatcggaaacgaaaattatttagactatatgacttccatgaagagattcaaaaatgaatctgacccagagggggcattatggtga

SEQ ID NO: 21867 - RNA, 9879 nt, synthetic construct
  misc_feature 1..9879: note = derived and/or modified CDS sequence (opt6) from DENV-1__GU131801__SS-prME
  source 1..9879: mol_type = other RNA
tccgtaactatgcttcttatgcttatgccaactgccttagcattccacctaaccacgcgcgggggtgaacctcacatgattgttagtaaacaagaaagaggtaaatccttactctttaaaacaagcgctggtgtaaacatgtgcaccctgattgcaatggacctaggagaattatgtgaagacactatgacatataaatgcccacggataaccgaagcagaaccagatgatgtagactgttggtgtaatgccacagatacatgggtaacctatggtacatgcagccaaacaggagaacatcgaagagagaaaaggtcggttgcactagcaccgcacgtggggctaggacttgaaacaaggaccgagacatggatgagtagtgaaggcgcctggaaacaaattcaacgagttgaaacatgggcactacggcacccaggatttacagtgatagcattatttctcgctcatgcaattgggacgtctataacacaaaaagggattatatttatattgttaatgttagtaactcccagtatggctatgcgatgcgtcgggataggatcgagggatttcgtcgaaggcctgtccggcgcaacctgggtagatgtagtcttagaacacggaagttgtgtaaccacaatggcaaaagacaaaccaacccttgatattgaacttctaaaaaccgaagtaaccaatcctgccgtattgcgtaagttatgcattgaagcaaaaataagcaacactacaactgacagtcgctgtccaactcaaggtgaagctacgcttgtagaagaacaagatgccaattttgtctgcagaagaacgttcgtcgatcgaggatgggggaacggctgtgggctgtttggcaaggggtcattattgacgtgcgccaaatttaaatgtgtaacaaaattagaaggtaaaattgtacaatatgagaatttaaaatattcagtaattgtaacagtgcatacaggagaccaacatcaagttggaaacgaatcgactgaacatggaacaacagccacaattacaccccaagcaccgacaactgaaattcagcttacggattatggtgctttaaccttggactgttctccacgaacaggtctagattttaatgaaatggttctactaactatgaaagagaaaagttggctagtacacaaacaatggtttttagacttaccattgccgtggacttctggggcaagtacaagccaagaaacgtggaatagacaagatcttctggtaacttttaaaaccgcacatgctaagaaacaagaagtagtagtcctaggatcacaagaaggtgccatgcatactgcactaactggtgccacagaaatacagacctcaggtacaacaactatatttgcagggcatttaaaatgcagactcaaaatggacaagttgactttaaaagggatgtcatacgtaatgtgtaccgggagctttaaactagaaaaagaggtcgctgaaacccagcacgggacagtattagttcagattaaatatgaaggaaccgatgctccatgcaaaatccccttttctactcaagatgaaaaaggcgtaacccaaaatggcaggctaattacagcaaatccaatagtaacggacaaagaaaaaccggttaatatagaagccgaaccgccctttggcgaaagctacattggtattggagcgggagaaaaagcactcaaattatcttgggtcaagaagggaagctcaataggcaagatggttgaagcaacggccaggggtgctaggaggatggctattctaggtgacacggcctgggactttggatctataggcggagtatttacctctgtaggtaaattagtgcatcagatctttgggacggcttatggagttctcttttctggtgtaagctggacgatgaagattggtattggtgtattattgacctggttaggcttaaacagtaggtctacctcactctctatgacttgtatagcagtaggactcgttacactatatctaggcgttatggtacaagcagatagcggctgcgttatcaattggaaaggaagggaattgaagtgtggaagtggtatattcgttacaaatgaggtgcatacgtggaccgaacaatacaaatttcaagcggactctcccaaacggttgagtgcagcaataggcaaggcatgggaagaaggagtatgcggaatccgatcagctacaagattagaaaatatcatgtggaaacagataagcaatgaactaaaccacattcttttagaaaacgatatgaaatttacggtagtggtaggcgacgtggcagggatcttggttcaaggcaagaaaatgatacgacctcaacctatggaatacaagtattcttggaagtcttggggaaaagccaaaataattggagcagatgttcagaacagtacattcattatcgatggcccaaatacacctgaatgtccggatgatcagagagcgtggaatatatgggaagttgaggattatggattcggtatattcacaactaatatctggcttaaacttagggattcatatacacaagtatgcgatcatagattaatgagtgctgcaataaaggactcaaaagcagtccatgctgacatggggtattggatcgaatcagagaaaaatgagacttggaaattagcaagggcttcgtttattgaagtgaaaacatgtatatggccaaagagtcacacactctggagtaatggtgttttggaaagcgaaatgataattccgaaaatacatggcggaccaatctctcaacataattatcgcccaggctacttcacacagacagctggaccatggcatcttgggaaactagaactcgacttcgatttgtgtgaaggaactacggtggtagttgatgagcattgtggaaaccgaggtcccagtcttcgaacgacaacagtgactgggaaaataatacatgaatggtgctgtagaagttgtacactcccacccttaagattccggggagaagatggctgctggtatggtatggaaatacgccctgtaaaagagaaagaagaaaatctagtgaagtccatggtctccgctggcagtggagaagtagactcctttagtctaggattactctgcataagcataatgatagaagaagtgatgcggtctagatggagtaggaagatgcttatgacgggaaccttggcggtattctttcttttgattatgggccaacttacctggaatgatctcatacgactatgcataatggtgggcgctaatgcttctgatagaatgggcatggggaccacatatctcgcattaatggctacatttaaaatgagaccaatgtttgcggtagggctgctgtttcgtcggctcaccagcagagaggtactactattaactattggattgtctttggtagctagtgttgaactcccaaatagcttggaagaacttggtgatggattagcgatgggtataatgatattaaaattattaactgacttccaatcatatcagctatgggcgacactattgtcattaacgttcatcaaaaccaccttcagtttacactatgcatggaagactatggctatggtgttatcaattgtatctctattccctttatgtttgagtacaacatcccagaaaactacatggttacccgtactattaggttcacttggatgcaaacccttgactatgttcttaattgctgaaaataaaatctggggacgtaaatcatggccattaaacgagggtatcatggcagtaggtatcgtttctattcttttaagctccctattgaaaaatgatgtacccttagcaggcccgttaatagcgggtgggatgttaattgcatgctatgttattagtggatcgtctgcggatttgtcacttgaaaaagctgcagaagtgtcatgggaggaagaagcagaacattctggcgccagccataacatcctagttgaggttcaagatgatgggacaatgaagatcaaagatgaagaaagagatgatacccttacaatactccttaaagcaacattgttagccgtttcaggagtttatccgttatcaattccagccacactatttgtatggcatttctggcaaaagaagaaacagcgaagcggggtactttgggataccccatctcctccggaagttgaaagggctgtattagatgacggtatttacaggataatgcagagaggattgttaggccgaagccaagtaggagttggtgtcttccaggaaaatgtttttcatacaatgtggcatgtgacacgaggagcagtgttaatgtatcaaggtaagcgcttagaaccttcttgggcaagtgtaaagaaggatttaatatcatatggcggtggatggcgatttcagggctcatggaacacaggggaagaagtacaggtgattgcagtcgagccaggtaaaaaccccaaaaacgtacagacggcacccggtacatttaaaacaccggaaggagaagtaggagcaattgccttggattttaagccaggtacaagtggtagcccaatcgtaaacagagaagggaaaattgtaggtctctatggcaatggggtcgtaactacaagtggcacgtacgtatccgcaattgctcaggcgaaagcaagtcaagagggtccattaccagaaattgaagacgaagttttcaggaaaaggaacttaacgatcatggacttacaccctggaagcggcaaaacgcgaagatacctaccagctatagtaagagaagcaatcaaaagaaaactaagaacattgatcctagccccaacaagagttgtggccagtgaaatggcagaggcactaaaaggcatgcccataagataccaaaccaccgccgtcaaatcagaacatacaggaaaggaaattgtagatttaatgtgtcatgctacgtttaccatgcgcttattatcacctgtaagagtacctaactacaacatgatcattatggacgaggctcattttaccgacccttcaagtatagccgcccgtggatacatatctactcgggtaggaatgggcgaggcggcagcaattttcatgacagcgacaccaccaggaagtatggaggcattcccccaaagtaacgcagtcattcaagatgaggagagggatatcccagaaagaagctggaacagtggatacgaatggataactgattttccgggtaagactgtatggtttgttccatctatcaaagcgggtaatgatatcgcaaattgcctacggaaaaatggtaaaagagtgatccaactatctcggaaaacttttgatacagaatatcagaaaactaagaacaacgattgggactatgtagtaacgacagatatcagcgaaatgggtgcaaatttccgagctgatcgcgttattgacccaagaaggtgcttgaaacccgttatacttaaagacggtccagaacgagtaatacttgctgggccgatgccggttacagtagcaagtgcagcacaacgaagaggccgtattggacgaaatcacaataaagaaggagatcagtacatttacatgggtcagccactgaataacgatgaggaccatgcgcattggactgaggcgaagatgcttctcgataacatcaatacaccagaaggtatcataccggcgttatttgaaccagaacgcgaaaagtcagcagcgatagatggtgaatataggttgcgaggagaagccagaaaaacgttcgtggaacttatgagaagaggagatttacctgtatggttgtcatacaaagtagcgtcggaaggctttcaatactcggacagacgctggtgcttcgacggagaaaggaacaatcaggtcctcgaagaaaacatggatgttgaaatatggacaaaagaaggagagcggaagaaattacgaccaagatggttagacgcgagaacttactcagatccgttagcactacgtgaatttaaagaatttgcagcgggtagaaggagtgttagtggagatctcatcctcgaaatcggaaaactgccacaacacttaactcagcgtgctcaaaatgctctggataatctagtcatgttgcacaattcggaacaaggtggcagagcatatcgccatgccatggaagaacttccagatacaatagaaacattaatgctattagctcttatcgccgtactgaccggcggcgtaaccttgtttttcctatcgggcaaagggctaggcaaaactagcatcggattattgtgcgtcatggcatcctcagttctactatggatggcaagcgtcgagccacactggatagcggcaagtattatactagagttcttcctgatggtattacttataccggaacctgataggcaaaggacaccacaagataatcaattggcgtacgtggtgatcggacttttattcatgatcttaacggtagcagcaaacgaaatgggacttctcgagacaacgaaaaaggatctgggtatcggacacgtggccgtcgaaaatcaccaccatgccgcaatgttagatgtcgatttacaccctgcaagcgcttggactttatatgctgtcgccacgactatcatcacgccgatgatgaggcacacaatagaaaacactaccgcgaacatcagtctaacagcaatcgcaaatcaagccgcaatattgatggggttagataagggatggccaatatcgaaaatggatataggagttcctttattagctcttggttgctatagtcaggttaatccactgacactcacagcagcagttttaatgttagttgcccattacgcaatcataggccccggcctacaagcaaaagcaacaagagaagctcagaagagaactgcagcaggaataatgaaaaacccgactatcgacggtatagtcgcgatcgatttagatccagtcgtctacgatgcaaaatttgaaaagcaactcggccaaataatgttgttaatattatgcacatcgcagatattattgatgcgtactacttgggctttatgcgagtccatcacactggcaactgggccactaacaaccttatgggaaggcagtcctggaaaattttggaacaccaccatagcagtaagcatggccaatatcttcagaggatcatatttagcaggagcgggtctcgctttttctttaatgaaaagcctaggagggggtagacgcggaactggcgcgcaaggggaaacactcggtgaaaagtggaagcgccaacttaaccaattaagcaagagtgagttcaacacttacaaaagaagcgggataatggaggtagacaggagtgaagccaaagaaggattaaaaagaggggagaccacgaaacatgcagtatcaagaggaactgccaaacttagatggtttgtggaaaggaacctagtaaaaccagaaggtaaggttatagatttggggtgtggaaggggcggctggtcctattactgtgctggattaaagaaggttaccgaagtaaaagggtatacaaaaggaggacccgggcacgaagaaccaattccaatggctacatacgggtggaacctagtaaaattacatagtggaaaagatgtgttctttattccccctgaaaaatgtgacactctgttatgcgacataggtgaaagttcccctaaccctacaatagaagaaggcagaacactgagagtcttaaaaatggtggaaccttggttaagaggcaatcaattttgcattaaaattctgaatccttatatgccgtctgtagtagaaacgcttgaacaaatgcaaagaaaacacggcggaatgttagttcgtaacccgctgtctcgcaatagtacccacgagatgtattgggttagttgcggtaccggaaacatagtcagtgctgtgaatatgacaagtcggatgttactaaatagatttacaatggctcatcgtaaaccaacatacgagagggacgtagatctaggagctggtacaagacatgtggccgttgaacctgaggtcgctaacctagatattatagggcaacgtattgagaatattaagcacgaacacaagagcacttggcactatgatgaagacaatccatataaaacatgggcatatcatggatcatatgaagttaaaccgtccggtagtgcttctagtatggtcaatggtgtggtcaaattattgaccaaaccatgggacgtaattccaatggttacacaaattgcaatgactgatacgacgccctttggacaacaacgcgtattcaaagaaaaagtcgatactcgaactccaaaagccaagcgtggtactgcgcaaatcatggaggtgacagcacgatggttatgggggtttttgtcgcgcaataagaaacctcgaatatgtacacgcgaggagttcacaagaaaggtaagaagcaatgcagcaattggagcagttttcgttgatgagaatcaatggaacagtgccaaggaagctgtcgaagacgatcgattttgggacttagtacatagagaaagagagttgcacaaacagggtaaatgcgcaacatgtgtgtataatatgatgggaaaacgagaaaagaaactcggagagttcgggaaagcaaagggctctcgagcaatatggtatatgtggcttggcgctagatttttagagtttgaggcgttaggatttatgaatgaggatcattggttcagccgagaaaactctttgagtggagtcgagggtgagggtttacataagttaggatacatcttaagggacataagcaaaattcccggaggtaacatgtatgcagatgacactgccggttgggatactagaataactgaagatgatttacagaatgaagcgaagatcacagacataatggaacctgaacacgcattgcttgcgaaatctatcttcaaattgacatatcaaaataaagtcgttagggtgcagagacccgctaagaacgggaccgtaatggacgtaatatctagacgtgatcaaagaggatcaggtcaagttggtacttatgggcttaatacttttaccaatatggaagcccagctaatcagacaaatggaatcagaaggaattttcctccccaatgaattagaaaccccgaatctagccgggagggttttagattggctagaaaaatacggagtagaacgactcaaaaggatggccataagtggcgatgattgtgtggtcaaaccaattgatgatcgatttgctacggcactaactgctcttaacgacatgggtaaggtaagaaaagatataccacaatgggaacctagcaaagggtggaacgattggcagcaagttcctttttgtagccatcattttcaccaactaattatgaaggacgggcgtgaaatagtagtaccatgccgaaatcaggatgagctagttggtcgagcaagagtttcacagggtgcaggctggtcattacgcgagaccgcatgtttaggaaaatcatatgcacaaatgtggcaattaatgtactttcatcgtcgagatctgcgattagctgctaacgctatatgttcggcagtacctgttgactgggtacccacaagcaggactacatggtcgatccatgcgcatcatcaatggatgacgacagaagatatgctaagtgtctggaatagagtttggatagaagaaaatccttggatggaagataaaacacgcataagttcctgggaagatgtgccatacctgggaaaaagagaagatcaatggtgtggatcactcataggtctaacagcacgagcgacgtgggcaacaaatattcaggtagcgataaaccaggtgcgaagactaataggcaatgaaaactactcagactatatgacttccatgaaaagatttaaaaacgagagtgaacccgaaggagcgttgtggtga

SEQ ID NO: 21868 - RNA, 9879 nt, synthetic construct
  misc_feature 1..9879: note = derived and/or modified CDS sequence (opt6) from DENV-1__GU131804__SS-prME
  source 1..9879: mol_type = other RNA
tcagtcacaatgtttttaatgcttatgccaaccgcgttagcatttcatttgactacacgaggaggggaaccacatatgatcgtaagtaaacaagaacggggaaagagtttactattcaaaactagtgcaggcgtaaatatgtgtaccttaattgcaatggaccttggagaactatgcgaggacacgatgacatataaatgtccaagaattacagaaacagaaccagatgacgtagactgttggtgtaatgccactgacacatgggtgacatatggcacttgtagccaaaccggagaacatagaagagataaaagaagtgttgcactggcacctcacgttggcctagggctagaaacacgaacagaaacgtggatgagctcggaaggtgcatggaaacagatccaacgagtagaaacgtgggcactgcggcatcctggctttacagttatagcattattcttagctcatgcgataggtacaagtataacacaaaaaggaatcatctttattttactcatgctagtaacgccatccatggcaatgagatgcgtgggtattggctcaagagactttgttgaaggactctctggagccacatgggtggacgttgtgttagagcatggatcgtgcgtaacaactatggctaaagacaagcctactttagatatcgaactattaaaaacagaagtcacaaatccagcagttttaaggaaactatgcatagaagcaaaaatcagtaacacgacaacagatagcaggtgcccaacacaaggggaggccactttagtggaagagcaggatgcaaacttcgtttgcagacgcacatttgttgacaggggatggggaaatgggtgtggtttgtttggtaaagggtcactaataacatgtgcaaaatttaaatgtgttactaaacttgaaggcaaaatagtacaatatgaaaatttaaagtatagcgtgatagtgacagttcatactggagatcaacaccaagttgggaatgagagtacagaacatggcacgacggcaacgataacccctcaagctcctacaactgagattcaactaaccgattacggagcattgactttggattgtagtccaaggacgggactggattttaatgagatggtactactaacaatgaaggaaaaaagctggctagttcataaacaatggttcctcgacctccccttaccatggacaagcggcgctagtacgagtcaggagacttggaacaggcaggatctactcgtaacattcaagacggcgcatgctaaaaaacaggaggttgttgtattgggctcgcaggaaggagcaatgcacaccgcgttaacaggagcaactgagattcaaacctcaggtaccacaacgatattcgctggtcacttgaaatgtcggttaaaaatggataagttaactttaaaaggcatgtcatacgtaatgtgtactggtagctttaagttagagaaagaattagccgaaacacaacatggaactgttttagttcagataaagtacgagggtacagatgctccatgcaaaattcccttcagcacacaagacgaaaaaggagttacacaaaacggcagactgatcaccgctaatcctatcgtgacggacaaggaaaaaccggtgaacatagaagctgagcccccttttggtgaaagttacatagtgataggagctggcgaaaaagcgctaaaattaagctggttcaagaaaggtagcagtatcggaaagatgtttgaagccaccgcccggggcgctcgcaggatggcgatacttggagatactgcatgggatttcgggagcatcggcggcgtcttcacaagcgtcggaaaattggtccaccaaatatttggtacagcatatggagttcttttttcaggggtatcctggactatgaaaatcggtatcggagttctattaacatggttaggactaaactcgcgatcgacctcattgtcaatgacatgtattgctgttggactcgtgactttatacctgggggtcatggtacaggcggatagtggatgtgtaattaattggaaaggaagagaactaaagtgtggtagcggaatatttgttacaaacgaagttcatacttggacggaacaatataaattccaggcagacagtccgaagagattgtccgcagccattgggaaagcatgggaagagggcgtgtgtgggatacgaagtgcaaccagattggaaaatataatgtggaaacaaatatcaaatgaattaaaccatatacttttggagaatgacatgaaatttactgtcgtggttggagatgtagctggaatactcgcccaaggtaagaagatgattagacctcagccaatggagtataagtattcttggaaatcgtgggggaaggcgaaaatcatcggggctgatgttcaaaatactacttttataatcgatggccccaatactccggaatgcccagatgatcagcgagcctggaacatttgggaagtagaggattacgggtttggaatctttacaacaaacatatggttaaaactccgagattcctacacacaagtgtgtgatcacaggttaatgagtgctgcaataaaggattctaaggcagtgcatgctgatatgggttactggatagaatctgagaaaaatgagacatggaagcttgcacgagcatcttttattgaagttaaaacatgcatatggcccaaatctcacacactatggagtaacggtgttttagaatcagaaatgataattcccaagatctatggaggtcctatatcacaacataattatcgaccgggatattttacccaaaccgccgggccttggcacttaggaaaacttgaattggattttgacttatgtgaaggcacaacagtagtcgtagacgaacactgcgggaacagaggcccttcgctaagaaccaccactgttactgggaagataatacatgagtggtgctgtagaagttgcacgttaccacctctcagatttagaggtgaagatggttgctggtatggcatggaaatcaggccagttaaagaaaaggaagagaatttagttaagtctatggtatcagcgggatcgggagaggtagacagcttcagcctaggcctactgtgtatatcaataatgattgaggaagtaatgagatcaaggtggtcaagaaagatgctcatgaccggaaccttagctgtgttttttcttttaatcatgggccagttaacatggaacgatctaataaggttatgtattatggtaggagcaaatgcatcagacagaatgggtatggggacgacctaccttgccttaatggcaactttcaaaatgagaccaatgttcgcggttggattattatttcgaaggctaacaagtcgcgaagtcctacttttgacgataggactgtcactcgtagcaagcgtagaactaccaaatagtctggaagaactcggtgacggtttagcaatggggattatgatcttaaaactactaacagatttccaatcccatcaactttgggcgacgctgctaagcttaacatttattaagaccacattttcattgcattacgcgtggaaaactatggctatggttttatcaatagtatccctttttccactgtgcttgagtactacctcacaaaagacaacttggttaccggttctactgggaagtcttggatgcaaacccctcactatgttcttgatagcagaaaataaaatctggggaaggcgatcttggcctctaaatgaaggcataatggcagtagggattgtgtctatattacttagttcgttactaaaaaatgatgtaccgttagctgggccactaattgcgggtggtatgttaatagcatgctatgtcataagtggaagcagtgcggatttgtcacttgaaaaggcagcagaagtcagttgggaagaagaggctgaacattcgggggcaagtcataatattctcgttgaggtacaagatgacggtactatgaagattaaagatgaagaaagagatgatacattgacaatcctgttaaaggcaacattattagcagttagtggagtatatcctctatccataccagcaacattatttgtatggtacttttggcagaagaaaaagcaaagaagcggcgtcctgtgggataccccgtccccaccggaagttgaaagggccgtattagacgatggaatttatcgtatcatgcaacgaggactgttagggagaagccaagtcggagtaggagtatttcaggaaaatgttttccataccatgtggcatgttacacgaggagccgtactaatgtaccaaggcaaaaggcttgagccaagttgggccagtgtcaagaaagatttaatctcttatgggggaggttggcgactacaaggaagctggaacacaggtgaggaagtgcaagtaatagctgttgaacctggaaaaaacccaaaaaatgtacagacagcgccaggaacatttaagacacctgaaggagaggtaggggcaattgctttagattttaagcccggaactagcggaagtccaatagttaaccgggagggaaaaatagtaggactttacggaaatggagtagtgaccacatctggaacgtacgtgtcggctatagcccaagcaagagcgagccaagaagggcctttaccagaaatagaagatgaagtatttcgaaaacgaaatttgacaataatggacttacatccaggaagcggaaagacgcgcagatacttaccagcgattgtcagagaggcaataaaaagaaaattgagaacgttaatactagctccaacaagagtggttgcaagtgaaatggcggaagcattgaaaggaatgccaatacgatatcagactacagcagttaagagtgagcatacagggaaggaaatcgttgacttgatgtgtcatgcaacctttaccatgagactattatcaccagttcgggtgccaaattataatatgattataatggacgaagcacacttcacggacccttcatcaattgcagctagaggttacatttccacgcgagtaggtatgggggaagcagccgcgatatttatgactgcaacccccccaggcagcgttgaggcttttcctcaaagtaatgcagtgatacaagacgaagagagggacataccagaaaggagttggaattccggatatgaatggataacagatttccctggaaaaactgtttggttcgtaccctccattaaatctggaaatgacatcgctaactgtctacgcaaaaatgggaagagagtaattcagctatcacgcaaaacattcgatacagaataccaaaaaactaaaaacaatgattgggactatgttgttaccactgacatatctgagatgggggccaattttcgagctgaccgagtaattgatccacgacgatgtctgaaacctgttatactcaaagatggccctgaacgtgttattttagcagggccgatgccggtaacagtagctagtgctgcacaacgccgaggaagaatcggccgtaatcataataaagaaggtgaccaatatatatatatgggccagcctctcaataacgatgaagatcacgcccattggacagaagctaagatgctcttagataatataaataccccggaaggcataataccagcactttttgagccagaaagagaaaaaagcgcagcaatagatggagaatacaggctcagaggagaagcacgtaaaaccttcgtagaattgatgagaagaggagatctccctgtatggctctcatacaaggtcgcgtcagaaggatttcaatatagtgacaggcgttggtgcttcgacggagaacgaaataatcaggttctagaggagaacatggatgtagagatatggacaaaggaaggggaaagaaaaaaattaagacctcggtggttagatgcaaggacctactcagatcctttagccctgcgtgaattcaaagaatttgctgccggacgtcggagtgtttcaggtgatctcatactagagattggcaagctaccacaacacttaacacaaagagcccaaaacgcattagacaacctagtaatgttacataacagtgagcaaggaggcagggcatatagacacgcgatggaagaattgccagatacaattgaaaccttgatgctactagcactaattgcagtattgacaggcggagtaacgctgtttttcctcagcggacgaggcttagggaaaacaagtattggactgttatgtgtaatggcttcttcagtgctattgtggatggcaagtgttgaaccacactggatcgctgcatcaataatcctagaattcttcctaatggtgttattaatcccagaaccagatagacagaggacccctcaggacaaccaactagcatacgttgttataggattactttttatgattttaactgttgcagcaaatgaaatggggctactagaaaccacgaagaaagatcttggaataggccatgccgctgttgagaatcatcatcacgcagcaatgttggacgtagacttgcacccagcgtctgcttggacactgtatgcagttgcaacaacaataatcacaccaatgatgagacacaccatagaaaacacaacggcaaacataagtctgacagcgattgcgaaccaagcggcgatacttatgggcttggacaagggatggccaatctctaaaatggatattggtgtaccattactcgcacttggttgttattcgcaagtaaacccacttaccctaaccgctgcggttttaatgttagttgctcattatgcgatcataggtcctgggctacaagcaaaagcaactagggaagcccagaaaaggacagcggcaggaatcatgaaaaatcccacagttgatggaatagtagcgatagacctggatccagtagtatatgatgctaaatttgaaaaacaactaggacagattatgcttctaatattatgcacatcacaaatactactgatgcgaacaacatgggctttatgtgaaagcataaccctcgcgactggacccttaactacattatgggaaggtagccccgggaagttctggaacacgactattgctgtatctatggcaaacatttttagaggatcttacttagccggggcagggttggcttttagtttgatgaagagtttgggaggaggccgtcgtggtacaggcgcacaaggggaaacattaggcgaaaaatggaagagacagctgaaccaattaagcaaaagcgaatttaacacatataaaaggtcgggtattatggaagtagacagatcagaagctaaagaaggacttaaaagaggagagaccactaagcatgcagtttctagagggacagcaaaactcagatggtttgtagagcgtaatttagttaagcccgaaggaaaagtgattgacttaggctgcggtaggggaggatggtcctattactgtgctgggcttaagaaagtcacggaagtgaaaggatacacaaaaggtggaccgggccacgaagagccaattccgatggctacctacggatggaatttagttaaactgcattcggggaaagacgtattttttattccaccggaaaagtgtgacaccttgctctgtgacataggggaatcatccccaaacccaaccatagaggagggacgtacactacgagtgctaaaaatggttgaaccgtggctaaggggtaatcaattttgtataaaaatattaaacccatatatgccttcggtagtcgagacattagaacagatgcagaggaagcatggtggaatgttggtgagaaatccgctatcaagaaatagcactcatgagatgtactgggtatcatgtggcacaggaaatatagtttcggcagtcaatatgacttcacgaatgctgttgaaccgctttactatggcacaccgcaaacctacatatgaacgagatgtagacctaggagcaggaacacgccatgtagcagtagaacccgaagtggcaaatatagacataataggacaaagaatagaaaacattaaacacgagcataagtccacttggcattatgacgaagataatccgtacaaaacctgggcctaccatggatcatatgaagtcaaaccatcaggtagcgcttcaagtatggttaatggtgttgtaaagctactaactaagccttgggatgtaattcctatggtaacacagattgctatgactgataccacgccgtttggacaacaaagagtttttaaagaaaaagtggacacacgtacaccgaaagcgaaaagaggcactgcccaaataatggaagtaacggcaaaatggctatggggctttctatcgcgtaacaaaaagccaagaatatgtacgagagaagaattcacacgcaaagtacgttcaaatgcagcaattggagcagtattcgttgatgaaaatcaatggaattcagcaaaggaggctgtcgaggatgaaaggttttgggatctcgtacatagagaaagagaattacacaaacaaggaaagtgtgctacctgtgtttacaacatgatgggaaagagggaaaaaaaattgggtgagttcggaaaagccaaaggtagtagggcaatatggtatatgtggctaggtgcacgatttctcgagttcgaagcattaggatttatgaatgaagaccactggttcagtagggagaactccctatcgggggtagaaggggaagggttgcacaaactaggttacatactacgcgacatatctaaaattccaggtggaaacatgtatgcagatgacactgcgggttgggacacgcgcataacagaagatgaccttcaaaacgaagcacgcatcacagacattatggaaccagagcacgccctcctagcaaaaagcatctttaaattgacttaccaaaataaagtggtccgagtacaacgcccagcaaagaacgggactgtaatggacgttatctccaggagggaccaaaggggatcgggccaagttggtacctatggtctaaacacatttacgaatatggaagctcagttgatacgtcaaatggaaagcgaaggaattttcagtccaagtgagttggaaacacccaatctagcagagcgagtattagactggttagaaaagtacggggttgagaggttaaagaggatggctatttccggagatgattgtgtcgtgaaacctatcgatgatcgatttgcaacagcattaactgctcttaatgacatgggaaaagtgagaaaggacatcccacaatgggagccatcaaaaggatggaacgattggcaacaggttccgttctgcagtcatcattttcaccaattgatcatgaaggacgggagagaaattgttgtaccgtgccgaaaccaggatgaattagtaggaagagcacgggtaagtcaaggggcaggatggagtctaagggaaacagcttgcttaggaaaaagttatgcccagatgtggcagctgatgtattttcatcggcgagatcttcgtttagctgcaaatgccatctgcagcgcagtccctgtggattggatacctacaagtaggactacatggtcgatacatgctcatcaccagtggatgaccaccgaagatatgctaagcgtgtggaacagagtttggattgaagaaaacccatggatggaggataaaacccacataagctcatggggtgatgtaccatatctcgggaaaagagaagatcaatggtgcggatctttaattggtttaacagcgagagccacatgggccacaaacattcaggttgcaatcaatcaagtgcggcgattaatcggtaacgaaaactacctggactacatgacgtcgatgaagaggttcaaaaatgaaagtgatccagagggtgctctatggtaa

SEQ ID NO: 21869 - RNA, 9879 nt, synthetic construct
  misc_feature 1..9879: note = derived and/or modified CDS sequence (opt6) from DENV-1__GU131805__SS-prME
  source 1..9879: mol_type = other RNA
agtgtcacaatgctattaatgcttatgccaacagctctcgcatttcatctcacgactcgaggaggggaaccgcatatgatcgtgagtaaacaagagcggggaaagagtctactttttaaaaccagtgccggggtcaatatgtgtaccttgatcgcaatggacctaggagaattttgtgaagacacaatgacatacaagtgcccaagaattacggaagccgagccagacgatgtagattgctggtgtaatgctactgacacctgggtaacatacgggacatgcagtcaaacaggtgaacatcgtcgggataaaagaagcgtagctttagctcctcacgttggactgggattggagacacggacagagacatggatgtcaagcgaaggtgcttggaaacaaatccaaagagtcgaaacatgggctttaaggcatccaggatttacagtcattgcactatttttagcgcatgccattggaacttcaataactcaaaaaggaataatttttatactgcttatgctagtaacgccaagcatggcaatgagatgcgtaggaataggatcgagggattttgttgaaggactatctggagcaacgtgggtagacgtcgtacttgagcatgggtcatgcgtaacaactatggccaaagataaaccaacccttgatattgaactattaaaaaccgaagtaactgacccagcggtattaagaaaactttgcatagaagcgaaaatcagcaatacaacaacagactcccgatgccctacccagggagaagccacattagtcgaagaacaagatgcaaatttcgtatgcagaagaacttttgtagataggggatggggcaatggatgtggtctcttcggaaaaggtagccttatgacatgtgctaaattcaaatgtgtaaccaaattggaaggaaaaatagtgcaatacgaaaatctgaaatattccgtgattgtaacagtgcatactggcgaccaacatcaggtgggaaatgaatcaacggagcatggaaccaccgctacaataacaccacaagcaccctctccagagatccagttgccagattatggagcgcttactctcgactgttcgccaagacctggattagatttcaatgaaatggtgctactacctatgaaagaaaaatcttggttggttcataaacaatggttcttggacttacccttaccgtggacatcaggggcatcaacttcacaagaaacatggaatcgtaaagatctattgggaacctttaaaacagctcatgctaaagaacaagaagttgtagtgctaggaagtcaagagggagcaatgcatacagcattaactggcgcaactgagatccaaacttcaggtacaacaacaatttttgcaggtcacctcaaatgcaggttaaaaatggataaattgacacttaaagggatgtcatatgtaatgtgtacaggctcatttaagctggaaaaagaagttgcagaaacgcaacatggaacagtattagtgcaaatcaaatacgaaggtacagatgccccatgtaagatccccttttccactcaagacgaaaaaggcgtcacacagaatggaagactaatcacagctaatcctatagtcacggacaaggaaaaacctgtaaacatagaagcagaaccggcctttggagagtcttacatcgtaatcggggcgggcgaaaaagcactaaaactatcgtgggttaagaaaggtagctcaatagggaaaatgttcgaagcaaccgctagaggtgcccgaagaatggccattctgggggacacagcctgggattttggaagcattggtggggtatttaccagtgtagggaaactggtacaccagattttcggaacagcttatggtgtgctattcagcggcgtaagttggaccatgaaaataggaataggcgttttactaacatggttaggtttaaactctcgatccacaagtctttcgatgacatgtattgcagtaggcctagtaactctttacctcggagtaatggtacaagccgatagcggctgcgtaataaattggaaaggacgggaattaaaatgtgggtccgggatattcgggacaaatgaagttcatacatggacagaacaatataaatttcaagccgacagccccaaaaggctttccgctgcaataggaaaggcttgggaagaaggggtgtgcggaataagatctgcaactagactagaaaatataatgtggaaacaaataagcaatgaactaaatcatattctattagagaatgctatgaaattaacagttgtagtcggcgatgttgccggaatattagcacaaggaaagaaaatgattcgtccgcaaccaatggaatacaaatatagctggaaatcttggggtaaagctaaaataataggagcggatgtccagaacacgacatttatcattgatggaccaaacaccccagaatgtccagatgatcaaagagcatggaacatatgggaagtagaagactatgggttcggcatatttacaacaaacatctggcttaaactcagagacagttacactcaagtgtgtgatcaccgtttaatgagcgcggccatcaaagactccaaggcagtccatgccgatatgggttactggatagaatcggagaaaaacgaaccttggaaattggctcgcgcttcatttatagaagtcaaaacttgcatctggccgaagtcacacactttatggagtaacggtgttttagaaagcgaaatgatcataccgaaaatttatggaggacccatttcccagcacaactaccggccagggtacttcacacaaacagcgggaccttggcacctaggcaaattagaattagattttgatctgtgtgaaggaacgacagttgttgtagatgaacactgtggaaatcgaggaccaagtctacgaacaactactgtgccaggaaaaatcattcacgaatggtgctgcaggtcatgtacattaccacctttaagattcaaaggcgaagacggttgctggtatggtatggaaatatcgccggtgaaagaaaaagaggaaaatttggtaaagagtatggtatctgccggatccggtgaagtagatagcttttccctcggacttctgtgcataagtataatgatagaggaggttatgcgctcaagatggagtagaaaaatgttaatgacgggaccactaccagtcttctttctactaataatggggcaacttccttggaatgatctaatcaggttatgcatcatggtaggcgcaaacgcgagtgacaggatgggaatggggacaccgtatttagctttaatggcaacatttaagatgagaccaatgtttgccgtagggttactttttcgacgactaacatcacgagaaggtttattactaacgataggactttcacttgtcgcgagcgtcgaacttcccaactccctggaagaattaggagatggtttagctatgggtatcatgattctcaaattattaactgacttccagagccaccaactttgggctacactcctcgcactgacatttattaaaacgacatttagtctcgactatgcatggaaaactatggctatggtcctaagcatcgtttcgttatttccactatgtctctcaacaacatcgcagaagactacatggttacctgttttactggggtcactgggatgtaagccattaacaatgtttttgatagccgaaaacaaaatttggggaaggaaatcatggccactaaatgaaggcataatggctgttggcatagtttccattttattaagtgcattgttaaagaatgacgtacctctcgctggaccattaattgcaggagggatgttgatagcatgttatgttatttcaggttctagtgcggatttgtcgctagaaaaggcggcagaagtatcatgggaagaagaagccgaacactcaggtggctctcataacattctagtagaagtacaggatgacggcacaatgaaaataaaagacgaggaacgggacgctacactaaccatcttgctaaaggccaccttactagctgtaagcggtgtatatccactgagcataccagccactttatttgtatggtatttctggcagaaaaagaaacagaggagcggtgttttgtgggatacgccaagtccccctgaagttgagagagccgttctagacgacggtatttacagaatcatgcagagaggtctactaggacgatcacaagtcggcgtaggtgtattccaagagaatgtttttcacaccatgtggcacgtgactaggggagcagtgctcatgtatcagggtaagaggttagaaccatcttgggccagtgtaaagaaagatctaataagttatggaggagggtggcgtttacaaggttcatggaacaccggagaagaagttcaagtcatagctgtagaacctggcaaaaatccgaaaaatgttcaaacggcgccgggtacatttaaaacatcggaaggtgaagtgggagcgatagcgctcgacttcaaacccggaacttctggttcccccatagtcaatagagaagggaagattgttgggttatacggtaatggagttgtaacaacaagtggtacgtatgtctctgcaatcgctcaagccaaagcatcacaggaaggaccattacccgaaattgaagatgaagtgttccgcaagagaaacttgaccataatggatttacatccagggtcaggtaagacaaggaggtatctgcctgcaattgtacgggaagcaataaaaagaaaattacgaacgttaatcctggcacctaccagagtagtagcctcggaaatggcagaggcattgaaaggaatgcctataaggtatcaaactacggctgtcaagagtgaacatactggtaaagaaatagtcgatctaatgtgtcatgcaacatttaccatgcgactcctctcaccagtaagagtacccaactataacatgatcattatggatgaagcacactttactgatccatcgtcaattgcagctcgtggatatatcagcacacgagtgggcatgggggaagctgcagcaattttcatgactgcgacaccccctgggtcagtagaggcctttccacagtcaaatgctgtaattcaagacgaggaacgtgatatacctgaaagatcatggaactctggatacgagtggataactgatttcccgggtaaaacggtatggtttgtaccttcaatcaaaagtggaaacgatatagctaattgtctgcgtaaaaacggaaaaagagtcatacaattaagtagaaagacattcgacaccgaataccagaagacaaagaataatgactgggactatgtagtaaccaccgatataagcgaaatgggtgcaaacttccgtgcagacagagtaatcgatccaagaagatgtttaaagcctgttatattaaaagacggtccggagcgagtaatattagccggtccaatgcccgtaaccgtagcttctgctgcgcaaaggcgagggcgaatcggacgtaatcataacaaggagggagatcaatatatttatatgggccaaccactgaataatgatgaagatcatgcacattggacagaggcaaaaatgctgttagacaatattaatacaccggaaggcataatacctgctctcttcgagccggaaagggagaaaagcgcagcaatagacggtgaatatcgactacgtggtgaggccaggaaaacttttgtagaattaatgcgacgaggtgatctaccagtgtggcttagttacaaagtggctagtgaaggttttcagtatagcgatcggcgatggtgtttcgatggcgagcgtaacaaccaggtacttgaagaaaacatggatgtagaaatatggacaaaggaaggagaaagaaagaaactccgtccgcgttggctagatgctcgcacctacagcgacccattagctttaagagaatttaaagaatttgcagcgggaaggcgatctgtcagtggtgatttaatccttgagattggaaaattaccgcagcatctcacacaaagggcgcaaaatgcgttagacaacctagtaatgctacataacagtgaacagggtggccgagcataccgtcacgccatggaagaactacccgatacaattgagacgcttatgttactagcactgatagcagtattaaccggaggtgttacactattctttctctccggacgcggactgggtaaaacgtcaatcggcttactatgtgtcatggcatcaagcgtactgttgtggatggcatcggttgaaccacactggatagcggcgagtattatcctggaatttttcttgatggtattgttgattccagaacccgatagacagagaactccgcaggataaccaattagcttatgttgttatcggcttactatttatgatattaacggtagccgctaacgaaatgggtttactggaaactacaaagaaagacttggggattggtcatgtggcggttgaaaaccatcatcacgctgcaatgctagacgtagatttacacccagcaagtgcgtggacactgtacgcggtcgcaactacaatcattactccgatgatgagacatactatagagaataccaccgcaaatattagtctaacggctatagctaatcaagctgccatacttatgggcttagataaaggatggcctatatcaaaaatggatattggagtaccccttttagctttaggatgttattcccaagtaaatccccttactttgacagccgcagtattaatgctcgtagctcattacgcaataattggtccaggcctccaggctaaagcaacacgagaagcccagaaaaggacagcagcgggaattatgaagaatccaactgtagacggtatagtagccatagaccttgaccctgtagtttatgacgctaaatttgaaaaacaattaggccaaatcatgttattaattttgtgtacaagccaaattctattaatgcgaactacatgggcattgtgtgagtccataaccctagcgacgggtccgttaaccactctatgggaaggaagccccggcaaattttggaatacaactattgcggtaagcatggctaacatctttagaggcagttatctggctggcgcaggattggcgtttagcctaatgaaatcactaggagggggccgacgaggcacaggagcccaaggagaaacactgggagaaaagtggaaaaggcagctaaaccaactaagcaagagtgagttcaatacctacaaaaggtctggaattatggaagtagaccgaagtgaggcaaaagagggactaaaaaggggcgagacaactaaacacgcggtatctcggggaaccgcaaaactgagatggtttgttgaaagaaatctagtaaagcctgaaggaaaagtaattgatctaggttgcggaagagggggttggtcatattattgcgcagggctaaagaaagtcacagaagtaaaaggatatacaaagggaggccccggacacgaggaaccaatcccgatggcaacatatggttggaatttggtgaaactacattcgggcaaagacgtcttctttatcccaccagaaaaatgcgacacattgttatgtgatatcggcgagtctagccccaaccctacgatagaagagggcagaactctaagagtgctgaaaatggtcgagccttggctacgtggtaatcagttttgcataaaaatattaaatccttatatgccaagtgttgttgagacgctagaacagatgcagaggaaacacggagggatgttggttaggaatcccttaagtagaaattccacacacgaaatgtactgggtttcctgtggaactgggaacatagtctcagcagtgaacatgacgagtagaatgctattaaaccgctttacaatggcacacaggaaacctacgtatgagcgggatgtggatttaggagccgggacacggcacgttgccgtagaacctgaggtcgcaaatttagatataataggtcaaagaatcgaaaatataaagcatgaacataaatcaacttggcattatgacgaagacaacccttacaaaacctgggcatatcatggctcctatgaagttaaaccaagtgggtcagcatcaagcatggttaatggcgtcgtgaaactcttgacgaagccatgggatgtaatcccaatggtaacccaaatcgcaatgactgataccacaccattcggacaacaacgagtttttaaagaaaaagttgacacaagaacaccgaaggcgaagagaggaaccgcccaaattatggaagttacagccaagtggctatggggatttctaagccgaaacaaaaagccacgcatatgcaccagagaagaatttacaaggaaagtaagatctaacgcggctataggcgcagtgtttgtggatgaaaaccaatggaactctgccaaagaagcggtcgaagatgaacgattctgggacttagtacatagagagcgagagctgcataaacaaggaaaatgcgcaacatgtgtgtataacatgatggggaaaagggaaaagaagctaggcgaatttgggaaagcaaaagggtccagagcaatttggtacatgtggctaggagcaagatttctagaatttgaagcacttggattcatgaatgaagatcactggttttcccgtgaaaattcactttccggtgttgaaggtgaaggactgcataaacttggatacatattgcgggatatttctaaaattccaggtggtaacatgtatgctgatgataccgccggatgggatacacggatcacggaagacgatttacagaatgaagccaaaattacagatataatggagccggagcacgcactcctggccaaaagcatattcaaactaacgtaccagaataaagtagttagggttcaaagacctgcgaaaaacggtacagtgatggacgttatttcaagacgtgaccagagagggagtggtcaagttgggacctacggtttaaatacatttacgaatatggaagctcagcttattagacaaatggaatctgaaggaatcttttcgccgagtgaattagaaactcctaatttagctggtagagttctggattggcttgaaaagcatggtgtagaaaggcttaaacgtatggctatttctggtgatgattgtgttgtaaagcccattgacgatcgattcgcagctgcattaacagcactaaatgatatgggaaaagttcgaaaagatatacctcaatgggagccatcaaaaggatggaatgattggcaacaagtcccgttttgttcacaccactttcaccaactaattatgaaagacggtcgagagattgtagtcccatgccgtaatcaggatgaacttgtaggtagagctagagtatctcagggggcaggttggtcccttagagaaactgcgtgtctcggaaaaagttatgctcaaatgtggcaattgatgtattttcatcgtagagatttaagattggcagctaacgccatttgtagtgcagtaccggttgattgggtgccaacatcaagaacaacttggtcaatacacgcgcatcatcaatggatgactaccgaggatatgttaagtgtctggaaccgtgtctggatagaagaaaacccatggatggaggataaaacgcatataagtagttggggtgatgtaccgtacctcggcaagcgtgaagatcaatggtgtgggtccttgataggacttaccgcaagggctacctgggctacaaacattcaagtggcaattaaccaagtacggagactaatagggaacgaaaactacttggattacatgacatccatgaagcggtttaaaaacgaaagtgatccagaaggggccctatggtaa

SEQ ID NO: 21870 - RNA, 9879 nt, synthetic construct
  misc_feature 1..9879: note = derived and/or modified CDS sequence (opt6) from DENV-1__GU131806__SS-prME
  source 1..9879: mol_type = other RNA
agtgttaccatgttcctaatgttaatgcccactgcactcgcattccatctaactactagaggtggagaaccacatatgattgtaagcaaacaagaacgcggaaaaagtctacttttcaaaacgtcagcaggagttaacatgtgcacattaatagcaatggatctaggagaactctgtgaagatactatgacgtataaatgtcctagaatcacagaaacagaacctgacgacgtcgactgctggtgcaatgctacagatacatgggtcacgtacggaacctgcagtcaaactggagaacacaggcgtgacaaaagaagcgttgcactggctcctcacgtgggcttaggtttagaaacacggacagaaacatggatgagttcggaaggggcttggaaacaaatacaaagagtagaaacatgggcgttgaggcaccccggatttacagtaattgcgctttttcttgctcacgcaataggaacatcgataacacaaaaaggaatcattttcatcctactcatgcttgtaacacccagtatggcaatgagatgtgtgggtattggatcacgagatttcgttgaaggcttgtcaggagcgacgtgggttgatgtcgtcttagaacatggttcgtgtgtaacaaccatggctaaagataaaccgactctagacatagaactacttaaaaccgaagtaacgaatccggctgttctaagaaagctctgtatcgaagccaagatttctaatacaactactgatagtcgttgccctactcaaggtgaagctacgttagtagaagaacaagatgcgaattttgtatgcaggaggacttttgttgatcgcggatggggcaacggatgtggactttttggcaaagggtcattaattacttgtgcaaaatttaaatgcgtgacaaaactggaaggaaaaatcgtacaatacgaaaacttgaagtattccgttatcgtaacggttcacacgggtgatcaacatcaagtcggaaacgaatcaaccgaacatgggacaactgcaacgattaccccacaagcgcctacaactgaaatacaactaaccgactacggcgcactaacgttggattgctcaccaaggacaggcctggatttcaacgaaatggtattattgactatgaaagagaaatcatggttggtccacaaacaatggttccttgacttaccgttagcttggaccagcggaggcagcacatcacaggaaacctggaatcgacaagatctcgtagtgacatttaagactgcgcacggcaagaaacaggaagtagtagtactcggaagtcaagaaggcgccatgcatactgcactcacgggagcgactgaaatacaaacaagtggcacgaccacaatattcgctgggcatctcaaatgcagattgaaaatggataaactaacgttaaaaggtatgagttacgtaatgtgcactggatcatttaagttagaaaaagagcttgcggaaacacaacacggtaccgtccttgttcaaataaaatatgaaggaacagacgcgccgtgcaaaattccctttagtacgcaagatgagaagggtgttacacagaacggtagactaataactgcaaacccaatagttacggataaagaaaagcccgtaaacatagaagcagaacctccattcggggagtcatacatagtcatcggggcaggcgagaaggcactgaaattaagttggttcaaaaagggctctagtattggaaaaatgtttgaggcaacagcgcgaggtgctagacgcatggcgatactcggagatacagcatgggactttggcagcattggaggtgtatttacgtctgtaggcaaactggtgcaccaaatatttggaacagcatatggagttctatttagtggtgtatcttggacgatgaaaatcggcataggtgtactactaacatggcttggactaaactcaagatccacatcattgagtatgacatgcatagcagtcggcctagtgacattatatttaggagtaatggttcaagctgatagtggctgcgtaataaattggaagggacgagagttgaagtgtggttcgggaatatttgtcacaaacgaggtgcatacctggacagagcagtataaatttcaagccgactcacctaaaagattatccgcggctatcggaaaagcctgggaagagggggtatgcggtataagatccgcaactcggttagaaaatataatgtggaaacagatatcaaatgaacttaaccacattctattggaaaatgacatgaaattcacggtcgtggtaggcgacgtcgcaggtatattagcacagggtaaaaagatgatacgaccacaaccaatggagtacaagtattcttggaaaagctggggtaaggctaagattataggtgctgacgtgcaaaacacaacattcataatagatggccctaacacgccagagtgcccggatgatcagagggcatggaatatctgggaggtggaagattacgggtttgggatttttaccaccaacatctggttaaaattacgcgattcatacacccaagtatgcgatcatcgcttaatgagtgcagcaattaaagactctaaagcagtacatgcagacatgggatattggatagaatcagagaaaaatgaaacctggaagttagcacgagcctcttttatcgaagtaaaaacatgcatatggcctaagagccatactttatggtcaaatggagttctggaatcagaaatgataataccgaagatttacggaggtccgatttctcagcataactataggccaggatattttactcaaactgcaggaccgtggcatctcgcgaaactcgagttagacttcgatctttgcgagggcacgacagttgttgtagatgaacattgcggaaaccgaggaccctcgttaagaacgacaactgtaacaggtaaaatcatacacgaatggtgctgtagaagttgcactttaccccctcttagattcagaggtgaggacggatgctggtacggcatggaaatcagacccgttaaagaaaaagaagaaaatttggttaagagcatggtgtcagcaggttcaggtgaagtggattcattttccctagggttgctatgtatcagcataatgatcgaggaagttatgagatcgaggtggtcacgtaaaatgttgatgaccggtacgcttgccgtattctttctactaatcatgggacaattaacatggaatgatctcatacgactgtgtattatggtaggagcaaatgcctccgataggatggggatgggcaccacttatttggcattaatggctacgttcaagatgagaccaatgttcgccgttggtctgctgttcagaagactaacatctagagaagtgttactactgaccattggactgtcacttgttgcaagcgtcgaactaccaaactcattggaagaactaggagatggactggcaatgggaataatgatattaaaattgctcaccgattttcaatcccatcagttgtgggccacattattatcattgacattcattaaaactacattctctctacattatgcatggaaaaccatggcaatggttctatccattgtaagtttattcccactatgcttatcgacaacaagtcagaaaacgacttggttaccagtactcttaggatctttgggatgtaaaccgctaacaatgtttttaattgcggaaaataaaatttggggtagacgatcctggcctttaaacgaggggataatggccgtaggaattgttagcattcttctctcgtctcttctgaaaaatgatgttccattagcagggcctctaattgctggcggcatgttaatagcctgttatgtaataagcggatcttcggccgacttatcattagaaaaagcggcagaagtatcttgggaagaagaagcagagcatagtggaccaagtcacaacattcttgtggaagtacaagatgatgggccaatgaaaattaaagatgaagaaagggacgatactctcacgatattactcaaagccacactattggccgtaagcggagtctatccattaagcatacctgcaacactatttgtctggtatttctggcaaaagaaaaagcaaaggtctggggtcttatgggacactccctcacctcctgaggttgagcgcgcagttcttgatgacggtatatacagaataatgcaacgtggtcttctaggacgatcccaggtgggggttggtgtttttcaagagaatgtattccatactatgtggcatgtcactcgaggtgcggtactgatgtaccaaggaaaaagactcgaaccctcgtgggcatcagtgaagaaagacttgatatcatacgggggaggttggcgtttacaagggagttggaatacaggtgaggaagtgcaagtaatcgccgtagaaccgggtaaaaatcctaaaaacgttcagacagctcctggaaccttcaaaacccctgaaggtgaagtcggtgctatagctttagatttcaaacccggaacctctggaagccccatagtgaatagggaaggcaaaattcttggcttgtacggaaatggagttgtaaccacttcaggaacgtatgtgagcgccatagcccaagccagagcttcccaagaaggtcccctaccggagatagaagatgaggtttttagaaaacgaaatctcactataatggatttgcatccaggctctgggaagactcggcgatatttacctgccatcgtgagggaagcgataaagagaaaattgaggacattaattttagctcctacaagagtagttgcatctgaaatggccgaagccctaaaggggatgccaataaggtatcaaacaacagcagtcaagagtgaacacacgggtaaagaaattgtcgatctgatgtgtcatgccacttttacgatgcgactactgagtcctgtaagggtccccaattataatatgataattatggatgaagcgcattttacagacccgtcatcaatagctgcccgaggatacataagcacaagagtcggcatgggggaagcagcggcaatttttatgacagcaacacccccaggtagtgtagaggcttttccgcagagtaatgcagttatacaggacgaggagagagatattcctgaacgaagttggaacagtggatatgaatggataaccgattttcctggcaaaacagtatggtttgtcccttcaattaaaagtggcaatgatatagctaactgtttgcgaaagaacgggaagcgagttatacaactatcaagaaaaacattcgatacagaataccagaagactaaaaataacgattgggattacgtagtaacgactgatatatcagagatgggcgcaaatttcagagcagatcgcgtaatagatccgagaagatgcctaaaacctgtgatactcaaagatggaccagaaagggtgattctcgcgggaccaatgccagtaaccgtagcctctgcagcccagagaagaggtcgaatagggagaaaccataataaagagggcgaccagtacatatatatgggacagccgttaaacaatgatgaagatcatgctcactggacagaggcaaaaatgctcttagataacataaatacgcctgaagggatcattccagcactgttcgaaccagaacgagagaaatcagcagctatcgatggagagtatagactaaggggcgaagcacgcaaaaccttcgtagaacttatgaggagaggggatttaccagtttggctgagctataaagtagcaagtgagggtttccaatatagtgacaggcgatggtgttttgatggtgaaaggaataaccaagttcttgaagaaaatatggatgttgagatatggacaaaagaaggagagcgtaaaaagctaagacctagatggttagacgcccgtacatacagtgatccgttagctttacgagagttcaaagaatttgccgcagggagaagaagtgtcagtggtgatttaatcttagaaatcgggaaattaccacaacatttaacgcagagggcacaaaacgcactagataacttggtcatgttacataatagtgaacaaggagggcgggcataccgtcatgcgatggaggagcttcctgatacgatcgaaactctgatgctgttagccttgatagccgttttaacaggaggtgtaacactcttcttcttgtcaggtcgaggcctgggcaagacaagtataggactactgtgtgttatggccagctcggttcttttatggatggccagtgtagaaccacactggatagctgcatcaatcatactagaatttttcctgatggtcttgttaatccctgaacctgacagacaaaggaccccacaagacaaccagttggcttacgtagttatcggactactcttcatgatcctcactgtcgcggcaaacgagatgggactactggaaacgacaaagaaagacttaggcattggacacgtagccgtagaaaaccaccaccatgctgctatgctagacgttgatctgcacccagcctcagcttggacattatacgcagttgcaacaactataattacccccatgatgcgtcacaccatcgaaaatacaactgctaatatcagcttgactgctattgcaaaccaagcggccatattaatggggttagataaaggatggccaatcagtaaaatggatataggtgtaccacttctcgccctgggatgctatagtcaagttaatccgttaacgctcacggcagcggtactaatgttagtagcacactacgcaataataggcccaggtcttcaagcaaaagcaactcgggaagctcagaaaaggacggccgctggaataatgaagaacccaactgtagacggcatcgtagcaatcgatcttgacccggtggtatacgatgcaaaattcgaaaaacaactaggacaaattatgctactgatcctctgtacatctcaaatccttttaatgagaacaacttgggcactttgcgaaagcataacccttgctactgggcccctaactacactttgggaagggagccctggaaaattttggaacaccaccatagctgtatcaatggctaacatttttagaggttcatacttggccggtgcggggttggctttctcgttaatgaaatcactaggaggcggtcggagagggactggagctcaaggggagaccttaggagaaaagtggaaacgacaactcaatcaattaagtaaaagtgagtttaatacatataaacgaagtggtattatggaagtcgatagatctgaggcaaaggagggattaaagcgaggtgaaactaccaaacacgcagtatctcggggcactgcaaaattgagatggtttgttgagagaaacctcgtaaaacccgaaggtaaagtaattgacctcggatgtggaagaggaggttggagttattattgcgccgggcttaagaaagtgacggaagttaaaggttatacaaaaggcggccctggtcacgaggagcctatacccatggcaacatatggatggaacctagttaaattacattcaggaaaggatgtcttcttcatacctccagagaaatgtgacactttactatgcgatattggggaatcaagtcccaatccaactatagaggaaggcaggactctaagagtgctaaaaatggtggaaccatggttaagaggcaatcaattctgtataaaaatattgaacccttatatgccatcagttgtcgaaactttagaacaaatgcaacgtaaacacggcggtatgttagttagaaatcccttaagtaggaacagtactcatgaaatgtattgggtcagttgtggaacaggtaatatagtatctgcagttaatatgacatctagaatgctattgaaccgttttaccatggcccataggaaacccacatatgaacgggacgtagatcttggagcaggtactcgacatgtagcggttgaacccgaggtcgccaacctcgacatcataggacaacgaatagaaaacattaaacatgaacataaatccacatggcattatgatgaggataacccctacaagacatgggcttatcatggttcgtacgaagttaaaccgtcgggaagtgcatcgtcaatggtaaatggtgttgtaaaactattaacaaaaccttgggatgttataccaatggtgacacaaatcgcaatgacagacacaactccattcgggcaacaaagagtatttaaggaaaaagtagacacacgaactccgaaagctaagagaggtactgcgcagattatggaagtcacagctaaatggctatggggatttttgagtaggaacaagaaaccacgtatctgtactagagaggaatttaccagaaaagtaagatcaaacgcagcgataggtgccgtctttgtagacgaaaaccaatggaatagtgcaaaagaagcggttgaagatgaacgtttttgggatctagtccacagagaacgagagctgcataagcaaggaaaatgtgcaacatgcgtatacaacatgatgggtaaacgggaaaagaagctgggagagttcggaaaagcaaaagggtccagggctatctggtacatgtggttaggagctcggtttctcgaatttgaagcactcggatttatgaatgaggatcactggttttctagagagaactccttgagtggcgtagaaggcgaaggtttgcataaattaggttatatacttagggatattagcaaaatacccggaggcaatatgtatgcagatgacacggcaggttgggacacaagaataactgaagatgacctccaaaatgaagcaagaatcacagacataatggaaccagaacatgcccttctagcaaaatcaatatttaaattaacataccaaaacaaagtagttcgtgtccaaaggcccgccaaaaatgggacagttatggatgttatatcacggcgggaccagagaggttcaggtcaagtaggtacttatgggttaaatacctttacaaatatggaggcccaactaatcagacaaatggagtctgaaggaatcttttcacctagtgaattagaaacgccaaacctggcagaaagagtgttagactggttggagaaatacggagttgaaaggttgaaaagaatggctataagcggtgatgattgcgtcgttaaacctatcgatgataggttcgcgacagctcttacagccctcaacgatatgggaaaagtacgaaaggatataccgcaatgggaaccatctaaggggtggaatgactggcaacaggttccgttttgcagtcatcattttcaccaattaattatgaaagacggacgcgaaatagtagtcccatgtcgaaatcaagatgagctagttggccgtgccagagtgtcacaaggtgcgggatggtctttgagggagacagcatgcctaggcaaatcctacgcgcagatgtggcaactaatgtactttcacaggagagacttgagattagccgcaaatgcaatttgctccgcagtgccagtggattggatacctacttcacgcaccacttggagtatacatgcacatcaccaatggatgacgactgaagacatgcttagtgtctggaatcgagtttggatagaagaaaatccgtggatggaagataaaacacacataagttcatggggagacgttccatatttaggaaaaagagaggaccaatggtgcgggtcattaattggtttaacagcaagggcaacatgggcgacaaatatccaagtcgcaataaaccaggtaaggcgacttatagggaatgaaaactatttagattatatgacctcaatgaaaagattcaaaaatgaaagtgatccagaaggagccttatggtaa

SEQ ID NO: 21871 - RNA, 9879 nt, synthetic construct
  misc_feature 1..9879: note = derived and/or modified CDS sequence (opt6) from DENV-1__GU131807__SS-prME
  source 1..9879: mol_type = other RNA
agtgttacaatgctcctaatgcttatgccgacggcactagcctttcatcttacaacaaggggaggagaaccgcatatgattgttagtaaacaagaacgaggaaaaagtctcttattcaaaacaagcgccggtgtaaacatgtgcacactcattgctatggacctgggagaactatgtgaagacacaatgacttataaatgcccacgtataacagaaacagagccagatgatgtggactgctggtgtaatgcaactgacacgtgggtgacgtatggtacgtgtagtcaaactggagaacatcgccgagataaaaggagtgtagccttggcaccacatgttggactaggacttgaaacaaggacagagacatggatgagtagtgagggagcctggaaacagatacagcgcgtggaaacatgggctctaagacatcccggattcactgttatagctctctttctagcgcatgcaataggaacgtctattacgcaaaaagggattatttttatcttgttaatgttagttactccttctatggctatgcggtgcgtaggaattggcagcagagactttgtagaaggactaagcggcgctacttgggtggacgtagttttagaacatggttcatgtgtgactacaatggccaaagacaaaccaacattagatatcgaactactgaaacctgaagtaacaaatccagctgtactgagaaaactgtgcatagaagcaaaaatatcaaacacgaccaccgattccagatgcccaacacaaggggaagctacacttgtcgaagaacaagacgcgaacttcgtttgccgtcgcacattcgtagatagaggctgggggaatggctgtggactctttggaaaaggatcactaataacgtgcgctaaattcaaatgtgttactaaacttgaaggcaaaattgttcaatatgaaaatctcaaatacagcgtgatagttacagttcatactggagatcaacatcaagtaggaaatgaatcaaccgaacatgggacaactgcaacaataactccgcaagcaccgacaacggaaatacaattaacagattatggagctctaaccctggactgcagcccgcggacaggactggatttcaatgaaatggtccttgtaactatgaaagaaaaatcttggttagttcataaacaatggtttttagacctaccccttccatggacgagcggtgcttcgacaagtcaagaaacctggaacagacaagatcttctagttacgtttaaaactgcacacgccaagaaacaagaagttgtagtcttgggttcacaggaaggagcaatgcacacagccctaacgggtgcaacagagatccagacttccggcaccactactatttttgcaggtcacttaaaatgtagattaaaaatggataaattgaccttaagaggaatgagctatgtaatgtgcacgggaagtttcaaattagagaaagaagtagccgaaacgcaacatggcaccgtattagtgcaaataaaatacgaaggtacagacgcaccgtgtaaaatcccattttctacacaagatgaaaaaggggtaacgcaaaatggacgtctgatcacggcgaatccgattgttacagacaaagaaaaaccagtaaatatagaagcagaaccacctttcggcgaaagttacatagtgattggagcaggagaaaaggctttaaaactttcctggtttaagaaaggctctagcattggaaagatgtttgaagccacagcccgcggggcgcgcagaatggccattcttggtgacacagcatgggactttggaagtatcggaggagtattcacatccgttggaaaacttgtacaccaaattttcggcccggcgtacggggttctattttcgggagtttcttggccaatgaaaatcggaataggagttttattaacttggctaggtttaaacagccgtagtacctccttaagtatgacatgtatagctgtcgggctagtaactctatacttgggcgtcatggtgcaagcggactctggatgcgtgataaattggaagggaagggaacttaagtgtggtagcggaatctttgtaaccaatgaagttcacacatggactgagcagtataagttccaagctgattcaccgaaacgattaagcgccgctattggcaaagcgtgggaagaaggcgtatgtggtattaggagtgctaccaggcttgaaaacattatgtggaaacaaatttcaaatgaacttaaccatatattattggaaaatgatatgaaatttacggtagtcgttggcgacgtggcaggaatcctagcacaaggtaaaaagatgattcgtccgcaacctatggaatacaaatacagctggaaatcatggggtaaagcaaaaataataggagctgatgttcaaaacacaaccttcataattgatggacctaacacgccagaatgccccgacgatcaacgagcatggaatatatgggaagtagaagactacggtttcgggatttttacgactaacatatggctcaaattgagagacagctatacccaagtgtgtgatcacagattgatgagcgcggcaattaaagacagcaaggctgtccatgcagacatgggctactggatagaatcagagaaaaatgaaacatggaaactcgccagagcatcttttatagaggtgaagacttgtatatggcctaaatcacacacgttatggagcaatggcgttttagaatcagaaatgattataccgaaaatttacgggggtccgatatcacaacataactatcgtcctggttatttcacacaaacggcaggaccttggcacctaggtaaattagaactagactttgacctatgtgaaggaacaacagtcgtagtagatgatcattgcggaaaccgaggaccatctttaagaacgactacagtcacaggaaaaataatacatgaatggtgttgcagatcttgtacgttaccccctctaaggttcagaggggaagacggctgctggtatggcatggaaattaggccagttaaagaaaaagaagaaaacctagtgaagtctatggtctcggccggctctggagaagtagatagtttctcattaggattgttatgcatttcaataatgattgaggaagttatgcgttcacgatggtcacgtaaaatgttaatgactggcacattagctgtattctttttgttaattatgggacaacttacgtggaacgatttaatcaggctatgtatcatggtcggtgcaaatgcgtccgaccggatgggaatggggacaacctatctcgccctaatggcaacatttaaaatcaggcccatgttcgcggtaggactcctttttcgacgattaaccagtcgggaagttttgctacttacgattggtttaagtctcgtggcttcagtggagttaccaaattctctagaagaactaggagatggattagcgatgggcattatgatattaaaactgctgacggacttccaaagtcatcaattgtgggcaacattattaagcctaacttttataaaaacgactttttctttgcactgtgcatggaaaacgatggcaatggtcttgagcattgtctccctattcccattatgcttatcaacaacatctcagaaaactacatggttacctgttttgcttgggtcacttgggtgtaaacctctaacaatgtttctaatagccgaaaataaaatttgggggagaagatcatggccccttaacgaaggaataatggcggtcggaatcgtatctatactattaagcagtctgctcaaaaacgacgtccctttagcaggcccactaattgcaggaggaatgctgatagcatgctacgttatctccggaagctcagcagatctgtcgctggaaaaagcggcagaggtgtcctgggaagaagaagctgaacattcgggtgctagccataacatactggtagaagtgcaggatgacggaacaatgaaaataaaggacgaggaaagagatgatacattaaccattctgttaaaggcaactttattagccgtctcaggggtatacccgctcagtatacccgctaccctgttcgtatggtatttctggcagaagaagaaacagcgtagcggagtactttgggataccccaagtccccctgaagtagagagagccgtacttgacgacggaatctatcggatcatgcaacgcggacttctgggaaggtcacaagtgggagtaggtgttttccaagagaatgttttccatactatgtggcatgttaccagaggagccgttctaatgtatcaagggaaaagattagagccttcgtgggcaagtgtcaagaaagacttgatatcatacggcggtgggtggcgcctccaaggttcctggaataccggcgaagaagtacaagtaattgccgtcgaaccgggaaagaatccgaaaaatgtacaaactgctcctggtacattcaaaacgcctgaaggagaagttggtgcgatcgcattagatttcaaaccaggaacgtcaggatccccaatcgtaaatagagagggtaaaattgtcggtctctacggaaatggtgttgttacgacgagtggcacttacgtaagcgcaatcgctcaagctaaagcctcacaagaagggccacttccagagatagaagacgaagtattcagaaaaaggaatcttaccataatggatttgcacccaggctcaggcaaaacaagaaggtatttaccagcaatcgtacgggaggctataaaacgaaaactaagaacgctgatattggccccaactcgagttgtagcctcagaaatggcagaggcactgaagggaatgccaatacggtatcagaccactgcggtaaaaagtgaacataccggtaaggagattgtagatttaatgtgccacgcaaccttcactatgaggctactaagtcccgtcagagtgcctaactataacatgattataatggacgaagctcatttcacagatccaagtagtatagctgcaagaggttatattagcacgagggtagggatgggagaagcggcagccattttcatgacagccacaccacctgggtccgtcgaggctttccctcaaagtaatgcagtaatacaagacgaagaacgagatattccagagagatcatggaactcaggatatgaatggataacagactttcctggtaaaactgtttggtttgtaccaagtataaaatctggcaacgatattgccaactgccttaggaaaaacgggaagagagtcatacaactctcacgtaagacttttgatacagaataccagaaaaccaaaaataacgattgggattacgtagtcaccaccgacataagcgagatgggagcaaatttccgtgcagatcgagtaatagatcctcggaggtgtttaaaaccagtgatactaaaggatggtccagaacgagtaatattggctggacccatgccagttactgtagcatctgccgctcaaagaagaggacgcatcggacggaatcacaataaagaaggagatcaatatatatacatgggacaacccctcaataacgacgaagaccatgctcactggacagaggcgaaaatgctcttggacaacatcaacacccctgagggaataatcccggcactctttgagcctgagagagagaaaagcgcagccatagatggagaataccgattgcgtggtgaagccagaaagactttcgtggaactcatgagaagaggcgatctaccagtctggttaagttacaaagttgcatcagagggcttccaatattccgacagaaggtggtgttttgatggtgaaaagaacaaccaggtactagaggaaaacatggatgtagaaatatggacaaaagaaggagaacggaaaaagctaagaccgagatggctggacgcaaggacatactcagatccgttagctttacgcgagtttaaagaatttgcggccggtagaagatctgtttctggtgacttaattttagaaatcggtaaacttccacagcacctgacacaacgagctcaaaatgcccttgacaatttggtaatgttacataacagtgaacaaggaggtcgggcatacagacatgccatggaggaattgccggacaccattgaaactctgatgttactggctctgattgcagtattaactggaggggtcacgttattctttctaagtggacgtgggctaggaaagacatctattggattactttgcgtaatggcaagcagtgtcttgctatggatggcatcagttgaaccgcactggattgcggcatccattatcctagagtttttcttgatggtactgttaatcccagagcccgacaagcaaagaacgccacaagataaccagttggcatacgtagttataggccttctttttatgatcctaacagtcgcagccaatgagatgggactcctagaaacaactaagaaagacctagggattggacacgtggcggtcgagaatcatcaccacgcagcaatgttggatgtagatcttcacccagcttccgcatggactttatatgcagtagctacaactattattacgccaatgatgagacatactattgaaaatactactgccaatatttcactgaccgccattgcaaatcaagctgcaatcctcatgggtctagacaaaggatggccaatatccaaaatggacattggagtaccactattagctttaggctgctatagtcaggttaatcctctaaccttaaccgcagccgtactaatgcttgttgcgcattatgctataattggtccaggactacaagcgaaggcaacaagagaagcccagaagagaaccgccgcaggaataatgaaaaaccccacagtggatggcatagtagctatagatctcgacccagtggtgtacgacgctaaattcgaaaaacaactaggccaaataatgctattaatattatgtacttctcaaattttattaatgcgaacgacttgggctctttgtgaaagtataactctggctactggaccattgaccacactctgggaaggttcgcctggaaagttctggaacacaactatagcagtgagtatggcaaacatatttcgaggatcgtacctcgcgggtgcaggcttagcgttttcgctcatgaagtccttgggtggagggagacgtggaaccggcgcacagggagaaactttaggggaaaaatggaaaaggcagctcaatcaattatccaaatccgagtttaatacatataaacgatcaggcattatggaggttgacagatcagaagcaaaagaaggactgaagagaggggaaacgaccaagcacgcagtgagtcgagggactgcaaaactacgttggttcgtagaacgaaatttagttaaaccagaagggaaagtaatagatttaggatgtggacgaggaggatggtcatactattgcgcaggcttaaagaaagtaacggaggttaaagggtataccaaaggaggtccaggtcatgaagaacctataccaatggccacgtacggatggaatttagttaaattacattctggcaaagacgtatttttcattcccccagaaaagtgtgacacgcttctatgtgatattggagaatcatctccaaatccaactatagaagaaggtcgaacgttgcgagtattaaagatggtagagccatggttacgaggtaatcaattctgtatcaaaattcttaatccatatatgccttcagttgtcgaaactctagaacaaatgcaacgaaaacacggtggtatgttggtcagaaatcccttgagtaggaacagtacccacgaaatgtactgggttagttgcggaactggtaatatagtgtctgcagtaaatatgacatctcgaatgctattaaataggtttactatggcgcatcgcaaacccacttatgagcgcgatgtagacttaggcgcaggaacacgacatgtagccgtagagccagaggtagctaacttagacattattggacaaagaattgagaatattaaacatgaacataaatcgacttggcattacgacgaggataacccatacaaaacttgggcttaccatggatcttatgaagtaaagcctagtggctcagcatcaagtatggtaaatggagtcgtaaaactcttgaccaagccgtgggacgttataccaatggtcacacaaattgcgatgacagatacaacaccgttcggacaacaacgagtcttcaaagagaaagttgatacacgaactcccaaggctaaaagaggtactgcccaaataatggaagttacggcaaagtggctctggggattcttatcccgtaacaagaaaccaagaatatgcactagagaagagtttacaagaaaagtgcgaagtaatgcagccattggggctgtttttgtcgacgaaaatcaatggaactctgctaaagaagcagttgaagatgagagattctgggacctggttcatcgggaaagagaactacataaacagggtaagtgtgccacatgtgtatataacatgatgggtaaaagagagaagaaattaggtgaatttggaaaagcgaaaggctcgagggcaatctggtatatgtggctaggagcgagatttttagaatttgaggccttaggttttatgaacgaagatcattggttctcaagagaaaactctcttagtggtgtcgagggtgaggggctccataaacttggatatattctcagggatatctctaaaatacctggcggtaatatgtacgcggacgatacagccggctgggacacaaggataacagaagacgatttacaaaatgaagctcgtatcacagatataatggaaccagagcacgctcttttagcaaaatcgatatttaaactaacgtatcaaaataaagtcgtaagagtccaacgcccagccaaaaatggaacagtaatggacgtgatttccagacgtgaccaaaggggttcgggccaagtgggaacatatggtttaaacaccttcactaacatggaagcgcagcttataagacaaatggaaagtgaaggtatattttcaccctcagaacttgaaacacctaatcttgccgagcgtgttctggactggttagagaaatatggggtagaacgcctaaagaggatggctattagtggtgacgattgtgtagtaaaaccgatagacgatagatttgcaactgcactaactgcacttaatgatatgggcaaggttcgtaaagacatacctcaatgggaaccttcaaaaggatggaatgattggcaacaagttccattctgttcacaccactttcatcagctaataatgaaagacggacgagaaattgttgtaccctgtagaaatcaagatgagctagtcggcagagctcgtgtatcccaaggcgcgggatggtcgctgagagaaacagcctgtttaggaaaatcttatgcgcaaatgtggcagctcatgtacttccaccgcagagatctacgtctagcagcaaatgcaatttgctctgctgtgccagtagattggatccccacctcccgtacaacatggtcaattcatgcgcaccaccaatggatgacaactgaagacatgctatccgtttggaaccgagtctggatagaagagaatccatggatggaagacaagacccatatttctagttggggtgacgttccatatctaggtaaacgggaagatcaatggtgtggaagtcttattggattaaccgcacgagcaacttgggctacaaacatacaagtagcaattaatcaagtacgtcgactaataggaaacgaaaattaccttgattatatgacgtcaatgaaacgatttaagaacgagagcgatccagaaggagcactgtggtga

SEQ ID NO: 21872 - RNA, 9879 nt, synthetic construct
  misc_feature 1..9879: note = derived and/or modified CDS sequence (opt6) from DENV-1__GU131811__SS-prME
  source 1..9879: mol_type = other RNA
tcggtgactatgttattaatgcttatgccaactgctctagcatttcatttgacgacgcgaggtggagaaccacatatgatagtttcaaaacaagagaggggaaaaagtcttctattcaaaacgtctgcaggcgtaaatatgtgcacactgatcgcaatggacttaggcgagttctgtgaagatacaatgacatataaatgtccaagaatcaccgaagcggaaccagacgatgttgattgttggtgcaacgccaccgatacgtgggtaacatacggcacatgctctcaaataggcgaacaccgtcgtgataaacggtcggtagctcttgccccacacgttggcctcgggctcgaaacacgaaccgagacatggatgtcatctgagggcgcatggaaacagatacaacgggtggaaacatgggcacttaggcatccgggattcactgttatcgcattatttttagcacatgcaataggaactagcatcacgcaaaaaggaatcatatttatccttctaatgctagtcacaccctcaatggcaatgcgttgcgtcggaataggatcgagagacttcgttgaagggttgtcgggtgcaacctgggtcgatgtagtacttgaacacggtagttgtgtaacaaccatggcaaaagacaaacctactttggatatcgaattactcaaaacagaggtgactaaccctgccgtattgagaaaattgtgtattgaagccaaaattagtaacacaacgacagacagtcgctgccccacccaaggagaggctacgttggttgaagaacaagacgcaaacttcgtttgtcgacgaacattcgtagaccgtggttggggcaatggttgtgggctgtttggcaaaggctctctaattacttgtgctaaatttaaatgtgtaacaaaacttgaaggaaaaatagttcaatatgaaaatctaaaatactcagtcatagtaacggtacatacgggggaccaacaccaagttgggaacgagtcaactgaacatggaaccacagcaactataactccacaggctccctctactgagatccaattaactgactatggcgcattaacattggattgttctccaagaaccggtctggactttaatgaaatggtcctattaaccatgaaagagaaatcttggttggtacataaacaatggtttctggatctaccactcccatggacaagcggcgcatctacttcacaagaaacctggaaccgccaagatctattggtaacatttaaaacagcccatgcgaaaaagcaggaagtagtcgtgcttggctcacaagaaggtgcgatgcataccgcacttactggggctaccgaaatacagacctcaggtacaacgactatttttgcaggtcatctaaaatgtagattaaaaatggataaacttacgcttaaaggaatgagttatgtaatgtgtacgggatcctttaaattggaaaaagaagtcgcagagacgcaacatggaacagtgttagtgcaaatcaaatatgagggtactgatgcgccatgtaaaattccattcagcacgcaagacgaaaaaggtgtgactcaaaacggtagattgattacggccaatccgatagtaacagacaaagaaaaacctgtgaatatagaggcagagcctccatttggtgaatcatatatagtaataggcgttggagagaaagccctaaaactctcatggtttaagaaaggaagctcaataggaaaaatgtttgaaacaacagcacgtggtgcccgacgaatggcaatattaggtgacactgcgtgggattttggaagtataggtggtgtatttacaagtgtaggtaagttagtacatcaaattttcggaacagcatacggtgtactattttcaggcgtgagctggacgatgaaaataggaataggggtactgctaacatggttagggcttaattcccgttcgacatccttgtccatgacttgcattgcggtcgggctagttaccctttatcttggcgtgatggttcaagcagatagtggctgtgtaattaactggaaaggtcgcgaactaaagtgtggctcgggcatttttgttacaaatgaagtacatacatggacagaacaatacaaattccaggctgattcgccaaaacgtttaagcgcagcaataggtaaagcctgggaagaaggagtttgcgggatacggtccgctactagattggaaaatattatgtggaagcaaatttctaatgagttgaatcacattctactcgaaaacgatatgaaattaacagtagtagttggcgacgtagccggaatactagcacaaggaaagaagatgattcgacctcagcccatggagtacaagtacagctggaaaagttggggaaaggcaaagataatcggggcggatgttcaaaatacaacatttatcattgacggcccaaacacacctgaatgcccagacgatcagagggcttggaacatttgggaagtagaagattatgggtttgggattttcacaactaatatatggttaaaattaagagatagctatacgcaagtttgtgatcacagacttatgtccgcggctattaaggacagcaaagctgttcacgctgatatgggctactggattgagtccgagaaaaacgaaacttggaagttagccagagcttcgtttatcgaagtaaaaacctgtatttggccaaaatcacataccctgtggagtaacggagtactagaatcggaaatgataataccaaaaatatacggaggtcctatatcacaacacaactaccggccgggttattttacacaaacagcaggtccctggcacctaggcaaattagaacttgattttgatctatgtgaaggcacaacggtggtagtagacgagcactgcggaaacaggggtccaagcctaagaacaacaacggttactggcaaaataatacacgaatggtgttgtcgatcgtgtacgctccctccactaagatttaaaggagaggacgggtgttggtacggtatggaaatacgaccagtaaaagagaaagaagaaaacctagtcaagtcgatggtatcagcaggatcgggagaagtagactccttcagcttgggtttactttgcatctcaatcatgatagaagaagtcatgaggagccgttggagtcgtaaaatgctaatgactggtacactggccgtatttttccttttaataatgggccaactaacttggaatgacttaattagactgtgtatcatggtcggagcaaatgcgtctgaccgcatgggaatgggcacgacatatttagctctgatggcaacatttaaaatgagaccgatgttcgcagtaggtctattgtttagacgactaacatcacgagaggtactgctactaacgattggtttgagtctagtcgctagtgtcgagttgccaaattctcttgaggaattgggagacggcttagctatgggaataatgatattaaaactgttgacagacttccaaagccatcaactatgggctacgcttcttagtatgacgtttattagaacgacgttttcattgcattatgcttggaaaactatggcaatggtgttatcaattgtatcattgtttccattatgcctgtcgactacttcacagaaaactacttggctgcctgtccttctaggtagtctgggttgtaagccattaacaatgtttctcatagcggaaaacaaaatttggggaaggaaatcttggcctttaaatgagggaattatggcggtggggatcgtctcaattctgttatcttctttgctcaaaaatgatgtaccgttagcgggacctctaatcgccggtgggatgctaatagcgtgctatgttattagtggaagctcagcagatttgtcattagagaaagcagcagttgtaagctgggaagaggaagcagaacattcgggagcaagtcataatattttggttgaagttcaagatgacggcaccatgaaaataaaagacgaagaacgcgatgatacacttaccatcctccttaaagccactctcctagcagtttccggtgtatatccactttccataccagcaacactttttgtatggtacttctggcaaaagaagaagcaaaggtccggagtactgtgggatactccaagtcccccggaagtagagagagctgtattagacgacgggatctatcgaatcatgcaaagaggactactcggacggtcacaggtcggagtaggtgtctttcaagagaatgttttccatacgatgtggcatgtaacacgtggagccgtattaatgtaccaagggaaaagattggaacctagctgggcctccgtcaagaaagatctaatatcttatggtggcgggtggagattgcaaggatcctggaacacaggtgaggaagtccaagtcatcgctgtcgaaccaggtaaaaaccccaaaaacgtacaaactgcgcctggtacttttaagacttcagaaggagaagtaggggctatagcgctggactttaaaccaggtaccagtgggagcccaatagttaatcgtgaaggaaaagtagttggtctgtacggcaacggtgtagtaacaacaagcggaacttatgttagcgccattgcacaggccaaagcatcacaagagggaccactgcctgaaatagaagacgaagtatttagaaaacgtaacctaacaataatggacctgcatccaggaagtggcaagactagaagatacttgccagcaattgtgagggaggcaataaagcgaaaactgagaacactaatactagctcctacaagagtagtcgcatcagaaatggccgaagcactaaaaggaatgcctatacgatatcaaaccacagcagtaaagtcagaacacacgggaaaagaaatcgttgatttaatgtgtcatgctacgtttacgatgaggctgttgagtcccgtacgagtaccaaactacaacatgataatcatggatgaagcacattttactgatccatcttccatagcagcacgtgggtatatatcaaccagagttggaatgggagaagcagccgcgatttttatgacagcaacacctcccgggtcagtcgaagcatttccccaatccaacgccgtaatacaagacgaagaacgcgatattccagaaagatcttggaactctggatatgaatggataacggattttccgggaaaaacagtgtggttcgtgccgtcgataaagtccgggaacgacatagccaactgtttacggaaaaatggaaaaagagtaatacaattatctaggaagacattcgatactgaatatcagaaaaccaaaaacaacgactgggattacgtagtgaccacagatataagtgaaatgggggcaaattttagagcggatagggttatagaccccaggagatgcctaaaaccggtaattttaaaagacggtcccgagagggtaatacttgctggaccaatgcctgtaacagtggctagtgcagcccaacgacgaggtagaattggccgaaaccataataaggaaggagatcaatatatatatatgggtcaaccactaaacaatgatgaagaccatgcacattggacggaggcgaaaatgctactagataacattaacacaccggagggtatcataccagcgttattcgaacccgaaagagagaaaagcgctgcaattgatggagaatacagactaagaggcgaagcgcgtaaaactttcgttgaacttatgcgaagaggggatttaccagtatggctcagttataaggtagcatcagaaggatttcaatactcagatcgaagatggtgttttgacggtgagcgaaataatcaggtgctcgaagaaaacatggacgtagaaatttggaccaaagaaggcgagagaaagaaattaagacctagatggttggacgccagaacgtattctgatcctttagcattacgagagtttaaagagttcgctgcaggaaggagatcggtttctggagatctgatacttgaaattggcaaattgccacaacatcttacacaaagagctcaaaatgccttagacaacctagtaatgttacataatagcgaacaaggagggagagcctataggcatgctatggaggagcttccagatacaattgaaacattgatgcttttagcgttaattgcggtattaacgggcggggtaactttattctttctttcaggtcgcgggcttggcaaaacgtctataggtctactctgcgttatggcatcatcagtcctcctgtggatggcttcagtagaaccccattggattgctgcatctattatattggagttcttcttaatggttttgttaatacctgaacccgacagacagaggactccacaagataatcaattagcgtatgtcgtaattggtctactttttatgatactaacagtagcagctaatgagatgggattactggagacaacgaagaaagatttaggcatcgggcatgtggccgtggagaaccatcatcacgctgcgatgctagatgtggatctgcacccagctagcgcttggactctctacgcagtagcgacaacaataataactccaatgatgagacacactattgagaacactactgcgaatattagccttacagcaatcgcaaaccaagccgccatactaatgggattagacaaaggctggcccatttcaaagatggatataggagtgccactactcgcacttggttgctacagccaagtaaatccccttacactaacagctgcagtgcttatgttagtggcacattacgccatcattggacctgggttgcaagcaaaagcaaccagagaggcacaaaaacgaaccgcggctggcatcatgaagaacccgactgttgacggaattgtagctattgacttagatccagtagtatacgatgcaaaattcgagaagcaactaggacaaataatgcttttaatcctttgtacttcacaaattctcttaatgagaacaacttgggcattatgtgaaagtataacacttgctaccggtccgctaacaacgctatgggagggaagccctggcaaattttggaatacaactatagcagtgtccatggctaatatatttcggggatcctacctcgccggagccggtttggccttcagcctcatgaaatcactaggaggtgggcgccgtgggacaggggcgcagggagaaacgttaggagagaaatggaaacgccaattaaatcaattaagtaaaagtgaatttaatacttataaacgatcagggataatggaggtagatcgaagcgaagctaaagaaggattgaaaaggggagagactactaaacatgctgtttccagaggcacagcaaaattgagatggtttgttgaacgcaatctggtaaaaccagagggcaaagtgatcgatctaggatgcggtagagggggttggtcgtattactgtgcaggtctgaaaaaggttacagaagtcaaaggttacacaaaaggtgggcccgggcacgaagaaccaatacctatggcaacttatggctggaaccttgtgaaattacattccggaaaagatgtattcttcattccacctgagaaatgtgatacactattatgtgacatcggcgagtcgagcccaaaccccacaatcgaggaaggccgcacactaagagttctaaagatggtagaaccttggctacgaggtaaccaattttgcattaagatactgaacccatatatgccttctgttgtagaaactttagaacagatgcaaagaaagcatggtgggatgttagtgaggaatcccctctcaagaaatagcacccatgagatgtactgggtgtcatgtggcactggcaacattgtttctgccgtcaatatgacttcaagaatgttattaaacaggtttacaatggctcatcgtaaaccaacatacgaaagagacgtagacttaggagcaggtacacgtcatgttgcagtggaacctgaagtggcaaatctcgacattattgggcaacgcatagagaatattaagcatgaacacaaaagcacttggcactatgacgaagataacccgtacaaaacatgggcatatcatggatcgtatgaagtaaaaccgtcaggaagcgcttcttccatggtcaatggtgttgtgaaacttttaacaaagccttgggacgtaataccgatggttactcaaatagccatgacagatacgaccccctttggacaacaaagagtattcaaagaaaaagtagacacaaggactccaaaggctaagagaggtacagcccagataatggaagtgacagctaaatggctgtggggatttttgtcaaggaacaagaaaccaaggatatgcacaagggaggaatttaccaggaaagtacgtagtaacgcggcaattggagccgtcttcgtagatgaaaaccaatggaatagcgctaaagaggcggtcgaagatgaaagattttgggacctagttcacagggaaagagaattacataaacaaggtaaatgtgcgacttgcgtgtacaacatgatgggtaaacgcgagaagaaattaggagaatttggcaaggccaaaggtagtagagcaatctggtatatgtggttaggagcgagatttttagagtttgaggcattgggtttcatgaatgaagatcactggttttcaagagaaaattctttaagtggtgtagaaggagaagggctccataaactagggtatattctaagggatataagtaaaataccaggaggcaatatgtatgccgatgatacagctggatgggacactagaattaccgaagacgatttacaaaacgaagcgaaaattacagacatcatggagccggaacatgcactcctggccaaaagtatatttaagctgacctaccaaaacaaggtagtaagagttcagcgaccagccaaaaacggtactgtaatggatgtcatatctaggagagatcaaagagggtcaggacaagtaggaacgtacggtctaaacacattcacaaatatggaagcccagctaatcaggcaaatggaatcggagggaatattttcaccctcagaacttgaaactccaaacctggccggacgcgcgctggactggctagaaaagcatggtgtagaacggttaaaaagaatggccatatcaggcgacgactgtgtcgttaaacctatagatgaccgttttgcaactgctttaacggctctaaatgacatgggtaaagtaaggaaagacatacctcaatgggaaccatcaaaaggttggaatgactggcaacaggtcccattctgttcacatcattttcatcagcttataatgaaagatggacgggagattgtagtaccttgtcggaatcaagatgagctagtaggacgtgctagggtatcacagggagcaggatggtcattaagagaaacagcgtgcctgggtaagagttacgctcagatgtggcaacttatgtactttcaccgtagagacttacgactcgcggcgaatgcaatttgtagtgccgttccagtggattgggttccaacatcaaggacgacttggtctatacacgcacatcatcaatggatgacaacagaagatatgctcagtgtgtggaatagagtttggatcgaagaaaacccatggatggaggataagacgcatatatcgtcctggggtgatgtaccctacctaggaaaacgggaagatcaatggtgtggttcattgatcggcttaacggcaagagcaacatgggcgactaacattcaagttgcaataaaccaagtaaggagattactcggtaacgaaaactatttagattacatgacaagtatgaaacgttttaagaacgaatctgaccctgaaggagcattatggtaa

SEQ ID NO: 21873 - RNA, 9882 nt, synthetic construct
  misc_feature 1..9882: note = derived and/or modified CDS sequence (opt6) from DENV-1__JF937615__SS-prME
  source 1..9882: mol_type = other RNA
tctgttacgatgctactaatgttaatgcctacagcattagcctttcacctaactacaagaggtggtgaaccccatatgatcgtgtcgaaacaggaaagggggaaatcactattattcaaaacttcagctggtgtaaacatgtgcaccttaatagcaatggacctaggggaattctgtgaagatacgatgacctataaatgccctcgcataacagaagctgagccagacgacgtagattgttggtgtaacgcgaccgacacatgggtaacatacggaacatgttctcaaacaggtgaacatagaagagataaacgatccgtagcattggcgccacacgtcggattaggactagaaacacgtacagaaacgtggatgtcctctgaaggagcctggaaacaaatacaaagggtagaaacttgggcacttcgacaccctggatttaccgtaatagctttatttttggcccacgccataggaacttctattactcaaaagggtataatattcatattactcatgttagtcaccccttcgatggcaatgcgatgtgtaggcataggctcaagggattttgtagagggacttagcggagcgacatgggtcgatgttgtattagaacatgggagttgtgtaacaactatggcaaaagataaaccaaccttagacatagaactccttaaaacagaagtaacagatcctgcggtactaagaaaactatgtattgaggcaaaaatcagtaatactactacggacagtcgatgcccaacgcaaggggaggctacattagttgaagaacaggatgctaattttgtgtgtcgaaggacgttcgttgatcgtggctggggaaacggatgtggtctatttggaaaaggcagtttaatgacatgtgcaaaattcaaatgcgtaacaaaattggaaggcaaaattgttcaatacgaaaatttgaagtactcggtcatagtcaccgtccacacgggagatcagcatcaagtaggaaacgaatcgaccgaacatggaacgacagcaactatcactccccaggcaccctccacagaaatacaactcacagattatggcgccctcacacttgactgctcaccacgtaccggccttgacttcaatgaaatggtattgttgaccatgaaagaaaaaagttggttggtgcacaaacaatggtttttagatctgcctctcccctggacaagtggagcgtcaacatcccaagagacatggaatcgaaaggacttacttgtaacttttaaaacagcgcacgcaaaaaaacaagaagtagtcgttcttggcagccaagaaggagccatgcacacagcattgacaggtgcaacggaaatacaaaccagcggtacaacaactatcttcgctggacacttaaagtgtaggctgaaaatggataaacttacactgaagggcatgtcctatgtaatgtgtacagactcattcaaattagaaaaagaagtagcggagacacagcacggaacagttctagttcagattaagtacgaaggaacagacgctccatgtaaaataccattcagcacacaagacgaaaaaggagtgacacaaaatggtcggcttatcacggcaaatccaattgtcaccgacaaggaaaagccagtaaacatcgaggctgaacctcctttcggagagtcgtatatcgtcattggggcaggagaaaaggcacttaaactgagctggttcaaaaaaggaagttcaattgggaagatgtttgaagctacagctcgaggagcaaggagaatggcaatattaggtgatacagcctgggatttcggatcaattggaggagtatttacatcagttggtaaattagtccaccaaatttttggcacagcttacggagttttgttctcaggtgtgtcctggacaatgaaaataggaattggagtcttattaacatggttagggcttaattcgcgaagtacctcgctcagtatgacatgtatagcggtaggtttagtaacgctatacttaggagttatggtgcaagctgacagtggttgtgtgataaactggaagggtcgagagctaaaatgtggaagtggaatctttgtaaccaatgaagtccacacttggacagaacaatataaatttcaagccgattctccaaaaagattatcggccgcgattgggaaagcttgggaggaaggcgtttgtggcattcgttccgcaactagattggaaaacattatgtggaagcaaattagtaatgaacttaaccatatattgcttgagaatgatatgaaatttacagtcgtagtcggtgacgtcgctggaatattggcacaaggtaaaaaaatgataaggcctcaaccaatggaatataaatatagctggaaatcttggggtaaagccaaaatcataggcgcagatgtccaaaatactacttttattatagatggacccaacacaccagaatgtccagatgatcaaagagcatggaatatatgggaggtggaggattacgggtttggtatttttacgactaatatatggcttaagctgagagatagttatactcaagtttgtgaccaccgactaatgtctgctgccataaaagatagtaaagcggtacacgctgatatgggatattggatagagtctgagaaaaacgaaacttggaaactagcgcgtgcgtcatttattgaagtaaagacctgtatttggccaaagtctcatactttgtggtctaacggagttttagagagtgaaatgataatacccaaaatatacggtggacccatatctcaacacaactacagaccaggatatttcacacagactgccggaccttggcacctcggtaaactagaacttgattttgatctatgcgagggtacgacggtcgtagttgatgaacattgtggcaatagagggccctcccttcgtactacaacagtcacaggaaagataattcatgaatggtgctgccgttcatgtacattacccccgctcagatttaaaggagaagatggttgttggtacggaatggaaatccgaccagtaaaagaaaaagaagaaaatctcgtaaagtcaatggtaagtgcaggcagtggagaagttgattcctttagtctgggattgctatgtatctcaattatgatagaagaagtgatgagatctcgttggagcagaaaaatgttgatgacgggcacactagcagtgttttttcttttaataatggggcagcttacgtggaatgatctaatacgactatgcataatggttggagcaaatgcaagtgatcgtatgggaatgggaacgacatatctggctttaatggctactttcaaaatgaggccaatgtttgcggtgggactacttttcagacggttgaccagtcgagaagtattactattaacaataggactaagcctagttgcttctgttgaattgccaaacagtttagaagaacttggagatggacttgcgatgggaattatgatcctaaaattacttatagattttcaaagccatcaactgtgggcaactctcttaagtctaacttttataaaaacaactttctccttacattatgcgtggaaaacgatggccatggtgctaagtattgtgagcctatttcccttgctgccagtgcacgatctccctaagaagacaacgtggttgcctgtattactaggtagcctagggtgtaaacccttaaccatgtttctaatagccgagaataagatctggggccgaaaatcgtggcctctcaatgaaggaataatggcagtgggcatagttagtattttactaagtgctctgttgaagaacgacgttccgctagctgggccgttgatagctggtggtatgctgattgcgtgctatgtgattagtggttcttccgcagatctgagcttagaaaaagcggcagaggtttcatgggaagaggaagcggaacatagtggggctagtcacaatatactggtggaagtacaggatgacggaacgatgaaaatcaaggatgaggaacgagacgacactttaacgatattactaaaagcaacactactagctgtctccggcgtatatcccctttcaatacctgctacactgttcgtgtggtatttttggcaaaaaaaaaaacaaaggtctggtgtattatgggatacgccatcaccaccagaggtagaaagagcggtactggatgacgggatatacagaattatgcaaagaggactcctgggccgaagccaagttggagttggagtgttccaagagaatgtctttcacacaatgtggcacgtaaccagaggggcagttctcatgtaccagggcaaacgtcttgaaccgagctgggcaagtgttaagaaagatctaataagctatgggggaggctggagacttcaaggttcttggaataccggagaggaagttcaagtaatagcagtggaaccaggaaaaaaccctaagaatgtccaaactgcccctggcacgtttaagacaagtgagggagaagtgggggcgattgcacttgactttaaaccgggaacctctggaagcccaatcgttaaccgcgaaggcaaaatagtaggattatatggaaatggtgtggtgactacttcgggaacctatgtaagtgccattgctcaggcaaaagcgagtcaagagggtcctctccccgaaatagaagacgaagttttccgaaaaagaaatttaactataatggacttacaccctggctctggtaaaactagaaggtatttacctgcgattgtaagagaggcaataaagaggaagttgcgaacccttatattagccccaactagggtagtagcatcagagatggcggaagcacttaaaggtatgcccatccggtatcaaacaacagctgtaaaatcagaacatactggaaaggaaatcgtagacctaatgtgtcacgcaacatttactatgcgcctattatcacctgtaagggtaccaaattataatatgattataatggacgaagcacattttacggacccatcatctatagcagctagaggatacattagtaccagagttggtatgggtgaagccgccgccatatttatgactgcaacacctcctggaagtgttgaagcttttccacagtcaaatgctgttatacaagatgaggaaagagatattccagaacgaagttggaacagtggctatgagtggataaccgattttcctggcaaaacagtctggttcgttccttcaataaagagcgggaatgacatagccaactgcctaagaaaaaacgggaaacgagttattcaactctctcgcaaaacattcgatactgaatatcagaagacaaagaataatgattgggactatgtcgtcactacagacatatcggaaatgggtgcaaatttcagagctgaccgtgtaatcgacccgagaaggtgcttaaaaccagtaatactaaaagacggtccagagagagtaattctcgcaggcccaatgccagtcacagttgcttccgccgcacaaagaaggggacgcattggacgaaaccacaataaagaaggagaccaatatatatatatgggtcaaccactcaataacgatgaagatcacgcccattggactgaagcgaaaatgctattggataatataaatacccctgaaggaataattcctgcactatttgagccagaaagagagaaaagtgcggcaatagatggcgaatatcgactgcgtggtgaagcgaggaagacgttcgtagagttaatgcgcagaggagacctacctgtctggctatcttataaagtagcatcggaaggttttcaatatagtgatagacgttggtgctttgatggagaaagaaacaaccaagtcttggaagagaatatggacgtagaaatttggacaaaagaaggtgaaaggaagaagctcagaccacgatggctcgatgctagaacctacagtgacccacttgctctcagggaattcaaagaatttgcagcaggaagacgttcggtatcaggagatctcatattggaaataggaaaattaccacaacacttaacgcagagggcacaaaatgcattagacaacttagtgatgttgcacaatagtgaacaaggtggaagagcgtatagacacgcaatggaagaactgccagacacaatcgaaacgcttatgtttttagcacttattgcagtactgacaggaggagtaactttattcttcttatcaggaagaggattaggtaagacatccattgggttgctttgtgtcatggcgagttcagtattactatggatggcgtcggtagagccccactggatagcagccagcattatattagagttctttctaatggtgctgctaattccagaacctgataggcaaagaactccacaggacaatcaacttgcatatgtggttattggtttattattcatgattctaactgtagcggccaatgaaatgggtttactggaaacaactaaaaaagacctgggaataggtcatgtagcagtagaaaatcatcatcatgctgcaatgcttgatgtcgatttacatcctgcctctgcttggactctatacgctgtagcaaccacaataatcacaccgatgatgcgacatacgatagagaatacgacagctaatattagtttaactgctatagctaaccaagcagctatcctaatgggtttagataaaggttggccaataagcaaaatggatataggtgttcctttgctggcactaggttgctatagtcaggtaaacccattaactttaacagcagcagtcttaatgctagttgcccattatgcaataattggaccgggcttacaagccaaggcgaccagagaagcacaaaaaagaacagcagcgggaattatgaaaaacccaactgttgatgggatagtagcaatagacctggatccagtagtatatgacgcaaagtttgagaaacaattaggccaaataatgctactaatactgtgtacatcacaaattctattaatgagaactacatgggcactatgcgagagtataactttggcaactgggccacttaccacactatgggaaggcagccccggtaaattttggaataccacaattgcagtctcaatggcgaacatatttcgagggagttatctcgcgggtgcaggtttagcattttctctcatgaaatctttaggaggtggaagacgaggcaccggagcccaaggagagaccttaggtgagaaatggaagagacaattgaaccaattatctaaaagtgagttcaatacatacaagagaagcggaataatggaggtcgatcgttcagaggcaaaagagggacttaagcgaggggaaactacaaaacatgctgtatctcgcggaacagccaaattaaggtggtttgttgagagaaacttagttaaaccggagggaaaagtaattgaccttgggtgtggaagaggcggatggtcatattactgcgcaggactaaaaaaagttaccgaggtgaaagggtatacaaaaggaggtccaggtcatgaagaacccatacctatggcaacatacggatggaacttagtcaaactacattctggaaaagacgtattttttatccctcccgagaaatgcgacacacttctctgtgatatcggagaatcttccccaaaccctaccattgaagaaggtaggacgctaagagtactgaaaatggttgaaccttggctaaggggaaaccagttttgcattaaaattctgaatccgtatatgccgagcgtggtcgagacactagagcagatgcagcgtaaacacggcggtatgcttgtgcgaaatcccttgagccggaatagtacgcatgagatgtattgggtaagctgtggcactggaaatatagtttcggccgttaatatgacttcacggatgttacttaaccggtttacaatggcacacagaaagccgacatatgaacgtgacgtagacttgggggcaggaacgcgacatgtagcagttgagccagaggtagccaatctagacataattggacaaaggatagaaaacataaagcatgagcataaaagcacatggcactacgatgaagacaatccctacaaaacgtgggcttatcacggctcatatgaggttaaaccatctggctctgcaagctcaatggtgaacggagttgttaagctactcacgaaaccttgggacgtaatacccatggttacacaaattgcgatgacagatactacaccgtttggtcagcaacgagtgttcaaggaaaaggtcgatacacgtactcctaaggccaagcgcggcaccgctcaaatcatggaagtaacagccaaatggctatggggatttttgtcgagaaacaaaaaaccacgtatttgtacgagggaggaatttacaagaaaagtaagatcaaatgcagctatcggtgcagtgttcgtcgatgaaaaccaatggaactcagcaaaagaagccgtagaagatgagaggttctgggatctcgtacatcgagagagagaattacacaaacagggtaaatgtgctacctgtgtgtacaatatgatgggcaagagagaaaaaaaattaggcgaatttggaaaagcaaaaggaagcagagcaatctggtatatgtggttaggagctcgattcctggaatttgaagctctcgggtttatgaatgaagatcattggttttccagggagaatagtcttagcggtgtagaaggtgaggggctacataaacttggttacatattaagagatattagtaaaattcccggtggtaacatgtacgcagacgatacagctggttgggacacacgaataactgaagatgaccttcaaaatgaggcgaaaattactgatataatggaaccggaacatgctttactggcaaaatcaatctttaaacttacatatcaaaataaagtagtacgggtacagagacctgcaaagaatggtactgtaatggatgtaatatcacgaagagatcaacgcggctctgggcaggttggaacgtatggtttaaacacttttactaacatggaggctcaactgatccggcaaatggaaagtgaaggaatatttagcccttccgaactggaaacacccaacctcgcaggaagagtactcgactggttagaaaaacatggagttgaaagattgaaacggatggcaatatcaggagatgattgtgttgtaaagcctattgacgaccgattcgccgcggccttaacagctctgaacgacatgggtaaagtaagaaaagacattccgcaatgggaacccagcaaaggatggaatgattggcaacaggtccccttctgtagccatcatttccatcaacttataatgaaagatggtcgggaaattgtagtaccatgtcgaaaccaagatgaacttgtcggacgagctcgcgtgagtcaaggtgcaggatggagtctaagagaaacagcatgtctaggcaaatcttatgcgcaaatgtggcaactcatgtattttcatcgtagagatttaaggctggcggcaaacgcaatctgttctgcagtcccggttgattgggtcccaactagccgaactacatggtcaatccacgcacaccaccaatggatgacaacagaggacatgcttagtgtatggaatcgagtatggatagaagagaatccttggatggaggataaaacacacatatcatcatggggggacgttccttatctaggcaaacgtgaagatcaatggtgtggatcgctaattgggttgactgccagggcaacgtgggcaacaaatatacaagttgcgattaatcaggtacggaggctcatagggaatgaaaattaccttgactatatgacaagtatgaaaagattcaaaaatgaatcggaccctgaaggagctttatggtag

SEQ ID NO: 21874 - RNA, 9879 nt, synthetic construct
  misc_feature 1..9879: note = derived and/or modified CDS sequence (opt6) from DENV-1__GU131814__SS-prME
  source 1..9879: mol_type = other RNA
agcgtgacaatgctgttaatgctaatgccaacagcacttgcgtttcaccttactacacgaggaggagaaccacatatgattgtaagcaaacaagagagaggcaaaagtttattgtttaaaacgagcgcgggcgtaaacatgtgcacgttaatagccatggacctaggtgaactatgcgaagacacaatgacatacaaatgcccacgtattacagaaactgagcctgacgatgtggactgttggtgcaacgcaactgacacttgggttacatacggaacctgtagtcaaacaggtgaacatagacgagacaaaaggtctgtcgctttagcgccacatgttggacttggcttagaaacgcggacggaaacgtggatgagcagcgaaggagcatggaaacaaattcagagggtagagacgtgggcactgagacaccctggatttacagtaatcgctttatttctggcacatgcaataggcacaagtataactcaaaaagggataatatttattctacttatgctagttacaccttccatggctatgagatgtgtcggaattgggtcccgtgatttcgtcgagggattgagcggagcaacgtgggtagatgtagtcctagaacatggtagttgcgtgacaacgatggccaaagataaacccacgttagacatagagctattgaaaacagaggttactaaccccgcaattttaagaaagctctgtatagaagcaaaaatatcgaatacaaccacggatagtagatgtccgacgcagggagaagcaactctggtggaagaacaagatgcgaatttcgtttgtagaaggactttcgttgatcgtggttggggcaatggatgcggactattcggtaaagggtcgcttattacatgcgccaagttcaaatgtgtaactaaattggaagggaaaatagtacagtatgaaaatctaaagtactcggtaattgtaacagtacacacaggagatcagcatcaggtgggtaacgagtctacagaacatggtactaccgctaccataaccccacaagcacccacaactgaaatacagctaaccgattatggcgcattaaccttggattgtagccccagaacaggattagatttcaacgaaatggtattgttaacgatgaaagaaaagtcgtggttagtgcacaaacaatggttcttggatttacccttgccgtggacgtcaggtgcctcaacaagccaagaaacttggaataggcaagatctcttagtcacatttaaaacagcacacgccaagaaacaggaagttgtagtattagggagtcaagagggagcaatgcatactgcgctgacaggagcaactgaaatacaaacctccggaacaacaacaatttttgcgggacacttgaaatgtagattgaagatggataaattaacattgaaaggtatgtcgtacgtcatgtgcacaggatctttcaaactggaaaaagaggtagctgagacgcagcacggaacggtgcttgtacagataaaatatgaaggcactgacgcaccttgtaaaatacccttctcaacccaagatgaaaaaggcgtaacgcaaaatggccgactaatcactgctaacccaatagtaacagataaagagaaaccggttaatatagaagctgaaccgcccttcggagaatcctatatagtaattggtgccggcgaaaaagcactaaaactaagctggttcaaaaaggggtcctcaattggaaaaatgtttgaagcaacagctcgaggtgcaagaagaatggcaatattaggagatacagcatgggacttcggttctattgggggagtctttacatcagtcggcaagttggtccaccaaatctttggaactgcgtatggggtattattctcaggagtctcatggaccatgaagataggaatcggagtgctattaacttggctcggactaaattcaagaagcacaagcctaagtatgacgtgtatagcagtgggactcgtcactctatatcttggagtcatggtacaggcggattccgggtgtgtaattaattggaaaggtagggagttgaaatgcgggtctggtattttcgtcacaaacgaagtacatacttggacagagcagtataagtttcaagcagactctccaaaaaggctgtcagctgctattggaaaggcttgggaagagggtgtttgcggcatacgtagtgcaacgaggctagaaaacattatgtggaagcaaataagtaacgaattgaatcatatattattagaaaacgacatgaaattcaccgttgtggttggcgacgtagcggggattttagcacaaggtaagaaaatgataagaccacagcctatggaatacaagtacagttggaaatcttggggaaaggctaagattataggagctgacgttcaaaatacaacgttcataatcgatggccccaatacaccagaatgtccagatgaccaaagagcctggaacatttgggaagtcgaggattatggattcggtatattcaccaccaatatatggttaaaactaagggacagctatacacaagtgtgcgaccatagattaatgtcagctgccataaaagattcaaaggcagttcacgctgatatgggatattggattgaatccgaaaagaatgaaacctggaaattggcaagagcttcattcattgaggtcaagacctgtatatggccaaaaagtcatactctttggtcaaacggagtacttgaatcagaaatgataatccccaaaatctatggaggacctatttctcaacataattaccgcccagggtatttcactcaaactgcaggaccatggcatttaggtaaattggaactggacttcgacttatgtgaagggaccacagtagtagtagatgaacattgtggtaatcgtgggcctagccttaggacaacaacagtaactggtaaaattatacatgagtggtgttgtcggtcttgcactttaccacccttacggttcagaggtgaagacggctgttggtacggtatggaaataagaccggtaaaagaaaaagaagaaaacctcgtcaaaagcatggtatcagctggaagtggcgaagtcgattccttctctctcggattactgtgtatcagtatcatgatagaagaagtcatgcgctcacgttggtcaagaaaaatgttgatgacaggaaccctagcagtgttccttcttctcataatgggacaattaacatggaatgacttaataagattgtgtatcatggttggagctaatgcttccgacaggatgggaatgggaactacttatttagctctaatggcaacattcaaaatgcgacccatgtttgctgttggactactctttcgtagactaacaagccgtgaagtactactattaaccatcgggttgagcctagtagcttcagtagaactacccaactcgctggaggaattgggtgatggcttagccatgggtattatgatattaaaattgctcaccgatttccagtcccatcaactttgggctactctgttatcccttacgtttataaaaactactttttcattgcattatgcatggaaaacgatggcaatggtgttgagtatcgtctctctctttccattgtgcttgagtacaaccagtcagaaaacgacctggttaccagtactactgggtagtctaggttgtaagccactaactatgttcctgatagctgaaaataaaatatggggaagaagaagttggcccctgaacgaaggaataatggctgtaggaatcgtaagcatacttttgtcaagcctattgaaaaatgacgttccactagccggaccattgattgctggcggtatgcttatagcatgttacgtaatttctgggagctcagcagacctcagcttagaaaaagctgcagaagtgagttgggaagaagaagcggaacatagcggagccagtcacaacatattagtagaagtacaagacgacggcactatgaagatcaaagatgaagaacgagacgacactctcacaatattgctgaaagcaacactccttgcagtttcaggggtctacccactgagcataccggccacacttttcgtttggtacttttggcaaaagaagaaacaaagaagcggagttttgtgggataccccatcacctcctgaagtcgagcgcgctgtactagacgatgggatataccgaattatgcagagaggtctcttaggaagatcacaagtcggagtgggagtttttcaagagaacgtttttcatacgatgtggcatgtaaccagaggtgctgttctcatgtatcagggtaagcgattagaaccctcatgggcatctgttaagaaagatttgataagctatggtgggggctggagactacaaggaagttggaatacaggtgaggaggttcaagtcatcgcggtagagcccggaaagaatcccaaaaatgtgcagacaacacccggaacttttaaaacgccagaaggagaagttggggcaattgctcttgacttcaagccaggcacatcaggaagtccaatagtcaacagagaaggaaaaatagtcggactatatggaaacggcgtagttactaccagcggcacctacgtcagtgctatagcacaagctaaagcctctcaagaaggacccttgcctgaaattgaagatgaagttttccggaaacgtaatctaacaatcatggatctccatccgggatccggcaaaacaagacgatatctaccagctatagtaagagaagcaatcaaaaggaaacttcgcactcttatccttgctcccactcgtgtagtggcaagcgaaatggcagaagccctaaaaggaatgccaattcgctatcagaccacggccgtgaaatccgagcacaccggcaaggaaatagtcgatctaatgtgtcatgcaactttcacaatgagattattatcccctgtaagggttccaaactataatatgattattatggacgaagctcactttacagatccctcatcaattgcagcccgaggctatataagtacacgagttggtatgggcgaagctgcagccatattcatgactgcaactccacccggatcagtagaggcctttccccaaagtaacgccgtcatacaagatgaagaacgggatatccctgaaaggtcatggaactcaggttatgaatggataactgacttccctggtaagactgtatggtttgtgcccagtatcaaatcaggcaatgatatagcaaattgtctaagaaagaacggtaaaagagtaatacagttaagtaggaaaacattcgatacggaatatcagaaaactaaaaataacgattgggattatgtcgtaacgacggatattagtgaaatgggcgcaaatttcagggccgacagggtgattgatccacgaagatgtttaaaacccgtcatattaaaggacggcccagaaagggtcatacttgctggaccaatgcctgtgacggtagctagtgccgcacaaagaagaggaagaatcggccggaatcacaataaggagggtgatcaatacatatacatgggacaacccctaaataatgacgaagaccacgctcactggacagaggctaaaatgttactggacaacataaataccccagaagggatcatcccagctctcttcgagccagaacgagagaagtcagctgcaatcgacggagaatatcgtctacggggagaggcgagaaaaacttttgtcgaactaatgagaagaggggacctcccagtttggctatcatataaagttgcgtctgaaggttttcaatactcggatagaaggtggtgttttgacggggaacgcaacaatcaggtcttggaagaaaacatggatgttgaaatatggacaaaagaaggtgaaaggaagaaacttcgtccaagatggctggacgctcgaacatattctgatcccttggcattacgcgaatttaaagagttcgcagcgggtcgcagatcggtaagcggagacttaatattagaaatcggaaaacttccgcagcacctaacgcaacgagcacaaaatgcgcttgacaatcttgtaatgctgcataacagtgaacaaggaggtagagcgtatcgacatgccatggaagaattacccgatactatagagacgttaatgctacttgctctgatagccgttttaacaggtggcgtaacgctctttttcctatcagggaggggtctagggaaaacaagtattggattgctttgcgttatggcttcgtcagtgctcctatggatggcgagtgtggaaccacactggattgcagcaagtatcatattagaatttttcctgatggttcttttaatacctgaacctgatcgccaacgtactccacaagataatcaattggcatatgttgttatagggttgctattcatgatattaaccgtggccgccaatgaaatgggacttctagagacgacaaagaaagaccttggcataggacatgtagcagttggaaaccaccatcacgccgcgatgctggatgtagatttgcacccagcctcagcatggacattgtatgctgtcgccacaacaatcataacacctatgatgagacacacaatagaaaatacgacggccaacattagtcttacagccatagcaaaccaagctgcgatattaatggggttggataaaggttggcctataagcaagatggatataggcgtaccattactcgccttaggttgttattcgcaagttaatccactaacgcttaccgcagctgtcctaatgctagtcgcccattatgctataatagggcctggtctacaggctaaagctacacgggaagcacagaaaagaaccgcagccggaataatgaaaaaccctacggttgatgggattgttgcgatagatctagaccctgtagtatacgacgctaagtttgaaaaacagctgggccaaataatgcttttgatattatgcacaagtcagattctactaatgagaaccacgtgggcattgtgtgaaagtattactttggcaactggaccgctgacaaccctgtgggaggggtcacctgggaagttttggaatactactatagcagtctcgatggcaaacatattcagaggcagctacctcgcgggcgcaggattggcattctcactcatgaaatcattaggcggcggaaggcggggaacaggagcgcaaggagagacactaggtgaaaagtggaaacgtcaactgaatcagctatcaaagtcagagtttaacacatataaaaggagtggaataatggaagtagatagaagcgaggcaaaagagggattaaaaagaggcgaaactaccaagcatgccgtatcacgggggacagctaaactacgatggtttgtagagcggaatctggtaaaaccagaaggtaaagtaatagacttaggatgtgggcgagggggatggtcatattattgtgcaggtctcaagaaagtaacagaggtgaaaggttatacaaagggaggccctggccatgaggaaccgataccgatggcaacatacggatggaatctggttaagctacactcaggcaaagacgtattctttataccaccagagaagtgcgatacacttttatgcgacattggtgaaagcagtcccaatccaactatagaagaagggcggacacttagagttttgaaaatggtagaaccatggttacgaggcaatcaattctgtatcaaaatcctaaatccttatatgcctagtgtcgtagagacactagagcaaatgcaaagaaaacatggaggaatgctagtcagaaatccactctcaagaaattctacccacgaaatgtactgggtatcatgtggcacaggcaatatagtttcagccgtaaatatgacaagtagaatgttgttaaacagattcacaatggcacaccgaaaacctacgtacgaacgggatgtagatcttggagcaggaacgcgacatgtagctgtcgaaccagaggtagcaaacttagacatcatagggcagagaatcgaaaatattaaacacgaacatgaatcaacttggcactatgatgaagataatccatataaaacctgggcctatcatggctcgtacgaagtgaaaccaagtggatcggcaagcagcatggtaaatggagtggtaaagctgttaactaaaccttgggatgttataccaatggtaacccaaatagccatgacggatacgacgccttttggtcaacaaagagtttttaaggaaaaggtggatactagaacaccgaaagcaaagcgtggcactgcacaaataatggaggtgactgcaaagtggctatggggatttttgagcagaaataagaaaccaagaatatgtacaagagaggaatttacgagaaaagtgagaagtaatgctgcaataggagcagtttttgtagatgaaaatcaatggaactctgctaaagaggcggtcgaagatgaacgcttctgggatttagttcaccgagagagagagttgcataaacagggaaaatgtgcgacgtgcgtttataatatgatgggaaaacgtgagaagaaactaggtgaatttggcaaagctaaaggcagccgcgcgatatggtatatgtggctgggggcgagatttctcgaatttgaggccctcggatttatgaatgaggatcattggttttcacgagaaaattcactttctggagtagaaggtgagggattacacaagttaggttacatcttaagggatatcagtaaaataccgggaggtaatatgtatgctgatgataccgcaggatgggatacaagaatcaccgaggacgatttacaaaacgaggctcgcataacagatataatggaaccagaacatgcattactagccaaatcaatatttaagttaacatatcagaacaaagttgtacgtgttcagcgaccagcgaaaaatgggacagttatggatgtaataagtagacgagatcaaagaggaagtggacaggtaggcacttacggcttgaatacattcacaaatatggaagcgcaactgattaggcagatggaatctgaaggaattttcagtccctcagaactggaaacgccaaatttggcagaaagagttttagactggttagaaaaatatggcgtagaacgtctgaaaagaatggctatatctggtgatgattgtgtcgtaaaacctatagacgataggttcgctaccgctcttaccgctctaaatgacatgggaaaggtacgaaaggacattcctcaatgggaaccaagtaaggggtggaatgactggcaacaggttccattttgcagccaccactttcatcaattaataatgaaagacggcagagaaattgtcgtaccttgccgaaatcaagacgaattggtaggtagagcacgggtttctcagggagcgggctggagtctcagagaaacagcctgccttggaaaatcatacgcacagatgtggcaactaatgtactttcatcgtcgagatttaagattagcggctaacgcaatatgctccgccgtacccgttgattggattccgacaagtagaaccacatggtccatacacgctcatcaccaatggatgacaactgaggatatgctgagcgtatggaaccgagtatggatagaggagaatccatggatggaggataaaacacacatatcatcatggggtgacgttccttatctaggcaaacgtgaggaccaatggtgtggatccttaatagggttgacagctcgcgctacatgggctacaaacatacaagttgcaatcaatcaggtaaggcgattgataggtaacgaaaactacctagactacatgacaagcatgaagaggttcaaaaacgagtcagaccctgaaggggctctttggtga

SEQ ID NO: 21875 - RNA, 9879 nt, synthetic construct
  misc_feature 1..9879: note = derived and/or modified CDS sequence (opt6) from DENV-1__GU131815__SS-prME
  source 1..9879: mol_type = other RNA
agcgtgacgatgctcctcatgttaatgcctacggcacttgcgtttcatctgacaacccgaggcggtgaacctcacatgattgtaagtaaacaagaaagaggtaaaagtttactattcaaaacaagtgctggtgtaaatatgtgtaccctaatagcaatggatcttggtgaattatgtgaagatacaatgacatataaatgcccgagaataactgaaaccgaacccgacgatgttgattgctggtgtaatgctactgatacatgggtaacatacggcacatgttcacaaacgggggaacatcgtagagacaaaagaagtgtggcactcgcaccgcatgtaggactaggcttggaaacaagaacagaaacttggatgagttcagaaggagcttggaaacaaatacaacgtgtagaaacctgggctttaaggcatcccggattcacagtcatagcattgttcttagcgcatgcaataggaacgagcataacacaaaaaggcataatatttatactgctgatgttagtcacgccatctatggctatgagatgtgtcggaattggttcgagggatttcgtcgaaggtttatcaggagcaacatgggttgatgtagtgttggaacacggttcctgcgtaactacaatggcaaaagacaaaccaacattggacattgaattactaaaaactgaggttacaaacccagcagttctaagaaaactatgtatcgaagctaaaatatcaaacactactacggactcaagatgtcctacccagggagaagcaacattagttgaagaacaagatgccaactttgtatgcaggcgaacttttgtagataggggatggggaaatggttgtgggctattcgggaaaggctctctaataacatgcgctaaattcaaatgtgttaccagacttgaggggaaaatagttcaatatgagaatttaaaatatagcgtaatcgtaacagtccacactggtgaccagcatcaggttggaaatgagtctacagaacatggaactacagcaacaatcacaccacaagctccaaccactgaaattcagctcacggactatggagcgttaaccttagactgttctccaaggaccggtctagacttcaacgaaatggtcctgctcaccatgaaagagaaaagctggctggtccacaagcaatggttcttagacttgcctttaccttggacctcgggcgccagtactagccaagaaacctggaacaggcaggatttgttagtcacctttaaaaccgctcatgccaagaaacaagaggtggtggtattaggctcacaagaaggcgccatgcatacagcattaacgggagccactgagatacagacatcgggaactaccacgatttttgcggggcatttaaaatgtcgtttaaaaatggacaaattaacacttaagggtatgtcctacgtaatgtgtacgggaagtttcaagttagaaaaagaagtggcggagacacaacacggtaccgtgctagttcagatcaaatacgaaggtacagatgcaccatgcaaaataccattcctaactcaagatgagaaaggtgtaacacagaacggaagactaattacagccaaccctatagtaactgacaaagaaaaacctgtcaatattgaggctgaaccgccttttggcgaatcatatataaccataggtgcgggtgagaaggcactcaaattatcatggttcaagaaaggatctagtattggaaagatgtttgaagcaactgcaagaggagcccggaggatggccatattaggagacacagcttgggacttcggaagcatcggtggagtgtttacatcagtaggaaagctcgttcatcagatatttggaacagcttacggagtactttttagcggcgtttcttggacgatgaaaataggcattggagttttattaacatggttgggtctcaactctcggagtacatctttgtcaatgacgtgcattgccgtaggtttagtaactctgtatctaggcgtcatggtacaagccgactccggttgcgttataaactggaaaggaagggaactaaaatgcggtagcggaatcttcgttacaaatgaagttcacacttggacggagcagtataaatttcaagcggactcaccaaaaagactttctgcagcgataggtaaggcttgggaggaaggggtttgtggcataagatctgcaacgcgactagaaaacataatgtggaaacaaataagtaatgaacttaaccatatccttcttgaaaatgacatgaagttcacagtagtagtaggtgatgtagctggcattcttgcacaggggaagaaaatgatacgtcctcagccaatggaatataagtattcatggaaatcctgggggaaggctaaaataataggagcggatgttcaaaacaccacctttataatagacggacccaataccccagaatgcccggatgaccagagagcgtggaatatatgggaagttgaagattacggattcggtatatttacaacaaacatatggcttaaactcagagattcatatacacaagtttgtgatcacagacttatgagcgcggccattaaagattccaaagcggtacatgcagacatgggatactggattgagtcagagaaaaatgagacatggaagttagcacgcgcctcatttatagaagtaaagacatgtatatggcctaagtcgcatacattatggtcaaacggagtattagaatcagaaatgataataccaaaaatatacggcgggccaatatcacagcataattataggccaggttactttacccaaacagcagggccttggcacttgggtaaacttgaattagatttcgacctgtgtgaaggaacgactgtagttgttgatgaacattgtggtaataggggaccctcactgcgtactacaacggttacaggcaagataatacatgagtggtgttgcagatcatgcacacttcctcccttaaggtttcggggagaagacggttgttggtatggaatggaaattcgcccagtgaaagaaaaagaagaaaatctagtaaagagtatggtaagtgccggatcgggggaagtagacagtttcagtcttggattattgtgcatatcgattatgatagaagaagtgatgagatcacgatggtcgaggaaaatgctgatgaccggaacacttgcagtcttcttcttactaataatggggcaactaacgtggaatgatttaatccgattatgtataatggtaggggcaaacgcatctgacaggatgggtatggggaccacatatctcgcactcatggcaacatttaaaatgaggccaatgtttgcggttggactattattccgacgattaacttcaagagaggtcctcctgttaacgattggactatcattagttgcttcggttgaactcccaaactcacttgaagaactcggggatggattagctatgggcataatgattcttaaattactaaccgatttccaatcccatcaattatgggctacacttctgagcttaacatttattaagacaacattcagtctccactacgcctggaaaacaatggcgatggtcctaagtattgtttctctattcccactttgtttatctactacatcacagaaaactacttggttacccgttctcctaggatcccttggttgtaagccgttgacgatgtttttaatagctgaaaataaaatatggggcaggagatcctggccattaaatgagggcattatggctgtcggaattgtttcaatattattatcttcattgttaaagaatgacgttcctctagctggaccactcatagctggtgggatgctcattgcttgttatgtcattagcggtagtagtgctgatctatcactagaaaaagcagcagaagtatcatgggaagaagaggcggagcactctggggccagtcacaatatcctagtagaagtacaagatgacggaactatgaaaattaaagatgaagaaagagacgatactctgactattttattaaaagcgacactacttgctgcatcgggagtgtatcccctttcaattccagctaccttatttgtatggtatttctggcagaaaaagaaacagagatcaggggttctctgggacaccccaagtcctccggaagttgaaagagctgtcctcgatgacggcatctatcgaattatgcaaagggggcttttaggtaggtcccaagttggagtaggagtcttccaggaaaacgtatttcacactatgtggcatgtaacaagaggtgctgtgctaatgtatcagggtaaaagactagaaccctcttgggctagtgttaagaaagaccttatatcatatgggggtggatggagacttcagggcagctggaatactggagaagaagtgcaagtaattgcggttgaaccagggaaaaatccaaagaacgtacaaacagcgcctggaacattcaagacacccgaaggagaagtcggcgcaatcgcacttgacttcaagcctggcacctcaggatcccctatagtcaatcgagaaggaaaaattgttggtttatacgggaacggggtagtaacgacaagtggcacctatgtgtccgctatagcacaagctaaagccagtcaagaaggaccattaccagaaattgaagacgaagtctttagaaaaagaaatttgactatcatggacttgcatccaggctcaggcaaaacccgacgttacctaccagccattgtccgagaggcaataaaaagaaaactaaggacactaatcctggctcctactagggtcgtagcttcagagatggcggaagcccttaaaggaatgcctataaggtaccagacaaccgcagtgaaatcagaacatacgggaaaggaaatcgtagatctaatgtgtcatgcaacatttaccatgagattactgagtcctgtacgtgtacctaactataatatgattattatggatgaggcccatttcactgatccctcttcagtagccgctcgtggctatatttctacaagagtgggtatgggtgaagccgctgcaatttttatgaccgctaccccgcctggatcggtagaagcattccctcaatcaaacgctgtgatacaggatgaggagcgagacattcccgaaaggagttggaatagtggttacgaatggataactgactttccaggaaaaacggtatggttcgttccaagtattaaatcagggaacgacatagctaactgtttaaggaagaatggtaaaagagtcatacaattatccagaaaaacttttgacaccgaatatcaaaagactaaaaataacgactgggattacgtagtaactacagacataagcgagatgggagccaattttcgcgccgaccgtgtaatagacccaaggaggtgcttaaagccagtcatattaaaagacggtccggaaagagtaattcttgcagggcctatgccggtcacggtcgcttcggcggcacagcggcgcggaagaattggtcgcaatcacaataaagaaggtgaccaatatatatacatgggtcaacctctgaataatgatgaggatcatgcccactggactgaagcaaaaatgttattggacaacatcaatacacctgagggaattattcccgcactatttgaaccagaaagagagaaaagcgcagcaatagacggcgagtatagactacggggtgaagcgagaaagacctttgttgaattaatgagaaggggtgacctaccagtttggctaagttataaagttgcgagcgaaggcttccagtattccgacaggagatggtgttttgatggagaacgaaataatcaagtactagaagaaaacatggatgttgaaatttggacgaaagaaggcgaaaggaagaaattgaggccgaggtggctagatgcaagaacatactcggacccacttgcgctaagggaatttaaagagttcgcagcgggtcgacgttcagttagcggagacttaatactagagattgggaaacttccccagcatttaacgcaaagagcacagaatgcactggacaacctggtaatgctccacaatagcgaacagggaggccgagcgtaccgtcatgccatggaggaactaccagatacaatcgaaaccttaatgttattggcgctgattgcagtcctaacgggaggcgtaaccctatttttccttagcggacgcggtttaggaaagacaagtataggtctactttgtgtcatggcatcaagtgtcttgttatggatggcttcagttgagccgcactggatagcggccagcatcattctagagttcttcctcatggttctattgataccagaaccagatagacaaagaacaccgcaagacaatcaacttgcatacgtggtcataggtctcttgttcatgatattaactgtcgcagccaatgagatggggctgctagagactactaagaaagatctagggataggacacgtagccgctgaaaaccatcaccatgctgcgatgttagatgtagatctccatcctgctagtgcttggacgttgtacgctgttgccactaccataattacgccgatgatgagacatacaattgaaaacaccactgccaatatcagcttgacagctatcgccaatcaagcggcaattctaatgggactagataaaggatggcctataagcaaaatggatattggagtacctctactagctcttggctgctacagtcaagtaaacccacttactctcacagctgcagttttaatgctagtagcgcattatgcgataataggacccggattacaagcgaaagcaacgcgtgaagcgcagaaaagaaccgcggcaggtattatgaaaaacccgacagtagatggaattgtggctatagacttggatcctgtcgtctacgatgcgaaatttgaaaaacaactaggccaaatcatgctattaatattgtgcacctcacaaatactactcatgagaacaacgtgggctctgtgtgaaagtataacactagccacaggacccttaaccactctgtgggaaggcagcccaggaaagttttggaacactacaatagcggtgtcaatggcaaatatcttccgaggaagctacttggccggagcaggtctagcattctcgttaatgaaaagtctaggagggggtagacgcggtacaggagcacaaggcgaaacgctaggagaaaaatggaagcggcaacttaaccaactgtcaaaaagcgaatttaacacatacaaaagatcgggtattatggaagtagataggagcgaagcaaaagagggcctgaagagaggtgaaacaacaaagcacgccgttagtaggggcacagcaaagttacgctggttcgtggagcgtaacctggtaaaacccgaaggcaaagtaattgacctaggttgcggacggggcggatggtcctattattgcgccggcttgaaaaaggtaacggaagtcaaggggtatactaaagggggtccgggccatgaagaacccataccaatggccacttatggatggaatctggtgaagttacacagcggaaaagacgtctttttcatacccccagaaaaatgcgatacacttttatgtgacattggtgaatcctcaccaaacccaacgatagaagaaggacgtactctgcgagtactgaaaatggttgagccttggttacgtgggaatcaattctgtataaagatcttgaacccatatatgccgagcgtagtagaaacactagaacagatgcaacgaaaacacggcggaatgctagtacgcaacccgttgtccagaaacagtactcacgagatgtattgggtatcatgtggcacgggaaatatagtatccgccgtgaacatgacaagcaggatgctgctaaatagattcacaatggcccatagaaagcccacctacgagagagacgtagatctaggagcaggaaccagacacgtcgcagtcgaaccagaggttgctaatttagatataataggacagaggattgaaaacataaaacacgaacataaatctacttggcactatgatgaagacaatccatataaaacttgggcatatcatggaagctacgaagtaaaaccatcaggttccgcatctagcatggtgaacggggtggttaaattattaactaaaccttgggatgtaattcctatggttactcaaatagcaatgaccgacacaacaccctttggtcaacagagagtcttcaaagaaaaggtggatacgagaacacccaaggcaaaacgaggtaccgcccagataatggaggtaacagcgaaatggttatggggattcctctcaagaaacaagaaaccaagaatatgcacaagagaggagttcactaggaaagtaagatcgaatgctgcaattggagctgtcttcgtagatgaaaaccaatggaatagcgcaaaagaagcagttgaagatgagagattctgggatctcgttcatcgagaacgagagttacacaaacaaggtaaatgcgctacatgtgtatataacatgatgggcaaacgcgaaaagaaactaggggagttcggaaaagcaaagggctcacgcgctatctggtatatgtggttaggcgctagatttttagaatttgaagcactcggatttatgaatgaagatcactggtttagtagagaaaattcattaagtggcgtagagggagagggcttacataaattaggatacattttacgtgacatctcaaaaatacctggtggaaacatgtacgccgatgacactgctgggtgggatacccgtattacggaagatgacctgcagaatgaggcaagaattaccgatataatggaaccagaacatgcattattagccaaaagcatttttaaacttacctatcaaaacaaagtcgtaagagtccaacgaccggccaaaaatgggactgttatggatgtcatatcaagacgggatcaaagaggatcaggacaagtaggaacatatggtctgaatacttttacaaacatggaggcacaattaattcgccagatggaatccgaaggaatattctcaccatcagaacttgaaacaccaaacttggcagagcgagtgctagattggctagaaaaatatggagttgaaaggttaaagagaatggcaatctccggcgatgattgtgtcgtaaagccaatagacgatagatttgctacagccctaaccgccctaaatgacatgggtaaagttagaaaagatattccccaatgggaaccaagtaagggatggaatgattggcaacaggtaccattctgcagccaccatttccatcagttgattatgaaagacggacgcgaaatagtggttccgtgtagaaaccaagacgagttagtgggacgcgcaagagtgtcccaaggcgcaggatggtcgttacgtgaaaccgcttgtctgggcaaaagttatgcacaaatgtggcaactcatgtactttcacaggagggatttgcgacttgcagcaaatgcgatatgcagtgccgtaccagttgactggatcccgacatcgcgcacaacttggtccatccatgcacatcaccaatggatgactacagaagatatgctatccgtttggaatagagtttggattgaagaaaatccttggatggaagataaaacacacatttcaagttggggtgacgtcccctatctgggtaaacgagaagatcagtggtgtggtagcctaataggactaacagctcgtgctacatgggcaacgaatatccaggtagcgataaatcaagtgagacgtctcattggtaacgaaaactacttggactatatgacatcaatgaaaagatttaagaatgaaagtgacccagaaggagctttatggtaa

SEQ ID NO: 21876 - RNA, 9879 nt, synthetic construct
  misc_feature 1..9879: note = derived and/or modified CDS sequence (opt6) from DENV-1__GU131818__SS-prME
  source 1..9879: mol_type = other RNA
tcggtaacaatgcttttaatgcttatgcctaccgcattggcatttcacttaactacaagaggaggagaaccgcacatgattgtttcaaaacaagaacgaggtaaatcgttgctattcaaaacatccgcaggagtaaacatgtgtactttaatagcaatggaccttggggagttctgtgaagatactatgacgtataaatgtccaagaataacggaagccgaaccggacgatgtagactgttggtgtaatgctacggacacctgggtaacttatggaacatgttcacaaaccggagaacatcgacgcgataaaaggtctgtagctttagctcctcacgtcggattaggacttgaaacccgtactgaaacatggatgtcctccgaaggagcatggaaacaaattcaaaaagttgaaacctgggcattacggcacccaggatttactgtaatagctctcttcttagcccacgctatagggacctctataacccaaaaaggaataatttttattttgcttatgttggtaacaccaagcatggcaatgagatgtgtagggataggctccagagattttgtagaaggtctcagtggggcaacatgggtagatgtggtcttagaacatgggtcgtgtgttaccactatggcgaaagacaaaccaacgttagacatagaactgcttaaaacagaagttacaaatcctgcagttctgagaaaactttgtatagaagcgaaaataagcaacacaaccacggactcgaggtgtccgactcaaggagaagcgacattagtggaagaacaagatgccaatttcgtgtgtcgacggacgtttgttgataggggatgggggaatggatgtggtctctttggaaaaggcagcttaatcacatgtgctaaatttaaatgtgttaccaaactggaaggtaaaactgttcagcatgaaaatttaaaatattcagtgattgtgaccgtgcacacgggagatcaacaccaagttggaaatgaatcaacggagcatggaactacagctactataacacctcaagcaccctccactgaaatacaattgaccgattacggtgccctaacattagattgcagccctcgtactggattagactttaacgagatggttcttttaacaatgaaagaaaaatcatggctggtgcataagcaatggtttttagatcttcccttaccctggacatccggggcatcaacctcccaagaaacatggaatcgtaaagatctcctggtaactttcaaaacagcgcacgcaaagaaacaggaagtcgtagtcctaggatctcaagaaggagctatgcacactgcattgactggcgccactgaaatacagacatccggtactaccacgatcttcgctggtcacctaaaatgtagactcaaaatggataagttaacactaaaaggaacaagttatgtgatgtgtaccggatctttcaaattggagaaggaagtagcagaaacacaacatggtacagtcctagttcaaataaaatatgagggtactgacgccccctgtaagatacctttctcaactcaagatgaaaaaggagttacacagaatggtcgtttaataactgctaatccgatagttactgacaaggagaaacctgtcaacatagaagcagagccaccctttggtgaatcctatatagtaataggcgcaggagaaaaagcattgaaattaagttggtttaagaaaggttcatctatagggaaaatgtttgaagctacagccagaggcgcacggagaatggctatcctgggagacacagcgtgggacttcggtagtataggcggagtatttacatcagtagggaaattggtacaccagatcttcggtactgcatatggagttttattcagcggtgtgtcatggacaatgaagattggaataggtgtccttttaacctggctagggctcaacagcaggagcacatcgctttcaatgacctgtattgcagtcggcctcgtaacactatacttgggagtaatggttcaagctgatagcggatgcgtaataaactggaaagggcgagagctgaagtgtggctccggaatattcgtaacaaatgaggtccatacctggacagaacaatataaattccaagcagattcccctaaaagactgtcagcggcgattggcaaggcatgggaggaaggagtatgtggaataagatcggccacacggcttgaaaacattatgtggaaacaaatctcaaatgagttaaaccatatattactagaaaacgacatgaaattcaccgtcgtagtaggcgacgtagccggtatattagcacaaggcaagaaaatgatcagaccgcaaccgatggagtataaatactcatggaagtcttggggcaaggctaagataatcggtgcagatgtacaaaacacaacatttataatagacggtcccaacactcccgaatgtccggacgaccaacgggcatggaatatatgggaagtagaagactacggttttggaatatttaccacaaacatttggttaaaacttagagatagctacactcaagtttgtgatcatcgcctaatgtcagcggcaataaaagactccaaagcagttcatgctgatatgggatactggattgaatccgaaaagaatgaaacttggaaactggcaagagcatcatttatagaagtcaaaacctgcatttggcctaagtcacataccttatggagtaacggggttttagaaagtgaaatgataattcccaaaatctacggcggaccaatcagccaacataactatcgaccaggatacttcactcaaaccgctggaccatggcatttgggcaaattagaacttgacttcgacctatgcgagggaactactgttgtagttgacgaacattgtggaaatagaggaccctcattgagaacgaccaccgttaccggtaagataatacatgaatggtgttgccgcagttgtactcttccaccgctcagatttaaaggcgaagacggatgttggtacggaatggagattagacctgtcaaagaaaaagaagaaaaccttgtcaaatcaatggtaagtgcgggaagcggggaagttgactcattttctcttggcctactatgtattagtataatgatcgaagaagtgatgcgcagccgatggagcagaaaaatgttgatgaccggtacgcttgcggttttctttctgttaataatgggtcaattaacttggaatgatcttattcgactatgtatcatggttggcgcaaacgcctctgatagaatgggaatggggacgacttatttagcgttaatggcaacgtttaagatgagaccaatgttcgcggttggcttactttttaggagacttacctcacgcgaagtccttctactcactataggcttaagtttggtagcaagtgtagagctgcccaatagcctagaagaattgggcgacggcctagcaatgggaattatgatactaaagttgttaacagactttcaaagccatcaattgtgggcgactttactttcgttgactttcataaaaaccactttttctctgcattatgcatggaaaacaatggcgatggtacttagcatcgtaagtttattcccactgtgtctatcgaccacatctcagaaaactacatggttacccgtgctcctcggctcattaggatgtaaacctcttacaatgtttctcatcgcagagaataaaatctggggacgaaaatcttggccacttaatgagggaataatggctgtcggcattgtttctatcctgttaagctcactcctgaaaaatgatgtaccactggccggtccgctcatagccggaggtatgttaatagcatgttacgttatatcgggaagttccgccgacctatcattagaaaaagcagcagaggtttcatgggaagaggaagcggaacatagcggcgccagccataatatactggtcgaagtgcaagacgatggtacaatgaaaatcaaagacgaagaaagagacgacacactaacaatattacttaaagctacactacttgcggtaagtggggtttatcccttatctataccagcaaccctatttgtctggtatttttggcaaaagaaaaagcaaaggtccggtgtactatgggacacaccatcgccacccgaagtcgaaagagcagtacttgacgacggtatataccgtattatgcagagaggactattagggagaagtcaagtcggagtaggtgtttttcaagaaaacgtgttccatactatgtggcatgtaaccagaggtgcagttttaatgtaccaaggaaaaaggcttgaaccatcatgggcaagtgttaagaaagatcttatttcctatggaggaggttggagacttcaagggagttggaacacaggagaagaggtacaggtcattgctgtggagccaggcaaaaatcccaaaaatgtacaaactgcccccggaacattcaaaacaagtgaaggtgaggtcggggcaattgccctagattttaagcctggtacaagtggaagtcccattgttaatagagagggaaagatagtaggattatatgggaacggagtggtaacaaccagcggaacttatgtttcggctatagcccaggcgaaagcaagtcaagaagggcctttaccggagattgaggatgaagtttttcggaagcgtaatctaacaatcatggacctgcacccgggatcaggtaaaacccgtcgttacttgccagcaatagtgcgcgaagctataaaaagaaaactaagaacattaattttagccccgacaagagtggttgcaagtgagatggccgaagcactaaaaggcatgcctataaggtaccagactactgccgtaaaatctgaacataccgggaaagagattgtcgatctcatgtgtcacgcaacattcaccatgagattactttcaccagttcgagtccctaactataatatgataatcatggatgaggcccatttcacggaccccagcagcatagcagctaggggatatatatcaacaagggtaggcatgggtgaagccgctgcaatatttatgactgcgacacctccaggatcagtagaagcatttccgcaatctaatgcagtaatacaagatgaagaaagagatatacctgaacgatcatggaatagcggatacgaatggatcacggacttccccgggaagaccgtttggtttgtacctagtattaagtcagggaatgatatcgcaaattgtcttaggaaaaatgggaaaagagttatacaattatccaggaagactttcgacacagaataccagaaaactaaaaataacgattgggattacgtagtaacgacagatatttctgaaatgggtgccaactttagagctgatcgagtaatagatccgcggcgatgtttaaaacctgttatcttaaaagacggaccagaaagggtaattcttgccggccccatgccagtaactgtagcatcagcagctcaacgaagaggtcgcataggtcgaaatcataataaagagggcgaccagtatatatatatggggcaaccgctcaataacgacgaggaccacgcccattggactgaagcaaaaatgttgctggataacataaacacccccgaaggaattataccagccctctttgaacctgagcgtgagaaaagtgcggcaatagacggtgaatatagactacgaggtgaagctcgtaaaacattcgtagagctgatgcgacgaggagatcttcccgtttggcttagttacaaagttgcctcagaaggatttcagtatagtgatcgaagatggtgctttgatggagaaaggaataaccaagtactcgaagaaaacatggacgttgaaatttggaccaaggagggcgaaaggaagaaactaagaccacgttggctagatgcgaggacctattcagatccattggcattgcgcgaatttaaagagttcgctgcaggcaggagaagcgtcagcggtgatttgattttagaaataggcaagctaccacaacatctaacacaaagagcacaaaatgccttagacaatttggtaatgttacacaattccgaacagggcggtagagcgtataggcacgcaatggaggaattacctgacacaatcgagactcttatgttactagctttaatagcagtactaacaggcggagtcacactgttcttcctaagtggccgcgggctaggtaaaacatcgattggccttctatgcgtaatggcctcttctgccctattatggatggcgtctgtcgaaccacattggatcgcagccagtatcatcttagagttcttcttaatggtattgctaataccagaaccggaccgtcaacgaaccccacaggataaccaattagcatatgtagtgataggattgctatttatgattttaacagtggcggcaaatgagatgggattactagaaactactaagaaagacttgggaatcggacatgtagcagttgagaaccaccatcacgccgccatgctagacgtagatctgcatcctgcctcagcatggacactttacgccgttgcaacaactataattaccccgatgatgcgacacactatcgaaaatacaacagcgaacatatccctaaccgctattgctaaccaggcagcgatactaatgggtcttgataaaggctggcctatttcgaaaatggatataggagtcccgttgttagccctaggatgctattcacaagtaaaccctctaacattaacagctgcggtattaatgctggtggcacactatgctataattggaccgggcttgcaagccaaagcaacaagggaagcccagaaaagaacagccgcaggaatcatgaaaaacccaacagtggatggaatagtcgcaatcgatttagacccagtagtatatgacgcaaaatttgagaaacaactaggtcagattatgctattagttctatgtacctctcaaatattactcatgcgcactacctgggcattatgtgaatcgattacacttgctacggggcccttaaccactttatgggaggggagccctggcaagttttggaatactaccatcgcagtttctatggccaatatattcagagggtcctacctagccggcgccagtctcgcattttccttaatgaagtctttgggaggagggagaaggggtacaggcgcacaaggtgaaaccctgggagagaaatggaaaagacaacttaaccagctaagcaaatcagagtttaacacatataaaaggtcaggtataatggaagttgaccgtagtgaagcaaaagaagggttgaaaaggggagaaacaacaaaacatgcagtgtctcgtggaacagcgaaattacgctggttcgtagaaagaaatcttgtcaaacctgaaggaaaagtaatcgatctcggctgcggacgtggaggatggtcatactattgcgcgggactcaagaaagtaacagaggttaaaggatacactaaaggaggtcctggacatgaagaaccaatacccatggcaacttatggatggaatctagtaaaactgcatagtggaaaagatgtatttttcatacctccagaaaaatgtgatactttgttgtgtgatataggagagtcttcgccaaaccctactatcgaagaaggaagaaccttaagagttttaaaaatggtggaaccatggttgcgaggcaatcaattctgcatcaaaatactaaatccctatatgccttcagtagtggaaacacttgaacaaatgcaacgtaaacatggaggtatgttggtacgaaaccctctcagcaggaatagcacccatgaaatgtattgggtatcttgcggtactggtaatattgtatccgccgtgaatatgactagcaggatgctactaaacagattcacgatggcacataggaaacctacgtatgaaagggatgttgatttaggagccggaacccgacacgtagccgtagagcctgaagttgcaaatcttgatataataggacaacgtattgagaatataaagcatgaacacaaatcgacatggcactacgatgaagacaatccatacaaaacctgggcttaccatggatcttatgaagttaagccaagtgggtccgcaagtagcatggtaaatggtgttgtcaaacttctgacaaagccctgggacgtcatcccaatggtcacacagatagctatgacagacaccacgccatttgggcaacaaagggtctttaaagaaaaagtagacacaaggacgccaaaagcaaaacgagggaccgcccagataatggaagttaccgcaaaatggctgtggggtttcctctctcgaaacaagaaacctcgtatatgtacacgtgaagaatttacacgaaaagttcgtagcaacgcagcaatcggggcagtttttgtcgacgaaaatcaatggaacagcgccaaagaggctgtggaagacgaacgattctgggatctagtgcatcgcgaaagagaattacataaacagggcaaatgtgcaacttgtgtatataacatgatgggaaaaagggagaagaaactaggtgagtttggtaaagccaaaggctcgcgagctatctggtatatgtggttaggagcaaggtttttagagttcgaagctctaggcttcatgaacgaagatcactggttcagcagagaaaattcactgtcaggagttgaaggcgaaggactacataagctaggatatatactacgggacattagcaaaatcccaggagggaatatgtatgccgatgacactgccggttgggatactagaataacagaagatgacttgcagaacgaagctaaaataacagatataatggagcccgaacatgcactactggctaagtccattttcaaattgacataccaaaataaggttgtacgcgttcaacgtcctgccaaaaatggcacagtaatggacgtcatatcccgaagagatcaaagaggatcagggcaagtgggcacgtacggattgaacacattcacaaatatggaagcccagttaataagacaaatggagtctgaggaaatttttagtccaagtgaactagagacacctaatttagcgggccgagtattagattggttggaaaaacatggggtagaacgactcaaaagaatggcgatctcaggcgatgactgcgtagtaaaacctatagatgatcgcttcgctactgctctaacagctttaaacgacatgggaaaagtaagaaaggacataccacaatgggaaccgagtaaaggctggaatgattggcaacaagtccctttttgtagtcaccattttcatcaactaatcatgaaagatggaagagaaatagtcgtaccatgtcgtaatcaagatgagctagtgggaagggcgcgcgtgagccagggggctggatggagcctaaaggagacagcttgtttgggaaaaagttacgcacaaatgtggcaacttatgtacttccacaggagggatctgaggctcgcggcaaacgccatatgctccgcagtacctgtagactgggtgcctacaagtagaactacttggtcaattcacgctcatcatcaatggatgactaccgaagatatgttatcagtatggaatcgcgtctggatagaagaaaacccatggatggaagacaaaacacacatatcttcatggggcgacgttccctatcttggaaaacgagaggaccagtggtgtggatccttgattgggttgacggcaagggcaacgtgggctacaaacatacaggtagccattaatcaagtacggaggcttataggaaacgagaattacctagactacatgaccagtatgaaaaggttcaaaaacgaaagcgatccagaaggagcattgtggtga

SEQ ID NO: 21877 - RNA, 9879 nt, synthetic construct
  misc_feature 1..9879: note = derived and/or modified CDS sequence (opt6) from DENV-1__GU131820__SS-prME
  source 1..9879: mol_type = other RNA
agcgtaactatgctcttaatgcttatgccaacagctttggcattccacttgacaacgcgaggcggagaacctcacatgatagtgacaaaacaagaacgaggcaaatctttactatttaaaacaagcgctggagtaaacatgtgcacattgatcgctatggatctgggtgaattatgtgaagataccatgacatataaatgtccacgtataacagaagctgaacctgacgacgtagattgttggtgtaacgcaacagacacttgggtaacctatggtacatgctcacagactggtgaacaccgccgcgacaaaagatcagttgcacttgccccacatgttggtcttggtctggaaacgagaacggaaacttggatgtcttcagaaggtgcatggaaacaaatacaaagagtcgagacatgggcacttcgacatccaggcttcacagttatagcgttattcctagctcatgccatagggacatccataacccagaaaggaatcatatttatacttctaatgctggtcacgccatctatggcaatgaggtgtgtagggatcggttcacgagatttcgtagaaggcctatcgggtgcaacatgggtcgatgtggtcttggaacacggatcctgtgtcacgacgatggccaaagataaaccgaccttggatatcgaactattgaaaactgaggtcacaaatccagcggttttaaggaaattatgtattgaagcgaaaatatccaacactacaacggattcgagatgcccaacccaaggtgaagctacacttatggaagaacaagatgctaacttcgtatgccgcaggacatttgtcgaccgaggttggggaaacgggtgtggacttttcgggaaaggttccttaattacatgtgcaaaatttaaatgtgtcacaaaactcgagggtaaaatagtgcagtacgagaatctaaaatacagcgtaatcgtaacagtacatacaggagaccaacaccaggtaggaaatgaatctacggaacacggaacaactgcaacaataacgccacaagcaccgacatcagaaatacagcttactgactatggagccttaactcttgactgctcacccaggaccggtctggactttaatgaaatggtactactaaccatgaaagagaaaagctggctagtccataagcagtggtttttagatttgccattaccgtggacatcaggtgctagtacttcacaagaaacatggaacaggcaggatttgctagtaacatttaagacagcacacgccaagaaacaggaagtggtcgttttaggatcacaggaaggtgccatgcatacagctctaacgggtgcaacagagattcaaacaagcgggactacaacaatctttgcagggcacttaaaatgtagactaaaaatggataaactcacgttaaaaggtatgtcatatgtaatgtgcaccggctcattcaagttagaaaaagaagtagcagaaacacaacatgggacagttttagtacaaataaaatacgaagggacagatgccccatgtaagataccattttcaacccaggatgaaaaaggtgtcactcaaaacggaaggttaataacagctaatcctattgtaacggataaagaaaaaccagttaatatagaagctgaaccaccttttggcgagagctatatcgtcatcggagcaggagaaaaagccctcaagctgtcttggttcaagaaaggaagttctataggaaaaatgtttgaagctactgcacggggagctagaagaatggcaatactaggggatacagcatgggatttcggatctatcggaggcgtatttaccagtgttggaaaactcgtgcaccaaatttttggtacagcgtatggggtattattttctggtgtgtcatggaccatgaaaatcggaattggagtattattaacgtggttaggtctcaactcacggtctacgtcgttgtcaatgacttgtattgcagtaggattagtgacgttgtacctcggggttatggttcaagcagatagtggatgtgttattaattggaaggggcgagaactcaaatgtgggagtggtatctttgtaactaacgaggtacatacatggactgaacaatataaatttcaagcagattcaccaaagaggctttcagcggcaattggcaaagcatgggaagaaggagtatgtggcataagatctgcaacccgattagagaacattatgtggaaacagatttcgaatgaactaaaccatatattattagagaatgatatgaagtttacagtggtcgtcggcgatgtcgtcggcatcctcgcacaggggaagaaaatgatacgtccgcagccaatggaacacaaatattcatggaaaagttgggggaaagctaaaattattggcgcagatgttcaaaacacaacatttataatagacggtcccaacactccagaatgtccagacgatcagcgcgcatggaatatatgggaggtagaggattacggcttcgggatatttactactaacatatggttaaaactaagagacagttacactcaagtttgtgatcatcgcttgatgtctgctgccataaaggattctaaagcagttcatgcagacatgggctattggattgaaagtgagaaaaatgaaacttggaaattagctcgagcatcattcattgaagtgaaaacatgtatctggccaaaaagtcatactctatggtccaatggagtactggagagtgagatgataataccaaaaatatatggaggaccaattagtcaacacaactatcgtccgggctattttacacagactgcgggaccgtggcatctggggaaattggagctggacttcgatttatgtgaaggcacaacagtagtcgtcgacgagcattgcggaaatagaggtccatctcttcggacgacaacggtgacaggaaaaatcattcacgaatggtgctgtaggtcatgtacattgccaccactacgattcaaaggagaagacggatgctggtacgggatggaaattagaccagtaaaagagaaagaagaaaatctggttaagagcatggtaagcgcaggactaggtgaggtggacagtttctcactgggattactttgtataagcataatgatagaggaggttatgcgctcaagatggagtcgcaaaatgttaatggcggggacccttgctgtgttcttactattaattatgggacaattaacctggaacgatttaatacggctatgcattatggtcggtgcaaatgcgagtgatcgtatgggtatgggaacgacgtacctggctttaatggctacattcaaaatgcgacctatgtttgcagttggcctgctttttagaagattaacaagtagagaggttttactcctaacaatagggctaagcctggtagcgtccgttgaactacccaatagtttagaagaactaggggatggactcgcaatggggataatgatcttaaaacttctaacagattttcaatcgcatcagttatgggcaaccttattatcattaacatttattaaaacgactttgtcgctccactatgcgtggaaaacaatggccatggttttaagtattgtcagcttatttccgctctgcctgagcactacatcccagaaaactacatggttaccggtgttgttaggttcactaggatgtaagccgctgactatgtttttaattgctgaaaacaagatatggggcagaaaatcatggccgttaaacgaaggtataatggctgttggggtagtaagcatattattatcttcactactcaaaaacgacgtcccattggcgggacccctaattgcaggaggtatgttgatcgcatgttacgtaatatcaggcagctctgcagacctttcgctcgagaaagccgcagaagtcagttgggaagaggaggcagagcattcgggagccagccataatattttagtggaggttcaagatgacggaaccatgaagataaaggatgaagaacgtgacgacacgctgacgattttattaaaagcgactcttttagccatcagcggagtatacccattatcaattccggcaactttatttgtatggtatttctggcagaagaagaaacaacgaagtggagtgctatgggacactccttcacctccagaagtagaacgcgctgtactcgatgacgggatatatcgtataatgcaacggggactattagggagaagccaagttggcgttggcgtatttcaagaaaatgtctttcacactatgtggcatgttactaggggagctgttttgatgtaccagggaaagcgattagaaccatcatgggccagcgttaagaaagacttaataagctacgggggaggttggagattacaaggatcatggaatactggagaagaagtccaagttatagctgttgaaccgggaaagaacccaaagaatgtccaaactgccccaggtacatttaaaactccagaaggagaagttggagccatagcacttgattttaaacctggaaccagcggaagcccgatagttaatagagaagggaaaatcgtagggttatatggcaatggagtagtaaccacgagtggaacatacgtttcagcgattgcccaggcaaaagctagtcaagaaggaccactacctgaaatagaagatgaggttttcagaaaaagaaaccttacgattatggacctacatcctggtagcgggaaaacgaggcgatatctgcccgccatagtaagagaggcaatcaagcgaaaactaagaaccctcattctggctcctacacgcgtagtggcatcagagatggcagaagcgttgaaaggtatgcccatacgttatcagacaactgcagtgaaaagcgaacacactggcaaagaaatagttgatctaatgtgccatgctacttttacaatgagacttctgtcacccgtaagagtaccaaactataatatgataataatggatgaagcgcactttacagatcctagttctatagcagcaagagggtacatatcaactagagtaggtatgggagaagctgccgcaatatttatgaccgccacaccgcctggctcagttgaagcatttcctcaatcaaatgcagttatccaggatgaagaacgagatatcccggagcgctcatggaactcagggtatgaatggatcactgactttccaggtaaaaccgtatggtttgtacccagcataaagtctggcaatgatatagctaattgtctaagaaagaacgggaaaagagtgatccaattaagtaggaaaacatttgatacggagtatcagaaaaccaaaaacaatgattgggattatgtagtaaccactgatattagtgaaatgggggctaatttccgcgccgatagagtaattgacccccgaaggtgtcttaaaccagtaatactcaaagatggtcccgaacgagtcattttagctggccctatgcccgtaactgtcgctagtgccgcacaacgcagaggccgtataggaaggaatcataacaaagaaggggatcaatacatttacatggggcaacctctaaacaacgacgaagaccacgcacattggacagaagccaaaatgctactcgataacattaatacacctgaagggattatacctgcattatttgagcctgaaagggaaaaatctgccgctattgatggtgagtatcgtctacgcggcgaagcccggaaaacttttgttgaacttatgagacgaggagacttgccagtatggctgtcatataaagttgcatccgagggatttcaatactcagatcgtaggtggtgcttcgacggcgaaagaaataatcaagtgctggaggaaaacatggacgttgagatttggacaaaggagggcgaaagaaagaaacttagacctaggtggctagatgcacggacctacagtgacccactcgcattacgtgaatttaaagaatttgctgctggacgacgatctgtaagcggagacttaatactagaaattggcaaactcccgcaacatttaactcaacgagcacaaaatgctttagataatctcgtaatgctgcacaattctgagcaaggaggtcgggcctataggcacgctatggaagaactacccgacacaattgagacactaatgttgttggccttaatcgcagtcctgactggcggagtaacgctattctttttatcaggaaggggattaggaaaaacctcaataggactactatgtgttatggcttccagtgttcttttatggatggcatccgtggaacctcactggattgcggcatcaattattttagaatttttcctaatggtattactaatcccagaacccgatagacagcgcacgccacaagataatcaactagcttacgtagtaataggattgctatttatgatcctaactgtagctgctaatgagatgggattgctagaaactacgaagaaagacttaggtataggacatgtcgccgttgaaaaccatcaccacgcaacaatgttagacgtagatttgcaccctgctagtgcatggacactatacgcggtagccacaaccattataactcctatgatgcggcatacaattgaaaatacaacagccaatataagccttactgctattgcaaatcaagcagcgatattaatgggattggataaaggctggccgatatcaaaaatggatatcggagtacccttactggctctcggttgttacagtcaagtaaacccgttaacgcttactgctgcagtactaatgttggttgctcattacgcgattataggaccaggacttcaagcgaaggcaacgagggaagcacagaagagaacggcagccgggataatgaaaaacccaacggttgatggaattgtagcaatagatctagatcccgtagtctacgacgctaaattcgaaaaacaattaggacagataatgctactaatcctctgcacttcgcagattttacttatgagaacaacttgggcactatgtgaatctattacgcttgcgactggaccattaacaactttgtgggaagggtcgccgggaaagttctggaacaccactattgcagtatctatggccaatatttttcgaggtagctatcttgccggggcaggactcgcattctctctcatgaaaagcctaggaggaggaagaaggggtaccggagcacaaggagagaccttaggagaaaaatggaaaagacaactcaatcaactatcgaaatcagagttcaacatttacaagaggtcaggaataatggaggtggatagatcagaagctaaagagggattaaagaggggagaaacaactaggcatgcagtaagccgtggtactgcgaaattacgttggtttgtagaacgaaatttagttaaaccagagggaaaggttattgatttaggttgtggaagaggagggtggtcttattattgtgcgggcttaaagaaagtaaccgaagtgaaaggatatacgaaagggggcccgggtcatgaggaacctataccaatggcaacctacggatggaacttagttaagttacactctggcaaggacgtgttctttaccccaccagaaagatgcgacaccttactatgcgatataggagaatcaagcccaaatcctacaatagaagaggggagaacactaagagtattgaaaatggtcgagccgtggcttcgaggcaaccaattttgtataaaaatcttaaacccgtacatgccgtccgttgtcgaaacattagagcagatgcaaagaaagcatgggggaatgctcgttaggaatccattgagtcgtaactcaacacatgagatgtattgggtttcctgtggcacgggaaacatagtgagtgctgttaacatgacctcaagaatgttattgaacagattcacgatggcacatcgcaagcccacatatgaacgcgacgtagatcttggggcaggtacacgacacgtagctgtggaacccgaagtagccaatctggatataatcggccaaaggatagaaaacataaagcatgagcataaatcgacatggcattacgacgaagacaatccgtacaaaacctgggcttatcacggaagttatgaagtaaaaccatctggatcggcttctagtatggtcaacggagttgtaaaattactgactaaaccatgggatgtcatcccaatggtaacacagattgctatgacagatactactccgttcggtcaacaacgtgtattcaaggagaaagttgataccagaacaccgaaagcgaaacgcggaacagcacaaattatggaagtcaccgcaaggtggttatggggatttttatcaaggaataaaaagcctagaatatgtaccagagaggaatttacccgaaaggttagaagtaatgcagcgatcggggctgttttcgttgatgaaaatcaatggaactcagcaaaagaagctgtagaagacgaacgattctgggatttggtacaaaaagaacgagagttacataaacaaggaaaatgcgcaacctgcgtgtacaacatgatggggaagcgtgagaagaaactgggcgaatttggtaaagcaaagggttcccgagccatctggtatatgtggcttggtgcacggtttctagaatttgaagcactcggatttatgaatgaggaccactggttttcgagagagaacagtttgtcaggagtagaaggagaagggctccataagctaggatacatattgagggatatctctaaaattcctggtggtaatatgtacgccgacgacacagcaggatgggacaccagaatcacggaagatgatctacaaaacgaagcaaaaataaccgacatcatggaacctgagcatgcgctgctcgctacttctatattcaaattgacataccaaaataaagtcgtacgggttcaaaggcccgcaaagaatgggaccgtaatggacgtaataagtaggagagatcaacgcgggtccggacaggtcggaacgtatggtttgaacacctttaccaatatggaagctcaattaatcagacaaatggaaagcgaggggatttttctcccaagtgaattggaaacaccaaatttagcagaacgtgtcctggattggttagagaaacacggggtcgaacgcttaaaaagaatggccatttctggtgatgattgtgtcgttaaaccaatagacgacagattcgccactgcactaactgctctaaatgacatgggcaaggtccgaaaagatataccacagtgggaaccttcaaagggatggaacgactggcaacaagtaccattttgcagtcaccactttcatcaattaataatgaaagacggcagggaaatagttgtcccatgtcgtaatcaagacgaactggttggcagggctagggtgagccaaggtgcagggtggtctttgagagaaacggcttgcctcggtaaaagttatgcacagatgtggcagttaatgtatttccatcgaagagatttacgtctcgctgcaaacgccatttgtagtgccgtccccgtagactgggtccctacttcgagaacaacttggtcaatccatgcgcatcatcaatggatgacgacagaagatatgttatcagtatggaatagggtatggatagaagagaacccatggatggaagataagacccatgtatcttcatggggagatgtcccttacctcggcaaaagagaagatcaatggtgtggaagcctgatcggattgacagctcgagcaacttgggcttcaaatatccaagtagcgataaatcaagtaagacgacttataggaaatgaaaactatttggactacatgacaagtatgaaaagatttaagaatgaaggagatccagagggcgccttatggtga

SEQ ID NO: 21878 - RNA, 9879 nt, synthetic construct
  misc_feature 1..9879: note = derived and/or modified CDS sequence (opt6) from DENV-1__HM181970__SS-prME
  source 1..9879: mol_type = other RNA
agtgttacaatgctactaatgttgatgccaacagcattggcattccatttaacgacgcgtggcggagaaccccatatgatagtatcgaaacaagaaagaggcaaatcgcttttgtttaaaacatcagccggagtgaacatgtgtacattaatagcaatggaccttggcgaattatgtgaagacacaatgacatataaatgtccaagaataactgaagccgaaccggatgacgtagattgttggtgcaacgccactgacacttgggttacatatgggacctgctcccaaaccggagaacaccgaagggacaaaagatcggtggcattagctccacacgtaggtttgggcttggaaacgcgaactgaaacatggatgagctcagaaggagcatggaaacaaatacaaagagtagaaacatgggcactaagacatccggggtttacagttatcgcgttatttttagctcacgcaataggaacttcaatcacacaaaaagggattattttcattttattgatgctggttacacccagcatggcaatgcgatgtgtaggaataggatctcgagactttgtagaaggactgagtggagctacatgggttgatgtagtactggaacatgggagctgcgtgacaacaatggcgaaagacaaaccgacactagatatagaactgctaaaaactgaagttacaaatccggcagtcctacggaaattgtgcatcgaagcaaaaatctctaatactactacggactcgcgatgtccaactcaaggcgaagcgaccctagtagaagaacaagatgcaaacttcgtatgcagaagaacgtttgtagatagagggtggggaaatggctgcgggttgttcggcaaaggaagtctaataacttgtgcgaaattcaaatgcgtgacaaaattagaagggaaaatagtccaatatgaaaacttaaaatattcagtaattgtcactgtccacacaggggatcaacatcaagtcggtaatgaaagcacagaacacggaactacagcaactattactccacaagctccaacaacggaaattcaactcacagactatggggcgctgactcttgattgctcaccgcgaacgggtctagacttcaatgaaatggtattgttaacaatgaaagagaaaagttggctggtacacaaacaatggttcttagatctgccattaccatggacatccggtgccagcactagccaagagacctggaatagacaagacttacttgtaacgtttaaaactgcccatgccaagaaacaagaggtagtggttctaggaagtcaagaaggagcaatgcacactgcattaacaggagcaacagaaatacaaacaagcggaaccacgacgatttttgcgggacacctaaaatgtagacttaaaatggataaactaacccttaaagggatgtcatatgttatgtgtacaggttctttcaaactcgagaaagaagtagcggagactcagcatggtactgtacttgtacaaatcaaatatgaaggaactgacgctccatgcaaaataccattcagcacacaagatgaaaaaggagtcacgcaaaatggccgattaattacggcaaatccaatagttactgataaagaaaaacccgtgaatatcgaagctgaaccaccatttggcgaaagctatatagttatcggagcgggtgagaaggctttaaaactcagttggtttaagaaagggtcatcaattggcaaaatgtttgaagcaacagcaagaggagcaagacggatggcaatcttgggagataccgcgtgggattttggatccattggcggagtatttaccagtgtaggcaaactaatacatcaaatatttgggactgcgtacggagtcttgttcagtggcgtaagttggacgatgaaaatcgggataggagttttattgacatggctggggctaaatagcaggagcactagcttatcaatgacctgcattgcagttggtctagtaactttatatctaggagtcatggtacaagcagattcaggatgtgtgatcaattggaaaggacgagaactgaaatgcgggagtgggatctttgtaacaaatgaggtacatacatggacagaacaatataaatttcaagctgactcaccaaaaaggttaagcgcagccataggcaaagcatgggaagaaggtgtgtgtggtatacgaagcgctacaagactagagaatataatgtggaagcaaatttcgaacgaattaaatcacatcttgttagaaaacgacatgaaattaacagttgtagtaggagacgtggctggaatattgggacaaggcaaaaagatgattagaccacagccaatggaatataaatacagctggaaaagttggggaaaagcaaaaattatcggtgcagatgcccagaataccacgtttataatagacggacctaacacacctgagtgtcctgatgaccaacgagcatggaacatatgggaagtggaagactacgggtttggaatctttacaacaaacatatggcttaaattaagggacagttatacacaagtctgtgatcacagattaatgtcagcagcaataaaagattcaaaagcggtccacgcagacatgggttattggattgaatcagagaaaaacgaaacgtggaagctagctagggcatcattcattgaagtaaaaacttgtatctggcccaagagtcatacattatggtctaacggggtattggaatcagagatgataatacccaaaatatacggcggaccgatatctcagcataactacagaccaggatattttacgcaaactgctggtccatggcatttgggcaaattggagttggatttcgatctatgtgaaggtaccacagtagtagttgacgaacattgtggcaaccgtgggcctagcttaagaacaacaaccgtaaccggtaaaattatccatgaatggtgctgtcgatcttgcaccttacctcctcttagatttagaggagaagatgggtgctggtatggaatggagatccgacctgttaaagaaaaagaggagaacctagtaaaaagtatggtatctgcaggtagcggggaggtagactcattctcgctaggactcttatgcattagtataatgatagaagaagtaatgcgttccaggtggtctagaaaaatgctaatgacgggtacattagctgtattcttcttgttaataatgggtcaactaacatggaacgatttaatcaggctttgcataatggtgggtgctaatgcttttgatcgtatgggcatgggcaccacttatctagctcttatggcgacatttaaaatgagacccatgtttgcagtaggtttattgtttagacgcctaacaagtagagaagttcttctactgacaataggtttaagcctggtagcatcagtggaattgccaaacagtctggaggaactcggtgatgggttagctatgggaattatgattctaaagctcttgacagattttcaaagccatcaactctgggcaacactactaagtctaacttttattaaaacgacattctcactacattacgcttggaagactatggcaatggtcctgtcaattgtgtcactattccctttgtgtttgtccacaacttcccagaaaactacctggctaccagttctcttaggatccctaggatgtaaacctctcactatgtttctaatagcagagaacaaaatatggggccgaaaatcgtggccattaaacgagggaattatggcagtagggatagtatctattctactctcgagcctcctaaagaatgacgtgccgctagctggtcccttgattgctggaggtatgctaatcgcatgttatgtcatctccggctcgtctgccgatttaagtcttgaaaaagcagctgaagtaagttgggaggaagaagcggaacactctggtgcatctcataatatcctagttgaagtacaagacgatgggacaatgaaaataaaagatgaagaaagagatgacactctcaccatattactgaaagcaacattacttgcagtaagcggggtttaccctctaagtatacccgccaccttgtttgtttggtatttctggcagaagaagaaacaacgttcaggggtactatgggatacaccaagcccaccagaagtggagcgtgccgttttagatgacggcatatatcgcatcatgcaaagaggccttttaggaagaagccaggtaggtgtcggcgtgtttcaagaagacgtattccataccatgtggcacgtaacgcgtggagcagtactcatgtatcaaggaaaaagattggagccctcatgggcatccgtaaagaaggatctcatatcttacggcggtggatggcgactacgtggctcatggaacaccggtgaagaggtacaggtaatagctgtagaacctggcaaaaaccccaaaaacgtacaaactgcacctggaacttttaaaaccccagagggagaggtcggtgcaatagctttggacttcaaacccggcacgagtggaagtcctatagtgaacagggagggcaagatcgttggactatatggaaatggcgttgtaacaacttctggtacatacgtgtccgcgatagcccaggcaaaagcatctcaagaaggaccactgcccgaaatagaagatgaagttttccgtaaaagaaatttaacaataatggatcttcatccaggtagcggaaagacaagacgatatttgccagcaatagttcgagaagccataaaaagaaagctaagaaccttgatcctagccccaacaagagtagttgccagtgaaatggcagaagcattaaagggaatgcccatcagatatcaaacaaccgccgtgaaatcagagcacaccgggaaggaaatcgtagacctgatgtgccacgcaacattcacaatgagactcttatcaccagtaagagtgcctaactacaacatgataataatggatgaggcacacttcactgatccatctagcattgctgctagaggttacattagtacgagggtcggtatgggtgaagctgcagcaatatttatgacggccacaccacctggatctgttgaggcctttccacaatccaatgcggtaatacaagatgaagaacgagacatcccggaacggagctggaacagcggacacgaatggataacagatttcccaggcaaaaccgtctggttcgtcccatctataaaatcaggaaatgatatagctaattgcctaaggaaaaatggcaagcgtgtaattcagttatctagaaagacttttgatactgaataccagaaaactaaaaataatgattgggattatgtagtgacaactgacattagtgagatgggagctaatttcagagccgacagagtaattgatccgagaagatgtctaaaaccagtaattctaaaagatggtcccgaaagagttatactcgccggaccaatgccagtgacagttgcaagtgctgcccaacgtcggggaagaattggtcgaaaccacaacaaagaaggtgaccaatacatatatatgggacagccgctaaataacgatgaagatcacgcccattggacagaggctaaaatgttactcgacaacattaatacaccagaaggcataataccagcactttttgaaccagagagagaaaaatcagcagccgtagatggggaatacagactcaggggagaagcacgcaagactttcgtagaactcatgagacgaggtgacctgccagtgtggttgtcttataaagttgcctcagaaggattccaatactcggatcgacgatggtgttttgacggagagcgaaataatcaggttctcgaagaaaatatggatgtagagatttggactaaagaaggcgaaaggaagaaacttcgtccgaggtggctagacgcgcgaacatacagtgacccattagcgcttagagaatttaaagagttcgctgcaggtcggagatctgtatcgggagacttgatcttagaaataggaaaacttccgcaacatttaacacaacgggctcaaaacgcgttggataacctggtcatgttacacaatagtgaacaagggggcagggcatatagacacgcaatggaagaacttccggatacaatcgaaacgctaatgttgctcgcattgattgcggtcctcactggaggggtaacactattctttctaagtggaagagggttagggaaaacgagcattggattactctgtgtgatggctagtagtgtgttactctggatggccagcgtcgaaccacattggatagcggcatcgatcattctagaatttttccttatggttctcctgatcccggaacctgatcgtcaaaggacaccgcaagataaccagcttgcatatgttgttatcggattactttttatgatattaactgtagcagctaatgaaatgggactgctagagacaaccaagaaagatctggggatcggccatgtcgcagtagagaaccatcaccacgctgcaatgcttgatgtagatctacatcccgcgagtgcatggacattatacgccgtagcaacaacgatcataactccgatgatgagacatacaattgagaacacaacagctaatatctcccttacggcgatagcaaatcaggcggcgattctaatgggattggataaaggttggcctattagtaaaatggatataggtgtaccattacttgcacttggttgttacagccaagtgaaccccctgacattaacagcagcggtgctaatgttagttgcacactatgcaattataggaccaggactacaagcaaaagcgacacgcgaagcacagaaacgaacggccgcaggaataatgaaaaatcccacagtggacggcattgtagcaatagatttagatcctgtagtgtacgacgcaaaattcgagaagcagttaggccaaattatgcttttaatactctgtacttcccaaatattattgatgcgaactacgtgggctctgtgcgaaagtataacgttggccacaggaccactaacaacgttatgggaaggcagtcctggaaaattctggaacacaacaatcgcagtgtccatggctaatatctttagaggctcttatcttgccggtgcaggcctagctttcagtttaatgaaaagtctcgggggaggtagaagggggacaggagcacaaggagaaactctcggcgaaaaatggaaacgacaactaaaccaattatcaaaatccgagttcaatacctacaagagaagtggcataatggaggtggacagaagcgaagcgaaggaagggttaaaaagaggggagactactaaacatgctgtatctcgagggactgcaaaactacgctggttcgtggaaagaaatttagtcaagcctgaaggaaaagtaatagatttgggatgcggaagaggaggatggagctactattgtgctggactcaagaaagtgacagaggtaaagggatatacgaaaggtgggccaggacatgaagaacccattccgatggcgacttatggttggaatcttgtaaagttacactcaggaaaagatgtcttctttatccctccggaaaaatgtgatactctactttgtgacattggcgaatcgtctccaaatcccacaatcgaggaaggaagaaccctcagagtcttaaaaatggttgaaccatggcttaggggtaatcagttctgtattaagattttgaacccatacatgccaagtgttgtagagacactagaacaaatgcaaagaaagcacgggggaatgctagtaaggaaccctctaagtagaaactcaacacatgagatgtactgggtatcctgtggcaccggcaacatcgtatccgcagttaatatgacatctcgaatgctactaaatcgttttacaatggcacaccggaaaccaacgtacgagagagatgtagatttaggaaccggtacgagacacgttgcggtagaacccgaggtggccaacctagatataataggacaaaggatagaaaacataaagcatgaacataaaagtacctggcattacgacgaggacaatccgtacaaaacgtgggcatatcacggatcttatgaagtaaaaccgtcgggcagtgcatcctctatggtaaatggcgttgttaagctattaacaaaaccttgggatgtgattcctatggtgactcagatagcgatgaccgacacgacgccgtttgggcagcagagagtattcaaagagaaggtcgacacccgcacccccaaagcaaagagaggtactgcacaaattatggaggtgactgcaaggtggttatggggattcctatcacgaaataagaaacctcggatatgtacaagagaagaatttacacgtaaagtgcgaagcaatgccgcgataggcgcggtgttcgttgatgaaaatcaatggaatagtgctaaagaggctgtcgaggatgaacgattttgggatcttgtacatagagaaagagaacttcataagcaaggaaaatgcgcaacctgtgtatataacatgatgggaaaaagagagaagaaactgggcgaatttggcaaagctaaaggttctagagcaatatggtatatgtggttgggggccaggttcttggagttcgaggcgctcggatttatgaatgaagatcattggttctccagggagaacagcctgtccggagtcgagggagaaggtttacacaaattaggatacatcttacgagatataagtaaaataccaggaggcaatatgtacgcagatgacactgcgggttgggatacacgaattactgaagatgatctacaaaacgaggcaaagataactgacataatggaacccgagcacgcattgttagcaaaagcaatcttcaaattaacttatcaaaataaagtcgtcagagttcaaagacccgctaagaacggtacggttatggatgtaatatccaggcgtgatcaaagaggctctgggcaagttgggacttatggcctcaacacatttacaaacatggaagctcaattaattaggcagatggagagtgaaggaatcttcagcccaagcgaattggaaacacccaatctagcggaacgagctctagattggctagaaaaatacggtgttgaacgcttgaaaaggatggcaatctctggcgatgactgcgtagtgaagccgatagatgacaggtttgcaaccgcattaaccgcactgaatgatatgggcaaagtaaggaaagacataccacaatgggaaccgtcaaaaggatggaacgactggcaacaagtaccattttgcagtcaccatttccatcaattgataatgaaggatggaagagaaatcgtggtaccctgccgtaatcaagatgagctagtcggacgagcacgcgtatcacaaggtgccggctggtctctcagggagacagcatgtcttggaaagtcttatgcccaaatgtggcaattaatgtattttcaccgacgagatttaaggcttgctgcaaatgccatctgctcagctgtgccagtggactgggttccaacctccagaacgacctggagtattcatgctcatcaccagtggatgacaacagaggacatgctatcagtatggaaccgggtctggatagaggaaaatccctggatggaggacaagacacacataagctcttgggaagatgtcccatatcttgggaagagagaagatcaatggtgtggatcattaatcggactaacggcaagagcaacgtgggccacaaacatacaagttgcgattaaccaagttcgcaggttgatagggaatgaaaattatctagactatatgacatcaatgaaacgattcaagaatgaatcagaccctgaaggtgctctttggtaa

SEQ ID NO: 21879 - RNA, 9879 nt, synthetic construct
  misc_feature 1..9879: note = derived and/or modified CDS sequence (opt6) from DENV-1__GU131821__SS-prME
  source 1..9879: mol_type = other RNA
agtgtaaccatgcttcttatgcttatgcccactgcattggcatttcatcttactactcgaggtggggaaccccatatgatcgtatctaaacaagaaagagggaaatctcttctttttaaaacatcggccggtgtaaatatgtgcaccttaattgctatggatctgggtgagttctgtgaggacacaatgacttataaatgtccaagaataacagaagcggagcccgacgacgtagactgctggtgtaatgcgacggacacatgggtaacctatggtacatgttcgcaaacaggagaacatcggcgtgataaaagatctgttgcattagctccacacgtgggactaggcctagagacgcgaacggaaacatggatgagtagcgaaggtgcctggaaacaaatacaaaaagtagaaacatgggctttgcgacatcccgggtttacagttatcgcactatttctagcccacgctataggaacttcaatcactcaaaaaggcatcatcttcatactgctcatgttagtaacaccatccatggccatgcgatgcgtaggaatagggagccgagactttgtcgagggactttccggagccacgtgggtagatgtcgtattagaacatggcagttgtgttacgacaatggcaaaagacaaacctactttagatattgagttattaaaaacagaagtgaccaatccagctgtcctacgaaaattatgtatagaagccaaaattagcaatacaactactgactcaagatgccctactcaaggtgaagcaacactcgtcgaagaacaagacgcgaattttgtatgtagacggacatttgtagacagaggatggggaaacgggtgcggtttattcggcaaaggttccttaataacatgcgcaaaattcaaatgcgtaacgaaattagaaggaaaaactgtacagcacgagaatctgaaatactccgtaatagtaactgtacatacgggcgatcagcatcaagtcggaaacgagagtacagaacatggaacgacggctacaatcactccacaagcaccttctactgagatccaattaacagactatggagcgcttacccttgattgtagtcccagaacaggcctagattttaatgaaatggttcttctaacgatgaaagaaaaatcctggttagtccacaaacaatggttcttagatctccccctaccatggacatccggggcaagtacaagtcaagagacttggaacagaaaagatttattagtcacattcaaaacggctcatgctaagaaacaggaagtagtagtactgggatctcaagaaggtgccatgcatactgccctaacaggggctacagaaatacaaacatctggcacaacaacaatattcgcaggtcatttaaagtgccgtcttaaaatggataaattaacgttaaaaggtatgagttacgttatgtgcacgggttcatttaaacttgaaaaagaagtggctgagacacaacatggaacggtgcttgtacaaattaaatatgaaggtacagatgcgccttgtaaaatcccattctccacccaagacgaaaaaggggtgactcaaaatggaaggcttattacagcaaatcccattgtaacggataaggagaaaccagtaaacatagaagctgagccccctttcggagaatcatatatagtaataggagcaggagagaaggctcttaaattatcatggtttaagaaaggcagttctataggcaaaatgttcgaagcaacggcccgtggagctagacgcatggcaatactaggcgacactgcttgggattttggcagtattggaggtgtgttcacttcagtagggaaattggtccaccaaatatttggtacagcatacggggtcctttttagtggagtatcctggactatgaagatcgggatcggtgtattattgacatggctaggactcaatagtcgatccacctctttgagtatgacttgtatagctgtaggtctcgtaacgctctacctaggagttatggtacaagcagattctggttgtgtaatcaactggaaaggcagggaactaaagtgcggctctggcatatttgtaacaaatgaggtacatacttggacagaacaatataaatttcaagcagactcacccaagcgattatcagcagcaataggcaaggcttgggaggaaggagtatgtgggatacgtagtgccacacgtctggaaaacatcatgtggaaacagataagcaatgaactaaatcatattttactagaaaatgatatgaaatttactgtagtagtgggtgatgttgccggaatcttggcacaagggaagaaaatgattcgtccacaacctatggaatataaatactcatggaaaagctggggaaaagcaaaaatcataggtgcggatgtccaaaatacaacatttataatagatggtccaaatacacctgagtgcccagatgaccaacgagcatggaacatctgggaagtcgaggactatgggtttggcatatttacaactaatatctggttaaaactcagggattcttatacacaagtttgcgaccacaggttaatgtcagcggctataaaagattcgaaagcagtgcacgcggatatggggtattggattgaatctgagaaaaatgaaacctggaaacttgccagggctagtttcatagaggtaaaaacatgcatatggccaaaatcgcatacactgtggtcgaatggagtacttgaatcagaaatgataatcccaaaaatctacggcggaccaatatcgcagcacaactaccgtccgggttattttacacaaaccgcggggccatggcacttggggaagttggaacttgatttcgacttatgcgaaggtaccactgtagtggtagatgaacattgcggaaatcgcggaccgtcactcaggacaaccacagtaacaggaaaaattatccacgaatggtgttgtagatcgtgcacactaccaccgttaagatttaagggcgaagatgggtgctggtacggaatggaaattagacccgttaaggaaaaagaagaaaacttagtaaaaagcatggtatcagccggcagcggagaagttgacagtttctcattgggactactctgcatttcaatcatgatagaagaagtaatgaggtcccgctggtctaggaaaatgctaatgaccgggacactagcagtcttctttttgttaatcatgggacaactcacgtggaatgaccttatccggctctgtatcatggtaggtgccaacgcatccgatagaatgggaatgggaacgacttatttagctttaatggcgacttttaagatgcgcccaatgtttgccgtaggactcctattccgtaggctaacttctcgtgaagttctactattaacgatagggcttagtttggttgcatcagttgagctacccaatagtctcgaagaattaggggacggcctagctatgggcattatgatattaaaactattaacggattttcaaagtcaccagttgtgggccacattactgtctctaacatttataaagactacattttctcttcactatgcctggaagactatggcaatggtactatcaatagtatcccttttcccattatgcctatcaacgactagccagaagactacttggttaccagttctactcggctcgttaggctgcaaaccgttgacgatgtttttgatagcggaaaataagatctggggaagaaaatcatggccgttgaatgaaggaattatggccgtaggaatagtttctatacttctgtcatcgttgctgaaaaacgatgtgccactagccgggcccctaatagccggaggtatgttaatagcatgttacgtcatttcgggttcatcagctgatctttcgttagagaaagctgccgaagtcagctgggaagaagaagcggaacattcaggtgcctcccataatatactcgtggaagtacaagatgacggaacgatgaaaattaaagatgaagagagggatgacactctaacaattttgttaaaagcaacgttgttagcagtatcgggggtctatccgttatcaataccggcaaccctcttcgtatggtacttctggcagaagaagaaacagaggtccggggtgttatgggatactccatccccgccagaagtagaacgtgctgtattggacgatggtatttatagaataatgcaacgcggattattagggagatcgcaggtcggcgtaggagttttccaggagaacgtctttcacactatgtggcatgtgacaagaggggccgtcttgatgtatcagggcaaacgacttgaaccatcatgggcttcggtcaagaaagatttaatctcatatggaggagggtggcgtttacaaggatcatggaacacaggcgaggaggttcaagtaattgcggtcgaacccggcaaaaatcccaaaaatgtacaaacggcaccgggaactttcaaaacaagcgaaggggaagtaggagccattgcattagactttaaaccagggacgtccggatcccccatagtcaatagagagggcaagattgttggactttatggaaacggagtggtgactacatcaggtacatatgtgtcagccatagctcaagctaaagctagtcaagagggacctttaccagaaatagaagatgaggtattccgtaaaagaaatcttacaatcatggatttgcatccagggtcaggaaaaactcgtagatatctaccggctattgtccgcgaagctattaaacgaaaattgcgaaccctaattctagctcccacaagagttgtcgcaagcgaaatggcagaagcactaaagggtatgccaattcgttatcaaacaacagcggtgaaatcagagcacaccggtaaagaaattgtggatttaatgtgccatgcgacgtttactatgagattgctatcaccagtgagagttcctaattataacatgatcataatggacgaagctcacttcactgacccctcaagcattgcagcacgcggttatatatccacacgggttggtatgggcgaagccgcggccatctttatgacagctacgcccccaggaagcgtagaggcatttccgcagagtaacgccgttattcaagatgaggagagagatatcccggaaaggtcatggaacagtggatacgaatggataacagattttccaggaaagactgtatggtttgtccccagtatcaagagtgggaatgacatagctaactgtctacgcaagaatggcaaacgggttatccagctatctagaaagacgttcgacacagagtatcaaaagacaaagaataatgactgggactatgtagttacaactgacatatcagaaatgggggcaaatttccgcgcggatagagtaatcgaccccagacgttgcctgaaacctgttatactaaaagatggtcccgaacgtgtaattctcgcaggcccgatgcctgtaacagtagcttctgctgcgcaaagacgaggaaggatcggtagaaaccacaacaaggaaggcgatcagtatatatatatgggacaaccattaaataatgacgaagaccacgcccattggactgaagcaaaaatgttattggacaacataaacacaccagaaggtattataccagctctttttgagccagaaagagaaaagtcggcagcaattgatggagagtatagattacgcggagaggctagaaagacctttgttgaattaatgcgaagaggcgatctacctgtatggctctcgtataaggtagcgagtgaaggattccaatattctgacaggcggtggtgctttgacggagaacggaataatcaagtccttgaagaaaacatggacgtggagatatggactaaagaaggtgaaaggaagaaactcagaccccgatggctagatgcgcgaacatatagtgacccactcgctctaagagagtttaaggaatttgctgctgggcgaagaagtgtgagcggtgatttgattctcgagataggcaaattacctcaacacctgacgcagcgcgctcagaatgcgctagacaatctcgtgatgttacacaactcagaacaaggcggcagagcctaccgacatgcaatggaggaattaccagataccattgaaactctaatgctcctagctctcatagcagtcttgaccggtggagtaacactattctttctatcaggcagagggttgggaaaaactagcattgggttactttgtgtaatggcaagttcagccctactatggatggcgtcggtcgagccgcattggatcgccgcctcaataatattagaatttttcttaatggtattactaatacccgagccggataggcaaagaacccctcaagacaatcaacttgcttatgtagtaataggtctactctttatgattcttacagtagccgcaaacgaaatggggcttcttgaaaccacaaagaaagatctgggaatagggcacgtggcagtagaaaaccaccatcacgcaacaatgttagacgttgacctacaccccgctagcgcgtggaccttatatgcagttgcgacaaccattataactcccatgatgcgacatacgatagagaacacgacagcaaacatatctctaacagctattgcaaaccaagccgctatactcatggggttagataaaggctggcccataagcaaaatggacataggtgtacccttgctagcattgggctgctattcccaggtgaaccctctaacgttaacagccgcggtcctaatgttagttgctcactatgccatcatcgggcctggtcttcaagctaaagccaccagggaagcacagaaaagaacagcggctggcattatgaaaaatccaactgtagatggaatagtagctatagacctggatcctgtagtgtacgacgcgaaattcgagaaacaattaggtcaaatcatgttgttgatattatgtacatcgcaaatattactcatgagaacgacatgggcactatgcgaatcgataacgttagctaccggacctttgaccacattatgggaaggaagtccaggcaaattttggaatactacaatagcggtgtctatggctaatatttttagagggtcgtacctcgcaggcgcaggactagctttttctttaatgaaatctctgggaggaggacgcagagggacaggagcacagggtgaaacactaggagaaaaatggaaacgtcagttgaatcagttaagcaaatctgaatttaatacatataagagatcaggaatcatggaagtagacaggtctgaagcgaaagaaggactaaagagaggagaaaccacaaaacacgcagtgagtcgaggaacagccaaattgcgatggtttgttgagaggaatcttgttaagccagaaggtaaagtaatcgacctaggctgtggaagaggcgggtggtcatactattgcgcaggcctgaagaaagttacagaagtgaaaggatacacaaaaggtggacccggacacgaagaacctattccaatggcgacttacggttggaatttagtaaagctgcattctggaaaagatgtattctttatcccacccgagaaatgtgatactttactttgtgatataggcgagagttcgccaaatcccaccatagaagaaggaagaacacttagagtcctaaaaatggtagagccatggcttagaggaaatcaattttgcataaagatcttaaatccgtatatgccaagcgtagttgaaacactagaacaaatgcaacgtaaacacggcggaatgttagtcagaaatccattaagccgtaatagtacacatgaaatgtactgggtatcatgtggtactggcaacatagtaagcgccgtcaatatgacaagtagaatgctattaaatagatttaccatggcccatagaaaaccaacatatgaaagagatgtagatttaggcgcaggtacaagacacgtagctgtagaaccggaagtagcaaatctcgatatcatagggcaaagaattgaaaatataaaacatgagcataaaagtacgtggcattatgatgaagataatccttacaaaacatgggcatatcacggtagttacgaagtcaagccgagcggaagtgcatcctcaatggtaaacggagtcgtgaaactactaacaaagccctgggatgtaataccaatggtaactcagatagcaatgaccgatacgacaccttttggtcaacaaagagtgttcaaagagaaagtcgatacaagaactcctaaagctaaaagggggaccgcgcaaatcatggaggtgacagccaagtggctatggggattcttgagtcgaaataagaaaccacgcatatgcacaagagaagaatttactcgtaaagttaggtcaaacgctgcgataggagcagttttcgttgacgaaaaccaatggaactctgcgaaggaagccgtagaggacgaacgcttttgggacctcgtccacagagaaagagaattacacaaacagggcaaatgtgctacttgtgtttacaatatgatgggtaaacgtgagaagaaactaggagaatttggaaaagctaaaggaagtcgtgcgatttggtacatgtggctaggggcaaggttcttagaatttgaagcgctaggtttcatgaacgaagaccattggttttctagagaaaatagtttatcaggtgttgagggggaaggtttgcataaattaggttatattttacgagatatttctaaaatacccggtggaaatatgtatgcagacgatacagcaggctgggacacgagaataacagaagacgatcttcaaaatgaagcaaaaattacagacattatggaacctgagcatgctctgttagcgaaatctatattcaaattgacttatcaaaataaagtagtgagggtacaaagacccgctaaaaatggaacagtaatggacgtgatctcgcgtcgagatcaaagaggtagcggacaagttggcacatacggtttgaatactttcacaaatatggaagcacaactgatcagacaaatggaatcagaaggcatcttctcacctagtgagctagagacacctaacttggcgggacgtgtacttgattggcttgaaaagcatggcgtagaacgtctgaaacgaatggctatctcaggtgacgattgtgttgttaaaccaatcgacgatcggttcgcaacagcgcttacagcattaaatgatatgggtaaagtaagaaaagacattccacagtgggagccatccaagggctggaacgattggcagcaagtgccgttttgctcgcaccacttccatcaactaataatgaaagatggacgcgaaattgtagttccatgcaggaaccaagatgaactggttgggcgggcaagagtaagtcaaggggcaggctggagtctccgcgagacagcttgtttaggaaaatcatacgcacagatgtggcaactcatgtattttcacagacgcgatctaagacttgcagctaatgcaatatgttctgcagtgcctgtagaatgggtcccaacatccagaacaacatggtcgatccacgctcatcatcaatggatgacaacagaagacatgttgtccgtatggaatagggtatggatagaggaaaatccatggatggaggacaaaacgcatatctcaagttggggagatgtcccgtatctaggaaagagagaagatcagtggtgtgggtcccttataggtttaacagcgagagctacttgggcaacaaatatccaagtagctatcaatcaagtacgaagactgataggtaacgaaaactacttagattacatgacaagtatgaaaaggtttaagaacgagagtgacccagaaggagcactatggtag

SEQ ID NO: 21880 - RNA, 9879 nt, synthetic construct
  misc_feature 1..9879: note = derived and/or modified CDS sequence (opt6) from DENV-1__JF937617__SS-prME
  source 1..9879: mol_type = other RNA
tcggttacgatgttacttatgttaatgcctacggcactagcattccatcttactaccaggggaggagaaccgcatatggtggtaagcaaacaagaacgagggaaatctctactgtttaaaacttctgctggagtaaacatgtgcaccttaatagccatggacctaggtgaactatgtgaagatacaatgacatataaatgcccaaggataacagaagccgaaccagacgacgttgattgttggtgtaacgcaacagacacatgggtgacatacgggacatgttcacaaaccggggaacatcgacgagataaacgctctgttgcacttgcaccccatgttggtctaggtcttgaaacaaggaccgaaacttggatgagctcagaaggcgcctggaaacaaatacaacgggtggaaacgtgggctttgcgtcaccccggtttcacagtcatagctttgttcttagcccacgccataggaacaagcataacccagaaaggtatcatcttcattttactcatgttggtaaccccctcgatggctatgaggtgcgtaggaatcggatcacgagattttgtagaaggactaagcggggctacgtgggttgacgttgtgcttgaacacggatcatgtgttacgacaatggctaaagataaaccgactttggatatagaattactaaaaacggaggtaacaaaccccgcaatcctaaggaaattatgcattgaagcaaaaataagtaatactactactgactctagatgtccaactcaaggagaggccaccctggtagaggaacaagatgctaactttgtatgtcggagaacgtttgtcgaccgcggttggggaaatggatgtggattatttggcaaaggttcattgataacgtgtgccaagtttaaatgtgtaacgaagttagaaggaaaaatagtacagtatgaaaacttgaagtactctgtaatagttacagtacacacaggagaccaacatcaagtggggaatgaaagtactgaacacgggactacagctacaataacaccccaggcgccaaccacagagattcaactcacagattatggcgcactcacactagactgttcaccaagaacaggattagatttcaacgaaatggtcctattaacaatgaaggaaaagtcgtggctagtgcacaaacaatggttcttggatttaccactaccatggaccagcggagcatcgacaagtcaagaaacctggaataggcaagatctattagtcacattcaaaacagctcacgcaaagaagcaagaagtggtagtacttggatcccaagaaggggctatgcataccgcgttaacaggggcaaccgaaattcaaacttcgggtacaacaaccatttttgcaggtcacttaaagtgcagattaaagatggataaactgacattaaaagggatgtcttatgtaatgtgcactggatcgttcaaattagaaaaagaggtagcggaaacacagcatggcactgtcctagtacaaataaaatacgaaggcacagacgcaccctgtaagattcccttttcgacacaggacgagaagggagtcactcaaaacggacgtttaattactgccaacccaatagttactgacaaagaaaaaccagtcaacatcgaggcggagccaccattcggagaatcctacatagtaattggagccggtgaaaaggcacttaagctatcatggtttaaaaagggctcatctataggaaaaatgttcgaagctacagcccgtggagcacgccgtatggccattttaggagatacagcgtgggatttcggctcaataggaggagtttttacaagtgttggcaaattagtacaccaaatttttggaacagcatatggagtcttgttcagtggggtatcttggactatgaagattggcctcggcgtgctattaacgtggctaggtttaaattctcgatcaacgtcgttatctatgacttgcatcgctgttgggcttgttacactctacttaggagtgatggttcaagctgatagcggttgcgtaatcaattggaaaggtcgagaattgaaatgtggatcaggaatattcgtgacaaatgaagttcacacatggactgaacaatataagttccaagccgattcaccgaagagactttctgcagcaataggaaaggcatgggaagaaggagtatgtggaatacgatctgctactagactagagaatgtgatgtggaagcaaataagtaacgaactaaatcatatcttactcgaaaacgatatgaaatttaccgtcgttgtaggcgatgtggccggaatactcgcccaagggaagaaaatgattaggccgcaacccatggaatataaatactcatggaaatcttggggaaaggcgaagataatgggtgctgacgtacaaaatacgacatttatcatcgatggacctaatacgccggaatgtcctgatgatcagcgggcttggaacatatgggaggtagaagattatggttttggtatatttactacgaacatatggttgaaattgcgggatagctatactcaagtatgtgatcataggcttatgtcagctgcaataaaagattccaaggcagtacatgcagatatgggatattggatagaaagcgagaaaaatgaaacatggaaactggcccgagcgagcttcatagaagtaaaaacatgtatttggcctaaatcgcatacactctggtctaacggtgtgttggaatccgaaatgataattccaaaaatttacggaggccccataagtcaacacaattatcgacccgggtactttacacaaacagcaggaccctggcacctcggcaaattagaactcgacttcgacctctgcgaaggaacgactgtagtagtagatgaacactgtggtaatagaggcccaagtttaagaacaacgacagtgacagggaaaatcattcatgagtggtgttgtagatcttgtacattaccaccattgcggtttagaggagaagatggctgctggtacggcatggaaattcggcctgttaaagaaaaggaagaaaatttggtcaagagtatggtaagcgcaggatctggtgaagttgatagcttttcactggggcttttatgtatatctataatgatcgaagaggtaatgagatcccggtggagtagaaagatgcttatgacaggtactctagtagtttttcttctgctaatcatgggtcaattaacatggaatgatctaataagattatgtattatggtaggagcaaacgcgtcagatcggatgggtatgggaacaacctatctagcattaatggccacatttaaaatgagacctatgtttgctgtaggattgctattcagacggctaacatcgcgagaggttctattactaactatagggctaagcctcgtggcatcggtagaattaccgaacagcttagaagagttgggtgacggactcgcaatgggaattatgattcttaaactactcactgattttcaatctcatcaactatgggcgacacttctatcactgacatttataaaaactacattctccctacattatgcctggaagacaatggcaatggtcctctcaatagtgagccttttccccttatgtttatcgacaacaagtcagaaaacgacttggctgccggtgttgttaggatcgttaggatgcaaaccgttaacaatgttcctaattgccgagaacaaaatatgggggagaaggtcctggcctctgaatgaaggaataatggctgtcgggatcgtgtcaatactgttgagcagtttgctcaaaaatgacgtaccgttagcgggtcccttaatcgctggaggcatgttgattgcatgctacgttatttcaggaagtagtgcagaccttagtttggaaaaagcagcagaggtatcgtgggaagaagaagcagaacattctggagcgtcacataacatactcgttgaggtccaagacgatggaaccatgaaaattaaagatgaggaaagagatgacacgttaacaatactactaaaagcaacactgttagccgtatcaggcgtatatcctttgagtataccagccaccctctttgtatggtacttttggcaaaagaagaaacaaagaagcggagttttgtgggatacgcctagtccaccagaagtagaacgtgcagttcttgatgacggaatatacaggattatgcaaagaggcttattaggaaggtcacaagtcggagtaggtgtatttcaggaaaatgtattccacactatgtggcatgttacaagaggggctgtgttgatgtatcaaggaaaaagattagaaccatcatgggcgagcgtaaagaaagatcttattagttatggcggaggctggcggcttcaaggatcttggaatacgggagaagaggtacaagtaatagctgttgaacccggcaaaaatcccaaaaacgtacaaactgcaccgggaactttcaaaacgccagaaggagaaataggcgccatagcacttgactttaaaccgggaacaagtggcagtccgatagttaacagagaaggaaaaatagtaggactttacgggaacggtgtagtgactacgtcagggacttatgtatccgcaatcgcgcaagcgaaagcgtcgcaagaaggccctctgccggaaatagaggatgaagtatttcgtaaaaggaatttaacaatcatggacctgcaccccgggtcaggtaaaacacggcgatatctaccagctattgtgagggaggccatcaaacgtaaactacggacactgatattagccccgactagggtagtcgcatctgaaatggcagaagcactgaaaggaatgcccatccggtatcaaactacggcggtaaaaagcgaacacacagggaaagagatagtagacttaatgtgccacgcaacttttacgatgcggttactttcccccgtacgagtcccaaattataatatgataatcatggacgaggcccactttacagatccttccagtatagcggcaaggggatacattagtacaagggttggaatgggggaggcagcggcgatatttatgacagccactccgcctggtagtgtagaggcatttccacaatccaatgcagtaatccaggacgaagaaagggatattccggaacgttcatggaactcgggttacgaatggatcaccgactttccagggaaaacagtatggttcgtaccttctatcaaatccggcaacgacatagctaactgcctgaggaaaaatggtaaacgagtaatacaactgtcaaggaaaacctttgacacagagtatcagaaaactaaaaataacgactgggactatgtagtcacaactgatatttctgaaatgggagcaaatttcagagcagatcgtgttatagacccgaggagatgtttaaaacctgtaattctaaaagatggtcctgaaagagtaatactagctggaccaatgcccgtcaccgttgctagcgcagctcaacgacgaggtagaataggaagaaaccacaataaagaaggcgatcaatacatatatatgggccaaccattgaataacgacgaagaccatgcacattggactgaggcaaaaatgcttctggacaacataaatactcctgaaggaataataccggccttatttgaacccgagagagaaaagtctgctgctatagatggtgaataccgacttcgtggagaggcccgaaaaacatttgtagaattaatgagacgaggcgatttaccagtatggctgagttataaagtagcctcagaaggatttcaatattctgatcgccgatggtgctttgacggagaacgaaacaatcaagtcttggaagaaaacatggatgtggagatctggacgaaggaaggagaaagaaagaaactccgaccaagatggttagacgctagaacatactcagacccattggcccttcgagaatttaaagaatttgcagcgggacgaagatcagtatccggggatttaatcttggaaataggaaaattaccgcaacacttaacacaaagggcacaaaatgctttagataatttagttatgcttcataattcagaacaaggaggacgggcatatcgacacgctatggaggaattacctgatactatcgagactctgatgctactagcccttatcgcagttctaacagggggtgtaacgcttttcttcctttccggcagagggctagggaaaacatctataggattgctttgcgtaatggcctcaagcgtactgctttggatggcttccgtcgaacctcactggatagccgctagcataattctcgagtttttcctgatggttctgctgatacccgaacccgatcgacaacgaacgcctcaagataaccaattggcttacgtcgttataggtttacttttcatgatccttacagttgcagctaacgaaatgggcctactggaaacaactaagaaagacttaggtattggacatgctgcagtcggaaaccatcaccacgccgcgatgctagatgtcgatttacatccagctagtgcatggacactatatgcagttgcgacaacaattattacacctatgatgcgccacacgatagagaatactacagctaacattagcctaactgcgatcgctaaccaggccgccatattaatgggtttagataaaggatggcctataagtaaaatggacattggagtgccactacttgcattaggatgctacagccaggtaaatcccttaacattaacagctgcggttctaatgctcgtagctcattatgctataattgggccaggcctacaagcgaaagccacaagagaagcacaaaaacgaactgcagcaggaatcatgaaaaaccccacggtcgatggcatcgttgccatcgacctggaccctgtagtttacgatgcgaaatttgaaaagcaattaggccaaattatgttactgatcctatgtacaagtcaaattttactcatgcgaacaacctgggcgttgtgtgaatcaataactttggctacagggccactgaccacactttgggaaggaagcccaggaaaattctggaatacaacgatagctgtgtcaatggcaaatattttcaggggtagttacctagctggagctggcttagcatttagcctaatgaagtcgttaggaggcggtagacgaggtacgggagcacagggagaaactctaggggaaaaatggaaaagacaactcaatcaactgagcaaaagtgaatttaatacctataaacgatccggcataatggaagtagaccgcagcgaggcgaaagaaggcttgaaaaggggagaaactaccaaacatgctgtttcacgtggaacagcgaaactgcgatggttcgttgaacgtaatttggtaaaacctgagggaaaagtcatagatttaggatgtggtagagggggatggtcgtactattgcgccggtctaaagaaagtaacggaagttaaaggttatactaaaggtggacccggacatgaagaaccgataccgatggcaacttatggatggaatttggtgaaattacactcaggaaaagatgtatttttcatcccacccgaaaaatgtgacaccttattgtgtgatattggcgaatcaagtcccaacccgactatcgaagagggtagaaccctaagagtactcaagatggttgaaccttggcttagaggtaaccaattctgtattaaaatcctcaacccctacatgccttcagtagtagaaacactggaacaaatgcaacgaaaacacggcggtatgctagttcgaaatcctctgtcaagaaattcgactcatgagatgtattgggtgtcttgtggtacaggaaacatcgtaagtgctgtaaacatgacgagcaggatgctactaaatcgtttcaccatggcgcataggaaaccaacatatgaacgcgatgtagacctaggggctggaacgcgtcatgtggcagtagagccggaggttgcaaatcttgacataatagggcagcgtatcgaaaacataaaacacgaacataaatcaacgtggcactatgatgaagataacccctacaagacatgggcataccatggtagttacgaagtaaaaccatcaggttcagcatcatcaatggtaaatggagtagtcaaacttttaacaaaaccttgggacgtcatacccatggtcacgcagatcgcgatgacagatacgaccccatttggacaacaaagagtcttcaaagaaaaagtagacacgcggactccaaaagcgaaacgaggaacagcacaaattatggaagtaactgctaaatggctttggggatttttatcacgaaataaaaagccaaggatatgtactagagaagagttcacaagaaaagtgcgtagcaacgcagccataggcgcagtatttgtcgacgaaaatcaatggaactctgccaaggaagctgtagaggacgaaagattttgggacctcgtgcatcgtgagagagagttgcacaagcaaggcaaatgtgcaacgtgtgtatacaacatgatgggtaaaagggagaagaaactgggagagttcgggaaggccaagggaagcagagcaatttggtatatgtggcttggtgccagatttttagaatttgaggctttaggttttatgaacgaagatcattggttctcgcgagaaaatagcttaagtggagtcgaaggagaggggctgcacaaacttggttacattctgcgggatataagtaaaatacctggaggaaatatgtatgcagatgacacagctggatgggacacgcgaattactgaagatgaccttcaaaacgaagcacgaataacagatattatggagcctgaacatgcgttgttagcaaaaagtatattcaaattaacataccaaaataaagtagttcgagtacaaaggccagcaaagaacgggacagtcatggacgttatatcgaggagagaccagagaggatcaggacaagttgggacatatggtttaaatacgttcacaaatatggaggctcaactaatcagacaaatggaaagtgaaggtatcttttcaccatcggaattagaaacacctaaccttgctgaacgggtattagattggttggaaaagtacggagttgaacggttaaaacgcatggccatatcaggagatgattgcgtggtcaaaccaatagacgaccgctttgccaccgcattgacggcgctaaatgatatgggcaaagtacgaaaggatattccgcaatgggagccgtcaaagggctggaatgattggcaacaggtgccgttttgttcgcatcactttcatcaattgataatgaaagatggtagggaaatagttgttccatgccgtaatcaagacgagttagtagggagagcaagagtaagccagggcgctgggtggagcttaagggagacagcatgcctaggtaagagttatgcgcagatgtggcaactaatgtattttcatcgaagggatttgcggctagctgccaatgcaatttgtagtgcggtaccagtagattggattcctacatcccgcacaacatggagcatacatgctcatcatcaatggatgactaccgaggacatgctatcagtttggaatcgcgtttggattgaagaaaatccatggatggaagataagacgcacataagctcatggggtgatgttccttacttaggtaaaagagaagatcaatggtgtggctctttaataggtctcaccgccagagcaacttgggccactaatatacaagtggcaatcaatcaggttcgccggcttatcggaaatgagaattacctagactatatgaccagcatgaaacgcttcaagaatgagagtgaccctgaaggagcactatggtaa

SEQ ID NO: 21881 - RNA, 9879 nt, synthetic construct
  misc_feature 1..9879: note = derived and/or modified CDS sequence (opt6) from DENV-1__JF937618__SS-prME
  source 1..9879: mol_type = other RNA
agtgtgaccatgcttttaatgctgatgcctacggcgcttgctttccatcttaccactcggggaggagaacctcacatgatagtgagtaaacaagaacgaggaaagtcattattattcaaaactagcgcaggagtcaacatgtgtacattgattgcgatggaccttggagaactttgtgaggataccatgacttacaaatgcccgaggattaccgagaccgaacctgacgacgtagactgctggtgtaatgcaacagatacatgggtaacctacggtacctgttctcaaaccggcgagcaccgacgagataaacgatcagtagcactagcgcctcatgtaggactgggattagaaacaagaaccgagacatggatgtcaagcgaaggggcatggaaacaaatacaaagagtagaaacatgggcattaagacacccgggttttacagttatagctttattcctggcccatgccatcggaaccagtattacgcagaaaggtatcattttcatacttttaatgcttgtgacaccgagcatggcaatgagatgtgtaggtatcgggtcacgcgacttcgtcgaaggacttagcggcgcaacatgggtagacgtcgttcttgagcatggttcttgcgttactaccatggctaaagataaaccaaccttagatatagagctacttaaaactgaggtaacaaacccggcaatactaagaaaactgtgcatcgaagccaaaataagcaataccaccacagactcacgatgtcccacacaaggcgaggcaacactcgttgaggagcaagacgcaaattttgtatgtagaaggacctttgtagacagaggatgggggaacggatgtgggctctttggtaaaggctccttgataacatgcgcaaaattcaaatgcgtgacaaaattagaggggaaaatagtacaatatgaaaatctaaaatactcagtcatagttacagttcatactggagatcaacatcaagtcggaaatgaatcaacggagcatggaactacagctacaataacgcctcaggcgccaaccacagagatacaactaacagactatggtgcgttgacactggactgcagtccgagaacaggattagacttcaatgagatggtattgctaaccatgaaagagaaatcatggctagtccacaaacaatggtttttagatctaccacttccttggacaagcggcgcctctacatcacaggaaacttggaacaggcaagatttattggtcacatttaaaactgcacacgctaagaaacaagaggtcgtagtactcggatcgcaagagggtgctatgcacaccgctctaactggggcaacggaaattcagacgagtggaactacaaccatttttgcaggacatttaaaatgccggctgaaaatggataaattaacactcaaaggaatgtcatatgttatgtgtacgggaagttttaaattggagaaagaggttgctgaaacacaacacggtaccgttttggttcagataaaatacgaaggcacggatgccccttgtaaaatccccttttctacccaagacgaaaaaggagtaacacagaacgggcgcctaataaccgcaaatccgattgtaacagataaagaaaaacccgtgaatatagaagcagagcctcctttcggagaaagttacatagtaatcggagcaggggaaaaagctctaaaattatcatggtttaagaaaggatcatctataggcaaaatgtttgaagctactgctcgcggagccagacgtatggcaatactgggggataccgcatgggacttcggctcaataggaggagttttcacgtcagtcgggaaacttgtgcatcaaatatttggtacagcctacggcgtactcttttcaggtgtatcttggactatgaaaattggaattggcgtactactcacatggctcggattaaattccaggtccacgtccctgagtatgacttgtatcgcagttggtctagttacgctttatctaggtgttatggtacaagcagatagcggatgtgtcataaactggaaaggaagagagttaaaatgcggaagtggtatttttgtgactaatgaagtacacacatggactgagcaatacaaatttcaggccgattcgccaaaacgcctttcagcggcaataggcaaggcttgggaagagggtgtgtgcggtataaggtctgcgacaaggctggaaaatatcatgtggaaacaaattagcaatgaactgaatcatatactcctcgaaaatgacatgaagttcactgttgtcgttggagatgtggcgggtatcttagcacaaggaaagaaaatgatcaggccccaacctatggaatacaaatactcatggaaaagctggggtaaagcaaaaattataggagcagacgtacagaatactacattcataatcgatggaccgaacacaccggaatgtcctgacgatcaaagagcatggaatatatgggaagtggaagattacggattcggcatttttaccactaatatatggttaaaattaagagattcatatacacaggtgtgcgaccacagattgatgtcagctgcaataaaagacagcaaagcagtgcacgcggatatgggatattggattgaatcagaaaagaacgaaacttggaagctagcaagagcatcattcatcgaagtgaaaacatgcatctggccaaagtcacacacattatggtccaacggagttcttgaatcggaaatgattatacctaagatctatgggggtccgattagtcaacacaattacagacctggatactttacgcaaaccgcaggtccttggcacttaggcaaactagaattggacttcgatttatgtgaaggtacgacagtagttgtggacgagcattgcggaaatcgtggcccttcattaaggacaaccacagtaacaggtaaaataatacacgagtggtgctgcagatcgtgcacactcccacctttgcgatttagaggggaagacggctgttggtatggcatggaaattaggcctgtaaaagaaaaggaagaaaatttggtgaaatcaatggtatcagctggcagtggcgaggttgacagcttttccttagggcttttatgtattagtataatgatagaagaagtaatgcgttccaggtggtctcgcaaaatgttaatgactggaacactagcagtcttccttcttttaattatgggacagttaacgtggaacgatttaattcgactgtgtataatggtcggagccaatgcaagtgataggatgggtatgggaacaacgtatttagctctgatggccacttttaaaatgagaccgatgttcgcggtcggtctgctatttagaagacttacaagcagagaggtattattattaacaataggactgtcattagtcgctagtgtagaactaccgaacagtttagaagagttgggtgacggtctggctatgggaatcatgatacttaaattattaactgactttcaatcacatcaattatgggcaacactactaagtttaacattcataaaaaccacattcagtctacactacgcctggaaaacaatggcaatggtcttgtctatagtatcattatttccactatgtttaagtacgacaagtcagaaaactacttggctcccagtgctcctaggaagcctaggatgcaaaccgctaacaatgttcctaattgccgagaataaaatttggggaaggcgttcatggccccttaacgagggcataatggccgttggcatagtatcgatactgctaagcagcttactcaaaaatgatgtaccgttggcagggcccctaatagcaggcggaatgttaatagcatgctatgtgatcagcggttcaagtgcagacctatcactagaaaaggcagccgaagtatcctgggaagaggaagctgagcactccggagcttctcacaatattttggtggaagtacaagacgatggaacaatgaaaattaaggatgaagaaagggatgacaccttaacaatattattgaaagctacacttctagcggtttccggagtataccctctttccatacctgccacactttttgtgtggtacttctggcaaaagaaaaagcaaagatctggggttttatgggatacaccaagtccacctgaagtagaaagagccgttctggatgatgggatatacaggataatgcaacgaggactactaggccgatctcaagttggagtgggagtatttcaagaaaacgtgttccatactatgtggcacgtcacccgaggggccgttttaatgtaccaaggtaaaagacttgagccgtcttgggcttcagttaagaaagatttaatatcatatggtggtggttggagactacagggaagttggaatacgggggaggaagtacaagtaatcgctgtcgagccaggcaaaaatccacgtaatgtacaaactactccgggaacgtttaaaaccccagaaggggaagtaggagcaatagcactcgacttcaaacctggcacaagtgggagtccaatcgtaaatagggaaggaaaaattgtcggactatatggtaacggggttgtcactacaagtggaacatatgtatcagcgatagctcaagccaaagcatcgcaggaaggaccactacctgagatcgaagatgaagtatttcgtaaaagaaatctaacaataatggacctacatccggggtcgggcaaaacacgtagatacctaccagcaatagttcgggaagcaatcaaaagaaaactaaggacattaattcttgccccaacaagagttgttgcaagtgagatggccgaggcattgaaaggaatgcctattagataccagacgaccgctgtcaagtctgaacatactggcaaagaaattgtggacttaatgtgtcatgcgactttcacaatgagattgttatccccagtaagagtcccgaattacaacatgataattatggacgaagcacattttacagatccaagttctatagctgcccgtggttacattagcactagggtaggaatgggagaggcggcagcaattttcatgaccgctacaccccctggaagcgtagaagcatttccgcaatccaatgcagttatacaagacgaagaaagagacatccctgaacgatcctggaactctgggtatgaatggatcacagatttcccaggcaaaactgtatggtttgtgccatccatcaaatcaggtaatgatattgccaattgtttaagaaagaatggaaaacgagtaatccaactctcgagaaaaactttcgacactgagtatcagaaaaccaaaaacaatgactgggactatgttgtaactactgacataagcgaaatgggagcaaacttcagagcggacagggtcatagatccaagaagatgtcttaaacctgtaattctaaaagatggacctgaaagagtaatacttgcaggccctatgcctgtgacagtagcttcagcagcacagagacggggaagaataggcagaaatcataataaagaaggagaccaatacatttatatgggacaaccactaaacaatgatgaagaccacgcacactggacagaagctaaaatgctcttagacaacataaataccccagaaggtattataccagcgttattcgaacctgaacgagagaaaagtgctgcgatagatggcgagtataggttaagaggagaagctagaaaaacattcgttgagttgatgcgacgaggcgatttacccgtttggctgtcttacaaggttgcaagcgaaggttttcagtattccgaccgtcgatggtgctttgatggggaaagaaacaatcaagtattagaagagaacatggacgttgaaatctggacaaaagagggtgaacgaaagaaacttcgtccacggtggttggacgcaagaacatattctgacccgttagccctacgtgagttcaaagaatttgcggctggcagaagatctgtgtcaggcgacttaatattggaaattgggaaattaccacaacatttgactcaacgtgcacagaatgcattagacaatcttgtaatgcttcacaatagcgaacaaggtgggagggcctatagacatgcaatggaagaactaccagatacaattgagactttaatgctattagcattgatcgcggtgctaacaggtggcgtcactcttttctttttaagtggacgtggattaggaaaaacatcaattggccttttatgcgttatggcttcgtcggtactcttatggaccgcatctgtcgaaccacattggattgctgcatctattatattagaatttttcctcatggtattactcataccagaaccagaccgccagagaacacctcaagacaaccaattggcttatgtcgtgataggattattatttatgattctcacggtggccgccaatgaaatgggtctgctagaaaccactaagaaagatttggggataggacacgttgcagtaggaaatcaccatcatgccgccatgctcgacgtagaccttcaccctgcctccgcatggactttgtacgcggtcgctaccacgattataacgcctatgatgagacatactatagaaaacaccaccgctaatataagtctcacagccatagcaaatcaagcagctattttaatgggtttagataagggttggccaataagtaaaatggacattggggtaccgttattagcattaggttgttatagtcaagttaatccattgaccttgacagctgcagtgctaatgttagttgcacattacgctataattggtccgggtttacaagctaaagctacaagagaagcccagaaaagaactgccgctggaattatgaaaaatccgactgtcgatggaatcgtagcgattgaccttgatccggtagtttatgatgcgaaatttgagaagcaattgggtcaaatcatgttattgatactatgcacttcgcaaattttactaatgcgtaccacttgggcattgtgtgagtcaattacactagcaactggcccgttaactaccctctgggagggatcaccagggaaattttggaatacaacgatcgccgtgtcaatggctaatatattcagagggagttatcttgcaggagcagggctagcattcagcttgatgaaaagtctaggtgggggccgaagggggacaggtgcacagggagaaacattaggtgaaaaatggaagcgtcaactaaatcaattgagtaagtcagagttcaatacgtataagaggtcggggataatggaagtagatagatcagaagccaaagaagggctcaaacgtggagaaacgacaaaacacgcagtatcccgtggaactgcgaaactgcgttggtttgtggaacgtaatcttgtaaaacccgagggtaaggtgatagatcttggttgtggcaggggtggatggtcatactactgcgcgggcctaaagaaagtaacagaggtcaaaggatacaccaagggtggacctgggcatgaagaaccaatacctatggcaacatatggttggaacttagtgaaactacatagtggcaaagatgttttctttatacctcctgaaaaatgcgacaccttattgtgcgatataggtgaatcaagcccgaatccaacaattgaagaaggcagaacacttagggttcttaagatggtagaaccgtggttaaggggcaatcaattctgtattaaaatactaaacccatatatgcctagcgtggtcgaaaccttagaacaaatgcaaaggaaacatggtggaatgttagtacgcaacccgttaagcagaaattcgacacacgagatgtattgggtttcatgtggaacaggaaatattgttagcgcagtaaatatgacatccagaatgctattaaaccggttcactatggctcatcgtaaacccacttacgaaagagatgtggatttgggagcgggtactagacacgtggcggttgagccagaagtagcaaatcttgatatcatagggcagcgcatcgaaaacatcaaacacgaacataagtcgacatggcattatgacgaggacaatccctataagacttgggcatatcatggttcgtatgaagttaaaccttctggctccgcatcgtcaatggtcaatggagtagttaagttattgacaaaaccctgggatgtgattccaatggtaacacaaatagcgatgacagacactacacctttcggacaacaaagagtttttaaagaaaaagttgacacacgaacacctaaagcaaagcgaggcacggcgcagatcatggaagtgacagctaaatggctatgggggtttttatcacgaaacaagaaaccacgaatttgtactagagaagagttcacacgtaaagtgagatctaatgcagctataggcgcagttttcgttgacgagaaccaatggaatagtgcgaaagaagcagtagaggatgaaaggttctgggatcttgtccaccgcgaaagagaattgcacaaacagggcaagtgcgcaacatgtgtatataacatgatgggcaaaagagagaagaaattgggagaatttggaaaggccaaaggctctagagctatctggtatatgtggctaggggcccgctttctcgaatttgaggctctaggtttcatgaatgaagaccattggttttcaagggaaaattcactgtcaggagttgaaggtgaagggttacacaagctgggttacatcttgcgtgatatctcaaagatcccaggagggaacatgtatgcggacgacacagccgggtgggatacgagaattacagaagacgatttacaaaacgaagcgaggataacagacataatggaaccagaacacgcgttattagctaaaagtatttttaaactaacctatcagaacaaagttgttagagtacaacgccccgctaaaaatggtaccgtaatggacgtgatatctcgccgcgaccaaaggggatcagggcaagtaggtacctacggcctcaacacgtttactaatatggaggcccaattaataagacaaatggaaagtgagggtatatttagtccatctgagctagagacacccaacctagcagagagagttcttgactggttagaaaaatatggtgtagaacgactgaaacgtatggcaatatccggggacgattgcgtagtaaagccaatagacgacaggttcgccaccgctcttacagctcttaatgatatgggtaaggtacgtaaagatattccacagtgggaacccagtaaaggttggaacgactggcaacaagtcccattttgctcacaccatttccatcaattaattatgaaagatggaagagaaatagtagttccatgtaggaaccaggacgaattggttggcagagcaagggtcagtcaaggtgctggatggtcgttaagagaaacagcttgtctaggaaaatcttatgcacaaatgtggcagttaatgtatttccacaggcgcgatttacggttagccgccaacgctatttgttcggcagtcccagtggattggataccaacctcgagaacaacctggagcattcatgcacaccatcagtggatgacaacggaggatatgttaagcgtctggaaccgcgtatggatagaagaaaatccttggatggaggataaaacgcacatttcaagctggggcgatgtcccatatttaggcaaacgagaagaccaatggtgtggttctcttattgggcttacggctcgcgcgacttgggcaactaatatacaagtggcaataaaccaagtaaggcgactaataggaaacgaaaactaccttgattatatgacatctatgaagaggtttaaaaatgaaagtgacccagaaggagccctgtggtag

SEQ ID NO: 21882 - RNA, 9879 nt, synthetic construct
  misc_feature 1..9879: note = derived and/or modified CDS sequence (opt6) from DENV-1__JF937619__SS-prME
  source 1..9879: mol_type = other RNA
agcgtgaccatgctcctgatgttaatgccaactgcgcttgcatttcacctaactactagaggtggagaaccccatatgattgtgtccaaacaagaaagaggaaaaagtctactcttcaaaacatcagcaggagtaaatatgtgcactctgatagctatggacttaggagaactatgcgaagatactatgacatacaaatgtccacggatcacggaagcagaacctgatgatgttgattgctggtgcaatgctacggatacctgggttacgtatggtacatgcagtcaaaccggggaacatagacgtgaaaaacgtagtgttgctttagcgccccacgtcggcctaggtcttgaaacaaggaccgaaacgtggatgtcatcagaaggggcctggaaacaaattcaaagggttgagacttgggcattgaggcatccaggtttcaccgtaattgcgctgtttctcgcacatgccataggtacatctataactcaaaaaggtataatatttatcttgttgatgttggtaaccccctccatggcaatgagatgcgtaggaattggaagccgtgactttgttgaaggattatcaggcgcaacatgggtagatgtagttctcgaacacggaagttgtgtaacaactatggcaaaagacaaacctacactcgacatagaattactaaaaacagaggtaactaatccggctgtgttgcgaaaactctgtattgaagcaaaaatatccaatacgaccactgactcgagatgtccaacgcaaggggaagcaactttggtcgaagaacaggacgctaatttcgtttgcagacgaacatttgtagatcgaggttggggcaatggatgtggactttttggtaaaggtagtttactaacgtgtgccaaatttaaatgtgtaacaaaactagagggaaaaatagttcaatacgaaaatcttaaatacagcgtaatagtcacagtacatacaggagatcaacaccaagttggaaatgaaagtacagaacacggaaccactgcaactataacaccgcaggctcccacaacagagattcagctaaccgactatggagccttgacactcgattgtagccctaggacaggtttagactttaatgaaatggtgttgctaacgatgaaagaaaaatcgtggttagtacataaacaatggtttttggatctgccgctcccatggacttctggagcctccacatcacaagaaacgtggaatcggcaagacttgttagtcacatttaaaacggcccacgccaagaaacaagaggtagtagttctggggagccaagaaggtgcaatgcacacagcgctcacaggcgcaaccgaaatccaaacgtcagggactactacgatttttgctggtcatttaaaatgcaggctcaaaatggacaaactgacactaaaaggcatgtcctacgtgatgtgtactggtagtttcaaactagaaaaagaagtcgccgagactcaacatggaacagtccttgttcaaataaaatatgaagggacggacgctccatgtaaaataccattttcaacgcaggatgaaaaaggagtaacccagaatggaagactgataacggcgaacccaatagttacagacaaagaaaaaccagttaatatagaagctgaaccaccatttggcgagtcttatatagtaattggagcgggggaaaaagcgctgaaattatcatggtttaagaaagggtcttctattggaaagatgttcgaagcaaccgctcgtggagcacgtcgaatggcaattttaggagatacagcatgggactttggatctataggtggtgtctttacaagtgtaggaaagttagtacaccaaattttcgggacagcttacggtgtattgtttagtggagtgtcatggaccatgaaaataggcataggcgtattattaacgtggctaggtctaaatagtaggagtaccagcttgagcatgacgtgcatagccgtgggattagtgactctatatcttggagtaatggttcaggcggattcggggtgcgtaataaattggaaagggagagaactcaagtgcggatcaggaattttcgtgacaaatgaagtccatacctggacagaacagtataaattccaggcggactcgccaaaacgactttcagctgctattggtaaggcatgggaagagggtgtttgtgggatacgtagtgcgactcggctagaaaacataatgtggaaacaaatcagcaacgaactgaaccatatactattggaaaacgacatgaagtttacagttgtagtgggggacgtagcgggaatccttgtgcaagggaagaaaatgataaggccgcaacctatggaatacaaatatagctggaaaagttgggggaaggccaaaataattggagcagatgtacaaaattccacattcataatcgacggtcccaacacacccgaatgtcctgatgaccaaagagcatggaacatatgggaagttgaagattatggcttcggcatatttacaaccaatatatggcttaaacttcgcgattcctacacacaagtatgcgatcaccggttaatgtctgccgcaataaaagactcaaaggctgtgcatgcagatatgggatattggatagaatccgaaaagaatgaaacatggaaactagcccgggccagttttatcgaggtaaaaacatgcatctggccgaaatcgcatacattatggtcaaatggagtcttggaaagtgaaatgataataccgaaaatacacggaggtccgatatcgcaacataattataggccaggttattttacccaaacggctggtccatggcaccttggcaagttggaattagacttcgacttgtgtgaagggactacagtagttgtggatgaacattgtgggaacaggggaccaagccttcgaactacaacggtaacgggaaagataatacacgagtggtgttgcaggtcatgtacactgccaccattaagatttcggggtgaagatggatgttggtacggaatggaaatacgtccagtaaaagagaaagaggaaaacctggtgaaaagtatggtgtcagccggaagtggagaggttgatagtttctcgctcggcctattgtgcataagtattatgattgaggaagtaatgagatccagatggagtcgtaaaatgctaatgacagggacgttagctgtcttctttttactgataatgggtcaacttacttggaacgaccttataagattgtgcataatggtaggggctaatgcaagcgacagaatgggtatggggaccacatacttagcgttaatggtgacattcaaaatgagacccatgtttgccgttgggttgctattcagaagattaacatcccgtgaggtattgctgctgaccataggattatcacttgttgcaagtgtagaattacccaatagcttagaagaacttggtgatggattagcaatgggcataatgatcctcaagttgttaacagactttcaaagctatcaactttgggctacattgttgtcgctaactttcattaaaactacattcagtttgcattatgcctggaaaacaatggcaatggtcttatcgattgtgtcgttatttcctctatgcctatcgacaacaagtcagaaaactacttggttaccggtattattaggctctctagggtgtaaaccactaaccatgtttttaatagccgaaaataaaatatggggcagaaaaagttggccactcaatgaaggcattatggctgtcgggattgtgagtatattgctatcctcgttattgaagaacgacgttccgttagcaggaccactgatagcgggcggaatgcttatagcatgttacgtaatttcaggatcgagcgcggacctatcattggaaaaagcagctgaagtgtcttgggaagaggaggcagaacactcaggagcatcacacaacatattagtagaagttcaagatgacggaacaatgaaaataaaagacgaggaaagagatgataccctgactattttgcttaaagctacccttcttgcagtatccggggtttaccctctttcaatccccgcaaccctttttgtatggcacttttggcaaaagaagaaacaaagaagtggcgtactgtgggatacaccatcacctcccgaagtagaaagggcagtgctggatgatggaatatacagaatcatgcaacgaggtttattggggcgtagccaagttggcgtaggagtatttcaagagaacgtgtttcatacaatgtggcatgtgacgaggggagcagttctgatgtatcaaggtaagagactagaaccatcatgggcaagtgtaaagaaagatctgatctcatatggcggtggatggagatttcagggatcctggaacaccggtgaggaagtacaggtcatagcggtagagcccggtaaaaatcctaagaacgttcaaaccgctccaggtacatttaaaacaccagaaggagaagtaggtgcgatcgcacttgactttaaaccaggaacatctggaagtccaattgtcaatcgagaagggaaaatagttggcctatacggaaatggagtcgtaaccacatctggaacttatgtgtctgcgatagcccaggccaaagcctcacaagagggtccgctcccagaaatcgaagatgaagtatttagaaagagaaatctaacaattatggaccttcatcccgggtctggaaaaacacgacgatacctacctgccatcgttcgagaagctatcaaaaggaaattaagaactctcattctcgcgccgactagggtcgttgcctcagaaatggctgaagccttgaaaggaatgccaatacgataccagacaacagccgtaaaaagtgaacatactggaaaagagattgtggacttgatgtgccacgcgacgtttacaatgcggttactgtccccagttagagtaccgaattataatatgattattatggatgaagctcatttcacagatccctcatcaattgccgcccgtggttacatttccaccagggtcgggatgggagaagctgcggcaatcttcatgactgctacgcctcctggctcgatggaagcattcccccaatctaacgcggtgatacaagacgaagagagggacatacccgaaagatcctggaactcaggatacgagtggattacagatttcccaggaaagactgtctggttcgtaccatctatcaaagcgggtaatgatatagcaaattgcttaaggaaaaatggcaagcgcgtgattcaattatcaagaaagacattcgacacagagtaccaaaagaagaaaaataatgattgggattatgttgtcacaacagacatctcggagatgggggctaattttagggcggatagagttatagaccctagacgatgtttgaagcccgtaatactaaaggatggtcctgaaagagtaatattagcaggccctatgcctgttactgtagcatcggcagctcagaggagggggcggatcggtagaaaccataataaagagggagaccagtatatttatatgggacagccattgaataatgatgaagaccacgcgcactggacggaagctaaaatgttattagacaacataaatactccggagggcattattccggccttattcgaacctgaaagagagaaaagtgctgctatagacggggagtatagacttcgtggagaggcgcggaagacatttgtcgaattgatgcggagaggagacttgccagtatggttatcatataaagtagctagcgaaggctttcaatattcagatcgaagatggtgtttcgacggtgaaagaaataaccaagtcctagaagagaatatggacgtggaaatctggacgaaagagggtgagcgtaagaaattaagacctaggtggctcgatgctagaacgtattctgatccacttgcattgagagaatttaaagagttcgcagctgggaggaggagtgtatctggagacctgatattagagattggaaaactaccgcaacatctaacgcagagggcgcaaaatgctttagacaacttagtaatgttgcacaattccgaacaaggaggacgagcatatagacatgccatggaagagttaccggatacaattgaaacgctaatgctcttagcattgatcgctgtcctaactggtggagtaacacttttctttctatctggcaaaggcttagggaaaaccagtattggattattatgtgttatggcttcaagtgttctactttggatggcatccgtggaaccacactggatagcagcatcaataatactagagttctttttgatggtactccttataccagagcccgacagacaacgaacgccccaagataaccaattggcatacgttgtaattggtttattattcatgatacttactgtagctgccaacgaaatgggtttactagaaaccacaaagaaagatctaggaattggacacgttgcggtcgaaaatcaccaccatgctgcaatgctagacgttgatctccacccagctagtgcctggacattatatgcagtagcgacaacaattataaccccaatgatgcgccatacaatagagaatacaacggccaatatcagcttaacagcaatagctaaccaagccgcaatactaatgggactggacaaaggctggccaatttcaaaaatggatataggggttccgttacttgcattaggctgttactcgcaagtaaaccccctcaccctgacagcggcggtactaatgttagttgcacattacgcgataattggaccaggcttacaagctaaagcaactcgtgaggcgcagaaacgaacagccgcagggattatgaaaaatccaacaatcgatgggatcgtagctatagatctcgatccagtgatatatgacgcaaaatttgaaaagcaactagggcaaattatgttattgatattgtgtacaagtcaaattttattgatgcggacgacatgggcactgtgtgaatctataaccctagcaacaggtccattgacgactctatgggagggttcccccggtaaattttggaatacgacgatagcagttagtatggcgaatatttttcgcggaagttatctagctggagcaggtcttgcattctcattaatgaagtcacttggaggaggcaggcgtggaacaggagcacagggtgaaactctaggagaaaaatggaaacgtcaattaaatcaactcagcaaatctgagtttaacacttataaacgtagtggaataatggaagtggacagaagcgaggcaaaagaaggtctaaagcgaggggaaacaactaaacatgcagtaagccgagggactgctaagctcagatggttcgtcgagagaaatttagtgaagcccgaaggtaaggtaatagacctcgggtgtggaagaggtggctggtcatactactgcgcgggattgaagaaagttactgaggttaaaggatacaccaaaggtggcccgggacatgaagaacctatccccatggcaacatatggatggaacttagtgaagctacattcaggaaaggatgtattctttataccgccagaaaaatgcgatacactactatgtgatataggggaatcctctccgaatcctacgatagaggaaggacgtacattgcgtgtactcaaaatggtggaaccttggttgcgcggaaatcaattttgtattaaaatccttaatccttacatgccgtccgtagttgagacactggaacaaatgcaacgaaagcacggcggtatgctcgttaggaatccactatcaagaaacagtacgcatgaaatgtattgggtaagttgtggaacaggaaacattgtctcggcagtaaatatgacgtcacgcatgctgctgaatcgttttactatggcccaccggaaaccaacgtacgaacgagatgtcgatttaggcgcaggtacacggcacgtggcggttgagccagaagttgcaaatttagatattataggtcaacgtatcgagaatatcaaacacgagcacaaatcgacctggcactacgacgaagataatccatacaaaacctgggcctaccacggtagctacgaagtgaaaccatcggggagcgcaagttcaatggtaaacggagtagttaaactattgactaaaccctgggacgttattcccatggttactcagatagcaatgacagatactactccatttggacaacaaagagtatttaaagagaaagtcgacacacgaactccaaaggctaagagaggaactgcgcaaataatggaagttacggcgagatggctatggggttttctatctagaaacaagaaaccaagaatatgtacgagagaggagttcacaaggaaggtgcgtagtaatgctgccatcggagcagtgtttgtagatgaaaaccaatggaactctgcaaaggaagctgtagaagatgatcgattctgggatcttgtacaccgagaaagagaattgcacaagcaaggtaaatgcgcgacgtgcgtatataacatgatgggaaaaagagagaagaaactaggggagtttggaaaggcaaaagggtcaagggcaatatggtatatgtggttgggtgctagatttctagaatttgaagcgttgggattcatgaatgaggatcactggttcagtagagagaatagtttatccggagtagagggcgaaggacttcataaattaggatacattttgagagatatcagcaaaattccaggaggcaatatgtatgctgatgataccgccgggtgggacactcgtattaccgaagacgatttgcaaaatgaagctaaaataaccgatataatggagccagaacatgctttgttagcgaaatcgatctttaaattaacctaccagaataaagtcgtcagggttcaacgtcctgcgaaaaacggaacagttatggatgtgatatctagaagagaccaaagaggtagcggacaggtcggtacgtatgggctaaacaccttcacaaatatggaggcacagttgatacggcaaatggaaagtgaaggaatatttttaccgaacgaacttgagactccgaatcttgctggtcgagtcctagattggctcgagaaatacggggtcgagagacttaaacgaatggcaatatcaggtgatgactgcgtagtaaagcctattgacgaccgttttgctactgcactcaccgcccttaatgacatgggaaaggttagaaaagatatccctcagtgggaaccaagcaaaggatggaatgattggcaacaggttccgttttgctctcatcattttcaccaacttattatgaaagacggtagagaaatagtagttccgtgcaggaaccaagatgaactggtgggcagggctcgagtaagtcaaggagccggatggagtttgagagagactgcttgtttaggaaaaagttatgcacaaatgtggcaacttatgtacttccatagacgtgatctccgcctagccgcaaatgctatatgttcggcagttccagtagattgggttcccacctcaagaacgacatggagtatccatgcacatcatcaatggatgaccacggaagatatgctttccgtatggaatagagtatggatagaagagaacccctggatggaggataagacaaggatcagctcttgggaagacgtaccatatctgggtaagcgggaagaccaatggtgcggttccctaattggtctcacagcgagggcaacatgggcaaccaatattcaagttgcaattaatcaagttagacgattaattgggaacgagaactattccgactatatgacaagtatgaagagatttaaaaatgagagtgagcccgaaggagcgctgtggtaa

SEQ ID NO: 21883 - RNA, 9879 nt, synthetic construct
  misc_feature 1..9879: note = derived and/or modified CDS sequence (opt6) from DENV-1__GU131827__SS-prME
  source 1..9879: mol_type = other RNA
tccgtaacgatgctgttgatgctcatgccaacagcattggcattccacttaacaacccgtggaggagaaccgcatatgatcgtatctaaacaggagcggggtaaaagtttgctatttaagacaagcgcaggcgtcaatatgtgtactctgattgcaatggatctaggggaattatgtgaagatacaatgacttacaagtgcccacgaataacagaaactgaaccagacgacgttgactgctggtgtaacgctacagacacctgggttacttatgggacatgctcacaaacaggagaacaccgtcgcgataagcgttcggtagcacttgctccgcacgttggtttaggactagaaactaggacggaaacatggatgagttccgaaggagcttggaaacaaatacagagggtagaaacgtgggcactaagacacccaggctttaccgttatagccttgtttcttgcacatgcaataggtacctcaataactcaaaaaggcatcatatttatactcctgatgttagtcacgccatcaatggccatgcgttgcgtaggaattgggagtagagactttgtggaaggtttaagcggcgcaacatgggttgatgttgtgcttgaacacggatcgtgtgtaactacaatggctaaagacaaaccaacactggatatcgaattattaaaaacagaggttactaaccccgcagtcctaagaaaattgtgtatagaagctaaaataagtaatacaacaacagatagccgctgtccaactcaaggcgaagctacacttgtagaggagcaagacgcgaatttcgtctgcagaagaacattcgttgacaggggctggggaaacgggtgcgggcttttcggaaaagggtcattaataacttgcgccaaatttaaatgcgtaaccaaactagaaggtaaaatcgtgcaatatgaaaatttaaaatattctgtcatcgtaacagtacatactggcgatcaacatcaagtaggaaacgaatctacggagcatggtacaacagcaactatcacaccccaagctcctacaactgaaatacaactaactgactacggagcactaacactcgactgctctccaaggactggcttggattttaacgagatggttctactaactatgaaagagaagagttggctagtccataaacaatggtttttggaccttccactgccatggacatccggtgcatcgacttctcaggagacatggaacagacaagatttacttgtaacctttaaaactgcccatgcgaaaaaacaggaagtggtagtcttaggatctcaagagggtgcaatgcataccgcactaaccggtgcgacagaaatccagacaagtgggacgacgactatttttgctggccacttaaagtgtagactaaagatggacaaattaacccttaaaggtatgtcttacgtgatgtgcacaggaagctttaagctcgaaaaggaagtggctgaaacacaacacggcacggtattggtccagattaaatatgagggaacagacgcaccttgcaaaatccccttctccacacaggatgaaaagggtgtaacacagaacgggaggctaatcacggcaaatccaatcgttacggacaaggaaaaacctgtcaacatagaagccgaaccgccttttggagagagctatatcgtgattggagcaggagagaaggcactcaaactctcctggttccgtaaagggagctcaataggaaaaatgtttgaggccacagctaggggtgcccggcggatggcaatacttggagatactgcgtgggattttggctctatcggaggagtttttacgagcgtcggcaaactagtgcaccagatcttcggcaccgcttacggtgttttgtttagtggggtctcgtggacaatgaaaataggcatcggggtactattaacatggttgggtctgaattcgcgctcaacctctctaagtatgacttgtatagcggtaggcctggttactttgtatttaggtgtaatggtacaagccgacagcgggtgtgcaataaactggaaaggtagagaactaaaatgcgggtcgggaatattcgtaaccaacgaagtacacacatggacagaacagtataaattccaggcagattctccgaaaaggctttcagcagcaataggaaaggcctgggaagaaggggtttgtggaatccgttctgcaacgagacttgagaatataatgtggaaacaaataagcaatgagttgaatcacatactactcgagaacgacatgaaatttacagttgtggtgggagatgtcgcgggaattctggctcaaggaaaaaagatgattagaccacaaccaatggagtacaagtattcttggaaaagttggggaaaagcaaagatcatcggcgctgatgtacaaaacaccacattcataatcgatggacctaatacaccagaatgtcctgacgatcagagagcttggaatatatgggaagtagaagattacggatttggcatatttacaactaatatatggctaaaactgcgagatagctatacacaagtctgtgaccatagattaatgagcgcggccataaaggacagcaaagccgttcatgctgatatgggatattggatagaatcagaaaagaatgagacttggaaacttgcaagggcttcatttattgaagtaaaaacatgtatatggccgaaaagtcatactctatggtcgaacggggtattggaatccgaaatgataatccctaaaatatacgggggccctatcagtcagcacaattaccgaccaggctatttcactcaaaccgcaggaccatggcacttaggaaaactggaattagactttgacctatgcgaaggaacgactgtcgttgtcgacgaacattgcggcaacagagggccatctctaagaacaacaacggttacgggaaaaataatacacgagtggtgctgccgttcgtgtacattaccacccctgcgctttagaggggaagacggttgctggtatggaatggaaatacggccggttaaagaaaaagaagaaaatcttgtgaagtcaatggtaagcgcgggttctggcgaggtagattcattctccttagggttactatgcatctccatcatgattgaagaggtcatgcggtctagatggtccagaaaaatgttaatgactggtacattggcagtattttttttgctcattatgggacaactgacatggaatgatttgattcgtttatgcattatggtgggagcaaatgcaagcgatagaatggggatgggtacaacatatttagcattgatggctactttcaaaatgaggcctatgttcgcagttggtctactcttcagacgattgacatcacgggaagtactgctcttaacaataggccttagtttagtagcgtcagtagaactccctaactcattggaagaactaggcgatggattagctatgggcataatgatattaaaacttttaacagacttccaaagtcaccaactctgggcgacactactctcacttacctttataaaaacaacattttctctacattatgcctggaaaacaatggcaatggttttatcaatcgtgtcgttgtttcctctttgtcttagcacaacgtcccagaaaacaacatggttacccgtattgcttggaagtttagggtgcaaaccactaactatgttccttatagcggaaaacaaaatatggggtcgaagaagctggcccctaaacgaaggaattatggctgtgggtatagtgtcaatccttctatcaagtttattaaaaaatgacgtgccactagctggtcctttaattgccgggggcatgctcatagcatgctacgtaataagtgggtctagtgcggacctatcattggaaaaagctgccgaagtttcatgggaggaggaagcagaacattctggagcatctcataacattttagttgaagttcaagatgatggaaccatgaaaatcaaagatgaagaaagagatgacacacttactatactcttaaaagcgaccctcttagccgtctcgggagtctaccccctaagcattccagctaccctgtttgtgtggtatttttggcaaaagaagaaacaacgatcgggggtattatgggatactccatcacctcccgaagttgaaagggccgttctagacgatggaatataccgaataatgcagaggggactactaggacgtagtcaggttggagtgggcgtttttcaagagaatgtttttcataccatgtggcatgtcactcgaggtgcagtattaatgtaccagggaaagagattagaacctagctgggcgtcagtaaaaaaggatttgatctcatacggtggaggatggagattacaaggaagttggaacactggggaggaagttcaagtaatagcagtggagccaggcaagaatcctaaaaatgtccaaaccgcgccgggaacctttaaaacccctgaaggtgaagtaggtgcaattgctctagattttaagccgggaactagcggttctccaatagttaaccgcgaaggaaaaattgtcggtctatatgggaacggagtagtcacaacttcgggaacatatgtgtcagcaatagcgcaagcaaaagcatcccaggagggacctctaccagagatagaagatgaagtgtttaggaagcgaaatttgaccatcatggatcttcatccaggatctggaaaaacccgaagatatcttccagctatagtaagggaagcgattaaacgtaaattaagaacccttatattggcaccaacgagagttgtagcatctgagatggcagaagccctcaaagggatgcccatcagatatcaaaccacagctgtaaaatcggaacatactggaaaagaaattgtagatttaatgtgccatgccacctttacaatgcgactgttgtcaccagttcgtgtacccaattacaacatgattatcatggatgaggcccattttacagaccctagctcaatagcggcgagagggtatatttcaacaagggtgggtatgggtgaggcagcagcaattttcatgactgctacccctcctgggtcagtagaagcctttccacagagtaatgcggtcattcaagatgaagagcgtgatataccagaaagaagctggaacagtggatatgaatggattaccgactttcctgggaaaacagtgtggtttgttccatcaattaaaagcggaaatgacatcgctaactgcttaagaaagaatggtaaacgagtaatacagctaagtcggaaaacgtttgatacagagtaccaaaaaacgaagaataacgactgggactatgttgtcacaactgacatttctgaaatgggcgcaaattttagagccgatagagtaattgatccgcgccgctgtctaaaaccagttatcctaaaagacggtcctgagagggtaatcctggcgggtcctatgcccgtaactgtagcatcagcagcgcaaaggcgggggcgcatcggcagaaatcataataaagaaggcgaccaatatatatatatgggtcaaccactgaataatgacgaagaccacgcacactggacagaagcaaaaatgttattagataatataaacacacctgaaggaattgtaccagcattatttgaaccagaacgagaaaagagcgccgcaatcgacggagaatacaggctacgtggcgaagcaagaaaaacttttgtcgaactcatgaggcgcggagatctacctgtatggttgagctataaagtcgcgagcgaagggtttcagtactccgacaggagatggtgcttcgacggcgagagaaacaatcaagtattggaagaaaacatggacgtcgaaatatggacgaaagaaggtgagaggaaaaaactgagaccaaggtggctagacgcgcgcacctattcagaccctttggcattaagagaattcaaggaattcgcagccggtcgaagaagtgtatcaggggatttaatattagaaattgggaaattgccgcaacacttaacacaacgagcgcagaatgcactagataatctggtgatgttgcataattctgaacaaggaggaagggcatatagacacgcaatggaagaactgccagatacaatagaaacattaatgttactagcattaatcgctgtacttacagggggggtaacactattcttcttatccggtcgaggactcggtaaaacgagtatagggctattatgcgtgatggctagttcagtactattatggatggcttcagtagaacctcactggattgccgcctccattattctagagttttttctaatggttctcttaattcctgaaccagaccggcaacggacgcctcaagataatcaattagcgtacgtagttattggattgttgttcatgatactaacagtagctgcgaatgagatggggcttctagaaacaacaaaaaaggatctcggtattggtcatgtagcggtagagaaccatcatcatgcggctatgttggatgtcgatttacacccagcttcagcgtggacgctgtatgcagtggcaacgacaattataactccaatgatgagacacacgatcgagaatacaactgctaatatatcgctaacagccattgcaaaccaagcggccatcttaatgggcctggataaaggctggccgataagtaaaatggacattggtgtaccccttctagctttaggatgctattcccaggttaatcctctaactcttacagcagcagttctgatgctcgtagctcattatgctattatagggccgggactacaagcgaaggcaacaagggaagcacagaaaagaactgcagcaggtatcatgaaaaatccaactgtcgatggaatagtagccatagacctagatccagtggtgtatgatgcaaaatttgaaaaacagttaggacaaataatgctacttatattatgcacaagtcaaatattgttaatgagaaccacatgggctttatgtgagtctattacactagcaactggtccactaacaactttatgggagggtagtcctggcaagttttggaacaccacaatcgctgtaagcatggctaacatatttagagggtcataccttgccggggcaggattagcattctcactaatgaaatcgctaggcggagggcgtagaggaacaggcgctcagggagaaacgttaggcgaaaagtggaagcggcaacttaaccaactgagcaaatcggaattcaacacgtataaaaggagcggaattatggaggtcgacagatctgaggctaaagaaggtttaaaacgaggggagaccacaaagcatgccgtatctagaggaaccgctaaattacgttggttcgttgaaagaaatttagttaaaccggagggaaaagtaattgatctgggatgtggtcgaggagggtggagctattattgcgccggcctaaaaaaagttacagaagttaaaggctacacaaaaggcggtccaggccacgaagaaccaatccctatggcaacatatggatggaatttagtaaaactacattccggcaaagacgtcttttttataccacctgaaaaatgtgacacactactctgtgatatcggggagtctagccctaatccgacgattgaagaaggaagaactttacgagttttgaaaatggtagaaccctggttaaggggaaaccaattctgcataaaaatcctcaacccatatatgccatcagtagtagaaacacttgagcaaatgcaacgtaaacatggcggtatgcttgtaagaaaccctctttctcgcaactcaactcatgaaatgtattgggtgagttgcggtacgggaaatatagtgagtgcggtaaacatgacctcccgaatgctgttaaatagattcacaatggcgcacagaaaaccgacttacgaacgtgatgttgatttaggagcaggtacaagacacgtagccgttgaacctgaagtagcaaatttagacataatcggccaacgaatcgaaaacattaaacacgagcataagagcacgtggcattatgatgaggataatccatacaagacgtgggcttaccatggtagttacgaagttaaaccaagcggtagcgcttcaagtatggtaaatggagttgttaaattgttgacaaaaccttgggatgtcataccaatggtaacacaaattgcaatgaccgacactacaccgtttggtcaacaaagggtattcaaagagaaagttgatactcgaacaccaaaagcgaaacgaggaaccgctcaaattatggaagttaccgccaaatggctatggggtttcttgtcacggaataagaaaccacgtatatgcacacgtgaggagtttacacgtaaggttaggtcaaacgccgcaataggagccgtgttcgtagacgaaaaccaatggaactccgcgaaggaagcggtcgaggatgaaaggttttgggatttagtacatagggagagggaattacataagcaaggcaagtgtgcaacatgcgtgtataacatgatgggtaagcgagagaaaaagctaggggaatttggtaaggcgaaagggagcagagcaatctggtatatgtggctaggtgcgagattccttgaattcgaagcattaggattcatgaatgaagatcattggttcagcagagaaaattccctatccggtgtagaaggtgaaggcctccacaaattaggttatatattaagagacatctcaaaaattccaggtggtaacatgtacgctgatgacacagcgggctgggatacacgaataaccgaggatgatctacaaaacgaggcaaggattacagatattatggagccagaacacgcccttttggccaaaagtatatttaaactcacttaccaaaataaagtagtacgagtacaaaggcccgcgaaaaatggaacagtaatggatgttataagccgaagagatcagcgtgggagtggacaagtaggcacttacggactgaatacattcactaatatggaagctcaactaataagacaaatggaaagcgaagggatttttagtccttcagaactcgaaaccccaaacctggccgaacgagtccttgactggctagaaaagtacggggtagaaaggttaaagagaatggcgatatctggcgacgattgcgtagtgaaacccatagacgacaggtttgcaacagcactaacggcattaaatgatatgggcaaagtacgcaaagatataccacaatgggaaccgtccaagggatggaatgattggcaacaagtaccattctgttcacatcactttcatcaattaatcatgaaggacggaagagaaattgttgtaccatgcagaaatcaagacgaacttgtagggagagcaagagtatcacaaggagcaggatggtcactaagggaaacggcatgtctagggaaaagctatgcacaaatgtggcaattaatgtactttcatcgaagggaccttagactcgccgccaacgcaatctgtagtgcagtgccggttgattggattccaacttctagaaccacatggtcaattcatgcgcaccatcagtggatgacaacagaagacatgttaagtgtatggaatagagtctggatagaagaaaatccttggatggaggacaaaacacatatatcttcatggggagatgtaccttacttgggaaaaagagaagatcaatggtgcggaagccttataggcttaactgcaagagccacatgggctactaatatacaagtcgcaatcaaccaagttagacggttaattggcaatgaaaactatttagactacatgacaagcatgaaaagattcaagaacgaaagcgaccctgaaggcgccctctggtga

SEQ ID NO: 21884 - RNA, 9879 nt, synthetic construct
  misc_feature 1..9879: note = derived and/or modified CDS sequence (opt6) from DENV-1__GU131831__SS-prME
  source 1..9879: mol_type = other RNA
agcgtcaccatgttgctaatgttaatgccaaccgcactagcgtttcatttaactacccgaggtggtgaaccccatatgattgttagtaaacaagagcgaggtaaatcactgttattcaaaacatcagcaggagttaacatgtgcacactgatagcaatggacctaggagaactttgcgaagacaccatgacatataaatgtccaagaataaccgaaactgaaccagatgatgttgattgttggtgtaacgcaacagacacgtgggtcacatatggcacttgtagtcaaactggagagcacagacgtgataaacggtctgtagccctagcccctcatgtcgggctaggtttagaaacccggactgaaacgtggatgtcatccgaaggagcctggaagcaaatccaaagagtcgagacatgggcactcaggcacccaggattcacagttatagcattattcctagcacacgcgataggcactagcattacgcaaaaaggcataatattcatattactaatgctcgtaacaccgtccatggcaatgaggtgtgtagggattggaagtcgcgattttgtagaaggattatcaggagccacatgggttgacgtcgtccttgaacatggtagttgtgtaaccaccatggccaaagacaagccaaccttagacattgaattattgaagacagaagtaactaacccggccgtattaagaaaattgtgcatagaagctaagataagtaatacaaccacagatagtagatgtccaactcagggagaagctactcttgtggaggaacaagatgcaaactttgtctgtcggagaacatttgtggacagaggatgggggaacggttgcggtctcttcggcaaaggatcacttattacctgcgcaaaatttaaatgcgtaacaaaacttgaaggaaagattgtacagtatgaaaacttaaaatatagtgtaatagttactgtgcacacgggagatcaacatcaggtaggtaacgagagtactgaacatgggacaacggccactataactccccaagctcccactaccgaaatacaattaacagattatggtgctcttactctagattgtagtcccaggaccggcttagacttcaacgaaatggtattgctaactatgaaagaaaaatcgtggctagtacacaaacaatggtttctcgatttgccattaccatggacgagtggagcgtcgactagccaagaaacatggaaccgtcaggacctattggtcactttcaaaactgctcatgccaagaaacaagaggttgtagtcctgggaagtcaggaaggtgctatgcatactgcacttacgggagcaactgaaatacagacatcaggcacaactactatctttgcgggtcatctcaagtgtaggttgaaaatggataagctgacacttaaagggatttcatacgtgatgtgcacaggaagttttaaacttgaaaaagagctcgcagaaacacaacatggcacggtacttgtgcagataaagtatgaaggaacagatgctccatgtaagatacctttctccacacaagatgaaaaaggcgttacacagaacggtagattaataacagccaatccaattgtaactgacaaagaaaaaccagtcaatatcgaggcagaacctcccttcggggaatcctatattgttattggagctggggaaaaggcattaaagttgtcttggtttaagaaaggatccagcattggtaagatgtttgaagctaccgccagaggagcaaggcggatggcgattttgggagacacagcatgggactttggttcgataggcggcgttttcaccagtgttgggaaactggtgcaccagatatttggaacagcatatggcgtactattttcaggagtctcatggacaatgaagatagggatcggggttctattaacctggctaggtctaaactcaagatcaacgtcactttccatgacatgcatagcggtgggtctggtaactctatatttaggagttatggtacaagcagattctggttgcgtgataaattggaagggacgagagttaaaatgtggctcaggaatttttgtgacaaacgaagttcatacttggacagaacagtataaattccaggccgacagtccaaaaagattgagtgcagcaattgggaaagcatgggaagagggagtgtgcggtatccgatctgcaacaagacttgaaaacatcatgtggaaacaaatttccaatgaacttaaccacattctcctggaaaatgatatgaaattcaccgttgtagtaggagacgtagcgggtatactcgctcaagggaaaaagatgatacgcccacaacctatggaatacaaatattcttggaaaagctggggtaaagcaaaaataataggagcagatgtgcaaaatacaacatttattatcgatggaccgaacacaccagaatgccctgacgaccagagagcatggaacatctgggaagttgaagactatggattcggaatattcactacaaatatatggctcaaattgagagactcctacactcaggtatgcgatcaccgcctgatgtcagccgccataaaagatagtaaagcagtgcatgccgacatgggttattggatagaatccgaaaagaatgaaacctggaagttagcaagagcttcattcatagaagtcaaaacctgtatttggcctaaatcgcatacgttatggagtaatggggtattagaatcagagatgatcatccccaaaatatatggtggcccaatatctcagcataactatcggccaggatactttacacagacggctgggccatggcacttaggaaaactggaattagactttgatctttgtgaaggaacgactgtggtggtagatgagcattgtggaaatcgtggaccaagtcttcgcacaaccactgtaacaggaaaaataatacatgaatggtgttgtcgctcgtgcacattacctcccctgagatttcgaggggaagatggttgttggtatggtatggagatacgacctgttaaagagaaagaagagaatttagtaaagtcgatggtaagtgccggttcaggggaagtagattcattttcactgggcctactttgcatcagcataatgattgaagaagttatgagatctagatggtctagaaaaatgctgatgactggaacactagcagtattctttcttctaattatgggacaattaacttggaacgatttaattcgcctatgtataatggttggtgcgaacgcaagtgataggatgggtatggggactacatatttagctcttatggcaacgtttaaaatgcgaccaatgttcgcggtaggattgttgtttagaagattaaccagccgagaggtactcctacttaccataggactatcgcttgtagccagtgtggagctcccaaactcattggaagagttaggagacggcctagcaatgggcattatgattttgaagttattaacggactttcaaagtcaccagctgtgggcgacgctattatcattaacattcatcaaaacaacattcagtctacactatgcatggaagacaatggcaatgatactctcaattgtatctctatttcctttatgtctctccacaacgtctcagaaaactacatggttaccagtattgttgggttctctcggatgcaaaccgcttactatgttcctaattgccgagaataaaatctggggccgtcgatcatggccactaaatgaaggaataatggccgtcgggatagttagtatacttttgtcttccttacttaaaaatgacgtaccgctagctgggccgcttatcgcagggggtatgttaatagcgtgctacgtaatatcaggctcgtcagctgacttaagtttagagaaagcggcagaagtatcatgggaagaagaggcggaacattcaggagcgtctcacaatattctagtagaggtacaagatgatggaacaatgaaaattaaagatgaagaaagggacgatactcttaccatactactaaaagctacacttcttgcagtatcaggagtctaccctctcagcataccagctacattgttcgtctggtatttttggcaaaagaagaaacaacgaagtggagtattatgggacacgccgtcaccgccggaggtggaacgagccgtattggacgatggtatatatagaataatgcaacggggacttctcggtagatcacaggttggcgtcggagtgtttcaagaaaatgtctttcacaccatgtggcatgtgacgagaggagccgtgttgatgtaccaaggaaaacgactagaaccatcatgggcttcagtaaagaaggatctaatctcatatggaggtggctggcgcttacaaggttcatggaacacgggagaagaggtgcaggttattgctgtagaaccgggcaaaaatcccaaaaatgtacagaccgctcctggtacattcaaaactccagaaggagaagttggagcaatagcactcgattttaagccgggaacatccggatctccgatagtgaatcgagaaggaaaaattgtcggattatacggaaacggagtggtaaccacttccggcacatatgtttcagccattgcacaggcgaaagcctcgcaggaaggtcccttgccggaaattgaagatgaagtattccgaaagcggaatctaacaataatggatctgcatccagggagtggaaagacaagaagatatttaccagcaatagtccgtgaagcaataaaaagaaagttaagaacattaatacttgctcccacgcgtgtggttgcctctgagatggcggaagcgctaaaaggcatgcctattagataccaaacgacagcagtaaaatcggaacacacgggaaaagagatagtagatttaatgtgtcacgccacatttactatgagactattatcacctgtcagagttccaaactataatatgataatcatggatgaggcacactttacagacccaagctcgatagcggcaagaggatatatatcaacgagggtagggatgggagaagcagcggcgatttttatgactgcaacaccacctggctctgtcgaagcctttccccaaagcaatgctgtcatacaagacgaagaacgtgatatacctgaacggtcttggaactcaggttatgaatggataacagatttcccaggcaagactgtttggttcgtgccatccataaagtctggcaacgacattgccaactgtctgcgtaaaaatggaaaacgagtcattcagttatccaggaaaacttttgacaccgaataccagaaaacgaaaaacaacgattgggattacgtcgtgacaactgatatcagcgagatgggagcaaatttcagggcggatagggttatagacccgcgaagatgtctaaaacctgttattctcaaagatggtcctgaaagagtaatcctagctggtcctatgccagtaaccgtagcatcggctgctcaaagacgtggtcgaataggtcgtaatcataataaagaaggagatcaatatatatacatgggacaacctttgaacaacgatgaggatcacgcccattggacagaagcgaaaatgttgctagacaatatcaatactcctgaaggaattatcccggcgctgtttgaaccagagagagaaaaatcagctgcgatagatggagaatatagactccgcggtgaggctcgaaagacattcgttgagttaatgagaagaggagatctacctgtgtggttatcatacaaagtagccagcgaaggatttcaatacagtgacagaagatggtgtttcgacggggaacgtaataatcaagtcttggaagaaaatatggatgttgaaatttggacaaaggaaggagaacgcaagaaacttagaccaagatggttagatgcccgaacctacagtgatcccttagccctaagagagtttaaagagtttgctgcgggtagaagaagcgtatcgggagatttaattctagaaattggaaagttaccacaacacctaactcagcgggcccagaatgcattggataacttagtaatgttacacaactcagaacaaggaggacgcgcttaccggcatgcaatggaggagctgcccgacacgatagaaacattaatgttattggctttaatcgcagtattaactggaggcgttaccttgttctttttgagcggtagaggccttggaaagacttcgataggactactatgtgtgatggcttctagcgtacttctctggatggcctcagtcgaaccacactggatagcggcttcaatcatccttgagttctttttgatggtactactaattccggaacccgacagacaaagaacgccacaagacaatcaattggcttatgtggtaataggcttactatttatgatattaaccgtagcagcaaacgaaatgggcttgttagaaacaacgaagaaggaccttggaataggacatgtcgcagttgaaaatcatcaccacgcagcaatgctagacgtagatctccatcctgcatccgcttggacattatatgcagtagccacaacaataataacacctatgatgagacacaccatcgaaaacacaactgcaaatattagtctaacggctatcgcaaatcaggctgccattctaatgggactggacaagggttggcctatttcgaaaatggacataggtgttccactgttagccctaggctgttattcgcaagtcaaccccctcacactaacagctgctgttctcatgctagtagcccactacgctattataggtcccggtcttcaggctaaagcaacgcgagaagcccagaaaagaactgccgcaggtatcatgaaaaatccaaccgttgatgggatagtagcaatcgatttagaccctgttgtatacgacgcaaaattcgaaaaacaattaggacaaatcatgctactcatattatgtacgtctcaaatactattaatgaggaccacatgggctttgtgtgaatcaatcactttagcgactggccctttgactacactttgggaaggtagtccaggtaagttttggaatacgacaatagcagtgtccatggcgaacatattccgaggaagctatttggccggagcaggtttggcattctcattaatgaaatcacttggaggaggtcggaggggaacaggggctcagggtgaaacccttggagaaaagtggaaaagacaacttaatcagctcagtaaatcagaatttaatacatacaaacgatcagggattatggaagttgatagatctgaagcgaaagagggtttaaaaaggggcgaaacaacgaagcacgcagtttctaggggtacagcaaagctaaggtggtttgttgaaagaaatttggtaaaacctgaaggaaaagttatagacttggggtgtggtcgcggcggatggtcgtattactgtgcagggctcaagaaagtaactgaagtaaaaggatacactaaaggaggacccgggcacgaagaaccaattccaatggcgacctatggttggaatttggtaaaacttcattctggcaaagatgtatttttcatcccacccgaaaaatgtgatacgttactatgcgatattggtgaatctagtcccaatccaacgatcgaagaaggtagaactcttcgtgttttgaaaatggtagaaccttggctgcgaggaaaccaattttgtattaaaatactaaatccttacatgccatcagttgttgagacactagaacaaatgcagaggaaacatggaggcatgttagtgagaaaccctttaagtaggaatagcactcacgagatgtattgggttagctgcggaacgggtaatattgtatcagccgtgaatatgacaagtcggatgctgcttaataggttcactatggcgcatcgtaaaccaacttacgaacgagatgtagaccttggcgccggaaccagacacgtcgcggtggaacctgaagttgccaatcttgatataatagggcaaaggattgagaatattaaacacgaacacaaaagtacttggcattacgacgaagataatccatataagacctgggcttatcacgggtcatatgaggtgaagccatcaggtagtgcatcctcgatggtcaacggcgtggtaaaactattaaccaaaccgtgggacgtaattccgatggtcacccaaatagccatgactgacacaacaccgttcgggcaacagagagtgtttaaagaaaaggtcgacactaggacaccaaaagctaaacgaggaacagcgcaaattatggaggttacagctaaatggctatggggatttttatcaaggaataagaaacccagaatatgcaccagagaggagtttactagaaaagttagatcaaacgccgccatcggagccgtttttgttgatgaaaaccaatggaactcggctaaggaagccgttgaagacgaaagattttgggaccttgtacacagagaacgtgaattacacaaacaaggaaagtgcgcaacgtgtgtatacaacatgatgggaaagcgtgagaagaaactcggcgaatttgggaaagccaaaggatcacgagctatatggtacatgtggttgggcgcaaggtttttagaatttgaggcattaggctttatgaatgaagatcactggttttcacgggaaaatagcttatccggcgtggagggagagggactgcacaaactcggctatatactaagagacataagtaaaatacctgggggcaatatgtatgccgacgataccgcagggtgggacactagaatcacagaagatgatttgcagaacgaagcaagaattacagatataatggaacccgaacacgcactcttagccaaatctatatttaaactaacataccaaaataaggtagtccgagtacaaagacctgcaaagaacgggactgtaatggatgtaatcagtaggcgagaccaaagaggtagtggtcaagtaggtacctacggactaaatacatttactaacatggaagcacaactaataagacaaatggaatcagagggcatattttctccaagtgaacttgaaacaccaaacctagctgaaagagtattggattggcttgaaaagtacggtgtagaacgattaaagcggatggcgataagcggggacgattgtgttgtaaaacctatagatgatcggtttgcaacagcactaactgctcttaatgatatgggtaaagtgagaaaggacattccacagtgggaaccttcgaaaggatggaatgattggcaacaagtaccattttgtagccaccactttcatcaattaataatgaaagacggtagagaaatagtggtcccatgcaggaaccaagacgaactggtagggagagcgcgcgtatctcaaggagctggttggagtctacgagaaacggcttgtctaggcaaatcttatgcacagatgtggcaattgatgtatttccacaggcgagacctaagacttgcggcaaacgcaatatgttcagcagtacccgtagactggattcccacttccagaaccacgtggtccatccacgcacaccaccagtggatgacgacggaagacatgctaagtgtttggaacagggtatggattgaggaaaatccgtggatggaggataaaacacatatttcgagttggggagacgtaccgtatttaggcaaaagagaagatcaatggtgtgggtcactaataggattaactgctagagcaacgtgggcgacaaatattcaggtcgccattaatcaggtacgacgtttgattggaaatgagaattacctggattatatgacatcgatgaaacgatttaagaacgaatcggacccagaaggagctttatggtaa

SEQ ID NO: 21885 - RNA, 9879 nt, synthetic construct
  misc_feature 1..9879: note = derived and/or modified CDS sequence (opt6) from DENV-1__EU482789__SS-prME
  source 1..9879: mol_type = other RNA
agtgtcactatgttactgatgctcatgcctaccgcattggcattccatctaacaacgcgcgggggcgaacctcatatgatcgtaacgaaacaagaacgagggaaaagtttattatttaaaaccagtgcaggggtaaatatgtgtactcttatagcaatggacctaggagaactttgtgaagacacaatgacatataaatgtccccggataacagaagctgaaccagatgatgtcgattgctggtgtaatgctactgacacgtgggttacctacggaacgtgcagccagacaggagaacaccggagagacaaaagatctgtagcgttagctcctcacgtcggcctaggtcttgaaacgcgaacggaaacgtggatgagttctgaaggggcatggaaacaaatacaaagagtagaaacatgggcgttaagacatccggggttcaccgtgatagctctctttttagctcatgcaataggaacatccattacgcaaaaaggaataatattcattctcttaatgcttgtcacaccgagcatggccatgaggtgcgttggtatagggagtcgagattttgtagaaggattaagtggcgctacatgggttgacgtagtattggaacatggatcatgtgtaacaacgatggcaaaagacaaacctacattagatatagaattgttaaaaacagaggtaaccaatcctgcagtacttcgaaaactatgtatcgaagctaaaatttcgaacacgacaactgactctcgctgcccaacgcaaggtgaagccacgttaatggaagaacaagatgccaactttgtgtgtagaaggacgtttgtcgatcgcgggtggggaaatggttgcggactctttggtaaaggttctctaataacatgcgcaaaattcaaatgtgtgactaaaatggaaggaaaaatagttcaatacgaaaacttaaaatacagcgtaatagtgacagttcacacaggagatcaacaccaagtaggtaatgaaagtaccgaacacgggactacagcgacaataacaccgcaagccccgaccagtgaaatacagttaaccgattatggggcactcacacttgattgttctccacgaacagggcttgattttaacgaaatggtactattaacaatgaaagagaaatcttggttagtgcacaaacaatggtttttggatctgcctctaccgtggacatcgggcgcgagtacgtcgcaggaaacttggaatcgacaagaccttttggtcacatttaaaacagcacatgccaagaaacaagaagttgtcgtacttggttcgcaagaaggagcaatgcataccgccctaactggcgcgacagaaattcagaccagtggcaccacaacgatctttgctggccatttgaagtgtagactgaaaatggacaaacttaccctaaaaggaatgagctatgtgatgtgtacaggatcatttaaacttgaaaaagaagtggcagaaactcaacatggaacagtgttggtacaaataaagtatgagggaaccgatgccccgtgcaaaattccattttccacccaagatgaaaaaggcgtaacacaaaatggtcgtttgattactgccaatccaattgttacagataaggaaaagccagtaaatatcgaagcagaacctcccttcggtgaatcgtatattgtgattggggctggcgagaaagccttaaaattatcgtggtttaagaaaggatcttcgataggtaagatgttcgaagcaaccgcacgaggcgcaagaaggatggcaattctaggagacactgcatgggacttcggaagcatcggaggagtttttacttcggtgggcaaacttgtacatcagatcttcgggactgcatatggggtattattctcgggagtttcatggacgatgaaaataggaatcggtgtgttactgacgtggctcggattaaactcgcgaagcacgagtctaagtatgacgtgtattgcggtgggactcgttacattgtacttaggagtaatggtacaagctgattcgggctgtgtaatcaactggaaaggacgagagctaaagtgtggttccggtattttcgttacgaatgaggtacatacatggacagagcaatataagtttcaagcagactcaccaaaaagattgtctgcagcaatagggaaagcatgggaagaaggtgtctgcgggatacgaagtgcaacaagactagaaaacataatgtggaaacagataagtaatgagctaaatcacatattgttggaaaatgacatgaaatttactgtggttgttggagatgttgttggaatactcgctcaagggaagaaaatgataagacctcaacccatggaacacaaatattcatggaagtcatggggtaaagcgaaaataataggagcagatgtacagaataccacttttatcatagacggcccgaatactcctgagtgcccagatgaccagcgagcctggaatatctgggaggtagaagactatggatttggaatctttacaactaatatatggcttaaattaagagatagctacactcaagtctgcgaccaccgcttaatgagcgcagccatcaaggacagcaaagcggtccatgctgacatgggttactggatagaaagcgagaaaaatgagacgtggaaattggctcgagccagcttcattgaagtgaaaacgtgcatatggcccaaatctcataccctatggagcaatggtgtgctcgaatcagagatgatcataccaaaaatctacggagggccaatttcgcaacacaactataggccaggctacttcacacagacagcaggaccctggcacctcggaaaattggaacttgattttgatctatgtgaaggcacgacggtagtagtggacgagcactgcggaaaccggggaccgagtttacgaaccacgacggttaccgggaaaataatacatgaatggtgctgtagaagttgcacgctacccccattaagatttaaaggggaggatggatgctggtatggtatggaaattcgtccagtcaaagaaaaagaggaaaacttagtcaaaagtatggtgagcgcagggtcaggtgaggtcgattcgttctcactaggcctactctgcatatcgataatgatagaggaagtcatgcgtagtcgttggtcacgtaaaatgttaatgacaggaacacttgcagtttttctcctacttattatgggccaattaacttggaacgatttgataaggttatgcatcatggttggagcaaacgcaagcgaccgaatgggtatgggcactacttacttagcactcatggcgaccttcaaaatgcgccccatgtttgcggttggtctcctattcaggcgtttaacctcacgagaagtactactcctgacgattggactgtcactggtcgcttcagtagaattaccaaacagcctggaagaattaggagatggcttagccatgggtattatgattctcaaactcttgactgactttcaaagtcaccagttatgggctactttgttaagtttaacttttatcaagacaaccttatctttacattatgcatggaagacaatggccatggttctctcaatcgtcagtttatttccgctatgcctatcgaccacgtcccagaagactacatggcttcccgttctgttagggagcttaggatgtaagccactgacaatgtttttaatagccgaaaacaagatctggggaaggaagagttggccactgaatgagggtataatggctgtcggagtagtaagtatcttgctcagctcacttctcaaaaatgacgtaccactcgccggacctttaatagcaggcggcatgctaattgcgtgttacgttataagtggatcatcagccgatttatccctagagaaagcagctgaggtttcctgggaagaagaagctgagcattccggagcctcgcacaatatactggtcgaagtccaagatgacggaaccatgaaaataaaagatgaagaacgtgatgataccctgacaatacttctcaaagcgacattattagctgtaagtggtgtatatccattgagcattccagccacgctgtttgtttggtacttttggcagaagaagaaacaacggtcaggagtgctgtgggatacaccaagcccaccggaagtagaaagggccgtacttgatgatggaatctataggattatgcaacgaggactattaggacgaagccaagtgggagtaggcgtgtttcaagaaaacgtcttccatacaatgtggcatgtaacacgaggagcagttctaatgtaccaaggaaagaggttggaaccatcatgggccagtgtcaaaaaggatttgatatcgtatggagggggatggagacttcaaggtagttggaatactggagaggaagttcaagtaatcgcagtggagccggggaagaaccctaaaaatgtacagacggcacccggcaccttcaaaacaccagaaggtgaagtaggcgcgattgcattagactttaaacccgggacatcaggatcacctattgttaatagagagggcaaaattgttgggttgtatggaaatggcgtagtcaccacaagtgggacatatgtatccgcgatagcacaagcaaaagcatctcaagaaggcccgctgccggaaatagaggacgaagtattcaggaaaagaaatctaacaataatggatctgcatccaggttcggggaagactcgtcggtacctaccagctattgtgagggaagcaataaaaaggaaactaagaacactcatactggcaccaacacgagtagttgcgagcgaaatggccgaagcattaaaggggatgccgattagatatcagacaactgcagttaaaagcgagcatacaggcaaagaaatagtagatctgatgtgccacgccacttttacaatgagattgttatccccagtaagagtccccaactataatatgattataatggatgaagcacacttcacggacccctcaagcatcgctgcaagaggatatatctctactagagtcgggatgggagaagcggcggcaatatttatgacggcaacaccaccaggaagcgtcgaggcatttccgcaatcaaacgccgtcatacaagacgaggaacgagatataccggaaagaagttggaactcgggctatgaatggattacggattttccaggaaaaactgtctggttcgtcccttcgatcaaaagcgggaatgacattgcaaactgtctacgtaagaacggcaaacgcgtaatccaactgtctagaaaaacattcgatactgaatatcagaaaaccaagaacaacgattgggattacgtcgtaactactgatatctccgaaatgggggccaactttagggcggatcgcgtaatagacccaaggcgatgccttaagccagtaatactgaaagatggaccggagagggtaatattagctgggccaatgccagtcacggtagccagtgcagctcaaaggcgaggccgaattgggagaaatcataataaagaaggagaccaatacatttacatgggacaacctttaaataacgacgaagatcacgctcactggacagaagctaagatgttacttgacaatatcaacactccagaaggaatcattcctgcactctttgagccggaaagagagaaaagtgcagctattgacggtgagtataggcttcgaggtgaagcaagaaaaacatttgtagaacttatgagaagaggggatctaccagtttggttaagctacaaagtagctagcgagggttttcaatactctgatcgacgctggtgtttcgatggcgaacgaaataatcaagtactcgaagagaatatggatgtagaaatttggacaaaagagggggaacggaagaaactacggcccagatggttagatgcgcgaacttacagtgacccattagccttaagagaatttaaagaatttgccgcaggtagacgatctgtatcaggggatttaattttagagatcggtaagttgccacaacatcttactcaaagagcacagaatgctttagacaatctagtgatgctgcataatagtgaacaagggggtagggcttatagacatgctatggaagaattaccggatacaatagagaccttaatgcttctggctctcatagcagtccttactggaggagtaactctattctttctgtccgggaggggtcttggaaaaacatctataggtcttctatgtgtaatggcaagtagcgtcctactctggatggcatctgtcgaaccgcactggattgctgccagcattatattggaatttttcctaatggttctgttaatcccagaaccagaccgacaaagaactccacaggacaatcaacttgcttatgttgttataggtctattgttcatgatcttgacagtagcagctaatgaaatgggtctgttagaaacaactaagaaagatttaggaataggccatgtagcagtagaaaaccaccatcatgcaacaatgctcgatgtagacttacaccccgcaagtgcatggaccctatacgctgtagcgactacaattattacgcccatgatgcgacatactattgagaacaccactgcaaacatcagcttgactgcaatagcgaaccaagcagcaatattaatgggtttggacaagggttggccaataagtaaaatggacataggggttccattgttagcgctaggttgctattcacaggttaacccactaacactgaccgcagccgtgctaatgttagtggctcattatgcgataataggacctggattgcaggctaaggcaacaagagaggcacaaaagagaacagcagccggcatcatgaaaaatcctaccgttgacggaattgtcgcaatagatctggatccggtagtatacgatgccaaatttgaaaaacaactcggtcaaattatgttgctaattctttgcacgtcacaaatactacttatgaggactacatgggcattatgcgagagcataacattggctaccggacccctcacgactttatgggagggatcaccaggtaaattctggaacactacaatcgcagtgagcatggcgaacatctttcgaggttcatacttagcgggtgcgggactcgcgttcagccttatgaaatcccttggtcgaggtaggagaggcactggtgctcaaggggagacactcggtgaaaaatggaaaagacaattaaatcagctatcaaaatccgagtttaatatatataaacgtagcggcatcatggaagtcgatagatccgaagccaaagagggacttaagaggggagagactacacgacacgctgtatcacgtgggacagctaaattaagatggttcgtagaacgaaatttagtaaaacctgaaggaaaagttattgacctcggttgtggtagaggcggttggagttactattgtgctgggctcaagaaagtaacagaagtaaaaggatataccaagggcggaccagggcacgaagaaccaattccgatggcaacctatggatggaacctagtaaaacttcattcaggaaaggacgttttcttcaccccaccagaaaaatgcgatactttgctatgtgatataggtgaatccagtccgaatccaactatagaagagggtagaacattgagagttctgaaaatggtggaaccttggctgcgaggaaaccaattttgcattaagatactgaacccatatatgcctagtgtggtggaaacattagaacaaatgcaacgaaagcatggagggatgttagtaagaaatcccctgtcaagaaacagcacacacgaaatgtattgggtaagttgtggtacaggaaacatagtcagtgccgttaatatgacttctcgaatgctattaaaccggtttaccatggcgcatcgaaaaccaacatatgaaagggatgtcgatctgggcgctggaacacgtcacgtagcagtggaaccagaagttgctaatttagatattattgggcaacgtatagaaaacataaaacatgaacataaaagcacttggcattacgacgaagataacccctataagacctgggcctaccatggaagttacgaagtgaagcctagtggatctgcaagttcaatggtgaacggcgtggtaaagttactaacgaaaccatgggatgtcattcctatggttacgcaaattgcaatgacagatactacacctttcggtcagcagagggtctttaaagaaaaagtcgatactaggacgccaaaggcaaaacgagggacagcacaaattatggaggtaactgctcgttggttatggggcttcttaagtagaaacaagaaaccgcgaatctgtactcgggaagagttcacacgtaaagtcagatcaaacgcggctataggagcggtatttgtcgatgaaaaccaatggaactcagcaaaagaagcagtcgaggacgaacgattctgggatcttgtccaaaaggaaagggaattacacaagcagggtaagtgcgccacctgtgtatataatatgatgggaaaaagagagaagaaacttggagagttcggcaaggctaaaggctctagagcaatatggtacatgtggctgggagctcgattcctagaatttgaagccttagggtttatgaacgaagaccattggttttctcgagaaaattcattgtcaggcgtcgaaggagagggattacacaaactgggctatatccttagagatataagtaaaatacccggtggtaacatgtacgcggatgacacagcgggttgggatactagaatcacagaggatgatcttcaaaatgaggcaaaaattacagatataatggagccagagcacgcgcttctagctacaagtatattcaaactaacctatcaaaacaaagtagtaagagtacagcgaccagctaaatccggaaccgttatggacgtgatatctaggagagaccaaagaggtagtggacaagtaggaacttatggattaaatacattcacaaacatggaagcgcaacttattagacagatggaatctgaaggaatatttctgccttcagaacttgagacgccaaatctagcggagcgcgttctagattggttagaaaaatatggcgttgaacgcttaaagagaatggcaatatcaggggatgattgcgttgttaaacctattgacgatagattcgcgactgcacttacagcactgaatgacatgggtaaagtgagaaaagacataccacaatgggaaccaagtaagggatggaacgactggcaacaagttccattctgttctcatcactttcaccaattaatcatgaaagacggtcgagaaatagtcgtaccttgtcgcaatcaagatgagctagttggacgagcacgtgtaagtcagggagcagggtggtcgctccgagaaacggcgtgtttaggtaagtcatatgcccaaatgtggcaattaatgtattttcacagacgagatcttaggcttgctgcaaacgcaatatgcagcgcagttcctgtcgactgggtgcccacaagcagaacgacatggtcgatacatgctcatcatcaatggatgacaacagaagacatgttgagcgtgtggaatagagtatggattgaggaaaatccatggatggaagacaagactcatgtgagttcatggggagacgttccatatcttggaaaaagggaagaccagtggtgtggaagtcttattgggttaactgcaagggcaacatgggccagtaatatacaagtagccattaaccaggtaagaagactgatcggcaacgaaaattacctggattacatgacatcaatgaaaagatttaaaaatgagggggatccggaaggagctttatggtag

SEQ ID NO: 21886 - RNA, 9879 nt, synthetic construct
  misc_feature 1..9879: note = derived and/or modified CDS sequence (opt6) from DENV-1__EU482790__SS-prME
  source 1..9879: mol_type = other RNA
agcgtaactatgttactaatgctgatgccaactgcactagcgtttcatttaactactcgagggggtgaaccgcacatgatagtatctaaacaagaaaggggtaaatcactactatttaaaacgtccgcaggggtgaacatgtgtactctaattgctatggatttaggggaattttgtgaagatactatgacttataaatgtccaaggatcaccgaagcggaaccagacgacgttgattgctggtgcaatgcgactgacacttgggttacatatggaacatgtagtcaaacaggagaacacaggcgagataaacgatctgtggcattagctcctcatgtcggtcttggtctcgaaacacgaactgaaacatggatgagcagcgaaggagcctggaaacaaatacaaagagtagaaacatgggcattaaggcatccaggtttcacggtcattgccttgtttctagcacatgccataggaaccagcataactcagaaaggtataattttcatactattgatgctagtaacccctagcatggcaatgagatgtgtaggaataggatcaagagactttgttgaaggtctatcgggagcgacctgggtcgacgttgtgctggaacacggttcatgcgtgacaaccatggctaaagacaaaccaacattggatatagaattattaaaaacggaagtgacaaatcctgccgtattaagaaaactatgtattgaagctaaaattagtaacacaacaaccgattcgagatgccctacacaaggagaagctacattagtagaagaacaagacgccaattttgtctgtagaagaacatttgtagataggggatggggaaatggttgcggcttgtttgggaaagggtcattaataacctgcgcaaaattcaaatgtgtcacgaaattagaaggaaaaatagtgcagtacgaaaacctaaaatatagcgtgatagtcactgtccacacaggcgatcagcatcaagtaggcaacgaatccacagaacatggtacaacagcaacaattactccccaagctccctccactgaaatacaattgactgactatggtgcactaactctggattgttcaccgcggaccggcttagattttaacgaaatggtattactaacgatgaaagaaaaatcatggttggtacataaacaatggtttttagatctaccgttgccctggacaagtgggagttccacaagccaagaaacatggaatagacaagatttactggtaacgttcaaaaccgctcatgccaagaaacaagaagtagtggtcttgggatctcaagagggggctatgcatacagccctgacaggagctacagagatccaaacctcgggaacaacaacaatctttgcaggccacctaaaatgtcgactcaaaatggacaaactcacattaaaaggcatgagctatgtgatgtgtaccggttcattcaagttagagaaagaagttgcagagacgcaacacggaacagttcttgtacaaattaaatatgaaggtacagacgttccttgcaaaataccgtttagtactcaagatgagaagggtgtaacccaaaatggaagattaattacagctaatccaatcgtcactgataaagaaaaaccggtgaacatagaggcagagccaccctttggagagtcatatatcgtcatcggagcgggtgaaaaggctttaaaactaagttggtttaagaaagggtctagcataggcaaaatgttcgaagcaacggcgagaggcgctcgaaggatggcgatattgggagatactgcatgggattttggtagtataggcggtgtatttacttccgttgggaagttagtccatcagatcttcggcactgcatatggagtattattctctggtgtgtcgtggacgatgaaaataggcattggagtgttacttacatggttaggattaaattctagaagtacaagtctgtcaatgacttgtatagcagtaggattagtcactctgtacttaggcgtaatggtgcaggctgatagtggttgtgtaataaattggaaaggaagagagctaaaatgtggctcagggattttcgttacgaatgaggttcacacatggaccgaacaatataaatttcaggctgacagcccaaaacgattatccgccgctataggaaaagcctgggaggagggagtctgcgggataagatccgctacacgattagaaaatataatgtggaaacaaataagcaatgagcttaaccacatcttattagaaaatgacatgaaattaacagttgtggttggagatgttgctggcatattagcacagggcaagaaaatgattcgaccacaacctatggagtataagtattcttggaaatcgtggggcaaagcaaaaatcattggggcagatgttcagaacacaaccttcattattgatgggccgaacacaccagaatgcccagatgaccaaagggcctggaacatatgggaggtagaagattacggattcggaatcttcactactaacatatggctaaaacttagggattcgtatacgcaggtttgcgaccatcgactaatgtcggctgcaattaaagatagtaaggccgtgcatgcagatatgggttattggatagaaagcgagaaaaacgaaacctggaaacttgcaagagcatcgtttatagaagtcaaaacatgcatatggccaaagagccacaccctttggagcaacggagtgttagaaagtgaaatgataattcctaaaatatatggcggacccatctctcaacataattatagacccgggtatttcactcaaacagctggaccttggcatctaggtaagctggaattagactttgatctttgtgaaggaacgaccgttgtagtcgatgaacattgtgggaaccgcggaccatcattacgaaccactaccgtaacaggtaagataatccacgaatggtgttgcagatcctgtacgttaccacccctgagatttaagggagaagacggatgttggtatggcatggaaataaggccagtaaaagaaaaagaggagaatcttgtgaaatctatggtatctgcaggatccggtgaggtagatagtttttcattgggcctactatgcattagtataatgattgaggaggtaatgcggtccagatggtccagaaaaatgttaatgacagggacgttggcggtattctttctcctaataatgggccaattgacttggaatgatctaattagattatgtattatggtcggagcaaatgcgagtgatcgaatgggcatgggtacaacctatttggccctcatggccacattcaagatgcggcctatgttcgcggtaggtttactcttcagaagattaacaagtcgtgaagtcttattactgacaataggactaagtttagtagcctcagtcgagctccctaactccctggaagaattgggtgatggcctagctatgggtataatgatccttaaactcttgactgactttcaaagccaccaactatgggcaacattgttaagcctaacgttcattaagacgacattttctctgcattacgcgtggaaaactatggcaatggtattatcaatagtatctctgttcccactctgtctcagtacgacatcccagaaaaccacatggttaccggtcctacttggttctttaggttgtaagcccctgacaatgtttttgattgccgaaaataaaatttgggggcgcaaatcgtggccattaaatgaaggtataatggccgtaggaatcgtttcaattctccttagttccctccttaaaaatgatgtcccgttagccggccccttaatagctggaggaatgttgattgcctgttatgttatttctggttcttcggcggacctcagcttggagaaagcagcagaagtatcttgggaagaagaagcagaacattccggtgccagtcacaatattttggttgaagtccaggatgatggcactatgaaaattaaggacgaagaacgagatgacaccttaactattttactgaaggccaccctgttagcagtttcaggagtgtatccactatccattccagcgacattatttgtctggtatttctggcaaaagaagaagcaacgttcaggtgtcttatgggacactccgagtccacccgaagtagagcgtgctgtgttagacgacggtatatacagaattatgcaaagaggtctgttgggcagatcgcaagttggggtaggggtctttcaagaaaacgtatttcatacaatgtggcatgtaacacgaggagctgtgttaatgtatcaaggtaaacgactagaaccctcttgggcatctgtcaagaaagacctaatatcgtatggaggcggatggagattacaaggatcatggaacacgggagaagaagtccaagtaatagcggtcgagccagggaaaaatcccaaaaacgttcagactgcccccggtacttttaaaacctcagaaggagaagttggtgcaatcgctcttgacttcaaacctgggacaagcggatctccgatagtaaacagagaaggtaaaatagtgggactctatggtaacggggttgtgacgacctcaggcacatatgtaagcgcgatcgcgcaggcgaaagcatctcaagaaggaccgttgcctgaaatagaagatgaagtattccgtaagagaaacttaacaatcatggacttacatcctggtagtggaaaaactaggagatacttacccgctatagttagggaagcaatcaaacgtaaacttcgtacattaatactcgcaccaactcgagtagtagcttctgaaatggcagaagcattaaaagggatgccgataagatatcagaccacagctgtcaagtcagaacacactggtaaggagatagtcgacctaatgtgtcacgcaacatttacgatgcgattactttccccagtgcgagttccaaattataacatgatcataatggatgaggctcactttacggacccaagcagtattgcggcaagaggatatattagtaccagggtaggcatgggtgaagcagccgctatattcatgacggcaacgcccccgggttcggtagaagcatttccccaatcaaacgcagtcatccaagatgaagaaagggatatccccgaacgctcttggaatagcggatatgagtggataacagattttccaggtaaaactgtttggttcgtaccttcaataaaatcgggaaacgatattgctaattgtttacgcaaaaacggtaagcgtgtaattcaactgagcagaaagacatttgacaccgaataccagaaaaccaaaaacaatgattgggactatgtcgtaacaacagatatatcagaaatgggagcaaatttcagagcagatagagtaatagatccccgccgttgtttaaaacccgtaatcttgaaagacggccctgagagagtaattctcgcaggaccaatgccggtaacggttgccagtgctgcacagcggagaggaagaatcggtcggaatcacaataaagaaggggaccaatatatatatatggggcaacccctgaataatgatgaagaccatgcacattggacagaggctaaaatgttactcgacaatattaatacaccagagggcataatccccgctctctttgagccagagagggaaaaatctgcggccatagatggagaatatagactacgtggggaggcgagaaaaacttttgttgaacttatgagacgtggggatttgccagtgtggttgtcgtacaaagtagcatccgaagggtttcaatactctgatcgcagatggtgctttgacggagagagaaataatcaggttctagaggagaacatggatgtggaaatttggacaaaagagggggaaagaaagaaactcagaccgcgttggttagacgcacgtacatatagcgaccccttggctctgcgagaatttaaagaatttgcagctggacggaggagtgtcagtggtgatctaatattagagatagggaaactaccacaacatttgacgcaaagggctcaaaacgctttagataatttagttatgcttcacaattcagaacaaggaggacgtgcgtacagacatgccatggaagaactccccgatactatagaaacacttatgctactagcattaatagccgttcttacaggcggagtgactttattctttttaagtggccgagggcttggtaaaacttcaataggtcttctctgcgtaatggcgtcatcagtacttctatggatggcatcagtggaacctcactggattgcggctagcattatactagagttctttcttatggtgttactcataccagaaccggacagacaacgaacaccacaagataatcaattagcgtacgttgtcatcggcttattgtttatgatcctaacagtcgcagccaatgaaatgggtctactagagacgacgaagaaagacctaggcataggtcatgtagcagttgaaaatcaccaccatgcagcaatgttagacgtggacttacatccagcaagcgcgtggacactatatgccgtcgcaactaccattattactccaatgatgagacacacgattgaaaacactacagcaaacattagcttaactgcaatagcaaatcaagcagcaatcctaatgggactcgataaaggatggccaatatcaaagatggatataggcgtaccattactagccctagggtgctattctcaagtaaatcccttaacattaaccgcagcagtattaatgctggtcgcgcattacgctataattgggccgggcctacaagcaaaagctacaagagaagcccaaaaacgaaccgcagcaggaataatgaaaaaccccacagtagatggaatagtagcgatagatctcgatcccgtagtgtacgacgcgaaatttgagaagcaattaggtcaaattatgctactaatactctgcacttcacaaatactcctaatgcgaacaacatgggctctgtgcgaatctataacccttgcaactggccctcttactacgttatgggagggctctccaggcaagttttggaacacaacaattgcagtatcaatggctaatatatttcgtggaagctatttagcgggcgcagggttagcattttcgcttatgaagtcgttagggggaggacgtagaggcacaggtgctcaaggggagacgttgggagaaaaatggaaacggcaacttaatcaactatctaaaagtgaatttaacacgtataaacgctcaggaataatggaagtggaccgctccgaggcaaaggaaggtttgaaaagaggagagacaacgaaacatgccgtatctcgaggaacagcaaaactacgctggttcgtagaaagaaacctagtaaaaccagaaggaaaggtcatagacctaggatgtggacgagggggatggagttactattgcgcgggactaaagaaagtaactgaagttaagggctacacaaagggcgggccgggtcatgaggaaccaataccaatggctacgtatgggtggaatttagtgaaactctatagcggaaaagacgtatttttcattccaccggagaaatgcgacacgctattatgtgatataggagaaagttcgcccaacccgacaatagaagaaggacgaactctacgtgttttaaaaatggtagaaccttggttacgaggtaatcaattctgtataaaaattctaaatccatatatgccctcagtggtagaaacacttgaacaaatgcaaaggaaacacggcggaatgctagtaagaaatccactaagcaggaacagtactcacgaaatgtattgggtatcatgtggaacaggtaatatcgtatcagcagtcaacatgacatcccgaatgctattaaatagatttacaatggctcatagaaagccgacctatgagagagatgtggatttaggcgccggtactcgccatgtagcagtcgaacccgaagtaccgaatcttgatataattgggcaaaggatagaaaatataaaacacgagcacaagtcgacatggcactatgatgaagacaatccatataaaacctgggcataccatggaagttacgaagtgaaacctagcggatccgcatctagcatggtaaatggagtggtaaaattacttactaagccatgggatgtaattcctatggttacccaaatagcaatgacagataccacgccttttggccagcaacgtgtgtttaaagaaaaagtggatacgcgcacaccaaaggctaaacggggtacagcacaaattatggaggtgacagcaaaatggttatggggcttcttatcgcgaaataagaaaccaaggatttgcaccagggaggagttcaccagaaaagtacgttctaatgctgcaataggagccgtttttgtggatgagaatcagtggaatagcgccaaagaagcagttgaagatgaacgcttttgggatttggtacaccgggaacgcgaattgcataaacaaggaaagtgtgctacatgtgtatataacatgatgggtaaacgggaaaagaaacttggggagttcggaaaagcaaaaggatcgagagcaatatggtatatgtggttaggagcgagatttctagagttcgaagcactcggatttatgaatgaagatcattggttttcacgcgaaaacagtctgagtggagtagaaggtgagggactccacaagctgggttacatacttagagatattagtaaaatacctggaggcaacatgtatgcagatgacacagcaggatgggatacaagaatcacagaagacgacttgcaaaatgaagctaaaattacagacataatggaaccagaacacgcacttttagcaaaatcgatatttaaactcacttaccaaaacaaggttgtccgagtacaaagacccgctaaaaatggtacagtaatggacgttataagcagacgagaccaacgtggctcagggcaagtcggtacctacggacttaataccttcacaaatatggaggcacaactcatacgccaaatggaatctgaaggaattttctcaccttctgaacttgaaactcctaacttagcaggccgagtcttggactggctagagaaacacggcgtagaaagacttaaaaggatggcgatcagcggagatgactgcgtggttaaaccaatagatgaccgtttcgctacagcattaacagccttgaacgacatgggaaaagtgcgaaaagacattccgcaatgggaaccctcgaaagggtggaatgattggcagcaggttccattctgtagccaccatttccaccaacttattatgaaggacggcagagagatagtggtcccttgccgaaaccaagatgagttagtaggcagagcgagagttagtcagggagctggctggtcgcttagagaaaccgcatgcctcggaaaatcatacgcccaaatgtggcaattaatgtactttcatcgtagggatcttaggctcgcggcaaatgcgatctgctccgcagttccagtggactgggtaccaacgagtaggacaacatggagtatccacgcgcaccatcaatggatgactactgaagacatgctctcagtatggaatcgggtctggatagaagaaaacccatggatggaggataaaacacatatatccagctggggagatgtaccatacctaggcaagagagaagatcaatggtgcggtagcttgattggattgacggcacgtgcgacgtgggcaacaaacatacaagttgctatcaaccaagttcgcagattgattggaaatgagaattatttagattacatgacctcaatgaaacgatttaaaaacgagagcgacccagaaggggctctatggtag

SEQ ID NO: 21887 - RNA, 9879 nt, synthetic construct
  misc_feature 1..9879: note = derived and/or modified CDS sequence (opt6) from DENV-1__EU482791__SS-prME
  source 1..9879: mol_type = other RNA
agtgtaacgatgctgctgatgttaatgccaactgctttggcctttcacttaactaccaggggtggagaaccgcatatgatagtcactaaacaagaacgggggaaatcgcttctgttcaaaacttctgccggcgtcaacatgtgcaccttaatagcaatggacctgggagaactctgcgaagacacgatgacgtacaagtgcccgagaataactgaagctgaaccggacgatgttgattgttggtgtaatgctacggatacatgggtaacctacggcacttgcagtcaaacaggagaacacaggagagataagagaagtgttgccctggcaccgcatgttggactcgggctagaaacacgaacagagacatggatgtccagcgaaggtgcatggaagcaaatacaaagagtagaaacctgggctttgcgtcatcctggattcacagtaatagcattattcctggcacacgcaataggaactagcataacacaaaagggaataattttcatactccttatgctcgtgactccatccatggccatgaggtgtgttggaattggatcccgagattttgttgaaggacttagcggagcaacatgggttgacgtagttttagaacacgggtcgtgcgtaacaactatggcgaaggacaaaccaacccttgacatagaacttctcaaaacggaagttacaaaccctgcagtattaaggaaactttgtatagaagctaagatcagtaacacaactacagactctagatgtcccacacaaggagaagcaacactaatggaggagcaagacgctaacttcgtgtgtcgtcgaacatttgttgacagagggtggggaaatggttgtggtctttttggcaaaggtagcctaattacatgcgcaaagttcaaatgtgtgaccaaactagaaggaaaaattgtacaatatgaaaacttaaaatattccgtaatagtcaccgttcacacaggagatcaacaccaagtaggaaatgaatcaactgaacatgggacaacagctacaataactccacaagcaccaacctcagagattcagttaacagattacggtgccttaacccttgactgttccccacgaacgggcctagatttcaacgaaatggtccttcttacgatgaaagaaaaatcatggttagtacataaacagtggtttttagatttaccattgccctggacaagtggagcatctacatcacaagaaacatggaatagacaggatctattagtcacgtttaagaccgcccatgctaagaaacaggaggtagtggtattagggagccaggaaggtgctatgcatactgcattaaccggcgcaactgaaattcaaacatcaggaacaacaactatattcgccgggcacttaaagtgcaggttaaaaatggacaagttaacgctgaagggaatgagttatgtaatgtgcactggatcgtttaaattagaaaaagaagtcgcagaaacacaacatggtacagtattggtacagataaagtacgaaggcactgacgctccgtgtaaaattccgttttcaacccaagacgaaaaaggtgtcacgcaaaatggaagactaataacggctaatcctatagttacggacaaagagaaaccggtaaacatagaagctgaacctccattcggcgagtcatatatcgtgataggcgcaggggaaaaagctctaaaactgagctggttcaagaaaggctctagtataggaaaaatgttcgaagcaactgcaaggggagcgagaaggatggccatattaggcgataccgcctgggacttcgggtctatcggtggagtatttacgtctgtcggaaagttggtacatcaaatctttggaaccgcatacggtgttttgtttagcggagtctcatggacaatgaaaatcgggataggagttctcctaacatggttaggtctaaattcacgatcgacgtccttatccatgacctgcatagcggtcggattagtaaccctgtacctgggtgtaatggtacaagcagactcgggatgcgtcataaattggaaagggagagaattgaagtgtggatccggaatatttgttaccaatgaagtccatacctggaccgaacaatataagtttcaggctgactcaccaaaaaggttaagcgctgcaatagggaaggcctgggaagaaggggtatgcggtatacgaagtgctactagacttgaaaatatcatgtggaaacagatatcgaatgagctaaaccatattctactagaaaacggaatgaaatttactgttgtagttggagatgtagtaggcatattggctcaaggaaagaaaatgattagaccacagccaatggaacataaatatagctggaaatcctggggcaaggcaaaaattatcggagccgacgttcaaaacacaacattcattatagatggacctaatactccagaatgccctgatgatcaacgagcctggaatatctgggaagtggaagattatggctttgggatatttacaaccaatatatggttaaaacttcgggattcatacacgcaggtctgcgaccatcgcttaatgtctgcagctattaaagattcaaaagctgtgcacgctgatatgggatattggatagagtctgagaaaaatgaaacatggaaactagcgagagctagctttatagaagtcaaaacatgtatctggccaaagtcacatacactgtggagtaacggtgttctagaatctgaaatgataatacctaaaatatacgggggtcccatatcccagcataattataggccaggttattttacacagacagccggaccatggcatctgggcaaattagagctggatttcgacttatgtgaaggaactacagtggtagtagatgaacactgtggaaatcgcggaccgtcgcttagaactaccacggttacggggaagataattcacgaatggtgttgccggtcatgcacactaccaccccttaggtttaaaggcgaagacggatgttggtatggcatggaaataagaccagtaaaagaaaaagaagaaaacttggtaaaatctatggtaagtgccgggtcaggagaagttgactcgttttcattaggtttattatgtacaagtataatgatcgaagaagtcatgcgctcgcgatggtccagaaaaatgcttatgacaggaactttagccgtatttttactcttgattatggggcaattaacgtggaacgacctcattcgattatgcataatggttggcgctaatgcctcagatagaatgggcatggggacgacctatttggcattaatggccacatttaaaatgcggccaatgttcgcagtcggactgctattcaggagattgacctctcgtgaggttctacttctgacaataggcctttccttggtcgctagtgtagaattaccaaattcactcgaagaactgggtgacggattggctatggggatcatgatcctaaaattactgaccgattttcaaagccaccaattatgggcaaccttgttgagtctgacgtttataaagaccacactatccttacactatgcctggaaaacaatggcaatggtcctctccatcgtatctcttttcccgctatgcctaagcacaacaagccaaaagaccacttggctaccagtgctccttggaagtttaggctgtaaacctttaacaatgttcctaattgcggagaataaaatatggggtagaaagagttggccactgaacgaaggcataatggcagtcggtgtcgtaagtatcttattatcttcattgctaaagaacgacgtgcctttagccggtccgttaattgcaggaggaatgctcatagcttgttatgttatcagtggtagcagcgccgatttgagtctagagaaagcggctgaagtatcgtgggaagaagaagcggaacattctggtgcatcgcataatatactggtagaagtgcaagacgacggtacaatgaaaattaaagatgaagaaagagacgataccctcacaattctactaaaagctactctattagccgtttcaggggtttatccacttagtataccagcgaccctattcgtatggtatttttggcagaagaagaaacaaaggtctggcgtactatgggataccccgagcccacccgaggtggaaagagcagtcctcgatgatggaatatatcgaatcatgcaacgggggctacttggacggagtcaagtaggagtaggcgtgtttcaagagaatgtcttccatacgatgtggcacgttactagaggggcagtcctaatgtatcaaggtaaacgattagagccgtcatgggctagtgtcaagaaagatctaattagctatggcgggggatggcgactacaaggatcctggaatacaggtgaagaagttcaagtgatcgcagtagagccaggcaaaaatcccaaaaatgttcaaactgcacctggaacgtttaaaacacccgaaggtgaggtaggtgcaatcgcattggactttaaacccggcacgtcgggaagcccgatagtaaatcgcgaagggaaaatagtcggattatatggtaacggggtagtaaccacctcaggaacttacgtatcagcgattgctcaagctaaagcgtctcaggaggggccgctgccagagatcgaggacgaagttttccgaaaacgcaatctaactataatggacttacacccaggaagtggtaaaacgaggagatatctaccggccattgtgcgcgaagctataaagcgcaaacttcggactttaattcttgcccccacacgggtcgtggcctctgaaatggctgaagcactcaaaggcatgccgatcagatatcaaactacagcagttaaaagtgaacacaccgggaaagaaatagtcgacctcatgtgccatgcgacttttactatgagacttttatcaccagtacgagttcctaattacaatatgattataatggacgaggcacatttcactgatccgtccagtatagcagctagaggttacataagtactcgagtaggtatgggtgaagcagccgctattttcatgacggccaccccacctggatcagttgaagcatttccccaaagcaacgctgtcatacaagacgaagaaagagatatcccagagcggtcgtggaatagcggctatgaatggataacagattttccaggaaaaacagtctggtttgtaccctcgatcaaatctggtaatgacatagccaattgtcttaggaagaatggcaaacgggttattcaacttagcagaaagacttttgatacagaatatcagaaaactaaaaataatgactgggattatgttgttacgactgacatatctgaaatgggagcaaacttcagagcagaccgagtaatagatccgagaagatgcttaaaacccgttatattgaaagatggccccgagagggtgattttggccggaccaatgcctgtcactgtagccagcgcagcacaacgaagagggagaataggcaggaaccataataaagaaggagatcaatatatttacatgggccaaccattaaataacgatgaagatcacgctcattggacagaagcaaagatgctattggataatataaatacgcctgaagggataataccagccctgttcgaaccagaaagggaaaaatctgctgccattgatggggaatatagactacggggtgaagcacgtaaaacatttgtagaattgatgaggaggggcgatctacccgtttggctcagttacaaagtagctagcgagggtttccaatattcagatcgacgatggtgcttcgatggtgaaagaaacaatcaagttctggaggaaaatatggacgtagagatttggacaaaagaaggagaacgcaagaagctgagaccccgttggctcgatgcacggacgtattccgatcctttagcactacgagaatttaaagaatttgccgccggccgacggagtgtttcgggcgatctcatactggaaataggaaaactgccgcaacacttaacacaaagggcccagaatgcattggacaacttggttatgctccacaactctgaacaagggggtcgagcatataggcatgcaatggaagaattacctgacactatagaaacactaatgctcttagcgcttatagccgttttgacgggaggtgttacactatttttcttatcaggcagaggcctagggaagacaagtataggattgctgtgcgtaatggctagttcagtgttactgtggatggcgtccgttgaacctcactggatcgctgccagtatcatactcgaatttttccttatggtattattaatcccggaacctgacaggcaaagaacgccacaagacaatcaattagcatacgtagttataggtcttttgtttatgatacttactgtagccgcgaacgaaatgggcctacttgaaactactaagaaagatctgggaatcggccacgtagctgtagagaatcatcaccacgctacaatgcttgacgtcgacctacacccagcatcagcatggactctatacgcggtagctaccactattataacaccaatgatgagacatacaatagaaaatactacggcaaacataagtctaacagctattgctaatcaggcagccatactaatgggactcgataaggggtggcctataagtaagatggatatcggagtaccattacttgctcttggatgctactctcaagtaaacccattaacgttaacagcagccgtcctaatgttagtagcgcactacgccatcataggacctgggcttcaggcaaaagccaccagagaagctcagaaaaggacggcagctggaataatgaaaaaccccacagtagatggcatcgttgcaattgatctggatccggtagtatacgacgccaaattcgaaaaacagttaggccaaattatgcttttaatattatgcacctcacaaatacttctaatgcgaacgacgtgggctttatgtgaaagtattacgctagcaactggcccgttaactacattgtgggagggatccccaggaaaattttggaatacaacaattgccgtctctatggctaatatattccgcggatcatacttagcaggggcaggacttgcgttctcattgatgaagtcattaggaggcggaagaaggggtactggggcacagggagaaacgctgggagagaaatggaaacgtcaattaaaccaactaagtaaaagtgagttcaatatatataaacgatctggtatcatggaggttgatagaagtgaagcaaaggaaggtttaaaaagaggggaaacgacaagacatgcggtaagtaggggcacagcaaagttaagatggtttgtagaaagaaatctagtgaaaccagaaggaaaagtaatcgacttaggctgcggtcgagggggctggagttactattgtgcaggcctaaagaaagtaactgaggtaaaagggtatacaaagggtggtccaggccacgaagaacccattccaatggctacatatggatggaatttagttaaattgcacagtggcaaagacgttttctttacgccaccagaaaaatgcgacacacttttatgcgatattggtgagtcatctccaaatccaacaatagaggaagggcgaacgttaagagtattgaagatggtcgaaccttggctaagaggaaaccaattctgcataaaaatcctaaatccatatatgccaagtgtagtagaaactctagaacaaatgcaaagaaaacacggtggaatgctagtaagaaatccactatcaagaaattcaacccacgaaatgtattgggtaagttgcggcaccggtaacattgtatctgcggtaaatatgacctcaagaatgctccttaaccgcttcactatggcccaccgtaagccaacgtatgaacgagatgtagatcttggtgccggaacccgtcatgttgcggtagaacctgaggtagctaacctggatattataggccagaggattgaaaatataaaacatgaacataaatcaacttggcactacgatgaagataacccatacaaaacatgggcatatcatggaagttacgaagtgaaaccatcaggttcggcatcatccatggttaacggggtcgtcaaattactaactaaaccgtgggacgttataccaatggtgacacagatagctatgacagatacaaccccctttggtcaacaacgagttttcaaagagaaggtagatacacgtacaccgaaggcaaagcgaggaacagcccaaataatggaggtgacagctagatggttatggggcttcctttctcgaaacaagaaaccgcgcatatgcacgagggaagaatttacaagaaaagtgagaagcaacgcagcaatcggagcggtattcgtcgatgagaatcaatggaactccgctaaagaagccgttgaagacgaaagattttgggatctagtacagaaagaaagggaacttcacaagcaaggtaagtgcgccacctgtgtttacaacatgatgggaaaaagagagaagaaattaggagagtttggtaaagcgaaaggcagccgagccatatggtacatgtggctaggagcgaggtttttagaatttgaagcgctaggattcatgaacgaagatcattggttctcacgcgaaaattcactttcgggggtagaaggggaagggttacataaattaggatacattttacgagacatatctaagataccaggcggcaatatgtatgcagacgataccgcaggatgggacacgagaattactgaagatgatttgcaaaatgaggccaaaatcacagacataatggaaccagaacacgcactcctagcgacctctatttttaaattaacgtatcaaaataaagtagttagggtccaaagaccagctaaaaacgggactgtaatggatgttataagtcgccgtgatcagcgcggatccggtcaagtgggaacctatggactaaatacatttacaaatatggaagcacagctcatacgacaaatggaatccgaaggtatctttcttccgtcggaattagaaacaccgaatttagctgaaagagttctagactggttggaaaagtacggtgtggaacgacttaagcgtatggcgatttccggcgatgactgtgttgtgaagccaatagacgatagatttgcaactgcgctcacagccttgaatgatatgggaaaggtgcgaaaagacattcctcaatgggagccgtctaaaggatggaatgattggcagcaagtaccgttttgtagccaccattttcaccaattaataatgaaggacggacgtgaaatcgtagtcccttgcaggaatcaagacgaattagtaggaagggcacgagtatctcagggggctggttggtccttacgggagacagcttgccttggtaaaagctacgcccagatgtggcagctgatgtacttccacagaagagatttgaggctcgcagctaacgcaatatgctcagcagtccccgttgattgggtccctacaagtagaaccacatggagcattcacgcacatcaccaatggatgaccactgaggatatgctttctgtatggaaccgcgtttggattgaggaaaacccatggatggaagataaaacccacgtgagttcatggggtgacgttccttacctaggaaaaagggaggatcaatggtgcggaagcctaataggactcacagccagagcaacatgggcctcaaacattcaagtagctataaatcaggttcgaagactaataggaaatgagaattatctcgattacatgaccagtatgaaaagatttaagaacgaaggggaccctgaaggagcattatggtga

SEQ ID NO: 21888 - RNA, 9879 nt, synthetic construct
  misc_feature 1..9879: note = derived and/or modified CDS sequence (opt6) from DENV-1__EU482792__SS-prME
  source 1..9879: mol_type = other RNA
agtgtaaccatgttgttaatgttaatgccgactgcactagcctttcacctgacaacacgaggaggggaacctcacatgatagtcacaaaacaagaaagaggaaaatcactattattcaaaacatcagcaggagtcaatatgtgtacactcatagcaatggatctgggtgaattgtgtgaagatactatgacatataaatgtcctcgcattacagaaacagaaccagatgatgtcgactgctggtgcaacgcaacagatacatgggtcacatatggcacttgctcacaaaccggtgaacaccgacgagataaaagaagcgtagctcttgcaccgcacgtaggacttggccttgaaactcgtacggaaacatggatgagctctgaaggggcttggaaacaaatccaacgtgtggaaacctgggctttaagacatccgggatttacggtaattgcactatttttagcacatgcaataggcacttcaataacccaaaaaggaataatatttattttattaatgttagttactccatcaatggctatgagatgtgttggaattggatcaagggacttcgtagaagggctttccggcgcaacatgggtagatgtagtcttagaacatggttcttgcgtaaccacgatggcgaaagataaacctactttagatatagaacttcttaaaaccgaagtaactaatcctgctgtattaagaaaattatgtattgaggccaaaatcagtaacaccaccaccgattcacgatgtccaacacaaggtgaggctactttaatggaggaacaagacgcaaatttcgtatgcagacgtacatttgtagatcgaggatggggtaacggctgtggcttgtttggcaaaggatctttgatcacatgtgcaaaattcaaatgtgttacgaaactagaagggaaaatagttcaatatgaaaacttaaaatatagcgtaatcgtgaccgtgcacacaggagaccaacaccaagtagggaatgaaagtaccgaacatggtaccactgctactataactccacaagctccgacatctgaaattcagctaacagattacggcgctctaactctagattgttcacctcgaactggtctcgattttaacgaaatggtactattaacaatgaaagaaaaatcgtggttagtgcataagcaatggttcctggacttaccccttccatggacctccggtgctagcacttcacaagagacatggaacaggcaagacctattagtgacattcaagactgcgcatgctaaaaagcaggaagtagtggtcctaggcagccaagagggtgccatgcacactgccttaacaggtgcgactgaaatacagacaagcggaacaactacaatatttgctggccatttgaagtgcaggctaaaaatggacaaattaacgctcaaaggaatgtcttatgtaatgtgtacgggtagttttaaacttgaaaaagaagtcgcagaaacccaacacggaacagttttagttcaaataaaatatgaaggtacagacgccccatgcaaaataccattcagtacacaggatgaaaaaggagtaacccaaaacggccggcttattactgccaacccaatcgtaactgacaaagaaaaaccggtaaacattgaggcagaaccgccgtttggtgaatcgtacattgtgatcggcgctggtgaaaaagcgctcaagttatcatggtttaagaaaggaagttctatcggaaaaatgttcgaagcgacagcacggggtgctagacgcatggccattctgggggataccgcatgggattttggtagcatcggaggagttttcacatccgtaggaaaattagttcaccaaatatttggtacagcatatggagtgttattctcaggtgtatcatggaccatgaaaattggaataggtgtgcttctaacttggctaggtcttaattcgcgatcaacaagcctatcaatgacatgtattgccgtcgggcttgttacattatatctaggcgttatggtccaggcggattcagggtgcgtaatcaactggaaaggaagggaactaaaatgcggcagtggaattttcgtcacgaacgaagttcatacatggaccgaacaatataaatttcaggcagacagcccaaagcgtttatcagcagcaatcggcaaagcctgggaagaaggagtgtgtgggataaggtccgccacacgtttagaaaacatcatgtggaaacaaatcagcaacgaactcaaccacattctactggaaaatgacatgaagtttactgttgtggtaggtgatgtagttggtattctcgcgcaaggaaagaaaatgatcagacctcaacccatggaacacaagtacagttggaaaagctgggggaaagctaaaataattggcgctgacgtacaaaatactacatttataattgatggtcctaatacaccagaatgtccggacgatcaaagagcatggaacatatgggaggtagaagattacggttttggtatcttcactacaaacatttggctaaagttaagggatagttacacacaggtctgtgatcataggctcatgagtgctgctataaaggacagtaaagcagtgcatgcagacatgggatattggattgaaagcgagaaaaatgaaacttggaagctggctagagcatcatttattgaagttaaaacatgtatctggccgaaatcacatacactatggtccaatggtgtactcgaaagcgaaatgatcattccaaaaatatatggtggtcccatatctcagcacaattaccgacccggatatttcacccaaacggcaggtccatggcaccttggtaaactagaattagatttcgacctatgtgaaggtacgacagtggtggtagacgaacattgtggaaatagaggaccatctctgagaacgaccacggtaacaggaaagatcattcatgaatggtgttgtaggtcatgtacactccctccattacgattcaaaggagaagatggttgttggtatggaatggaaatacgacctgttaaagagaaagaagaaaatttagttaaatcaatggtatcagcaggctcgggggaggtcgactcattttccctagggttactatgcatctctattatgatagaagaagtaatgagatcacgctggagtcgcaaaatgcttatgaccggcactctagcggtttttctactcttaataatgggtcaactaacttggaatgacttgatccggctttgcattatggtaggagcaaatgctagtgataggatgggaatgggtaccacctatctcgctttaatggcgacgttcaaaatgagacctatgttcgctgtggggttactctttcgaagacttactagcagagaagtcttattactaaccataggactaagtctagtagcaagtgtagaactccccaattctcttgaagaattaggagatggattggctatggggataatgatattaaaactcctaacagattttcaatcacatcagttatgggctacgctactttctttaacatttataaaaactaccctttcgttacactatgcatggaaaacgatggccatggtcctctcgatagtcagtctcttcccgttatgcctaagtacaacctcccagaagacgacatggctaccggtacttctcggtagtttaggatgcaagccactgaccatgtttctaatagctgaaaataaaatttggggaagaaagtcatggcccctaaacgaaggtataatggcagtaggggtcgtatccatcttactgtcctcactcctcaaaaatgatgtgcctttagcgggtccactcatagcgggagggatgctaattgcgtgttacgttatctctggttcttctgctgatcttagcttagaaaaagctgcagaagtcagttgggaagaagaggcagaacattctggagccagtcataacattttggttgaggttcaagacgacggcacgatgaaaattaaagacgaagaacgggatgacactttaactattctattaaaagctactttgcttgcagtgagcggtgtgtatcctcttagtattccagctaccctttttgtttggtacttctggcagaagaagaaacaaaggagtggtgtgctatgggatacaccgtctcctccggaggtagaacgtgcagttttagatgatggaatttatcgaattatgcaacgtggtctcctaggcagatcgcaggtaggcgtcggggtctttcaagaaaatgtattccacaccatgtggcacgtcacgcgaggagcagtgcttatgtatcaaggtaaaaggttagaaccctcgtgggctagtgttaagaaagacctaatttcatacgggggcggatggaggcttcagggtagttggaatacaggggaagaggtacaagttatagcggtagaaccaggaaagaaccccaaaaatgtgcaaactgcccctggaacattcaaaacaccagaaggggaggtgggtgcaatcgcgttagattttaaaccagggacttctgggagccccatagtcaatagagaaggcaagattgtaggactgtatggaaatggagtagtaaccacctcaggaacatatgtatctgccatagcacaagcgaaagcatcgcaagaagggccattacccgaaatcgaagacgaagtctttagaaaaagaaacttaacaattatggatctacatccaggatctgggaaaacgagacgttatttaccagcaatcgttagagaagcgataaagaggaaactccgcacactaatactcgcaccaactagagttgtcgcttctgaaatggcggaggctttaaagggaatgcccattcgatatcaaactacggctgtgaagtccgaacatactggtaaagaaatcgttgatctaatgtgccacgccacctttactatgaggttactaagtccagtgcgcgtcccaaattataacatgataatcatggacgaagcccatttcactgacccaagctccattgctgctcgaggatacattagtacacgggttggtatgggtgaggctgcggcaatttttatgaccgccactccacccggcagcgtcgaggccttccctcagagtaatgcggttattcaagacgaagagagagacatacctgagagaagttggaactcagggtacgaatggataactgattttcccggtaaaactgtttggttcgtaccttcaataaaaagcggcaatgatatcgccaattgtctcaggaaaaatgggaaaagggttatacagctaagccgaaagacattcgatactgagtatcagaaaactaagaacaatgattgggattatgttgtgaccacagatataagtgaaatgggagcaaatttcagagctgatagggttatagatccacgaaggtgtcttaaacctgtcatactaaaagatggaccagagagggtaatacttgctgggcctatgcctgttacagttgcaagtgctgcccaaagacgaggtaggatcggtaggaaccacaacaaagaaggagaccaatacatttacatgggacaaccacttaataatgatgaagatcatgcacactggacagaagccaagatgctattagacaatattaacacaccagaagggatcataccagctctattcgagcccgagcgcgagaaaagtgcagcaatcgatggtgaatacagactaagaggggaagcaagaaaaacatttgttgagttaatgaggagaggagatttgccagtatggctatcatacaaagttgcgagtgagggttttcaatattctgatagaagatggtgttttgacggagaaagaaacaatcaagtactggaagaaaacatggacgttgaaatttggacaaaggaaggtgagaggaagaaactaagacccagatggttggacgcaagaacctactcagatccgttagctttaagagaatttaaagagtttgccgcgggacgccgtagcgtctctggagacctgatcttagaaatcggtaaattaccacaacacttgacacaaagggcgcaaaacgcccttgataacttagtaatgctacacaactcagagcagggcggccgagcttacagacacgctatggaggaactacccgataccatagaaaccctaatgttattagcactgattgcggttttgactggaggagtcacgctatttttcctcagcggtcgtggtctaggtaaaacatccataggtttgctatgtgtaatggcttcctctgtgctactatggatggcttcagtcgaaccgcattggatagccgcgtcaattatattggagttctttttaatggtgctacttatacctgaaccagatagacaaagaacaccacaggacaatcagttagcatacgtagtcataggattgttatttatgattttaacagtggcggcgaacgaaatgggactgttagaaacaacaaagaaggatctaggcataggtcatgttgcagtcgaaaaccaccatcacgctactatgctagacgtagatctgcatcctgcgtcggcatggactctatacgccgttgcgaccacaatcataaccccaatgatgcgacatacgattgagaatacaacagcgaatatctcattaactgccatagccaatcaagcagctatactgatgggtttggataaaggttggccaatctcaaagatggacattggcgtaccattactagccctcggatgctactcccaagtaaacccgctgacactaacggcagctgttttaatgttggtcgctcattatgcaataattggcccgggattgcaagcgaaagcaacaagggaagcacagaaaagaacagcagcgggaataatgaaaaatccaaccgtcgatggaattgtagctatagatttagacccagtagtatacgatgcaaaatttgagaagcaattgggccaaataatgctgttaatactttgtacttcgcagattctcttaatgagaacaacatgggcattatgtgagtcaatcactctggcaacaggaccgcttactacgttatgggaaggttcaccaggtaagttttggaacactacaatcgcggtctcgatggcgaacatatttagaggtagctatctagcgggcgctggtcttgcatttagcctaatgaagtctttaggagggggaaggagaggaaccggtgcccaaggagaaaccttaggagagaagtggaaaagacagctcaatcaactaagcaaaagcgaatttaatatctacaaacgaagtggaatcatggaggtcgacagatcagaagcaaaggagggactcaaacggggagaaacaactcggcacgccgtgtcacggggaacggcaaagctcagatggttcgtcgaaagaaacctcgtcaagccagaaggtaaagttatcgatttaggatgcggaaggggcggctggtcctactactgtgcagggctaaagaaagtaactgaagtcaaagggtacacgaaaggaggacccggacacgaagaaccgataccgatggccacgtacggttggaatcttgtcaaattacattccggtaaagacgtattcttcaccccacctgaaaaatgcgacactttactttgcgacatcggcgaatcctcacctaatcccacaattgaggaagggcgtactcttcgagtattaaaaatggtagagccatggttacgaggcaaccaattctgtatcaagatattaaatccatacatgcctagtgttgtagagactttagaacaaatgcagaggaaatatgggggaatgctagtaagaaatcccttatctagaaacagtacacatgaaatgtactgggtatcctgtggtactggaaatatcgtttccgcagtcaatatgacaagtcgaatgcttttaaacagatttacaatggcccatcgaaaaccgacctacgaaagggacgtagatttaggcgctggtactcgacatgtagctgtagaaccagaagttgctaatttagacataataggtcaaagaatagaaaatataaaacacgaacataaatcgacatggcattatgacgaagataacccatacaaaacatgggcttaccacggaagttatgaagtaaaaccgagtggctcggcatcgtctatggtaaacggagtagtaaaattgctcacaaagccatgggatgtaatacccatggtaacgcaaattgcaatgacagacacaacaccattcggacagcagagagtctttaaagaaaaagttgacacaagaacacccaaggcaaagcgcggcactgctcagataatggaagtcacggcaagatggctatggggctttctaagccgcaataaaaagccgcgaatttgtacacgagaggagttcactagaaaagttcgaagtaacgctgcaataggcgctgtttttgtagatgaaaaccaatggaactcagcaaaagaagccgtggaggatgaaagattttgggatttggtacaaaaagagcgtgagttgcataaacagggaaagtgtgcaacctgtgtatataatatgatggggaaaagggagaagaaacttggtgaatttgggaaagcgaaagggagccgggcgatctggtacatgtggttgggagcgcgattcctagagttcgaagcactaggatttatgaatgaagatcattggttttctagagaaaattcactgagtggcgtagaaggcgagggactgcacaaattagggtacatccttcgagatatatctaaaatcccagggggaaatatgtatgcagatgatactgcgggatgggatacaagaattacagaagacgatttgcaaaatgaagcaaaaatcactgatataatggaaccagaacacgcactcttagccacaagtatttttaaactaacctatcaaaataaagttgttagagttcaacgaccagccaaaaatggtacggttatggatgtcatcagtcgtagggatcaacggggcagtgggcaggtaggaacctacggccttaatacatttacaaatatggaagcccaacttatcaggcaaatggaatcggaaggtatatttttacctagtgaactcgaaacacccaacctagcagaaagggtcctggactggttagagaaatatggcgtcgaaaggctcaaacgtatggcgatttcaggagacgactgtgtagtaaagcctatagacgatagattcgccacagcactgacagccttaaatgatatgggcaaagtacgaaaggatataccgcaatgggaaccttcaaaaggctggaatgactggcaacaagtaccattttgttcgcatcattttcatcaactaattatgaaagacgggcgagaaatagttgtcccctgtagaaaccaagatgagttagtgggcagagcccgtgtatcacaaggtgctggatggtctttaagggaaacggcatgtctaggcaaatcatacgcacaaatgtggcaacttatgtatttccatagacgtgatttaagattagccgctaatgcgatatgtagcgccgtacccgtggactgggtgccaaccagccgcactacatggtcaatacacgcccaccatcaatggatgacgactgaggacatgctaagtgtttggaatagggtatggatagaagaaaacccatggatggaagacaaaacacatgttagttcatggggagatgtgccgtatcttggaaaacgcgaagaccaatggtgtggctctctaatcggactgactgcgagagccacttgggcctcaaatatacaagtcgcgataaatcaagttcgaagattaataggcaatgagaattaccttgactatatgacatctatgaaaagatttaaaaacgagggcgatccagaaggggcactatggtaa

SEQ ID NO: 21889 - RNA, 9879 nt, synthetic construct
  misc_feature 1..9879: note = derived and/or modified CDS sequence (opt6) from DENV-1__EU482707__SS-prME
  source 1..9879: mol_type = other RNA
agcgtaacaatgttattaatgctgatgcctactgcgctggcctttcatctgacgacccgagggggagaaccacacatgatagtatcaaaacaagaaagaggcaaatctctattatttaaaactagcgccggcgtgaacatgtgcaccttgatcgcaatggatcttggcgaactgtgcgaagatacaatgacgtacaaatgcccgcgaataacggaagcagaacccgatgatgtagattgctggtgtaatgccacagacacgtgggtcacgtatgggacatgctcccaaacaggagaacatcggagagacaagagatcagttgcattagcgccacatgtaggtctgggtctagaaacaaggacagaaacctggatgtcatcagaaggggcatggaaacaaattcagagagtggaaacctgggctctaagacatcccggttttactgtcatagcgttattcctagctcatgcaattggtacatctataacacaaaaaggtatcatttttatactactgatgttagtaacaccgtcaatggccatgcgttgtgtcggcattgggtcaagagatttcgtagagggtttgtcgggagccacttgggtagacgtggtattagaacacggaagttgtgtaacaactatggcaaaagacaaaccaacgctggacatagaattgctaaaaacagaggttactaatccggcggttttaagaaagctgtgcattgaagcaaaaataagtaataccacaacagacagccggtgtccgacccaaggtgaagcgacgctagtagaagaacaagacgccaattttgtttgtaggaggacattcgttgatagagggtggggcaacggatgcggattgtttggaaaaggctcattgataacctgtgcaaaatttaaatgtgtcacaaaactagaaggaaaaatagttcagtatgaaaatttaaaatactctgtaattgtgacagtacacaccggcgatcaacatcaggttggaaatgagagcactgaacatgggacaaccgcgactataactcctcaagcacctacgacagagatccaactaacggattacggcgcacttacattggactgtagcccacgaactggactggacttcaatgaaatggtcttgcttacaatgaaagaaaaatcttggttggtacacaagcaatggttcttagacttaccactaccatggacatcaggggcaagtacatcccaagaaacctggaacaggcaagatttattagtaacatttaaaacagcccacgcaaaaaaacaagaagttgttgtacttgggagccaagaaggtgcaatgcatacggcattgacaggagcaactgagatacaaacaagcggcacaacaaccatatttgccgggcaccttaaatgtcgtttgaaaatggacaagctaacgttaaaaggaatgagttatgttatgtgcacggggtcattcaagttagaaaaagaagtagcggaaacacagcatggaacagtgcttgtacaaataaaatacgaaggaacagacgcgccatgtaaaatacctttcagtactcaggacgaaaagggcgtaacacagaatggacgcctgataacggcaaaccccatcgttaccgacaaagaaaaacctgtgaatatagaggccgaacctccattcggcgaatcatacatagtgatcggtgctggggaaaaggcactcaaattatcatggttcaaaaaggggagcagtatcgggaagatgttcgaagcaacagcccgcggcgcgaggcgaatggcaatactaggcgatactgcgtgggattttggaagtataggaggggtattcacctcagttgggaaacttgtacaccaaatatttggaacggcttacggggtattgttttcaggagtaagctggacgatgaagataggaattggcgtactgttaacatggcttggactcaatagtagatctacatcgctaagcatgacatgtatagctgttggattagtcactctgtaccttggcgtaatggtacaggcagactccggatgtgttattaattggaaaggcagagaattgaaatgcgggtcaggaatatttgtcacaaatgaggtacacacttggacggaacaatataagttccaagcggatagtccaaaacgactgtccgcggccataggaaaagcctgggaggaaggagtttgcgggatcagaagcgccacacggttagaaaatatcatgtggaaacaaatatcaaatgagctgaaccacatattactggaaaacgatatgaaactcaccgtagtcgttggagatgtggctggaattctcggccaaggaaaaaagatgataagacctcaacccatggagtacaagtacagttggaagtcgtggggaaaagctaagatcattggagctgatgcacaaaacacaacttttatcattgatggaccaaataccccagaatgtccggatgatcaacgtgcatggaacatatgggaagtcgaggattacgggtttggtatattcacaaccaatatctggcttaaattacgggattcatatactcaagtttgtgatcatagactaatgtctgcggcgatcaaagacagtaaggctgtccatgcagatatgggatattggattgaaagcgaaaaaaacgagacctggaaactcgcacgagcttcatttattgaggtaaaaacttgtatatggccgaaaagtcacactttatggtcgaatggcgtcttggaatcggagatgattatacctaaaatttatggtggccccatttctcaacacaactacagaccaggatatttcacgcaaactgcaggtccctggcatttaggtaagttggagctagacttcgacttatgcgaagggacaacggttgttgtggacgaacattgtggaaaccggggtccatctctcaggacgacaacagtcacaggaaaaattatacacgagtggtgctgcagaagttgtaccttgccaccactccgttttcgaggtgaagacggatgctggtatggaatggaaatacgacctgtaaaggaaaaggaagaaaatctggtaaaaagtatggttagcgctggatcaggagaggtagattcattttcactaggcctcctatgcatcagcatcatgattgaagaagtgatgaggtctagatggagtagaaaaatgttgatgacaggtactttggctgtgtttttccttttaataatgggtcaacttacttggaatgacttaattaggctctgtataatggtcggcgctaatgccagtgatagaatgggaatggggactacatacctcgcactaatggcaactttcaaaatgcgaccgatgtttgctgtcggattgttgtttcggagattgacaagtcgggaagtgttattattaactattggactctcgctagttgcaagcgtagaattgccaaacagccttgaagaactaggagatgggctagcaatgggaattatgatacttaagctcctaacagatttccaatctcatcaactctgggccacactgctatctttgacatttataaagacaacctttagtctccattatgcatggaagactatggcaatggttctgtctattgtgtcgctatttcccctatgcttaagtaccacatctcaaaaaacaacttggttacctgtactcctagggtcgttaggatgtaagcccttaacaatgttcttgatagcagagaataaaatctggggtaggaaaagctggcctttaaacgaaggaataatggcggtgggaatagtgagtatcttactaagcagtcttttaaaaaatgatgtaccgctcgcaggtccattgattgcgggaggtatgttaatagcctgctatgtaatctctggaagctccgcagacctgagtttggaaaaggctgcagaagtatcatgggaggaggaagctgagcattcaggagcaagtcataatatattagtggaagtacaagatgatggtactatgaaaataaaagatgaggaacgcgatgacacactaacaattttattaaaagcaacgcttcttgccgtctcaggtgtttacccattatctatacctgccactctctttgtctggtatttctggcaaaaaaaaaagcaaaggtcaggtgtgctctgggacacccctagcccgccggaagttgagagagccgtattagatgacggaatttacagaataatgcaacgaggacttttaggtcgatctcaagtaggtgtgggagtatttcaagaaaacgtctttcatacaatgtggcatgttacacgaggtgcagtgctaatgtaccaaggcaaaagattagagcccagttgggccagtgttaaaaaggaccttataagctatggcgggggatggcgattacgtggatcatggaataccggcgaagaagtgcaagtaatcgcagtggagcctggaaagaacccaaagaatgttcaaactgccccaggaacttttaaaacaccagaaggggaagttggagcgatagctttagactttaaaccaggtacgtcgggatcaccaatagtaaatagagaaggaaaaatagttggtttatatggaaatggagtagtgacaacatccggcacctatgtatcggcaattgcccaagcaaaagctagtcaagaagggccattaccggagatcgaagacgaggtattcaggaaacgaaatctgaccattatggatcttcacccgggaagcggtaagacccggcgctacctcccggcaatcgttagagaggctataaaaagaaaactaagaacgctaattctagcgccaaccagggttgttgcaagcgaaatggcagaggctttaaaaggcatgcctatacgctatcaaactacggcagttaaaagcgaacacacagggaaagaaatagtagatttaatgtgccatgcaacctttacaatgcgacttttgtcaccagtacgcgttcctaattataacatgatcataatggatgaagcacatttcacggatccatcgtcgatagctgcccggggctatatcagtacacgagttggcatgggagaagcagccgccatcttcatgacagcaacaccacccgggtcggtcgaagccttccctcaaagtaacgctgttatacaagacgaagaaagagatatcccagagcgtagttggaattcaggctatgaatggataacagacttcccaggaaaaacggtctggttcgttccatcaataaaatcaggcaatgacatcgccaattgccttcgaaaaaatgggaaaagagtgattcaactgagcagaaaaacatttgatacggaatatcaaaaaacaaaaaataacgattgggattatgtcgttacaactgatatcagcgaaatgggagccaactttcgagcagaccgtgtaattgacccacgaagatgtctaaaacccgtaatcttaaaagacggaccagaaagggttattctcgcaggccctatgccagtaaccgtggcttccgcggcacagcgacgcggccgtataggtagaaaccataataaagaaggagaccaatatatatatatgggacaaccattaaacaatgatgaagatcacgcccattggactgaagcaaaaatgctactggacaatataaatacaccagaaggaataattccggcgctttttgagcctgagagagagaaaagcgcagcggttgatggtgagtataggttgaggggtgaagctagaaaaacttttgtagagcttatgagacggggggatctacctgtttggctgtcttataaagtagcatccgagggatttcaatacagtgataggcggtggtgctttgatggggagaggaataaccaagttctagaggaaaatatggatgtagaaatatggacaaaagaaggggaaagaaaaaaattgcgtccccgttggttggacgcaaggacttatagtgacccgcttgcacttagagaatttaaagaatttgccgcgggtaggaggtcagtaagtggagatctaatcctagaaatcggaaaacttccgcaacatctaacacaaagggcacagaatgcattagataaccttgtgatgcttcataattcggaacaggggggaagagcatatcgccatgcaatggaagaactacctgatacaatagaaacacttatgttacttgccttgatagctgtattgacggggggagttacattatttttcttaagcggaaggggactaggcaaaacttctataggtctactttgcgtcatggcctcgtccgtcctattatggatggcctccgtagagccccactggatagctgcctcaataatattggaatttttcctaatggtactactaattcctgaaccagatcggcaaagaacaccacaagacaaccaacttgcctatgtagtaatcggactcctcttcatgatcctcacagttgcagcgaacgaaatgggactacttgaaacgaccaaaaaggatctaggtataggacacgtcgcagtggaaaatcaccaccacgcagcaatgttagacgtagaccttcatccagcatcagcatggactctctatgctgtagctaccacaatcataacgccaatgatgcggcacactatcgaaaacacaacagctaatatttccttaactgcaattgcaaaccaagcggccatactaatgggccttgataagggatggcccataagtaaaatggacattggtgtgcccctcttggcgcttggttgttatagtcaggtaaaccctttaacgctaactgccgctgttttaatgttagtggcgcattacgcgataattggaccaggattgcaggcaaaggctaccagggaagcacagaagcgtacggctgccggaattatgaagaatccaacggtagatggaattgtagcaattgacttggaccctgtagtttatgatgcaaaattcgaaaaacaactaggtcaaattatgctattaattctatgcacatcacaaatattactcatgagaacgacatgggccttatgtgaatcaatcacattagctacaggacctttgacaacattatgggaaggatcgccaggcaaattttggaatacaacaatagctgtatcaatggcgaacatatttcgtggatcatatttggctggggcaggtctagcctttagcctcatgaaaagcttaggaggaggaaggagaggaaccggagctcaaggagaaacattgggcgaaaaatggaaaagacagctaaatcagctatcaaaatcagaatttaacacttataaaaggtcgggaataatggaagttgacagatcagaagctaaggagggactaaaacgtggcgaaacgacaaaacatgccgttagtagggggaccgcaaaattacgatggtttgtggagagaaatttagtgaagcctgaaggaaaagtaatagatttaggatgcggtcgagggggatggtcatattattgtgcaggtctgaaaaaagtgacagaagtgaaaggatatactaagggaggccccggccatgaagagccgattccaatggcaacatacggatggaacctggtgaagctacactcagggaaggacgtcttttttattcctcccgaaaaatgtgacactctattatgcgatataggtgaaagtagccccaacccgacgattgaggaagggcgaacattaagggttctcaaaatggttgaaccttggttacgaggaaaccaattctgcatcaaaattcttaatccatacatgcccagtgtcgtagaagccttagagcagatgcaaagaaaacatggcgggatgcttgttagaaaccctctatcgcgtaatagtactcatgaaatgtattgggtttcttgcggaacaggtaacatcgtaagcgcggtaaacatgacatctagaatgctactaaaccgatttacgatggcacatcgaaagccaacgtacgaacgagatgtcgatctaggaactggaactcgacatgtggctgtagagcccgaagtggctaatttagacataatcggacagcggatagagaatattaaacacgaacataagtcgacatggcactacgacgaagataacccatacaaaacatgggcttaccatggctcttacgaagttaagccatcaggttcagcatctagtatggtaaatggagtcgtaaaactgctaacaaaaccatgggacgtgataccaatggtaacacaaatagcaatgactgatacaacccccttcgggcaacagagagtgttcaaagagaaggtcgacacgagaacaccgaaagcgaaaagaggaacggcacaaataatggaagtcacagcacgatggttgtggggattcttatctcgaaacaaaaaacctcgaatatgcacaagggaggaatttactaggaaagttcgtagtaacgctgcaataggtgcggtattcgtcgatgaaaaccagtggaattctgcaaaggaagccgtagaagacgaaagattttgggatttagtgcaccgcgagagggagcttcacaaacaagggaaatgcgcaacttgtgtctacaatatgatgggaaaacgtgagaagaaactgggagaatttggcaaagcaaagggctcaagggcaatatggtatatgtggctaggcgcacgcttcctcgaatttgaagccctagggtttatgaatgaagaccactggtttagtagggagaatagtttaagtggtgtagaaggagaaggactacacaagttaggatatatacttagggacataagcaaaataccaggtgggaacatgtacgcggacgacactgcaggatgggatacaagaataaccgaagacgacctccagaacgaggcaaaaataaccgacataatggaaccggaacacgcattactagctaaggcaatttttaaactcacataccaaaataaagttgttagggttcaacgaccagctaaaaatggcacagtaatggacgttatatctcgtcgcgatcaaagagggagtggacaagtaggaacatatggactcaacaccttcacgaacatggaagcgcaactaattcgtcaaatggaaagtgaggggatcttttcacctagtgaactcgaaactcctaatcttgcggagagggctttggactggcttgaaaaatatggtgttgaacgtcttaaaagaatggcaataagtggagatgactgtgttgtaaaaccaatcgacgatcgctttgcaacagccttaacggcactcaatgatatggggaaagtccgaaaagacatcccgcaatgggaaccaagcaagggttggaatgattggcaacaagtacctttttgttcgcaccattttcatcaactcataatgaaggatgggcgagagatcgttgttccttgcagaaatcaagatgagcttgtaggaagagcccgggtgtcccaaggagcagggtggtcactgcgagaaactgcatgcctaggcaaatcatatgcccagatgtggcaattaatgtacttccaccgtcgggatctaagattagcggcaaacgcaatatgctctgcagttcctgtagactgggttccaacatcacgaactacatggagtatacatgcacaccaccaatggatgaccacagaagatatgctatctgtatggaacagagtttggattgaagagaatccttggatggaagataaaacacacattagcagctgggaagatgttccatatttgggaaagagagaggaccaatggtgcggatcactcattggactgacggcaagggcaacgtgggcaaccaacatacaagttgccataaatcaggttagacgtcttattggaaacgaaaactatttagactacatgacgagtatgaagagattcaagaacgagagtgacccagaaggtgcattgtggtag

SEQ ID NO: 21890 - RNA, 9879 nt, synthetic construct
  misc_feature 1..9879: note = derived and/or modified CDS sequence (opt6) from DENV-1__EU482708__SS-prME
  source 1..9879: mol_type = other RNA
tctgtgactatgttacttatgctaatgcccactgcactcgcatttcacttaactactagaggaggggaacctcatatgatagttagcaaacaagaacgtggtaaatccttattattcaaaacatcagctggggtaaatatgtgtacactaattgctatggaccttggagaactgtgcgaagatacaatgacatataaatgtccacgaataacagaaacagaaccagacgatgtagattgctggtgtaacgctactgacacatgggttacatacgggacttgttcacaaactggcgaacacaggagagacaaaagaagtgtagcactagctccccatgtagggttgggtctggagacaagaaccgaaacatggatgtcttctgaaggggcatggaaacaaattcaacgtgtggaaacttgggcacttcgtcatccagggtttacagtaatagcactcttcctcgcacatgctattggaacaagcatcacgcaaaagggcatcatatttatactacttatgctagttactccatcaatggctatgcgatgtgtcggcataggatccagagattttgtagaaggattgagcggagcaacgtgggtcgatgtagtactagaacatggatcttgcgtaacaacaatggctaaagacaagccgaccttagacattgaactattaaagactgaagtaacaaaccctgcggtattaagaaagctgtgtatcgaagcaaaaatcagtaatacaacaacagactcgcgttgccccactcaaggagaggcaacccttgtcgaggaacaagacgctaatttcgtgtgcagacggacatttgttgacagagggtggggtaacggatgtggacttttcggcaaaggttccttaattacatgcgcaaaattcaaatgcgtaacaaagctagaaggaaaaattgttcaatatgaaaacttgaaatattcggttatagtaacagtgcacacgggtgatcagcatcaagtaggaaacgagagtacggagcatgggactaccgccaccatcactccacaagcacccacgacagaaatacaattgactgactacggcgcgctgactttggactgtagccctcgtactggtttagattttaatgaaatggtcctcctcaccatgaaggaaaaatcctggttagtacacaaacaatggttcttggatctacctctaccatggacttcaggtgcatcgacatcacaggagacgtggaatagacaagacttattggtaacttttaaaacggcgcacgctaaaaagcaggaagtcgtagtactaggatcacaggagggggcaatgcataccgcattgacgggagcaactgaaatacaaacttcaggaactacaacaatatttgctggtcacctaaaatgtagattaaaaatggataagttaacattaaaaggtatgagttatgttatgtgtactggctcatttaaattggagaaagaggtcgccgaaacacaacacggaactgttcttgtacaaataaaatacgaaggtacagacgcaccatgtaagatacctttttcaacccaggatgaaaaaggagttactcaaaacggccgactcataactgccaacccaatagtgactgacaaagagaaaccagtcaatatcgaagctgaaccacctttcggtgaaagttatatagtaataggcgctggagaaaaggctttaaaattatcttggttcaagaagggaagttccattggtaagatgtttgaagcaactgcacgaggtgcgagaagaatggcaatccttggagatactgcatgggatttcggatcaatcggtggagtatttacaagcgtaggaaaattagtccatcaaatattcggaaccgcgtatggagtgcttttctccggagtcagctggacaatgaagattggaatcggtgtattacttacatggctaggacttaactcacgatcaacatcattatcaatgacgtgcatagcagttggcttagttactttgtacttaggcgtgatggtacaagctgacagtggatgcgtgataaactggaaaggcagggaattaaaatgtggatcgggaatatttgtgacgaatgaagttcacacctggaccgaacagtataaatttcaagcagactcaccgaaacggctaagtgcagctataggaaaggcatgggaagaaggagtttgcggaatacgaagcgccacaagattggaaaacataatgtggaagcaaatcagcaatgaattaaatcacatactactcgaaaatgatatgaaatttactgtagtggttggcgacgttgcaggtattttagcacaaggaaagaaaatgatcagaccgcaacccatggaatacaaatatagctggaagagttggggtaaagcgaagataataggggctgacgtacaaaacacaacatttataatcgacggacccaatactccagaatgtccagatgatcaacgtgcttggaacatatgggaggttgaggattatggattcggaatctttacaaccaacatctggttgaaactaagagactcttacacgcaggtttgtgaccaccggttgatgtcagcagcgataaaagatagtaaggcagtgcacgccgatatgggttactggatagaatcagagaaaaacgaaacctggaaacttgcacgtgctagtttcatcgaagtcaaaacttgtatttggccgaaatcacatacattgtggtccaatggggttttggaaagtgaaatgattatcccgaaaatttacggtggccctataagccaacacaattaccgccctggatactttacacaaactgctggtccctggcatttgggaaaacttgaattagatttcgatttatgtgagggtactactgtggttgttgatgaacattgtggaaatcgaggaccttcacttagaacaactacagtaacagggaaaatcatccatgaatggtgctgcagatcttgtacattacccccgctgagattcagaggggaggacggttgttggtatgggatggagataagaccagttaaagaaaaagaagaaaatttggttaagagcatggtctcagctggttctggagaagtggatagtttctcgcttggtttattatgtattagtattatgatagaggaagtaatgcgttcccgttggtcaagaaaaatgctaatgacgggtaccctagctgtattctttctactgatcatgggacaactcacatggaatgacttaattagactatgcataatggttggcgctaacgcttccgatagaatgggcatgggtacaacctacttagcattaatggcgacgtttaaaatgcgccctatgttcgcggtaggcctcttatttcgaagactaacgtcacgagaagtcctactgcttacaataggactttctttggtcgcatcagtagaactcccaaacagtttagaagagttgggtgatgggttagcaatgggtattatgatactcaaactactgactgactttcaaagtcatcaactgtgggcaacactgcttagtctcacctttatcaagactacgttcagtcttcattacgcatggaaaactatggcaatggtactgtctatagttagcttatttcctctttgcctttccacaacaagtcagaaaactacgtggttaccggttttgctaggatcattaggttgtaagcctttaacaatgttcttgattgccgaaaacaagatatggggccgaaggagttggcctttaaatgaaggaattatggcagttggaattgtctcaattttactgtcctcgttactcaaaaatgatgtaccacttgcggggcctttaattgccgggggaatgttaatcgcatgttacgttatatcagggagtagcgcagacttaagtttagaaaaagctgctgaagtatcctgggaggaagaagcagagcactcaggagcgtcacataatatacttgtcgaagttcaagacgatggaaccatgaaaattaaggatgaagaacgagatgatactcttacaatattactcaaagctacattactcgcagtaagtggtgtttacccgctctcgattccagctactttattcgtatggtatttctggcagaaaaagaaacaaagaagtggtgtgttatgggatacaccaagtccacccgaggtcgaacgagccgttcttgacgatggaatatatagaataatgcaacgggggcttttgggccgtagccaagtcggagttggtgtctttcaagagaatgtcttccacacgatgtggcatgtaaccagaggtgctgtgcttatgtatcaaggaaaaagactagagccctcttgggctagtgtgaagaaagacttgatcagctacgggggaggctggagattacaaggctcttggaatacaggtgaagaagtgcaagtaatagctgtggagccgggcaaaaatcctaaaaatgttcagaccgcccctggtacattcaaaacacccgaaggggaggtaggcgccattgccttggacttcaaacctggaacaagtggcagcccaatagtgaacagagaagggaaaatagtcggcctatatggaaatggtgttgtaacgacatcagggacatacgtaagcgcaatcgcgcaagccaaagcgagtcaagaaggtcctctaccggaaatcgaggacgaagtcttcaggaaacggaaccttaccataatggatctgcatccaggtagtggtaaaacaagaagatacctgccagcaatagttagggaagccattaaacgcaaactgcgaacattaatcttagctcctacgcgggtggttgcgagtgaaatggcagaagctcttaagggtatgccaattcgatatcaaacgactgcagttaagtcagagcatacaggcaaagaaatagtagaccttatgtgtcacgctacatttacaatgaggcttttatcacctgtcagagtacctaattataatatgataataatggacgaagcgcatttcacagatccgagtagtatagcagcgcgcggctacattagtaccagagtagggatgggcgaagccgccgccatttttatgacagccacaccaccgggaagcgtcgaggcttttccacagtctaacgcggtaatacaagatgaggaaagggacattcccgagcgtagttggaatagcggatatgaatggataacagattttcccggcaagacagtatggtttgttccctcgataaaatccggtaacgacatagcaaattgtttaagaaagaacggaaaaagagtgattcaattgtcaagaaaaacattcgataccgaatatcagaaaacgaaaaacaatgattgggactacgtagttacgaccgatatatcagagatgggagctaactttcgagccgacagagtaatagacccacggagatgcttaaaacccgttatcctaaaggatggcccggaaagagtaatattggcagggccaatgccagtcacagtcgcatcggcggcacaaagacggggtagaataggaaggaaccacaacaaggaaggggaccaatatatatacatgggccaaccgctaaacaacgacgaagatcacgctcattggactgaagcaaaaatgctgctcgataatataaacacacccgaaggcataatacctgctttatttgaacctgagcgagaaaagagtgctgcaatagatggcgaatatagacttcggggtgaagcacgaaaaacattcgttgaactaatgcgaagaggtgacctgcccgtctggctaagttacaaagtagcaagcgaaggatttcaatactctgacaggaggtggtgtttcgatggggaaagaaataaccaggtgctagaggaaaatatggatgtcgaaatatggactaaggaaggtgaacggaagaaactacgtccaaggtggctcgacgccagaacctattccgacccattggccctaagagaatttaaagaatttgccgcaggaaggcgtagcgttagcggagatttgatatccgaaattggaaaactcccccagcatctaacgcaacgagctcaaaatgctttagataatcttgtgatgttacataactcggaacaagggggccgcgcataccgacacgctatggaagaactgccagatacaatagaaaccttaatgttattagcactaatagctgttttaaccggtggagttacgctattctttctatcaggacggggattggggaaaacatcgattggtttactatgcgtgatggcaagctcagttctcttatggatggcctcagttgaaccccattggatagccgccagtataatattggagttctttctaatggttttgttaattcctgaaccggatcgacagagaacaccgcaagataaccagctagcttacgtagttatcgggctcttatttatgatcttaactgttgcagcaaacgaaatggggctacttgagaccacgaagaaagacctaggcatagggcatgttgcggtagaaaatcatcatcatgctgcaatgctcgatgtggacttacatcccgcatccgcgtggacgttatatgctgtcgcaactacaattataactcctatgatgagacatacaatagaaaatacaactgcgaacatttctctcacagctatagctaaccaagccgcgatattaatggggctagacaaaggatggccaatatcaaaaatggatataggggtaccccttttagctttgggatgttactcacaggtaaatccattgacactcacagctgccgtactcatgctagttgcacattatgcaatcataggaccggggcttcaggcgaaagctaccagagaagcgcaaaaacgaacagccgccggcataatgaagaatccgacagttgatggtatagtggccatagaccttgaccccgtagtatacgatgccaaatttgaaaaacagttaggccaaatcatgcttctcattttatgcacgagccaaatcctattgatgagaactacatgggctctatgtgaatctatcactctagccacagggccactgaccacactatgggagggaagtccaggaaagttttggaacacgaccatagcggtgtcgatggcgaacatattcagaggcagctatttagccggtgcaggcctagccttcagtttaatgaaaagcctaggtggaggtcgacgtgggaccggagcacagggcgaaacattaggcgaaaaatggaaaagacaactaaaccaattatcaaagtccgaatttaacacttacaagagatctggtataatggaagtagatcgttcagaagctaaggaaggcctgaaacgtggagaaactacaaaacatgctgtatctagagggacggctaaactcaggtggttcgtagaacgcaacctggtaaaaccggaaggcaaggttattgacttgggatgcggaagaggagggtggtcttactactgcgcaggactgaagaaagttacagaagttaaaggctacacaaaaggaggtcctggtcacgaggagcctattcccatggcaacctatggttggaacctagtaaaactacactctggtaaagatgttttctttatacctccagaaaaatgtgacacccttctatgcgacattggagaaagttcaccaaacccaactatagaagaaggccgaacattaagagtcttaaaaatggttgagccatggctaagggggaatcaattttgcattaaaatattgaatccctatatgccctctgttgttgagacattagaacaaatgcaaaggaaacatggaggaatgctcgtaaggaaccctctaagtagaaattctacacacgaaatgtattgggttagttgtggaacaggaaatatagtctcagccgtgaacatgacaagtaggatgcttctcaatagattcacaatggcgcataggaagccaacttatgaacgtgacgtggatttgggtgcaggcacgagacatgtggcggttgaacccgaagttgctaacttagatataatcggacaacgcatcgagaacatcaagcatgagcacaaatcaacctggcattacgatgaagataacccttataaaacatgggcatatcatggttcctacgaagtgaaacccagcggctctgcgagcagcatggtaaacggagtagttaagttactaaccaagccttgggatgttatccctatggttactcaaatagcgatgactgatacaacaccctttggacaacaaagagtttttaaggaaaaggtggatacaagaacaccaaaagcaaagagaggtacagcacaaattatggaggtaacagcaaaatggttatggggatttttgagcagaaataagaaaccaagaatatgtacaagagaagaatttacgagaaaggtacggtcgaacgcagcgataggggcagtattcgttgatgaaaatcaatggaactctgccaaagaagcagtcgaggatgaaagattttgggatctagtgcatcgcgagcgagaattacacaaacagggaaagtgtgcaacttgcgtctataatatgatggggaaacgtgagaagaaattaggcgaatttggcaaagctaagggaagtagagcaatttggtatatgtggctaggtgcaagatttttggaatttgaagcattaggattcatgaacgaagatcactggtttagtcgcgaaaattccctgtctggtgtcgaaggtgaagggcttcacaagttaggatatatacttagggacatttctaaaataccgggcggaaacatgtatgcagatgatactgcaggatgggacaccagaattaccgaagacgatctacaaaatgaagcacgcattacagacattatggaacccgaacatgcccttctagctaggagcattttcaagctaacgtatcaaaacaaagttgttcgagtccaacggcctgcaaagaatggaacagtaatggatgtgataagcagaagagatcaaagaggatcaggacaagtagggacatacggtctaaatacttttaccaatatggaagcacaactaataagacaaatggaatctgaaggcatttttagcccgtctgaattagagaccccaaatttagccgagcgtgtactagattggcttgaaaaatacggagtcgaaagattgaaaaggatggctattagcggagatgactgtgtggtaaagccaatagatgataggtttgctactgccttaactgcattaaatgacatgggtaaagttcgtaaggatattcctcaatgggaaccatccaaaggttggaatgactggcagcaagttccattttgtagtcaccacttccaccaattaataatgaaggatggtcgggaaattgtagttccttgtagaaatcaagatgaattagtcgggagagcgcgagtttcccaaggcgctggatggagcctaagagagacagcttgtctaggcaaatcttacgcacaaatgtggcaactaatgtatttccataggagggatcttcgattggccgctaatgcgatttgttcagctgtgcctgtggattggataccgaccagcagaactacatggtcgatccatgcccaccaccagtggatgacgactgaagacatgttaagcgtatggaatagagtatggatagaagaaaacccatggatggaggataaaacacacatcagttcgtggggagatgtaccatacttaggcaaacgtgaggatcaatggtgtggttcacttatcggactaacagccagagcaacctgggcaacaaatatacaggtagctataaaccaggtgcgtagactgatagggaacgaaaattacttagactatatgacatccatgaaacgttttaaaaatgaatcagacccagagggagcgctctggtag

SEQ ID NO: 21891 - RNA, 9879 nt, synthetic construct
  misc_feature 1..9879: note = derived and/or modified CDS sequence (opt6) from DENV-1__EU482709__SS-prME
  source 1..9879: mol_type = other RNA
tcagtaacaatgttgttgatgttggtaccaacagcattagcattccacttaacaacccgcggtggagaaccgcatatgattgtaagcaaacaagagaggggaaaatctttacttttcaaaacttcggctggagtcaatatgtgtacactcatagctatggacctaggcgagttatgtgaagatacaatgacgtataaatgtccccgtataactgaaacagaaccagacgatgtagattgttggtgtaacgccactgacacatgggttacttatggcacttgtagccaaactggtgaacatcgtcgtgataaaagatcagtagctttagcaccacacgtgggattgggcttagaaacacgcacggaaacttggatgagtagtgaaggagcatggaaacaaatccagcgggtagaaacttgggcgttaaggcatccaggcttcacagtaattgctctatttttggcacatgcaataggaacctcaattactcagaaaggaattatatttatattgttgatgctagtaaccccaagtatggccatgagatgtgtaggaattggaagtcgagattttgtagaaggtcttagcggagcaacatgggtggatgtggttctcgaacatgggtcatgtgtaacaacgatggctaaggataaaccaactttggacattgaattgctaaagacagaagtaaccaatccggcagttctaaggaaattatgcatagaagcgaaaatctccaatacaaccacggacagtaggtgtcccacacaaggtgaggcaaccttagtagaagaacaagatgcaaattttgtttgccgtaggacttttgtagaccgaggctggggaaatggctgcgggctatttggcaagggtagcctgataacgtgcgctaaatttaagtgcgtaaccaaacttgaagggaaaattgttcaatatgaaaatttaaaatatagtgttattgtaactgttcatacaggggatcaacaccaagtaggcaatgaatccactgagcacggcacaaccgcgactatcacaccacaggcgccaactaccgagatacaactaacagactatggcgcacttacgctagattgtagcccaagaacaggtctggattttaacgaaatggtgcttctaaccatgaaagagaaaagctggttggtacataaacaatggtttcttgatctaccactcccttggacgtcgggagcttcgaccagtcaagagacttggaatagacaagaccttcttgtaacatttaaaaccgcacacgcgaaaaaacaagaggtggtcgtattagggtcccaagaaggagcaatgcacacagcattaacaggggctaccgagatacaaacaagtggaacgacaacgatattcgctggtcatttaaaatgcagactgaagatggataaactaacactcaaagggatgtcatacgttatgtgtacaggctcatttaaactagaaaaagaagtcgctgagacccaacatggtacagtccttgtgcagatcaagtacgagggcacagatgcaccttgcaaaattccgttctccactcaagacgaaaaaggtgtaactcagaatggtagacttatcactgccaacccaatagttactgacaaagaaaaaccagtaaacattgaagcggaacctccattcggagagtcctatatcgttataggtgcgggggaaaaagcattaaagctttcgtggtttaagaagggatcgagcataggaaaaatgttcgaagcaacagctagaggagctaggcgaatggcaattttgggggacactgcatgggatttcggtagcataggaggagtattcacctcggtaggaaaactagttcatcaaatatttggaacagcttatggagtgctctttagcggtgtatcttggaccatgaaaattggtattggagtgctgctaacatggctaggtttaaactcaagaagcactagcctgtcgatgacttgtattgcagtaggcctggtcacattataccttggtgtaatggtccaagccgacagtggttgcgtcattaattggaagggacgagaactaaaatgcggctcgggaatcttcgttaccaatgaagtccacacctggaccgagcaatataaattccaggcggattcccctaaacgactatcggcggctataggaaaagcttgggaggagggagtttgtggaattcggtctgcaacaagattggaaaatattatgtggaaacagatcagcaacgaattaaaccacatactcttagaaaacgatatgaaatttacagtcgtggtcggagacgttgcaggtattctcgcgcagggtaagaaaatgataaggccacagccaatggagtacaagtactcatggaaatcatgggggaaagccaaaattattggcgccgatgtgcaaaatacgacgttcattattgatggacccaatactcctgagtgtcctgacgatcaacgtgcctggaacatttgggaagtagaggactacggctttggaattttcactacgaatatctggctaaaactcagagattcttatactcaagtttgtgaccacagactcatgagcgctgcaattaaagacagcaaagccgttcatgccgacatgggatactggatagagtcggagaaaaatgaaacctggaaactagcaagagcatcatttattgaggtaaagacatgcatatggcctaaatcgcacacactctggagcaatggagtcctagagtcagagatgataatcccaaaaatctacgggggtcctatcagtcaacacaactatcgacccgggtatttcacgcaaacagctggaccatggcatctgggtaaattagaactagacttcgatttatgtgaaggcaccacagtagttgtagatgagcattgcggcaacagaggaccaagcttacgtacaaccacagttactggtaaaataatccatgaatggtgttgtagatcatgtacattaccaccactgagattccgaggggaagacggatgctggtatggaatggagatacggccagttaaggaaaaagaggaaaacctagtgaaatcaatggtttccgctggatcaggtgaagtagattcttttagtctgggtttgttgtgcatatcaatcatgattgaagaagtaatgaggtctagatggtctcggaagatgctcatgactgggactttagcagtatttttcctactcatcatgggacagctgacatggaatgatctcatacgactatgtatcatggtgggcgcaaatgcttctgacagaatggggatgggcacaacatacttggccttgatggctacatttaaaatgcgaccgatgtttgccgtcggtttactctttcgtagacttacgtctagggaagtattgctactaactataggtttgagcttagtcgcctccgttgaacttccaaactcactagaagaacttggggatggcttagctatgggaataatgattctaaaactattaacagactttcaatcccatcaactctgggccacactactatccctaacattcattaaaaccacatttagtttacactatgcatggaaaacaatggctatggtactatccatagttagtttatttcccctgtgcttaagtaccacatcacaaaagacaacatggttaccagtattacttggatcactagggtgtaaaccactaacaatgtttttaattgcggaaaacaaaatctggggaagacgtagttggccgctcaatgaagggattatggctgttggcatagttagtatacttttaagtagtttgttgaaaaacgatgtaccattagctggaccattaatagctgggggcatgctaatagcctgttatgtaatttccggtagctcagcagatttatccttggagaaagcagcagaagtttcgtgggaagaagaagcagagcatagtggggcatcacataacatcttagtcgaagtgcaagatgatggtacaatgaaaataaaagatgaagaacgtgatgataccctaacgattttgttaaaggcaacattgctggcagtatcaggagtataccccctttcaatacccgcgacgctctttgtttggtatttctggcaaaagaaaaaacaaagatctggcgtcttatgggacacaccatctccacctgaagttgaaagggcggttctagatgatgggatctatcgaattatgcagcgaggtctcttaggacgttcgcaagtgggagtaggtgtattccaagagaatgtatttcatacaatgtggcatgtaacacgtggagctgtgttaatgtatcaaggtaagcgattggaaccaagctgggctagcgttaaaaaggacctaattagctatggcggcggatggagactgcagggatcatggaatacaggtgaagaagtccaagtgattgcagttgagccaggtaaaaatcccaagaacgtacaaactgctccgggtaccttcaagacacctgaaggcgaagtaggggctatcgcattagactttaagcctgggacgtcaggttccccgatagtaaatcgtgaaggcaaaatagtcggactttatggaaatggtgtagtgacgacttctggaacgtacgtatcagcaattgctcaagctaaagcctctcaagaaggtccactacccgaaattgaagacgaagtgtttcggaaaagaaacctaactataatggacttacatcccggatcaggtaaaacaagaagatacttaccagctatagttagagaagctatcaaaaggaaattacgcacactcatcctggcaccgacaagagtagtagcatccgagatggcggaagcactcaaggggatgcctataagataccaaacgacagctgtcaaatctgagcataccggaaaggaaatcgtcgaccttatgtgccacgcgacctttacgatgcgacttctatctcctgttagagtacccaactacaacatgatcataatggacgaagcgcactttactgatccgtcttcaatagctgcaagaggatatatatctaccagggtcggcatgggcgaagcagcagcaatatttatgacagctacgccacctggttcggtcgaggcatttccacaatctaacgcagttatacaagatgaggagagagatattccagaaaggtcatggaactcaggatacgaatggatcaccgattttccagggaagacagtttggtttgttccaagtataaagagtggaaatgacatagctaactgcttgcggaaaaatggcaagagagtgattcaacttagtcgaaaaacatttgatacagagtatcaaaaaacgaaaaacaacgactgggactatgtagtaactacggatattagtgaaatgggagcgaattttagagcagatcgagtaatcgatcctagaagatgtctcaagccagtaattttaaaagacggacctgagcgggtaattctagcgggcccaatgccagtaaccgttgctagtgctgcccaaagacggggtcgaattggtagaaatcataacaaagaaggagatcaatatatatatatgggacagcccttaaacaacgacgaagaccatgcacactggaccgaggccaaaatgctgctagataatattaatacacctgagggcataataccggctcttttcgaacctgaaagagagaaatcagctgcgatagacggagaatatagattaagaggagaagcccgaaagacttttgtcgaacttatgcgacgaggagatttaccagtatggctttcttataaagttgcatccgaaggttttcagtatagtgatagacgttggtgctttgacggtgagaggaataatcaagtactagaagaaaatatggatgtggaaatctggacaaaagaaggggaacgaaagaaactgagaccaagatggttagatgcccgaacttattcagatccactagcgcttcgtgaatttaaagaattcgcggccggtagacgtagtgtgagtggagatctaatattggagataggtaagctaccccagcacttaacccaaagggcacagaacgctctagacaaccttgttatgctacataactcagaacagggaggaagagcatataggcatgctatggaagaacttcccgatactatagagacattaatgctattagcacttatagccgtcctcactggaggtgttactctctttttcctgagcggacgaggcctcggtaagacatctataggcctactatgtgtaatggcaagcagcgtactgctatggatggcgtcggtagaaccccattggatcgctgcaagtataatactggaatttttcctgatggttttacttatacccgaacctgacagacagcgtactccgcaagacaaccaactagcttacgtggtcataggactactatttatgatattaacggtggcagcaaacgaaatgggactacttgaaacaactaaaaaagacttaggtattggacatgtagccgtagaaaaccaccatcatgcagccatgctagatgtggacttacacccagcctcagcgtggactctatatgcagtggcaacaacaataatcacgccaatgatgagacataccattgaaaacacaacagctaatatttctttaaccgcgattgccaaccaagcggcaatactcatgggtttagacaaaggatggccaattagtaaaatggacataggcgtgccactactagcacttggctgttattcacaggtaaacccactgacattaaccgcggctgtgttgatgttagtagcacactacgctattataggccctggccttcaagcaaaagcaacgagagaggcacaaaaaaggactgccgcaggcatcatgaaaaatccgacagtggatggaattgttgcaatagacttagacccagtcgtttacgacgcaaaatttgaaaaacagttgggacaaattatgctcctaatcttatgtaccagccaaatcttacttatgaggacaacatgggccctatgtgaatcgataacattggcaacaggtccgcttaccacattatgggaaggaagtccaggaaagttttggaatacaaccatcgcagtgtcaatggcaaacatctttcgcggttcatatttagcaggtgctggactcgcatttagcctaatgaagtcattaggaggtggcagacgtggtacaggcgcacaaggagaaacgctcggagagaaatggaagcgacaattgaaccagctttcaaaaagcgaatttaacacttataaacggtccggtattatggaggttgaccgaagtgaggccaaggaaggcctaaagagaggtgagacaacgaagcacgcggtaagtagaggcaccgccaagttaaggtggtttgtagaacgcaatcttgtaaaacctgaaggaaaagtaatcgacctaggatgtggacgaggcggatggagctattactgtgctggattgaagaaagttactgaagtcaagggctatacaaagggcggaccaggccacgaagaacctatacctatggcaacatacgggtggaatttagtcaaattacactcaggaaaagatgtatttttcatacctcctgaaaaatgcgacacattgctctgcgatataggagagtcttcccctaacccaactattgaagaaggaagaacactcagggtcctaaaaatggtagaaccatggctacgaggtaatcaattctgtattaaaatccttaatccgtacatgccatctgtagtagaaacgttagaacaaatgcagagaaaacatggcgggatgcttgtaagaaatcccctgtcgagaaattcaacacacgagatgtactgggtaagttgcggaacaggaaatatagtgtcggccgtaaacatgacgagcaggatgttactcaatcgattcaccatggcgcacaggaaacctacgtatgagagggatgtagatctaggcgcaggaactagacatgtagccgtagaaccagaagttgcgaacttggacataataggacagagaatagaaaacataaaacatgaacataaatctacttggcactatgatgaagataatccttacaaaacatgggcataccacggaagctatgaagtaaaaccatcaggcagtgcctccagcatggtgaatggagtagttaaattattaaccaaaccttgggatgtcattccaatggtaactcagatagcaatgactgataccacacccttcggccaacaacgagtttttaaagagaaagtcgacactcggaccccaaaagccaagaggggtacagctcaaattatggaagtaacagcaaaatggttgtgggggtttttgtcgcgcaacaagaagccgaggatttgcacacgcgaagagtttactagaaaggtaagatcaaatgccgctataggcgctgtatttgtagatgaaaaccaatggaatagcgctaaggaagcagtggaagatgagaggttttgggatcttgtccacagagaaagggaattacacaagcaaggtaagtgcgcgacatgcgtatataacatgatgggaaagagggaaaaaaaattaggtgaatttggaaaagctaaaggtagtcgtgcaatatggtatatgtggttgggagcccgctttttagagtttgaagcactaggatttatgaacgaagatcattggttcagtcgagagaatagcttatctggagtagaaggagaaggactacacaaattaggttacattttaagagacattagtaaaatcccaggcggaaatatgtacgcagatgatactgcagggtgggatactcgaataacagaggacgacttacagaatgaagcacggataacagatatcatggaacccgaacatgcgctgttagcaaaatctatctttaagcttacctaccaaaacaaggtcgtgcgagtacaaagacctgcaaaaaatggtacagttatggatgtgataagccggagggaccaacgaggttcaggccaggttggtacttatggtctgaatacctttactaatatggaagctcaactaatcaggcaaatggaaagtgaaggcatcttttcgccatctgagttagagacacctaacttggcagaaagagtacttgattggttggaaaaatacggcgttgaacgtcttaaaagaatggctattagcggtgacgattgcgtcgtaaagcctattgacgaccggtttgcaacagcacttaccgctttgaacgacatgggcaaggtacgaaaagatataccacaatgggaaccttctaaaggttggaatgattggcaacaagtgcctttctgctcgcaccatttccaccaactaataatgaaggatggtagagaaattgtagtaccatgtcgtaatcaagacgaattagtagggagggcacgagtgtcgcagggagctggatggtcgttacgagaaactgcgtgtcttgggaaaagctatgcccaaatgtggcaattaatgtactttcatcggcgtgacttgcgtttagccgcgaacgcaatatgttcagctgtacccgtggattggattccaacatctaggacaacctggtccatacatgcccaccatcaatggatgaccactgaagatatgctatcggtttggaatagagtatggatcgaggaaaatccatggatggaagataaaactcacatttcaagctggggtgatgttccttacttgggaaaaagggaagaccaatggtgtggtagtttaatagggctaaccgctcgcgcaacatgggcaaccaatatacaagttgcgataaaccaggtacggagattaatcggtaacgaaaactatctagactatatgactagtatgaaaagatttaaaaacgagagtgatccagagggggctctatggtga

SEQ ID NO: 21892 - RNA, 9879 nt, synthetic construct
  misc_feature 1..9879: note = derived and/or modified CDS sequence (opt6) from DENV-1__EU482710__SS-prME
  source 1..9879: mol_type = other RNA
tcagtaacaatgctcttaatgttaatgccaacagcattagcgttccacttgaccacaagagggggagaaccgcacatgattgtcacgaaacaagaacgcgggaaatcactactatttaaaacaagcgccggtgtaaatatgtgcacattaattgcaatggatctcggagaactctgtgaagacactatgacttacaaatgtcctcgtataacagaggctgaaccggatgatgtagactgttggtgtaacgcaacagatacctgggtaacttatggaacatgctcacaaacgggtgagcatagacgcgacaaacgtagcgtagctttggctccgcatgttggactaggattggaaactcgaactgagacttggatgtcgtctgaaggcgcatggaaacaaattcaaagagttgagacgtgggcattgaggcatcctggatttacggttattgccttatttttagcacatgctatagggacaagtattacacaaaaagggattatctttatactattaatgcttgtgacgccaagtatggccatgagatgcgttggtataggcagtagagacttcgtggagggactaagtggtgcgacatgggtagatgtagtactagaacatggtagttgtgtgaccactatggcgaaagacaaaccaacactcgatatagaactcttaaaaaccgaagtgactaaccccgccgtactaagaaaattatgcattgaggccaaaattagtaatacaacaactgattcgcgttgccctacccaaggagaggccacgctgatggaggaacaagacgcgaattttgtttgcaggcgcacttttgttgatcgaggatggggaaacggatgtggattatttgggaaaggttcactaataacatgcgctaaatttaaatgtgtgacaaaattagaagggaaaatagtacaatacgaaaatctaaaatatagtgtgatagtaaccgtgcatactggggatcaacaccaagtgggtaatgaaagtactgaacatggcactaccgcaacaattactccgcaggcacctactagcgaaatccaactgactgattatggtgcattgactctagattgctcccctcgaacgggattagacttcaatgaaatggtcttattaaccatgaaagagaaatcatggctcgtgcacaaacaatggtttcttgatctcccgcttccatggacttccggagcatcaacttcccaggaaacttggaatagacaagacttattagtaacatttaagactgcacacgctaaaaagcaagaagtagtagtgttaggctctcaggaaggagccatgcatacagctttaaccggtgctacagagattcaaacgagtggtaccaccaccatatttgctggacatcttaagtgccgtctgaaaatggataaattaaccttgaaaggaatgtcgtacgtaatgtgcacaggcagctttaaactggaaaaggaagttgccgaaacgcaacatggcacggtcttagtacaaattaaatacgagggaaccgacgcaccgtgtaagattccatttagtacacaggatgagaagggcgttacacaaaatggaaggttgataacagcaaatccaatagtaactgataaagagaagccagtaaatatagaggcagaaccaccctttggagaatcctatatagtaataggagctggtgagaaagcactaaaactttcgtggttcaagaaagggtctagtattggaaaaatgtttgaggcgacagctaggggtgctcggcgaatggctatattaggggatacagcatgggattttggaagtgtcggaggggtatttacgagtgttggcaaacttgtacatcaaatctttggaactgcctatggggttttattttccggggtctcatggaccatgaaaatcggtattggtgtacttttaacatggttgggactaaatagtagatcaacctctttgtcaatgacatgtatagctgtagggctagttactttgtatttgggggtgatggtacaggctgattcaggctgtgttataaattggaagggaagggaattaaaatgtgggtctggaatttttgttacaaatgaagtacatacttggacggaacaatataaattccaagcagattccccaaagcgcctatccgcggctataggtaaagcatgggaggagggggtatgtggaataagatctgccactcgtctggaaaacattatgtggaagcagatctctaacgaactaaaccatattttattggaaaatgacatgaaatttacggtagtagtaggtgatgtagtaggcatcttagcacaaggcaagaaaatgattcgacctcagcccatggagcataaacactcctggaaatcttggggtaaagcaaagattattggagctgatgtgcaaaatactacctttataattgacggccctaatacacccgaatgtccagacgatcaacgtgcttggaacatatgggaggttgaagattatgggtttggcatattcacaacaaacatatggctaaaattaagagacagctatactcaagtatgtgatcaccgcctaatgagtgcggcgattaaggactccaaagcagtccacgcagacatgggttattggatagaatctgagaaaaatgaaacatggaaattagccagggcatcattcatcgaagtaaaaacttgcatatggccgaagtcgcatacattgtggtccaatggggtgttagaatccgaaatgatcattcctaaaatatatggaggtccaatttcacagcacaaccacaggcctggatactttacccaaacagcaggtccgtggcatttgggcaaacttgagttagattttgacttatgtgaaggaactacagttgtggtagacgaacattgtggaaataggggaccatcactgagaacaactaccgtgacaggaaagatcattcatgaatggtgttgcagaagctgtactctaccaccattacgatttaaaggagaagacggctgctggtatggcatggaaataaggccggttaaggagaaggaggaaaatttagtaaaatctatggtaagcgcaggctctggggaagtagatagcttcagcctaggattactatgtatatctatcatgattgaggaagtgatgcgatctcgctggagcagaaaaatgcttatgacagggacattggccgtatttctattactaataatgggccaattgacctggaatgaccttatcagattgtgtataatggtaggtgctaacgcttcagaccgtatgggtatgggaacaacctatttagctctaatggcgacctttaagatgagacccatgtttgccgtaggattactatttcgcagactcacgtcgcgtgaagttctactcttaactatagggctaagcctcgtagcatctgtggaactaccaaactccctggaagaactaggagatggattggccatgggaatcatgatattgaaactactaaccgattttcagtcccatcagttgtgggcaaccctgttgtcactaacattcataaaaacgacactaagtctgcattatgcgtggaagaccatggcaatggttctatcaatagtctcactattccctttatgtttgtcgaccacgtcacagaaaactacatggttacccgttctcttgggaagtctaggatgtaaaccattaacaatgtttttaattactgaaaacaaaatatgggggaggaaaagctggcctcttaacgagggcattatggcggtaggagtagtctcaatcctactttcatctttgcttaaaaacgacgttcccctagcaggccctttaattgcagggggaatgctaatcgcatgttatgttataagcggaagttctgctgacttatccttagagaaagcagccgaagtaagctgggaagaggaagcggaacattctggtgcatctcacaacattctcgtagaggtccaagatgatggaaccatgaaaattaaggacgaggaaagagatgacacattgacaattttactgaaagcaacgctattagctgtaagtggggtttatccattatcaatcccagctacactgttcgtatggtatttttggcagaagaagaaacaaagatctggagtcctatgggacactccgagtccaccagaagtagaaagggcggtattggacgatggtatctacagaataatgcagaggggtttacttgggcgcagtcaagtcggggttggtgtgttccaagagaacgtttttcacaccatgtggcatgtaacaagaggagcagtactcatgtatcaaggaaaacgattagaaccttcatgggcaagcgtaaagaaagaccttattagttatggtggcggatggagattacaaggatcatggaacacaggcgaagaagtacaagtaatcgccgttgaaccaggcaaaaaccccaaaaacgttcaaacagcaccaggaacattcaaaacgccagagggcgaggtaggagcaatagccttagactttaaaccaggtacgtcaggatcaccgatagtaaatcgtgaaggaaaaatagtaggtctatatggaaatggagttgtgacgacttcaggcacctacgttagtgccattgcacaagcaaaggcatcacaagagggacctctcccagagattgaagacgaagtattcaggaaaagaaacttaaccataatggatttacatcccggtagcggcaaaactagacggtaccttccagccattgttcgtgaagctataaaaagaaagttacgaacattaattctcgctccgaccagagttgtcgcgtctgaaatggcagaggctctaaaaggaatgcctatccggtaccaaactacagctgtcaaaagtgaacacactggtaaagaaattgtagatttaatgtgtcatgcaacattcacaatgagattgttaagtccagttcgagtaccaaattataacatgattattatggatgaagcccattttactgacccctccagcattgctgcccgaggatacattagtacacgagttggtatgggagaggccgctgcaattttcatgacagctacgccgccaggcagtgtcgaagcatttcctcaaagcaacgccgtcattcaggatgaagaacgggatataccagagagaagttggaactccggatacgaatggataactgacttcccaggcaaaaccgtgtggtttgtacccagcatcaaatctgggaatgatattgctaattgcctaaggaaaaacggaaagagggtaattcaacttagtcgcaaaactttcgataccgagtatcagaaaacgaaaaataatgattgggattacgtcgtcactaccgatatctccgaaatgggcgctaattttcgtgctgacagagttatagatccccgaaggtgtttgaaaccagttatcttaaaagacggtccggaacgcgtaatcttagcaggacctatgcctgtaacagttgcgtcagcagcccaaaggaggggaagaataggcagaaatcataataaagagggagatcaatatatatatatgggccaaccattaaacaatgatgaagatcatgcgcactggactgaggcgaaaatgttacttgacaatattaatactccagaaggaattatacccgctctgttcgaaccagaaagagaaaaatccgccgcaatcgatggtgaatataggctgcgaggagaggcacgcaaaacattcgtcgaacttatgcgaagaggggatttacccgtctggctaagttacaaagttgcaagtgagggcttccaatatagtgacagacgatggtgttttgatggagagagaaacaaccaggtattagaagaaaatatggacgttgagatatggacaaaagaaggagaaaggaagaagttgagaccacgatggttagatgccagaacttactctgacccacttgctttaagagaatttaaagagtttgcagcaggtcgaaggagcgtgagcggtgacctcatttcagaaattggaaagctgcctcagcatttgacacagcgcgctcagaatgccctagataacctagttatgttacacaactcagaacaaggtggaagggcttataggcacgctatggaagaattaccggatacaatcgaaacactaatgttactcgctttaatcgcagtactaactggtggtgttactttgtttttcctttcgggaagaggccttggcaaaactagcattggattattgtgtgtaatggctagtagtgttttgctgtggatggcaagtgtcgaaccacattggatagccgcttcaatcattcttgaatttttcctaatggtcttattaataccagaacccgataggcagaggactccacaggacaatcagcttgcatacgtcgtgataggcctactcttcatgatattaacagttgctgctaacgagatgggtcttctagagacaactaagaaagacctaggtataggccacgtcgctgtagaaaatcaccatcatgccacaatgcttgatgtagatttacacccggcatcagcatggaccttgtatgcagtagctaccacaataataactccgatgatgcgacatactattgaaaatacaactgctaatatttcgctaactgctattgccaatcaagccgcgatactaatgggacttgataagggatggccaattagcaaaatggacatcggtgtacctctgcttgctttaggctgctattcacaagttaatcctttaacccttacagctgcagtgttgatgttggtcgcccattatgcgataatcggccccggactccaagcaaaagctacaagagaggcgcaaaaacgaacagcggcaggtataatgaagaatccaactgtggacggcataattgcgatagacttggatccagttgtatacgacgcaaagtttgaaaaacagttagggcaaataatgttgcttattctatgtacttctcaaatattgttaatgagaacaacttgggccctatgtgaaagtattacgctagctactggacctttaacgacactatgggaaggatccccaggaaagttctggaatacgaccatagcagtttcaatggcgaacatcttccgagggtcctaccttgctggcgcgggcctagcattttcattaatgaaatctctaggagggggaagaagaggcacgggagcacagggcgaaactctaggagaaaaatggaaaagacaattaaatcaattatcaaaatcagaatttaacatttataaaagaagtggaatcatggaagtggatcgaagcgaagcaaaagaaggcttaaaaagaggggagacaactcgtcacgcggtctcaagaggaactgccaaattacgctggtttgtagagcgaaatttggttaagcctgagggtaaagttatagatttaggctgtgggcgtggtggctggagttattactgtgccggactaaagaaagtaacggaagttaagggctatacaaaaggtggacccggtcacgaagaacctataccgatggcaacgtatggctggaatctggtaaaattacacagtggaaaagatgtattctttacccctccggaaaagtgcgataccttgctgtgtgacataggtgagagtagccccaatcctacgatagaagaagggcgaactttaagagtattaaaaatggtggagccctggctccggggcaaccagttttgtataaaaattttgaatccttacatgcctagtgttgtagaaacactggaacagatgcaaagaaaacatggcggcatgttagtacggaatcctcttagtcgcaattcaacgcatgaaatgtactgggtttcttgcggcacaggtaatatcgtctctgcggttaatatgacaagccgaatgctacttaatagatttactatggctcatcgtaaacctacctatgagagagacgttgatcttggagccggaacacgccatgtggcagtagagcctgaggtagcgaatcttgatattataggccaaagaatagaaaacattaaacacgaacataaaagtacatggcactatgatgaagacaatccatataaaacttgggcatatcacgggtcatatgaagtaaaaccttctggatctgctagtagcatggtcaatggtgtagtcaaattattaacaaaaccttgggacgttataccgatggtcactcaaatagcgatgaccgatactacacccttcggtcaacagagagtattcaaagaaaaggtggatacccgaactcccaaagccaaacgaggcaccgcacaaataatggaagttaccgcacgatggctttggggctttctatccagaaataagaaaccaaggatatgtactagagaggaatttactcgtaaggtacgttccaatgccgccataggagctgtatttgtagatgagaatcagtggaacagcgctaaagaagcagttgaagacgaaagattttgggatttagtacaaaaggaacgagaattacataaacaaggaaagtgtgctacatgcgtttataatatgatgggtaaaagggagaagaaattgggtgaatttggaaaagcgaagggatctagagcaatctggtatatgtggctaggagccagatttttagagttcgaagcactaggtttcatgaatgaggaccattggttttcaagagaaaacagtttaagcggagtggaaggggaaggattacataaacttggttacattctgagggatatctcaaagattccgggcggaaatatgtatgcggatgatactgcagggtgggatacacgtataactgaagacgatttacagaacgaggccaaaataacggatattatggaacctgaacacgcattattggctacatcgatttttaaattaacctatcaaaataaagtcgtaagagttcaacgcccagctaaaaatggaactgttatggatgttattagcagacgggaccaacgcggaagcggacaggtgggaacctatggactaaatacatttacgaacatggaagcccagctcataaggcaaatggagtcagaaggaatatttttgccgagtgagttagaaacacctaacttggcagaacgagtcttagattggttggaaaagtatggcgtagaacgactgaaaagaatggctatctcaggtgatgattgcgtagtaaaacctatcgatgacagattcgcaacagccctgactgcactaaacgacatgggcaaggtcagaaaagacataccacaatgggaaccatctaagggatggaatgattggcaacaagttccattttgttctcatcactttcatcagctaataatgaaagacggtcgagaaattgtcgttccgtgcagaaaccaggacgagctagtcggaagggcccgggtatcgcagggtgccggttggtcgctcagagaaaccgcgtgcttaggaaaatcatatgctcaaatgtggcaacttatgtactttcatcgaagggatctccgcttggctgcaaatgcaatttgttcagcggttccagtagactgggtaccaacatcgcgcacaacttggagtatccatgcacaccatcaatggatgacgacagaagacatgctttccgtgtggaatagagtttggattgaagaaaatccatggatggaggacaaaacacacgtgtcctcttggggcgatgttccatatttaggaaaacgtgaagatcaatggtgcggaagtttaataggtcttacagcacgggcaacatgggccagcaatattcaagtagcaatcaaccaagtacgaagattaattggaaatgaaaattatctagattatatgacgtcgatgaaacggtttaaaaacgagggggacccggaaggcgcattatggtaa

SEQ ID NO: 21893 - RNA, 9879 nt, synthetic construct
  misc_feature 1..9879: note = derived and/or modified CDS sequence (opt6) from DENV-1__EU482712__SS-prME
  source 1..9879: mol_type = other RNA
agtgttactatgcttctaatgttgatgccgacggctttggctttccatctaacgacaagaggaggggaaccccatatgatagtctcaaaacaagaaagaggtaaatctcttttattcaaaacatcagctggcgttaatatgtgtacattaatagctatggatctgggtgagttttgtgaagacactatgacatataaatgcccccgaataacagaagcggaacctgacgatgttgattgttggtgcaatgcaaccgatacttgggtcacttatggaacatgcagccaaacaggggaacatcgtcgggacaaacggtctgttgctttggctccacatgtcgggcttgggctggaaacaagaactgaaacgtggatgtcaagtgaaggggcgtggaaacagattcagagagttgaaacatgggcattaagacatcccgggtttactgtcattgctctgttcttggcacatgcgatcggaaccagtataacccaaaaaggcataattttcatattgctcatgcttgttaccccaagtatggctatgaggtgcgttggaattggaagtcgagatttcgttgaaggactctctggtgcaacctgggtcgatgtagtattggaacacggttcgtgcgtgacaactatggctaaagataaaccaacgctagatatagaattgctcaaaacagaggtaacgaatccggcagtattacggaaattatgtatagaagcgaaaatatcaaataccacaacagactcgagatgcccaacacagggcgaagctacacttgtagaagaacaagacgctaattttgtatgtcggagaacattcgtagatcgaggatggggcaatggatgtggcctttttggcaaagggtcactgataacctgtgcaaaattcaaatgcgttactaagctagagggaaaaaccgtccaatatgaaaacctaaaatactctgttatcgtaaccgtgcatactggggatcaacatcaagtcggtaacgaatctacggaacacggcacgacagcaacaataactccgcaagcaccatccactgaaatacaacttacagattatggagccttaacactagattgcagcccaagaacgggtttagattttaatgaaatggtgttactaacaatgaaagagaaaagttggttagttcacaaacaatggttcctagatttaccattgccgtggacatccggtgcaagcacatcgcaagagacctggaatagaaaagatctactggttacgttcaagaccgcgcacgccaagaaacaagaagtggtagtattaggcagtcaagaaggagcaatgcacacagcgctaacgggtgcaaccgagatacaaacgtctggtacaacgacaatctttgcgggacatctaaagtgccgattgaagatggataaactaactctaaaaggaatgtcttatgtaatgtgcactggttcatttaaactcgaaaaagaggtagcagagacccaacatggtacagttctagttcaaatcaagtatgagggaaccgatgccccatgtaaaataccgttttcaactcaagacgaaaaaggcgtaacacaaaacggaaggcttataactgccaaccctatagtgactgacaaggagaaacctgtaaacatagaagcagaacccccatttggagaatcttatatagtaattggcgccggtgagaaagcactaaaactaagttggtttaaaaagggatcttcaatagggaaaatgtttgaggcaaccgcgaggggcgccagaaggatggctatattgggcgatacagcttgggatttcggtagcattggtggagtcttcacaagtgttggaaagttagtgcatcagatttttggaacggcttatggagtgttgttcagtggagtatcttggacaatgaaaataggaattggtgttttattaacgtggctgggacttaacagcaggtcgacaagtctctctatgacctgtatcgcggtaggcttggtgaccctgtacctaggtgttatggtccaggcggattcgggttgtgttataaactggaaaggtcgtgaactcaaatgtggcagcggcatattcgtcacgaatgaagttcatacgtggactgaacaatacaaatttcaggcagactctccaaagcgactttcagcagctataggaaaagcatgggaagaaggtgtatgcggaattaggagtgctacccggctcgaaaatattatgtggaaacaaataagtaacgaattgaatcacatacttctcgaaaacgatatgaagtttactgtagtagtaggcgatgtggcaggaatattagcccagggaaagaagatgattcggccacaacctatggagtataagtattcgtggaaaagctggggaaaggcaaaaatcatcggtgcagatgttcaaaataccactttcattatagacggacctaacaccccagaatgcccagatgatcaaagagcttggaatatatgggaagtcgaagattatgggtttgggattttcactactaatatttggctaaaattaagagacagttacacccaggtatgcgatcaccggctaatgagtgcggcaattaaggattccaaagcggtacatgcggacatgggctattggatcgagtccgagaaaaatgagacatggaaactagcaagagcatcatttatagaagttaagacgtgtatatggcctaaaagtcacacattatggagtaatggcgtactagaatctgaaatgattattcctaaaaattatggcggtcctataagccagcacaattaccgtccaggttacttcacacaaacagcaggaccatggcatttaggtaaactagaactcgattttgatctatgtgagggaacaacagtagtcgttgatgaacattgtggcaatagaggtccttccttaagaacaactactgttacagggaaaataatccatgagtggtgttgtaggtcctgtaccctcccacctttaagattcaaaggggaagatggatgttggtacgggatggaaatacggccagtaaaggaaaaagaggaaaacctcgttaaaagcatggttagtgcgggatctggcgaagttgatagcttttccctaggtctattatgcataagtataatgatagaagaagttatgaggtctagatggtcccggaaaatgctaatgacaggaactctggcggtgttatttttgttgataatgggacaactaacttggaatgatctgatccgcttatgcataatggtaggggcgaatgcgtctgatcgaatgggtatgggcacaacttacttagcactcatggctacattcaaaatgcgacccatgtttgctgttggtttactatttagaaggctaacatctagagaggttttattgctgacgataggactatcgcttgtagcaagcgtcgaactacctaattcactggaagaacttggggatggacttgcgatggggatcatgattttgaagctactaacagacttccagtcacatcaattgtgggcaacgttattaagtcttacgttcataaagacaactttttcacttcattatgcatggaagacaatggcaatggttctcagcattgtttccttatttcccctgtgtctctctacaacctcacagaaaacaacatggttaccggtattactaggatcactagggtgcaaaccattaaccatgttccttatagctgagaataaaatctgggggagaaaatcatggccacttaacgaagggataatggcagttggaatcgtcagtatacttctctcaagccttctcaaaaatgatgtaccattggctggtcctctaatagctggcggtatgctcatagcatgctatgtaataagtggatcatcagctgatctctcattggaaaaagcagcggaagtcagctgggaggaggaagcagaacatagcggggcaagtcataacattctggtagaagttcaggacgatggcactatgaaaattaaagacgaggaaagggatgataccttaacaatattactgaaggccactttgttagcagtatcaggcgtgtaccctttgagtattccagcaacactatttgtttggtacttctggcaaaagaagaaacaaagaagcggagtgctatgggacaccccatctccaccagaggttgaacgagcagtattagatgacggcatatatagaattatgcagagaggccttctagggcgaagtcaagttggtgtgggagtatttcaagaaaacgtttttcacacaatgtggcatgttacaagaggggctgttttaatgtatcagggaaagcgcctagagccctcatgggctagtgtcaaaaaggatttgattagttatggaggaggatggaggttgcaaggtagttggaacactggtgaagaagtacaagtgattgcagtcgaaccaggtaaaaatccgaaaaacgtacaaaccgctccaggaacattcaaaacaagcgagggagaagtcggtgctatagcactagacttcaaaccaggtacgagtggatctccaatagttaaccgagagggaaaaatagtgggtttatacgggaacggcgtagttacaacatcagggacatacgtaagtgctatagcacaggcaaaagcatcccaggagggtccactaccggaaattgaagacgaagtttttaggaaaaggaacttaacaataatggacctacatccgggctcggggaagacccgaagataccttccggccatcgtaagagaagctatcaaaaggaaattaaggacgcttatactggccccaactagggtagtagccagcgaaatggcagaagcattgaaaggtatgccgatacgatatcaaacaacagcagtaaaaagtgaacacaccggcaaagaaatagtagacctaatgtgtcacgctacttttactatgcgactgctctcacctgttagggtccctaattacaatatgataattatggatgaagcacactttacagatcctagctcaatagccgccagaggttacatttctacacgagttggcatgggagaagccgctgcaatttttatgaccgcaacccctccaggttccgtagaagcatttccccaatccaatgctgtaatacaagacgaggaacgtgacatcccagaaagaagctggaactccggttacgaatggataacagattttcctggtaagactgtatggttcgttccatctataaaatcaggaaatgacatagcgaactgtcttaggaaaaatgggaaaagagttattcaacttagcagaaaaacctttgacactgagtaccagaaaaccaaaaacaacgattgggactatgtagtaacgaccgacatatcagaaatgggtgccaattttagagcagatagggtaatagatccccgcagatgcttaaagcctgtcatcctaaaggatggacctgaaagagtaatattggcgggccctatgccagtaaccgtggcttcagctgcacaaagaaggggtcggattggtagaaaccacaataaggaaggagatcaatacatttatatgggacaacccttaaataatgacgaagaccatgcacattggacagaagctaagatgttgttagataacattaatacacctgaagggataatacccgcattgtttgaacctgaaagagagaagtccgccgctatcgatggcgagtacagactgagaggcgaggctcgaaaaacatttgtagaattgatgagacgaggagaccttccggtatggttgtcttataaagtcgcaagtgaaggatttcaatatagcgatagaagatggtgttttgacggcgaacgaaacaaccaggtcttagaagaaaatatggacgtcgagatttggactaaggaaggagaaagaaagaaactcagaccgaggtggctagatgccagaacgtacagtgatcctttagctctaagagaatttaaagaatttgccgcaggacggagaagtgtttccggggacttgatcttagaaatagggaaattaccacaacatttaacgcaaagggcacaaaacgcacttgataatctggtcatgttgcacaattcagaacaagggggacgcgcatatagacatgcgatggaggaactacctgacacaatagaaacattaatgttactcgctttaatagcagtactaacagggggtgtcacgcttttctttttatctggccggggtttgggtaaaacaagcattggtctgctttgcgtaatggcttcgagcgtacttctatggatggcttcagtagaacctcattggatcgccgcaagcattattctagaatttttccttatggtgcttcttatacctgaacctgataggcaaagaacgccgcaagataaccaactagcatacgttgtaataggactactattcatgatacttacagtcgctgcaaacgaaatgggtttactagagaccactaagaaagatttaggtattggtcacgtcgcggtagaaaatcatcaccatgctgccatgctagatgtagatttacatccagcgagtgcatggaccttatacgctgtggcaacaaccattataactcccatgatgagacatacgatagagaatacgactgcaaacatatcgctaacagcaattgctaatcaggctgcgattcttatgggacttgataaaggatggcctatctcaaagatggatataggcgttccgcttcttgctttgggctgttacagccaagtaaacccactaacattgactgccgcggtacttatgctagtagcacattatgctataattggaccgggactccaggctaaagcgactcgagaggcccagaaaaggacagcggctgggataatgaaaaatcccacggtagacggcatagtagcaatagaccttgatcctgtagtctacgacgcaaaatttgagaaacaacttggacagataatgttactaatattatgcacgtctcaaattctactaatgagaacaacttgggcattatgtgaatcaattacactcgcaacaggacccttgacaactctttgggaaggctcacccgggaaattttggaatacaacaattgcagtatccatggcgaatatctttagaggatcatacctagccggtgcaggtctagctttcagtctaatgaaaagtctgggaggaggaagacgtggaactggcgcacagggggaaacgttaggcgaaaagtggaaacgacaactcaatcaattgagcaaatcagaatttaacacatacaaacgatcgggtatcatggaagtagatagaagcgaagcgaaagagggactaaagagaggagaaacaacgaaacatgctgtgtcccgtggcactgcaaaacttcgatggttcgtagaaagaaaccttgtaaaaccagaaggcaaagtaattgatttaggttgtggaaggggtggatggtcttattattgcgcagggcttaagaaagttactgaagtaaaaggatacacaaaaggagggccaggacatgaagaaccaataccaatggctacgtacgggtggaacctagtaaagctacattctggcaaagatgtattcttcatacctccagaaaaatgtgatacattgttatgtgatataggcgaatcttctccaaatcctacaatcgaggaagggagaactttaagagtcctaaaaatggtggaaccgtggttgagaggtaatcaattttgcattaagatcttgaatccatatatgccaagcgtagtcgagaccctagaacaaatgcaacggaaacatggtggaatgctcgtccgaaatcccttaagcaggaatagtactcatgagatgtactgggtaagttgtggaacggggaacatagtttcagctgtgaacatgacaagtcgtatgctattaaacagatttactatggcccatagaaagcctacttatgagagagacgttgatttaggagcaggtacgaggcatgtagccgtagaaccggaggtagcaaatttagatataataggacaacgtatagagaatatcaaacacgaacacaagagcacctggcattacgacgaagataacccatacaaaacctgggcataccacgggtcctatgaggtaaaaccaagtggatcggcgagtagtatggtaaacggtgtggttaaattattaaccaagccatgggatgttatcccaatggttacacaaatagcaatgactgatactacgccttttggccaacaaagagtttttaaggagaaagtggatactcgcacaccaaaagcaaagcgtggaaccgcacaaattatggaggtaacagcaaagtggttatgggggttcttatctagaaacaaaaagccgaggatttgcacaagagaagagttcactcggaaagttcgatcaaacgccgcgatcggtgctgtattcgtcgatgaaaaccaatggaactcggcgaaagaagcagtagaagatgagcgcttctgggaccttgtacaccgagaacgagaactacataaacaaggtaaatgcgcaacttgtgtttacaatatgatgggtaaaagagagaagaaacttggagagttcgggaaagcaaagggatcacgagcgatctggtacatgtggttaggcgcacggtttttagaatttgaagcattaggtttcatgaatgaagaccactggttttcacgagaaaacagtctgtcaggtgtagaaggtgaaggattacataaacttgggtacatcttgagagacattagtaagatcccaggtggtaatatgtatgccgatgatactgcagggtgggatacaagaatcacagaagatgaccttcagaatgaagctaaaataacagacattatggagcctgaacatgcacttcttgccaaatcgatatttaagttgacataccagaataaagttgttcgggtacaacgtccagccaaaaatggaacagtaatggatgttatttcaagacgagaccaaagaggttccggccaagtggggacatatgggctcaatacattcacaaatatggaagcccaattaataagacaaatggaatccgaaggaatttttagtccgtcggagttggaaacacctaatttagcgggaagagttttagattggttagagaagcatggcgttgaacggctgaagcgtatggccatctctggggatgactgcgtagttaaacctatagacgaccgatttgccactgcactaactgcactaaatgatatgggtaaagtcagaaaagatataccacaatgggaaccatcaaagggctggaacgactggcagcaagtacccttttgttcacaccattttcaccaattaataatgaaggatggaagagagatcgtcgtaccatgcaggaaccaggacgaattagtagggcgggctagagtcagccaaggcgcaggatggtcattgcgggagacagcttgtctaggaaaaagttacgcacagatgtggcaattaatgtactttcatagaagagatctcagactagccgcaaatgcaatatgcagtgcggtcccagtagattgggtacccacaagtcggacgacatggtcaatacacgcccaccatcaatggatgacaaccgaagatatgttaagtgtttggaatcgagtttggatagaagaaaacccctggatggaagataagacacatatcagtagctggggtgacgtgccatatttaggaaaacgagaagaccaatggtgtgggtcattaatcggactgacggcaagagccacgtgggcaactaatatccaagtcgcaataaatcaggtaaggagacttattggcaacgaaaattatctagactacatgacaagtatgaaacgcttcaaaaatgagagcgatcccgagggggcactttggtag

SEQ ID NO: 21894 - RNA, 9879 nt, synthetic construct
  misc_feature 1..9879: note = derived and/or modified CDS sequence (opt6) from DENV-1__EU249490__SS-prME
  source 1..9879: mol_type = other RNA
agcgtaactatgcttttaatgttaatgccaactgcacttgcctttcacctgactactcgagggggagaaccacacatgattgtatcaaaacaagaaagaggaaagagtttgctctttaaaacatcagcgggtgtaaatatgtgcaccctgatagctatggacttaggggaattttgcgaagatacgatgacatacaagtgccctcgcataactgaagcggaaccagatgacgtagattgttggtgcaatgcgacggatacatgggtaacgtacggaacttgcagtcaaacgggcgaacatagaagagataaaagatctgtagcacttgctccacacgtgggactcggtttagaaaccagaacggaaacttggatgtccagtgaaggcgcgtggaaacaaatacaacgagttgaaacttgggctctccgccatcctggattcaccgtaatcgcgctatttttagctcatgccattggtacttccattactcaaaagggtataatatttatattacttatgttggtgacaccaagcatggctatgagatgtgtaggaataggctcaagagattttgtcgaaggtctgtcaggcgctacctgggtagatgttgtgcttgagcatggaagctgtgtaactacgatggctaaggacaagccgacgttggatatcgaactattgaaaacagaagttaccaaccctgctgtactgagaaaactttgtattgaagcaaaaatctcaaatactacaactgactctcgatgtcccactcaaggggaagccacactggtagaagaacaggacgctaactttgtatgccgtagaacattcgtcgatcgaggatggggtaacggatgcggtctttttggcaagggctcattgattacttgtgcaaaatttaaatgtgttacgaagctcgaaggaaaaacagtccaatatgagaatttaaaatactccgtaatagtaactgtacacactggtgatcaacatcaagttggtaacgaaagtacggaacacggcacaacagccactattacaccacaagcaccatctacagaaatacaacttaccgattacggcgcactgacactggactgtagtccacgcacaggattagatttcaatgaaatggtccttctgacaatgaaagaaaagtcttggttagtgcacaagcaatggtttctagacctaccattgccatggacaagtggagcttcgacttcacaagagacatggaatagaaaagacttgttagtaacatttaaaacagctcatgccaagaaacaagaggtagtggtgttaggatcacaagagggagctatgcataccgcactcacgggtgccactgagatccaaaccagcggaacaacaacaatattcgctggtcatctaaaatgtcggttgaaaatggacaaacttacactgaaaggaatgtcatatgtaatgtgtacaggttcgttcaaattagaaaaagaagtagcggaaacacagcatggaacggtcttagtacaaattaaatacgagggaacagacgcaccgtgtaaaatcccgttctctacacaagacgaaaaaggggttacacaaaacggtaggctaataaccgcgaacccaatcgtcacggacaaagagaaacccgtcaatattgaagccgaacccccgtttggtgaaagttatatcgtaatcggagccggggaaaaagcattgaaattatcatggttcaagaaagggagcagtatcggtaagatgttcgaggctactgctcgtggagctcgaagaatggcgatcttaggtgacacagcatgggacttcggtagcataggaggagtttttacatccgtaggtaaattggtacatcaaatctttggaactgcttacggagtattattctcaggcgtatcgtggaccatgaaaataggcatcggggtactattgacttggctaggtctaaattctagatcaacatcgctcagtatgacttgtatagcggttggactggtcaccttatatctaggggtaatggtacaagccgattctggttgcgttataaattggaaaggacgggaattgaagtgtggctccggaatttttgttacgaatgaagtacatacttggactgagcagtataaatttcaagccgattccccaaaaagattatcggcagcaataggaaaggcatgggaagaaggagtttgcggtattcggtcggcaacgcggcttgagaacattatgtggaagcagatatcaaacgaattaaaccatattctgctcgagaacgatatgaaatttacagttgtcgtaggggatgtcgcaggaatcttagcccaaggcaagaaaatgatccgaccgcaacctatggaatataaatacagttggaaatcatgggggaaagcaaagataattggggcagacgtgcaaaatactacattcatcatagatggaccaaatactccagagtgtcccgatgatcagagagcatggaacatttgggaggttgaagactacggatttggaattttcacaacaaatatatggctcaaattacgagactcatatacccaagtttgtgatcaccgcctaatgtcagcagcaataaaagacagtaaagcggttcatgcagatatgggctattggatagagagtgagaaaaatgagacctggaaattagcgcgagcatcctttatcgaagtgaaaacttgcatctggccaaaatcgcatacactctggagcaacggcgttttagaatcagaaatgatcatacccaaaatctacggaggacctatatcacagcataattataggccgggatattttacacaaactgccggaccttggcatctaggaaagttagaattagatttcgatttgtgtgaggggactaccgtggtagttgacgaacactgtggtaacagaggaccgagcctgagaacaacaacagtcacaggaaaaataatacatgagtggtgctgtcggagctgtacactccctccgttacgatttaaaggagaagacgggtgttggtatggtatggaaatacgtccagtaaaagagaaagaagagaatctcgtcaaatcaatggtttctgctggtagcggtgaagtagatagcttcagcctcggattactctgcatctccattatgattgaggaggtcatgcgctctcgatggtcgagaaaaatgttgatgacaggtaccttagcggtgttctttcttctaattatggggcagttaacttggaatgatctaattaggctgtgtattatggtaggtgcaaacgccagtgatcgaatgggtatgggtacgacgtatctggcacttatggcaacttttaaaatgcgtcctatgtttgccgttggactcttatttcgtagattaacaagccgtgaagtattactattaaccattggactatcacttgtagcatccgtcgaactacctaactccttagaagaacttggagacgggttagcaatgggaataatgatcttaaaactcttgacagacttccaatcgcaccaactatgggctacacttctatcgctgacatttatcaaaactacctttagcctacattatgcatggaaaacaatggctatggtgctatcgattgtttccttattcccattgtgcctatccaccaccagtcagaaaaccacgtggctgccagtgctactagggtccttaggatgtaagccgttaacaatgtttctcatagccgaaaacaaaatttgggggagaaaatcatggcctttaaacgaagggataatggctgttggaatcgtaagtatacttttatcgagcctgttaaagaatgatgtacctttagcaggccctctcatagccggaggtatgttgatcgcctgctatgtaattagtgggtccagcgcagatttgagcctagaaaaagctgcggaggttagttgggaagaagaggctgaacactcaggcgccagccataatatattagttgaagtccaagatgatggtaccatgaaaattaaagatgaagagagggatgacaccttgacaatactgcttaaagctacactacttgcagtgtccggggtttaccctctttctataccagccaccctatttgtatggtatttttggcagaagaagaaacaacgatcaggcgtcctctgggatacaccgagtcctcccgaggtggaaagagctgttctggacgacggaatttacagaattatgcaaaggggattacttggaagatcccaggtaggtgtaggtgtgtttcaagaaaatgtattccatactatgtggcacgttactagaggcgctgttttaatgtaccaaggtaaacgactcgaaccatcgtgggcatcagtaaagaaagatttgatatcttacgggggaggttggagacttcaagggagctggaatactggagaagaagtgcaagtaattgcagtcgaacccggcaaaaacccgaagaatgtacaaacggcacccggaacattcaaaacatcagagggagaagttggagccatagcattagacttcaaaccaggaactagcggaagtcctatagtaaatagggagggaaagatagtgggattgtacgggaacggagtagttacaacttcaggaacttacgtaagtgcaattgctcaagccaaagcgagccaagaaggtcctttgcctgaaatagaggatgaggtattccgcaaacgaaatctaactattatggacttacacccaggttctggtaaaacaaggaggtatttaccagcaatcgtaagagaagcaattaagagaaagctacgaacgctaatcctcgcacctacaagagttgtagcaagcgaaatggcagaggcgttaaagggaatgccgataagataccaaacaacagcagtgaaatcagaacacacaggcaaagagatagtagatctaatgtgtcatgccacgttcacgatgagactactaagtccggtaagggtacctaattacaacatgatcatcatggatgaagcgcatttcactgatccatcatcaatagcagcaagaggttacatttccacacgagttgggatgggcgaggcggcagcaatctttatgactgctacgccgccgggttcagtagaagcattcccccaatctaatgccgtaatccaagatgaagaaagagatataccggaacgttcttggaactccggttacgagtggattacagactttcctggtaaaacagtttggttcgtaccttctattaaatcagggaacgatattgctaactgcctaaggaaaaatggtaagagagtaatacaattatcgagacgaacatttgacacggaatatcagaaaacgaaaaacaatgattgggactatgtcgtaacgacagacattagcgaaatgggcgcgaacttccgcgcggatcgagtcatcgacccacgacggtgcctaaagcccgtcattctgaaagatggaccggagagggtaatcctagcaggacctatgcccgtaaccgtagcaagtgccgcccagagaagaggaagaataggaagaaaccacaacaaagaaggagatcaatacatctatatgggccaaccgctcaacaatgatgaagatcatgcacattggaccgaagcaaaaatgttattagacaatataaacacaccagaagggataatcccagcattgtttgaacctgagagggagaaaagtgcagccatagatggagaatatagattaagaggagaagcacgaaagacgttcgtagaacttatgagacgaggtgacttacctgtctggctctcatacaaagtagcaagcgaaggctttcaatatagcgatagaagatggtgttttgatggagaaaggaataaccaagtacttgaagagaacatggacgtagaaatctggacaaaagaaggggaacgtaagaaactaagacctaggtggcttgatgcgagaacttattcagaccctttagctttgagagaatttaaagaatttgcggcgggaaggagatccgtatcaggagacttaatactagaaataggaaaattaccacaacatctcacacaaagagcccaaaatgctctagacaatttggtaatgctacacaactctgaacaagggggcagagcgtatcgtcatgccatggaagaattgcccgacaccatagaaacgctcatgctattggcattaattgctgtcctaactgggggagtaacactatttttcttaagcgggagaggtttaggaaaaacaagtataggacttctatgcgtcatggcgagtagtgcactgctatggatggcctcggttgagccacattggatcgcagccagtataatattagagttctttttaatggttctactcataccggaacctgacaggcaacggacaccacaagataaccagctagcctatgtagttattggattattatttatgatattgaccgttgcagcaaatgaaatggggctacttgaaaccacgaagaaagatctcggtatcggtcatgtagcggtagaaaatcaccatcatgccgctatgcttgacgtagatttacatccggctagcgcttggactttatatgccgtagcaaccacgataataacacctatgatgcgacacacaatcgagaacactactgcgaacatatcacttactgcaatcgccaatcaagctgctatattgatgggactagacaaagggtggcccataagtaaaatggatataggtgttccgctgctagctttaggatgctatagtcaggttaatccactaactctaacggcagcagttttgatgttagtggcacactacgcaattatcggcccaggacttcaagctaaagcaacacgcgaggcgcaaaaacgcactgcagctgggataatgaaaaatcctaccgtagacggaatagtggcaatcgatctagatcccgtagtttacgacgcgaaattcgaaaaacaactaggacagattatgcttttaatattatgcacttctcagatattattaatgagaactacatgggcactatgcgaaagtattaccctcgcaacaggaccgctaacaacattgtgggagggttcaccgggtaagttttggaatactacaattgcagtatctatggcgaacatatttcgtggcagctatttagctggagccggccttgcattctcattaatgaagagtttaggaggaggaagacgaggcacgggagctcagggagagaccctaggtgaaaagtggaagcgtcagttgaatcaactgagtaaatcagagttcaatacatacaagaggtcaggaataatggaagtcgatagaagtgaagccaaagaaggtttaaaaagaggagaaacgaccaaacacgctgtctcaagaggaactgcaaaacttcgttggttcgttgaaagaaatctggttaaaccagaggggaaagttatagacttaggatgcggtagaggcggttggtcttattactgtgctggtctcaagaaagtcacagaggttaaaggctataccaagggagggcctggacatgaggaacctataccgatggcaacatatggctggaacttagtaaaattacattctggaaaagatgtatttttcatacctccagaaaaatgtgacacgcttttgtgcgacatcggagagtcatcaccaaatccaaccatcgaggagggaaggacgcttcgggtcttgaagatggtggaaccttggttgagaggtaaccaattttgtataaaaatactaaacccgtacatgccatcagtcgtggagacactcgaacagatgcaaagaaaacatgggggtatgttggtacgcaatccgctaagtaggaactcaactcatgagatgtattgggtttcatgcgggacaggcaacatagtaagtgctgtcaatatgacaagtagaatgcttttgaacagatttacgatggcacacagaaagcctacttacgaacgagatgttgatcttggagcaggaacaagacatgttgcggttgaaccagaagtagccaatcttgatataatagggcaaagaatagagaatataaaacatgaacataagtctacttggcattatgacgaagataatccctataagacttgggcctatcatggcagttatgaggtcaagccttcaggcagtgcatcaagtatggtcaatggtgtagttaagttacttactaagccatgggatgtaattccgatggttacccagattgcaatgacggacactacaccatttggacaacaaagagtctttaaagaaaaagtagatacacggacaccgaaagcaaaaagagggaccgctcaaataatggaagttacagcaaagtggttatggggttttctgagcagaaacaaaaagcctcgtatatgtacaagagaagagtttactagaaaggttagaagtaatgcggcaataggagccgtctttgtagatgaaaatcaatggaacagcgccaaagaagcagtagaagatgagaggttttgggatctggtacatagagaacgagaattacacaaacaagggaaatgcgcaacttgtgtttataatatgatgggaaaacgggagaagaaactaggagagtttggaaaagccaaaggatcgcgagcgatatggtacatgtggttaggagcacggtttcttgagttcgaggcactcggctttatgaacgaagaccattggtttagcagagaaaattcattatccggagtcgaaggcgagggactacataaacttggatatatacttcgagatataagtaaaattcccggaggtaatatgtatgcagatgatacagcagggtgggatacacgaataacagaagatgacttacaaaatgaagcaaaaattacggacatcatggaacctgaacacgcattattagcaaaatcgatattcaaattaacgtatcagaataaagtagtgagagtacaacgtccagccaaaaatggcacagtcatggatgtaataagtagaagggatcagagaggctcaggtcaggtcggaacctacggtctaaatacattcaccaacatggaagcccaattgataagacaaatggaaagcgaaggcatattttctccatcggaattagaaacaccaaatctagctggtagagttctagattggctggaaaagcatggtgtggaacgtttaaagagaatggccataagtggagacgactgcgttgtcaaaccaatagatgacagattcgcaactgcgttaacagcattaaacgacatggggaaggtcaggaaagacatcccacaatgggaaccatcaaaagggtggaatgattggcaacaagtaccgttttgttcacatcattttcatcagcttataatgaaagatggtagagaaatcgtggtcccgtgtagaaaccaggacgaactcgttggcagagctagagtttcccagggggctggatggtctttaagagaaaccgcgtgcttgggcaaatcctacgcccaaatgtggcagcttatgtattttcatagacgtgatttgagactagcagctaatgccatatgctctgccgtaccggtagactgggtacccacgtccaggaccacgtggtctattcatgcccatcaccaatggatgacgaccgaagatatgctcagcgtgtggaatagagtatggatagaagaaaatccttggatggaagataagacacatataagtagctggggagatgtaccctatctaggcaaaagagaggatcaatggtgtggaagtttaatcggattaactgctcgagccacctgggccaccaatattcaggtcgctattaatcaggtaagacgacttatcggtaatgaaaattacttagactacatgacatcaatgaaacgatttaaaaacgaatcagatcctgaaggggctttatggtag

SEQ ID NO: 21895 - RNA, 9879 nt, synthetic construct
  misc_feature 1..9879: note = derived and/or modified CDS sequence (opt6) from DENV-1__EU249491__SS-prME
  source 1..9879: mol_type = other RNA
tcagtgacaatgctgttaatgctgatgcccacagcactagcatttcacttaacgacccgtggcggtgaacctcacatgatagtaagtaaacaagaaagagggaaatccttattatttaaaacatcggctggtgttaatatgtgcactctaatagcaatggacctaggagaattatgtgaagacacaatgacatataaatgccctaggataacagaagctgagcccgacgatgtagactgctggtgtaacgcaacagacacttgggtaacgtatggaacatgttcacaaaccggtgaacatagacgggataaacgatccgtggcattagcaccacacgttggactaggtttagaaaccagaactgaaacctggatgagcagcgaaggtgcttggaaacaaattcaaagagtagaaacgtgggccctgaggcatccaggatttaccgtaatagccctatttctcgcccacgctataggaacttctatcactcaaaaaggtataatattcatattattaatgttagtaacacctagtatggccatgcggtgtgttggaatcggaagccgcgattttgtcgaaggattaagcggtgctacatgggttgacgttgtactagagcatgggtcttgcgttacaacaatggcaaaagacaaacctaccttagatatagaacttctgaaaaccgaagtgactaatccagctgtattaagaaaattatgtattgaagccaaaatttcaaatacaacaactgattcaagatgtccaactcaaggagaggctaccttagttgaggaacaggatgcaaattttgtctgtcgtagaacatttgtagatcgaggatggggtaacggctgcggattatttggcaaaggatcactcattacttgtgcaaaattcaagtgcgttactaagctagaagggaagatagtacagtacgaaaatctaaaatattccgtaatcgtaactgtccacactggtgaccaacatcaggtggggaacgaatctaccgaacacggaacaacagccaccatcacccctcaagcgccgacaacagaaatccaattaactgactacggcgctctaacgctagattgcagcccccggacaggtttagattttaatgaaatggtgctattaactatgaaagaaaaatcgtggttggttcataaacaatggttcttagatctaccattaccttggacctctggtgcttccacgagccaagaaacatggaataggcaagatctattagttacattcaaaacggcccacgccaagaaacaggaggtagtagtactaggatctcaagaaggcgcgatgcatacagcactaacaggtgcaacagaaatacagaccagtggcacaactactatctttgctggccatctaaaatgtcgacttaaaatggacaaactcacactaaaaggtatgagctatgtgatgtgtactgggagttttaagttggaaaaagaagtagccgaaacacagcatggaacggtcctagtacaaataaaatacgaagggacagacgcaccctgcaaaataccgttctccacgcaagacgagaaaggggtaactcagaacgggcggctgataaccgccaatccaatcgttacagacaaggaaaaacctgttaatattgaagctgagccacccttcggagaaagttatatcgtgatcggagccggcgaaaaagccttaaaactcagttggtttaagaaaggaagtagtataggcaaaatgttcgaggcaaccgctcgaggcgcgaggcgaatggcgattttaggagataccgcgtgggactttggatcaatagggggtgtcttcacatctgttggaaaacttgtacatcagatttttggaacggcttatggagtcctattcagcggagtatcttggactatgaaaataggaataggtgtcctacttacatggctggggctaaattcccgatcaacaagtctgtcaatgacgtgtattgcagttggattggtaactctttatctgggagcaatggtgcaggctgattctggttgtgtcataaattggaaaggacgagaattgaaatgcggctccggaatttttgtaactaacgaagtacatacatggacagaacaatacaaatttcaagctgatagtccaaaacgtctttccgccgcgatagggaaagcgtgggaagaaggtgtctgtgggatacgttctgcaacccgtcttgaaaatatcatgtggaaacagattagtaacgaactcaaccatattttgctagagaatgatatgaaattgacagtagtagtcggagacgtagcagggattcttggacaagggaagaaaatgataagaccgcagcccatggaatacaaatacagttggaaatcttggggaaaagccaaaataataggagcagatgcacaaaacacgacatttattatagacggacctaacactcccgagtgccctgacgatcaacgcgcttggaacatatgggaagtcgaagattacggctttggtatttttacaactaatatttggttgaaattaagggatagttatactcaagtatgcgatcatcgattaatgtctgcagctattaaggattctaaagccgttcatgcagacatgggatactggatagagtcagagaaaaatgaaacatggaaattagcacgagcatcgttcattgaggtcaagacttgtatatggccaaaatcacatacattatggtccaatggtgttttggagtccgagatgattatacccaaaatttacggtggaccaatatcacaacacaattatcgacctggctacttcacacaaacagcaggaccatggcacttagggaaacttgaacttgactttgacctatgtgaagggacaactgtagtcgttgatgaacattgtggaaataggggtccatcactaagaacaactacagttactggaaaaatcattcacgaatggtgttgtcggagttgtaccctaccaccgcttaggtttcgtggagaagacggctgctggtatggtatggaaatacgacccgtgaaagaaaaggaggaaaaccttgtaaaaagtatggtttccgcagggagcggtgaggttgattcctttagtctaggtctgctgtgcatatcaattatgatagaagaagttatgcgatcgcgatggtcacggaaaatgctgatgaccggcactttagcagtattctttctactaataatgggacaattaacatggaacgatctcatccgcttatgtattatggtaggggcaaacgcatcagacagaatgggtatgggtaccacatatttagctctgatggcaacatttaaaatgagacctatgttcgcagtgggactcctctttcgccgtcttacttcaagagaagttcttctactaacgataggattatcattagtagcgtccgtcgaattacctaattcattagaagaacttggtgacggtcttgccatgggtataatgattcttaaattattaacggattttcaaagccatcagttatgggccacattattgagccttacatttatcaagacgacgttttctttacattatgcctggaaaacgatggcaatggtgctcagtatagtcagtttattcccactatgtctttcaaccacaagccagaaaacgacgtggcttcctgttctactcggtagtctaggatgtaaaccattaacaatgtttttaatagccgaaaataaaatctggggaagaaaatcgtggcccttaaacgaaggaattatggcagttggtatagtctcaatattattgagttctctgcttaaaaacgacgttccactagcaggaccactcattgctggaggaatgctcattgcttgttacgtgattagcggttcatctgcggatttaagcctcgagaaggccgcagaagtcagttgggaagaggaggcggaacattcaggagcatcgcataacatattggtggaggtccaagacgatggaactatgaaaatcaaagacgaagaacgtgacgacacattaacgatactgctcaaggcaacactcctggctgtgagtggagtgtacccactaagtatacctgccaccctgttcgtttggtatttttggcaaaagaagaaacagcgatctggtgtcctatgggacaccccttctccaccagaggttgaacgggcagttttagatgacggaatttatcgtatcatgcagagaggtttattaggccgtagccaagtgggagtgggagtcttccaagaaaacgtctttcacacaatgtggcatgtgacacgtggggcggtattaatgtatcaaggaaagagactagaacctagctgggccagtgttaagaaagacctcataagctatggtggtggatggagattaagaggttcttggaacaccggtgaagaagtacaagtaatcgcggtagaaccgggcaagaatcccaaaaatgttcaaaccgctccggggacatttaaaactcctgaaggcgaagtgggagcaatcgctctcgatttcaaacctggaaccagtggtagtcctatagttaatcgagaagggaaaattgtaggattatacgggaacggagtggttacaaccagtggcacatatgtgtcagccatcgcacaagcaaaagcgtcacaagagggacctttaccagaaattgaagatgaagttttccggaagagaaaccttacaattatggatttacatccaggcagcggcaaaacccggagatatttaccagccatcgttagagaagccattaaaagaaaattgcgtacactaatattagcacccacaagggtggtagcctcggagatggccgaagcattaaagggaatgccaataagatatcaaacaaccgcggtaaagagcgaacacacgggcaaagaaatcgttgacttaatgtgccacgccacatttaccatgcgcttgcttagccccgttagggtgccaaattataacatgataattatggatgaagctcattttacagacccctcatctatcgcagcacgaggatatataagtacgcgtgtcggtatgggagaagcagcagctatcttcatgacagctacaccccctggcagcgtcgaggcttttccacaaagtaatgctgttattcaagatgaagaaagagatatacctgaaaggtcatggaatagcggatatgaatggataacggattttccagggaagacagtatggtttgttcctagtattaagagtggcaacgatatagctaattgcctaaggaaaaatggtaaaagagtaatacaattgtctagaaaaacgtttgatacagaataccagaaaacgaaaaacaacgattgggactacgtagtaacaaccgatattagtgaaatgggagcaaacttcagagcggatcgtgttatagatcctaggaggtgtctgaaaccagtcatattgaaagacggaccagaaagagtaattctggcaggcccaatgcctgtgacagtcgcgagtgcggcacaaagaagaggtcgtattggaagaaaccataataaagaaggagatcaatacatatacatgggacagcctttaaataatgatgaagatcatgcacattggacagaagcgaaaatgctcctagacaacataaacacaccagaaggcattataccggcattgtttgagccggagcgagaaaagtcagctgctgtcgacggtgaatacagacttagaggagaggcaagaaagacatttgtcgaattaatgagacgcggagacttgcccgtttggctcagctacaaagtagcttccgaaggcttccaatattctgatcgacggtggtgctttgacggggaacgcaataatcaagttctagaggagaatatggatgtggaaatatggactaaagaaggggaaaggaagaaacttaggccaagatggttagacgctagaacatactctgatccgttggcactcagagaatttaaggaatttgcagcgggtcgaaggtccgtatcgggagatctcattttagaaattggtaaattgcctcaacacttaacccaaagagctcaaaatgctttagacaatttggtcatgttacacaattcggagcaaggtgggagagcatatagacacgcaatggaagaactaccagacacaatagaaacgttgatgcttcttgcactcatcgcagtactaaccggaggagtgaccctgttctttctatcaggacgtggtctaggaaaaacatcgatcggtttactttgtgttatggcttcatccgtgcttctatggatggcaagtgttgagccacattggatagcagcctcgattattttggagttctttctaatggtcctattaatacctgaaccagatagacaacgaacccctcaagacaatcaattagcctatgtcgttataggtctcctctttatgatactcacagtagcggccaatgaaatgggattactagagacaacaaagaaagatctcggtatcggccatgtagccgtagaaaaccatcatcatgccgcgatgctagatgtagatctacacccagcaagcgcttggaccctctatgcagtagcaacaactattatcacgcccatgatgagacatactatagaaaacacaactgcaaatatcagtttaaccgccattgcgaaccaagcggcgatacttatgggcttggacaaagggtggcccatatctaaaatggacataggtgttcccttattagctctaggctgctatagccaagtcaaccctctcacgctcacggctgcagtgttgatgctggtagcgcattatgcaataataggacctggattacaagctaaagctacccgagaagcacagaaaagaactgccgcagggatcatgaaaaacccaacagtagatgggattgtagccatcgacctggatccggtcgtatacgatgcaaaatttgaaaagcagctaggccaaattatgcttctaatactctgtacttcgcaaatattactaatgcggactacatgggctctttgtgagtcaatcactttagctacgggacccctgacaaccttatgggagggatctccaggaaaattctggaatacaacaatcgctgtgtctatggcaaacatattcagaggatcctacctcgccggagccggtcttgccttcagtctcatgaagtctttaggaggagggagacggggaacaggggcacaaggtgagacacttggtgaaaaatggaaaagacaattaaatcaactgagcaaatccgaatttaacacatataaacgatccgggataatggaagtcgataggtccgaagctaaggaaggtctaaaacgtggagaaacaacaaaacacgccgtaagcagaggcacggctaaattgcgttggtttgtagagagaaatctggttaaaccagaaggaaaggtaatagatctggggtgtggaagaggaggatggagttactattgcgccggtttaaagaaggtcactgaagtaaagggatatactaaaggaggccccggtcacgaagaaccaatccccatggctacctacggttggaatttggttaaacttcactcaggtaaggacgtattctttattcccccggaaaaatgcgatacacttttatgcgacataggagagagcagtcctaatccaaccatagaggagggcagaacattaagagttctaaaaatggtagaaccatggttacgtgggaatcaattctgtataaaaattctgaatccttatatgccctctgtagtagagactctcgaacaaatgcaacggaaacacggaggtatgctagtgaggaatcctcttagtagaaattcgactcatgagatgtattgggtttcttgtggtacaggaaatatcgtttcagctgtaaacatgacatcaagaatgttgttaaatagattcaccatggcacaccgaaaaccaacatacgaacgagatgttgatctgggaactggaactagacatgtagctgtagaaccagaagtagcaaacttagatatcattggccaaagaattgaaaacataaaacacgagcacaaaagcacgtggcattacgacgaagacaacccctataaaacatgggcttatcatggttcttatgaagttaaaccatccggttcggcaagcagcatggtgaacggcgttgttaaattattgaccaaaccttgggatgtaattccaatggtcacccagatcgcaatgacggacaccacaccattcgggcaacaacgtgtcttcaaggaaaaggtagatactaggacaccaaaggccaaaagaggtacggctcaaattatggaggttacagctagatggttgtggggatttttaagcaggaacaaaaagccacgtatctgtacgagagaagaatttactagaaaagtcaggtctaatgcagccattggagctgtattcgtcgatgaaaatcaatggaactctgcaaaagaggcggtcgaagacgagagattttgggacttggtccaccgcgaacgagaacttcataaacaaggaaaatgtgctacatgtgtatacaacatgatgggaaaacgagaaaagaaattaggtgagttcggaaaggcaaaagggagccgcgcgatttggtatatgtggttaggagctagattcctggagtttgaagcgctaggattcatgaacgaagatcattggttctcccgagaaaactctctgtccggagtagagggggaaggattacataaacttgggtatatattacgtgatatatctaaaatacccggagggaatatgtacgccgacgatacggcaggatgggatacacgcattactgaagatgatttacagaacgaagcgaaaattacggacataatggaaccagagcacgcacttctagctaaagcaatattcaaacttacctaccaaaacaaggtcgtaagagttcaaagacccgccaaaaatggaactgttatggatgtaatctctagacgagaccagaggggcagtggacaagttggcacttacggattaaacacgttcactaatatggaggctcaacttatcaggcaaatggagagcgagggcattttcagtcccagtgaactagaaacacccaatctagcagagagagcactagattggcttgaaaaatatggagttgaacgtctcaaaaggatggcaatctcgggtgacgattgcgtagtcaaaccaatagacgatagattcgctactgcgctaactgccttaaatgacatgggcaaagtgaggaaagatattccacagtgggaaccaagtaaaggttggaatgactggcaacaggtgccattttgtagccaccatttccatcagttaataatgaaagatggaagggaaattgtagtaccatgtagaaatcaagacgagctagttggacgagcacgagtatcgcagggggccggatggtctttgagggagacggcttgtttaggaaaaagctacgcccagatgtggcaattaatgtattttcatcggagagatctgagactggctgcaaacgccatatgtagtgcggtaccagtagactgggtcccaacctcgaggacgacatggtctatacacgctcatcatcaatggatgaccacagaagacatgctatcagtgtggaatagagtgtggattgaagaaaatccatggatggaggacaaaacgcacattagcagctgggaagatgtaccttatctaggaaaaagggaagaccaatggtgcgggtccttaattgggttgacggctcgtgcaacctgggctacaaacatacaggtggctattaatcaggtaagaagattgataggaaacgaaaattatctcgactacatgacgagtatgaagaggttcaaaaacgagagtgacccagagggggcactttggtaa

SEQ ID NO: 21896 - RNA, 9879 nt, synthetic construct
  misc_feature 1..9879: note = derived and/or modified CDS sequence (opt6) from DENV-1__EU249492__SS-prME
  source 1..9879: mol_type = other RNA
tctgtgacaatgttactaatgctaatgccaacggcattagctttccatttaacaacaagagggggcgaaccacacatgattgtatcgaaacaagaaagaggtaaatccttattattcaaaacaagtgccggtgtaaatatgtgcactttaatcgctatggatctcggggaattttgtgaagatactatgacttataaatgtcctcgtattacagaagcagaacctgatgacgtagattgttggtgcaatgctacggatacgtgggttacatatggtacgtgctcgcaaaccggagaacaccgtcgagacaaacgtagcgtggcactagcaccgcacgtaggtctcggattagaaacgcgtacagagacctggatgagtagcgaaggagcatggaaacagatccaaagggtagaaacgtgggcactgaggcacccggggttcacagtgatagcactctttctagctcatgcaattggtacgtcaattactcaaaaaggtataatcttcattcttcttatgctggttacaccaagtatggcgatgagatgtgtaggcatcggatctagagactttgtagaaggactgtcaggcgcaacttgggtagatgtggtgctagagcacggctcttgcgtaaccacaatggccaaagataaaccaacattggacatcgaactactcaaaaccgaagtaactaacccagcagtacttagaaaactttgcatcgaagcaaaaatttctaacacaacaacagatagtaggtgtccgacccaaggagaagcaaccctagtagaagaacaggatgcaaacttcgtatgtcgtaggactttcgtagacagggggtggggaaatggatgcggtctttttggaaagggatcactaataacatgcgcaaaattcaaatgcgtaacaaaacttgaaggcaaaattgtgcaatacgaaaatttaaaatatagtgtcatcgttacagtacatactggagatcaacatcaagttggaaacgaatcgacggaacatggaaccacagcgacaattacaccacaagccccaagcacagagattcaactaaccgattacggagcactaacactcgactgctcccctagaactggattagatttcaacgagatggtactacttactatgaaagaaaaatcatggctagttcacaaacagtggtttctagacctacctctaccatggaccagcggcgcctcgacaagccaagaaacatggaataggcaagacctcctggtaactttcaaaacagcacacgcaaagaaacaggaagtcgttgtactcggttcgcaggagggagcgatgcatacagctcttacaggggctactgaaattcaaacatctggaactactacaatttttgcggggcacctaaaatgtcgactgaaaatggacaaactcaccctaaagggtatgagctacgtgatgtgcacaggatcttttaaattagaaaaagaagtagccgaaactcaacatggtactgttctagttcagataaaatacgaggggacagatgctccttgtaaaattccattttcgactcaagatgagaaaggcgtcacccaaaacggaagactaatcactgcaaatccaatagtaacagataaggaaaaacctgtcaatatcgaagcagaaccgccatttggggaaagttacatcgtcataggagctggagagaaagcgctaaaactttcctggttcaagaaaggaagctctataggtaagatgtttgaggcaacagctcgcggcgctagaagaatggcgatattaggcgatacggcatgggattttggatcaattggaggagtcttcacaagtgttggcaaactggtacatcagattttcggaacggcctatggtgtgctattttctggtgtgagttggacaatgaagataggaataggagttttactaacatggctaggacttaattcgcgatcaacgtcactaagtatgacttgtatagcggtaggattagtaacactgtacttaggagtaatggtacaggcggacagcggctgcgtaataaattggaagggccgtgaattgaaatgcggttctggcatttttgtgacaaatgaagtacacacgtggactgaacagtataagttccaggcagatagtccaaaaagactaagcgcagcgattggaaaggcttgggaagagggtgtctgcgggataagatctgcaacacgtcttgaaaatatcatgtggaaacaaatcagcaacgaattaaaccatatcttattagaaaacgacatgaagctaactgtagtcgtaggtgatgtagcgggcatattggcacaaggaaagaaaatgataagaccccaacccatggaatacaaatacagttggaaatcttggggtaaagcaaaaataatcggagctgatgtacaaaatacaacatttataattgatggtccaaatacaccagaatgtcccgacgatcaacgagcatggaacatctgggaagtcgaagactatggattcggcatattcaccacaaatatatggctcaaattgcgtgattcatatactcagatgtgtgatcaccgtcttatgagtgcggcgattaaagattcaaaagcggtacatgctgacatgggatattggatagagagcgagaaaaatgagacttggaagttagccagggctagtttcatagaagtaaagacatgtatatggccaaaatcacacacgctctggtcaaacggagttttagaatcagaaatgataataccaaaaatctacggaggacccatatctcagcataattacagacccggttattttacacaaacagcagggccttggcacttgggtaaattggagttagacttcgatctctgtgaaggaaccacagttgtcgtcgacgaacactgtggcaatcgaggacccagcttgcggacaactacggtaactggcaagatcatacatgagtggtgttgcaggtcctgcacactccctccgttgagattcaaaggagaagacggctgttggtacggtatggaaatcaggcctgtaaaggagaaagaagaaaatcttgtaaaatctatggtatcagcaggttcaggagaagtggactcgttctctttaggcctcctatgtattagcattatgattgaggaagtaatgcgaagccgatggtcaagaaaaatgcttatgacaggaacactagctgtgttctttttgctcatcatgggccaattgacgtggaacgaccttatacgactatgtattatggtgggggccaatgccagcgatcgtatgggaatgggaactacatatctcgcgttaatggcgactttcaaaatgcggcctatgtttgcagttggacttctatttaggcggttaacgagtcgtgaagtattattactaactattggcctctcgttggtcgcttccgtagaactaccaaattcgctagaagaactgggcgatggtctcgcgatgggaatcatgatccttaaattattaacagatttccaaagtcatcagctatgggctacacttttatctatgacctttattcgaactacattttctttacattatgcatggaaaaccatggcaatggttctaagcatagttagtctgtttccactatgtttgtctaccacatcgcagaaaactacatggttaccagtgctgctaggctctttaggctgcaaaccattaactatgtttttaattgcggagaataaaatctgggggagaaagagttggcctcttaatgaagggataatggcagtcggaattgtttctatactactttcatcattgcttaaaaatgatgttccgctagcggggccattaattgcgggtggtatgttaattgcatgttatgttatcagcggatcatctgcagacttgtctttagagaaggccgccgaagtgagttgggaagaagaagctgagcactccggcgcctcacataacattttggtcgaagtacaagatgacggcacaatgaaaattaaagatgaagagagagatgatacattaaccatcctattaaaagctacccttttagcagtctcaggagtgtacccgctgtcaataccagcaacactgttcgtctggtatttttggcaaaagaagaaacaaagaagcggagtcctatgggatacaccttcacctccagaagtacaaagagctgttttagacgacggaatttatcgcataatgcagagagggttactgggtagaagccaagtaggagtaggagtattccaagagaacgtattccatacaatgtggcacgtgacaagaggcgcagtgttaatgtatcaaggaaagcgtttagaaccatcatgggcaagtgtcaagaaagatctaatcagctatggaggaggctggagattgcaaggctcatggaacactggcgaagaggtacaagtaatcgcggtagaacccggtaaaaatcccaaaaatgtacaaacagcaccaggaacatttaaaacgagtgaaggggaggtgggagcaattgcacttgactttaaaccaggaactagcggctcgcccatagttaatcgcgaaggaaagatagtggggttgtacggcaacggagtcgtcacaacatccgggacttatgtgagtgctatagcacaagctaaggcttcacaagaaggaccactcccggagatagaagatgaggtgtttagaaaacggaatttaacaatcatggatttacacccggggagtggcaagacacgtagatatttgcctgccattgtgagagaggccatcaaaagaaaactgagaactttaatattagctcccacgagggtagtagctagcgaaatggcggaagccttaaagggcatgcccatacgataccaaacaacggcagtcaagagtgaacatacaggcaaagaaatcgtggatctaatgtgtcatgcaacattcactatgcgacttctgtcgccagtacgagtacctaactataatatgataataatggacgaagcacactttacggacccctcttcaattgcagcgaggggatacataagtacacgagttggaatgggcgaagctgcagcaatttttatgacagctacacctccgggcagtgttgaggcttttcctcaaagtaacgcggtgatacaggatgaagaaagggacataccagaaagatcctggaacagtggctatgaatggataaccgattttccaggaaaaacggtctggtttgtaccctctataaagagcgggaacgatattgctaactgtctaaggaaaaatggaaaacgagtaatacaattgtccagaaaaacctttgacacagaataccaaaagactaaaaacaatgattgggattatgtggtaactactgacattagtgagatgggtgcaaatttccgtgccgatagagttattgatccaagaagatgtctaaagccggttattctaaaggatggacccgagcgcgtaatattagcaggacccatgcctgtaacagtagcaagtgcagcacaacgcagaggacggattgggcgaaatcacaataaagaaggggatcaatatatatatatgggacagcctttaaataatgatgaagatcacgcgcattggacagaagcgaaaatgttactagataatataaatacacccgaaggaattattccagctttattcgaacccgaacgtgagaaaagtgcagctattgatggtgaatataggttgagaggcgaagctcgtaaaacttttgttgagcttatgaggaggggagatttacccgtatggctaagttataaagtagcctctgaagggtttcaatattccgataggcggtggtgtttcgacggcgaacgaaataatcaagtccttgaagaaaacatggatgtagaaatttggacgaaagagggagagcgtaagaagctcagaccccgatggctagacgcacgcacgtactcagatccgttagcattgagagagttcaaggaatttgcagcagggagaaggtcggtcagcggagacctaatcttggaaatcggcaaattaccccaacatttaacccaacgtgcacagaatgcccttgacaatctcgttatgcttcacaattctgagcaagggggtagagcctaccggcacgcaatggaagagttaccagatacgatagagactttaatgttattagccttaatagcagttcttacaggcggagtgacgctgttcttcttgagtggtaggggactaggaaagacatcgatcggactgttatgcgtcatggcttcaagtgtacttctttggatggcctctgtagaaccgcactggatagccgctagtattatcttagagttcttcttgatggtattactaataccggaacctgaccgtcaaaggacgcctcaggacaatcaactagcatatgtagtgataggactgttattcatgattctaacagttgctgctaacgaaatgggtttattagaaaccaccaagaaagatttagggattgggcatgtcgccgtagaaaaccatcatcatgcagctatgcttgatgtagacctacacccggcgtcagcatggactctttatgcggtagcgacaacaattataactccaatgatgagacatacaatagaaaacacaacggcaaatatcagccttacagctatagcgaatcaagctgcaattctgatggggctagacaaaggctggccgatatctaaaatggacattggagtacctctattggccctaggatgttattcccaggtgaaccctttgacattgacggccgcagtacttatgctcgtggcacattacgcgatcataggaccaggattacaagcgaaagcaactcgggaggcccagaaaaggacagcagccggtataatgaaaaacccaactgtggatggaatagtagctatagacttagaccccgttgtatacgatgcaaaattcgaaaaacaactcggccaaataatgttactaatattatgtacatcacaaattttattaatgaggacgacatgggctttatgtgaatctattacactagcgactggaccgctaacaacactatgggaaggttcccccggaaaattctggaacaccacgatcgccgtatccatggctaatatattcagaggatcatacctggcaggagcaggcttagcattttcattgatgaaaagtttaggaggatcgcgtcgaggtaccggtgcacaaggagaaactctcggagaaaagtggaaacgacaactcaaccaactaagcaagtcggaatttaacacatataaacgcagcggaataatggaagttgatcgaagcgaagcaaaggaaggactcaaaaggggagagacaactaaacacgcagttagccgaggtacagcgaaactaagatggtttgttgaaaggaatctagtcaagccggagggaaaagtaatagatctgggctgtggaagaggagggtggagttattattgtgcaggactcaagaaagtaaccgaagttaaaggttatacgaaaggtggccctggacatgaagaaccaataccaatggcaacatatgggtggaatttagtcaaactgcacagtgggaaagatgttttctttatcccacccgaaaaatgtgacaccctcttgtgtgatataggagagtctagccctaatccaacgattgaagaaggtcggacacttcgagtattaaaaatggtagagccttggctaagaggaaatcaattttgtattaagatacttaatccatacatgccatcagttgtagaaactcttgagcagatgcaacgaaaacatgggggaatgttagtgaggaacccactttctagaaattcgacccatgaaatgtactgggtttcttgcggaacagggaacattgtttctgccgtaaacatgaccagcaggatgctattaaaccgtttcacaatggcgcataggaagcctacgtatgaaagggacgttgacttaggcgcaggaaccaggcacgtagcagtagaaccagaagtcgccaaccttgacattatcggtcaacggatagaaaatataaagcacgaacataaaagtacttggcactacgacgaagataatccatataaaacatgggcatatcacggatcttatgaggtgaaaccgagcggaagtgcttcgagtatggttaatggagtcgtcaagctactaacaaaaccttgggatgtgatccctatggttacgcagatagctatgacagatacgacaccgttcggacagcagagagtatttaaagaaaaggttgacaccagaactccaaaagcaaagagaggaaccgcgcagatcatggaagtaacggctaaatggctttggggctttctttcaaggaacaagaaaccaagaatatgcacacgggaagaatttacgcgaaaggtaaggagcaacgccgctataggagcagttttcgtagatgaaaaccagtggaatagtgcaaaagaagcagtagaagacgaaaggttttgggacttggtacaccgagaaagggaactacataaacaaggtaaatgcgctacgtgcgtatataacatgatgggaaaacgagagaagaaattaggagagttcggaaaggctaagggaagtagagcaatatggtacatgtggctcggtgctagatttctcgaatttgaagctcttggctttatgaacgaagatcactggtttagcagggaaaattccctatctggagttgaaggggaaggcttacataagctaggatatatcttaagagatatatccaaaattcctgggggaaatatgtatgcggatgatactgctggttgggacacccgcataacagaagatgacttacaaaatgaagcaaagataactgatataatggaacctgaacatgcactgcttgctaaaagtatttttaagttaacataccaaaacaaagtagtacgagtacaaagaccagcaaagaatggaacagttatggacgttatcagtagaagggatcaaagaggaagcggtcaagtaggaacttatggactaaatacctttacaaatatggaagcacagctcattcggcaaatggaatctgaaggaatcttcagtcctagcgagcttgatacaccaaatttagccggaagggtattagattggctggaaaaacatggagttgaacgcctaaaaagaatggcaatttctggcgacgattgtgttgtaaaaccaattgatgaccgatttgccaccgcactgaccgccctaaatgatatgggtaaagtgagaaaggacatacctcaatgggaacctagtaaaggttggaatgactggcagcaagtaccattttgttcacaccactttcatcaacttattatgaaagacgggagagagatagttgtgccttgtcggaaccaggacgaactggttgggagagctcgtgtgtcgcaaggagcgggatggtccctcagagaaacagcatgtctgggcaaatcatatgcccaaatgtggcagttaatgtattttcacaggagagacttgcggttagcggccaatgcaatatgttcggccgtgccagtagattgggtacctacaagcagaactacctggagcatacacgctcatcatcaatggatgacaacagaagatatgctaagtgtatggaatcgagtatggattgaagaaaacccatggatggaagacaagacccatatatcatcgtggggagacgtaccctatctaggtaagcgagaagatcagtggtgcggttcactcatagggcttacagcaagagcgacttgggcaaccaacatacaagtcgcaattaaccaagttcgacgcctcctgggtaatgaaaattatctagactatatgacatcaatgaaacgctttaagaatgaaagcggtccggaaggagctctgtggtga

SEQ ID NO: 21897 - RNA, 9879 nt, synthetic construct
  misc_feature 1..9879: note = derived and/or modified CDS sequence (opt6) from DENV-1__EU249493__SS-prME
  source 1..9879: mol_type = other RNA
agcgttacaatgctccttatgcttatgccaacagctcttgcatttcatctaactacgcgaggaggtgaaccccatatgatagtctcaaaacaagaacgcggaaagtcattactattcaaaacaagcgcgggagttaatatgtgcacacttatcgcaatggacctcggtgaattttgcgaagacacaatgacatataaatgtccaagaattacagaagcagagcctgacgatgtcgattgctggtgtaatgcgacagacacatgggtcacatatggaacctgttcacaaacaggggaacatcgtagagacaaaagatcggtcgccctcgcgccgcatgtcggacttggactagaaaccagaacagaaacatggatgtctagtgagggagcctggaaacaaattcaacgtgttgagacctgggcgcttcgacatcctggattcacagtaattgctctatttctagcgcatgcaataggaaccagtattacgcagaaaggaataatcttcatactcttaatgttggtgacaccaagcatggcgatgcgatgtgtaggtattgggagcagggattttgtagaaggactctcaggagcaacgtgggtagatgtggtcttagaacacgggagttgtgtaactacaatggcgaaagacaaaccaacattagatatagaattgttgaaaactgaggtaactaacccagctgtattaaggaaactatgtattgaagcaaagatcagcaatacaactaccgacagccgatgtccaactcagggagaagccactctagtcgaggaacaagacgccaactttgtatgtcgcaggacttttgtcgatagagggtggggtaacggatgcgggctatttggaaaaggatcccttattacatgtgcaaagtttaagtgtgttacaaaattagaaggaaaaacagttcaatatgagaacttgaagtattccgttattgtaacagtacatacgggcgaccaacaccaagttgggaacgaatcaactgaacatggaacgacagctactataacacctcaagctccctccaccgaaatacagctaacggattatggcgcgctaacacttgattgttctccgcgaacaggactagatttcaatgaaatggtacttcttacaatgaaggaaaaatcatggcttgtgcacaagcagtggtttttagacctaccattaccatggactagcggggctagcacgtcacaagagacttggaatcgtaaagacttattagtcacatttaaaacagcccatgccaagaagcaggaagtagtcgtattaggctcccaagaaggagcgatgcatacagccttaacgggagctacagaaatacaaacttctggtacaactactatttttgctggtcatttaaaatgtcggctgaaaatggataaattaaccttaaaagggatgtcatatgtgatgtgcacaggatcttttaaacttgaaaaggaggtagcggagacccaacatggtacagttctagtacaaataaaatatgaaggaaccgatgccccgtgtaaaataccatttagcacacaggacgagaaaggagtgacgcagaacggaagattaatcacagctaatccaatagttacagacaaagaaaaacccgtaaacattgaagctgagccacccttcggtgaatcttatattgtaatcggtgctggagaaaaagcattaaaattgtcgtggttcaagaaagggtcttccataggtaaaatgtttgaggcaacagcgcggggagcgcgccgcatggcaatactaggtgatacagcctgggattttggatcgattgggggcgtctttacgagcgttggaaagctcgtccaccagatctttggcacagcatacggagtactattttcaggtgtgtcctggacgatgaagatcggaataggggtgttattgacatggttaggacttaatagcagaagtacgtcactatccatgacttgtattgcagttggcttagtgactttataccttggagtcatggttcaagcagactctggctgcgtaatcaattggaagggaagagaattaaaatgtggatccgggatattcgttacgaatgaagtccacacatggaccgagcaatataagttccaagctgatagcccgaaaagactatctgcagcaataggaaaggcctgggaggaaggagtgtgcggaatacgaagtgctactagactggaaaatattatgtggaaacaaattagcaacgagttaaatcatatattattggaaaatgatatgaaatttacagtagtcgttggtgatgtggcagggatcctagcacaaggcaagaaaatgataagacctcaaccaatggaatataagtatagctggaaaagttgggggaaggcaaagataattggcgccgacgtccagaatactacatttatcatcgatggcccaaacacaccggaatgcccagacgatcaacgagcatggaatatttgggaggttgaagattatggattcggaatttttacaactaatatatggctcaaactgagggactcatacacccaagtttgcgatcatagattgatgtcagcggcgattaaagactcgaaagccgtacatgcggatatggggtactggattgaaagtgagaaaaatgaaacatggaagctggctagagcatcgtttattgaggttaaaacctgcatctggcccaaatcacatactttatggtcgaacggtgtccttgaatcagaaatgattataccgaaaatatatggagggccaatttcacaacacaactatcgccccggttatttcacgcagaccgccggaccttggcatcttggcaaactagagctagattttgacttatgcgaaggcacaacagtagttgttgacgaacattgtggtaatcgaggtccctctctcaggacaacgaccgtgaccggaaaaataatccacgaatggtgctgtagatcttgtaccttgcctcctcttaggttcaaaggagaagatggctgttggtatgggatggaaattaggcctgtaaaagaaaaagaagaaaatttagtaaaatctatggtatcggcaggttcaggggaagtggacagcttctcactaggtttactttgcataagtataatgattgaagaagtaatgcgaagtagatggtcaagaaagatgttaatgacagggacactagcagtctttttccttctcatcatgggacaactcacatggaacgacttaattaggctttgcataatggtaggagcaaacgctagcgatagaatgggaatgggaactacctatttagcacttatggctacttttaaaatgagaccaatgtttgcggttggcctactgtttaggaggcttacgagtagggaagtcctattactcacaatcggactatcgctggtcgcatcagtagagcttcccaactcattagaagaactgggtgacggtttagcgatgggcataatgatattgaaactattaacagactttcaatcacaccaattatgggcgactttattatcacttacgtttataaagacaacgttttccttgcactatgcctggaaaacaatggctatggtactgtcgatagtaagtttgtttcccttatgtttatcaactacatcacagaaaactacatggttaccggtccttctgggttccttaggctgtaaacctttgacaatgttcctaattgcagaaaataagatatggggaagaaagtcatggccgttaaatgaggggatcatggcagttggcatagtaagtattctgttaagtagccttcttaaaaatgatgtaccactagcgggcccattaatcgcgggaggcatgctaattgcttgctacgtgatttcaggatctagcgcggatttatctctagaaaaagcagcagaagtttcatgggaggaggaagcagaacacagtggagcatcccacaatatccttgtagaagttcaagatgacggaaccatgaaaataaaggatgaagaacgagacgatactcttacgatactcctaaaagcaacgttgcttgcagtcagtggagtatatccgttatccattcctgctacactttttgtttggtatttttggcagaagaagaaacagaggtctggagtgctgtgggataccccatctccaccagaggtcgagagagcagttctagatgacgggatatataggatcatgcaacgcggtttattggggcgctcccaagtaggagtaggagtcttccaagaaaacgtattccacacaatgtggcacgttactcgtggcgccgtacttatgtatcagggcaaaaggctagagccatcttgggctagtgtaaagaaagatctaatctcatatggaggagggtggcgtttacaaggtagctggaatacaggcgaggaggtacaagtgattgcggttgagcctggcaaaaatcccaaaaacgtgcaaacagcacccggaacatttaaaacaagcgagggggaagtcggggcgatagcgttagatttcaaaccaggcacatcaggctctccaattgtaaatcgtgagggcaagatagtcggactttatggcaatggtgtagtgacgacaagtggaacttacgtgagtgcgattgcgcaagcgaaggccagccaagaaggaccgttgccagaaatagaggatgaagttttccgaaagagaaacttaaccataatggacttacatccaggttcggggaaaacaagacgttatttaccggctatcgtaagagaagctattaaacgaaaactaagaacactaatactagcaccgacaagggtggtagcatcagaaatggccgaagctcttaaaggaatgccgataagataccaaactactgcagtgaaatccgagcatacgggtaaggagatcgtcgatctgatgtgtcatgccacctttaccatgagattattaagtccggtccgcgtgcctaattataatatgataataatggatgaggcacactttactgacccatcatctatagcagcaaggggatatatctcaacaagagtaggtatgggtgaggcggctgccatatttatgacagcaacacccccaggaagcgtcgaggcatttccacaatccaacgcagtaatacaagacgaggagcgcgatataccagagaggtcttggaactcaggatacgaatggataactgatttccctggtaaaacagtatggttcgtgcctagcataaaaagtggtaatgacattgctaattgtttacgcaaaaatggaaaaagagttattcaacttagcaggaaaacgtttgatactgaatatcagaaaactaaaaataatgattgggattatgttgtgacaacagacatcagcgagatgggtgcaaattttcgcgcagatcgagtgattgatccacgacgatgcctaaagccggtaattttaaaagacggaccggaaagggtaattctggctggcccaatgccagtaacagtggctagcgcggcacaaagacgtggcaggataggcagaaatcacaataaagaaggcgatcaatacatttatatgggccaaccactgaacaatgacgaagaccatgcacattggacggaagctaaaatgctactagacaacatcaatactccggaaggcataatacctgcactctttgaaccagaaagagagaaaagtgcagcgatagacggagaatacagattacgaggcgaggctagaaagacatttgtagaacttatgagacggggagacttgccggtgtggctttcatataaggtagccagcgaaggtttccaatatagtgatcgtcgctggtgtttcgatggtgaacgcaataatcaagtcctagaagaaaacatggatgttgaaatctggaccaaagagggagagagaaagaaattacgccctaggtggttagatgcgagaacctacagtgatcctctagcacttagggagttcaaagaatttgcagcagggcgtagaagtgtatcaggcgacctaatacttgaaataggtaaattgccgcagcatctcacgcaacgagctcaaaatgccttggacaatttagttatgttacacaattccgaacagggagggagagcgtatagacatgcaatggaagaattgccggatacgatagaaaccctgatgttactcgctttaatagcagtcttgacaggaggagttaccctattcttcttaagcggaagaggcctaggaaaaacttccataggtctgttatgcgtaatggcatcatcggtactgctatggatggcatctgtcgaaccccattggatagctgcatcaataatactagagttctttttgatggtgctacttataccagaacctgatcgtcaacggactccacaagataaccagcttgcatatgttgtaattgggttactgtttatgatattaaccgtggctgcaaacgaaatgggactactcgaaacaacaaagaaagatctaggcataggccacgtagccgtagaaaatcatcaccatgcagcaatgctagatgtagatctacaccccgctagtgcgtggacgctttacgcagttgcaactacaataatcacccccatgatgagacacaccatagagaatacgacagcaaacatatcactaaccgcgatcgcaaatcaagcagcaattttaatgggcctcgacaaagggtggccaatttcgaaaatggatattggtgtaccgctattagcgttgggatgttactctcaagtaaacccgcttaccttaacagcagcggtattgatgctagtggcacactacgcaataatcggacccggtttgcaagcaaaagcaacacgagaagcacaaaagcggactgcggctggaatcatgaagaacccaaccgtagatggcatagtagctatagacctagatcccgtagtatacgatgcaaaatttgaaaaacaactaggacaaataatgctattaatactatgtacttcgcaaattcttctaatgcggactacttgggcattatgcgaatcgattactctggcaactggaccacttactacgttatgggaaggaagccccggtaaattctggaatactacgatagcggtttccatggccaacatttttagaggatcgtatctagcaggagctggactcgcattctcactcatgaagtcattgggtgggggacgaagaggtacgggtgcgcagggtgaaacactaggcgagaagtggaagaggcaattaaaccaattaagtaagtcagagttcaatacatataaacgatcggggatcatggaagtagataggagcgaggcaaaggaggggctgaagcgcggcgagacaacaaaacatgcagtcagtcgaggtacagcaaaattaagatggttcgttgagcgaaatcttgtcaaaccagaaggcaaagtgattgacctaggttgtggcagaggtggatggagttattattgtgcaggactcaagaaagtaactgaagtgaagggttatacgaaaggtggccctggacatgaggaacctatcccaatggctacttatggatggaatcttgtaaagctacactcaggtaaagacgttttctttattccgccagaaaaatgtgacacacttttatgtgacatcggcgagagcagcccaaacccaacaatcgaggaaggtcgaacattgagggtactaaaaatggtagagccttggttacgaggaaaccagttctgcataaaaatacttaacccgtatatgccatcagtagtcgaaacattggaacaaatgcaaagaaaacatggaggcatgttggtacgaaacccattgagccgaaactccacacacgagatgtactgggtatcatgtggaacaggaaatattgtgtccgcagtgaatatgacatcaagaatgttacttaacagatttacaatggcccatagaaagcccacatacgaaagagatgtcgacttgggagcgggaacccggcatgtagcggtagagcctgaagtggctaatcttgatattatagggcaaagaatcgaaaatattaaacatgaacataagtctacctggcactatgacgaagataacccatataaaacttgggcttaccatggctcttacgaggtaaaaccttctggtagcgcaagtagcatggtcaacggagtagtcaaattgctaactaaaccatgggatgtcatcccaatggttacacaaattgcaatgactgatactactccattcggtcaacaacgcgttttcaaggaaaaggtggatacaaggacacccaaagcgaaacggggaacagcccaaattatggaggttactgccaagtggttgtggggttttctatcccgaaataaaaagccgaggatctgtacacgcgaagagtttactagaaaagtgcgaagcaacgctgcaattggcgctgtattcgtagatgagaaccaatggaactccgctaaagaagcggtagaggacgaaagattctgggatttggttcacagagagcgagaactacataagcaagggaaatgcgcaacatgcgtgtacaacatgatgggaaaacgagagaagaaactaggagagttcggaaaagccaaaggaagtagagccatctggtatatgtggcttggagccagatttttagaatttgaagctctaggctttatgaatgaggaccattggttcagtagagaaaactccttatcgggagtggaaggggaaggattacataaacttggatacatactgagggacataagtaaaattcctggtggcaacatgtacgctgacgatactgcgggatgggatacacgtataacagaagacgacttgcaaaatgaagcaaaaataaccgacataatggaacccgaacatgcgctattggctaagagtatattcaaacttacgtatcaaaacaaggtggtgagagtccaacggcctgctaaaaacggcactgttatggatgttatatctaggagggatcaaagagggagtggacaagtgggaacctacggtctcaatacatttacaaatatggaagcacagttaattcgacagatggagtccgaaggaattttcagtccctcagaactagaaactcctaatcttgctggcagagttttggattggcttgaaaaacacggagttgaaaggctcaaacgaatggcaattagtggtgatgattgcgtcgtgaaaccaattgacgatcgctttgcgacagcattaacagccttaaatgatatggggaaggtcagaaaggacatacctcaatgggaaccaagtaaaggttggaatgattggcagcaagtaccgttttgttctcaccattttcaccagctgattatgaaagacggccgcgaaattgttgttccttgtagaaatcaagatgagttagttgggagagcaagagtttcacaaggtgcgggctggtcattgagggacactgcatgtcttggtaaaagttacgcccaaatgtggcagttaatgtacttccatcgcagagatttgaggttagcagcgaatgcaatttgttccgctgtaccggtagactgggttccaacatcaaggacaacttggtctatacatgcccatcaccagtggatgacaacagaggacatgctatctgtgtggaatagggtttggatagaagaaaacccctggatggaagataaaacccatatctctagttggggcgatgtaccatatttagggaaaagagaagaccaatggtgtggatctctaattggtctaaccgctcgagcaacctgggcaactaatattcaggttgcaattaaccaagttcgacgtttaattggtaatgaaaactacctagactacatgacgtccatgaagcgttttaaaaatgaaagtgatcccgaaggagcattatggtaa

SEQ ID NO: 21898 - RNA, 9879 nt, synthetic construct
  misc_feature 1..9879: note = derived and/or modified CDS sequence (opt6) from DENV-1__EU249494__SS-prME
  source 1..9879: mol_type = other RNA
tccgttactatgttgctgatgcttatgccaactgctcttgcattccatttaacaacacgtggaggtgaaccacacatgattgtaacgaaacaagaaagaggtaaatctctgctgttcaaaacaagcgccggtgtaaatatgtgcacacttattgcaatggacttgggagaattgtgtgaagatacaatgacctacaaatgtcctcgtataacagaagcagagcccgacgatgttgattgctggtgcaatgcgacagacacatgggtcacctatggaacatgctcacaaactggagagcatagacgtgataaaagatccgtagcactagctccgcatgtaggcctaggtctagaaacacgaacagaaacatggatgtcatcagaaggggcatggaaacagatccaaagagtagagacatgggctttacgacatccaggttttactgtaatagccctctttcttgctcacgcaattggaacgtccattactcaaaaaggaataatttttattttacttatgctagtcactccctcaatggccatgaggtgtgtaggtataggatctcgagactttgtcgagggtctatcgggagcaacgtgggtcgatgtagtattggaacacgggagctgtgttacaactatggccaaagacaaaccaactctagacatagaattactaaaaacagaagtaacaaatcccgcagttctgaggaaactctgcatagaggcaaaaatttccaacactacgacagacagcagatgtccaacacaaggtgaagccacactaatggaggagcaagatgctaattttgtttgccggagaacatttgtagacaggggatggggtaatggttgtggcttattcgggaaagggagtctaataacctgtgcaaaattcaaatgtgtcacaaaactagaaggtaaaatagtacaatatgaaaacttaaaatattctgtcatagtaacagtccatacaggtgatcaacaccaagtgggaaatgaaagtacggagcacggcacaacagccacaattacaccccaagcaccaacaagcgaaattcaacttactgattatggtgcacttacactcgattgctcccctcggactggtttagattttaatgaaatggttctattgacaatgaaagaaaaatcgtggcttgtccacaagcaatggtttctcgatttgccactgccgtggacgagcggtgcaagtacgtcgcaggaaacttggaacagacaagacctattagttacttttaaaacagcccacgccaagaaacaagaagttgtggtactcggaagccaggaaggtgcaatgcacacggctctcacaggagcaaccgaaatacagacatccgggaccaccaccatatttgctgggcacttgaagtgtaggctcaaaatggataaactgacattaaaaggcatgtcatatgttatgtgtacaggtagctttaaactcgaaaaggaggtcgccgaaactcaacatgggacagttttggtccaaattaaatatgaaggaacagatgctccctgcaagattccattttctacgcaggatgaaaagggagtgacacaaaatggacgattaataacggcgaatccaatcgtaacagataaagagaaacctgtaaacattgaggccgagccgccattcggtgaatcttacatagtcattggagccggcgaaaaagcgctaaagctctcatggtttaagaaaggaagctcgattggcaaaatgtttgaagccacggcaaggggagcgagaaggatggctatcctgggagatacagcttgggattttggatccataggcggagtattcacttctgtgggaaagttagtgcatcaaatatttggaaccgcatatggggttctttttagtggagtatcatggacaatgaaaataggtataggggtattactaacttggttaggactaaatagtcgttcaacaagtcttagtatgacttgcatagcggtagggctagtaactctgtacttaggtgcgatggtacaggccgactcggggtgtgtcattaattggaaaggtagagaattgaaatgtggatctggaattttcgtaacaaacgaagtgcacacatggacggagcagtacaaatttcaagccgattccccaaaaagactcagtgcagcaattggtaaagcatgggaagaaggggtatgcggtatccgttcagctacgagactggaaaatattatgtggaaacaaatcagtaatgaactaaatcacattttattggaaaacgatatgaaatttactgttgtagtgggtgatgtggttggaatattggctcaaggcaagaaaatgataagaccgcaacctatggagcataaatattcttggaaaagttggggaaaagcaaaaataataggtgccgatgtacaaaataccacctttataatcgacggtccaaacactcctgagtgccctgacgaccaacgagcatggaatatttgggaagtagaagattatggatttggtatatttactactaatatctggttaaaacttcgagattcttatactcaggtctgtgaccatagactgatgtcggctgcaataaaggactctaaggcagtccacgcagatatgggatactggatagaaagtgagaaaaatgaaacatggaaactcgcaagagcatcgtttattgaggttaagacatgcatatggccaaaaagccatactctttggtctaatggagtgctagaaagcgaaatgattattccaaaaatctatgggggaccaataagtcaacataattaccgcccaggatatttcacccaaacggcaggtccgtggcacctcggaaaacttgaacttgactttgatttatgcgaaggaactactgtagtagttgacgaacattgtggtaacagaggaccatcgctccgaaccaccaccgtcactggaaaaataatccacgaatggtgttgccgttcttgtacattacctccactacgtttcaaaggcgaagatggttgttggtacggcatggaaattagacctgttaaagaaaaggaggaaaatttagtaaaatcaatggtgtcggcaggtagcggcgaagtcgacagtttttctctaggtttgttgtgtatatcgataatgatagaagaggtcatgagaagtaggtggtccaggaaaatgttgatgacgggaactctcgcagtctttttactgttaataatgggtcagttaacttggaatgatttaatacgtctgtgcattatggtaggggctaatgcaagcgaccggatgggtatgggtactacatacttagcattaatggcaacctttaagatgcggcctatgttcgccgtagggttattatttcggagattaacatcaagagaagtgttattacttactataggactaagcctcgtagcaagtgtagagttacctaacagtttagaggaattaggtgatggattagccatggggataatgattctaaaacttttgacagatttccaatcacatcagctttgggctactcttctgagtctaacattcattaaaacaaccctgtcattacattatgcttggaagacaatggctatggttttaagcatagtgtctttatttccgttgtgtttaagtacaacaagccagaaaactacatggctgccagtactgttaggcagtctaggttgcaaaccactcaccatgttcttaattgcagaaaataagatatggggaagaaaaagttggcctttaaatgagggcattatggcggttggggtagtaagtatattgttatcatccctactcaaaaatgatgttccattggctggtccacttatagctggaggaatgttaatcgcttgttatgtaatctcaggatcaagcgcagacctatctttagaaaaagcagccgaagtctcatgggaagaagaagcagaacatagtggggcctcccacaacatactggttgaggttcaagatgacggtacaatgaaaataaaagacgaggaaagagacgacaccttaacgatactgcttaaagctacattactagcagtttcaggtgtttacccattgtcgattccagctacacttttcgtatggtatttttggcagaagaagaaacaaagatctggagtcttgtgggacacaccaagtcccccagaagtcgaacgagccgtattagatgacggaatttatcgaatcatgcagagaggattactagggagaagtcaggtaggtgttggagtttttcaagaaaatgtattccacacaatgtggcatgttactaggggagctgtgctaatgtaccaaggaaaaaggctagaaccatcttgggcgagtgttaaaaaggatcttatatcctatggagggggttggagattacagggaagttggaacactggggaagaagttcaagtaattgcagtcgaaccgggtaaaaaccccaaaaatgtccaaaccgctccgggaacatttaaaactcccgagggagaagtaggagcaattgctttagattttaagccaggaacatccggatctccaatcgtaaatcgagagggaaagattgtcggactttacggcaatggggtagtaactacttcgggaacttacgtgagcgcaatagcacaggctaaggcaagccaagaaggaccgctaccagaaatagaagatgaagtattcagaaaaagaaatctaacaatcatggatttacatcccgggtcaggaaaaactagacggtacttacctgccatagtacgagaagccatcaagagaaaattgagaaccttaatactagcacccactagagttgtagcttcagaaatggctgaggctttaaaaggaatgcctattagatatcagacaactgcagttaagtctgaacatacaggtaaggagatagtagatcttatgtgtcatgcaacatttacaatgaggttacttagtccagtacgggttcccaactacaatatgattataatggatgaggcccattttaccgacccaagtagcattgcagccagaggatatataagtacaagagtggggatgggagaagcggcagctatcttcatgaccgctacaccccctggaagcgtagaggcatttccacaaagcaatgcggtgatccaagatgaagaaagagacatccctgaacgatcatggaactccggttatgagtggataacggatttcccgggaaaaacagtatggtttgtaccgagtattaaatccggaaatgacattgctaattgtctaagaaagaatggtaaaagagtaatacaattatccagaaaaacctttgacactgaatatcagaaaacgaaaaacaacgactgggattacgttgtcacaaccgacatctccgaaatgggagcaaactttagagcagatagagttattgatccaaggcggtgtctgaaaccggtgattttaaaagacggtcccgagcgagttatacttgccggacccatgcctgtaacagtagcttcggcagcacagcgtcgaggaaggataggacgaaaccataacaaggaaggagatcaatatatttatatgggccaaccacttaacaacgacgaggatcacgcgcattggacagaagctaagatgctcctcgataatataaataccccggaggggataatccccgcgcttttcgaaccagaaagagagaaatctgccgctattgatggagagtacagactaagaggggaggcaagaaagacattcgtagaactaatgcgtaggggagatctaccggtatggttaagttacaaggtcgcaagtgagggctttcagtattcagaccgacgttggtgctttgatggcgaaagaaacaaccaagtacttgaagaaaacatggacgtagaaatttggactaaagaaggtgaacgtaaaaagctacgtccgcgatggctagacgccaggacctattcagatccgttagctctaagagaatttaaagaatttgctgccggacgacgctccgtcagcggagatctaattttggaaattggcaaattgcctcagcacttgacacaaagagctcaaaacgccttagacaatttggtcatgctgcacaattccgagcaaggtggacgggcgtatagacacgctatggaagaattgccggataccatcgaaaccttgatgcttttagcactcatagcagtactaacaggcggtgtgaccttattctttctgtcaggacgagggctaggtaaaacgagtataggccttctttgcgtgatggcaagttctgtactactttggatggcaagtgtggaaccacactggatagcagcaagtatcattctagagttctttttaatggtcttgttgataccagaaccagataggcaacgaacgccacaagataaccaattagcttacgtagtgattggtttattatttatgatactcacagtagcagcaaatgaaatgggtctgttggaaacaactaagaaagatctcggtattggtcatgttgcagtagagaatcatcaccacgctacgatgctcgatgttgatctgcatcccgcgagcgcttggaccctatacgcggttgccactacaatcatcacgcctatgatgcgccacacaattgaaaatacaacagcgaatataagcctaactgcgatagcgaaccaggcagctatactgatgggtttggacaaaggatggcctataagcaaaatggacattggagtaccgctactagcattggggtgttacagccaagtaaatcctttgacactaactgctgcagtgttaatgttggtggcgcactacgcaatcattggtccgggactacaagctaaagcaacaagggaagcacagaagcgtacagcagcgggtattatgaaaaatccgacagttgacggaatcgtggcgatagatcttgatcccgtagtttacgacgctaaattcgaaaaacaattgggacaaattatgctattgattctatgcacgtctcaaatactcttgatgcggacgacatgggcgctttgtgagagcatcacattggcaacgggtccccttactacgctatgggagggttccccagggaaattttggaatacaaccattgctgtatctatggcaaacatatttagaggaagctacttagcaggagcaggcctagcctttagtcttatgaagtcgttgggtggtgggcgacgaggcacgggcgctcaaggtgagacgctaggggaaaagtggaaacgacaattaaatcaattatctaaatcggaatttaacatctataaaagaagcggtatcatggaagtcgatcgatcagaggctaaggaggggttgaagagaggagaaacgacacgccatgccgtgtcgagaggaacagcaaaactaagatggtttgtcgaacgtaatttagttaagccagagggaaaggtcatagatttgggctgcggaagaggcggatggtcttactattgcgcaggactaaagaaagtaacagaggtaaagggatataccaaaggaggacccggccatgaagaacccattccgatggccacatatgggtggaatctcgtgaaattgcactcgggaaaggatgttttctttactccacccgaaaaatgtgatactttactctgcgacatcggagaatccagtcctaacccaacgatagaagaaggcaggacacttagagttttaaaaatggtcgaaccatggctaagaggaaaccaattctgtattaagattcttaatccatacatgccttccgtggtagaaaccctcgaacaaatgcaaagaaagcacggcggaatgctagtaagaaatccactatctcgcaacagtacccatgaaatgtattgggtatcatgtggcaccggaaatattgttagtgcagtcaatatgacatctcgaatgcttctcaataggtttactatggcgcatcgaaaacctacttatgaaagagatgtggacttaggtgctggcacgcgtcacgtagctgttgaacccgaagtagccaatttagatataatagggcaaagaatcgagaacattaaacatgagcacaaatcaacttggcattacgacgaagataacccgtacaaaacatgggcctaccacggttcgtacgaagttaagccttcaggttccgcgtcatcaatggtaaatggagtcgttaaattattgaccaaaccatgggatgttataccaatggttacgcaaatagccatgacagatactacaccattcggtcaacaaagggtctttaaagaaaaagtggatacgagaactccaaaagcaaagagaggaacggcccagattatggaagtaacagccagatggctttgggggtttttgagtaggaacaaaaagccgcggatctgtacaagagaagagttcaccagaaaagtaagatcgaacgctgccattggagctgtgtttgtagacgaaaatcaatggaatagcgcaaaagaagcggtcgaagatgaaagattttgggaccttgttcaaaaagaaagagaacttcacaaacaaggtaaatgcgcgacatgtgtctataatatgatgggaaaaagagagaagaagctgggagaatttggaaaagcgaaaggttcccgggcgatttggtacatgtggttgggcgccagatttttagagtttgaagccttgggattcatgaatgaagaccactggttctcaagagaaaattctcttagtggagtagaaggagagggtttacacaaacttggttatatcttaagagatatctctaaaatacccggtggaaacatgtatgcagacgataccgctggatgggatacaagaataactgaggacgaccttcaaaatgaagcaaaaataaccgatataatggaacctgaacatgcgttgctcgcgacatcgattttcaaattaacttaccagaataaagtagtacgggtacaacggccagcaaagaatggaacggtgatggatgttatcagcagaagagaccaaagggggtcgggtcaagttggaacatatggcttaaatacctttacgaacatggaagcacaattaatccggcaaatggagagcgaagggatcttctcaccttcagaattagaaataccaaatttagccgaaagagtacttgattggttagagaagtacggagtggaacgacttaaacgaatggcaatcagcggagatgattgtgtagtcaaaccaattgatgacaggttcgcaacagccctgactgccctaaatgacatgggtaaggtgagaaaagatgttccacaatgggaaccgtctaaaggatggaatgattggcaacaagttccattctgtagccatcactttcaccaattaataatgaaagatggccgtgaaatcgtcgtaccgtgtagaaatcaagatgaacttgtgggtcgagctagagtcagtcaaggggcggggtggagcctacgggaaacggcgtgtcttggaaagtcttatgcgcaaatgtggcaactgatgtacttccacaggagagacttacgattggcagctaacgccatttgctcagcagtcccagtagactgggtacccacatcgcggacaacgtggagtatacatgcgcatcatcaatggatgacaacggaggatatgttaagtgtatggaatagagtatggatcgaagaaaatccatggatggaagacaaaacacacgtaagttcttggggagacgtaccgtacctaggtaaaagggaagatcaatggtgtggcagcctaataggattaacagcacgggcaacatgggcatcaaatatacaggtggctatcaaccaagtaagaagacttatcggcaacgaaaattatctagattgcatgacatcaatgaagagatttaagaacgagggtgacccagagggggcactatggtaa

SEQ ID NO: 21899 - RNA, 9879 nt, synthetic construct
  misc_feature 1..9879: note = derived and/or modified CDS sequence (opt6) from DENV-1__EU249495__SS-prME
  source 1..9879: mol_type = other RNA
agtgttacgatgttacttatgcttatgcctacagcacttgctttccacctaacaactagagggggagaaccacatatgatcgtgacaaaacaagaaagaggcaaatcgttactcttcaaaacgacagccggtgtgaatatgtgtaccctaatagcaatggatctaggtgaactatgtgaagataccatgacatataaatgcccccgtattacagaagcggaaccggacgatgtcgactgttggtgtaatgctactgatacatgggtaacatacggaacctgttctcaaaccggagaacatagacgagacaaaagatccgttgcacttgcaccccacgtaggtctggggcttgaaactagaacagaaacatggatgagctctgaaggtgcttggaaacaaattcaacgtgtcgaaacttgggcgctacgtcaccctgggtttacggtgatcgcactctttctcgctcatgcaattggcacaagtataactcaaaaagggattatcttcatattgcttatgcttgtaactccctcaatggcaatgcgatgtgtcggcataggatcacgggattttgtggaaggcctaagtggagcaacatgggttgacgtcgtgctagaacatggcagttgcgtaactactatggccaaagataaacccactctcgatatagaattgctaaaaacagaagttaccaatccagcagtcctaagaaaactttgtattgaagcaaaaatctccaacacaaccaccgattcaagatgccccacccaaggagaagcaactttaatggaggagcaggacgcaaattttgtgtgccgaaggacctttgtagatcgaggttgggggaatggatgtggtctttttggcaaaggatcgctaatcacttgtgctaaatttaaatgtgtgaccaagttagaaggaaagatagtgcaatatgaaaatctcaaatatagcgtaattgtaactgtacatacaggagaccaacatcaggttggcaacgaaagtaccgaacatggtacaacagctactattactccacaagcacccacatctgagatacaactaaccgactacggtgcattaactctggactgttctcctcgaactggcttagattttaatgaaatggtattgcttaccatgaaggagaaatcatggctagtccacaaacaatggtttctagacctgcccctaccgtggacctcaggtgctagtacatcacaagaaacctggaatcgtcaggatttattggtaacgttcaaaacagctcacgctaagaaacaggaggttgttgtgcttggcagtcaagaaggcgctatgcatactgcattaacaggtgcaacagaaattcagacatcgggaactacgacaatatttgcagggcacttaaaatgtagactaaagatggataaacttacgttgaaaggaatgagctatgtaatgtgtaccggatcctttaaactagaaaaagaagtagcggaaactcagcatggtacggtattagtccaaataaaatatgagggaaccgatgcaccttgtaaaatacccttttctacacaggacgagaaaggcgtaattcagaacggtaggctaataacagcgaatcctattgtaacagataaagaaaagcccgtcaacattgaagctgaaccgccttttggggagtcctacatagttatcggagttggagaaaaagctctaaagctaagctggtttaaaaagggatccagtataggtaagatgtttgaagctacagcaaggggagctcgcagaatggcaattttaggtgacacagcgtgggattttgggtcaataggcggagtcttcacttcggtgggaaagttagtccaccagatattcgggacagcatacggagtattatttagcggggtatcgtggacgatgaaaatcggaataggtgtattactaacttggctcggattaaatagccggagtacaagcctaagtatgacttgtattgccgtcgggcttgttacgttgtatcttggggtcatggttcaagcagattctggatgtgttattaattggaaaggaagagagctaaagtgcggatcaggtatttttgtgactaatgaggtacatacttggactgaacaatataaattccaggcagatagtcctaaaaggctcagcgctgccatagggaaggcatgggaagaaggtgtatgcggaataagatcagcaacacgactggaaaatattatgtggaagcaaatttcaaatgaactaaatcatattttactagaaaatgatatgaaatttaccgtagttgtgggagatgttgtaggaatcctagcacaaggaaagaaaatgatcagaccacaaccaatggaacacaaatactcatggaaaagctggggtaaagcgaaaattatcggtgccgacgtacaaaatactacttttatcattgatggacctaatactcctgaatgcccagatgatcaaagggcttggaacatttgggaggtagaagattacggctttggtatctttaccactaacatttggctaaaattgcgagacagctatacgcaagcgtgcgaccacaggcttatgagtgccgcaataaaggactcaaaagccgttcatgcagacatgggctattggatagaaagtgagaaaaatgagacttggaaactagcacgcgcaagttttatagaagtgaagacttgtatatggccgaaaagccatacgttatggagcaacggggtccttgagtctgaaatggtaattcccaaaatttacgggggacccatctcccaacataactacaggccaggatacttcacacaaacagcaggcccctggcacttaggaaaactggaactagactttgacctttgcgaaggcactacggttgtcgttgatgaacactgtggtaacagaggaccatcactaagaactacaactgttaccgggaaaattatccatgagtggtgctgtcgatcgtgcactcttccacccctacgattcaaaggagaagatggttgttggtatgggatggaaatcagaccggtcaaggaaaaagaagaaaatcttgttaaaagtatggtttcagccggctctggagaagtagattccttcagcttaggtttattatgcatatcaattatgattgaagaagtaatgagatcacgatggtcgagaaaaatgctaatgacaggaacactcgcggtatttctattattaataatgggccagttaacatggaatgatttaataagattatgcattatggtaggagcaaatgcatcagaccggatgggaatgggaaccacctaccttgcacttatggccacatttaaaatgagacctatgtttgctgttggccttttgtttagaagactaacaagtagggaggttctcttgttaactattggtttaagtttagtagcatctgtggaattgccaaattccctagaagaactaggagatggactcgctatgggaatcatgatcttgaaacttctcactgatttccaatcacaccagttgtgggcaaccctcctctctttaacattcattaaaactacattaagcctccactatgcctggaaaactatggcaatggttttgtcaattgtgtcactgtttcctttatgcctatcaacaacaagccagaaaacaacatggttgccagtcttactaggatcgttgggatgtaagccattaactatgtttctaatagccgaaaataagatctggggccgcaaaagttggccgctgaatgaaggaataatggctgtgggcgtagtttctattctcctgagttcccttttgaaaaacgatgttcctctagcgggacctcttattgctgggggtatgctcatagcgtgttatgtaataagcggatcgagtgccgatcttagtctagaaaaggctgctgaggtaagctgggaggaggaagcagagcattcaggagcgtcccataatatacttgtagaagtacaagatgatggaacaatgaaaatcaaagacgaggagagagatgatacattaaccatcctgcttaaagcaaccttattagcagtgagcggcgtgtatccgcttagtataccagctacgctttttgtttggtatttttggcagaagaagaaacaaagatctggggtattgtgggatactcccagcccaccagaggtagaaagagcagttcttgatgacgggatatataggattatgcaacggggtcttctaggtcgttcacaagtcggggtcggcgttttccaagaaaatgtgttccatactatgtggcatgtaacaagaggagcagtgctgatgtatcaaggtaaaagactagaaccttcgtgggcttctgttaagaaagatttaatatcctatggaggagggtggcgtctccaaggatcatggaatactggagaagaagtgcaggtaatagcagtagaacctggcaaaaatcctaaaaacgttcaaactgcaccaggaacatttaaaacaccggagggagaagttggggccatagctttagactttaaaccaggcacgtcgggctcacccatagtaaatagggagggaaaaatagttggtctatacggtaacggagtagtaacaacatccggtacgtacgtaagtgctatagcgcaagctaaagcatctcaagaaggtcctctaccagaaatagaggacgaggtatttaggaaacgtaatctaacaataatggatttacatccaggcagtggtaaaacgcgaagatatcttccagctattgtccgggaagccatcaagcgaaaactcagaaccctaattttagcaccgacacgggtagtagcctccgagatggccgaagcattgaaaggtatgcccataagataccaaacaacagccgtcaagtcagaacacaccggaaaggaaattgtcgatctaatgtgccatgccacatttacaatgcgattgctgagcccagtacgcgtacctaattacaatatgataatcatggatgaagcacactttaccgatccgtcgtcaattgcggctcgtggctacatatctacgcgggtagggatgggagaggcagctgcgatattcatgactgcaaccccacctggaagcgtagaagccttcccacaatcaaatgccgttatccaagacgaagaaagagatatacctgaacggtcctggaactcaggatacgaatggatcacagactttccaggtaagacagtctggtttgtcccatcaattaaaagtgggaacgatatcgcgaactgcctacgcaagaacggtaaaagagtgatccaattgagtcgtaaaacgtttgatactgaatatcagaaaacgaaaaataacgactgggattatgtcgtcacaactgacattagcgaaatgggggccaatttccgggctgaccgagtaatagatccaagacgttgtctaaaacctgtaatccttaaagatggacctgagcgtgtaatcttagcaggtccaatgccggtaacagtggcatcggccgctcaacgccgaggaagaatagggcgaaatcacaataaagagggtgaccagtatatctatatggggcaacctcttaacaatgacgaggaccatgcacattggacagaagcaaaaatgctccttgacaacattaatactccagaaggaatcatccctgcgttatttgaacctgaaagagaaaaatcagcagctattgacggagaatatcgcctaagaggtgaagcacgtaaaacctttgtagaattaatgcgacgtggcgatttaccagtctggttatcctataaagtcgcatcagaaggatttcagtattctgacagacgctggtgcttcgatggggaacgaaacaaccaggtattagaggaaaatatggacgtggaaatttggacaaaagagggagaaaggaagaaattacgaccgcgatggctagatgcgaggacatattcggaccctcttgcgctaagagaatttaaagagtttgctgcgggccgaagaagcgtatcaggggacctaattcttgagatcggaaaattacctcaacatctgactcaaagggctcagaatgcattagacaacttagtgatgcttcacaatagcgaacaaggaggccgagcctacagacacgccatggaagaactgcctgacaccatagaaacactaatgctccttgcgctaatcgcagtgcttactggcggagtgacattatttttcctctcaggacgcggcttagggaagacaagcattgggctattatgtgtcatggcgtcatctgtattattatggatggcaagcgtagagccccattggatcgctgcatcgataattcttgagttcttcctaatggttcttctcatacctgaacccgatcgtcaacgtacaccacaggataatcaacttgcctacgtagtaatagggttgttatttatgatcctcacagttgcagcaaacgaaatgggactattagaaacgaccaagaaagatctgggaataggtcatgtggcagtagagaatcatcaccacgcaaccatgctagatgtagacttacaccccgcaagtgcgtggaccctatacgcagttgctacaacaataattactcccatgatgagacacacaattgaaaatactactgccaatataagccttacagcaatagctaatcaggcagccatccttatgggacttgataaaggatggccaatttcaaaaatggacataggagtaccattgttagcactcggttgttatagccaagttaacccactaacattaacagctgcagtcctaatgctagtcgcacactatgcgataattggccctgggctgcaggcgaaagccacgcgcgaggcgcagaaacggactgcagctggaataatgaaaaatccaacagtggatggtatagtagcaatagatcttgatccggtagtctacgatgcaaaatttgaaaaacagttgggacaaatcatgctactaattctatgtacttctcaaatcctactaatgcgtaccacatgggcgctgtgcgaatccataacattagctactggacccctaacgacattatgggaaggtagcccaggaaagttctggaatacgacgatagcggttagcatggctaacatatttcgaggcagttaccttgctggtgccgggcttgccttcagtcttatgaaaagcctagggggaggacgcagaggcacaggtgcacaaggagaaacactaggagagaaatggaagagacaactcaaccagctgtccaaaagtgagttcaacatatataaacgttcaggaatcatggaggtcgaccgaagtgaagcgaaagaaggcttaaagagaggggaaacgactcggcatgcagtatcacgtggtacagctaaactgagatggtttgttgaacgtaatctagtaaaacctgaaggtaaagttatagatctaggatgtggccgtggagggtggtcttactactgtgcgggcttaaagaaagtcactgaagtgaaggggtatactaaaggaggaccaggacacgaggagccaataccaatggcgacatatggttggaacttagtgaaacttcacagcggtaaagatgtattctttacaccaccggaaaagtgcgacacgttgttatgtgatatcggggagagtagtccgaatccgactattgaggaaggcagaacactaagagtgctaaaaatggtggaaccttggcttagaggaaatcaattttgcattaagatcctaaatccctatatgccatccgtcgttgagactctagagcaaatgcagaggaaacacggcggtatgttagtacgcaatccattgtctaggaacagtacacatgaaatgtactgggtctcctgtggaaccggcaatattgtaagtgcggttaatatgactagcagaatgctattaaatagatttacgatggcgcataggaaaccaacctatgaacgagatgttgatctcggcgccggtaccagacatgtagctgtggaacctgaggtcgcaaaccttgatataataggacagcgcatagaaaatataaaacatgagcataagagtacctggcactatgatgaagacaatccatataaaacatgggcctatcatggaagttacgaggttaaaccaagtgggagtgcttcatcaatggtaaatggtgtcgtaaaattattaactaaaccatgggatgttatcccaatggtcacacaaatcgcaatgacagacaccactccttttggccaacaaagagtattcaaagaaaaggtcgacaccaggacacctaaagcaaagaggggaactgcgcaaataatggaagtgactgctagatggctctgggggtttttatccagaaacaagaaaccacgtatctgtacacgcgaagagttcacaagaaaagttaggtcaaatgctgccatcggtgcggtgtttgtagacgaaaaccaatggaactcggctaaggaggctgtggaggatgagagattttgggatttagtacagaaagaaagagaattgcataaacaaggtaaatgtgcaacgtgcgtgtacaacatgatgggaaaaagggagaagaaactaggtgaatttggtaaagcaaagggatcgagagctatttggtatatgtggttaggggctagatttctcgaatttgaagcattaggctttatgaacgaagatcattggttctcacgtgaaaattcactctctggcgtggaaggtgaagggcttcacaaattaggttacatcttaagagacatttctaaaataccaggtggaaacatgtatgccgacgatacagctggatgggacacaagaataacagaagacgatctccagaatgaggcaaagatcacagacatcatggaaccagaacatgctttgctagcaacttcaatctttaaactaacataccaaaacaaagtcgtgagagtacaaagaccggctaaaaatggaactgttatggatgttatctctaggagagaccaaagggggtcaggacaagtgggcacatacgggttaaatacatttactaacatggaagcgcaactaatacgacagatggagagcgaagggatatttcttccctcagaattagagacaccaaatttggctgaacgagtattagactggcttgaaaaacacggcgtcgaacgtctaaaacgaatggctattagtggggacgattgtgtagtaaaaccaatagatgatcggtttgctacagcgctcacagctttaaatgatatgggaaaagttagaaaagacattccccaatgggaaccatcaaagggatggaacgattggcaacaagtgcctttctgctcacaccattttcaccagttaattatgaaagatggaagagaaattgtcgtaccttgccgtaatcaagatgagctagtagggagagcaagggtatcacaaggtgctggttggtctctacgtgagacagcgtgtttaggtaagtcttacgctcaaatgtggcaattgatgtatttccaccgccgagacttgagattagcggctaatgccatatgtagtgcagttccggtggactgggtgcccacgagtagaacaacatggagcatccatgctcaccatcaatggatgacaacggaagatatgcttagcgtttggaaccgcgtatggatagaggagaacccatggatggaagataagacacatgtaagctcatggggagatgtaccttatttagggaagagagaagaccagtggtgtgggagcctaataggactaacagcgagagcaacatgggcatcaaacattcaagtagccataaatcaagtgagaagattgataggaaatgaaaattacttagattatatgaccagcatgaaacgttttaagaatgagggcgatcccgagggagctctttggtag

SEQ ID NO: 21900 - RNA, 9879 nt, synthetic construct
  misc_feature 1..9879: note = derived and/or modified CDS sequence (opt6) from DENV-1__EU482794__SS-prME
  source 1..9879: mol_type = other RNA
tcggtaactatgcttttaatgcttatgccgacagcattagcattccatttaactacaagaggtggagaaccacacatgatagtaactaaacaagagagaggtaaatcattgttatttaaaacaagtgcgggtgtaaatatgtgcacattaatagcaatggacttgggagaactgtgcgaggatacgatgacttacaaatgccccagaataacggaagcggaacctgatgatgtagactgttggtgtaacgcgaccgacacatgggtaacctatggtacttgtagccaaaccggggagcacagacgcgataaaaggagtgtcgccctagcaccccatgttggattaggtttagaaacaagaacagaaacctggatgagtagtgaaggtgcttggaaacaaattcaacgagtagagacgtgggctttaagacatccgggatttacggtaatagcattgttcttggcccatgcgataggtacatctataactcaaaaaggtattatctttatactgcttatgctcgttacgccctcaatggctatgagatgcgtcggaatcggtagtagagatttcgttgaagggctatctggagctacatgggttgatgtggtcttggaacatggttcctgcgtaactacgatggcgaaagacaaacctaccctagacatcgaattattgaaaactgaagtcacaaaccctgccgtattgagaaaattatgcatagaagccaagatctcaaacactacgactgatagtagatgtcctacacaaggggaagcaacacttatggaggagcaagacgcaaacttcgtatgccgaaggacatttgtcgatagaggttggggaaacggctgtggattgtttggaaaaggatccttaatcacatgtgcaaaattcaaatgtgtaacaaaattggaaggaaaaatagtccaatacgaaaatctaaagtattcggtaatagttacagttcacacaggagaccaacaccaagtaggaaatgaatcaaccgaacatggaacaacagccactattacaccacaagctcccacgtctgagattcaattaacagattatggcgcattgacgttggattgctcaccgcgcacaggtcttgattttaatgaaatggtgttacttacgatgaaagaaaagtcttggctagtacacaaacaatggtttttggatctgcctcttccttggacaagtggcgccagtacctcacaagaaacttggaacagacaggatctgttagtcacctttaagacagctcacgcaaagaaacaggaggtggtagtcctcggctcccaagaaggagcaatgcatacagcacttacgggtgcaaccgagattcagacctcaggtacgactacgatattcgccggccacttaaaatgcaggctaaagatggataagctaaccctaaaagggatgagttatgttatgtgtacagggagtttcaagttagagaaggaggtagccgaaacgcaacatggaacagtcttggttcaaattaaatatgaaggtactgacgccccctgtaaaattcccttcagcacgcaagacgaaaaaggggtcacacaaaacggccgtcttattactgcaaatccaatagtgactgataaggaaaaacctgttaatatcgaagcagaaccaccatttggagagagctatatcgtcatcggtgctggagaaaaggctttaaaactgtcgtggttcaagaaagggagttccatcggtaagatgttcgaagctacggctagaggagcgagaagaatggctatcttgggagatactgcctgggactttggttcagtaggaggcgtatttacgtcagtgggtaagttagtacatcagatttttggaaccgcatatggggtactattttccggagtttcgtggactatgaaaattggaataggcgtcttattaacctggcttggcttaaattctcggtccacaagtctaagtatgacttgtatagcagtgggacttgtaacgctctatttgggggtaatggtacaagcagatagtggatgcgtaatcaattggaaaggtagagaactaaagtgtggatccggaatcttcgtgacaaatgaggtacatacttggacagaacaatataaatttcaagccgattcaccaaagcgtttaagcgcggctatagggaaagcatgggaagaaggtgtttgcgggatcaggtcagcaacacggttagaaaatataatgtggaaacagatctcgaacgaactgaaccatatattattggaaaacgacatgaaattcacagtcgtggtaggagatgttgtaggaatactagcacaaggcaaaaagatgattcgaccacagcctatggaacataaatattcctggaaatcctggggtaaagcgaaaataattggagctgatgtacaaaatactacattcatcatagacggaccgaatacccctgaatgtcctgacgatcaacgagcttggaatatttgggaagtagaagattacggttttggcatcttcacaactaacatatggctcaaattaagagatagttatactcaagtttgcgaccacagactaatgagtgcagctattaaggactcaaaggctgtacacgcggacatgggttattggatagaatcggagaaaaacgaaacgtggaaacttgcgagagcatcattcatagaagtaaagacatgcatatggcctaaatctcataccctctggagtaacggtgtgctagaaagcgagatgataatacccaaaatatatggaggtcctatttctcagcataattatcggcccgggtactttacacaaactgccggaccatggcatctagggaaattagaattagattttgatctttgcgagggaactacagtagttgttgacgaacattgtgggaatcgaggacccagcttacgaacaacaacagtcacaggcaaaataatacatgaatggtgttgtagatcatgtaccctcccacccttacgttttaaaggcgaggacggatgctggtacggaatggaaattagacccgtgaaagagaaggaagagaatttagtaaaatcaatggttagtgcagggtcgggtgaagtcgattcctttagcctaggcttactgtgcatttcaataatgattgaagaagttatgcgatcccgatggagtagaaaaatgttaatgactggtaccctagcagtattcttattgttgattatgggacaactaacgtggaacgacttaatacgactttgcattatggtaggcgcgaacgcttcagatcgcatgggtatgggaacaacctatctagcgctaatggcaacattcaaaatgcgtcctatgttcgccgtgggcctactttttagaaggctaacatcacgagaggtacttctattaacgatcggcttatcgttagtagccagcgtagaattaccaaacagtcttgaggaactgggagatggccttgcgatgggcatcatgatcttaaaattattaacggactttcaaagtcatcagctctgggctacgttactttcactaacgttcattaaaacaactcttagtctacattatgcgtggaagacgatggcaatggtgttgagtattgcatcactctttccgttatgtctttcgactacatcacagaaaactacatggcttccggttctgctaggtagcttgggatgtaaaccattaacaatgtttttaatcacggaaacaaaaatttggggtcgcaaaagttggcctctaaatgaaggtataatggcagttggcgttgtttcaattctattgagttcacttctcaaaaacgatgtaccactagctggaccgttgatagcaggcggaatgctaatagcatgttatgtgataagtggaagttcagcagatctttcgctagaaaaggctgctgaagtaagttgggaagaggaggcggaacatagtggcgcaagtcacaacatacttgtagtagtccaagacgacggaactatgaagataaaagacgaggaacgagatgacacactcaccattttactcaaagcaactcttctcgcagtatctggagtatacccattaagtattccagcaacactattcgtatggtatttctggcagaaaaagaaacaacgtagcggtgttttatgggatacaccttcgccaccagaagttgaacgcgcggtgctagacgatggcatctatcgaataatgcaaaggggtctactaggtaggagccaggtgggagtaggagtgtttcaagagaatgtatttcataccatgtggcacgtaacgagaggagcggttttgatgtaccagggaaaaagattagaaccctcctgggcaagtgtcaagaaagatcttatatcatatggtggcggttggcgacttcagggatcatggaacacgggcgaggaagttcaggttatcgctgtagaaccaggcaaaaaccctaaaaatgtacaaacagcgcctggcacttttaaaacacccgaaggcgaagttggggcaatagcgttagactttaaaccgggaacttcaggttctccaatagtgaatagagaaggaaaaatagttgggctatacggaaatggagttgtgaccacttctggaacatatgtaagtgcgatcgcacaagcgaaagcatctcaagaaggaccgctgccagaaatagaggatgaggttttccgcaaaagaaatttaactataatggacctacatcccggatccggaaaaacgaggcgttacttaccagcgatagtgagagaagccataaagcgtaaactaagaactttaattctagcaccaacgagggttgtggcatcggaaatggcggaagcactaaaaggaatgcccatcagatatcaaactacagccgtaaaatcagaacatacgggtaaggaaattgtagatcttatgtgccacgcgacttttaccatgcgccttttatccccagtacgggtaccaaattacaatatgataataatggatgaggcacactttacagatccgtcttccatcgccgctagaggctacattagcactcgcgtagggatgggcgaagcagcagcaatattcatgacagccactcctccaggatccgttgaagcattcccacagagtaacgcagtgatacaggacgaagaaagggatataccagaaagatcatggaactcgggatatgaatggatcaccgatttcccgggcaaaactgtttggttcgtccctagcattaaaagcggaaatgatatcgcgaactgcttaaggaaaaatgggaagagagtgatacagctatcaagaaaaacgtttgacacggaatatcaaaagaccaaaaataacgattgggattatgttgtaacaacagatataagcgaaatgggtgctaactttagggctgaccgagtgatcgacccaagacgatgtttaaaaccagtcattctgaaagatggccctgaacgtgtgatcctcgctgggccaatgccggtaacggtagcttccgccgcacaacgccgaggacgaataggccgcaactacaacaaagagggcgatcaatacatctatatggggcaaccattaaacaatgatgaagaccatgcacactggacagaggcaaaaatgctgctagataacataaatacaccagaagggattataccggcactgtttgaaccagaaagagagaaatcagctgcaatcgatggggaatataggctacgcggggaagccagaaagacgtttgtcgaactaatgaggcgaggagatcttccagtctggttatcatataaagttgctagcgaagggttccaatactcagatcgtagatggtgtttcgatggtgaaagaaataatcaagtcctcgaagagaacatggatgtggaaatctggacaaaagaaggagaaaggaagaaattaagacctagatggttagacgctagaacttactcagatcccctagcacttagagaatttaaggaatttgccgctggccgcaggagtgtcagcggtgacctaattctagaaatagggaaacttccacagcatctgacccaaagagctcaaaacgctttggacaacttagtaatgttgcataacagcgagcaagggggtcgggcttaccgccacgcaatggaagaactgcccgacacaatagagacccttatgctacttgcgttaatagccgtcctcacaggaggggtcacactattctttttatcaggcagaggcttgggcaaaacaagcataggtctactatgtgtaatggcaagttcagtccttctatggatggcaagcgtggagccccattggatagccgcgagcataatattagagttctttttgatggtattattaataccagagcccgacaggcaaagaacaccgcaagataatcaactggcatatgtggttatcggactgttatttatgatactcacagtagcagcaaatgaaatgggtctcctagaaacaaccaagaaagacttgggaataggacacgttgccgttgagaaccatcaccacgctactatgttggacgtagaccttcatccggctagcgcttggacgctttatgcggtagctacaacaataattacacctatgatgcgacatacgattgaaaatacgaccgctaatataagccttacagcaatagcgaaccaagcggccatattaatgggtctggataaaggatggccgatttcgaagatggacatcggcgtaccactactggccttagggtgctattctcaagtaaatcccttgacactaacagccgccgtactgatgctagtagcacattacgcaattatcggcccagggctacaagccaaggcgaccagagaagctcaaaaacgtaccgcagccggaatcatgaaaaatcctacggtggacggtattgtagcaatcgacttagatccagtagtatacgatgctaaatttgaaaagcaattagggcaaataatgttactgatcttatgcactagccaaattttactaatgagaacaacatgggcattatgtgaatcaataacgctagcaacaggaccattaaccacactatgggaaggatcgcctggtaaattttggaacacaacaatagccgtaagcatggcaaatatatttagaggatcttatctcgccggtgcaggactggccttttccttaatgaaatcattgggaggcggtcgacgaggcactggtgcccagggagaaacactaggggaaaaatggaaacgacaactaaaccaattatcaaaatcagaatttaatatatacaagagaagcgggataatggaagtagataggagtgaagccaaagaaggattaaaaagaggcgaaacaacaaggcatgctgttagtcgagggacggctaaattacggtggtttgttgaaagaaacttggtcaaaccagagggaaaagtcatagatttaggttgtggacggggaggttggtcctattactgtgcaggactcaagaaagtaacagaagtcaaaggctacaccaagggagggccaggacacgaagaacctataccaatggcaacttacggatggaatttagtcaaattacattctgggaaggatgttttcttcacgcctccagagaaatgtgatacgctattatgcgacattggagaaagtagtccaaatcccacaattgaagaaggacgtactctaagagttttaaaaatggtagaaccttggttaagaggaaatcaattttgtataaaaatcctaaatccatatatgccgtccgtcgtagagacacttgaacaaatgcagcgcaaacacggcggcatgctggttcgtaatccgttatcgcgaaactcgacacacgagatgtactgggtaagctgtggtacgggtaatatagtaagtgcggtaaatatgacgtctaggatgttgcttaatagatttacaatggctcatcgaaagcccacttatgaaagggacgtagatttgggagccggaaccagacatgtggccgtggagccagaggtagctaatttagacataataggacaacgaatagagaatatcaaacatgagcacaaatccacttggcattacgatgaggataatccatacaaaacgtgggcataccatggttcatatgaagttaagcccagtgggagtgcatcatccatggtcaacggagtagtcaagctccttaccaagccatgggatgtcatacctatggttacccaaattgctatgactgatacgaccccattcggacagcaacgtgtgttcaaagaaaaggttgacactagaaccccaaaagctaaaagagggacagctcagataatggaagtcacagctaggtggttatgggggttcttaagcagaaataaaaagccccgtatatgtacaagggaggagttcacgcgtaaggtccgtagcaatgccgcaatcggtgcagtatttgtcgatgaaaatcaatggaatagtgccaaagaggctgtagaggatgaacgattttgggatttagtacagaaagagagggagcttcataagcaaggaaaatgtgctacatgcgtttataatatgatggggaaaagagagaagaaacttggtgaatttggaaaagcgaagggaagtcgagcaatctggtatatgtggctcggcgcgaggtttctagagttcgaggcgcttggtttcatgaatgaagaccattggtttagcagggaaaactcacttagtggtgtcgaaggcgagggcctccataagctaggttacatcctaagagatatatcgaaaataccaggagggaacatgtatgccgatgacacggctggatgggatactagaataactgaagatgatctacaaaacgaagcgaaaataaccgatataatggagccggaacacgccttattggctacatcgatatttaaattgacttaccagaacaaagtagttagagtccagcgcccagcgaaaaatggaaccgtaatggatgtgatttcacgacgagaccaacggggatcggggcaagtcggtacttacggactaaatacgtttactaacatggaagctcagctaataagacaaatggagagcgaaggcatcttcttaccatccgaactagaaacaccaaatttagcagaacgcgtactggattggttagaaaagtatggagtcgaacgcctaaaaagaatggcaattagtggcgatgattgcgtagtgaagccaattgacgatagatttgctacagccctaaccgcattaaacgacatgggaaaagttaggaaagatattccacagtgggaaccgagtaagggatggaatgattggcaacaggtaccgttttgttctcatcacttccaccaattaataatgaaagacggtagagaaatagtcgttccgtgtcgaaaccaagatgagttagtcgggcgggcgcgggttagtcaaggagcaggatggagtctacgtgaaactgcttgtcttggaaaaagctatgcacaaatgtggcaacttatgtatttccatcgcagagatctacgacttgcagcaaatgcgatatgctctgcagtcccagttgattgggtacccacgtcgcgtaccacttggagtatacatgcacaccatcaatggatgactacggaagacatgctaagcgtttggaatagagtgtggatagaagaaaatccatggatggaggataaaacgcatgtatcatcatggggtgatgtaccatatctaggcaaaagggaagatcaatggtgcggtagcttaatagggttaacggctcgtgcgacttgggcctctaatatacaggtggcaattaatcaagttagacgcttgattggaaatgaaaattacttagattatatgacctcgatgaaaagattcaaaaatgaaggagatcctgaaggagctctatggtga

SEQ ID NO: 21901 - RNA, 9879 nt, synthetic construct
  misc_feature 1..9879: note = derived and/or modified CDS sequence (opt6) from DENV-1__EU482795__SS-prME
  source 1..9879: mol_type = other RNA
agtgttactatgttactaatgctgatgcccacggcattagcttttcatttaactactagaggaggggaaccgcatatgatcgtaagtaaacaagagagaggtaaatcattattgttcaaaacctcagctggtgtcaatatgtgtactttaattgcaatggatctcggagaattttgcgaagataccatgacgtacaaatgcccacgaatcaccgaagcagaaccagacgatgttgactgctggtgcaacgcaactgacacatgggtaacctacggaacatgctcgcagactggtgaacatagaagagataaaagaagtgtcgcactagcaccacacgtaggcctaggattggaaacaagaacagaaacgtggatgtcttcagaaggagcatggaaacagatccaacgagtagagacctgggcactaagacaccccggattcaccgtgatagcattgtttttagcccatgctattggaaccagcattacacaaaaaggtattatatttattttattaatgctagtaaccccctctatggcaatgcgctgtgttggaattgggtcaagagattttgtcgaagggctatcaggtgcaacttgggtagacgttgtactggagcatggaagctgcgtgacgacgatggcgaaagataaaccaaccttggatatagaactcttaaaaacagaagtaaccaatccagccgttcttcgaaaattatgtatagaagctaaaatatcaaacacgactactgattctagatgccctactcaaggcgaagcaacattggtagaggaacaagatgcaaatttcgtttgcagacgcacattcgtcgatcgaggatggggaaatggatgtgggttattcgggaaagggagcctgataacttgcgcaaaatttaagtgcgtgacaaaactcgaaggaaagactgtccagtatgaaaatttaaaatacagcgtaatcgtaacggttcatactggtgaccagcatcaagtgggaaatgaatcaacagagcatggcacgaccgcgaccataacccctcaggcaccaagtaccgaaatacaattaaccgattatggagcactgacattagattgctcgccccgtaccggtttagactttaatgaaatggtgttgctaacgatgaaagaaaaatcgtggttagtgcacaagcaatggtttctagatttaccgctcccgtggacgtctggggctagcactagccaagaaacttggaatagaaaggacctgctggttactttcaaaactgcccatgcgaagaaacaggaagttgtagttttaggaagtcaagaaggagccatgcatactgctttgacaggagcgactgagatccaaacatcgggaaccacgaccatcttctcaggacacttaaaatgccgcttaaagatggataaacttacattaaaaggaatgagctacgtaatgtgtactggaagtttcaagctagaaaaagaggtagcggagactcagcatgggacagtcctagttcaaattaagtacgaagggaccgatgcgccatgtaagataccattttcaacgcaagatgaaaagggggttacacaaaatggacgtcttataactgcaaatcccatagtaactgataaagaaaagccagttaatatcgaggcggaaccaccattcggagaaagttacattgttataggagccggtgagaaggcactaaaactttcttggtttaagaaaggatccagtatcggcaaaatgttcgaagcaacagcaagaggcgcaagacggatggctatactaggagatacggcatgggatttcggctcaattggcggagtattcacgtcagtaggaaaacttgtccatcaaatatttggaactgcgtatggagtattgtttagcggagtatcatggaccatgaaaataggtattggtgtcctactaacgtggttgggattaaattcacgttcaacaagtctttcaatgacatgcatcgcagtggggctagtaacactctacttgggcgttatggtacaggcggattcggggtgtgtgatcaactggaaagggagggaactaaaatgtggcagtggtatttttgtaactaatgaggtgcatacttggactgaacaatacaagttccaggcagattcgccgaagcgtttgagcgctgcaataggcaaagcatgggaagaaggagtgtgcggaatacgctcggctacccgactcgagaacataatgtggaaacaaatcagtaacgagctgaatcacatactgttagaaaacgacatgaaatttactgtagtagttggagacgtcgcaggcatacttgcacagggtaagaaaatgataagaccacaaccaatggaatataaatattcctggaaaagttggggaaaagctaagataataggtgctgacgttcagaatacaacatttattattgatggtccaaacacacctgagtgcccagatgaccaaagagcatggaatatatgggaagtcgaagattatggatttggaatatttactacgaatatatggcttaagctgagggacagctacactcaggtttgtgatcacaggctaatgagcgctgccataaaggactcaaaagctgtacatgcagatatgggctattggatagagagtgagaaaaatgagacgtggaaattagcacgagcttcgttcatagaagtcaaaacatgtatttggccgaagtctcatacgttatggagcaatggcgtattagaatctgagatgataatacccaagatttatggtgggccaatatcacaacacaattaccgtcccggatactttactcagacggcgggaccctggcatttgggaaagttggaactagactttgatctttgtgagggaacaaccgtcgtagttgacgaacattgtggcaacagaggtcccagtttaagaacaactactgtaacaggcaaaataatccacgagtggtgttgtagaagttgtacactgcctccacttaggtttaaaggtgaagacgggtgctggtatggtatggagatacgacctgtcaaggaaaaagaagaaaacctggtaaaaagtatggtctccgcaggtagtggagaagtagattcttttagcctcggattactatgcataagtataatgatcgaagaagtcatgagatctagatggagcagaaaaatgttaatgacaggcacattagcggtattctttttattaattatgggacaattaacttggaatgaccttatccggctatgcataatggtaggtgcaaacgcttccgacagaatgggtatggggacgacatatctagcattgatggcaacttttaaaatgcgacccatgtttgcggttggactcttgtttcgacgtttaacatcaagagaagttctattgttgacgataggactatcgcttgtagcatcggtggaactaccgaacagtctagaagaactgggagatggactagcaatgggaatcatgatactaaaactattgacagatttccagtcccatcagctctgggcaacattattatcattgactttcataaaaacaacctttagtttgcattacgcatggaagactatggcaatggtgttaagcatagttagtttactgcccttgtgtcttagtactacaagtcaaaagaccacctggctaccagtattgctcggcagcttaggctgcaagccactcacgatgtttttaattgctgaaaacaaaatttggggtagaaaaagctggccactaaatgaaggaatcatggcagtagggatagtaagcatacttctttcttcattgcttaaaaacgatgtcccattagcaggaccactaatcgccggtggaatgttgatagcttgttatgtaatctcaggtagtagtgcagatttgtcactggagaaagccgcagaagtatcttgggaagaagaagctgagcatagtggggctagccacaatatcttagtagaggtgcaagacgacggaacaatgaagataaaggacgaagaaagagatgacacattaacaatccttctcaaggcgacacttttggcggtttcaggagtgtatcccctaagtatccccgcgaccttattcgtgtggtacttctggcagaagaagaaacagcgctcgggagtcttgtgggacactccctcacccccagaagtagagcgtgccgtactggacgacggaatatatagaataatgcagaggggacttcttgggagaagtcaagtcggagtcggagtgttccaggaaaatgtattccatacaatgtggcacgtaacaagaggagctgtactgatgtaccagggtaaaagacttgaaccaagctgggcatcagtgaagaaagaccttattagttacggtgggggctggaggctgcaaggatcttggaataccggtgaggaagttcaagtaatcgctgttgagccaggtaaaaatcctaaaaacgtccaaacagcaccagggacgtttaaaacttcagaaggtgaagtgggggcaattgcgctagactttaaaccgggaacaagtggaagtcctatcgttaacagagaaggaaaaatcgtaggcttatatggcaatggagtcgtaacgacaagtggaacctatgttagcgctatcgcccaggctaaggcttctcaagagggacctttaccagaaattgaggatgaggtctttagaaaaagaaacttaaccataatggacttacatccaggatcggggaaaacaagaagatacttacctgcgatcgttcgagaggctataaagcgcaaacttaggacattaattttagcaccgactcgcgtggtagcctcagaaatggcagaagcacttaaggggatgccaattagatatcagacgaccgcagttaaaagtgaacataccggaaaggaaatagttgatctgatgtgccatgcaacttttactatgcggttattaagtccagtacgagttccaaattataatatgataattatggacgaagctcatttcacggacccaagctcgatagccgccagaggatacatttctactagagtaggaatgggcgaagctgccgccatatttatgaccgctacaccaccaggttccgtcgaggcttttccgcaatccaatgcagtaatacaagacgaagaaagagacatccccgaacgtagttggaactcgggatatgaatggatcactgatttcccaggaaagacggtgtggtttgttccctctatcaaatctggtaatgacattgctaactgcctcaggaaaaatgggaaaagagtaattcaactaagcagaaggacgtttgatactgaataccaaaagactaagaacaatgactgggactacgtagttactacagatatatctgaaatgggagcaaattttagagcagatagagtgattgacccaagaagatgtttgaaaccagttattttaaaggacggtcctgaaagagttatactcgctggaccaatgccggtgacagtcgcgagtgcagcgcaacgtcggggtcgcataggaagaaatcacaataaggaaggtgaccaatatatttacatgggacagccattaaataacgatgaagatcacgctcattggactgaagccaaaatgttactagataacattaatactccagaaggtattatccccgcattatttgaaccagagagagagaagtctgctgcgatagatggagagtatagattaagaggcgaagccagaaaaacatttgtagaactcatgcgtcgtggagatctaccggtttggttatcatacaaagtggccagcgagggatttcaatactccgaccgacgctggtgtttcgatggcgagaggaataaccaagtattggaggagaacatggacgtcgaaatttggacaaaagaaggagaaaggaagaaacttagaccccgttggttagatgcgagaacttattcagaccccttagctctgcgcgaatttaaggaatttgctgcagggagaagaagtgtgtccggagatttaattttagaaataggtaagttgccacagcacttaactcagcgagcacagaacgctctagataacttagttatgctgcacaattcagaacaagggggaagggcatataggcacgcaatggaggaactacctgataccatcgaaacgctcatgttattagcgttaatagcggttttgacaggcggcgtaacactgttctttttaagcggaaggggcctgggaaagacatccatcggtttactatgcgttatggcgtcaagcgccttactatggatggcctccgttgagcctcattggatcgcagcatctataatattagagttcttcttaatggttcttttaattccagaacccgatcgacagagaacacctcaggataaccaattagcctacgttgtaataggactgttgttcatgattttaacagtcgcagcaaatgagatgggattactagaaacaaccaaaaaggacttggggataggccacgttgctgtagagaaccatcaccatgcggctatgttagatgttgatctacacccagcctcagcatggactttgtatgcggtagccactacaatcatcaccccaatgatgagacacacaattgagaatacaacggcaaatatctctctcaccgccattgcaaaccaagctgcaattctgatgggcctagataaaggttggccaatatctaaaatggatataggtgtccctttacttgcactagggtgctattcacaagttaaccccctcactttaacagccgctgttttaatgctagtggcgcattacgcaataataggaccgggccttcaagcaaaagcaacaagagaggcccagaagcgaaccgcagccgggattatgaaaaaccctaccgtagatggaatcgtggcaatagatcttgatccagtggtctacgatgctaaatttgaaaaacaactagggcaaataatgttacttatactatgcacatcacagatattactgatgagaacgacgtgggcactatgcgagtcaataacacttgcgactggccctttaactacgctttgggaaggaagtcccggaaagttctggaacaccactatcgcagtctcgatggcaaatatatttcggggttcatatttagcaggggctggcttagctttttcgctcatgaaatcactaggagggggacggagaggaacgggcgcccaaggtgaaacattaggggaaaaatggaaaagacagcttaaccagctaagtaaaagcgaatttaatacatataagagatcaggaataatggaggtcgatagatcagaggctaaagaaggactaaaacggggcgaaactactaaacacgccgtaagtagaggaaccgcaaaattgcgatggtttgtggaaaggaatctagtaaaacctgagggaaaagtgatagacttaggttgcggtagagggggatggagttattattgtgcggggctgaagaaagtaacagaagtaaaaggatatactaaagggggacccggacatgaagaacctattcctatggcaacatacggatggaacttagtgaaacttcactcaggtaaagacgtctttttcatcccaccagaaaagtgtgacacactcttatgtgatataggagaaagtagtccgaatccaactatagaagaaggccgaacgctccgggtgttaaaaatggtagaaccttggcttagaggaaaccaattttgcattaaaatattgaacccttatatgccatccgtcgttgagactctggaacaaatgcaaagaaaacatggtggcatgctagttagaaacccactcagcagaaattcaactcacgaaatgtattgggtaagttgtggaactggaaatattgtttcagccgttaacatgacatctaggatgctactcaaccgatttacaatggctcatcgaaaaccgacgtacgaaagagatgtagacttaggggctgggactcgacacgtagcagtagagccagaggttgccaatctagacattataggtcagagaatagaaaacattaaacacgaacataaatctacttggcactatgatgaagacaacccatacaaaacttgggcctaccatggtagttatgaagttaagccatcaggctcggcatctagcatggtaaatggtgtagtaaagctcctgacgaaaccttgggacgtcatacctatggtaacacaaatagcaatgacagatactaccccatttggacagcagagagtgtttaaagaaaaagtagacacgagaaccccaaaggccaagagaggaaccgcccagataatggaagttacagccaaatggttatggggattcctctcaagaaataagaaaccaaggatatgcacccgtgaggagttcaccaggaaggttagatctaatgcagcgatcggcgcagtatttgtagacgaaaaccaatggaatagtgcaaaagaagcagtggaagacgagaggttttgggatttagttcaccgcgaaagagagcttcataaacaagggaaatgcgcgacatgtgtatataatatgatgggaaaaagggagaagaaattaggagaatttggaaaagccaaaggttcacgtgcaatttggtacatgtggcttggagcaagattcttagagtttgaagcccttggatttatgaacgaggaccactggtttagtagggaaaatagtttgagcggcgtcgaaggagaaggtttacataaattaggctatatattaagagacattagtaaaatcccaggcggaaacatgtatgcagatgataccgcaggatgggatacaaggataacggaagatgacttacaaaatgaagctaagataactgatatcatggagccagaacacgcacttttagcgaaatcaatatttaaacttacgtaccaaaacaaagtcgtcagggtacaacgccctgccaaaaatggtacagttatggacgtaatttcacgtagagatcaaagaggatctgggcaagtgggcacctatggcctcaacacgtttactaatatggaggcacaattaatacgtcaaatggaaagtgagggcattttcagtccatcggagctcgaaacccccaacttagcgggaagggttctcgactggttggaaaagcacggagtggaaaggttaaaaagaatggcgatatctggcgacgactgtgtggtgaaacctatagatgatcgtttcgcaacagcattaactgccctaaatgacatgggtaaagtgaggaaggacattccacaatgggaaccctcaaaaggatggaatgattggcagcaagtaccgttttgtagccatcattttcaccagttaatcatgaaagacggacgtgaaattgtcgtcccgtgccgcaaccaggatgaattggtgggacgagctagagtctctcagggggctggttggagtcttagagaaactgcttgtcttggcaaaagttacgcacaaatgtggcagctaatgtactttcaccgacgggacctgaggctagcggcaaacgctatatgttcggctgtgccagttgactgggtacctacgagcagaacaacatggtcaatacacgcgcatcatcaatggatgacgactgaagacatgctctccgtatggaatagagtgtggatagaagagaacccctggatggaagacaaaacccatatatcatcttggggagatgtcccctatttgggtaaacgcgaagatcaatggtgtggttctttgattggactaactgcaagggcaacgtgggcaactaacatccaagttgcaataaaccaagttcgcagattgataggtaacgaaaattacttggactatatgacatctatgaaaagatttaagaacgaaagtgaccctgagggagcactatggtag

SEQ ID NO: 21902 - RNA, 9879 nt, synthetic construct
  misc_feature 1..9879: note = derived and/or modified CDS sequence (opt6) from DENV-1__EU482796__SS-prME
  source 1..9879: mol_type = other RNA
tcagtaacgatgcttttaatgcttatgccgacggcgttagctttccatcttacaacaagaggtggtgaacctcatatgatcgtaacaaaacaagaaagaggtaagtccttgcttttcaaaacttcagctggtgtaaacatgtgcacattgatagcaatggatttaggagagttatgtgaagacacgatgacttataaatgtccacgcataaccgaagcagaaccagacgacgtagactgttggtgtaatgctactgatacatgggtaacttacgggacgtgtagtcaaacaggtgaacataggcgagataaacggagcgtcgcacttgcaccacacgtgggtttaggactagaaacgaggacagagacctggatgtcttcagagggagcatggaagcaaatacaacgagtagaaacgtgggcactacgtcatccaggattcacagttatagcgctattcttggctcacgcaataggaacgagtattactcaaaagggaattatatttatattactaatgttggtaacacctagcatggcaatgagatgtgtcggtatcggttctagagatttcgtagaagggctatcaggagccacttgggtagacgttgttttggagcatggatcgtgtgtaactacaatggcaaaagataagcctacgctagatattgaattattgaaaactgaagtgactaaccctgcagtattacgaaaattatgcatagaagctaagatttcaaacacgactacggactctcgttgtcccacacaaggtgaagctacactcatggaagaacaagacgcaaacttcgtgtgccgtagaacatttgtggatcgtggatggggaaacggctgtgggttatttggcaagggcagcctaataacttgcgccaaatttaaatgtgttacaaaattagaaggaaaaattgtacaatacgaaaatctcaaatattcagtgatagtcacagtacacacaggggatcaacatcaagtaggcaatgaatccacagaacatgggacaacagcaacaatcacccctcaagcgccaacgtcagagattcaactaacagattacggagcattaacattagactgcagcccacgtacaggattagacttcaacgaaatggttctgctaaccatgaaagaaaaatcgtggttagttcataaacaatggttcttagacttacctctgccgtggacatcaggcgcatccacctcacaagaaacatggaaccgccaagacctgttagttacctttaagacggcacatgctaagaaacaagaagtggttgtccttggttcgcaagaaggagctatgcacacagcgctaaccggagcaacagaaatacaaacatcaggcacaacaacaatatttgctggccacttaaagtgcaggctgaaaatggacaaattaacattaaagggtatgtcatatgtcatgtgtaccggatctttcaaacttgaaaaagaagtggcggaaacacaacacggcacggtactcgtacaaattaagtacgaggggaccgatgccccatgcaaaattccgttcagtacacaagacgaaaaaggggtgacccaaaatggcaggttaataacagctaaccccatagtaactgacaaagaaaaacccgtcaacatagaagctgagcccccattcggagaaagttatattgttataggcgccggcgagaaagcattgaagttaagctggttcaagaaagggagctcaattggtaaaatgttcgaagcaaccgcaaggggagccagacggatggccatactgggagacacagcatgggattttggcagcataggtggtgttttcaccagtatagggaaacttgtacatcagatttttggaacagcatatggtgtactcttctcaggagttagctggaccatgaaaattgggattggggtactcttgacctggcttggtctaaattcacgcagtaccagtttgagtatgacttgtattgcagtaggattagtgacattgtacctgggagttatggtacaagctgatagtggttgcgtaataaattggaagggaagagaattaaagtgcggaagcggaatatttgtaactaatgaagtacacacttggacagaacaatataaattccaagccgattcaccaaaaaggttgtctgcggccattggaaaagcatgggaagaaggtgtatgtggtattaggtcagcgacaagattggaaaatataatgtggaaacaaatatctaatgaactaaatcatatactccttgaaaacgatatgaaatttacagtcgtagttggcgatgtagtaggaatccttgcccaagggaagaaaatgattcgccctcaacctatggaacataaatatagctggaaatcatggggaaaggctaagattataggagcagacgttcagaatacaacattcattattgatgggccaaacacgcctgaatgcccagatgaccaacgagcatggaatatttgggaagtagaagactacggttttgggatttttacaacaaacatatggctgaaaatgagggatagttacacacaggtatgcgaccaccgactgatgagcgcagcaattaaagatagcaaagccgtccatgcagatatgggatattggattgagagtgagaaaaacgaaacttggaaattagccagggcttcatttattgaggttaaaacatgcatatggccaaaaagccatacgttatggtcaaacggagtccttgaatcagaaatgattatccccaaaatctacggagggccaatatcacagcacaattatcgacccgggtatttcacccagactgcgggaccatggcacttagggaaactagagttagatttcgacttatgtgaaggcacaaccgttgtggtagatgaacattgtggcaacagaggtccatctctaagaaccactaccgttactgggaagattatccacgaatggtgttgcagatcctgtacgcttcccccattaagatttaaaggtgaagatgggtgttggtatggtatggaaatacgacctgtaaaagaaaaagaggaaaacctcgtaaaatctatggttagcgcgggtagtggagaagtagatagtttctctctaggcttactgtgtataagtataatgatagaagaagtaatgagaagtaggtggagccggaaaatgctgatgactggtacactggcggttttcctgctcctaatcatggggcaacttacctggaacgacctaattcggttatgtataatggtaggtgctaatgcttccgaccgcatgggaatgggtacaacttatttagctttgatggctacttttaaaatgagaccaatgttcgccgtaggtcttctgttccgccgactaacctccagagaagtactactactgaccatagggctgtctttggtggcatcagttgagttaccaaacagcctagaagagttgggagatggtcttgcaatgggcattatgatattaaaacttttgacagactttcaaagccaccaactatgggctacactattaagtttgacctttataaaaacaacgttgtctttgcattacgcatggaaaacaatggcaatggtactatcaatagtaagccttattccactatgcttgtcgacgacgagccagaaaacgacctggttacccgtgttactcggatccttagggtgcaaaccactgacgatgttcttaatagcagaaaataaaatatggggtagaaaaagctggccccttaatgaaggcataatggcagtgggtgtagtatcgatacttctaagcagcttattgaaaaatgatgttcccttagcagggccattgatagcaggaggaatgttgatcgcctgttatgtgatctctggatcatctgcagatctcagtcttgaaaaagcagcagaagtatcatgggaggaagaagcggaacatagcggagctagtcataacatattagtagaagtccaagatgacggaaccatgaaaattaaagatgaggaaagggacgacacattgacaattctattgaaggccaccctccttgcagtgtctggagtctatccgctttccattccggccacattattcgtttggtacttttggcaaaagaagaaacaaagaagtggagtattatgggatacaccttcgcctccagaagtagaaagagcagtattagatgacggcatatatagaataatgcaaagaggattattaggaagatctcaagtgggtgtaggagtttttcaggaaaatgtatttcacacaatgtggcacgtaacacggggagcagttttaatgtatcaaggaaaaagacttgaaccaagttgggctagtgtcaagaaagatttaatctcctatgggggaggatggagacttcagggtagttggaatacaggagaggaagtacaagtaattgcagtagagcctggcaaaaatcccaaaaatgttcagaccgctccaggtacattcaaaacaccagagggagaagtaggagccattgccttggactttaaaccgggtacatcaggttcaccgatagttaatagggagggtaaaatagtaggtttatatggaaatggagttgtcaccacctctggcacatatgtaagtgctatagcgcaagcaaaggcgagtcaagagggacccctgcccgagatagaagacgaggttttcagaaaaagaaatctaacgataatggacttacatccggggtcaggtaaaacaaggcggtacctcccagcaatagtccgtgaggcaataaaaagaaagttgcgaacactcatacttgctcccaccagagtagttgcatcagaaatggccgaggccctcaagggaatgcccattcggtaccaaacaacggctgtaaaatcggaacatacaggtaaagagattgtagacttaatgtgtcacgctactttcaccatgagactactatcaccagttcgggtaccaaactacaatatgatcataatggatgaagcacactttaccgacccaagctccatcgcggctaggggatacatctctacgcgtgtaggcatgggtgaagcagctgcaatatttatgaccgcgacacccccaggatccgtagaggcttttccacagtctaatgcagtgattcaagacgaggaaagggacataccagagagatcgtggaactcgggctacgagtggataacagacttcccaggcaaaacagtgtggttcgtacccagtataaaatcaggaaatgacattgcaaattgtttaaggaagaatggaaagcgagtgatacaactttctagaaaaacatttgacacggaatatcagaaaaccaaaaataacgactgggattatgtagttaccacagatataagcgaaatgggtgcaaattttcgagctgatagagtaattgacccgaggagatgtttaaaaccagtcatcctcaaagacggtccagagcgagttattctagctggacctatgccggtgactgtagctagtgctgcccaaaggagagggcgaataggtcgaaatcataataaagagggcgaccaatacatctacatgggacaacctctcaataatgacgaagatcacgctcattggacggaagcaaaaatgctcttggataatataaacacaccagagggtataataccagctttatttgaacctgaaagagagaaaagtgctgcgatagatggtgaatatagactgcgcggggaggcgaggaagacattcgttgaacttatgagaaggggtgatcttccagtatggctttcctataaagtggcatccgaaggattccagtattcggaccgacgatggtgtttcgatggtgaaaggaataatcaagtactagaagagaacatggacgtagaaatttggaccaaggaaggagaaagaaagaaattaaggccacgctggcttgatgctcgaacctattcagacccgcttgctttgagagagtttaaggaatttgcggctggcagaagaagcgtcagcggggatctaatcctggagattggtaaattgcctcagcatttgactcagcgggctcaaaatgcattagacaatttggtaatgctacataatagtgaacaagggggacgtgcctataggcatgccatggaagaactgcctgacaccattgaaacattaatgctgctagcactgattgcagtccttacaggtggtgtaacattattcttcttatcaggcagaggactcggcaaaacttcaattggattattatgtgttatggcctcctcagtcctgctctggatggcttcagtggaaccgcactggattgcagcaagtataatactggagtttttcctaatggttttattaatcccggagcctgatagacaaagaactccgcaggacaatcaattagcatatgtggtgatcggcttgttgttcatgatactaacggttgcggcaaatgagatggggttgttagaaacaacgaagaaggatctgggcattggacatgttgcggtggaaaatcaccatcacgcaactatgcttgacgtcgatttacaccccgctagtgcatggactctttatgctgttgctacgaccataatcacaccaatgatgaggcacaccatagaaaacactacggcgaacatcagtctcaccgcgattgcgaaccaagctgctatattaatgggactggataaaggttggccgatctcgaaaatggatataggagtaccattgttggctctgggctgttacagtcaagtaaatccactaactttgactgcggcggttcttatgcttgtagcacactatgcaatcattggccctggacttcaggccaaagcaactagggaagctcagaaaagaacagcggctgggataatgaaaaatccaacagttgacggaatcgtagctatagacctagatcctgtagtttatgatgctaaatttgagaaacaattgggccaaattatgttactgatactctgtactagccaaatactcctaatgcgtacaacttgggcgttatgtgagagcataacactagccacagggcccttgacgacactatgggaaggttcacctgggaaattctggaacacgacaatagctgtgtcgatggcgaatatctttagaggtagttacttagccggagcaggccttgcttttagccttatgaaaagcctaggaggaggcaggaggggaaccggtgcccaaggagaaactcttggagagaagtggaaacgtcaattaaaccaattaagcaaaagcgaatttaacatatataagcgaagcggaatcatggaagtagatagatctgaagcgaaagaaggattaaaacgtggagaaaccacaagacacgccgtaagtcgtggaacggcgaagttgcgctggtttgtagaacgaaatctagttaaaccagaaggaaaagttattgatttagggtgcggtcgaggtggatggtcttactattgtgctggactaaagaaagtcactgaagtcaaagggtatacgaaaggaggacctggacatgaggaacctatccctatggctacttatggatggaatttagtaaaattacattcgggaaaggatgttttctttacaccgccagaaaagtgtgatactctgttgtgtgacataggagaaagctcaccaaatccgactatcgaagaaggccggacactcagggtactaaaaatggtagaaccatggttaagaggtaaccaattttgtataaaaattttaaacccctacatgcctagcgtggtagagacattagaacaaatgcaacggaagcacggtggtatgctggtgcgtaatcctttatcacgaaatagtactcatgaaatgtactgggtcagttgcggcacaggaaacatagtatctgcagtaaatatgactagccgcatgctattgaatcgtttcacaatggcccaccgaaaaccgacttatgaaaaggatgtagatttaggggctggaacccgccatgtagctgtagaaccagaagtagctaatttagacattatcggccaaaggatcgagaacattaaacatgagcataaatctacatggcattacgatgaagataatccatataaaacgtgggcataccacggatcctatgaagtgaaaccatccggcagtgcatctagtatggtaaatggagttgtcaagctccttacaaaaccttgggacgtaatcccaatggtgactcaaattgcaatgacagatacaacaccatttggccagcagagagtgttcaaggaaaaagttgacacgcgtactcccaaggcgaagagaggcacggtacagattatggaggtaaccgcaaggtggttatggggatttctttcaagaaataagaaaccacgcatatgtacgagggaagaatttacccggaaggtacgatcaaatgctgcgatcggagcagtctttgtcgatgagaaccagtggaactcagctaaagaggccgtagaagatgaacgcttctgggaccttgtaaagaaagaacgggaactacacaaacagggaaaatgtgcaacatgtgtatataatatgatgggaaaaagggagaagaaattaggtgaatttggcaaagcgaaaggaagcagagctatatggtacatgtggttaggtgcaagattcctagagtttgaagcgctgggatttatgaatgaagatcattggtttagtagagaaaattcactatccggggttgaaggagaaggtctccataagttaggatatatacttcgggacattagcaaaatcccaggaggtaacatgtatgccgatgatacagccggttgggatacaagaatcacggaagacgatctccaaaatgaagcaaagattaccgacataatggaacccgaacacgcattgctagctacatctatcttcaaattgacatatcagaataaagttgttagagtccaacgaccagccaaaaatggaacagtcatggacgtgatcagtaggagggatcaacggggaagtggccaagttgggacgtacggacttaacacgttcactaatatggaggcacagctaataagacaaatggaatcagaagggatattcttaccaagcgagctggagacgccaaatttagcagaacgagtattagattggcttgagaaatacggtgttgaacgcttgaaaaggatggcgatttccggagatgattgcgtagtaaaaccaattgatgaccgttttgcaaccgccctcactgccctcaatgacatgggaaaagtcagaaaagacattccacaatgggaacctagcaagggatggaatgattggcaacaagttccgttctgctcccaccactttcaccagctcataatgaaggacggtcgagaaatcgtagttccttgtcgaaatcaagatgaacttgtaggtagagcaagagttagtcaaggagcagggtggtcactcagggagacagcatgtctaggcaaaagctatgctcaaatgtggcaactaatgtacttccatagaagggacctccgattggcggcaaacgccatatgctcagcagtgcctgtagattgggtcccaactagccgaacgacgtggagtatacatgcgcatcatcaatggatgacaactgaagatatgcttagcgtatggaatagggtatggatcgaagagaacccgtggatggaggataaaacacatgtaagtagttggggagacgttccgtatcttggtaaacgcgaagatcaatggtgtggcagcttaatcggcctaaccgcacgagccacctgggcatcaaatattcaagtagctataaatcaggtcaggcgtcttataggaaatgaaaattatctagactacatgactagcatgaagcgattcaaaaacgaaggtgatccagaaggagcactgtggtaa

SEQ ID NO: 21903 - RNA, 9879 nt, synthetic construct
  misc_feature 1..9879: note = derived and/or modified CDS sequence (opt6) from DENV-1__EU482797__SS-prME
  source 1..9879: mol_type = other RNA
tctgtaacgatgttacttatgttaatgccgactgctctagcattccacttaacaacacgaggaggggaacctcatatgatagtaagcaaacaagaacgtgggaaatctttgttatttaaaacgtcggcaggagtaaacatgtgtacgcttatcgcaatggacttaggagagttctgtgaagacacaatgacctataaatgccctaggataacagaagcagaacctgatgatgtagactgctggtgcaatgcgacagatacatgggtaacttatggaacatgctcacaaacgggagaacaccggcgagacaaacgtagtgttgccttagcacctcatgtcggattaggccttgaaacaagaactgaaacttggatgagttcggaaggcgcatggaaacaaatacaaagggttgaaacgtgggcattacgccacccgggctttactgtcatcgccctattcctagcacacgcaatcgggacgtcgataacacaaaaaggaataatctttatattactgatgttggttaccccttcaatggcaatgcgatgtgtaggaattgggtcccgagatttcgtcgaaggtttgtcaggggcaacatgggtagatgttgtgctagaacacggatcatgcgttaccacaatggctaaagacaaaccgacactagatatagaactattaaaaacagaagttacaaacccagcggttttaagaaaattgtgtattgaagcaaaaatatctaacactactacagattcaagatgtcctactcaaggggaagcaacgttagtagaagaacaagacgccaattttgtctgcagaagaacgtttgtcgataggggatggggcaacggatgtggcctattcggtaaaggcagcctcattacttgtgcaaaatttaaatgcgtcactaaactagaagggaaaacggttcaatatgaaaatttgaaatattcggtaatcgttactgtacacacaggagaccaacatcaagttggcaatgaatctacagaacatggtacaacggccaccataacaccacaagcgcctagcactgaaatacaacttacagactacggggcacttacgctagactgcagccctaggacaggtttagacttcaacgaaatggtcttacttactatgaaagagaaaagttggctggtgcacaaacaatggtttctcgatttgccattaccatggacatcaggcgcctcaacatctcaggaaacttggaacagaaaagatcttctcgtaacttttaaaacggcccatgcgaagaaacaagaagtagtagtattaggctctcaagaaggtgctatgcatacagctttaacaggagctacagaaatccaaacatctgggacgacaactatatttgcaggccatctaaaatgtcggttaaaaatggacaaattaactctaaaaggaatgagctatgtaatgtgcactggatcctttaaactcgaaaaagaagtggccgaaacacaacacggcacagtgctcgtgcaaatcaaatatgaaggcacagatgcaccttgtaaaatcccgttttccacacaagatgaaaaaggggtcacgcaaaatggaaggttaatcactgcaaatcctatcgttactgataaagaaaaaccggttaatatcgaagcagaacctccttttggtgaaagttacatcgtaatcggggctggagaaaaggcattgaaattgagttggtttaaaaagggcagctctatcgggaaaatgttcgaagcaactgctagaggagctagaaggatggcaatactaggagataccgcatgggactttggaagcatcgggggagtgttcacaagtgtcggaaagttagtacaccagattttcggcacagcgtatggcgtactatttagtggagttagttggacaatgaaaataggcataggggttctactaacgtggctaggcttgaactcgagatcaacttcattaagtatgacatgtattgcagtgggattagtaacgctgtatttgggggttatggtacaagctgatagcggatgcgtgataaactggaaaggaagagaactcaaatgcgggtccggaatattcgttactaatgaagttcacacatggacagaacaatacaaatttcaagctgattctcctaagcgactctcagcggcgattggcaaggcctgggaagaaggtgtatgtggaattagatcagccactagactcgaaaacatcatgtggaagcaaataagtaatgaattaaaccatatcctactagagaatgatatgaaattcactgtagttgtaggtgatgtagcaggtatattggctcagggaaagaagatgatccgaccacaaccaatggagtataagtactcatggaaaagctggggaaaggctaagataataggggcagatgtccaaaacaccacattcataatagatggaccaaatacaccggaatgcccggatgatcaaagagcatggaatatatgggaggtagaagattatggattcgggatatttacaaccaacatatggttgaaacttagagattcatacacacaagtttgcgatcatcgattgatgtcagcggcgattaaagacagtaaagcagtgcacgcagacatgggatactggatagaatccgagaagaatgaaacctggaaattagctcgagcgagcttcattgaagttaaaacatgcatatggcctaaatcccacacgctatggagtaatggcgttttagaatcagaaatgataataccaaaaatttatggtggaccgatttcccaacataactatagaccaggatattttactcagacggcagggccgtggcacttaggaaaattagaactcgacttcgacctatgtgaaggaacaacagtagtcgtagacgaacactgtggaaaccgcggcccaagtcttaggaccacaacagtaaccggaaaaattatacacgagtggtgttgcagaagttgcacactaccaccattgcgtttcaaaggggaagatggttgttggtacggaatggaaataagaccagtgaaggaaaaagaggaaaatctggtaaaatcaatggttagtgcagggagtggcgaagtagattcattctccttaggtcttttgtgcatttcaatcatgatagaggaggtaatgcgaagcagatggtcgaggaaaatgctaatgactggtacccttgccgtatttttcctacttattatgggacagttaacctggaacgatctcataaggttatgtataatggtaggagccaatgcatcagaccggatgggtatgggtacaacttatctagcactaatggcgacttttaaaatgagaccaatgtttgctgtaggtttacttttccgcagattaacaagtcgagaagtccttttgttaacaatcgggctatctctagttgcgagtgtagagcttcccaattctctggaggaactcggtgatggactcgcaatggggattatgattttaaaactcctgactgattttcagtctcaccaactttgggcaacattgctgagtttgacatttataaagacaacgtttagtctacactacgcctggaaaacgatggctatggtattgagcattgtgtcactatttccattatgcttatcgacaacttcccagaaaaccacatggcttccagtattacttggcagtctgggctgtaaaccgctaactatgttcctaattgcggaaaacaaaatatggggaagaaaatcatggcccctgaacgaaggtataatggccgtaggaattgtgtccattttgttgagtagtcttctgaaaaatgatgttccgctagcgggacccttgattgcaggcgggatgctgatagcatgttatgtcataagtgggtcttcggctgatttatcccttgagaaagcagcagaggtaagctgggaagaagaagcagaacattccggagcaagtcataacatcctggtagaagtccaagacgatggtactatgaaaataaaagatgaagaacgcgacgatacacttacaatacttttaaaggcgactttattggctgtcagcggcgtttatcccctcagtattccagcaactcttttcgtatggtatttttggcagaagaagaaacaaagatcaggggtactctgggatactccaagcccacctgaagtcgagcgggcagtgctcgacgacggaatatatagaataatgcaacggggtttacttggtagatctcaagttggagttggagtatttcaggaaaatgtgttccacacaatgtggcatgtaacccgtggcgcagtactaatgtaccagggaaaaagattagaaccatcctgggcaagtgttaagaaagatctaatctcatatggaggtggctggcgcctacaaggatcttggaatacaggagaggaagtacaggtaatagcagtagaaccgggcaaaaaccccaaaaacgtgcaaacggcgcccggtacattcaaaacaagcgagggcgaggtaggcgcaatagcgctggacttcaaaccaggaacatccgggtctcccatagtaaatagggaaggtaaaatagtagggctatacggaaatggtgttgttacaacttcgggtacatacgtaagtgccatagcacaggccaaagctagtcaagaaggtcctctacctgaaattgaagacgaagtctttaggaaacgaaatctaacaataatggacttacatccaggtagcggcaagacacgcagatatctaccagcaattgtacgcgaagctataaaacgcaaattgcggacgttgattttggccccaacccgagttgtagcatctgaaatggctgaagctctgaaagggatgcctatccggtaccaaacaactgcagtgaaatcagaacatacggggaaggaaattgtagatctaatgtgccacgctaccttcactatgcggttactgtcacctgttcgggtgccaaactataacatgataataatggacgaagcacattttaccgacccgtcttccatcgcggcaagaggctatataagcacaagggttggaatgggtgaagcagcagcaattttcatgaccgccacccctccaggaagtgttgaagcatttccccaatctaatgctgttatccaggatgaagaacgtgatattcctgaacgatcctggaatagtggatatgaatggataactgattttcctggcaaaaccgtctggtttgtgccaagtattaaatctggcaacgacatagctaattgtttgcgtaaaaatggaaaaagagtaatacaactttcaagaaaaacattcgatacagaatatcagaaaaccaaaaataatgattgggattacgtggtcacgacagatatatcagagatgggagctaatttcagggcagatcgggtaatcgacccaaggcgatgtttaaaaccagtaatactcaaagatgggccagaaagagtaatattagctggaccaatgcctgtaactgtcgccagtgccgctcaaagaagaggtagaattggccgtaaccataataaagaaggcgaccaatacatatatatgggccaaccattaaataacgatgaagaccacgcccattggacagaagcaaagatgttattagacaacataaacactcctgaaggaataatacccgcgttattcgaaccggagagagagaaaagtgcagcgatcgatggcgaatacagactacgcggcgaggcaagaaaaactttcgtggaacttatgcgtcggggagacttaccagtctggctatcctataaagtggcaagcgaaggattccagtactccgacaggcgatggtgtttcgacggagagcgaaacaatcaagtattagaagagaatatggatgtggaaatttggacgaaagaaggcgaaagaaagaaacttaggccgcgatggttggacgcaaggacttattctgacccattggccctacgggagttcaaagagttcgcggcagggagacgtagcgtaagcggtgatttaatattagagataggcaaattaccccaacatctgacgcaacgtgcacagaacgccctagacaacctagtcatgctacataacagcgaacagggtgggagagcatatcgacacgcaatggaagaactgcctgatacaatagaaacattaatgcttttagccttaatagcagtactaacaggtggggtaactttgttctttttgtcaggacgtggactgggtaagacaagtattggtttattatgtgtcatggcctctagtgtattattatggatggcaagcgtcgaaccacactggatagccgcttcaataatactggagttctttctaatggtattgttgatccccgaaccagacaggcaaagaacaccccaagataatcaacttgcatacgtagtaattggtttgttgttcatgatactaacagttgcggctaacgaaatgggattactggagacaaccaaaaaggatcttggcatagggcatgtggctgtagaaaatcaccatcacgcagccatgcttgacgtagatttgcatccagcatcggcatggactttgtatgcagtagcaacaactattataacacctatgatgagacacacaattgaaaatacaaccgcaaatataagtctaaccgcaatagccaatcaggccgcaatactaatgggattagataagggatggccaatttcaaaaatggacataggagtgcccctattagcactgggctgttattcccaagttaatccgctgactttaaccgccgccgtacttatgttggtagcgcactatgcaattatcggcccagggttgcaggctaaggcaacgcgtgaggcacaaaagaggaccgctgcaggcatcatgaaaaaccccactgtcgatggtatagtcgcaattgatttagatcctgtagtttacgatgcaaaattcgaaaaacagctaggacaaattatgctgttgattctgtgcactagccagatactactaatgcgaaccacatgggctttatgtgagtcgataacgttggctacaggtccattgaccacattatgggaaggatcgcccggtaagttttggaatacaacgatcgctgtaagtatggcaaatatttttagaggttcttacctagcaggagcaggtctcgccttttcgctaatgaaatcattgggcgggggtagacgaggtactggagctcaaggcgaaactttaggagaaaagtggaaacgacaactaaatcaattaagcaagtctgagttcaatacatataaaagaagcggtatcatggaggtcgatcgaagcgaagcgaaagagggacttaagaggggagaaacaacaaaacacgcagtatcacgtggaacagcgaaattgcgctggtttgtcgaacgcaacctagtgaagccagaaggaaaagttattgatttgggatgcggcagaggcggctggtcgtactattgtgctgggctaaagaaagtcacagaagtaaagggttatactaaaggcggacccgggcacgaagaaccaataccaatggcaacgtacggttggaacttagtgaagctgcatagcggcaaagatgttttctttattccacccgaaaaatgtgatacgttactatgtgacattggagaatcatctcctaatcctacaatagaagagggtagaacgttaagagtactaaagatggtggagccatggttgagaggaaaccagttctgtattaagatattgaatccttacatgccgtcggttgtagagacactagagcaaatgcagcgaaaacatggcggtatgcttgtacgaaatccattgtcccggaactcgactcatgagatgtattgggttagctgcggaacggggaatatagttagtgcagtaaacatgacaagccgcatgttattaaatagattcacgatggcacatcgaaaacccacatacgaacgcgacgtagatctcggagctgggactcgacatgtcgccgtagaaccggaagttgctaatcttgacattattggacaacgcatcgagaatataaaacacgaacacaaatcaacgtggcattacgatgaggacaacccttacaaaacttgggcttatcatgggagttatgaggttaaaccgagtggcagtgcatcatcgatggtcaacggagtagtaaaactgctaacaaaaccctgggacgtgataccaatggttactcaaattgcgatgacggataccacgccgttcggacagcaaagagtatttaaagaaaaggttgataccaggacgcctaaagctaaacgtggcacagcgcagataatggaagtgacagcaaaatggctgtggggcttcctgtcacgaaataagaaacctaggatctgtactagagaagagttcactcgtaaggtcagatcaaacgcggcaataggtgcagtattcgtagacgaaaaccagtggaatagtgcaaaggaggcagttgaagacgagagattctgggatcttgtgcatcgagaaagagaattacataaacaaggaaaatgcgcgacatgcgtttacaacatgatgggaaaaagagagaagaaactaggggaatttggaaaagcgaagggttcacgagctatatggtatatgtggttaggagcaagatttctagagttcgaagcactaggttttatgaatgaagatcactggttcagccgagaaaacagcctaagcggcgttgaaggtgaagggttacataaattggggtatatccttcgagatatttccaaaataccaggtggaaatatgtacgcggatgacaccgcaggttgggatactcggattacagaagatgacctacaaaacgaagcaaaaataactgacataatggagcctgagcatgcacttctagcgaaaagcatattcaagttgacatatcaaaataaagttgttcgagtacaacgacccgccaaaaatggaacggtcatggatgtaatatctagaagggaccagagaggcagtggacaagtaggaacatatggactaaacacatttacaaatatggaggcccaactaattaggcaaatggaatctgaaggcatattctcaccgtcagagctagaaacaccaaaccttgcaggaagagttttagactggctagaaaaacacggagtagaacgtttgaaaagaatggctatatctggtgacgattgtgtggtgaagcctatagatgatcgatttgcgacagcactcacagcactaaatgacatgggaaaagtacgtaaagatgtgcctcaatgggaaccttcaaaaggctggaatgattggcagcaagttccattttgtagccatcattttcaccaattaataatgaaagacggaagagaaatagttgttccgtgtcgtaatcaagatgagctagttggtagagcgagggtcagtcaaggtgcgggatggtctttaagagagacagcatgtttaggaaaatcatatgcacaaatgtggcagctaatgtactttcatagacgagatttaagattggcggctaacgcaatttgtagtgcagtgccggtagattgggtaccaacctcaaggacaacatggtctattcacgcccatcatcaatggatgactacggaagacatgttatcagtatggaatagagtatggatagaagaaaacccatggatggaggataaaactcatatatcatcgtggggagacgtgccttatcttgggaagagagaggatcagtggtgcggctctttgatagggttaacagctagggcgacatgggctactaacatacaagtcgccataaaccaagttcgaaggttgatagggaatgaaaactatctcgattacatgacatcaatgaagcgatttaaaaacgaatcagatccagagggtgcactctggtga

SEQ ID NO: 21904 - RNA, 9879 nt, synthetic construct
  misc_feature 1..9879: note = derived and/or modified CDS sequence (opt6) from DENV-1__EU482799__SS-prME
  source 1..9879: mol_type = other RNA
agtgtaacaatgctacttatgttaatgccaacagcattagcatttcatttaacaacacgagggggtgaaccgcatatgatcgtatctaaacaagaacgcgggaaaagcctactattcaaaacgagcgctggggtaaacatgtgcactttgatagcaatggacttaggtgaactatgtgaagatacaatgacttataaatgcccgaggataactgaaaccgaaccagatgatgttgattgttggtgtaatgccactgatacatgggtaacatacggcacatgcagtcaaacaggagagcatagaagagataaacgtagtgttgctctagcaccgcatgtagggctaggcctagaaacacgaacagaaacctggatgtcttctgaaggcgcatggaaacaaattcaaagggtagaaacttgggctctaagacaccctggattcactgttatcgcattatttctagcacatgtgattggaacatcgataacacaaaaagggattatctttattttactaatgcttgtaacgccatccatggctatgaggtgcgttgggataggtagtcgcgactttgttgaaggactcagcggagcgacttgggtcgacgtagtcctagagcacgggagttgcgtaacgaccatggctaaagataaacccactttagatatagaactacttaaaactgaagttacaaatcccgcagttcttagaaaactatgcatagaagcgaaaataagtaacaccacaacagacagtaggtgccctacacaaggagaagcaactttggttgaagaacaagatgctaattttgtatgtagacgcacgtttgtagatagaggttgggggaacggatgtggattattcggaaaaggttcactaataacttgcgccaaattcaaatgcgttacgaaacttgaaggcaaaatagtacaatacgaaaaccttaaatatagtgtaatagttacggtacatacaggtgaccaacatcaagttggaaacgaatccaccgagcatggcaccacagccactataacacctcaggcccctacaacagaaatacaattgaccgattatggagccctaacacttgattgttctccccgaacaggactggacttcaacgaaatggttctattgaccatgaaagaaaaatcttggttagtccacaaacaatggttcctagacttaccgttaccttggacttccggagcatccacatcacaagaaacatggaataggcaagatctcctagtaacatttaaaacagcacatgccaagaaacaggaggtagtcgttctcggtagccaagagggagcaatgcacactgccctaacgggagccacagaaatccaaacgagtgggacgacaacaatatttgcgggacatcttaaatgtcgactgaaaatggacaaacttaccctcaaagggatgtcttatgtaatgtgcactggtagcttcaaactggaaaaagaagttgctgaaacccaacacggcacggtcttagtacaaattaagtatgaagggaccgatgccccatgcaaaatcccatttagtactcaggatgagaaaggcgtaactcaaaacggacgattaatcacagccaacccaatagtcacagacaaggagaagcccgtgaatattgaggcagagcctccttttggtgagtcttatataattataggcgccggcgagaaaactttaaaactaagttggttcaaaaagggttcttctatagggaaaatgttcgaagctacggcccggggagcaagaagaatggcaattctcggggacacagcatgggattttggatcaattggaggagtctttacctctgtgggcaaacttgttcaccaaatttttggaacagcgtacggagtcttattttctggtgtatcttggacaatgaagatcggtatcggagtgctcctcacatggctaggactaaattcgagaagtacatcattatctatgacctgcatagctgtcggattagtaaccttataccttggagtcatggtccaagcagattctggatgcgtgataaattggaaaggccgagaattgaaatgtgggagcggtatctttgtaacaaatgaaatacacacctggaccgagcagtacaagtttcaagctgatagtcctaaacgacttagcgccgcgataggaaaggcttgggaagaaggcgtatgcggcatccgatcggccacaagattagagaacattatgtggaaacaaatatccaatgagctaaaccatatcctgttagaaaatgatatgaaattcaccgtcgtagtaggcgatgttgcaggtatactagcgcaaggtaagaaaatgataaggccgcagccaatggagtataaatattcatggaaaagttggggcaaagcaaaaatcattggcgccgatgtccaaaatacaacgtttataattgatggaccaaatactccagagtgccccgacgaccagagggcttggaacatatgggaagtcgaagactatggctttggtatctttacgaccaatatctggcttaaactgagagactcctatactcaagtatgtgatcaccgattgatgagcgctgcaatcaaagacagtaaagcagtacatgcggatatgggatattggatagaatcagagaaaaatgaaacatggaagctagctagagctagctttatcgaggtaaaaacttgtatatggccaaaaagccatacactgtggagtaacggcgtattagaatcagagatgataataccgaaaatttacggcggcccaatatcacaacataattaccgacctgggtactttactcagacggctggtccatggcacttagggaaactggagttagatttcgacctatgtgaagggactacagtcgtcgtagacgagcattgtggaaatagaggaccaagtctcaggactactactgtaacgggtaagattatacatgaatggtgctgtcgtagttgtacacttccacctttgagattcagaggcgaagacggttgttggtatggcatggaaatcaggccagtaaaagaaaaggaagaaaatctagtaaaatctatggtaagtgcagggagtggcgaagttgatagcttttcattgggcttgctttgcatcagtattatgatagaggaagttatgagatctcgatggagccgaaaaatgcttatgacaggaactcttgcagttttctttctattgataatgggacaattaacatggaatgacttaatacgattgtgcataatggtaggggcaaatgcgtcggatcgaatgggaatgggtacaacctaccttgcactaatggccacctttaagatgaggcccatgtttgcagttggcctattatttcgcagactaacaagtcgagaggtattactacttacaataggccttagtctggtagcttctgtagaattacctaattcattagaggaattgggagacggtttagcaatgggcataatgatccttaagttgctcacggatttccaatctcaccaactgtgggccacattactgtcattgaccttcattaagactacgttcagcttacactatgcgtggaagacaatggctatggtattgagtatagtttcactatttccgttgtgtttatccaccacaagccaaaagaccacgtggctgccagtgctacttgggtcgttgggttgcaagccattaacgatgttcctaatagcggaaaacaagatatggggccgccgcagttggcctctaaatgaaggtattatggctgtcggcatagtgtcaattcttttatcatcgttacttaagaacgatgtgccgctagcaggaccacttatagccggcggaatgctaattgcttgctatgtaatttctggttcatcagcagacctctcactggaaaaggcagccgaggtgagctgggaggaggaagcggaacatagtggagcaagccacaacattctcgttgaggtccaggacgatggcacaatgaaaataaaggatgaagaacgtgatgatacattgacaattctattaaaagcaacattactcgcagtaagtggggtataccccttatcaattccagctacattattcgtctggtatttttggcagaagaagaaacaaagaagcggtgtactgtgggacacaccgtcaccaccagaagttgaacgagccgtcttggacgatggaatttaccgtataatgcaaagaggtctgttaggacgctctcaagtaggcgtgggagttttccaggaaaatgtgtttcacacgatgtggcacgtaacaagaggtgcggttctaatgtatcaaggtaaacgattagagccatcgtgggctagtgtgaagaaagaccttatctcttacggaggtggatggcgactccaaggatcatggaatacaggagaggaagtgcaagtgatagcagtagaacctggcaaaaatcccaaaaatgtacaaaccgcacctggaactttcaagacacctgagggagaagtcggtgcaattgctttagattttaaacctggaacatccggaagccccatcgtgaatagagagggcaaaattgtagggctttatggtaacggtgtagtgacaacctcaggaacctatgtatctgcgattgcacaagctaaagcgagccaggaagggccacttcctgaaattgaagatgaggttttcaggaaaagaaatttaactattatggatttacatccaggttcaggaaagactaggaggtaccttccagcaatagtacgagaagcaataaagagaaaactacgcactttaatactagcgcctacaagagttgtagcgtcggaaatggcggaagcattaaaaggaatgccgattcgttatcaaaccacggcagtaaaaagtgaacatactggtaaggaaatagtggacttaatgtgtcacgctacgtttaccatgagattactttctcctgttagagtgccaaattataatatgattataatggatgaagctcacttcacagaccctagttcaatcgcagcaaggggttacatttctacgcgcgttggaatgggagaagcggctgcaatatttatgactgcaacaccacctggttccgttgaggcattcccacagtcgaatgcagtaatacaagatgaagaacgtgatatacctgaacgcagctggaactccggatatgaatggatcactgactttccgggaaagacggtttggtttgttccttctatcaaatccggaaatgacatagctaattgtttgcggaaaaatggcaaacgagtcattcaactatctaggaaaacatttgatactgaataccaaaagactaaaaataacgactgggactatgtagttaccacggacatatctgaaatgggcgctaattttcgagccgaccgcgtaatagatccaagaaggtgccttaagccagttatactcaaagacggccctgaacgggtaattctggctggcccaatgccggttactgtagctagcgcagcacaaaggagggggaggattgggcgaaaccataataaagagggagatcaatatatatatatgggacaacctttaaataatgacgaagaccacgcacactggacagaagctaaaatgttattggataatatcaacactccagaagggataatcccagcactttttgagcctgaaagggagaaaagcgcagctatagatggagaatacagactacgcggagaagcaaggaaaacgtttgttgaattaatgaggagaggagatttaccagtatggttatcgtacaaagtagcctccgaagggtttcaatactcagacagacgctggtgcttcgacggtgaacgtaataatcaggttttggaagaaaatatggatgtagaaatatggaccaaagaaggagagaggaagaaactcagacctcgatggctggacgccaggacttatagcgatccactggcactacgcgagttcaaggaatttgcggcgggcagaaggtctgtcagtggtgatctaattctagagataggtaagttaccacaacatctgacacaaagggcacaaaatgccttagataatctggtcatgttgcacaactctgaacagggcgggcgggcgtaccgtcacgccatggaagaattaccggacactatagaaactctaatgttgcttgctcttatagcagttttaacgggaggtgtaactttatttttcttgagcggtcgtggtcttggtaagacaagtataggattattgtgtgtcatggctagctccgtcttactatggatggcttcagtagaacctcactggattgctgcatccatcatattagaatttttcctaatggttttgttaattccggaaccagacagacaaagaacaccgcaggataatcaactagcgtacgtagtgattggactcttgtttatgattcttacagtcgctgcaaacgaaatgggattattggaaacaaccaagaaagacttagggataggtcacgttgcggtcgagaaccatcaccacgcagccatgttagatgtcgatctccatccagcatctgcctggacactatatgcggtggctactacgatcataacaccgatgatgcgccacacaatagaaaataccacagctaatatctcgctaaccgccatcgcaaaccaagccgcgatcttgatgggacttgacaaaggatggcctatctctaaaatggatattggtgtacctttattagctctgggatgttacagtcaagtaaatcccttgacgcttactgccgctgttttaatgttagtcgcccactacgcgattataggacccggattgcaagcgaaagcaacgcgtgaggcccagaaaaggacagcagcgggcattatgaaaaatcccacagttgatggaatagtcgctattgatttggacccagtagtctacgatgccaaatttgaaaaacaactaggacaaataatgctccttatcctgtgcacttcacaaattttgctgatgcgaactacatgggcgctatgtgaatctataactctcgcgactggtcccttaacgacactatgggaagggtccccggggaaattctggaacacaactattgcagtctcaatggcaaatatatttagaggttcttatttagccggggctggcttagcattctcattaatgaaaagcctaggtggaggcagacgcggaacaggtgctcaaggtgaaacattaggagaaaaatggaagagacaactgaatcaattatccaaatcagagttcaatacctacaagcgaagtggaataatggaagtagatagatcggaagccaaagaaggcctcaaaaggggagaaactacgaaacatgcagtctctcgtggaacagcaaaactcagatggttcgttgaaagaaatctagtcaaacctgaaggcaaggtgatagacttaggatgcggaaggggcggctggtcatactattgcgcaggtctcaagaaagtgacagaagtaaaagggtataccaagggtggaccagggcatgaggagccgattccaatggccacgtatggctggaatttagtaaagctacacagtggaaaggatgtattcttcatcccgccggaaaaatgtgatacattgttatgtgacataggtgaatcctctcctaatcccacgatagaagaaggtagaacacttagagttttgaaaatggtagagccatggctaagaggaaatcaattttgtattaaaattctgaatccatatatgccgtccgtggttgagacccttgaacaaatgcaaaggaaacacggtggaatgcttgtaagaaatccgctgtccagaaatagtactcatgaaatgtattgggtaagctgcggaacaggaaatattgtgtccgctgtcaatatgacaagtagaatgttgctcaatcgttttactatggcacacaggaagcctacatacgaaagagacgtagatttaggcgcaggaaccagacacgtagcagtcgaaccggaagtagccaatcttgatatcataggccaaagaatagaaaatattaaacacgaacataaaagcacatggcattatgacgaagacaatccctataagacttgggcgtaccacggttcgtatgaggttaagcctagcggaagtgctagctctatggtaaacggagtagtaaaactattaacaaaaccatgggatgtaattcctatggtaactcagattgctatgaccgataccacgcccttcggacaacagcgggtttttaaagaaaaggtggacacaagaacaccaaaagcaaaacgaggaactgcacaaattatggaagttactgcaaaatggttatggggatttttaagcagaaataaaaagccccgtatctgtacaagagaggaatttactaggaaagtacggagtaacgcggcaataggagccgtttttgtagatgaaaaccaatggaacagtgcaaaagaagccgtagaagatgagagattctgggatttagtgcatagagaaagagaattacataaacaaggaaaatgtgcgacttgtgtctacaatatgatgggcaagagggagaagaaactcggagagtttggtaaagcaaagggttccagggctatctggtatatgtggttaggagccagatttcttgaatttgaagctctaggatttatgaacgaagaccattggtttagtcgagagaactcattaagcggtgtggaaggtgaaggactacacaagttgggttatatcttacgagacattagtaaaatccccgggggcaatatgtatgctgacgatacagcgggttgggacacaagaattacagaagatgacctgcaaaacgaagctagaattactgatattatggaacctgagcacgcactcctagcgaagagtatatttaaactaacgtaccaaaataaagtagtgcgggtgcaacgaccagccaaaaatggtacagtcatggatgttattagtaggcgagatcaaaggggttctgggcaagtgggaacatacggcctgaacacttttacaaacatggaagcacaactcattagacagatggaatcggaaggtatattttctcctagcgaacttgaaaccccgaacttagcagagagagttctagattggttagaaaagtatggtgtagaacgattaaaaagaatggcaattagtggtgatgattgtgtcgtaaagccgatcgacgaccggtttgcaacagcattaactgccctaaatgatatgggaaaggttaggaaagatattccacaatgggaacctagtaagggttggaatgattggcaacaggtgcctttttgtagtcaccactttcatcagttgataatgaaagacgggcgtgaaattgtagtaccatgtcgaaatcaagacgagctagttggacgagctcgcgtatctcaaggcgccggctggtcactaagagaaacagcctgtctaggcaaatcttatgcgcagatgtggcaacttatgtatttccataggcgtgatctaagattagcagctaacgcaatttgtagtgcggtaccagtggattggatcccaacgtcccgaacaacgtggtccattcacgcccatcaccaatggatgactacggaagatatgctatcagtctggaaccgggtatggatcgaagaaaatccatggatggaagacaaaacgcatatttcatcatggggagacgtgccatatttaggcaaaagagaagatcaatggtgcggtagtcttattggattaaccgcaagggccacctgggcgaccaacattcaggttgcaattaatcaggttagaagactaattgggaacgagaattatttagattatatgacaagtatgaaacgcttcaaaaatgaaagcgatccagaaggagctttatggtag

SEQ ID NO: 21905 - RNA, 9879 nt, synthetic construct
  misc_feature 1..9879: note = derived and/or modified CDS sequence (opt6) from DENV-1__EU482800__SS-prME
  source 1..9879: mol_type = other RNA
tcggtaacaatgttactaatgctaatgccgactgctttagctttccatctgacgacccggggaggtgaaccccatatgattgttagcaaacaagaaagaggaaaatctttattgtttaaaacctcagcaggcgtaaatatgtgcactttaatagctatggatcttggagaattttgtgaagacacgatgacttacaaatgtccgaggattacagaagcggaaccagatgatgttgattgttggtgtaatgctaccgacacctgggtcacttacggtacctgttcgcaaacagggcagcatagaagagataaacgctctgtagcattagctccacatgtgggacttggattagaaacaagaaccgaaacttggatgtctagcgagggagcttggaaacagattcaaagagtcgaaacttgggccctcagacatcccgggtttaccgtaatagcactattcctagcacatgcaattggcaccagtattacccaaaaaggaataatattcattctattgatgttggttacaccaagcatggctatgcgatgtgtgggtatcggctcaagggactttgtagaaggtctgtccggagcaacatgggtagatgtcgttctagagcacgggagttgcgtaactaccatggcaaaagataagccgacgttggatatagaacttctcaagacagaggtgacaaacccagctgtactgagaaaattatgcatagaggcaaaaatatctaatactacaattgacagtaggtgtccgacccaaggagaagctactcttgtagaagaacaagatgccaatttcgtatgtagacgaacctttgtcgatcggggatggggaaacggttgtggactctttggaaaaggttctttaatcacatgtgcaaaattcaagtgtgtcacaaaattagaaggcaaaaccgttcaatatgaaaatctaaagtacagcgtcatagttacagtccataccggagaccagcaccaggttggtaacgagtctacagaacatgggacgactgcgacaataactcctcaggcgccaagtacagagatacaactaacggattatggtgcactaacactagattgctctccaagaacaggattagacttcaatgaaatggttctcctgacaatgaaagaaaagtcttggttagtacataagcaatggtttttagacctaccattgccttggacatcaggcgcatctacctctcaggaaacatggaatagaaaagacttattggtgaccttcaaaacggctcatgctaagaaacaggaagttgttgtattagggtctcaagagggagctatgcacacagcgcttaccggtgcgacggaaatacaaacaagcgggactactacaatcttcgcgggacatctcaaatgcagacttaaaatggataaactgacgctaaaagggatgtcatacgtaatgtgcaccgggagctttaaattggaaaaggaagttgccgaaacacagcacggcacagtattagttcagatcaaatatgaaggcacggacgcaccatgtaaaattcctttctcgacacaggatgagaaaggggttactcaaaatggtagactaatcacagctaatccgattgttacagataaagagaaacccgtcaacattgaagctgaacctcccttcggtgaatcatacatagtgataggagcaggagaaaaagcactaaagttatcatggttcaagaaaggctccagcataggtaagatgtttgaagccacagctaggggtgcacgacgtatggcaattttgggtgatacagcgtgggactttggcagtatcgggggcgtgttcacaagtgtaggcaaattagtacatcaaatttttggtacggcttacggcgtcttattctcgggagtgtcgtggacgatgaaaatcgggattggagtgcttcttacgtggttaggattaaactcacggagtacatcactgtctatgacgtgcatcgcggttggattagtgactttgtatctcggcgtaatggtgcaggctgactcaggctgtgttataaactggaagggtcgagaactaaagtgcgggtcaggtattttcgtgacaaatgaagtgcatacatggaccgagcaatacaaattccaagccgactcaccaaaacgtctctcggcggcgatcggtaaagcctgggaagagggggtttgcggaatacggtccgtaactaggttggaaaatattatgtggaaacaaatatcaaatgaactcaaccatatcctattagaaaacgatatgaaatttacagttgtcgttggtgacgttgctggaatactggcgcaagggaaaaagatgatccgtccccaaccaatggaatacaaatattcatggaaatcctggggaaaagcaaaaattatcggcgcagatgtacaaaatactacatttataatagatggaccgaatacaccagaatgtccagatgaccaaagagcatggaacatatgggaagtagaagattacggttttggtatatttactaccaacatatggttaaagttaagagatagctacactcaagtatgcgaccatagattaatgtcagcggcaattaaagattctaaggctgttcacgctgatatgggttactggattgaatctgagaaaaacgaaacttggaagttggcaagagctagctttatcgaagtaaaaacttgcatctggcctaaatcacacactctctggtccaacggcgtattagaatcagaaatgataataccaaaaatatatggaggaccaattagtcagcataactatagaccaggatattttacccaaacagcaggcccatggcatctaggtaaactagaactcgattttgatctttgtgaaggaactactgtagtcgtagatgagcattgtggaaacaggggtccctcgctaaggacaactaccgtcacaggaaaaataatacacgagtggtgttgccgttcatgcactttaccgccgttacgttttaaaggagaggacggatgttggtatggtatggaaattcgcccggttaaagaaaaggaagaaaatttagtaaaatctatggtttcggcaggaagtggggaagtagacagtttcagtttaggactcttatgtatatctattatgatagaagaagttatgagatcacgctggtcccgaaaaatgctgatgacagggacgctagctgtattctttctgcttattatgggacaattgacatggaatgatttaattcgtctatgtattatggttggagcaaatgcttcggaccggatgggcatgggaactacatatctagccctcatggccacttttaaaatgcgacctatgttcgcggtcggtcttttatttaggaggttaaccagcagagaagtactactgttgactattggtttatctttagtagcttcagtagaattaccaaattctttagaggagttaggagatggtttagcgatgggaataatgattcttaaattattaaccgattttcaatcacatcaactttgggctacgttgttgagtctgacgtttataaaaactactttttcgcttcattatgcgtggaaaactatggcgatggttctaagcattgtgtcattattcccgctatgccttagtactacaagtcagaaaacaacgtggttgccagtattactcggatctctagggtgtaaaccattaacaatgttcctaattgcggagaacaaaatttggggaagaaaaagttggccactgaatgaaggaattatggctgtgggcatagtatcgattcttctttcttcattactcaaaaatgacgtacctctcgcgggcccacttatcgccggaggaatgttaatcgcatgctatgttataagtggttccagtgctgacttatcattggagaaggctgctgaggtatcgtgggaagaagaagcagaacattctggtgcgtcccataatatattggtagaagtacaagacgacgggacaatgaaaataaaagatgaagaacgcgacgatacattaactattctcttgaaagcgaccctgctagcagttagcggcgtatatcctctcagtattccggcaacacttttcgtatggtatttttggcagaagaagaaacagcgatcgggtgtgttgtgggacacaccttcaccgccagaggtcgaaagagctgtgttagatgacggtatatatcgaataatgcaaaggggtcttttaggccgttcccaagtaggtgttggggtatttcaggaaaatgtattccatactatgtggcatgtaacgagaggtgctgttttaatgtaccaagggaaacgcctggaaccctcgtgggcctctgttaagaaagatctaattagttacggaggtggatggagactgcaaggttcatggaatacaggagaagaagttcaggtgatagcggtagaacccggaaagaatcccaaaaacgtacaaacagcaccaggtacgtttaaaactagcgaaggtgaggtcggtgctatagctttagactttaaaccaggcacatccggtagtccgattgtaaatcgagaaggaaaaatagtaggactttatggaaatggagttgtaacaacctcaggcacgtacgtaagcgcgatagcacaagctaaggcatcacaagaaggaccactaccagaaatcgaagatgaagtattcagaaaaagaaacttaacaataatggatttacatccaggctcagggaaaacacgacgctacttacctgcaatcgttcgcgaggccatcaaacgtaaactcaggacacttatactagcccccactcgagttgttgctagcgaaatggcggaagctctgaagggtatgccaatacgttatcagaccacagcagtaaagtccgaacataccggcaaggagatagtagacctgatgtgtcatgctacgttcactatgagactcttatcgcccgttcgagtacccaattataatatgattatcatggatgaagcacattttacagatccgtcttctattgcggctcgagggtacatctcaacacgggttggaatgggagaagcagctgcgatctttatgactgcaacaccaccaggaagcgtagaagcgtttccacagagtaatgcagttattcaagacgaggaaagagacatacccgaaagatcctggaactcgggttacgagtggataacagattttccaggcaagactgtttggttcgttccgtctataaaaagcggtaatgacatcgcaaattgcctccgcaaaaatgggaagcgcgtgattcaattaagtagaaagacatttgatactgaatatcagaaaaccaaaaataacgattgggattacgtagtgacaacggatatttcggaaatgggagcaaattttcgagcagatcgtgttatagatccacggcgatgtttaaaaccagtaattctcaaagatggcccagaacgtgtaatactcgctggacccatgccggttacggtcgctagtgccgcacaaaggcgtggaaggattggtcgaaatcacaataaagagggagatcaatatatttatatgggacagccactgaacaatgatgaagatcacgcgcattggacggaggcaaaaatgctcttagataatataaataccccagaaggaattatacctgcactattcgaacccgaaagagaaaagtcggcggcaattgacggcgagtatagactacgaggagaagcccgtaagacatttgtggagctcatgcgtagaggtgatctaccagtgtggctctcctacaaagtcgcatcagaaggatttcaatacagtgataggcgatggtgctttgatggagagagaaacaaccaagtactagaggaaaatatggatgttgaaatctggacaaaagaaggagaaagaaagaaactaagacctcggtggcttgatgctagaacgtacagcgatcctctagcattgcgagaatttaaagaatttgcagcaggtcggagaagcgtttccggcgatttaatcctagagattggcaaattacctcaacacttaacgcaacgcgcacaaaacgcattagataacttagtgatgttacacaattcagaacagggaggaagggcctatcgacatgctatggaagaattaccggacactatagagactctaatgcttctggctttaatcgcggtacttacagggggcgtaactttatttttcctatcagggagaggtttaggaaaaacatcgattggtctactttgtgttatggcatcaagcgtcctactatggatggcgagcgtagagccgcattggatagcggccagtatcatacttgagttctttttgatggtattattaatacctgaaccagatcgtcaacgaaccccgcaagacaatcaactcgcgtacgttgtcataggattattattcatgatactcactgttgctgcaaacgaaatgggtttattggaaaccacgaaaaaggacctgggcataggacacgtagctgtagaaaatcatcaccatgctgcgatgctagacgtcgatcttcacccagcgtcagcatggactctttatgctgtagccaccactataataacacccatgatgcgacacactatagaaaatacaacagctaacataagtttaactgccattgctaatcaggcagcgatattgatggggcttgacaaaggatggccaatatcgaaaatggatattggcgtcccgttattggcgttaggatgttatagccaagtaaacccacttactctgactgccgcagtgttgatgctagttgcacattacgcaataattggaccaggcttacaagcaaaggcaaccagagaagcacaaaagagaaccgctgcaggcataatgaaaaacccgacggttgatggaatagtcgcaattgatctggaccctgtcgtgtacgatgctaagttcgagaaacagctcgggcagatcatgttattaattttatgcacaagccaaatactactcatgaggacaacatgggcactatgtgaaagcattactcttgcaacaggaccattaaccacactgtgggagggatcacccgggaaattttggaataccactatagcggtaagcatggcgaacatatttcgcggaagttatcttgccggggcagggctggcattttcactaatgaagtctctagggggaggaagaaggggaacaggcgctcaaggcgaaacactcggagaaaaatggaaaaggcaacttaatcagctatctaaatcagaatttaatacatataaacgtagcgggataatggaagtagatagaagtgaagcgaaggagggcttaaaacgcggggaaaccaccaaacatgcagtaagtagggggaccgccaagctacgctggtttgttgaaagaaacttagtaaagccagaagggaaagttatagatttggggtgcggtaggggcggttggtcatattactgcgcgggactgaagaaagtgaccgaggtcaagggatacactaaaggcggtccaggacatgaagaaccaatacctatggctacctatggttggaatctcgtaaaattacacagtgggaaggatgtgttctttattcctccagaaaaatgtgatacattgctatgcgacattggagaaagctcgccaaaccctacaattgaagaaggacgcaccctacgcgtcttgaaaatggtggaaccttggttacgtggaaatcaattctgcataaaaatattaaacccgtatatgccttcagtcgttgaaactttggaacagatgcaacgaaaacacggcggaatgctagttcgtaacccattatccaggaacagcacgcacgaaatgtactgggtatcatgtggaacggggaatattgtttccgctgtaaatatgactagcagaatgctactaaatcgtttcacaatggtgcatagaaaaccaacctatgagagggacgtagacttaggagcgggaacacgacacgttgcagtagagcctgaggttgcaaatttagacataataggacagaggatagaaaacattaagcacgaacataaaagtacgtggcactatgacgaagacaacccttataagacttgggcgtaccatgggagttacgaggtaaaaccttcaggctcggcttcatcaatggtaaatggagtcgttaaattgcttacaaaaccatgggatgtaatacctatggtaacacaaatagcaatgactgatacaaccccatttggtcagcaaagagtatttaaagagaaggtagatacaagaacacccaaagcaaaaaggggcaccgcccaaatcatggaagtgacagcgaaatggttatggggtttcctatcccgaaacaaaaagcctagaatctgtactagggaagaatttacaaggaaagtaagatccaatgccgcaattggcgcagtattcgttgatgagaaccagtggaactcggcgaaggaagccgttgaggacgaacggttctgggatttggtacatagggaacgcgaactacacaagcaaggcaaatgcgccacatgtgtatacaatatgatgggcaaacgtgagaagaaattgggtgaatttggtaaagcgaagggatctcgcgccatttggtatatgtggttgggcgcaaggttcctcgagttcgaggcattaggcttcatgaacgaagaccactggttcagccgtgaaaatagtctaagtggagtcgaaggggaaggattacataaactaggatatattctaagagatattagcaagataccaggaggaaacatgtatgctgacgatacggctgggtgggacacgagaattaccgaagacgatctacaaaacgaggccaaaattactgacataatggaacctgaacacgcccttttagcgaaatctatatttaaattaacttatcagaacaaagttgttagagtacagagacctgcgaaaaatggtactgtaatggatgtaataagtagaagggaccaaagagggtctggccaggtaggcacatatggactaaacacatttacaaacatggaagcacaacttattcgtcaaatggaatccgagggaatattctcaccgtccgagctcgagaccccaaatctagcagggagagtatttgattggttagagaagcatggagtggagcgattaaagagaatggcaatcagtggtgacgattgtgtcgttaaaccaatcgatgatcgcttcgccacagcacttacagctttaaatgatatgggtaaagttcgaaaggatataccgcaatgggaacctagcaagggttggaatgattggcagcaagtaccattttgctcacaccatttccaccaacttataatgaaagatggcagagaaatcgtggtgccgtgtcgaaaccaagatgaacttgtcggcagagcaagagtatcccaaggagcgggatggagtttacgagaaactgcctgcctaggaaaaagttacgcacaaatgtggcagttaatgtatttccatcgaagagacctgagactagcagcaaatgctatatgttcagcagtacctgtagattgggtgccaacaagccgcacaacatggtccattcatgcacaccatcaatggatgacaaccgaggatatgctttcagtgtggaacagagtatggatagaagaaaatccttggatggaagacaaaacacacatatcatcttggggcgacgtaccatacctagggaagagagaagatcaatggtgcggttcactaataggattaacagcgagagctacgtgggctactaatatacaagtagcaataaatcaagtgagaaggttaattggtaatgagaattacctagattatatgacaagcatgaaaaggttcaagaacgaatcagatcctgaaggtgcgctatggtaa

SEQ ID NO: 21906 - RNA, 9879 nt, synthetic construct
  misc_feature 1..9879: note = derived and/or modified CDS sequence (opt6) from DENV-1__EU482801__SS-prME
  source 1..9879: mol_type = other RNA
tccgtaactatgctactcatgttaatgccgactgccttagcctttcatttaactacaagaggaggtgaaccacatatgatagtcagtaaacaagaaagaggtaaatcactcctttttaaaacaagtgctggagttaatatgtgcactttgatagctatggatttaggagaactatgcgaagatacaatgacatataaatgcccacgaataacagaaacggaacctgatgacgtggactgttggtgtaatgcgactgatacatgggtgacgtacgggacatgtagtcaaacaggagaacaccgacgtgacaaaagatcagtcgctttggcaccccatgtgggcctaggacttgaaacgcgcacggaaacatggatgagttcagaaggcgcatggaaacaaatccaaagggtcgaaacttgggcactgaggcacccaggttttaccgttatcgctctcttcctagcccatgccataggaacatccattacacagaaagggataatttttatactattaatgttggttactccaagcatggcgatgcgctgtgtaggaatcggttcgcgagattttgttgaagggttaagtggagcaacctgggtagatgtcgttttagaacatggctcatgtgtgacaacaatggcaaaggataagccgactcttgacattgaattgctgaaaacggaagtcacaaacccagcagtacttcgaaaactatgtatcgaagcaaaaatttcgaacacaaccacagatagtaggtgtccgacacaaggtgaagcgacgctagtcgaagaacaggatgcgaatttcgtatgtagaagaacatttgtcgatcgaggttggggtaatggttgcggattattcggcaagggctcattaataacttgtgcaaaatttaagtgtgttacaaaattagaaggaaagattgttcaatatgaaaatcttaagtactctgtaatagtcaccgttcatacaggtgatcaacaccaagtcggcaatgaatccacagaacatggcacgacagctacaattacgccccaagcaccgacaactgagattcaactaacggactacggcgcactaacactagactgcagcccccgtaccggattagactttaacgagatggtactcctaaccatgaaagaaaagtcgtggttagtacataagcaatggtttcttgacttgccgcttccctggacgagtggggccagcacatctcaagaaacttggaacaggcaggacttattggtgactttcaaaacagcccacgctaaaaagcaagaagtagttgtgctaggctctcaagaaggagccatgcatacagcccttacaggagcaacagaaatacagacaagtggaacgactacaatattcgctggccacctaaaatgtaggctaaaaatggacaagctcacacttaaaggaatgtcgtatgtgatgtgtacaggatcgttcaaactggaaaaagaagttgctgaaacacaacatgggacagtcttggtacagataaaatatgagggcaccgacgctccatgtaaaatacctttcagtacacaagacgaaaaaggtgtaactcaaaacggcaggctaatcactgctaatcctatagtaactgacaaagaaaaacccgtcaatatagaagcagaaccaccatttggagagtcttatatcgtaatcggcgccggagaaaaagctctgaaattgagctggtttaagaaaggttcttctataggtaaaatgttcgaagctactgctcgaggggcgagacgaatggccatcctaggagatacagcatgggactttggatcaatagggggcgtttttacctctgtaggaaaattagtccaccaaatatttggaactgcttacggagtactgttttcgggcgtctcttggacaatgaaaattggcattggagtactgctaacttggttgggactaaattcaagaagtacatccttgagcatgacgtgtatagcagtcggattggtgaccctttatcttggcgttatggttcaagcagacagcggctgtgttatcaactggaaaggaagagaacttaaatgcggatcaggaatttttgtgactaatgaggtacacacatggacagaacaatataagtttcaggcggattccccaaaaagactgagtgccgccataggtaaagcctgggaagagggagtgtgtggaataaggtcagcaacccgtttagaaaacataatgtggaagcagatctcaaacgagttgaatcacatattacttgagaatgacatgaaatttacagtcgttgttggagacgtcgccgggattctagcacagggaaagaaaatgataagaccgcaacccatggaatataaatattcttggaaatcatggggtaaagcaaaaataataggtgctgatgtacaaaatactacgtttataatagacggaccgaatactccagaatgccccgatgaccagcgagcatggaacatctgggaggtagaagattacggattcggtatttttactactaacatttggttgaaattgagagatagctatacgcaggtatgcgatcacaggttaatgagcgcggcaataaaggattcaaaagctgtacacgctgacatgggctattggatcgaatcagagaaaaacgagacatggaaacttgcccgtgcctcatttattgaagtcaagacttgcatttggccgaaatcccatacattatggtccaacggtgttctagaatcagaaatgatcatacccaaaatctatggaggccccatatcgcagcacaattatagaccaggatattttacacaaactgcaggcccatggcatttgggaaaattagagctcgattttgatttatgtgaaggcacgacggtcgtagtagacgaacactgcggcaaccgagggccctctctaagaacgaccaccgtgacaggaaaaattattcacgaatggtgttgcagaagctgcactcttcctcccctacgtttccgaggagaagacgggtgttggtatggaatggaaattaggccagtcaaggagaaggaagaaaatctagtaaaatcgatggtctcagcaggatcaggtgaagttgatagtttctctttaggcttactctgcatatcgattatgatagaagaagtcatgaggtcaagatggtcgagaaaaatgttaatgactggtacactggctgtcttctttttattaataatgggtcaattaacctggaatgatctaattcgcctctgtattatggtcggcgccaacgccagtgaccgtatggggatgggaacaacgtatctagccctcatggcaacgtttaaaatgaggccaatgtttgcagtagggttattgttccgacgactcaccagtagagaagttctacttttgacgattggattatcgttggtagccagtgtagagttacctaattctttggaagagttaggtgatgggctagctatgggcatcatgatattaaagctcctcacagattttcagagccatcaactgtgggccaccttattatcactaacgtttattaaaaccacattttcattacactacgcgtggaaaacaatggcaatggtactaagtatagtctccttattcccgctgtgtttaagcactacatcacaaaagacgacgtggctcccagttctattaggatctcttggctgcaaacctctgacaatgtttctaatagcagaaaacaagatatggggcagacgatcttggcctcttaacgaaggaataatggccgttggaattgtttcaatcctcctttcaagtcttctaaagaatgatgtaccattggcgggtcccctaatagctggagggatgctgattgcatgttacgtcatatccggttcttcggcagacctaagtttagaaaaagcagcagaggtgtcttgggaagaggaagcagaacatagtggtgcaagtcacaatatactggtagaggtacaagatgatggaacaatgaagataaaagacgaggaacgagacgatacgttaacaatacttctgaaggccaccttgttagctgtgtcgggagtttatcctttatctataccagctacattgttcgtttggtacttttggcagaagaagaaacaaagaagcggagtactttgggacacaccttctccccctgaagtaggaagggcagttttagatgatggaatctataggataatgcagagaggcctcttaggacgatcgcaagtaggagtaggagtattccaagaaaatgttttccatacgatgtggcacgtaacacggggagccgtacttatgtatcaaggtaaaagattagaaccctcgtgggccagtgttaagaaagatctcatatcttacggtggtggatggaggctacaagggtcgtggaacacgggagaagaagttcaggtaatagcagtggaacctgggaaaaatcctaaaaacgttcaaacagcaccaggaacttttaaaaccccagaaggagaagtaggcgcaattgctcttgattttaaacctggaacatcgggatcccctatcgtaaatcgagaaggcaaaattgtgggattatatggcaatggggtcgttactacatctggcacttatgtaagcgcaatagctcaggctaaggcttctcaggaaggtcctctacctgaaatagaagacgaagtctttcgaaagcgaaatttaactattatggacctacacccaggaagcgggaagaccagaagatatctccccgcaatagtaagagaagctataaaaagaaaactcagaacgttgatacttgctccaacccgagtggttgcatcggaaatggctgaagcactaaaaggcatgcccatacggtaccaaaccacggcagtaaagagtgaacatactggaaaagagattgtggaccttatgtgtcacgccacatttacaatgcgccttttatcgccggtaagagtaccaaactacaatatgataattatggatgaagcacatttcaccgatccttctagcattgctgcgcgaggatatatttcgactagagtagggatgggagaggcagcagccatttttatgacggcaacacctccagggtctgtggaagcatttccacaatcaaacgctgttatacaagacgaagaacgagatataccagaaagatcttggaactctggttacgagtggattacggatttccctggaaagactgtatggttcgtaccctcaataaagtcaggcaatgacatcgcgaattgtctacgcaaaaatgggaaacgtgtcattcagctatcaagaaagacatttgatacggaatatcagaaaacgaaaaacaatgactgggattatgtagtcacaaccgacatttcagaaatgggagctaactttcgggctgatcgggtgatcgacccgagacgttgtcttaaaccggttattctaaaggatgggccagaacgcgttatcttggccggtccgatgccagtaaccgtggccagcgcagcacaaagacgcggaaggattggtaggaatcataataaagaaggagatcagtacatatatatggggcaaccccttaacaacgatgaagatcatgcgcattggacagaagctaaaatgttacttgacaatattaataccccagaaggaataatccctgccctgtttgagccagaacgggaaaaatcagcagcgattgacggtgagtatcgacttagaggagaagctagaaaaacatttgtagagcttatgcgtcgcggtgatctaccagtgtggctatcttacaaagtagcatcagagggttttcaatattctgacaggcgctggtgcttcgatggtgaacgaaacaatcaggtgcttgaagaaaatatggatgttgaaatctggactaaagaaggagaaagaaagaaactgaggccgagatggcttgatgcacgaacatacagcgatcccttagcccttcgagagttcaaagaatttgcggctgggaggcggtcggtatcaggagatttaatactagaaataggcaaattaccacaacatttaactcaaagggcacagaatgcactggacaatctagtcatgttgcacaacagcgaacagggtggcagagcatatagacatgccatggaagaattaccagacaccatcgagacactcatgctcctagccctcatagcagtactaacaggcggggtcacactatttttcttatccggacggggactaggcaaaacctctattggtctattatgcgtcatggctagttcggtactattatggatggcaagcgtggaacctcattggatagccgctagtataattttagagttctttttaatggtattgctaatcccggaaccggatcgacaaagaacacctcaggataaccaactagcttatgttgtgataggactcctatttatgatccttacagtagcggctaatgaaatgggcttattggagacgactaagaaagatctgggaattggccacgtagctgtggaaaaccatcatcacgcggcaatgttagatgtggatctacatccggctagcgcctggactctttatgcagtagctactactattattaccccaatgatgagacacacaattgaaaacacaaccgctaatatatcactgacggctatagcaaaccaagctgcaatattaatgggactggacaagggctggccgatctcaaaaatggatatcggggtaccattgttagcattagggtgctactcacaagttaatcctctaactctaacagctgcagtattaatgcttgtagcacattatgcaatcatagggccaggactacaggccaaagccacaagagaagcgcagaaacgaaccgccgcgggtattatgaagaacccaaccgttgacggaatcgtcgcgatcgacttagaccctgtcgtctatgacgcaaagttcgaaaaacaattaggccaaataatgctcttaatactctgcacttcccaaatactactcatgagaaccacatgggccttatgtgaaagtattaccttggcaaccggaccactcacaacattatgggaaggctcacccggaaagttctggaacacaaccatagcagttagcatggcaaatatatttcgaggaagctatcttgctggtgccgggttagcctttagtctaatgaaaagtttaggtggcggaagacggggaacaggagctcagggagagaccttaggcgaaaaatggaagaggcagttaaatcagttatctaaaagtgagtttaacacttacaagagaagtggtataatggaggtcgatagaagcgaagcaaaagaaggattaaagagaggagaaactaccaaacatgcagtttcaagaggaactgcaaaattaagatggtttgtcgaaagaaacctagtaaaaccagaaggaaaagtgatcgatttgggatgtggcaggggcgggtggtcttactactgtgctggactcaagaaagttacagaggtaaaaggatatacaaaaggtggacccggccatgaagaacctataccaatggccacatacggatggaatttggtaaaactccatagcggaaaagatgtattctttattccacctgagaagtgtgacacactgttatgcgacataggagagagtagtccaaatcccacaatagaagaaggacgtacattgcgggttcttaagatggttgaaccatggttaagggggaaccagttttgcataaaaatacttaacccctatatgccatcagttgtagaaacattagaacagatgcagagaaagcatggcggaatgcttgtacgtaaccctctcagtagaaattcaacccatgaaatgtattgggtctcctgtggtactggaaatatcgttagcgccgtgaatatgacatcaagaatgttattaaacagatttacaatggcacacagaaaaccaacttacgaaagagatgtagaccttggagctgggacacggcacgtagcagttgaacctgaggttgccaatttagacataataggtcaaagaatagaaaacatcaaacatgaacataaatctacgtggcattatgatgaagacaatccatataaaacctgggcctatcatggttcctacgaagttaaacccagtggatcagccagcagtatggttaatggagttgtaaaactactaacaaaaccatgggacgtaataccaatggtaacgcagatcgcaatgacagataccacaccgtttggacaacaacgggtatttaaggaaaaagttgatacgaggaccccaaaagcaaaaaggggaactgcacagatcatggaagtcacagcaaaatggttgtggggattcttatcacgcaacaagaaacccaggatatgtactcgagaagagttcacaagaaaagttcgctctaatgccgcgataggggctgttttcgtagatgagaatcagtggaactcagccaaagaagcagtagaagatgaaagattctgggatttagtacaccgcgaacgcgagttacacaagcaaggaaagtgcgctacttgcgtctacaatatgatgggaaaacgagaaaagaaactaggagagttcggcaaagcaaaaggcagtcgtgcaatctggtacatgtggctaggagcacgctttctagagtttgaagcgttaggcttcatgaacgaagatcattggtttagtagggagaactcactatcaggagtagagggcgaaggtctccataaattaggatatatcctaagagatataagtaacattcctggtggcaatatgtatgcagatgatacggcaggttgggacacgcgaataactgaagacgacttacaaaatgaagcacgtataacggacataatggagccagagcatgcattactagctaagagtatatttaaattgacttatcagaacaaggttgtaagagtgcaaaggcccgccaagaatgggaccgttatggacgtaatttcaaggcgagaccagagaggcagtggtcaggtcggtacatacggcctaaacacctttacaaatatggaagcgcaacttataagacagatggaaagtgaaggaatattctctccctctgaattggagacaccgaatctagcggaacgtgttctagactggttggaaaaatacggagttgagcgtctcaaaagaatggcgatatcaggtgacgactgtgtggttaagccaatcgatgacagatttgcaacggcactcaccgcactaaacgacatgggtaaggtaagaaaagacataccccagtgggaaccgtcaaaaggctggaatgactggcaacaagtgccgttctgtagccatcatttccatcaattaataatgaaagacggtagggagatcgtcgtaccctgtagaaatcaagatgagctagtaggacgagcacgagttagtcaaggcgctggatggagtctcagggagacagcatgtttaggtaaaagttacgcacaaatgtggcaattaatgtattttcatcgaagagatttgcgattagcagcaaacgcgatttgctccgcggtccctgtggactggattccaacctcaaggacaacatggtcgatacatgcgcatcaccaatggatgacaacagaggacatgcttagcgtatggaacagggtttggattgaagaaaatccttggatggaagataaaacacacataagctcatggggagatgtgccctacttaggaaaaagagaagatcaatggtgtggttcactaataggcctaaccgcacgagcaacatgggctacaaatatacaggtggcgataaatcaggtacgtagattaataggtaatgaaaattatctagactatatgacaagcatgaaaagattcaagaatgaaagtgacccagaaggtgcactctggtag

SEQ ID NO: 21907 - RNA, 9879 nt, synthetic construct
  misc_feature 1..9879: note = derived and/or modified CDS sequence (opt6) from DENV-1__EU482802__SS-prME
  source 1..9879: mol_type = other RNA
tccgtaaccatgcttcttatgcttatgcccacagcactagcatttcacctcacaacccgaggaggggaaccccacatgatagtatcaaaacaagaaaggggcaaatctctgttgtttaaaacgtcagctggcgtcaacatgtgtacgttaattgctatggacttaggagaattttgcgaagatacaatgacttataaatgcccaaggataacagaagcggaaccagatgatgttgactgttggtgcaatgcgacggatacctgggttacatatggaacatgtagccaaactggcgaacaccgacgagacaaaaggtctgttgctcttgcaccgcatgtaggattaggtctagaaacgcggactgaaacgtggatgtcttcagaaggagcatggaaacaaatccaaagggtggaaacttgggctttgaggcatcccggatttactgtcatcgctttattccttgctcatgcaatcggtacgtcgatcacccaaaaaggcattatttttatcctgcttatgctggtaactcctagcatggctatgcggtgtgtcggtattggctcgagagactttgtagaaggattaagtggtgcaacatgggttgatgtcgtcttagaacacgggagttgcgtgactactatggcaaaagacaaaccgactttggacatagaattattgaaaacagaagttacaaatccagccgttcttcgtaaattatgcatagaggcaaaaataagtaacacaaccacggactccaggtgtcccacacaaggtgaagcaacgcttgtcgaagaacaagacgcaaattttgtttgccgcagaacatttgttgatagaggatggggaaatggttgcggtttattcggcaaaggttctctaataacttgtgcaaaatttaaatgtgtcactaagttagagggaaaaaccgtccaatatgagaacctaaaatatagtgtaattgtaactgtacatactggtgaccagcatcaagtagggaacgaatcaactgaacatggtaccacagcaacgataacaccgcaagcgcctagtaccgagattcagttgactgattacggggctcttaccctagattgttcaccacgaacgggactcgatttcaatgagatggttctactgacaatgaaagagaaaagttggttagtacacaagcaatggttccttgatttacccctaccgtggacttctggtgctagtacatcacaagaaacttggaataggaaggatcttctcgtaacctttaagactgcacacgccaagaaacaagaagtagtagtattaggctctcaggaaggcgctatgcacactgcgctgaccggagcaaccgaaatacaaacgagtggaaccacaacaatatttgctggacacttgaaatgcaggcttaaaatggataaattaacattgaagggcatgtcgtatgtaatgtgcactggcagcttcaagttagagaaagaagttgcagaaacacaacatggaactgtattggtccaaataaaatacgagggcactgatgcaccatgtaaaattccttttagcactcaagatgaaaaaggcgtgactcaaaacgggagattaataaccgctaaccctatagtcacagataaagagaaaccggtgaacatcgaagccgaacctccatttggtgagagctacatagtcatcggagccggagaaaaggcacttaaattatcctggtttaagaaaggctcatcgatcggaaagatgtttgaggctaccgccagaggcgcgagaaggatggctattctaggagatactgcatgggatttcggaagtattggaggcgtattcacttcggtaggcaaattggtacaccaaattttcggcacagcatacggagttttattctctggtgtgtcctggacgatgaaaattggtattggagtcctactaacatggctcggactgaatagccgttcgactagcctttcaatgacctgtatagcagtgggattggttactttatatctaggagtaatggttcaagccgactcaggatgtgtgataaactggaagggaagagaattgaaatgtggcagtggaatatttgtgacaaatgaagtacatacatggacagagcaatataaatttcaggccgattctccaaaacggctatcagcagccataggcaaggcgtgggaagaaggcgtttgtggcatccgatctgcgaccagacttgaaaatatcatgtggaaacaaatttctaacgaacttaatcacattctattggaaaacgatatgaaatttactgtagtagtcggagatgttgcagggattcttgcgcagggtaagaaaatgatacgtccccagccaatggaatataaatactcatggaaatcgtggggcaaagcgaaaataataggagccgatgtacaaaacaccacattcataattgacgggccaaacacaccggagtgcccagatgatcaaagagcatggaatatctgggaagtcgaagactacggttttgggattttcactaccaatatctggttgaaactgcgcgacagttatacacaagtgtgtgatcacagactaatgagcgctgccataaaggattccaaagcagtacacgcagacatgggatattggatagaatcggagaaaaatgaaacctggaaattggcaagagctagcttcatagaagtaaagacctgcatttggccgaaatcacacacactatggtctaacggcgtcttagaatcagagatgataatccccaagatctatgggggaccgataagccaacacaattatagaccaggttactttactcaaacagcagggccatggcatcttggaaaattagaactagatttcgacctgtgtgaaggaacaacagtagtcgttgatgaacattgcgggaataggggtcccagtctaaggaccactacagtgaccggaaagataatacacgagtggtgttgcagatcttgcacattacctccactaagattcaaaggagaggacggctgctggtatggcatggaaataaggccagtaaaagaaaaagaagaaaatttagtaaaatcaatggtttccgctggaagcggagaggtagactccttttctctcggacttttatgtataagtataatgattgaggaggttatgcgctcccgatggagccgcaagatgcttatgacaggcactctcgcagttttcttcctactcattatgggccagctcacatggaatgatctaattagattgtgtattatggtaggtgcgaacgcttcagatagaatgggaatgggtactacatatctagcacttatggcaacatttaagatgcgacccatgtttgcagttggtttactatttagaagactcacaagtcgggaggttttacttttaactataggtttgagcctagtagcatctgttgaattgcctaacagtctggaagaactcggagacggacttgctatgggaattatgatattaaagttgctaaccgattttcaaagccatcaactctgggcaacactattatcactaacgtttattaaaacaacattcagtctacattatgcttggaagaccatggcgatggttttatcaatagtatcactgcttcctctgtgcttaagtacaacttcacagaaaactacctggctacctgtattattaggatctctaggatgcaagcccttaaccatgtttctaatagctgaaaataaaatatggggacgtaaaagttggcctcttaatgaaggtataatggccgtaggcatagtttcaatattgctatcctctcttttaaagaatgacgtgcccttggcagggcctcttattgctggcggtatgctaatagcatgctacgtcataagtggtagtagcgcagatttgtccctagaaaaagcggcagaagtatcttgggaagaagaagcggaacattcgggtgctagtcacaatatcttggtggaagtacaagatgacggaaccatgaaaattaaggatgaagaaagggacgatactctaacaatcctgcttaaagcaactttattggcggtgagcggagtatacccattgtcaataccggcaactttatttgtttggtatttttggcaaaagaagaaacaaagatcaggtgtattatgggatacaccgagtccgcctgaggtagaacgcgccgttttagatgatggtatatacagaatcatgcaaagaggtcttctagggcgctcgcaagtgggagtaggtgtttttcaagaaaatgtcttccatactatgtggcacgtcacgagaggcgcagtacttatgtatcagggaaagcgtttagaaccatcttgggcgagtgtgaaaaaggaccttatcagctatggtggtggatggagactccagggatcctggaataccggtgaagaagtacaagtaatcgctgtggaaccgggaaagaatcctaaaaatgtacaaacagcgcctggtacgttcaagacgtcagaaggcgaagtcggagctatagcgcttgacttcaaacctggaacgtctgggtctccaattgtgaatcgcgaaggtaaaatagtgggactttatggcaatggcgtagtaacgacaagtgggacatacgtttcagcgattgcacaggctaaagcatcccaggaaggaccgcttcccgagatcgaagacgaagtctttcgcaaaagaaatctaacgattatggatcttcacccaggcagtggcaagacaaggaggtatctgcctgcaattgttagagaagcaataaaacgaaaactaagaaccttaattctagcccccaccagggtagttgcatcagaaatggcagaagcactcaaaggcatgccgatcagatatcaaacgacggcagtcaaatccgaacatacaggtaaagagattgtagatttaatgtgtcatgcaactttcactatgagattattgagcccagttagggtgccaaactacaatatgattattatggatgaggcacatttcacagatccatcatcaattgccgcccgtggttacatatctacaagggtcggtatgggcgaggccgcagcgatctttatgacagcaacgccacctggaagtgtagaagcatttccacaatcaaatgcagtaatccaagatgaagaacgggatattcctgaacgatcatggaatagtggctatgaatggattacagatttccctggaaagactgtgtggtttgtaccatccatcaagtcaggaaatgacattgctaattgtctgcgcaaaaacggaaagagagtaatacagctgtcgcggcgaacattcgacactgaatatcagaagaccaaaaataacgactgggactatgttgtcactacagacatctctgaaatgggtgcgaatttccgagcagatagagtcattgaccctagaagatgtttgaaacctgtaatactaaaagatgggcctgaacgggtaatattggccggaccgatgccagtgacagtagcttctgcagcacaacggagaggtaggataggccgtaaccacaataaagaaggggaccaatatatttacatgggacaacccttaaataacgacgaagaccatgctcactggaccgaagcaaaaatgttgctcgataacataaatacacccgaaggcataataccagccttattcgaacccgaaagagaaaagtccgcagcgatagatggagagtataggttaaggggagaagcacgtaaaacattcgtagaattgatgagaagaggagatctgcccgtatggttgtcatataaagttgcctctgaaggttttcaatatagtgaccgcagatggtgctttgacggagaaagaaataatcaagtcctcgaagaaaatatggatgtagaaatatggacaaaggaaggagaaaggaagaaactccggccgcgttggctggacgcaagaacatactctgatccactcgctctacgtgagttcaaagaatttgctgcaggtcgcagaagtgtcagtggggatctgatattagaaataggaaagttaccgcaacatctaacccaaagggctcaaaatgcattagataatttagtcatgttacataacagcgaacagggcggtagagcatataggcacgcaatggaagaattaccagataccatagagaccctcatgttactggcactgatagctgttttaacaggaggggtaacactatttttcttgtctggcaggggtcttggaaaaacgtccataggcctactttgcgtaatggcctcatctgccttactatggatggcgtcagtagaaccacactggatcgcggcgagtatcattctcgagttctttttaatggttctcctcattccagaaccggatcgccaacgaactccccaagataatcaattagcatacgttgttataggtcttttgtttatgattctgacagtcgcagcaaatgaaatgggattattagaaactacgaagaaggacttaggtataggccatgtagcagttgaaaatcatcaccatgctgcaatgcttgatgttgacctgcatccggcgtccgcctggacgctatatgccgtagctacgacaataataactccgatgatgcgtcatacaatcgaaaatactactgctaacatctcattaacagccatcgcgaaccaagcggcaatattaatgggcttagataaagggtggccaatctcaaaaatggatataggtgttccactcctagctttgggatgctattcacaagttaacccattgaccttgacagcggcagtgttgatgctggttgcccactacgccattattggtccagggttacaggccaaggccacaagagaagcgcagaaaaggacagctgccggaataatgaaaaacccaacggtagacggcatcgtcgcaattgatctggatcccgtagtttatgacgcaaagtttgagaaacaacttggccaaataatgttgttaattctgtgcacatcacaaattctattaatgcgtactacatgggcactttgcgaaagcattactctagcaactggaccattaactacactgtgggaaggttcaccaggcaagttttggaataccactatagcggtaagcatggcaaacatctttagagggtcttatctagcaggagcaggattagcatttagtttaatgaaatcgttaggtggcggtcgcagaggaacgggagctcaaggagaaactctaggtgaaaaatggaagcggcaattaaatcaactctctaaatcagagttcaatacgtacaaacgatcaggtataatggaagtggacaggtcagaagctaaagaaggtctgaaacgtggtgagacaacgaagcatgcagtttctagagggactgccaaactgagatggttcgtagaacgtaatttagtaaagcctgaaggaaaagttatcgatttaggctgtggaagagggggttggtcatattactgtgcagggctcaagaaagttacagaagtgaaaggatacacaaaaggaggaccgggacatgaagaacctattccaatggcaacatacggttggaacttggtaaaactacattcgggaaaagatgtgtttttcatcccgccagaaaaatgcgacacattattgtgcgatattggggagtcatcaccaaacccgacaatagaagagggacgcacgttgcgagtcttaaagatggtagagccttggttaagggggaaccaattctgtataaaaatcttaaacccatacatgccatccgtagttgaaacactcgagcagatgcaacgcaaacatggagggatgctagttcgtaacccattgtcgagaaattctacacatgaaatgtattgggtaagttgtggaaccggaaatatcgtctctgcagttaatatgacctcacgaatgttacttaatcgcttcacgatggcacacagaaaaccaacgtatgagagagatgtagacttgggtgcaggaactagacacgtagctgtagaacccgaagtcgctaatctagatataattgggcaaagaatagaaaacataaaacacgaacataaatctacgtggcattatgatgaggataatccatataaaacttgggcataccatgggagctatgaagtaaaaccaagtgggtcagcatcatctatggtaaacggagtagttaaattactaactaagccgtgggacgttatccctatggtaacccaaatagcaatgactgataccacaccgttcgggcaacaacgagtattcaaggagaaagttgatacgcgcacgcctaagagcaaaagaggaactgcccagattatggaagtaactgcaaaatggttatggggattcttgtctagaaacaagaaacccagaatttgcactcgagaagagtttacccggaaagtaagatcgaatgctgctattggtgccgtatttgtagatgaaaatcaatggaactccgcaaaagaagccgtagaggacgagagattttgggatttagtacaccgagaaagagagttacataaacagggtaaatgtgcaacatgcgtatacaacatgatggggaaaagggagaagaaacttggtgaatttggaaaagccaaaggatcgagagctatctggtatatgtggctaggtgcgcgctttcttgagtttgaagcgctaggcttcatgaacgaagatcattggttctcccgcgaaaattctctctcaggggtcgaaggggaagggctgcacaaactaggatatatcctaagggatataagtaaaatcccgggaggaaatatgtacgctgatgacactgcaggatgggataccagaataactgaagacgacctacaaaacgaagccaaaattacagacataatggagccagaacatgccctactcgcaaaaagtatttttaaattaacctatcaaaataaagtagtacgtgtacagcggcccgcgaaaaacggaactgttatggatgttattagcagacgtgatcagcgtggttcggggcaagttggaacatacggattaaacacatttacgaacatggaggcgcagctaatacggcaaatggaaagtgaaggaatcttctccccaagcgagctagaaaccccaaacttggccggtagggtactagattggttagaaaaacatggggtagagagattgaaaaggatggctataagtggagacgattgtgtagttaagcctattgacgacagatttgcaacagcattaacagcgttgaacgacatgggaaaggtaagaaaggacatcccccaatgggaaccgtcaaagggctggaatgattggcaacaagtacccttttgtagtcaccacttccaccagcttatcatgaaagatggtagagagatcgtcgtaccctgtcgtaaccaagacgaattagttgggcgcgcacgagtctcccaaggagctggctggagtttgagggagacagcgtgtctaggaaaatcatatgcacaaatgtggcagctaatgtattttcatcgaagggacctcagattagctgcaaacgcgatttgtagcgctgtaccagtggactgggttccaacgagtagaactacatggagcatccatgcacaccaccaatggatgacaacggaagatatgcttagtgtatggaaccgcgtatggatagaagaaaatccgtggatggaagataaaactcacatcagcagctggggtgatgtaccatacctaggcaaacgagaagatcaatggtgtggcagcttgataggattaacggctcgggcgacatgggctacaaatatccaagttgccataaaccaagtcagaagactaataggaaatgagaattacctagattatatgacttcaatgaagcgctttaagaatgaatcagatccagaaggagctttatggtaa

SEQ ID NO: 21908 - RNA, 9879 nt, synthetic construct
  misc_feature 1..9879: note = derived and/or modified CDS sequence (opt6) from DENV-1__EU482804__SS-prME
  source 1..9879: mol_type = other RNA
tccgtgactatgttactgatgctaatgcctacagcattggcctttcatctaacgacaaggggaggtgaaccgcatatgatcgtctcaaaacaagaaaggggtaaatcattgctatttaaaacctcagctggtgtcaacatgtgcacactaatagcaatggacttaggagaattttgtgaagatacaatgacctataaatgcccaaggataacggaagctgaaccagacgacgtagactgttggtgtaacgctacagacacatgggtaacatacggcacatgttctcaaaccggtgaacaccggcgcgataaacgtagtgtcgcattggcaccacacgttggcttgggattagaaacccgcacagaaacttggatgtcatcagaaggcgcctggaaacaaatccaacgagttgaaacttgggcactaaggcacccgggattcacagtcatcgccctatttctagcccacgcaataggaacatccatcacgcaaaaaggtattatatttatactactaatgttggtaacgcctagcatggcaatgagatgcgttggtataggatctcgagacttcgttgaaggcctgagtggagctacttgggtagatgttgttctggaacatggaagttgtgtaaccactatggctaaagataaaccgacactcgacatcgaactactaaaaacagaagttacgaatccagcagtcctcagaaaattgtgtattgaagctaaaattagtaacaccacgacagattctaggtgccctacccaaggagaagcaacattagtagaagaacaagacgcaaactttgtttgtagaaggacattcgttgataggggatggggtaatggttgcgggctgttcggaaaaggatctttaataacatgtgctaaattcaaatgtgttacaaaattagaaggtaaagtagtacaatatgaaaacttaaaatattcagtgatcgtcaccgtacacacaggggatcaacaccaagttggtaatgaatcgaccgagcatggaacaacagcaactatcacaccacaagcaccatcaacagaaattcaacttacagactacggagctcttacactggattgttcacctcgaactggacttgattttaacgaaatggttttactgaccatgaaagaaaaatcgtggctagtgcacaaacaatggttcttagacttgccattaccttggacctccggcgcatcaaccagccaagaaacatggaatcgcaaagatctattagttactttcaaaactgcacatgctaaaaagcaagaagtagtggttctgggctcacaagaaggagccatgcacacagcgctaactggcgccacagagattcaaacgtcgggaacaactaccattttcgccggacatctaaaatgtagactaaaaatggataaattaacccttaaaggtatgtcttatgtcatgtgtactggaagttttaagctcgaaaaagaagtagcagagacccaacacgggactgtactcgtccaaataaaatatgaaggtactgacgccccgtgtaagattcctttctcaacccaagatgaaaaaggtgtaacgcaaaatgggagattgattaccgcgaacccaattgttacggataaagagaaacctgtaaacatcgaagctgaaccccctttcggagaaagttatatcgtaattggcgcaggagaaaaagccttgaaattgtcatggttcaagaaaggatcatcaattggcaagatgttcgaagcaaccgcccgtggtgcgcgccgaatggcaatactgggcgatacggcctgggacttcggctcaataggtggcgtttttacgagtgtcggtaagttagtacatcaaatttttgggacggcatatggagtattgtttagcggcgtatcctggacaatgaaaataggtataggtgtactactgacctggttaggattaaatagcagaagcacatctctatctatgacatgtatagcggtcggcttggtaaccttatatttaggagttatggtacaagctgattcagggtgcgttataaactggaaaggcagagaacttaaatgtggctctggaatttttgttactaacgaagttcatacctggaccgaacagtataaattccaggctgactcaccaaagcgattatcagcggctataggcaaagcgtgggaggaaggagtgtgtggcattcgctcaaccacgagacttgaaaatataatgtggaaacaaattagtaacgaacttaaccacatcctcctggagaacgatatgaagtttaccgtagttgtaggagatgttgcaggaatactagcacaaggtaagaaaatgattcggcctcaacctatggaatataaatattcatggaagtcttggggaaaggctaaaattatcggcgcagatgtccagaatacgacgtttataatagacggaccgaatacacctgaatgccccgatgatcaacgagcctggaatatatgggaggttgaggattacggatttggaattttcacaacaaatatatggctgaaattgagagattcatacacacaggtatgtgatcataggttgatgtcggctgcgattaaggattctaaagcagttcacgcggatatgggatattggatagaaagtgagaaaaatgagacttggaaactagcaagggcttcattcatcgaagttaaaacgtgcatttggccaaagtcacacaccctatggagcaacggtgtgctagaatcggaaatgatcatacctaagatctacggaggaccgatctcgcagcataattatagaccaggctactttacacagactgcagggccatggcaccttggaaaattagagctagactttgacttgtgtgaaggcacaactgttgtagttgatgaacattgtggcaaccgggggccgagcttacgtacaactactgttacaggaaaaataatacacgaatggtgttgccgaagctgcacattacccccgctcagattcaaaggagaagacggttgttggtatggtatggaaatccgccccgttaaagaaaaagaagagaacctcgtgaaatcgatggtatcagcgggctctggagaagtagacagtttcagtttaggcttattatgtataagtatcatgatcgaggaagtaatgaggagtcgatggtcccgcaaaatgttaatgactggtactctcgcagtcttctttctattaataaccggacaattgacatggaacgacctaatacgattatgcataatggtgggagcaaacgcatcagatcggatgggcatgggtacgacctacctggcactcatggctacgtttaaaatgcgtccaatgttcgctgttggtttacttttcagaagactcacaagtagggaagtattattattaacaatcggtttgagcctagtcgcatcggttgaactgccgaactcattagaggaattgggagacggattagctatgggtataatgattttaaaactgcttacagatttccaatcacaccagctatgggctacacttttgagtctaacattcataaaaacaacgttctctttacactatgcgtggaaaactatggcaatggttttaagtattgtatcgttatttcctttatgtctaagtacaacgagccaaaagacaacatggctccccgtgttattagggtctctaggatgtaaacctctaacaatgttcttaatcgcggagaataaaatctggggtagaaaaagttggccattaaacgaaggtataatggcggttggaatagtttcaattttgctttcttccctgttgaaaaacgacgtacctctggcaggtcccttaatcgcgggtggcatgctaatcgcatgctatgtcatatcaggatcatcggcagatttaagtctagaaaaggcagcagaagttagttgggaagaagaagcagaacattctggcgcgagtcataacatcttagtagaagtacaagatgacggtactatgaaaataaaagatgaagagagagatgacacactaacgatccttttaaaagcaacattattagcagtatcgggggtgtatcccttaagtataccagcaactttattcgtatggtacttttggcagaagaagaaacagaggagtggggtattatgggacacgccatcacctcctgaggtagaaagagcagttttagatgatggtatctataggataatgcaaagagggcttcttggtcggtctcaggtaggagtcggggtttttcaagaaaacgtatttcatactatgtggcatgtgacacgcggtgcagttttaatgtaccaaggtaaaagattagagccttcgtgggcctcagttaagaaagatctcatttcgtatgggggcggttggagactacaaggcagctggaacaccggagaagaggtacaagtcattgcagttgaacctggcaaaaatccaaagaatgtacagacagcgcctgggaccttcaaaacctcggaaggagaagtaggcgccatagctcttgattttaaaccaggaaccagtggatcacctattgtaaatcgagaaggaaaaatcgtagggctctatggcaacggcgtcgtaaccactagcggaacatatgtgtccgcgatagctcaagcgaaagcatcacaagaagggcccctccccgaaattgaagatgaagttttcagaaaacgcaacttaacaataatggacctccatccgggctctgggaaaactcgaagatacttaccagctatcgtgcgagaagcgataaaaaggaaacttagaaccctgattttagcccccacccgagtagttgcatcagaaatggcagaggctttaaaaggtatgccaattagataccagactacagcagtaaagtcagaacatacagggaaagaaatagtggatctcatgtgccacgcaactttcaccatgcgcttactatcacctgtacgcgtacctaattacaatatgataatcatggatgaagcccacttcactgaccccagtagcatagcggctcgaggctatataagtacccgagtcgggatgggagaagcagcagcaatttttatgactgcaacgcctccaggctcagtagaggcttttccacaaagtaatgcggtaatccaagatgaggaacgtgatatacctgaaagaagttggaactcgggatacgaatggatcacagactttccagggaagactgtgtggttcgttccttcgataaaatcaggaaatgatatagccaactgtttaaggaaaaacggaaaacgcgttatccagttaagtcgtaaaacatttgatacagaatatcagaaaacgaaaaacaacgattgggattacgttgtaaccacagatattagtgaaatgggcgccaatttccgtgcggatagagtaatagaccctcgcagatgtttaaaaccggtcatcttaaaagacggaccagaaagagtaatacttgcaggtccaatgccggttaccgttgctagtgctgctcaaagacgcggacgcattgggcggaatcataataaagagggagaccaatatatttacatgggtcaacctctaaacaatgatgaagatcatgcacattggacggaggcaaaaatgttattagataatataaatacaccggaaggaatcatcccagcgttattcgaaccagagcgagaaaaatcagcagctatagatggggagtacagattaagaggagaagctaggaagacatttgtagagctaatgaggagaggagatttaccagtctggttgtcatacaaagtcgcctcagaagggtttcagtactctgaccgacgctggtgctttgacggtgaaaggaataatcaagtgctcgaagagaatatggacgtagagatatggaccaaagaaggagaacgtaagaagttaaggcccaggtggttggatgcacgaacgtattccgaccctcttgctttaagagaatttaaggaatttgccgcagggcgcaggtctgtttcgggtgatctgatactagaaattggcaaattacctcaacacttgacacaaagggcacagaatgcattggataatttggtgatgcttcataactcagaacaagggggacgggcttatcggcacgccatggaagagttacctgacacaattgaaacactcatgttactggcactcattgctgtccttacaggcggagtaactcttttcttcttatccggaagaggactaggaaaaacctcaattggcttactttgtgttatggcttcatcagtactactttggatggcgtcggtagaaccgcattggattgcagcaagtataatactagaatttttcttgatggtgctcttaatacccgaacccgatcgacaaaggactccacaggataatcaacttgcttatgttgtaataggtctgctattcatgatcttaacagtagcggcaaacgaaatgggactactcgagactacgaaaaaggacctgggcataggtcatgtcgcagccgaaaatcaccaccatgcagcaatgttggatgtagatctacatccagccagtgcgtggacgctatacgcagtcgcaacaactataattacacccatgatgaggcatactatagagaatactactgcaaatatttcacttaccgctattgccaaccaggccgctatactgatgggcctagataagggatggccaataagtaaaatggatattggtgttcccctcttagcactcggatgttattcacaagtgaacccattaaccttaactgcagcggtattaatgcttgtggctcattatgcaataatcggaccagggctgcaggcgaaggcaacgagagaagctcagaaaaggacggcagccggcatcatgaaaaatcccacagtggatggaatagtagctatagatctagatcctgtagtctatgatgctaaattcgagaaacaattaggccagataatgttgctaatcctttgcacaagtcagattttacttatgcgaaccacgtgggcattatgtgaatcgatcacgctggcaactggcccactaactacactttgggaaggatctcctggaaaattctggaacacgacgatagccgtttccatggccaacatatttagaggtagctatttagccggcgcaggcctcgcttttagtttaatgaaatcgttaggaggcggaagacgtggaacaggcgcacagggagaaacattgggagaaaaatggaaacgtcaattaaaccagttatctaaaagtgaatttaacacctacaaaaggtcaggtataatggaagttgacagatccgaagctaaagaaggactcaaaagaggagaaacgacaaaacatgcggtgtcgagagggacagctaaattacggtggttcgtggaacgcaatctcgtgaaaccagaaggaaaagttatagacttaggttgcggtagaggtggctggagttattactgtgctggcctgaagaaagtaacagaagtcaaaggatacacaaaaggcggtccgggccatgaggaacccattccgatggcaacgtatggctggaaccttgttaagctccatagtggtaaagacgtattctttatacccccagagaaatgtgatacattgctttgcgacatcggtgagtcgagtccaaatcctacaatagaagaagggagaacactgagagtgttaaagatggtagaaccgtggcttcgaggcaatcaattctgcatcaagattctaaatccatatatgccttcagttgtagaaacgctggaacaaatgcaacgtaaacacggaggcatgttagtaaggaaccccttaagcagaaattcaactcatgaaatgtattgggtaagttgcggaacaggcaacatagtatccgctgtaaacatgacttcacgtatgctgctaaacagatttactatggcacacagaaaacctacttatgaaagagatgttgatttaggtgcgggcactagacatgttgccgtcgaaccagaggttgccaacctcgacataataggccaacgtatcgagaatataaaacatgaacacaaaagtacgtggcattatgatgaggataatccatacaaaacctgggcctatcatggatcatacgaggttaagccaagcggatcggcctcctcaatggtgaacggagttgttaaactattaacaaaaccttgggatgtaatacctatggttacgcaaatagcaatgacagatacgacaccttttggtcagcaacgagtatttaaagaaaaagtagacacacgtaccccaaaagccaaaagaggaacagcacaaatcatggaggtcaccgctaaatggctatgggggtttttgtcccggaacaagaaaccgcggatttgtacaagagaagagtttacgcggaaggtcagaagtaacgcagcaataggtgcagtctttgttgatgaaaaccaatggaactcagccaaggaagcagtagaagatgaaagattttgggatctcgttcatcgagagcgtgagttacacaaacaaggtaaatgcgctacatgtgtatacaatatgatgggtaaaagagagaagaaactaggcgaatttggaaaagcgaaggggtcaagggctatctggtatatgtggcttggcgctcgcttccttgagttcgaagcattaggtttcatgaacgaggatcattggttttcacgggaaaattcattatccggagtagaaggagaaggccttcacaaactcggttacattctacgagacatttcaaaaatcccaggtggaaatatgtatgctgacgacaccgcaggttgggatacacggatcactgaagacgacttgcaaaatgaagctaaaataactgacataatggaaccagaacatgccttgctagccaaaagtatatttaaattaacttatcagaacaaggttgtcagggttcagcggccggcaaagaatggtactgtgatggacgtaatttctcgcagagatcaacgtggcagtggccaagtaggtacgtatggtctaaacactttcaccaatatggaagcacaacttattaggcaaatggagtcggaaggtattttcagtccatcagaattagaaacacccaaccttgctggacgagtattggattggttagaaaaacatggagtagaacgattaaaaagaatggcgatctctggagatgattgcgttgttaaaccaatcgatgacaggttcgcaactgctctcacggccttaaacgatatgggaaaagtaagaaaagatatccctcagtgggaaccttccaaaggatggaacgactggcaacaagttcccttctgttcacatcattttcatcagctgataatgaaagacggtagagaaatagtcgtcccttgtaggaatcaagatgaattagttggacgcgcgagggtgagccagggagcgggttggtcactacgtgaaacagcgtgtttgggtaaatcgtatgcccaaatgtggcaattaatgtatttccatagaagggacttaagattagctgccaacgcaatatgttcagcggtaccagtagattgggtgccaacatcccgcaccacttggtccattcatgcacatcaccaatggatgactacagaagacatgctatctgtttggaacagggtttggattgaggaaaatccgtggatggaggataaaactcatatttcatcatggggtgatgtcccctatttaggaaaaagggaagaccagtggtgtggaagtttaataggacttacagcgcgtgccacttgggctacaaacatccaagttgcaattaaccaagtacgaagattaatagggaatgaaaactacttagattacatgacttctatgaaacgatttaaaaatgaatcagacccagaaggagcgttatggtaa

SEQ ID NO: 21909 - RNA, 9879 nt, synthetic construct
  misc_feature 1..9879: note = derived and/or modified CDS sequence (opt6) from DENV-1__EU482806__SS-prME
  source 1..9879: mol_type = other RNA
tccgtaacaatgctattaatgttaatgcctacagctttggcatttcatctgacaacgagaggtggtgaaccacacatgatagtcacaaaacaagaacgtggaaaatcactccttttcaaaacaagcgcgggtgtgaacatgtgtactctgatagcaatggatctaggagaactctgtgaagatacgatgacttataaatgcccacgtataacagaagcagaacctgatgatgttgattgctggtgtaatgcaacagacacatgggttacatacgggacttgtagtcaaactggagagcacagaagagacaaaagatccgtagcattagcaccccatgtaggtttgggactcgaaactagaactgaaacctggatgagtagcgagggcgcatggaaacaaatacaaagagtagagacctgggctctacgacaccccggattcacagttattgcgttatttcttgcacacgcaatagggacctcaataactcaaaaaggtataatatttatactgctgatgcttgtcacacctagcatggctatgcgatgcgtgggtatagggtcgcgggattttgtagaaggattgtcaggagcaacgtgggtagatgtagtactcgaacatggatcatgtgttactacaatggctaaagataaaccaacgcttgacatcgagctactcaaaacagaagtaaccaatcctgcagtgttacgaaaactatgtatagaagcaaaaatcagcaacaccacaactgatagccggtgtccaacgcaaggtgaagcaactctaatggaagaacaagatgctaatttcgtttgcagacgcacattcgtagacagaggatgggggaatggatgcgggttattcgggaaaggtagcctaatcacatgcgcaaaatttaaatgtgtcacgaaattagaggggaaaatagtccaatatgaaaacttaaaatactcagtaatagtaacggttcatacaggagatcaacaccaagtgggtaatgaatccacggagcatggaactaccgccacgatcacccctcaagctccaacatcagagatacaacttaccgactatggggcactaacattagattgtagcccccggaccggcctagattttaatgaaatggttttattaacgatgaaagaaaaatcgtggttagtgcataagcaatggttcttagaccttccacttccatggacttccggagcaagtacgagccaagaaacatggaatagacaagatctattagttacattcaaaacagcgcatgcaaagaaacaagaagtcgtagttttggggtctcaagaaggtgcaatgcatactgccctaacaggagccactgagattcagacgtcaggaacaacaacaatatttgcagggcacctgaaatgccggttgaagatggacaaattaactctaaaaggtatgagctacgttatgtgtacaggatcctttaaactagaaaaagaagttgccgagactcagcacgggactgtgttagttcaaataaaatacgaaggtactgatgcaccatgtaagattccttttagtacacaagacgaaaagggagttacccaaaatggtcgcctgataacagcaaacccaattgtaactgataaggagaaaccggtaaatatagaagcggaaccaccctttggagaaagctatatagtaattggagcaggagagaaagcactgaaactaagttggtttaagaaagggagtagcatcggtaagatgttcgaagctacagctcggggagctcgaagaatggctattttgggagacacagcttgggatttcggctccatcggtggtgtttttacctctgtaggaaagttagtacaccaaatattcggtacggcgtacggtgtcctatttagtggtgtctcatggactatgaaaataggaataggtgtgttattaacttggttaggactaaactctagaagtacatcgttaagtatgacttgtatagccgtaggattggtaactctttacctaggagtcatggtacaagcagactcaggatgtgtgattaactggaaggggagagagctaaagtgtgggagtggtatatttgtgaccaatgaagtacacacctggacggagcaatataaatttcaagcagattcacctaagcgtttgagtgccgccataggaaaagcctgggaagagggagtgtgtggcattagatcagcaacacgactagaaaacattatgtggaaacaaatatcaaatgagctcaatcatatactactagaaaatgacatgaaattcacagtagttgttggagacgtagtaggaatactcgcccaaggtaaaaagatgatacgaccacaacccatggaacacaagtatagttggaagagttggggaaaagctaaaattattggtgctgacgtgcaaaatacaacctttattatagatggacccaatacaccagaatgtccagatgaccaacgagcatggaatatttgggaagtagaagattatggattcggaatatttactactaatatctggctgaaattaagagattcgtacacacaagtatgtgaccatagattaatgagtgcggcaatcaaagactcaaaagctgtccacgccgatatggggtactggatagagagtgaaaagaacgaaacgtggaaactagcaagagctagcttcattgaagtaaagacgtgtatatggccgaaatcacataccctctggtcaaacggagtactagaaagcgagatgataattcctaagatctatgggggcccgatttcgcagcataattatagacccggatatttcacccaaaccgcagggccatggcatttaggaaagctagaattggactttgatctttgcgagggaacgacggtagtagttgatgagcattgtgggaatcgtggaccatcactccgtactacaactgttactggtaagattatacatgaatggtgctgtagaagctgcactttaccacccctaagattcaaaggtgaagatggttgttggtacggaatggaaataagacctgttaaagagaaagaggaaaacttagtaaagtcaatggtaagcgccggaagtggagaggtcgattcatttagcctcggtctattatgtatctcaataatgatagaggaagtaatgagaagtaggtggagcagaaaaatgctaatgacaggaacattagctgtatttctccttttgatcatgggtcaacttacttggaatgacctaataagattatgcattatggtgggcgcgaatgcatcagataggatgggaatgggaacaacctacctagcactaatggcaacatttaagatgaggcccatgtttgcagtaggtctgcttttccgacgactaacgtctcgcgaagttctactactcactatagggctctcgctcgtcgcgagtgttgaactacctaattcgctggaggaactgggggacggattagcgatgggaatcatgatattaaaattattgactgatttccaatcacaccagttatgggcgacattgctttcccttacttttataaagacaaccttatctttgcactacgcctggaaaacaatggcgatggttctatcaatagtgtctctattccctttatgtttaagtactacctcgcagaaaacaacttggctaccagtacttcttggatcattaggatgtaaacctttgacaatgtttttaatcgctgaaaacaaaatatggggaagaaagagctggccacttaatgaaggtataatggcagtgggagtggtcagtatcctattaagttccctcttgaaaaacgacgtaccactggctggaccactaatagctgggggcatgttaattgcttgctatgtgattagcggatcttcggcagacttaagcctggagaaagctgcagaagtgtcttgggaagaggaagcggaacattcaggagcatcacacaatattcttgttgaagttcaagatgatggaacaatgaaaataaaagatgaagaaagagatgacaccctaacgatactgttaaaggcaacacttcttgcagtaagtggcgtgtaccccctttcaattccagcaaccctcttcgtgtggtacttctggcagaagaagaaacaacgctcaggtgtcctatgggacacaccttcgccacccgaagttgaacgtgctgtcttagatgacgggatttacaggatcatgcaaagaggtctcctaggaagaagtcaggtaggcgttggagtgttccaagagaacgtatttcatacgatgtggcatgtcacacggggagctgtattgatgtatcaaggaaagagactagaaccctcttgggcatcagtaaagaaagacctaatcagctatggaggtggttggagattgcagggtagttggaacaccggagaagaagttcaggtcattgctgtggaacctggcaaaaatcccaaaaatgtacagaccgctcccgggacttttaaaacaccggagggtgaagtcggtgcaattgccctagatttcaaaccagggactagcggatccccaatagtgaatcgagaaggaaaaattgtaggtctatatggaaatggagttgtaacaacctcaggtacatatgtatccgcgatcgcgcaagcaaaagctagccaggaaggtcctttaccagagatagaagatgaagtcttccgtaaacgaaatctaacaataatggacttacatcctggaagtggaaaaacaagacgatacttacctgctattgttagagaagctattaaaaggaaactaagaacactaattctagctccaactagagtagttgcttcagaaatggccgaggcattaaaaggtatgcccataagatatcaaactactgcagttaaaagtgaacataccggaaaagaaattgtagacctaatgtgtcacgcaacatttacgatgcgattgttaagtcccgtcagagttccgaattacaacatgattataatggacgaagctcatttcacagacccctcatcaatcgcagcaagggggtacatatccactagagtcggaatgggtgaagctgctgcgatcttcatgactgctacaccaccaggatcagtagaggcttttccgcaatccaacgccgtaatacaagacgaagaaagagacataccagagaggtcctggaacagcgggtatgaatggattactgattttcctggtaaaactgtctggtttgtgccaagcatcaaaagcggcaacgatatcgcgaattgcttaaggaaaaatggtaagcgtgtcatacagttgtccaggaaaacgtttgatacagaatatcagaaaacgaagaacaatgattgggattatgtcgtgacaactgacatttcggaaatgggtgcgaattttagagccgatagagtaatagacccacgaagatgtctaaaacccgttatcctaaaagatggtccagaacgagtaattctagcaggcccgatgccagtcacagttgcatcagcagcacagagacgcggaagaattggtaggaaccataataaagaaggggatcagtacatctatatgggacagcctttaaacaatgatgaagatcatgcacattggacggaagcaaaaatgttacttgacaacataaacacacctgaaggtattatcccagcattgttcgaaccggaaagagagaaaagcgcggcaatcgacggcgagtacagattacgaggtgaagctcgcaaaacctttgtagagttaatgagacgaggggatctaccagtatggcttagttacaaggtcgccagcgaaggttttcaatactcagaccgtagatggtgtttcgacggagaacgcaataatcaggtgttagaagaaaatatggatgtagaaatttggaccaaggagggggaacgtaaaaagttacgacctcgatggctggatgctaggacctattctgatccgctcgcactcagggaatttaaagagtttgccgcgggaagaagatctgtgagcggagatcttatcttggaaattggaaaactgccccaacatctaacacaacgtgcgcaaaatgctttagacaatttagttatgctccataattccgaacagggtggtcgcgcctacaggcatgcaatggaagaactaccagatactattgaaaccctaatgctcttggcattaatagcggtattgacaggcggggtaacactgttcttcttatctggccgtggattaggaaagacatccattgggctgttgtgtgtgatggcctcatctgtacttctttggatggcatcagtggaaccccattggatcgctgcttctattatcctagagttcttcctcatggtgttactaatcccggaacctgataggcagcgaacaccgcaagataatcagctggcttatgtagtaataggactattattcatgatactgacagtggccgcgaacgaaatgggtttactggagacaaccaagaaagatttaggtataggccatgtcgcagtagaaaatcatcatcacgctacaatgctagatgttgatcttcatcctgcatcagcatggaccttgtacgctgttgcaacaaccataatcacacctatgatgagacacacaatagaaaacacaactgcgaatatcagcttgacagcgatagctaatcaggcggcaatccttatggggctggataagggatggcctataagcaaaatggatataggagtcccactgttagcattaggatgttatagtcaggtcaacccacttacgctaaccgccgccgtgctaatgcttgtcgcacactacgctataattggccccggcttacaagcaaaggcaaccagagaagcacagaaaaggacagcagcaggaattatgaagaaccctacagtagatgggattgttgccattgatttagatccggttgtatatgatgccaaattcgaaaaacagcttggtcaaatcatgttacttatcctttgtactagccaaatactattgatgagaaccacctgggctttatgtgagagcataacattagcaacggggccactaaccacgctatgggaaggtagcccaggaaagttttggaacacaacaattgcggtctcaatggctaacatatttagagggagttacctagccggtgctgggttggcattttctctgatgaaaagcctcgggggtggaagaagaggtacgggcgcacaaggagaaactcttggagaaaaatggaaaaggcaactgaaccaactgagcaaaagcgagttcaacatatacaagagaagcggtattatggaagttgataggagtgaggcaaaagaaggcttgaaacgtggagaaacgacaaggcatgcagtttcaaggggaactgcaaaactgcgatggttcgtagaacgaaatttagttaaacctgaaggaaaggtaatcgatttaggttgcgggagaggaggctggagctattattgtgcagggctaaagaaagttacggaagtaaaaggatacaccaaaggcggacccggtcatgaagaaccaataccaatggctacatatggatggaatctagttaaactacattcaggaaaagacgttttctttacacctccggagaagtgtgatactttactatgcgatatcggagaatcatctccgaatcctactattgaagagggaagaacattgagagttttgaagatggtagaaccttggctaagaggaaatcaattttgtataaaaatacttaacccttacatgccatcggtcgtagaaacgttggagcagatgcagcgcaaacatggaggaatgctcgtacggaacccattgagtcgaaatagtacacatgaaatgtactgggtgtcttgcggaactggaaacattgtgtcagctgttaacatgacatcaagaatgctcctaaataggtttacaatggcgcacagaaaaccgacttacgagcgagatgtcgatttaggagctggtacaaggcacgtcgcagtcgaacccgaagtggccaatctcgatatcattggacaacgtatagaaaacatcaaacacgaacataaatcaacatggcactacgatgaggataatccttataaaacgtgggcctatcacgggtcatacgaggtaaaacctagcggcagtgcatcctcaatggtaaatggggtcgtaaagttactaactaaaccgtgggacgtaataccaatggtgactcaaatcgcaatgacggacactacaccctttggtcaacaaagagttttcaaagaaaaggtagatactcgaactccaaaagcgaaaagaggaacagcacaaattatggaagtaaccgcgcgctggctatgggggtttctgagtcgaaataagaaaccccgaatttgtacacgagaggaatttactagaaaagtccgctcaaacgcggctataggtgctgtatttgttgacgaaaatcaatggaatagcgctaaagaagctgtggaagacgaaagattttgggaccttgtccagaaggaaagagaattgcataaacaaggcaaatgtgccacgtgtgtatataacatgatgggaaaaagagaaaagaaacttggagaatttggaaaagctaaaggctcgagggcaatttggtacatgtggttgggtgcacgatttctagagttcgaggcgcttgggtttatgaacgaggaccactggttttcaagagaaaatagtttaagcggtgtcgaaggtgaagggctccacaagctaggatacatactccgtgacatcagtaaaattccgggtgggaatatgtatgccgacgatacagcgggttgggatacaagaataactgaagacgaccttcagaacgaggcaaaaataactgatatcatggaacccgaacatgccctgttagccacgtctatattcaaattgacataccagaacaaagtagttagggttcaacgaccggctaaaaacggtacagttatggacgtcatatctcgtagagatcaacgaggatctggccaagtcggcacatacggtcttaacacattcactaatatggaggcgcagcttatacgacaaatggaaagcgaaggtatattctcaccctgtgaactagaaattcctaaccttgcggagagagtattagattggttagaaaaatatggcgtagaacgtctaaaaagaatggccatttcaggcgacgattgtgtcgtcaaacctattgacgatagatttgcaacagcactaactgcactaaacgatatgggtaaagtccgaaaagatgtaccgcaatgggaaccctcgaaagggtggaacgactggcaacaagttcccttttgttcccaccattttcatcagttaataatgaaagatggtcgagaaatcgtcgtaccatgtcgtaaccaagacgaactcgtaggccgtgcgcgagtgtcccaaggggctggctggagtttaagggaaactgcttgtttaggcaaatcgtatgcgcagatgtggcaactcatgtatttccatagaagagatctacgtctggcggctaatgcgatatgtagtgcagtccccgtcgattgggtacccacatcgagaacaacctggagcattcacgctcatcaccaatggatgacgacggaagatatgttatcggtatggaaccgtgtatggattgaagagaatccttggatggaagacaaaacacatgtcagttcatggggtgacgtaccgtacttggggaaaagggaagatcaatggtgcgggagtctgataggactcactgcgagggctacatgggccagtaatattcaagtagccataaaccaggtaagaagattgattggtaatgagaactatctagactatatgacttcaatgaaacgattcaagaatgagggcgatcctgagggcgctttatggtaa

SEQ ID NO: 21910 - RNA, 9879 nt, synthetic construct
  misc_feature 1..9879: note = derived and/or modified CDS sequence (opt6) from DENV-1__EU482807__SS-prME
  source 1..9879: mol_type = other RNA
agcgtgactatgctactcatgctcatgccgactgctttagctttccatttaactacacgtggaggagaaccgcatatgatagtttccaaacaagaacgaggtaaatctttattattcaaaacatccgccggtgtaaatatgtgtacattggtagctatggaccttggagagttctgtgaagatactatgacctacaaatgtcctcgtataactgaagcggagcctgacgacgttgattgctggtgcaacgcaacagatacctgggtaacatacgggacttgttctcagaccggggaacatagacgagataaacgatctgttgcattagcacctcatgtaggcctcggacttgaaacacggacagaaacgtggatgtcaagcgaaggagcctggaaacaaatccaacgcgtggagacttgggcgttacgacaccccggatttaccgtgatagctctatttttggctcatgctatagggactagcatcacccaaaaaggaatcattttcatcttattaatgttagttactcctagtatggcaatgagatgtgtcggtatcggtagccgagatttcgtagaaggacttagcggtgcaacttgggtcgatgtagtattggagcatgggagttgtgtaacaactatggccaaagataaaccaacgttggatatcgaattacttaaaacagaagttactaatccggcggtactaagaaaactatgtatagaggctaagatctcaaacactactacggatagtcgttgccccactcaaggagaagctacgttagtggaagaacaagatgcgaattttgtctgtaggcgcacctttgtagacagaggttggggcaacggttgtggattgtttggtaagggatccttgatcacctgtgcaaaattcaaatgtgtaacaaaactagaaggaaaaactgttcaatatgaaaatttaaaatattcagtaatagtaaccgtccacactggtgaccagcatcaagttggaaatgagagtaccgaacatggcaccactgccacgataacgccacaagccccaagcacagaaattcaactaacggactacggagccctaacacttgattgttcgccaaggacaggtcttgacttcaacgaaatggtgttattaacaatgaaagaaaaatcctggttggttcacaaacagtggtttctagatttgccgttaccttggactagcggggcatccacaagtcaagagacctggaatagaaaagatctcctagtcacatttaagacggcacacgctaaaaagcaagaagttgtcgttttaggtagtcaagaaggcgctatgcataccgctcttaccggagctactgagatacaaacaagtgggactacaactatatttgctggacatttaaaatgtcgcttaaaaatggacaaactcacactaaaagggatgagttacgtgatgtgtacaggctcgttcaaactcgagaaagaggtagcagaaacacagcacggaacagtacttgtacaaataaaatatgaaggtactgatgctccctgtaagatacctttcagtacgcaagacgaaaaaggtgtaactcaaaacggaagacttataacggccaacccaatcgtaactgataaggaaaagccagtaaatatagaagctgaaccaccattcggagagagctatatagtgataggtgcaggggagaaagcattaaaactaagttggttcaagaaaggcagtagtattggtaaaatgttcgaagcaacagcccgaggagcaagaaggatggcgatactcggagatacagcatgggattttggatcaatcggaggagtatttacttcagttggcaaattagtgcaccagatcttcggaactgcatatggagtcttattcagtggagtttcttggaccatgaaaataggaatcggagtgctactaacgtggcttggattaaatagtcgcagcacaagtctatcaatgacatgcatagcggtaggactcgtcacactatatcttggagttatggtacaagcggactcaggttgtgtaatcaactggaaaggtagggaactaaaatgcggatcaggcattttcgtaacaaatgaagttcatacatggacagaacaatataaattccaggctgatagtccgaagcgactgagcgctgctataggaaaggcatgggaagagggggtttgcggaattagatctgcaacaaggctagaaaatataatgtggaaacaaattagtaacgaactaaatcacattctattggaaaatgatatgaaatttaccgtcgtggttggggatgtggctggaatcctagctcagggtaagaaaatgatcagaccacaaccgatggaatacaaatacagttggaaatcatggggtaaagcgaaaattataggagcagatgtacagaacacgacatttataattgatggccccaacactccagaatgccccgatgaccaacgagcttggaacatttgggaagtcgaagattatggtttcgggatatttacaacaaatatatggcttaaactgcgcgactcatacactcaagtttgtgatcaccggttaatgagtgccgcgatcaaagatagcaaggctgtccatgcggacatgggctattggatagagagtgagaaaaatgaaacttggaaactcgcacgtgcaagttttatagaagtaaaaacatgcatttggcccaaaagtcataccttgtggagcaatggagtattagaatcagaaatgattataccaaagatatatgggggtcctatatctcaacataactatcgacccggatattttactcaaacagctggcccctggcacttgggcaaactagaactggattttgacttatgtgaaggaaccactgtggtcgtagacgaacactgcggcaataggggtccatcattaagaaccacaacagtaacggggaagataattcacgagtggtgttgtcgaagctgtaccttgccaccactaagatttaagggagaagatggctgctggtatgggatggaaatccgacccgtgaaagaaaaagaagaaaacttagttaaatcaatggtttcagctggtagcggggaagtagattctttttcactaggcttactgtgtataagtataatgatcgaggaagttatgagatctcgatggagtagaaaaatgctgatgacaggcactcttgccgttttctttttactaataattggacaattgacctggaacgatttgatacggctgtgcataatggtaggagctaacgcatctgataggatgggtatggggacaacctacctagcattgatggcgactttcaaaatgaggccgatgtttgcagtgggactattatttaggagactcacaagtagagaagtattactattaacaataggactatcactggtagcttctgtagaattaccgaatagtttagaagaactcggagatggactagcaatgggaatcatgatacttaaattacttacagacttccaatcacatcagctatgggcaacccttctatcccttacatttatcaaaacgaccttctccttacactatgcatggaagacaatggctatggttttatcaatcgtgtctttattcccgttatgcttatcaacaacttctcaaaagaccacatggcttccagtattattaggttctttaggatgcaaaccattaacaatgtttttgatagctgaaaataaaatctgggggcgaagatcttggccactcaacgaaggtataatggcagttggaattgtttcgatcctattgtctagtcttttgaaaaatgacgtccctctagcaggacctctaatagccggcggtatgttaatagcttgttacgtcataagcggttcgagtgcagacctatcgttagaaaaagcagcagaagtgtcatgggaagaagaagcagagcatagcggagcctctcataatattcttgtagaagtacaagatgatggaactatgaaaataaaagacgaagaacgagatgatacgctcacgatccttttaaaagccactttactcgcggtatcaggggtatacccattatcaataccagctacattattcgtgtggtatttttggcagaaaaagaaacaacgaagtggagtgttatgggatactccctcaccgccagaagtagaaagagctgtactagacgacgggatttatagaataatgcaaagggggctattgggtcgatctcaagttggggtcggcgttttccaagaaaacgtgttccacacaatgtggcatgttacacgaggagcggtacttatgtaccaaggaaaacgattagaaccatcatgggctagtgtaaagaaagacttgattagctacggtggtgggtggagactacagggctcatggaatactggtgaagaggtccaagtaatagcagtggaacccggcaaaaatccgaaaaatgtacaaacagcacctggaacctttaaaacgagtgagggagaggtaggtgctattgcattagactttaaacccggaacttccggaagcccaatagtcaacagagagggaaagatcgtaggtctgtatggaaacggagtcgtgaccaccagtgggacctacgtgagtgcaatagcgcaggcgaaagcatcgcaagaaggacctttaccggaaatagaagatgaagtgttcagaaaacgaaatttaacaattatggatttgcacccaggaagtggaaaaactcgcagatatttgccggctattgtccgtgaagcaataaaaagaaaactcagaacattaatactagcaccaactagagttgttgcgtccgaaatggctgaagcactaaagggtatgccaatacgctaccagacaactgcggttaaaagtgagcacacagggaaggagatagtggatttaatgtgtcacgcgactttcactatgagattactgtcgccagtaagagtgccgaactataatatgattattatggatgaagctcactttactgacccatcgtcaatagccgccaggggatacatttcaactagagtcggaatgggtgaagccgctgcaattttcatgactgctaccccgccaggaagtgttgaagcatttcctcagagtaatgcagtgatacaggatgaagaacgggacatcccggaaagatcatggaactcaggttacgagtggattactgactttccaggcaaaactgtatggtttgtcccatcgattaaaagcggaaacgatatcgcaaattgtctacgtaaaaacgggaagagagttattcagctatcgagaaaaacatttgatacagaatatcagaaaaccaaaaataacgactgggattatgtcgttaccaccgacatatcagaaatgggcgcgaattttagggccgaccgagtaatagacccaagacgatgcttaaaaccagttatcttaaaagatggcccggaacgtgtcatactagcgggacccatgccagtaacagttgcgagcgcagcacaaagacgaggtagaatcgggagaaatcacaataaagaaggagaccaatacatttatatgggtcagcctttaaataacgacgaagatcatgctcattggacagaagctaaaatgttactcgataatattaatacacctgagggtataatcccagcattatttgaaccagaaagagaaaagagcgcggctatagatggtgaatatcgtcttaggggtgaggcaaggaagacctttgttgagttaatgcgaagaggagatttaccggtgtggctctcctacaaagtagccagcgagggctttcagtactccgatagacgttggtgttttgatggagaacgtaataaccaagtcctcgaagagaacatggacgttgaaatctggacaaaggaaggagaaagaaagaaattgaggccgaggtggctagacgctagaacatactcagatcctcttgcattaagagagtttaaagagtttgccgctggtagaaggtcagtctcgggagatttaatactggaaattggaaaattacctcaacatctcacacaacgagcgcagaacgccctcgataacttagtaatgctgcataattcagaacaaggtggacgtgcgtaccggcatgcaatggaggaactaccagatactattgagacacttatgttactcgcactaatagctgtgttaaccggaggagtcacgctgttcttcctatctggtcgcggattaggaaaaacatcaataggcttactatgtgtcatggcaagttctgtattattatggatggcaagtgtggaacctcattggatagcagcttccataattcttgagttctttctaatggtcctcctcattccagaaccagataggcagagaacacctcaagataatcagctcgcatatgtagtgataggattattattcatgatcctgacagtggctgctaacgaaatgggactactagagacaaccaagaaggacctgggtattggtcatgtcgctgtagagaatcatcaccatgcagccatgctagacgtagacctccatccagcaagcgcctggaccctttatgctgtagccacaacgatcataacacctatgatgcgccatactatagagaatactactgcaaacatatcactaacagcgattgcaaatcaagcggcgatcctgatgggattagacaaaggttggccaatatcaaaaatggacattggagtgccactactagcacttggatgttattctcaggttaaccccttaactttaacagccgcagtcttaatgctagtagctcactacgcgattattggcccggggttgcaagccaaggcaacaagggaagcgcaaaagcgaaccgccgctggcataatgaaaaatcccacagtagacggaatcgttgctattgacctagacccagtcgtctatgatgcaaagttcgagaaacaactaggtcaaatcatgttattgattttatgtacaagtcaaatacttcttatgcgaactacttgggctttatgtgaatcaataactttagcgacaggaccattgaccactctgtgggaagggtcacctggcaaattctggaacacaaccatcgccgttagtatggctaatatattcaggggaagctatttagcaggggcgggtttggcgttctcactaatgaaatcgctagggggaggacgtagaggcaccggagcccagggggaaacattaggcgagaaatggaaaagacagttaaatcaattatcaaaatcagagtttaatacatacaaaagatcgggtataatggaggtagaccgtagtgaggcaaaagagggtctaaaacggggagaaacaaccaagcacgcagtctcgaggggcaccgccaaattacgctggtttgttgagagaaacttggtgaagccggaaggaaaagtaattgacctagggtgcggacgaggaggatggtcctactattgcgctggccttaagaaagttacagaagtaaaaggatataccaaagggggtcctggacacgaggaacctatccccatggcaacttatgggtggaaccttgtaaaactccacagtggtaaggacgtgttctttatcccaccagaaaaatgtgataccttgctttgtgatataggcgaaagcagccccaatccaacgattgaagaaggaaggacattaagagtgttaaagatggtagaaccttggttacgaggtaaccagttttgtataaaaatccttaacccgtatatgccctcggttgtcgagacacttgaacggatgcaacgaaaacacgggggtatgctggtgcggaatcccctgagtcgcaatagtacccacgagatgtactgggtttcttgtggtacaggaaatatagtaagcgcagtgaatatgacaagcagaatgctgctcaaccgtttcaccatggcccacagaaaaccaacatatgaacgcgatgtcgatttaggggcgggaacacgtcacgtcgctgtcgaacccgaagttgcgaatttagatatcatcggccaacgaattgaaaacataaaacatgaacacaaaagcacctggcactatgacgaagataatccctataaaacttgggcatatcatggcagctacgaagtaaaaccttcaggttccgcaagctctatggtcaatggagttgtaaaactattgaccaaaccctgggatgtgataccaatggtaacccaaatcgcaatgactgacacaacgccttttgggcaacaaagagtctttaaggaaaaggtggacactagaacgccaaaagcgaaaagaggtacggcgcaaatcatggaggtgacggctaagtggctctggggatttcttagtagaaacaagaaaccacgaatatgtaccagggaagaatttacacgaaaggtacgaagcaatgcagctattggcgctgtatttgtggatgaaaaccaatggaactctgctaaggaggcggtggaggatgaacgattttgggatctagtacaccgtgaaagggaacttcacaaacaaggaaaatgtgctacgtgcgtgtataacatgatgggtaaaagagagaagaaacttggcgaatttgggaaagcaaaaggtagccgagcaatttggtatatgtggctgggagcaagatttttggaatttgaagcactagggtttatgaacgaagatcactggtttagtcgagaaaattcattaagcggggtggagggagaaggcctacacaaactaggttacatactaagagacattagcaaaataccaggaggtaatatgtatgcagatgatacggctggatgggatacgcggattaccgaagatgatctccagaatgaggccaaaataacagacataatggaaccagagcacgctttactcgctaagtcaatctttaagctcacatatcaaaataaagtagttagagtacaaagaccagctaagaacgggactgtaatggatgtaatatctcgaagagaccaaagagggtcaggtcaagtaggcacgtatggacttaatacttttacgaatatggaagcccaactcattagacaaatggaatctgaaggaatattttcaccatcagagttagagactccaaatctagcggggcgagtgctcgactggctcgaaaaacatggagtcgagcgactaaagcgaatggcgatatcgggagatgactgtgtagtcaaacccattgacgatcgatttgctacagcacttaccgcattgaacgacatgggtaaagtcagaaaagatataccacaatgggaacccagtaaaggttggaacgactggcagcaagtaccattctgtagtcaccatttccatcaattaataatgaaagacggacgagagattgttgtaccatgtagaaaccaagatgagttggttggccgtgcaagagtatcccaaggagctggatggagtttacgagagactgcctgtttaggtaaatcttatgctcaaatgtggcaactgatgtatttccatcgtagagatctaagattggcagcaaatgcaatttgtagcgctgtccctgtagactgggtcccaacctcgagaactacatggtcaattcacgcacaccatcagtggatgacgacagaggacatgcttagtgtgtggaatcgagtatggatagaagaaaatccatggatggaagacaaaacacatatctcatcttggggcgatgtcccgtatttaggaaaacgagaagatcaatggtgcggttctctgataggcctaacagctagagcgacatgggcgacgaatatacaagttgcgatcaaccaggtacgtagactaatcgggaatgaaaattaccttgattacatgacatccatgaaacgttttaagaatgaatcagatcccgagggggcactttggtaa

SEQ ID NO: 21911 - RNA, 9879 nt, synthetic construct
  misc_feature 1..9879: note = derived and/or modified CDS sequence (opt6) from DENV-1__EU482808__SS-prME
  source 1..9879: mol_type = other RNA
tctgttactatgctactaatgcttatgccgacggcactagcattccacctaactacaagaggtggtgaaccacacatgattgtttccaaacaagaaagaggtaaatcactactatttaaaacaagtgcgggcgtaaacatgtgcacacttatagcaatggacctaggggagttctgcgaagacacaatgacttacaaatgtccacggataaccgaagcagaaccggatgacgtcgactgttggtgcaatgctaccgatacttgggtaacttatgggacgtgttcacaaaccggtgaacaccgacgagataaaagatccgttgcactagctccacatgtcggactaggactggaaacaagaacagaaacctggatgagttcagaaggcgcttggaaacagattcaaagagttgaaacgtgggcattgagacatccagggtttacagtaattgcattatttctagcacatgcgatagggacttcaattactcagaaaggcattatatttatactactcatgttggtaaccccttccatggcgatgagatgtgtaggcataggttcacgcgatttcgtagagggactctctggagcaacgtgggtagatgttgtattagaacacggcagttgtgtaactacgatggcaaaagacaaaccgaccttagacatagaactattaaaaacggaagtaacaaacccagcagtattacgcaaactctgcattgaagcgaaaattagcaatacgacaactgattctaggtgtccgacacagggtgaagcgaccctagttgaggaacaagacgccaactttgtatgccgacgtacctttgtagacagaggatggggtaacggttgcggcctgttcgggaaagggagcctcattacttgcgccaaattcaaatgtgttactaaattagaaggaaaaaccgtacaatatgaaaatttaaaatacagtgtgattgttactgttcacactggggatcaacaccaggtcggaaacgaatcaacagagcatggaacaacagcgacaattacccctcaggctccttcaacggaaattcaattaactgattacggcgcgctgacgttagattgtagtccacgtacaggacttgattttaatgaaatggtccttctcacgatgaaagagaaatcttggttggtacacaaacaatggttcttagatctgccattaccctggacttctggtgcaagtacaagccaagagacatggaaccgaaaagatcttttagtaacatttaaaacagctcatgccaagaaacaagaagtagtggttctagggagccaagagggagcaatgcataccgcattgacgggtgccactgaaatccaaacaagtggtacaaccacaatttttgctggccatttaaaatgtaggctaaaaatggacaaacttactttaaagggtatgtcttacgtaatgtgtacagggagctttaaactagaaaaagaagtagctgaaactcaacatggaacggttttagtgcaaataaaatacgaagggacggacgcaccttgtaaaattccattctccactcaagacgaaaaaggcgtaacacaaaatggccgtttaattacggccaacccaattgtaacagataaagaaaaaccggtaaatattgaagctgaacccccatttggcgaaagttatatagtcataggcgcaggcgaaaaggctttaaaacttagttggttcaagaaaggatcgtccataggaaaaatgtttgaagctacggcacgaggggctagaagaatggcgattttgggcgacactgcatgggattttggaagtataggaggtgtattcacgagtgttggaaagctagttcaccaaattttcggaacagcgtacggagtgttattctccggcgtcagttggacaatgaagattggaattggggtcttgttaacctggttaggcctaaacagtcgatcaacgtcattatcaatgacctgtattgctgttggtcttgtgacattatatcttggggtcatggtacaagcagactcaggttgtgtcattaactggaaaggacgagaattgaaatgcggttctggcattttcgtaacaaatgaagtacatacttggaccgaacaatacaaattccaagcagatagtcctaaacgactgagtgcggctatcggaaaagcatgggaagaaggagtatgtggtataagatctgctactcgattagaaaacattatgtggaaacaaatatcgaatgagctgaaccatatactacttgaaaacgacatgaaattcacagttgtggtaggagacgttgcaggtatactagcccagggcaagaaaatgatacgtccacagcctatggaatataaatatagttggaaaagttgggggaaagcgaaaataataggagcggacgtccagaatactaccttcattattgacgggccgaatacgcctgaatgccctgacgatcaaagagcttggaacatatgggaagtggaagattacgggtttggaatattcacaacaaatatttggcttaaactacgagactcttacactcaagtctgtgatcatcgtttaatgtctgcagcaataaaggattcaaaagctgtacacgctgacatgggatattggatcgaatccgagaaaaatgaaacatggaaactggctcgcgcttcattcatcgaagttaaaacttgtatatggccaaagtcgcatacgctatggagcaacggagtcttagaatcagaaatgataatcccaaagatatacggtggtcctatttcacagcacaattatagaccaggatattttacccagactgcagggccttggcacttaggcaaactagaactagatttcgacttatgcgagggtaccacggtagttgttgatgaacattgcggtaacagaggcccctcgctacgtaccactactgtcacaggcaaaataattcatgagtggtgttgccgcagttgtacacttcctcctttgcgatttaaaggagaagacgggtgctggtatggaatggaaattagaccggtcaaagaaaaagaggaaaatctcgttaaaagtatggtctctgcgggaagtggggaagttgattcctttagccttgggttactgtgtatatctataatgatagaggaagtaatgagaagtagatggtcaagaaaaatgctgatgactggaacgttagctgtgttctttctactcatcatgggacaactgacatggaacgatctaatacgcttgtgtattatggtaggagccaatgcctcagatcgaatgggcatggggactacgtatctggcattaatggcaacttttaaaatgagacctatgtttgcggtagggctattatttagaaggctgaccagtagagaggtattacttttaaccatcggcttaagtcttgtcgcaagtgtggagttaccaaactcactagaggaactaggagatggactcgcgatgggaataatgatactaaaattgctcacagatttccaatcacatcaattatgggctactctcctgtcactaacatttataaaaactacatttagtttacactatgcatggaaaactatggcaatggtactaagtatagtcagtctctttcccttatgcttaagtactacatctcagaaaactacgtggttacctgttttactgggctctctaggatgtaaaccgcttacaatgtttttaatcgctgaaaataaaatatgggggcgcaaaagctggcccttaaacgaaggtataatggctgttggtattgtaagtatattactttcaagtctattgaaaaacgacgtaccactagctggtcctctcatagcaggcggaatgctaattgcgtgttatgtaatttccgggagtagcgctgacttgagcctagaaaaagcagcagaagtatcatgggaagaagaggctgaacactctggagcctcccataatatcctagtagaggtacaagatgatggaacaatgaaaattaaagacgaggaaagagacgacacgctaacgatactgttaaaggcaacgctcctggcagtgagcggagtttatccattatcaatacctgctacgctctttgtttggtatttttggcaaaagaagaaacaaagatcaggggttctctgggacactccgtcaccgcctgaagttgagagagcagtcttagacgacggaatctatagaatcatgcaaagagggttactaggaagatcacaagtcggagttggagtgttccaggaaaacgttttccacaccatgtggcatgtcacacgcggtgccgtactgatgtaccaaggaaaaagactcgaacctagttgggcaagcgtcaagaaagatcttataagttatggaggagggtggcgactacagggatcatggaacaccggagaagaagtacaggtaatagcagtggaaccgggtaaaaaccccaaaaatgttcaaacagccccgggtacatttaaaaccagcgaaggggaagtaggagctattgcgctagacttcaaacccggaacgagcggatctccgattgtgaatcgagagggaaaaatagtaggattgtacggcaatggcgtcgttacaacttctggcacatatgttagtgcgatagctcaagccaaagcctcgcaagaaggtcctcttcccgagatagaagacgaagtgtttagaaaaagaaatctaacgattatggatcttcaccccggctccgggaaaactagaaggtatttacccgctatagtcagagaagcgatcaagagaaaactaaggacactaatattagctccaacacgcgttgtggcctcagaaatggcagaagccttaaaaggaatgcctatacgttatcaaactacggctgttaaaagcgagcatacgggaaaagagattgtagatcttatgtgtcatgcgacattcaccatgagattattaagtccagtgcgtgttccaaattacaatatgataattatggatgaagctcacttcacagatcctagtagcatagcagcaagaggctatatttcaaccagggtaggcatgggggaagcagcagctattttcatgaccgcgactcccccaggatccgtcgaagcatttcctcaaagcaatgcagtaatacaggacgaagagagggacataccagaacgcagctggaactctggatatgaatggattacagatttcccaggaaaaaccgtgtggtttgttccctcgataaaatccggcaatgatatcgcgaattgtctccgcaaaaatggaaaaagagtaattcagcttagtagaaaaacctttgataccgaataccaaaagacgaagaataatgactgggactacgtcgttacgactgatataagtgaaatgggagcgaactttagggcagatcgagtcatagatcccagaagatgtttaaagccggtaattcttaaagacgggcctgaacgtgtaattttagcaggcccgatgccagtaacggtggccagtgcagcgcaaagacgaggccgtattggcaggaaccataataaagaaggtgaccaatatatctacatgggacagccactaaataacgacgaagaccatgcacattggacagaagctaaaatgttattagacaacataaatactccagaaggtataattcctgcattatttgaaccagagcgcgagaagtcagcggcaatagacggtgaatataggctaaggggtgaagcacggaaaacttttgtagagcttatgaggagaggtgacttgcctgtatggctttcttacaaggtggccagtgaaggatttcaatattcggatcgacggtggtgttttgatggtgaacgtaacaaccaagttttggaagaaaatatggacgtcgaaatttggacaaaagagggcgaaagaaagaaattgagaccccgatggttagacgccagaacttactcagacccattagctctcagggagtttaaagaatttgctgctggccgtaggagcgtaagtggagatttaattttggaaataggaaaactaccgcaacaccttacacaacgagcacaaaacgcattagacaacttagttatgttgcacaatagcgaacaaggtggtcgagcctatcgacacgccatggaagaacttcctgatactattgaaacactaatgttactagcacttatagcagtgctaaccgggggagtcactttatttttcctaagtggaaggggtttaggtaaaacatccataggtttattgtgtgtaatggcatctagcgttttactatggatggcctcggtagagccacattggatcgcagctagtatcatactagagtttttcttaatggtcttactaattccagaaccagatcggcaacgcacgcctcaagacaaccagctagcttacgtcgtcatcgggctcctattcatgattttgactgtagcagcaaacgaaatgggtttattagaaaccacaaagaaagatttaggaattggccatgtagccgttgagaatcatcaccatgctgcaatgttagatgtagatttgcatccggctagtgcatggaccctatacgcagtagcgacgacaataattactccaatgatgcgacataccattgaaaatacaactgctaatatctccctgacagccattgctaaccaggctgcaatactaatgggcttagataaggggtggccaatctcaaaaatggacatcggtgttccattgcttgctctaggatgctatagccaggtaaatccattaacgttaacagctgcagtgctaatgcttgtggcacactacgcaataataggtcctggtttacaagctaaagccacccgagaagcacagaagagaactgcggcggggatcatgaaaaatcccaccgtcgacggaatcgtcgcaatagacctagatccggtggtatatgacgcaaagtttgaaaaacaactagggcaaataatgttactaatcctatgcacttctcaaattcttttaatgagaacgacatgggcgttgtgcgaatcaataacactggctactggaccattgacaactttatgggaaggaagcccggggaagttctggaatacaacaatcgctgtatcaatggcaaacatcttccgaggttcctatcttgccggtgcaggcttagccttttcattaatgaagtcacttgggggtggccgtaggggaaccggtgcgcagggggaaacgttaggtgaaaagtggaaacgacagcttaaccaactatcaaagagtgagttcaatacttataaaagaagtggaataatggaggtcgatcggtcagaagcaaaagaagggcttaaacgaggggagacaaccaaacacgcggtatctagaggaacagctaaactaagatggtttgtagaaagaaatctagttaaaccagagggtaaagttatagatttagggtgtggaaggggtggatggtcatattattgtgcaggactaaagaaagttaccgaagtcaaaggatacacaaaaggcgggcctgggcacgaagaaccaatccctatggctacttacgggtggaatttggtcaaattacattcagggaaagatgtattctttaccccacctgaaaaatgcgatacacttttatgcgatattggcgaatcatctcctaacccgacaattgaagaaggtaggacgttgcgtgttctgaaaatggtagaaccttggttacgaggcaatcaattttgcataaaaattttgaacccatatatgccttccgttgtagagactctagaacaaatgcaaagaaagcatggcggcatgttagtacgtaacccccttagccgcaatagtactcatgaaatgtattgggtgtcatgtggaaccggtaatatagtaagcgcggttaacatgacgagtcgaatgttattaaatcgattcacgatggcgcataggaaacccacttatgagagagatgtagacttaggagccggtacacgacacgtcgcagttgaaccagaagtagcaaatttagacattatcggccaacgaatagaaaacataaaacatgaacacaaatctacatggcattacgatgaagataatccatataaaacatgggcctaccacggatcatatgaggttaaaccgagtgggagtgcctcttcaatggtgaatggggtagtaaaattattaactaagccatgggatgtaatcccaatggtaacgcagatagcaatgacagacacaactccatttggtcaacaaagagtctttaaagaaaaagttgacacacgtacaccgaaggctaagcggggaacggctcaaataatggaggttaccgccaaatggctatggggtttcttaagcagagacaaaaagccgcgaatctgtacacgagaagagtttacacgaaaagttaggtctaatgctgctataggagccgtattcgttgacgaaaaccaatggaactcagcaaaagaggctgtggaggatgagcgcttttgggatctggtacaccgcgaacgcgaactacacaaacaaggcaaatgtgccacttgtgtgtataatatgatgggtaaacgggagaagaaactcggagagttcggtaaagctaaaggaagtcgagcaatctggtacatgtggctgggcgcaagatttctcgagtttgaggccttaggcttcatgaacgaagatcattggttctctagagaaaattcactttcgggagtagagggcgagggactacataaattagggtatattcttcgcgacataagtaaaataccgggtgggaatatgtatgctgatgacacagcgggctgggataccagaataacagaagacgacttacaaaacgaagcaaaaattacagacattatggaacctgagcatgctctccttgcgaagtcaatcttcaaactaacatatcaaaacaaagtagtgcgagtacaacgccctgccaaaaatgggacggttatggacgtgatctcaagacgggaccagagaggatccgggcaggtaggcacttacgggctgaacacatttacaaacatggaggctcaactgattcgacaaatggaatcagaagggatctttagtccatcagaattagaaacccctaatcttgcgggaagggtactggactggctagagaagcatggcgtagaacgcctgaaaagaatggcaataagcggagacgactgtgtagtaaaacctatcgacgacaggttcgccaccgcccttactgcactaaacgatatgggcaaagtccgaaaagatattccacaatgggaaccttcaaaaggttggaatgactggcagcaggttcccttctgttctcatcattttcatcaattaataatgaaagatggaagagaaatcgttgtgccatgcagaaatcaagatgaattagtaggtagagcgagggtctcacaaggcgctggatggagtcttagagaaacagcctgcttagggaaatcttatgcccaaatgtggcagcttatgtatttccatcgcagagatctgcgcctcgctgcgaacgcaatatgtagcgcagttccagtagattgggtacctacttcaagaactacatggagtatacatgcacatcaccaatggatgacgacagaggacatgcttagtgtttggaatcgtgtatggatagaagaaaacccgtggatggaagacaaaacacacatctcatcttggggagatgtaccatacctggggaaaagggaggatcaatggtgcggtagcctcatcggactaacagcccgtgctacctgggcgacaaatatccaagttgccataaaccaagtaaggagactaatagggaatgaaaattatttagactatatgacatcaatgaaaagattcaagaatgaaagcgaccctgaaggagcactatggtag

SEQ ID NO: 21912 - RNA, 9879 nt, synthetic construct
  misc_feature 1..9879: note = derived and/or modified CDS sequence (opt6) from DENV-1__EU482809__SS-prME
  source 1..9879: mol_type = other RNA
tcagtaactatgttattaatgctaatgccaacggcgttagcatttcatctaacaacgaggggaggagaacctcacatgatcgtttcgaaacaagagcgagggaaatcactactgtttaaaacaagtgcgggagttaatatgtgcacattaatagctatggacctaggagaattttgtgaagatactatgacttataaatgtccacgaatcacagaagctgaacctgacgatgtagattgttggtgtaatgcgacagatacatgggtaacgtacggaacgtgctctcaaacaggagaacacaggagggataaaagatcagtggcgttggccccacatgtgggactaggtctggagacaaggacagagacttggatgagttcagaaggagcatggaaacaaattcaaagagtcgagacatgggcactgcgacatccaggctttaccgtaatagcgttatttttagcgcacgcgatcgggacctcaataacacaaaaagggattatttttatactgctaatgttagtgacaccatccatggcgatgagatgcgtcggtataggatctagggattttgtcgaaggactttcaggtgcaacatgggtcgacgtagtacttgagcatggttcctgcgtaacaaccatggccaaagataaacctacactagacatagagcttctaaaaacagaagtgacaaacccagcggtattaagaaaactttgtatagaagcaaaaatctcgaacactactaccgattctcgatgcccgacccaaggagaagcaacattagtcgaagaacaagatgctaattttgtctgtagacgtacatttgttgatcgagggtggggcaatgggtgtggcttgtttggcaaaggtagtttaatcacatgtgctaaatttaaatgcgtaacaaaattggagggcaaaatcgttcagtatgaaaatctcaaatatagtgtaatcgtaacagtacatacgggcgatcaacaccaggtgggaaacgaatccaccgaacacggtacaactgcaaccattactccacaggcaccatctacagagatacaattaaccgattacggggcattaacattggactgttcaccgcgaacagggctagattttaatgagatggtattgttaactatgaaagagaaaagctggttagtccacaaacaatggtttctcgatctacctctaccgtggacgtcaggcgcttctacatcgcaagaaacatggaaccggcaagacttgcttgtcactttcaaaaccgctcatgcaaagaaacaagaagtcgtggtcctagggtcgcaagaaggagcgatgcataccgcgttaacaggggccactgaaattcagacatctggaactactactatatttgctggccaccttaaatgtagactgaaaatggacaaattaacccttaaaggaatgtcctacgttatgtgcacaggctcttttaaactagaaaaagaagtagcagaaacccaacatggtacggtattagttcaaattaaatacgagggaaccgacgcgccatgtaaaataccattcagtacgcaggatgagaaaggtgttacacaaaacggaaggctaattactgcaaatcccatagtcactgataaagaaaaaccagtaaatattgaagctgaaccgccattcggtgagtcatacatagtgatcggggcaggagaaaaagcattaaaactcagctggtttaagaaaggctcaagtattggaaaaatgttcgaagcaactgcacgcggtgcgcgaagaatggctattctaggagacacagcttgggacttcggaagtatcggaggcgtttttacatcagtaggtaaattagtccaccaaatatttggtacggcttatggcgtcctatttagtggtgtatcttggactatgaaaataggaataggtgttttattgacatggttaggacttaattcacggagcaccagcttaagtatgacgtgcattgcagtaggtttggtaacactatatctgggggtaatggtgcaagctgacagcgggtgtgttatcaactggaaaggaagggaactgaagtgcgggtccgggatatttgttacaaatgaggtacatacttggactgagcaatataaattccaagcagactcccctaaaaggctgtcagcagcgataggaaaagcgtgggaggaaggagtatgtggaatcaggtccgccactcgtttagaaaacattatgtggaaacaaatatctaatgagctaaatcacatattgttggaaaatgatatgaaattaacagtggttgtaggtgacgttgcaggcatccttgcgcaaggaaagaaaatgatacgcccacagccaatggaatataaatactcatggaaatcatggggaaaagcgaaaataataggggctgatgtccagaacacgacattcataatcgacggaccgaatacaccggaatgtcccgacgaccaacgtgcctggaatatatgggaagtggaagattatggtttcggaatattcacaacaaatatatggctgaagctcagggactcttacacgcaagtgtgtgaccatagacttatgagcgctgcaattaaggattccaaggctgtacacgccgatatggggtactggattgagagtgagaaaaatgagacttggaaattagcaagagcgtccttcatagaagtaaaaacctgcatatggccaaaaagtcatacattatggtctaatggagtcctagaatcagaaatgataattcctaagatttacggaggtccaataagtcaacacaattatcggcccgggtactttacacagactgctggaccgtggcatttagggaaattagaactcgattttgatctttgtgaaggaacaactgtcgtagtggatgagcactgtggtaatagagggcccagtttacgaacaacgactgtgacaggaaaaattattcatgaatggtgctgtaggagctgtacgttgccacctctgagattcaaaggagaagatggctgctggtacggcatggaaataagacctgtaaaagagaaagaagagaacttagtaaaatctatggtgtcagccggttctggtgaagtagatagttttagcttaggactgttatgtataagtataatgatagaagaagtaatgcgtagtaggtggtctcgtaaaatgttaatgactggaactctagcagtcttctttctattgataatgggtcaattaacttggaacgatttgataagactttgcattatggtaggagcaaacgcatcagacagaatgggcatgggaaccacttatttagcacttatggcaacattcaaaatgcgtcctatgtttgcggtaggcttgttgtttaggagacttacctcccgcgaagtactacttttaaccataggattatcattagtagcgtcagtagaactacccaactccttggaagaacttggggatggactagccatgggaataatgattttgaaattgctaactgattttcagagtcaccaattatgggccaccttactatcattaacctttattagaacaacattctcgctacattacgcatggaaaacaatggcgatggtcctgtccatagtttcgctatttcccctgtgcttatctaccacatcgcagaaaactacttggcttcctgttttattaggatccctagggtgtaaaccactaacaatgtttttaatagcggaaaacaaaatatggggcaggaagtcatggcctttaaatgaaggtataatggccgtgggaattgtatcaatacttttatcatctctactcaaaaatgatgtgccactggccggaccactcatagccggtggaatgctaattgcctgttatgtaatcagcggatcatctgcagatctcagcttggaaaaagctgccgaagtcagctgggaggaagaagcagaacattcgggagcatcacataatattctggtagaagtgcaagacgatggaacgatgaaaatcaaagatgaagaaagagatgatacactaacaatcctattgaaagctacactattagctgttagtggggtttatccgctatctatccccgcaacactattcgtatggtatttctggcagaagaagaaacagcgatcaggagtactatgggatacaccgtcaccaccagaagtcgaacgtgctgttctagatgacggtatctacaggataatgcaaaggggacttttaggacgatctcaggtcggagtaggagtatttcaagaaaacgttttccataccatgtggcacgtcacaaggggtgcagtattaatgtatcaaggcaagcgcctagagccctcctgggcatccgtaaagaaagatttaataagttatggcgggggttggcgcctacaaggatcctggaatactggcgaagaggttcaagttatcgcagtcgagccaggcaaaaaccccaaaaacgtgcagactgcacctggcacgttcaaaacaagtgaaggtgaagtgggtgcaatagccttagacttcaaaccgggtacgtctgggtctcctatagtgaatagagaagggaaaatagtaggattatacggtaatggggtagttacgacctctgggacttacgttagtgcaattgcgcaagcaaaggcatctcaggagggaccactaccggaaatagaagacgaagtttttagaaaacgtaatcttacaattatggatttgcatccagggagtggaaagacacggagatacttacctgcaatcgtaagagaagcgataaaaagacggctacgcacacttatactagctcccaccagagtggtagcgtcagagatggcagaggcattaaaaggaatgcccattcgctaccagacgactgcagtaaaatcagaacacacagggaaggaaatagtagatttaatgtgccacgccacctttaccatgagactgttatcacctgtacgtgttcctaattataatatgataataatggacgaagcacattttactgacccgtcaagcatagcggcccgaggatatattagcacaagagtaggtatgggggaagcagcagcaatcttcatgacggccacgccacctggttcggttgaagcattcccacaaagtaacgcggtgatacaggacgaagaaagagatattcccgaacgttcttggaactctggttacgagtggataacagactttccgggaaaaacagtttggttcgtacccagtatcaaaagcggaaatgacatcgcgaattgtctacggaaaaacggcaaaagagttattcaactttcaagaaagactttcgacactgaataccagaaaactaaaaacaatgactgggactatgttgttacaacagacatatccgaaatgggagcgaactttcgagcagatagagtaatcgaccctaggagatgcttaaaacctgtgatcctaaaagacggacctgaaagagttatccttgcgggacctatgcctgtaacagttgcttctgccgcacaacgacgtggaaggattggccgaaatcataataaagagggagatcagtacatatatatgggacaacctcttaataacgatgaagaccatgcgcactggactgaggcgaagatgctattagataacatcaataccccggaaggaataataccggcactgttcgaaccggaaagagaaaaatcagctgccatagatggagaatatagactgcgaggagaggcgaggaaaacttttgtggaactcatgcgtcgaggagatttaccggtgtggctctcatacaaagtagcaagtgagggatttcagtactcagatagacgttggtgtttcgatggagagaggaacaatcaggtattggaagagaatatggatgtagaaatttggacaaaagagggagaacgaaagaaactaagacccagatggttagatgcacggacttattcagatcccttggcgttgcgggagtttaaagaatttgcagcaggcagacgatctgttagcggagacctaatattagagataggaaaacttccacaacatcttactcaacgagcgcaaaatgcacttgacaatctcgtaatgctacataattctgagcaagggggtcgggcgtataggcatgcaatggaggaactacctgacaccatagaaacattaatgctattagcgttgattgcagtgcttaccggtggggtgacgttgttctttctatcagggcgagggctcggaaagacaagcattggcctattgtgcgttatggcatcttcagttttgttatggatggcatcagtcgaaccacactggatcgcagcgtcaatcatacttgagttctttctaatggtcttattaatacctgaaccggacaggcaaagaaccccacaagataatcaactcgcctatgtagtaatcggattactattcatgattttaacagttgcagctaatgaaatgggactattagaaacgaccaagaaagatttggggattggtcacgtcgcggtggaaaaccaccaccatgctgctatgttagatgttgacttacacccagcgagtgcttggaccttgtacgctgtagcgacaactataatcactccaatgatgcgtcatacaatagaaaatactacggctaatatttcccttaccgcgatcgcgaatcaagccgccattttgatggggttggataagggttggccgatttctaaaatggacataggtgtaccccttttagctcttggatgttatagtcaagtcaatccacttactttaacagcggcagtattaatgcttgtagcccattatgccataataggacctggtctccaggctaaagcaacacgcgaagcccaaaagcgcactgccgcaggtataatgaaaaatcccacagtagacgggattgttgccatagacttagacccagtcgtgtacgatgccaaattcgaaaaacagttaggtcaaattatgttattaatattatgcacttctcaaattctacttatgagaaccacatgggctttatgcgagagtatcactttggcgacaggccctttgactacgttatgggagggttctcccggtaaattctggaacactacaatcgcagtttccatggcgaacattttccgaggatcgtatcttgccggtgctggattagcattctcattgatgaaatccctgggaggcgggcgaagaggaacgggagcacagggggaaacccttggtgaaaaatggaaacgtcaactaaatcaactttcaaaatcagaatttaacacttataagcgatccggaattatggaagtagatcgctcggaagcaaaagaaggacttaagagaggtgaaacaactaaacatgctgtatctagagggacagctaagttacgatggtttgtcgaacgtaacttggtaaagccagaaggaaaagtaatagatctgggatgtggacgaggcggttggagctattattgtgcaggactcaagaaagtaaccgaagtaaaaggctacactaaaggcggtcccgggcatgaagaacccattcctatggctacctatggatggaacctggtaaaactacatagtgggaaagatgtgttctttattcctcccgaaaaatgcgacactctgctatgtgacatcggtgagtcgtcgccaaatccaacgatagaagaaggacgaaccctcagagttctaaagatggtagaaccctggcttcgcgggaatcaattttgcataaaaatactgaatccatatatgccttcggttgtggaaacgttagagcagatgcaaagaaaacatggtgggatgctcgtaagaaatccactgtcacgtaattcaactcacgaaatgtattgggttagctgtggaactggtaatatcgtcagtgcagtaaacatgacctcaagaatgttactgaatcgctttacaatggcacatcgaaaaccaacttacgagcgagacgtagacctcggagcaggtacacgacatgtcgctgtggaacctgaagtggcaaacctagatataataggtcaacgtattgaaaatatcaaacatgaacataaaagtacatggcattatgacgaagacaacccgtataaaacatgggcatatcacggctcatacgaggtgaaaccgtcaggatccgcatcctctatggtgaacggtgtagtgaaacttttaacaaaaccctgggatgtaattccaatggttacacaaatagctatgaccgacaccacacctttcggacaacaacgggtattcaaagaaaaagttgacacgagaactccaaaggcgaagcgaggcacagctcagatcatggaagtaactgcgaaatggctttggggatttctaagccgaaacaagaaacctagaatatgcacaagggaagagttcactaggaaagtcagatcaaacgctgcaattggtgcagtgtttgtagacgaaaaccaatggaatagtgccaaggaagcagtagaagacgaaagattctgggatttagtacacagagaacgtgagttacataaacagggaaaatgcgcaacatgcgtatataacatgatgggcaaacgggagaagaaattaggagaatttggcaaagctaaggggtctcgagctatatggtacatgtggctaggagcacgtttcttagagtttgaagcattgggctttatgaacgaagatcattggttctcgagagaaaactcactttcaggggtagaaggcgagggattgcataaattaggatacatcctgagagatatttctaaaataccaggtggtaatatgtatgccgatgacacggcaggatgggacacacgcatcacagaggatgatttacaaaacgaagctaaaattactgatattatggagccggagcatgcattattagctaaatcaatttttaaattaacttaccagaataaagttgtaagggtacaaagaccagccaaaaatggtacggtgatggacgttatttcaagacgagatcaacgcggatccgggcaagtaggtacttatggcctaaatacatttactaatatggaagcacaattaatacggcaaatggagtctgaaggcatattctcgccgtcagaattagaaacgcccaacctggccggtcgcgtccttgattggttagaaaaacatggtgtagagcgactaaagcggatggctattagcggtgatgactgtgtagtaaaaccaatagatgacagattcgccacggcattaacggccctcaacgacatgggtaaagtccgaaaagacatccctcaatgggaaccctccaaaggctggaacgactggcaacaagtacccttctgctcccaccattttcatcagctaattatgaaagacggaagggaaatagtcgttccttgtcgtaaccaagatgagcttgtaggacgagcgagagttagccagggcgcaggatggtcgttgagggaaaccgcgtgcctaggcaaaagctatgcgcagatgtggcaacttatgtattttcaccgacgagatctacgtcttgctgctaacgcaatctgttccgcagtaccagttgattgggtccctacttctcgtacaacctggtcaatccatgcacatcatcaatggatgacgacagaagatatgctcagtgtatggaatcgggtatggattgaagagaatccctggatggaggacaaaacacacgtaagttcgtggggcgacgttccgtacctaggaaagagggaagatcaatggtgtggctcactaataggtctaacagcgcgagcaacgtgggctaccaatattcaagttgctataaatcaagttcgaagactactgggtaacgaaaattatctggattatatgacttctatgaaaagatttaaaaatgaatctgatccggaaggggctttatggtaa

SEQ ID NO: 21913 - RNA, 9879 nt, synthetic construct
  misc_feature 1..9879: note = derived and/or modified CDS sequence (opt6) from DENV-1__EU482810__SS-prME
  source 1..9879: mol_type = other RNA
tcggttacaatgttactgatgttaatgccaacagcactagcatttcatttgacaacaagaggaggagagccacatatgatcgtatcgaaacaagaaagaggaaaaagcctacttttcaaaacaagcgcaggcgtgaacatgtgtacgcttattgcaatggacttaggtgaattttgtgaagatactatgacatataaatgtccgagaataacggaggcagagccagatgatgtggactgttggtgcaacgcaacagatacatgggttacgtatggaacctgtagtcaaacgggggaacatagaagagataaaaggtcagtagcgctagcgccacacgtcggcctcgggttggaaactagaacggaaacttggatgagcagcgaaggcgcatggaaacaaatccaacgcgtagaaacatgggcgctaagacatccagggttcacagtaatagcattgtttctagctcacgcaatagggacttccattacgcaaaaaggaataatatttatcttacttatgctagtgactcccagcatggcaatgcgctgtgtggggataggatcacgagactttgtagaaggactgagcggagcaacatgggtcgacgtagtacttgaacacggaagttgcgtgacaacaatggccaaagacaaacctactttggatatagaattattaaaaacagaagtcacaaacccggcagtactaaggaaattgtgcatagaagcaaaaatatcaaataccacaaccgacagtcgatgcccaacacaaggagaagccacattggttgaagaacaagacgcaaatttcgtatgcagacgaacatttgtagatagaggatggggaaatggttgtggtttgttcggcaaagggtcattgattacttgtgctaaattcaaatgtgttacaaaattggagggaaaaatagtacaatatgaaaatctcaaatatagtgtcatagttactgtacatacaggagatcaacatcaagtaggaaacgaaagtacagaacatggaaccacagcaacgataacaccacaagctccctctaccgagatacaattgacggattatggcgcattaaccctagattgtagcccgcgaactggtctggactttaatgaaatggtactactgactatgaaagagaaatcgtggttggtacataaacaatggtttttagatctgccgttaccatggacctcaggagcatctacgagtcaagaaacatggaacaggcaagatcttctggttaccttcaaaactgcacatgcaaagaaacaagaagtcgtcgtgttaggctcacaagagggagctatgcatacagcgttaacgggagcaacagagatacaaacttcaggaactactactatatttgcaggacatctcaaatgtagactgaagatggataaattaacacttaaaggcatgagttacgttatgtgtactgggtcgtttaaattggaaaaagaggtcgcagaaacccagcatggcacagtccttgtgcaaatcaaatatgaagggactgatgcgccctgtaaaataccgttttccacccaagacgaaaaaggtgtcactcaaaacgggcgattgattaccgcaaaccccatagttacggataaagaaaaaccagtcaacatcgaagctgaacctccatttggtgaatcgtatatagtcatcggagctggagagaaagcattaaaactgagttggtttaaaaagggatcctctattggaaaaatgtttgaagctacagctagaggggcccgtcgaatggcgatactcggcgatactgcttgggacttcgggagtatcgggggagtttttacatctgtaggtaagttagtacatcaaatttttggcaccgcatacggtgtcctgttttccggcgtaagttggacgatgaaaatcggaatcggagtattattaacatggttaggtttaaattcaagatccacctcattaagcatgacttgtattgccgttggactcgttacactatatttaggtgtcatggtacaagcagactcaggttgtgtaataaactggaaaggcagagaactcaaatgtggttccgggatctttgtaactaatgaagtgcatacctggacagaacaatacaaatttcaggctgactcgcctaagaggctaagcgctgcaataggcaaagcctgggaggaaggagtctgtggaatacgaagcgcgactaggcttgagaacataatgtggaagcaaatatcaaatgaacttaaccatatactattggaaaacgatatgaaactaacagttgttgtcggagatgtggcgggaattttggcccaaggcaaaaagatgattcgaccacaaccaatggaatacaaatacagttggaaaagctggggcaaagcgaaaataatcggagcagacgtacaaaataccaccttcattattgacggaccaaataccccggaatgcccagatgaccaaagagcttggaatatatgggaagtagaggactatggattcggaatatttaccactaatatttggttaaaattgagggattcttatacacaaatgtgcgatcatagactgatgtcagctgccatcaaagattcaaaagcagtccacgcagatatgggatattggatagaatcagagaaaaatgaaacttggaaactagctagagcaagtttcattgaggtaaaaacctgcatctggccaaaaagtcacacactatggagcaatggtgtattagaatcagaaatgataatacccaagatatatggtggaccaattagtcaacataattatagaccaggctactttacccaaaccgctggcccttggcatttgggaaaactggagctagattttgatctatgtgaaggaacaaccgttgtcgtagatgaacattgcggcaaccggggtccgagtttaagaacgactaccgtaacaggtaaaataatacatgagtggtgttgtcgatcgtgtactttaccgccattaagatttaagggcgaggacggatgctggtatggcatggaaatcagaccagtaaaagaaaaagaagaaaatctagttaaaagtatggtatcagctggctccggtgaagtagattcttttagcttaggactgttatgtatcagcataatgatagaggaagtcatgcgttcacggtggtctcgaaaaatgctaatgactggcacgcttgcggtcttcttcttactaataatgggacaactgacatggaacgatttaatacgactctgcataatggtaggagctaatgcaagtgacagaatgggcatgggtacaacatacctcgccctgatggcaactttcaaaatgcgtcctatgtttgctgtcggcctattatttagaaggctcactagccgcgaagttctacttcttacgatcggactaagcctggttgcaagcgtagagttaccaaatagccttgaggagctcggcgacgggcttgcaatggggataatgatactcaaactgttaactgattttcaatcgcatcaattatgggctaccctcttaagtatgacgtttattcgcaccacattttccttacattatgcctggaaaactatggctatggttttgtcaatcgtctcgctattcccattatgtttatctacaacctctcagaaaacaacatggcttcctgttcttctaggttcattggggtgcaaaccgctcactatgttcttgatagcagagaataaaatctggggccgcaagagttggcccttaaatgaaggtattatggcggtaggtatagtaagtatactactatcgtcattattgaaaaatgacgtaccactagccggaccactcatagcaggaggaatgctaattgcctgctacgttatttcaggtagctcggcagacttaagccttgaaaaggcagctgaagtttcatgggaagaagaagcagaacattctggagcctcacacaacatattggtggaagtacaggatgatgggaccatgaaaattaaagatgaagaacgtgatgacacacttacaatacttctcaaagctacattactagcagtctctggtgtttatcctttatcgattcctgcgactctctttgtatggtatttttggcagaagaagaaacaacgaagtggagtcctttgggatactccgagtccacctgaggtccaaagagcagtgttagatgacgggatttatcgaatcatgcagcgtggactcttaggaaggtcacaggtaggagtgggtgtatttcaagaaaatgtctttcatactatgtggcacgtcactagaggagcagttcttatgtaccaaggaaaacgattagagcctagctgggcttcagttaagaaggacttaattagctatggtggcgggtggcgcctgcaaggaagctggaatacaggagaggaagtacaagtaatagcagtggaaccaggcaaaaatcccaaaaatgtacaaaccgcaccgggaacattcaaaacgagcgagggggaggttggtgctatcgcattagattttaagcccgggacatcaggaagccccatcgttaaccgcgaaggtaaaatcgtaggtctatatggaaatggagtggtcacaacgtcaggtacatacgtttcagcaatcgcgcaggcgaaggcaagccaagaaggacctttgcccgagatcgaagacgaggtatttaggaagagaaatttgacgataatggacctgcatccaggatccggtaaaacaagaagatacctgccagctattgtacgagaagcaataaaacgtaaacttcgaactctaattctagcaccaaccagggtggtagcttcagaaatggcagaagctctcaaaggaatgcctattaggtatcaaaccacagcagtaaagagtgagcacacaggaaaagaaatagtcgaccttatgtgtcatgctacctttacgatgcgattgcttagtcctgtacgagtaccaaattataatatgataataatggacgaggcccattttactgatccatccagcattgccgcaagagggtatataagtactagagtgggaatgggggaggccgcagcaatattcatgactgcgacacccccaggtagtgttgaggcatttccacagtccaatgctgtcatccaagatgaagaaagagacattccagaacgttcttggaactcaggatatgagtggatcacagatttccccggaaagacagtctggtttgtgcctagtatcaaaagtggtaatgacattgcgaattgtctaaggaaaaatggtaaacgtgtgattcaactcagcagaaagacctttgacacagaataccagaaaacgaaaaataatgattgggattacgtagttacgaccgatatatcagagatgggtgcaaattttcgagcggatcgagttatagatcccagaagatgtctaaaaccagtaattttgaaagacggtcctgaacgtgtgatactagctgggccaatgccagtcacggtagcttctgcagcacaacgtagaggccgaattggaagaaatcacaataaagaaggtgatcaatatatttatatggggcaacccctgaataacgatgaggatcatgcacactggacagaagcaaaaatgctcctagacaacattaatacaccggagggaattataccagctctatttgaaccagagcgagaaaagtcagctgctatagatggagaatacagactgagaggcgaagcgcgcaaaactttcgtagaactaatgagacgaggagatttacctgtctggctatcacataaagtagcatcggaggggtttcaatatagtgaccgccgttggtgctttgatggtgaaagaaataaccaagtcttggaagaaaatatggatgttgaaatatggacaaaggaaggagagcgtaagaaattgcgccctagatggttagatgcaagaacctattcggatccgctggcattgcgcgagtttaaggagtttgctgctggcagaagaagtgtgagtggagatctgattttggagataggcaaactacctcaacatctcactcaaagagcgcaaaatgcactagataacttagtaatgctgcataatagtgaacaaggtggacgtgcttatagacacgccatggaggaactaccagatacgatagaaactttaatgttgttagctttaatagccgttctgactggtggagttacgttgttctttttgtctggacgaggtctagggaaaacatccatcggactactatgcgttatggcttcaagtgtcttactttggatggcatccgtagaaccacactggattgctgcctcaatcattctagagttctttttaatggtactactaatcccggaaccggacaggcagagaacaccacaagataaccagctggcttacgtagttatcggtttattatttatgatactaacagtagcggccaatgaaatgggtctgctagagactaccaagaaagatctgggtataggtcatgttgctgtagaaaaccatcatcacgctgctatgctcgatgtagacttgcatccagctagcgcatggacgctatatgctgtcgcaacaacaataataacaccgatgatgcggcacactatagaaaacacaacagctaatataagtctaacggcaatagcgaatcaagcagcaatattaatgggtttagataaaggctggccgataagcaagatggatataggagttcctttattggcactaggatgctattcacaagtaaacccgctaactctcactgctgctgtactaatgctagtggcacactatgccataatcggtcccggcctacaggcaaaagcgacaagagaagcgcaaaagagaactgcagctggtattatgaagaatccaacagtagatgggatagtcgccatagatcttgacccggttgtatatgacgcaaaattcgaaaaacagcttgggcagattatgcttcttattctatgcacttcccaaattttactcatgaggacgacatgggccctatgcgaatccatcactctcgccacaggccctcttacaactctctgggaaggttcgcccggtaaattttggaatactacaatagcagtatcaatggcaaacatatttagaggatcttatcttgctggagctggattagcattttctttgatgaaatcactagggggttcccgaagaggaactggtgcccaaggagaaaccttgggggagaagtggaagagacaacttaatcaattgagcaaatcagaatttaatacatataaacgttcaggtatcatggaggtagataggtcagaagcaaaagaaggtttgaaaaggggagaaacaacaaaacacgcggtatcaagaggaactgctaaactcagatggtttgtagagcgcaatttggttaagcctgaaggtaaagtaatcgatttgggctgcggaagaggtggatggagttactactgcgctggattaaagaaagtaactgaggtaaaaggatatacgaaaggcggaccgggacacgaggagccaattccgatggcgacgtacggttggaacctagtgaaactacactcaggaaaggacgtattctttatacctcctgaaaaatgtgatacgctgctgtgtgatataggagaatcttcaccaaaccccaccatagaagaaggtaggacattgcgagtattgaaaatggtagaaccatggttaaggggaaatcaattttgtataaaaatacttaacccgtatatgccgagtgtagtggaaacgttagaacaaatgcagagaaaacatggcggaatgctcgtaagaaatccattgtcgcggaacagcacacatgaaatgtattgggtatcttgcggaaccggtaacatcgtttccgctgtaaatatgacatcaagaatgttattgaatagattcacaatggctcatagaaaaccgacatatgagagagatgtggaccttggcgctggaactcggcatgtagccgttgagccggaagtagcaaacttagacataataggacaacgaatagaaaatatcaaacatgaacataagtcgacgtggcattatgatgaagacaatccctacaaaacatgggcttatcacggttcttacgaagtcaaaccgtccggtagcgcctcatcaatggtgaatggagttgttaagctcttaacgaagccatgggacgtaatacccatggttacacaaatagctatgacagacacgacaccctttggccaacaaagggtatttaaggagaaggtagatacgaggactccgaaagccaaacgaggaacagcacaaatcatggaagtaacagctaaatggctgtggggctttttgtcgagaaacaagaaaccccggatttgtactagagaagaatttacacgaaaagtacgctcaaatgcagcaattggtgctgtatttgtagatgagaatcagtggaactccgcaaaagaagctgtagaggatgaaagattttgggaccttgtacacagagaaagagagttacataaacaaggaaaatgtgcgacatgcgtgtataatatgatgggtaaacgagagaagaaactcggagagtttggtaaagcaaaaggttccagagccatatggtacatgtggctaggagccaggtttcttgaatttgaagcattgggattcatgaatgaggatcattggttcagtagagaaaatagtttaagtggtgtcgaaggagagggcttgcacaaacttggctacattcttcgtgatatttctaaaataccgggaggcaatatgtatgcagatgatactgctgggtgggatactcgtattacagaggacgatcttcagaatgaagcgaaaatcacagatatcatggagccagaacatgcactccttgccaagagcatattcaagttgacctaccaaaacaaggtcgtccgtgtacaaagacccgctaaaaatggaactgtaatggacgtcataagtagacgtgaccagcgcggtagtggtcaagtcggaacctatggtctaaatacatttacgaatatggaagcacagcttatacgtcagatggaaagtgagggcatattttcaccatcagaattagatactcctaatctcgcgggcagagttcttgattggctagaaaaacatggagtagaacgtttaaaaagaatggcaatttccggagatgattgcgttgtcaaacccatcgacgacagatttgcgacggctctcactgcactgaacgacatgggaaaagtacgaaaagatatcccacaatgggaacctagcaaaggttggaacgactggcaacaggtaccattttgctcgcaccattttcatcaactgattatgaaagatgggagagagatagtcgtcccatgtagaaaccaagatgaattggtaggtcgcgcgagggtttcacaaggagccggatggtcactaagagagacggcctgcctgggaaagtcttacgcgcaaatgtggcaactaatgtatttccatcggcgggatctaaggctcgctgctaacgctatatgctcagccgttccagtcgattgggtgcccacgtcaagaacaacgtggtctatacacgcccatcaccaatggatgacaacggaagacatgttgagtgtttggaatagggtatggattgaagaaaatccgtggatggaagacaaaacccatatcagtagctggggagacgtaccctacttgggaaagcgagaggaccaatggtgtggttcattaattggtctaaccgcccgagctacttgggcgacaaatatacaagtggcgatcaatcaagtgagaagattattaggaaatgagaactacctagattacatgacatctatgaaaagattcaaaaacgagtctggacccgaaggagccttgtggtaa

SEQ ID NO: 21914 - RNA, 9879 nt, synthetic construct
  misc_feature 1..9879: note = derived and/or modified CDS sequence (opt6) from DENV-1__EU482811__SS-prME
  source 1..9879: mol_type = other RNA
agtgtaacaatgctattgatgctaatgccaactgcgttagcgttccatttgactacaagaggaggagaaccccatatgatcgtctctaaacaagaaagagggaagtcattattatttaaaacatccgccggagtaaatatgtgcacattgatagcaatggacttgggtgaattatgcgaagatacaatgacatataaatgtccgcgtatcacagaagcagaacctgacgacgtagattgctggtgtaatgctacggacacgtgggtcacatatggaacatgctctcaaaccggagaacatagaagagagaaaagatcagttgcgctcgcaccccatgtgggattaggactagaaactagaacagaaacttggatgtcgtcagaaggagcttggaaacaaatacagagagtagaaacatgggcgctaagacatcctggattcactgtgatagcgctattcctggcgcacgccataggtacatcaattacccagaaaggaataattttcatactcctaatgttagtgacaccatcgatggctatgcgatgtgtaggcataggttcgagagatttcgtagaaggcttaagtggagcgacctgggtagatgtagtattggaacacggctcatgtgtgactaccatggcgaaagataaaccgacattagatattgaattacttaaaactgaagttacaaaccctgccgttttgagaaaattatgcatcgaagcgaaaatctccaacactactacagacagcagatgtcctacacaaggggaagccaccttagtggaagaacaagacgctaactttgtatgccgtcgcactttcgtagaccgcggctggggtaatggttgtggcttattcgggaaaggcagtctactgacatgcgctaagtttaaatgcgtaactaaactcgaagggaagattgtccaatatgaaaacttaaagtattcagtaattgtcactgtacatacaggggaccagcatcaagtaggtaatgaaagtaccgaacatggtacaaccgcaaccataacaccacaggctcccactacagagatccagcttacagactacggcgcacttacccttgattgctctccacgaactggcttagattttaacgaaatggtacttctgactatgaaagaaaagtcttggttggtgcataagcaatggtttcttgatttgcctctaccgtggacgagtggagcatctacgtctcaagaaacctggaaccggcaggacttactcgtgactttcaaaacagcccacgcaaagaagcaagaggtcgtagtgttaggttcacaggaaggagcaatgcacaccgcactgacaggagccacagaaatccagactagcggtacaacgactatctttgccgggcacctaaaatgccgactaaaaatggataaacttacccttaagggtatgagttacgttatgtgcaccggaagttttaaactggaaaaagaagtagctgaaactcagcacggaaccgtgctagtgcaaattaaatacgagggaacagatgcaccttgcaaaattcctttcagcactcaagacgaaaagggagtcacccaaaacggacgtctgatcacagccaacccaatcgtcacagataaagagaagccagtaaatatagaggccgaaccgccctttggtgagagctatattgtaatcggagctggagaaaaagctctaaaattatcttggttcaagaaaggatcttcaatcggaaagatgtttgaagcgacagcaagaggtgctagacgcatggccattttaggcgatactgcttgggattttggatcaataggaggagtatttacaagcgttggcaaattggtacatcaaatattcggtacagcatacggagttctattttcgggtgtaagctggactatgaaaataggtataggagtactgttaacctggctcggactaaacagccgtagcacctcgctatcaatgacctgcatcgcagtaggattggtaactttgtatcttggcgtgatggtccaagcggatagtggctgcgtaataaattggaaaggacgcgaactgaaatgtggatcgggaatctttgtaactaacgaagttcatacatggacggaacaatacaagtttcaggccgacagtcccaaaagattatctgccgcaataggcaaggcttgggaggaaggtgtgtgtggaataaggtcggcaactcgtttggaaaatataatgtggaaacagataagtaacgaattgaaccatatcttattagaaaatgatatgaaatttactgtcgtggttggtgatgttgcaggtattctagtccaaggaaagaaaatgatccgcccgcaaccgatggaatataaatactcatggaaaagctggggtaaggcgaaaattataggggcggacgttcaaaattcaacatttattatagacgggccaaatactccggaatgtccagacgatcaaagggcatggaacatatgggaagtagaagattacgggttcggtatatttacaacaaacatctggctcaaattgcgcgactcgtacacacaagtatgcgaccatagattaatgtcagcggctatcaaggatagtaaggctgttcacgccgatatgggctactggattgaatcagagaaaaatgaaacttggaaactggcaagagcgtcatttatcgaagttaaaacgtgcatatggcccaaatcacacaccttatggtctaatggggttctcgagagtgaaatgattatacctaaaatacatggcggccctatatcacagcataattatagacctggttattttactcaaacagcgggtccctggcacttgggaaaattggaactagattttgacttatgtgaaggcactacagtcgttgtagatgagcactgtggtaaccgcggaccttcacttaggactacaactgtgaccggaaagataatccatgaatggtgttgcaggagctgcactctaccacccctcagatttcgaggagaagacggatgttggtatggtatggaaattaggccagtgaaagaaaaagaggagaacttagttaaatcgatggtttcagcaggatcgggtgaagtagattccttctctttgggattgctctgcatatcaataatgatagaagaagtaatgcgatcaagatggtccagaaaaatgctcatgaccggtacactcgctgtattctttctcctaatcatgggccaattaacctggaatgacctaataaggctttgcataatggtaggtgctaacgcaagtgatagaatgggtatgggaactacctacttggcattaatggcaacatttaaaatgagaccaatgtttgccgtaggattgttattcagaaggcttacgtcacgagaagtactattattaactattggcctttcgctcgttgcttcagttgaactgccaaacagcttagaggaattaggcgatgggctagcaatgggcataatgattttaaaactgctaacagactttcagagttaccaactttgggcaacattactcagccttacattcatcaaaactacgttttcattacactatgcctggaaaaccatggccatggtattatcgatcgtaagcctatttccgctctgtcttagtactacctcgcagaaaactacctggctcccagtattactaggatcactaggttgtaagcccttaacaatgtttcttatcgcagaaaacaaaatctggggaagaaaatcgtggccccttaatgaaggcatcatggcagttggtattgtcagtatactattgagcagcttactcaaaaatgatgttcctctagcgggccctctaatagcgggaggaatgctaattgcttgctacgtcataagtggttccagcgcggacttatcactagaaaaggccgcagaagtttcctgggaagaagaagctgaacactccggagctagccacaacattttagttgaggtccaagatgatggtacaatgaaaatcaaagacgaagaaagggacgatactcttactatactattgaaagcaacactattggcagtgtcaggtgtctaccccttatcgataccagcaactctttttgtgtggcacttttggcaaaagaaaaagcaaaggagcggcgtcctctgggacacgccaagtccaccggaggtagaacgagctgtcctagacgatggaatatacagaattatgcaacgaggacttttaggccgatcacaagtcggcgttggggttttccaagaaaacgtatttcacacaatgtggcatgtcacgcgaggagcggtacttatgtaccaagggaaaaggctagaaccctcttgggcttcagtcaagaaagatcttattagttacgggggaggctggcggttacaaggttcctggaataccggagaagaagttcaggttatcgcagtcgaaccaggaaagaatcccaaaaatgtacaaacggcaccaggaacttttaaaacgcctgagggtgaggttggagcaatagcgttagactttaaacccggtacaagtggaagtcctatagtcaaccgtgaggggaaaatagtcggactgtatgggaacggagtagtcacaaccagcggcacatatgtttcggcgatagcgcaggccaaagccagtcaagaaggtcctctaccagaaatagaagatgaagtatttcgtaaacgaaacctaacgataatggacttacacccaggatcaggaaaaacgagaaggtaccttccggcaatagttcgtgaagctatcaaacgaaagctaagaaccttaatccttgctcccactagagtagtcgccagcgaaatggccgaagcgctaaaagggatgcctatacgttatcaaacgactgcggtgaagagtgaacacactggtaaagaaatagtcgacctgatgtgtcacgcaacctttaccatgagattattgagcccggttagggtcccaaattataacatgataatcatggatgaggcccatttcacagatccatcatccattgctgcgcgaggatatatcagcacacgtgtgggcatgggagaggcggcagcaattttcatgaccgcaacaccaccaggctctatggaagccttcccgcaaagcaatgctgtaatacaagacgaagaacgtgatatccctgaaagaagttggaatagtggatatgaatggatcactgattttccggggaaaacagtttggttcgtcccttccatcaaagcaggcaatgacatagctaattgtttacgaaagaatggcaaacgagtaattcagctaagtcgtaagacattcgatacagagtatcagaaaactaagaataatgattgggactacgtcgttacaacagacatatcggaaatgggtgctaatttcagggcagaccgcgtgattgatcctcgacgttgtctaaagccagtaatcttaaaagatggtccagagagagtaattttggccggaccaatgccggtaacagttgcaagtgctgctcaacgacgtggaaggattgggagaaaccacaataaagaaggtgatcagtatatatatatgggccagcccttgaataatgatgaggatcacgcacattggaccgaagcaaagatgcttctagataacattaatactcctgaaggaataatcccagcactgtttgaaccagaaagagagaaatcagctgctatagatggagaatataggttaagaggagaggcaagaaagacgttcgtagaactaatgagacgtggagatttaccggtttggttaagttacaaagtagcgtcagaaggttttcaatattcggacagacgatggtgttttgatggggaacgtaataaccaagtgctagaagaaaatatggatgtagaaatctggacaaaagagggtgaaagaaagaaattaaggccgcgctggttagacgcaagaacatattccgatccactagcattaagagaatttaaagagttcgctgcaggaagacgttcagtctcaggagatttaatcctagagataggaaaattaccccaacatttaacacaaagagcccaaaatgctttagataatctagtcatgttacataattcagagcagggaggcagagcttaccgccatgcgatggaggaactaccagatacaatagaaactcttatgttattagctttgattgctgtattaacaggaggagtaactttgttcttcctatctggtaagggccttggtaagactagcatcgggcttttgtgtgttatggcttcaagtgtgttactatggatggcctcagtagaaccacattggatagcagcctctataattttagagttcttcttaatggtactgcttatcccggagccggaccgacaacggacaccgcaagataatcaactagcctatgtagtcataggtttactcttcatgatactaaccgtggccgcaaacgaaatgggtttattggaaacgacaaagaaagatctcgggataggtcacgtcgccgtagagaatcatcaccatgcagcaatgttagatgtggacctgcatcccgcatcggcttggaccttatatgcagttgctacaacgataattacccccatgatgagacacactattgaaaatactacagctaacatcagcctaacggctatagcaaatcaagcggccatcctcatgggattagataaaggctggccaatcagtaaaatggatatcggagtgcccctattagcactagggtgttactctcaagtaaaccctctaactctcacagcagcggtcttaatgttagttgcacattacgctattattgggcccgggttacaagccaaagcaacgcgcgaagcccagaaacgaactgctgcaggaataatgaaaaatccgactattgatggcatagttgctatagacttggaccctgtagtatacgatgctaagtttgaaaaacaactcggacaaataatgcttctaatattgtgtacatcacaaatactcttaatgagaaccacctgggcactgtgtgaaagtataacgctagcaaccggaccattaacaaccttgtgggagggatccccaggtaaattctggaacactaccatcgctgtttcgatggccaatatttttcgaggatcatatctggcaggggcagggctagcattctctttaatgaaatctttaggaggaggacgacgcggcacgggtgcacaaggagaaacacttggagaaaaatggaaacgacaattgaaccaactttcaaaatcagaatttaacacttacaaaagaagcggaatcatggaggtggacagatctgaggcaaaagaagggcttaaacgaggagagacaacaaagcacgcagtatccagaggtacagctaaattacgatggtttgtggaacgaaacctggtgaaaccagaaggtaaggtaattgacctcggatgcgggagagggggttggtcatattattgtgctgggcttaagaaagtaacagaagtcaagggatatactaaaggtgggcctggtcacgaggaaccaatccctatggcgacctatggttggaaccttgttaagctacattcaggaaaggatgtattctttatcccaccggaaaagtgtgatactttgttgtgtgacataggagagtccagtccaaatccgactatcgaagaagggcgtacattacgagtattgaagatggtggaaccgtggcttagaggaaaccaattctgcataaagattttaaacccgtacatgccatcagtggtggaaacactggaacagatgcaaaggaaacatggaggtatgttagtaaggaacccactttcgcgcaatagtacgcatgaaatgtactgggtatcatgtggtacagggaatattgtcagcgccgtcaatatgacatctcgaatgctcctgaacagatttactatggcacataggaaaccaacatacgaaagggacgtagatctgggggcaggaactagacacgtagccgtagaacctgaagtcgctaaccttgatataataggacaaagaatagaaaacataaaacacgaacacaaatcgacatggcactatgatgaggacaatccatataaaacgtgggcttaccacggttcatatgaggtgaaaccttcagggagcgctagtagtatggttaacggtgtagttaaacttttaacaaaaccttgggacgttattccaatggtaacgcaaattgccatgactgatacaacgccattcggacaacaacgagtatttaaggaaaaagttgacacaaggacaccaaaagcaaaacgtggtacagcacaaataatggaagtaacggcgaggtggttatggggatttttaagccgaaacaaaaagccaagaatttgcacacgcgaagagttcacccgaaaagtgagatctaatgctgcgataggcgcagtatttgtagatgaaaaccagtggaactcagctaaagaagccgtagaagatgatagattttgggacttggttcatagagaaagggaacttcataaacaaggtaaatgcgcaacgtgtgtttacaacatgatggggaaaagggagaagaaattaggagagttcggaaaagcaaaaggatcgagagctatatggtacatgtggttaggggctagatttttggaatttgaggcgttaggattcatgaatgaagaccactggttctcaagagagaactcattatcgggagtcgaaggagaagggcttcacaagctgggctatattcttagagatataagtaaaatacccggtggtaatatgtatgctgacgataccgccggatgggataccagaattacagaagacgatctgcaaaatgaagcgaaaattacagacataatggagccagagcatgcattacttgcgaaaagtatatttaagctcacataccagaataaagttgtcagagttcaaaggccggctaaaaacggtaccgttatggatgtaatcagcagacgtgatcagaggggctctggccaagttggaacctatggcttaaatacatttacgaacatggaagcacaattaattcgacagatggaaagtgaaggaatattcttaccgaatgaactagaaacacctaacctagccggacgagttttagactggttagaaaaatatggagtggaacggttaaaaaggatggctatatcaggagatgactgtgtcgtgaagcctatagacgatagatttgctacagcattaacagccctaaatgatatgggaaaagtaagaaaagacatcccacaatgggaaccaagtaagggttggaatgactggcaacaagtacctttttgcagccatcattttcatcagctcattatgaaagacggaagagagatcgttgttccatgtcgaaaccaagatgaattagtaggtagagcaagagtttcccaaggcgcaggctggtcgcttcgagaaactgcttgcttaggaaaatcatatgcccaaatgtggcaactaatgtattttcatcgcagggacttaagactcgctgcaaacgctatatgttccgcagttcctgttgactgggtcccaacaagtagaacaacgtggtcgatccatgcgcatcatcaatggatgaccacagaagatatgctatcggtctggaatcgagtgtggattgaagagaatccctggatggaagacaagacacgtatttctagctgggaagatgtaccatatctgggaaaaagagaagatcaatggtgtggcagcttaatcggattaactgcaagagcaacatgggccacaaatattcaggttgctataaaccaagtgaggagattaattggcaatgaaaattacagtgattacatgaccagtatgaagcgattcaaaaatgagtcagaaccagagggagctttatggtaa

SEQ ID NO: 21915 - RNA, 9879 nt, synthetic construct
  misc_feature 1..9879: note = derived and/or modified CDS sequence (opt6) from DENV-1__EU482812__SS-prME
  source 1..9879: mol_type = other RNA
tcggtgacgatgctactaatgcttatgccaacggcacttgcttttcatttaacaacacgtggaggggagccacatatgatagtaagcaaacaagagcgtgggaaatctttactatttaaaacatcggcaggcgtaaatatgtgcactttaatagcaatggatcttggggaattatgtgaagatacaatgacatataaatgcccaagaatcacagaaacggaaccagatgacgtggattgctggtgtaatgcaacagacacatgggtgacatatggaacatgttctcaaactggagaacatagaagagataaaagatcggtagccctagctcctcatgtagggctaggactagaaactcgaacagaaacgtggatgtcctctgaaggagcatggaaacaaattcaacgggttgaaacttgggcactccgacacccaggatttacagtgattgccttatttttagcccacgcaattgggacatctattacacagaaaggcataatttttattttgcttatgctagtaacaccaagtatggctatgagatgcgttggaatcggaagtcgagactttgtcgaaggactatcaggagcaacttgggtagatgtagtacttgaacatggcagttgtgttactacaatggcaaaggataaacccactctagacattgaacttcttaaaactgaggttaccaacccggctgtgctaagaaagctatgcatcgaagcgaaaataagtaatacaactacagactcaagatgtccaactcaaggagaagctactcttgtagaggaacaagacgcaaattttgtttgtagaaggacgtttgtagatcgtggctggggaaacggctgcggcttgtttggtaaaggatctctaattacatgcgcgaaatttaagtgtgtaaccaagctggaagggaagattgttcagtacgagaacttaaagtattcagtaattgttacggtgcatactggagatcaacaccaagtagggaatgaaagtacagaacatggtactacagctacaattacaccgcaggctccgacgacagagatacaactcacagattacggagcattaactcttgattgtagtccgagaactggtctcgacttcaacgagatggtcttattaactatgaaagagaaaagttggcttgtacacaagcaatggtttttggacctccctttaccatggacttcaggagcctctaccagtcaggaaacatggaacaggcaagacctattagttacatttaagaccgcccatgcaaagaagcaagaagttgtagtactaggatcacaagaaggtgctatgcacactgcactgacaggagcgacggaaatacagacaagtggtaccacgaccattttcgccgggcatcttaaatgtcggttaaaaatggataaattaacactaaaaggtatgagctatgttatgtgcacaggatcgttcaaattggaaaaggaggtagctgaaacgcaacatggtacagtgttagtgcaaattaaatacgaaggaactgatgcaccatgtaaaataccattcagcacgcaagatgagaaaggagctactcaaaacggaaggttgataacagcaaatccgatagtaaccgataaagaaaaaccagtgaatatagaagccgaaccacctttcggcgaatcctacatcgttataggagcaggagaaaaagcgctgaaacttagctggtttaagaaaggttcaagcataggaaagatgtttgaagccacagcaaggggagctcgtagaatggctatattaggagacacagcatgggactttggcagtataggaggtgtgtttacgagtgtcggaaaattagtacatcaaatatttgggaccgcctatggagtactattctctggtgtgtcatggacaatgaagataggaataggggttctactaacatggctcggattgaatagtcgcagcacctcactaagtatgacttgtattgcggtaggattagttacattatatttaggtgtgatggttcaagcggattctggttgtgtaattaattggaaaggaagagagttaaaatgcggatcggggatattcgtgaccaacgaggtgcacacctggaccgagcaatacaaattccaggctgattcaccaaagagactgagcgcggcgatagggaaggcatgggaggaaggggtctgcggaataaggagcgcaacgagactcgagaacataatgtggaagcaaatatccaacgagctcaatcatatcctgttagaaaatgacatgaaattcactgtggtggtaggagacgttgcaggaatacttgcacaaggcaagaaaatgattcgtccacaaccaatggaatacaaatatagttggaaatcatggggaaaagctaaaataattggtgcagatgtacagaacactacgttcattattgatggacctaacacaccagaatgtccagacgaccaacgggcctggaacatttgggaagttgaagattacggatttggaatttttaccacaaatatctggctaaagctaagagattcatatacacaggtatgtgaccataggcttatgtcggccgcaataaaagattcgaaggccgtacatgcagacatggggtattggattgaaagtgagaagaatgaaacatggaaactagcaagagccagttttatagaagtaaagacgtgcatatggcccaaatcgcacacactttggtctaacggtgtattagaaagtgaaatgataatacctaaaatttacggaggaccgattagtcaacataattatagaccggggtattttactcaaacagcaggcccatggcatttagggaaattagagctagatttcgatctttgtgaagggacgacagtcgtagtggacgaacactgtggtaatcgagggccatcattaagaaccactacagtgacaggaaaaataattcatgaatggtgctgcagaagctgtacattaccaccactcaggttccgcggtgaagatggatgttggtatggaatggaaattagaccagtaaaagaaaaagaggaaaatttagtaaagtcgatggtgtcagctgggagtggagaagttgatagtttttcgctcggcctgttatgtatcagcatcatgatagaagaagtgatgagatcaagatggtcacgaaaaatgttaatgacaggcacgctagcagtcttctttttactcataatgggacagttgacatggaacgatttaattagactgtgtataatggtgggagctaacgcgtcagacagaatgggaatggggactacatacttggctcttatggcaacattcaagatgagacccatgttcgcggtaggtttattatttcgacgcttaacctccagggaagtacttcttctaactatcggtctgagtttagtcgcatcagtcgaactacccaatagtctagaagaacttggcgacggactcgcaatgggaataatgatcttgaagctcctaacggatttccaatctcaccaactatgggcaactctactaagtctaaccttcattaaaaccacatttagccttcattatgcatggaaaacgatggcgatggtactaagcattgttagcttattcccactatgtctaagtacaaccagccagaaaacgacatggcttcctgtgttgttaggatcacttggctgcaaaccattaacaatgtttcttatcgctgaaaataagatatggggccgtagaagctggccgttgaatgaagggataatggctgttggaattgtgtctatattactaagctcattgctgaaaaatgacgtcccactggcaggtcctttaatcgcaggaggtatgttaatcgcttgttatgtaatttctggatctagtgcagatctcagtctcgagaaggcagcagaagtgtcatgggaagaagaggcagagcattccggggctagtcataatattcttgtagaagtgcaagatgatggaacaatgaaaataaaagacgaagaacgggacgatacattaactattctgttaaaagcgacgttgttagcagtatctggagtctatcccttatcgattccggcaactcttttcgtttggtatttttggcaaaagaagaaacaacggtccggagtattgtgggatacaccgagtccgccagaggttgaacgtgctgttttagatgatggcatttatcgaataatgcagagagggctattaggaagatcacaagtgggagtgggcgtctttcaggaaaacgtattccatacaatgtggcacgttacgcggggagcagtgttaatgtatcagggcaagagattagagccttcatgggcgtcggtgaagaaagacttgataagctacggaggaggctggcgcttacagggaagttggaatactggtgaagaggtccaggtaatagctgtcgaacccggtaaaaacccgaagaatgtacaaacagctcctggtacatttaaaaccccggaaggggaagtgggcgcaatagccctcgacttcaagcctggtacatcgggatccccaattgtcaaccgcgaagggaagattgtgggactctatggtaatggtgtggtaacaaccagcggtacatacgtttcggctattgcacaagccaaagcctcgcaagagggccctctccccgaaatcgaagacgaggtattccgcaagcggaatctaactatcatggatttacatccggggtcgggtaaaacgcgacgctacctcccagcaatcgtaagagaagcaataaaacggaaattacgtacattaatactagcgcccacgcgagtggtagcctccgaaatggctgaagcgctgaaaggaatgcccatacgataccaaactactgccgtaaaaagtgaacacactggaaaggagattgtagatttaatgtgccacgctacatttactatgagattactttcgcccgtaagggtcccaaattacaatatgataataatggacgaagcgcacttcacagacccctcttcgatagcagcaagaggatatatcagtactagggtaggtatgggtgaagcagccgccatctttatgaccgcaaccccacccggaagtgtagaagcatttccacaatcaaacgcggtaattcaagacgaagaaagagacattcctgaaagatcatggaatagcggatacgaatggataacggattttccaggtaagactgtgtggtttgtaccctcaattaagagcggcaacgacatagctaactgcctacgcaaaaatggtaaacgagtaattcagttgtcgcgtaaaacctttgatacagaataccagaaaactaaaaacaatgattgggattacgtagtcaccactgatatttcagaaatgggagcaaactttagggctgatagagttatagacccccgcagatgtctgaaaccggtaatactaaaggatggacccgagagagttatactagcaggtcccatgccagtaacggttgcttcggcagcacaaagaagaggcaggataggaagaaatcataacaaagagggtgatcaatatatctatatggggcaaccattgaacaatgatgaagaccatgcacactggaccgaagctaaaatgttattagacaacataaacactcccgaaggcataattcctgccttattcgagccagaaagagaaaagtctgcagctatcgacggggaatatagactacgtggagaagcaagaaaaacatttgtagagcttatgaggaggggtgatctaccagtatggttgtcatataaagttgcatccgagggattccaatactccgatcgtcgatggtgttttgatggagagaggaacaaccaagtgttagaagaaaatatggatgtggaaatatggacaaaagaaggggagcgtaaaaagctccggcctagatggttggatgcaagaacctattcagaccctcttgcactgcgtgaatttaaagaatttgcagcaggtagaagaagtgtcagtggagatcttatcctagaaatagggaaattaccccaacatctaacacaaagagcgcaaaatgcattagataatttagtcatgcttcataactccgagcaaggcggacgagcataccgacacgccatggaagaactcccagacacgatcgaaacactgatgttacttgcactaatagccgttttaaccggtggcgtgacattgttctttctgagtggaaggggtcttggtaaaacaagtattggactactgtgtgtaatggcttcatctgtattactttggatggcgtcagtagagcctcattggattgcggcatctataattctagagttctttttgatggttcttctaattccagaacctgatcgacaaagaacccctcaagacaaccaattggcatacgtagtaataggtctgctatttatgatattaacagtagcggctaatgaaatgggactgttagaaacaaccaaaaaggacctagggattggacatgtggccgtagaaaatcatcaccatgcggccatgttagacgtggacttacatcctgcatcagcttggactctttacgcagtcgcgacaacaattataaccccaatgatgcgccatacaatagaaaacaccacggcaaacatatccctaacagctatagctaaccaagcagcgattttgatgggattagacaaaggttggcccatctcgaaaatggatatcggagttccactcttagctttaggatgttattcgcaagttaatccgcttactttgacggctgccgtactaatgctggtcgcccactatgcaataattggaccaggactccaggctaaagcaacacgggaagcacagaaaaggactgcagcaggtataatgaagaaccctacagtagatggaatagttgccatagacctggacccggtcgtgtatgatgcaaaatttgagaaacagcttgggcagatcatgctcctgatactatgcaccagtcaaatacttcttatgagaacgacatgggctctatgtgaatcaataacattagctaccggtccccttactactctttgggagggttcaccaggcaaattctggaacaccacaattgcagtgtctatggcaaacatttttcgtgggtcttatctcgcgggggcaggactcgcctttagtttaatgaaatcattaggagggggaaggcggggcacaggtgctcagggcgaaactttaggggagaaatggaaacgccaactaaatcagttatcaaagtctgaatttaacacatataagcgaagcggaataatggaagtggataggtcagaagccaaagagggacttaaaaggggagagacaacaaaacacgcagtaagtaggggtaccgcaaaactacgttggttcgtagaaaggaatctagttaaaccagaaggtaaagtaattgacttgggctgtggaaggggtggatggtcgtactattgtgcaggcctaaagaaggtaactgaagtcaagggatacactaaaggaggcccaggtcacgaagaacccataccaatggctacatacggttggaacctggtaaaattacattcaggaaaagatgtattcttcataccgccggaaaaatgtgacacattactatgtgatattggagaaagctcaccgaatccgactatcgaagaaggtcgaaccttacgcgtactcaaaatggtagagccttggttaagaggaaatcaattttgtataaaaatactcaatccatatatgccttcggtcgttgaaacattagaacaaatgcagaggaaacatggtggaatgttggttagaaatccactcagcagaaacagtacgcatgaaatgtactgggtaagttgtggaacgggaaatatagtatcagcggtaaatatgacatccagaatgctactcaatagatttacgatggcccacaggaaaccgacatacgaaagagacgtagatttgggagcaggtacccggcacgttgctgtcgaacctgaagtcgccaatcttgatattataggacaaagaattgaaaatatcaaacacgaacataaatcaacatggcactatgatgaagacaacccatacaagacttgggcttatcacggaagctatgaggttaagccatctgggtctgcgagcagtatggttaatggtgtagttaaactactcacgaagccctgggacgtgattccaatggtgacacaaatagctatgacagatacgacgccatttggtcaacaacgggtcttcaaggaaaaagtcgacactagaacacctaaggcaaaacggggcacagctcagataatggaagtcacagcgaaatggctctggggatttctcagtcgtaacaagaaacctagaatatgcacccgcgaagaatttactagaaaggtaaggagtaatgctgcaataggcgcagttttcgtggatgaaaaccaatggaactccgcgaaagaagccgttgaagatgaaagattttgggaccttgtccacagagaaagggagttacacaaacagggtaaatgtgctacatgtgtatataatatgatgggaaagagagagaagaaacttggagagtttggaaaagcgaaaggatcaagagctatatggtacatgtggttaggagcacgtttcctcgaatttgaagcgcttggatttatgaacgaggatcactggtttagtagggaaaattcacttagcggagtagaaggagaaggcctccataagttagggtacattcttagggatatctcaaagatcccagggggtaatatgtatgcagacgacacggctggatgggatacaaggataacagaagatgatcttcaaaatgaagcacgcattaccgatataatggaacctgaacacgcgctactcgccaaaagtatattcaaacttacataccaaaataaggtggtaagagtccaacgaccagccaaaaatggtacagtgatggatgtaatatctaggcgagatcagcgaggtagtggccaagtgggaacgtatggactgaacacatttaccaatatggaagctcaactaatccgacaaatggaatcggaaggaatattttcaccgtcggaattggaaacccctaacttagcagaaagggttcttgattggttagaaaaatatggtgtcgaaaggttaaaacgcatggctattagtggagatgattgcgtagtaaagccgattgatgatagattcgcgaccgcgcttactgcactaaatgacatgggaaaggtaaggaaagacatccctcagtgggaaccctcaaagggttggaatgactggcaacaagttccattctgctctcaccattttcatcaactaataatgaaagatggaagagaaatagtagtgccatgtcgaaatcaagatgaactcgttggccgagctcgcgtatcacaaggagcaggatggtcattacgagagacggcatgtcttggtaaatcatatgcacaaatgtggcaactgatgtactttcaccgaagagacctccgacttgcagcaaatgcgatatgctcagccgttccagttgattggatcccaacaagtaggactacatggtcgatccatgcacaccatcagtggatgacaacagaagatatgttaagcgtgtggaatagagtatggatagaagaaaatccttggatggaagataaaacccacataagttcctggggtgatgtaccctacctaggtaaaagagaagatcaatggtgtggtagcctcataggactaacggcgagagcaacttgggcgactaatatacaagtagctataaatcaggtacgtcggctcattgggaacgaaaactatctcgactacatgacgtcgatgaaacgatttaaaaatgaaagtgatcctgaaggtgcgctgtggtga

SEQ ID NO: 21916 - RNA, 9879 nt, synthetic construct
  misc_feature 1..9879: note = derived and/or modified CDS sequence (opt6) from DENV-1__EU482813__SS-prME
  source 1..9879: mol_type = other RNA
tcggttaccatgctcttgatgttgatgcctacagccttagctttccatttaaccacacggggaggagaaccccatatgattgtttctaaacaagaacgaggaaaatcattactatttaagacaagtgcaggagtcaatatgtgtaccctcattgcgatggatctcggggaattttgtgaagatacaatgacatataaatgtccacggattactgaagcggaaccagacgatgtggattgctggtgcaacgccacggatacgtgggtaacctatggaacatgctcgcaaacaggtgaacataggcgcgataaaagaagtgttgcgttggcaccccacgtgggattaggactagagactagaacagaaacctggatgagcagtgagggggcatggaagcaaatccaaagagtggaaacctgggcgctaagacatccaggttttacggtgatagctttattcctcgcccacgctatagggacatctattacccaaaaggggatcatcttcattttactaatgttagtgactccgtctatggcaatgagatgtgtggggatcggctcgcgagacttcgtggaaggtttaagtggtgctacgtgggtagatgtagtacttgagcatggatcgtgtgtgactactatggctaaagataaaccgactctcgatattgagctactaaaaacagaggtaacgaatcctgcggtcctgagaaaattgtgtattgaagccaagatttcgaatacaacaacagacagccgatgtccgacccaaggcgaagcaactttggtcgaggaacaagatgcaaattttgtttgccgacggacatttgtcgatcggggctggggaaacggatgtggattattcggcaagggtagtttaattacttgcgccaagtttaaatgcgtaacaaagttagaaggtaaaactgtgcaatatgagaatctcaaatatagtgtcatagttaccgttcatacgggcgatcagcatcaggtaggtaatgaatcgacagaacatggaacaacggcaaccattacaccccaagcccccagtactgaaattcagctgacagattatggtgcacttacactggactgttcaccaagaactggattggatttcaacgaaatggttttattaactatgaaggagaaaagttggctagtacataaacaatggttcttggatctgccgttaccatggacatccggagcgtctacatcgcaagagacgtggaacagaaaggatttacttgtgacttttaagacggctcatgccaagaaacaagaagtagtcgtattgggaagccaagagggtgcaatgcacactgcattaacaggagcaactgaaatacaaacctctggtacaactactatatttgcaggacacttaaagtgtcgtctcaagatggataaattgactctcaaaggcatgtcttatgtcatgtgcacgggtagctttaagctggaaaaggaagtagccgagacgcaacacggaacagttttagtacaaattaaatacgaggggacggatgccccatgtaaaattccattttctacccaagatgaaaaaggggttacgcaaaacggacgcttaataactgcaaacccaatagtgacagataaggagaaaccggtaaacattgaagcagaaccgccgttcggagaaagttacatagtaataggcgctggagaagaagctcttaaactatcctggtttaagaaaggcagttccatcggtaaaatgtttgaagctacagcaagaggagcacgacgaatggcgatactaggtgatacagcctgggattttggcagcataggcggtgtatttacatctgttggcaaacttgtccaccaaatttttggaacagcatatggagttctctttagtggtgtcagttggaccatgaaaataggtataggtgtactactaacgtggttaggacttaatagcagatccacatctttatccatgacatgtatcgcagtgggcttagtcacactatacttaggtgtaatggtccaagcggattcgggttgtgttataaattggaagggacgcgaattaaagtgcggcagcggaattttcgtcacaaacgaagtccatacctggacggagcaatataagttccaagctgatagtcctaagagactctccgctgcaattgggaaggcatgggaggagggagtgtgtggaataagaagcgccacacgcctagaaaacattatgtggaaacaaatctcaaacgagttgaaccatattttactagaaaatgacatgaaatttacggttgtcgttggtgatgtagcaggaatactagcccaaggcaagaaaatgataagaccacaaccaatggaatacaaatacagctggaaatcttggggtaaagcaaagataattggggcggatgtacaaaatactacatttataattgacggacccaatacgccggaatgtccagacgatcaacgagcatggaatatatgggaggtagaagattatggatttgggatatttacaactaatatatggttaaaacttagagattcatatacccaagtttgtgatcacagactaatgtcagctgccataaaggatagtaaagctgtccacgctgacatgggttattggatagaatctgagaaaaatgagacatggaaattagccagagcaagttttattgaggttaaaacatgtatatggccaaaatcgcacactctttggagtaatggcgttctagagagtgaaatgattattccaaaaatttacggaggcccaatcagccaacataactacagaccggggtattttacccagactgcaggaccttggcatttaggtaaattagaattagactttgatctatgcgaggggactaccgtcgtggttgacgagcactgcggcaatcgaggaccaagtttaagaacaactacagtaaccggaaaaatcatacatgagtggtgctgcagatcgtgcaccctgccaccactacgattcaaaggcgaggatggatgctggtatggaatggaaataagacctgtcaaggaaaaagaagaaaatctagtaaaaagtatggtatcagctggatccggagaggtagattccttcagtctcggactcttatgtatatcaattatgatcgaggaagtaatgcggtcaagatggtcaaggaaaatgttaatgaccggaacattagcagttttctttttacttataatgggccaattaacttggaacgacttaattcgattatgcattatggtcggtgcgaatgcttcagatagaatgggaatgggcacaacctaccttgcactcatggcaacttttaagatgagaccaatgtttgctgttgggcttctgttcagaaggctcacaagccgtgaggttttattactaaccatcggacttagtcttgtcgcgtctgtcgaattgcctaattctctcgaggagcttggcgatggccttgctatggggataatgattttgaaacttttaacagattttcaaagccaccaactttgggcaaccctattgtccctaacttttattaaaacaacattctcactacattatgcgtggaaaacaatggcaatggtactgagcatagttagtctgtttccgttatgtctaagtacaacatcgcagaaaaccacatggctaccagttctattaggcagtttaggatgtaagccacttaccatgtttttaatagctgaaaataaaatctggggacgaaaaagctggcctctgaatgaaggaataatggccgtcggaattgtgagtatattgctctcttcattattgaaaaatgatgttcctctcgcagggccattaattgcaggagggatgcttatcgcatgctatgttatttctggaagttcagcggacttaagcctagagaaagctgcagaagtcagttgggaagaagaagcggaacactctggagcatcgcacaacattcttgtggaggtgcaggatgatggcactatgaagattaaagacgaagagagagatgatacactaacgatattgcttaaggctaccctattagcggtatcaggagtttacccgctaagtatacccgcaacattatttgtatggtatttctggcagaagaagaaacaaagaagtggagtactctgggacacaccgtctccgccggaagtagaaagggcagtgttagacgacggaatttacaggataatgcaaagagggctcttaggcagatcgcaagttggagttggggtgtttcaagaaaacgtctttcatacaatgtggcatgtcacaagaggggcggttttaatgtatcaaggaaaaagattagagccaagttgggcatccgtcaagaaagatttgatatcatatggaggaggatggcgccttcagggaagttggaatacaggagaagaagttcaagtgatagcagtggaaccaggaaagaatccgaaaaacgttcaaacagcaccaggtacctttaagacgtcagagggcgaggtaggtgctatcgccctagattttaaacctggaacttccggatcccctatagttaatagagagggcaaaatcgtaggactatatggtaatggtgtagttactacatcaggtacctacgtttctgcaatagcccaggcaaaagcatcgcaagaaggtccattaccagaaatagaagatgaagtatttagaaaaagaaatttaacgataatggatctccatccgggcagtgggaagactcgcagatacctaccggcaattgtgcgtgaagcaataaagagaaaacttcgaactttaattctagcacctacaagggttgtcgctagcgaaatggccgaagcattaaaagggatgccgataaggtatcaaacaaccgcggtgaaatccgaacacacaggaaaggaaattgttgatttgatgtgtcatgctacttttacgatgcgtcttctttcacccgttcgtgtcccgaactataacatgataattatggatgaagcgcatttcactgaccctagtagtatagcagctcgaggctatatctcaacacgagtaggaatgggagaagccgctgcaatatttatgacagcaacaccgcctggtagtgtagaggcttttccccaatctaatgcggttatacaagatgaggaacgagacatacctgaaagaagctggaatagcggatatgaatggataacagactttcctggtaagactgtatggtttgtaccttccataaagtcaggcaatgatattgcaaactgcctaaggaaaaacggaaaacgagtaatacaactatcgaggaaaacgtttgacactgagtatcagaagaccaaaaataacgactgggactatgtagtaacgacggatatttcggagatgggtgctaattttcgtgcagatagagttatagatcctagaagatgtttaaaaccggtgatactaaaggacggaccggaacgagtgatattagcaggacctatgccggtgactgtcgcaagcgcagcgcaaaggcgaggcaggattggacgaaatcataacaaagaaggagatcagtacatctatatgggccaaccactgaacaatgatgaggatcatgcacattggaccgaagccaagatgttactagataacataaacacgccagagggcattataccagcactttttgaaccagaacgagagaaatcagctgcaatagatggggaatatcgtctgcgaggagaagcgcggaaaacgtttgtcgaattgatgcgccgaggggacctcccggtttggcttagttacaaagtagcttctgagggattccagtattctgatcgtaggtggtgcttcgatggagaaagaaacaaccaagtattggaagaaaatatggatgtagaaatatggacaaaagaaggtgaaaggaaaaagctacgaccgaggtggctcgacgctaggacctattcagatcccttagccttacgagagtttaaagaatttgccgcgggaagaagatcagtaagtggtgatcttatactagaaatcggaaagttacctcaacatttgacacaacgagcccaaaatgccctagataacctagtaatgctgcataattcggaacaaggtggacgtgcttatagacacgcaatggaagaacttcccgacacaatcgagactttaatgttactggcgttaatagcagtattaactggcggagtgaccctcttctttttatcagggagagggttaggcaaaacatcaatagggctattatgtgtcatggcttcctcggttctgctatggatggcatctgtcgagccccattggatcgcagcaagcatcatcttggagttctttttaatggtgcttcttataccggaacctgacagacaaaggacgccacaagataatcaattagcctacgtggttataggactgttgttcatgattcttacggtcgccgcaaacgaaatgggtctattagagacaaccaaaaaggatttaggaattgggcacgtagccgtcgaaaatcatcaccatgctgctatgttagatgttgatctgcacccagcgagtgcttggactttatacgccgttgcaacgaccataataacaccaatgatgagacataccattgagaacaccactgcaaatatatccctaacagcaatcgcaaatcaagcagctattttaatgggattagataaagggtggcctatatcaaaaatggatatcggcgttcctctgcttgcccttggctgttactcacaagtgaatccactcacgttgactgcggcggtactcatgctagtcgcacattatgcaattatagggcctggattgcaagcgaaagctactagagaagcacaaaaacgaactgcagctgggataatgaaaaatccgactgtagatggcattgtagccatcgacttagacccagtagtatatgatacaaagtttgaaaaacaattaggccagataatgttattgatattatgtacgtctcagattctactaatgagaactacgtgggcgctatgcgaatctataacactggcgacgggccctctaacaacgttgtgggaaggcagtccgggtaagttctggaacacgacaatcgcggtaagcatggcaaatatatttcggggctcgtatttagcgggagctggactagcattcagcctaatgaaaagtctagggggaggtaggcgcggcactggcgcacagggagagacattaggggagaaatggaaaagacaactcaatcagttatccaagagcgaatttaatacttataaaagatcaggtattatggaagtcgatcgttcagaggcaaaagaggggctaaagagaggagagacaacaaaacatgcagtaagtagagggacagcaaagttaaggtggttcgttgaaaggaatttagtaaaaccagaaggtaaagttatcgatttggggtgtggtcgaggaggttggagttattattgcgctgggctaaagaaagtcaccgaggtgaaggggtacacgaaagggggaccaggccatgaagaaccaattcctatggccacgtacggttggaatttggtgaagctgcactctggaaaggatgtatttttcataccacctgaaaaatgtgacacactattatgtgatatcggggaatcctcacctaaccctacaattgaagaaggtagaacactaagagtactgaagatggtagagccatggctacgaggaaatcaattttgtataaagatattaaatccttatatgccgagtgtagtggagacactagaacaaatgcaaaggaagcatggagggatgcttgtaagaaaccccctttcaagaaattcgacgcatgaaatgtattgggtgagttgtggtacagggaatatagtatcagcagttaatatgacatcaagaatgctattaaatcgctttacgatggcccacagaaaacccacatacgaaagagatgttgatttaggagcaggcacaagacatgtggctgtagagccagaagtagcaaatttagatatcataggccagcgtatagaaaacataaaacatgaacacaaaagtacttggcattatgacgaggataatccttacaaaacttgggcatatcatgggagttacgaagtaaagccatcaggatcagcatctagtatggtgaacggtgttgttaagctattaaccaagccatgggatgtaataccgatggtcacgcaaatagctatgacagatacgacgccatttggccaacaaagggtatttaaagaaaaagtcgacacgcgaacaccaaaagccaaaaggggaacagcacaaataatggaagttacagcaaaatggctttggggattcctgtcaagaaataagaaaccgaggatatgtacacgcgaagagttcacaaggaaagttaggtcaaatgcagcaataggcgcggttttcgtagatgaaaatcaatggaactctgcaaaagaagctgtagaagatgagagattctgggatttggtacaccgtgagcgggagctacataagcaagggaaatgcgcaacatgtgtatacaatatgatgggcaaacgcgaaaagaaattgggagaatttggtaaagcaaaggggagccgagcaatatggtatatgtggctaggagccagattcctcgaatttgaggcattggggtttatgaatgaagatcactggttcagcagagaaaactcattatcaggagttgaaggagagggattgcataaactaggctatatactacgtgacatatcgaagatcccaggtggtaatatgtacgccgacgacacggcaggctgggatacaagaataacggaagatgatttgcaaaacgaagcaaaaataacagatattatggaacctgaacatgcattattggcaaaatctatattcaaattaacttatcaaaataaggtcgtccgagtgcagcgtccagccaaaaacggaactgtcatggatgtaatatcgagacgtgatcaacgggggtctggacaggttggtacttacggcttaaacacatttacgaatatggaggcgcaactgattcgacaaatggaatccgagggcatattcagcccatcagaattggaaacaccaaatttagctggacgcgtactagattggttagaaaagcatggtgtagaaaggcttaaaaggatggccatttcaggcgacgactgtgttgtaaaacccattgatgatagatttgctacggctctaactgcgctgaatgatatgggaaaggtaagaaaagatatcccacaatgggaaccaagtaaaggatggaatgactggcaacaggtaccattctgctctcaccactttcatcagcttataatgaaagacggaagagagatcgtagttccatgcaggaatcaggatgaattagtggggagagcccgcgtcagccaaggagcaggatggtcattaagagagacagcctgtctgggaaaaagctatgcgcaaatgtggcaactaatgtactttcatagaagagatttaaggcttgctgccaatgcgatttgtagcgcagtaccagtagattgggtgccaactagcagaactacctggtcaatacatgcacaccaccaatggatgacaacagaagacatgctttcggtatggaatagagtttggatagaggaaaatccctggatggaggataaaacgcacatttcgagttggggagacgtgccatacttgggcaaaagagaagatcaatggtgtggatcattaattggattgaccgcccgagcaacttgggcaactaacatacaggtcgcaatcaaccaagtccgcagattgataggaaatgaaaattatttagattatatgacatcaatgaagagatttaaaaacgaatcagacccggaaggagcactatggtaa

SEQ ID NO: 21917 - RNA, 9879 nt, synthetic construct
  misc_feature 1..9879: note = derived and/or modified CDS sequence (opt6) from DENV-1__EU482814__SS-prME
  source 1..9879: mol_type = other RNA
tcagtaacaatgctcctaatgttaatgcctacagctttagcattccatctgacaactcgaggtggagaaccacatatgattgtttcaaaacaagaaaggggaaaatcactgttattcaaaacaagtgccggcgtaaacatgtgtacactaattgctatggacctaggcgaattttgtgaagatacaatgacttacaaatgtccacgaataactgaagcagagcctgacgatgtagattgttggtgtaatgctacagatacatgggttacatacggaacctgttcacagaccggcgaacatagacgtgacaagaggtcagttgcgctggctccacatgtgggttttggactagagacccgtactgaaacttggatgtcaagcgaaggcgcttggaaacaaatccaaagggtggagacttgggcgttacgtcatccgggattcactgtaatcgccttattcctcgcacacgctattggaacatccattacacaaaaaggaattatatttatcttactcatgctggtaacgccttccatggcgatgagatgtgtgggaataggatcccgagactttgtggaaggtctatccggggccacatgggtagacgtagttttagaacacggctcttgtgttacgacaatggcgaaggataaacctacattagacatagaattacttaagacggaagtcaccaacccagcagttctaagaaaattgtgcatcgaagccaaaatttcaaacacgacaactgattcaagatgtccaacacagggtgaagctactcttgtcgaagagcaagatgccaattttgtgtgtagacgaacttttgtagaccgtggttgggggaatgggtgtggattgtttgggaagggctcattaattacctgtgcgaagtttaagtgcgtcacgaagcttgaagggaagacagtacaatacgagaacctaaagtattcggttatcgtaacagtccatacgggtgaccaacatcaagtgggaaatgaatctaccgagcacggaactacagcaaccattaccccccaagctccctctaccgaaatacagctaaccgattacggcgcattgacattagactgttcaccacgaacgggtttggatttcaatgagatggtattgttaacgatgaaggagaagagctggttggttcacaaacaatggtttttagatctgccattgccatggactagtggtgcgagtacatcccaggaaacttggaatcggaaagacctattagtcacatttaaaactgcccatgcgaagaaacaagaggtggtagtgttaggatctcaggaaggagcaatgcataccgctctgactggggctacggaaatccaaacaagtggaacgactacaatttttgctggacaccttaaatgtagattaaaaatggacaaactaactttgaaaggcatgtcatacgtaatgtgcaccggatcatttaaattagaaaaagaagtggcagaaacacaacatggtacagtacttgtgcaaattaaatacgagggaacagacgcaccctgtaaaattcctttttcaacgcaagatgaaaaaggagttactcaaaatggccgtctaattacagcaaatcctattgtaacggataaggaaaaaccggttaacattgaagctgagcctccttttggtgaatcatatatagtcattggtgcaggagaaaaagcgttaaagctaagctggttcaaaaaaggcagcagtataggcaagatgttcgaagcaacggctagaggcgctcgtaggatggcgatactgggagataccgcttgggactttggatcaatcggtggggtatttaccagtgtcggtaagttagttcaccaaatttttggaacagcgtacggagtcttattctcaggagtatcatggacaatgaaaatcggaattggcgtgctcctaacatggcttggattaaattcccgatcgacctcgctaagtatgacctgtatcgccgtaggtctggtaacactttatctgggggtaatggttcaggcggattcaggttgtgtaattaactggaaagggcgcgaattaaaatgcggttctggcatattcgttactaatgaagtgcatacttggacagaacaatataaattccaagctgactcacccaaacgactatcagcagcaattggaaaagcgtgggaggaaggagtctgtggcatacgttcggcaactcgtcttgaaaacataatgtggaaacaaataagtaatgagttgaaccatatacttctcgaaaacgatatgaagttcacagtagttgtcggcgatgttgcgggtatactagcgcaaggaaaaaaaatgattagaccacaaccaatggaatataaatatagttggaaatcatgggggaaagcaaagataatcggcgcagatgtacagaatactacctttataatagacggaccgaatacacccgagtgcccagatgaccagagagcctggaatatatgggaagtggaagactacggtttcggcatttttacaactaatatttggctaaaacttagagactcgtatacgcaggtatgcgaccatcgattaatgagcgctgcgatcaaagatagtaaagctgtccatgcagacatgggttattggatcgaaagcgaaaaaaacgaaacgtggaaactcgctcgtgcgagttttatagaagtaaaaacatgtatatggccaaagtcccacacactatggtcaaatggagtattagaatcagaaatgatcatacccaaaatttacgggggacccatatcacaacacaactataggccgggatatttcacccaaacagctggcccatggcatctgggaaagttagaattagatttcgatttatgcgaaggaacaacggtcgtagtcgacgaacactgtgggaataggggaccatcccttaggactaccaccgttacgggaaaaattatccatgaatggtgctgcagatcatgtacgctaccacctctaagatttaaaggcgaagatggatgttggtacggtatggaaataagacccgtaaaagagaaggaagaaaatctcgtaaaaagtatggtctcagccggtagcggagaggtcgactcatttagccttggccttttatgcatttcaattatgatcgaagaagtgatgcgttcgaggtggtcaagaaaaatgcttatgacgggaacactcgcagtgttttttttgttgatcatggggcaactcacatggaacgatctaattagactttgcataatggtcggagccaatgcgagtgatagaatggggatgggtacaacatatctcgcattaatggcaacattcaagatgcgaccaatgtttgcagtaggattactgttcaggcgtttaacttcgcgagaggtactattactcaccattggcctatcattagtggcatccgtggaattaccgaactcattggaagaactgggtgatgggctggcaatgggcatcatgatccttaaattgcttactgatttccaatcgcatcaattatgggccaccttgttatcgctgacatttattaaaacaacattcagtctacattatgcatggaaaactatggcaatggttttaagcatcgtaagtttatttcctttatgcctctccactacctcacaaaaaacaacttggctccctgtgttattagggtcgctcggatgcaaaccactaactatgttcctgattgctgaaaacaaaatatggggtagaaaaagttggcctttaaatgaagggattatggcagtaggaatagtgtcaattcttctctcatcactgttaaaaaacgatgtgccgttagccgggcctttgatagccggtggtatgttaatagcgtgttacgttattagtggcagttctgcagatttgtcactggagaaagcagcggaagtaagttgggaggaagaagccgaacatagtggcgccagccataatatacttgtagaagtccaagacgacggaactatgaaaatcaaagatgaagagagagacgatacattaacaatcttattaaaagcgacattattagcggtaagcggtgtttatccactctcgattcccgcaaccctttttgtatggtacttctggcaaaaaaaaaaacaaaggtcaggtgtactttgggacaccccttcgcctcccgaagtcgaaagagcagtattagacgacggaatatatagaattatgcaaagagggctattaggacggtcgcaagtgggagtaggagtcttccaagaaaatgtatttcatactatgtggcatgtaacaagaggcgctgttttaatgtatcagggaaaaagattggagccaagttgggcctcggtcaaaaaagatttaatttcatatggaggaggttggagactgcaaggatcttggaatacaggggaggaagtacaagtcatcgccgttgagcctggaaaaaacccaaagaatgttcaaaccgcgcccgggacatttaaaacatccgaaggggaagttggcgcaattgctttagactttaaaccaggtaccagtggatcaccaattgttaatcgggaaggcaaaatagtaggcctctatggtaatggagtggtaaccacctcaggaacctatgtatccgcgatagcccaagcaaaagcttctcaagaaggccctctaccagaaatagaagatgaagtctttagaaaaagaaacctaactataatggatttacaccctgggagtggaaaaaccagacgatatttaccagccatcgttcgagaggccataaaaaggaaattacgaacattaatactcgcccctacacgtgttgttgctagtgaaatggcagaagcactaaaagggatgcctatcaggtaccagaccaccgctgtaaaatccgaacatactggtaaagaaatagtcgatctaatgtgccacgcaacgtttacgatgcgactgttatccccagtgagggtccccaattacaacatgatcattatggacgaagcacactttaccgatccatcttcaatcgcagcacgagggtatatatccacacgagtaggaatgggagaagctgctgcaatatttatgaccgcaacaccaccaggatcagtcgaggcattcccacagtcaaacgcagtaattcaggatgaggaaagagatattccggaacgaagttggaactcaggatacgaatggattacggacttcccaggaaaaacagtatggttcgtccctagtataaagagcggaaatgatatcgctaattgtctaaggaagaatgggaaacgagtgattcaattgtcacgaaagacatttgatacagagtatcagaaaactaaaaacaatgattgggactacgttgtgacaacggatatatcagagatgggtgcgaactttagagctgatcgagtgatagatcccagacggtgcctcaagccggtcatattgaaagacggcccggagcgagttattttagcaggacctatgcctgttactgttgcttcagctgctcaaagaagaggcagaatcggtcgaaaccacaacaaggaaggggaccaatacatatacatgggtcaacccctgaataacgacgaagaccatgctcattggaccgaagcaaaaatgctactagacaacattaatacacctgaaggaattatcccggccttattcgaacccgagagggaaaaatcagctgccatagatggagagtatcggctaagaggtgaagcccgtaagacgttcgtagaactaatgagacgaggggatctacctgtctggctctcttacaaagtggctagtgaagggtttcagtatagtgatcgtcgttggtgtttcgatggagagcggaacaaccaggttttagaagaaaatatggacgtcgaaatctggactaaagaaggtgaacgtaaaaaactgaggccaaggtggctagacgctaggacttactcagatcccttagcactccgagaatttaaagaattcgcagcgggtcgtcggtccgtctctggtgatttaatactagaaattggaaaactacctcaacacttaactcaacgagcacaaaacgctttagacaatcttgtaatgctgcataacagtgagcagggcggcagagcatacagacacgccatggaagaattacccgatactatcgaaacattgatgctattagcattaatcgccgtcttgacgggaggcgttacactattctttttaagtggaagaggtcttggaaaaacttcgataggactattgtgtgtaatggcttcctcggttcttctatggatggcctctgtagaaccccactggatcgctgcttcaataatactagaatttttcctgatggtcttactaataccagagccggatcgccagcgaactccccaagataatcaattagcctacgtagtaatcggactactgttcatgatactaactgttgcagcaaacgagatgggtctattagaaacaactaaaaaggatcttgggataggtcatgtagcagtagaaaatcatcaccacgcagcaatgctggacgtcgacttacatccagcttcggcatggacgctatacgcagtcgctacgaccattataaccccaatgatgcgccatacaatagaaaatacgactgcaaatatcagtctcacagctatcgctaaccaagccgctattctaatgggcctggacaaggggtggcccatttctaagatggatataggtgttcccctactggccctaggatgttattcgcaagttaacccgctaactttgacagcggcggttctgatgctagtcgctcactatgctatcattggtcctggcctacaggcaaaagcaactagagaggcacaaaaacgaacggctgccggtataatgaaaaatcctaccgttgatggaattgttgctattgacctagaccctgtggtttatgatgctaagttcgagaaacaattgggacaaataatgttgcttatcctttgcacttcgcagatattattaatgaggactacttgggccctgtgtgaatcaataactcttgcaacaggtcctcttactacgttatgggagggatcacctggaaaattttggaatacaactatagcagtttcaatggctaacatttttcgggggagttatttggctggtgcaggtttagcattttctctaatgaaatcattaggaggaggacgaaggggtacaggagcacaaggagaaacattaggtgaaaaatggaaaaggcaattgaatcaactatcgaaaagtgaattcaatacgtataaaagaagtggaatcatggaagttgacagatcagaagcgaaggaaggtctcaaacgaggcgaaacaacaaagcacgccgtatcaagaggcaccgcaaaactaagatggttcgtagaaaggaatttagtaaaaccggaggggaaagttattgacctaggatgtggaagaggaggatggagttattactgtgcaggactcaaaaaagtaacagaagtgaaaggttatactaaaggtgggcctggacatgaagaacccatacctatggctacttacggttggaatttggtaaaacttcacagcggcaaagatgtctttttcattccaccagagaaatgtgatacattattgtgcgatatcggagaaagtagtccaaacccaacaattgaagaaggacgaacacttagagtcttaaaaatggtggaaccctggcttcgcggtaaccagttttgcattaaaattctcaatccatatatgccatctgtggtagagactttagagcaaatgcaacgcaaacacggtggtatgttagtacgtaacccacttagtcgtaactccacccacgaaatgtattgggtaagctgcggtacaggaaatatagtgtctgcagtaaatatgacttcgcgcatgctattaaaccgattcacgatggcgcatcgaaagcccacctacgagagagacgtagatctgggtgcaggcacaaggcatgttgcagttgaacctgaggtagccaatttagacatcataggacaaaggattgaaaatataaaacacgaacacaagtcaacatggcactatgatgaagacaacccatacaaaacttgggcttaccatggatcatatgaagttaaacctagcggatcagcatcaagtatggttaatggagtagtgaaattgctcactaaaccgtgggatgttatacccatggtcacacaaatagcaatgaccgatacgacaccattcggccaacagagggtattcaaagaaaaggtcgatacaagaacaccaaaagctaaaagaggaacggcccagataatggaggtaacagccaaatggctatggggctttctatctagaaacaaaaaacctcggatatgcaccagagaggaatttacccgtaaagtgcgttcaaacgcagcgataggtgcagtgtttgttgatgaaaatcagtggaattcagcaaaagaagccgtagaggacgagcgtttttgggatttagttcatagagaacgagaattacataaacaaggtaagtgcgccacctgtgtttacaacatgatggggaaaagagaaaaaaagctaggagagtttggcaaagcaaaagggtctcgtgcaatatggtatatgtggcttggagcaagattcctcgaatttgaggccctagggtttatgaacgaagatcattggttctcaagagaaaattccctgtctggcgtggaaggtgaaggattacataagttggggtacattttacgagacatttccaaaattccaggaggaaacatgtacgccgatgatacagctggttgggacactagaatcacagaggacgatctgcaaaacgaggcaaaaatcactgatataatggaacctgaacacgcactactagcaaaaagcattttcaagctaacctatcaaaacaaagtagttagggttcaacgcccagctaaaaatggtactgtgatggacgttatcagtagacgtgatcaaagaggatctggacaagtcggtacttacggtctaaacacattcacaaatatggaggctcaattgattaggcagatggaatcagaggggattttttctcccagcgagttagaaactcccaatttggccggacgtgtgctagactggctagaaaaacatggtgtagaaagattaaagagaatggcaatctctggagacgattgcgttgtaaagccaatagacgaccggttcgcaaccgcattgaccgcactaaacgatatgggaaaagtccgtaaagatatcccgcagtgggaacctagtaaaggttggaatgactggcaacaagtacccttttgttcgcatcacttccaccagttgataatgaaagatggtagagaaatagttgtcccatgcagaaatcaagatgaactagttggtcgagctagagtatctcaaggcgcaggttggagtttaagggaaactgcatgccttggaaaatcatatgcacaaatgtggcaacttatgtattttcaccgcagagatcttagactagctgctaatgcaatttgcagcgctgtgcctgtggactgggtcccaacgagtagaaccacatggtctatccatgcacatcaccagtggatgacaactgaagacatgctaagtgtctggaaccgggtctggatagaagaaaacccatggatggaagataaaactcatatttctagttggggtgatgtcccctacctagggaaaagggaagaccagtggtgtggctcactaataggactcacagctcgtgcaacgtgggcgacaaacatacaggtagctataaatcaagttaggagactgatagggaatgaaaattacctagattatatgacatcaatgaaacgatttaaaaatgaaagcgatccagagggggctttatggtag

SEQ ID NO: 21918 - RNA, 9879 nt, synthetic construct
  misc_feature 1..9879: note = derived and/or modified CDS sequence (opt6) from DENV-1__EU482815__SS-prME
  source 1..9879: mol_type = other RNA
tcggtgacaatgttgttaatgctaatgccagctgctctagcgtttcatttgacaacccgcggaggtgaaccacatatgatcgtatcaaaacaagaaagagggaaatcgttactatttaaaacttctgccggtgtgaacatgtgcaccttgatagctatggacttaggcgaattttgtgaagacacaatgacttacaaatgtccgagaattacggaagcagaaccagacgatgtcgactgttggtgtaacgcaaccgatacttgggtaacttatgggacctgcagtcaaactggcgaacatagaagagataaaagatctgttgctcttgcacctcacgtaggcctagggctagaaacaaggacagagacttggatgtcgagtgaaggtgcatggaagcagatacaaagagttgaaacgtgggcacttagacatccaggattcacagtaatagctctcttcctggcacacgcaattggcacctcaataacacaaaaaggaataatattcattttacttatgctagtcaccccatcgatggctatgagatgtgttggaataggcagtagagattttgtcgaagggttaagtggggcgacatgggtcgacgtagtactagagcatggaagttgtgttacaactatggctaaagataaaccgacactagatatagaactgctgaaaacagaagtgactaacccggcagtattacgaaaactttgtatagaagcaaaaatctcaaatacaacaacagactcaaggtgtcctacccaaggagaagcaaccttagtggaagaacaagacgcaaacttcgtatgtcgacgcactttcgtcgatcggggttggggtaatggatgtggactattcggaaaaggatcactgatcacatgtgcaaaattcaaatgcgtaacgaaacttgaggggaaaacagtacaatatgagaatttaaaatactctgtaactgtaactgtacacactggagaccaacatcaagtaggaaatgaaagcacagaacatgggactacagcgacgatcacaccacaagcaccatcgaccgaaatacaattaacagattatggtgcacttacactcgattgctcacctagaacgggattagacttcaatgaaatggttctgttgactatgaaagaaaaatcctggctggtacacaaacaatggtttctagatcttcccctaccttggacatcaggggcaagcacttcacaagaaacctggaaccgaaaagatctgctagttactttcaaaacggctcatgctaagaaacaagaggtagttgtcttaggaagtcaagaaggagccatgcatacagcattaacgggcgcaacagaaatacagacatcggggacaacaaccatttttgctggtcacttaaaatgtagactaaaaatggataaactcacattaaagggtatgagttatgtaatgtgtactggaagttttaaacttgaaaaggaagtagctgagacacaacacggtacggttctagtccagattaaatatgagggtactgatgcaccatgtaagataccgttctctactcaagacgaaaagggagtaacgcaaaatggacgactaataactgcaaacccaatagtcacagataaagagaaaccagtcaatatcgaagctgagcccccatttggggaatcatatattgtcatcggggctggagaaaaagctctaaaattaagttggtttaagaaaggttcttccatagggaaaatgtttgaagccacagcacgtggagccagaagaatggcaattttaggcgatactgcatgggatttcggcagtattggcggcgtatttacaagcgtaggaaagttagtacatcaaatctttggaacagcctacggcgtcttattttcaggagtttcgtggacaatgaagataggaataggagtgctactaacttggttaggactaaactcaagatcgacaagtttgagcatgacatgcatagcagtcggacttgtgactctttacctaggtgtcatggtgcaagctgacagtggttgtgttattaattggaaagggcgcgaattaaaatgtggcagcggaattttcgtaacaaacgaagtacatacctggacggaacaatacaaatttcaggcagatagtcctaagagattatctgctgcaatcggaaaagcatgggaagaaggagtatgtggaatacgaagtgcaaccagattagaaaatataatgtggaaacaaataagtaatgaactcaaccatatcttattagagaacgatatgaagttcaccgtagtcgttggagatgtcgcaggaatattagcacaggggaaaaagatgatacgtccccaaccaatggaatacaaatattcctggaagagttggggaaaagccaaaataataggagctgatgttcagaatacgactttcataatagatggaccaaatactccagagtgtccagatgaccagcgcgcatggaacatatgggaggtggaggattacggatttggaatctttaccacaaatatctggttgaagctcagggactcctatacgcaagtatgcgaccatagactgatgagtgctgctataaaagatagtaaggccgtacacgcagatatgggttactggattgaaagcgagaaaaatgaaacatggaaactcgctcgtgctagttttatagaagtaaaaacttgtatttggccaaagtctcacacgctgtggtcgaatggagtactggaatccgaaatgattataccaaaaatatacggcggcccgatcagtcaacacaattaccgaccgggatattttactcaaacagccggcccttggcaccttggaaagttagaattggactttgacctttgcgagggaacgacagtggtagtcgacgaacactgtgggaatagaggaccatcattgcgtactacaacagtcactggtaaaataatacatgaatggtgctgccgttcatgcacgttgcctcctctgaggttcaaaggagaagacggatgctggtacggaatggagatcaggccagtaaaagagaaagaagaaaacctcgtaaaatccatggtatctgcaggaagcggcgaggttgacagcttcagtctaggactattgtgtattagtattatgatcgaagaggtcatgagatccagatggtcacggaaaatgttaatgacaggcacattagcagtattcttccttctaataatgggacaattaacctggaatgaccttatcaggctgtgtataatggtaggtgcaaatgcaagtgacagaatggggatggggacaacttatttagcacttatggccacttttaaaatgcggccaatgtttgcagttggtcttctttttagacgactgaccagccgtgaagtcttattactaactataggcttgtccctagttgcaagcgtggaattacctaactcactggaggaattaggagatggactagccatgggcataatgatactcaaacttctgaccgacttccaaagccaccaattatgggcaacgttgctcagcttaacattcattaaaactacttttagcctccattacgcctggaaaacaatggcaatggtgctttcgatcgttagcctttttccgctatgcctatccacaacaagccagaaaacaacatggctgcccgtactgctcgggagcttaggatgcaaaccactaaccatgttcttcatcgccgagaataagatctggggaaggaagtcctggccactcaacgaagggataatggctgtcgggatagtcagtatattactttcatcactccttaaaaatgatgttccactagcgggaccattaatcgctggaggcatgcttattgcatgctatgtaataagcgggtcaagcgcagatttaagtctagaaaaagccgcagaagtgtcatgggaagaagaagcggaacatagcggcgcttcgcataacattcttgtcgaagtacaggacgacggaactatgaaaataaaggatgaagaaagggatgacacattgactatacttttgaaggcaaccctgctagccgtttcaggggtctacccacttagtataccagcaactcttttcgtatggtatttctggcagaagaagaaacaacgaagcggtgtgctctgggacactccgagccctccagaggttgaacgggcagtccttgacgatggaatttacagaattatgcaaaggggtcttctaggccgaagccaagtcggtgtaggggttttccaagaaaatgtcttccatactatgtggcacgttacaagaggtgctgtacttatgtaccaaggaaaaaggcttgaaccgtcatgggcaagtgtaaagaaagatcttatctcgtatggaggaggctggcgtttacaaggttcatggaatactggcgaagaagtacaagttatagcagtagagccagggaaaaaccctaaaaatgtccaaacagcaccaggaacattcaaaacatctgagggcgaggtcggagccattgcactagatttcaagcccggaacaagtggctcccctatcgtaaatagagaaggtaagatagtgggtctgtacggaaatggtgtagtaaccaccagtggcacctacgtaagcgctatagcacaagccaaagcaagccaggaaggtcccttaccagaaattgaagatgaagtattcagaaaacgtaatcttactataatggatttacatccggggagcggtaaaacaagacgttaccttcctgcaatagtaagggaggcaataaaacggaagttgcgaaccctaattttagcaccgacaagggtcgttgcttcagagatggccgaagccctaaaaggtatgcctattcgatatcagacaacggcagtaaaaagtgaacacacgggaaaagagatagttgatttaatgtgtcatgcaacatttacaatgagattattgagtcctgtcagggttcctaactacaatatgatcataatggacgaagcgcattttaccgacccaagctcaatagctgcacgtggatatatttcaacacgagtcggcatgggggaagcagccgcaatattcatgacagcaaccccacctggatcggtagaggcttttccacaaagtaacgccgtcatacaggatgaagaacgagacattcctgaacgtagttggaactcaggttatgaatggataactgattttccgggaaaaaccgtttggtttgtgccaagcataaaatcaggaaacgatatagccaattgtctcaggaaaaacggcaaacgtgtaattcagttaagtagaaaaacatttgatactgagtatcagaagacaaagaacaacgactgggattatgtcgttaccacggatatttcagaaatgggtgctaacttcagagccgacagagtaatagatccgcgtcgatgcctgaaaccagtaatactgaaagatggacccgaacgagtaatattagccgggccgatgccagtaacagtagcatcagcagcacaaagaagaggacgaataggtagaaatcacaacaaagagggggaccaatatatctatatgggacaaccgttgaataacgatgaagatcatgctcactggacagaagcgaaaatgctattggataacattaatacgccggagggaattatccctgcactttttgaacccgagagagagaaatccgcggcaatcgacggagagtacagacttcgaggagaggcccgaaagacattcgttgagcttatgcgacgtggtgacttgcccgtatggttgtcatacaaggtagcgtcagaagggtttcaatacagtgatagacgatggtgcttcgacggtgagaggaataatcaagtgctagaagaaaacatggatgtagaaatttggacaaaagaaggagaacgtaagaaactacgtccacgctggctagatgcaagaacatacagtgaccctcttgcactccgcgaatttaaagaatttgcagcaggacgacgttcggtatcaggagatttaattctggagattggtaaactgccccagcatcttactcaacgagcccaaaatgccctcgacaacttagtgatgctacacaattctgagcaaggaggacgagcatatcgtcatgctatggaagaattgccggatacaatagaaacattaatgttgttggcgttaatcgcagtccttacaggaggtgttacgctgttctttctatccggtcgcggtctaggaaagacaagcatagggttattatgtgtaatggcatcatcagcactattatggatggcttcagtagaaccacactggatagcagcctcaatcatcttggagttcttcctcatggttctactaatccccgaaccggataggcaaagaacaccccaagacaatcaacttgcttatgttgtgattgggctactattcatgatcctaaccgtcgcagcaaacgagatgggcctactagaaacaactaagaaagatttggggatcgggcatgtagcagtcgaaaatcatcatcatgctgcaatgttagacgtggatctacatccagcgagtgcctggaccctgtacgctgtggccacaacaataataacaccaatgatgagacatacaatcgaaaatactaccgcaaatatttctttgactgcaatcgctaatcaagcagcaatactaatgggcttagataagggttggcccataagtaagatggatatcggggtaccacttctggcattaggatgttacagtcaagtaaatcccttaacactaactgctgctgtactaatgttagtagcgcattacgcaataatcgggccagggttacaagctaaagcaacaagggaggctcagaaaagaactgctgcaggtataatgaaaaatcccacagttgatggtatagttgcgatagatctcgacccagtagtctatgatgctaaattcgagaagcaattgggtcaaataatgctccttattttgtgcaccagtcagatcttactcatgagaacgacatgggcactctgcgaatcgataactctggctacaggtccacttactaccctttgggaaggctcaccaggaaagttctggaacacgacaattgcagtaagtatggctaatattttcagaggttcctatttagctggggctgggttagcattctctctgatgaaatcgttaggaggagggaggaggggaactggggctcagggagagactcttggtgaaaaatggaaacgacagttaaatcaattatctaaaagcgaatttaacacttacaaacgtagtggtataatggaagtggatagaagtgaagctaaggagggtcttaaaagaggagaaactacaaagcacgcagtatcgaggggaacggcaaaattgagatggttcgtagaaagaaacttagtcaaaccggagggaaaagttatcgacttgggatgcgggagaggcggctggagttattactgcgcgggactcaagaaagtgaccgaggtaaaaggatataccaaaggcggtccaggtcatgaagaacccataccaatggccacttacggatggaacttggttaaacttcactctggaaaagatgtattctttataccaccagaaaaatgcgatacgttattatgtgacattggggaatcaagtcctaatccaacgatagaggaaggacgcacattaagggttctgaaaatggttgaaccttggttacgagggaaccaattttgtattaaaatattaaatccgtatatgccctccgttgtggaaacattagaacaaatgcaacgaaagcacggtggtatgctagttagaaacccattaagtcgaaactcaactcatgaaatgtattgggttagctgtggaaccggaaatatagtaagtgcagttaatatgacctcacgcatgctattaaataggtttaccatggcacaccgcaagcccacatatgaacgagacgtagaccttggagctggtacaagacatgtggcagtcgaacccgaagttgcaaatctggatatcataggccaaagaattgaaaacattaagcacgagcacaaatcaacctggcactatgatgaagacaacccctacaagacgtgggcttatcatggtagctatgaagtaaaaccctctggttccgcatcaagtatggttaacggagtagtcaaactgcttacaaagccttgggatgttataccaatggttactcaaatcgccatgacggacacgaccccatttggacaacaaagagtatttaaagaaaaggttgatacaagaaccccgaaagcaaaaagaggaacggctcaaataatggaagttaccgcgaaatggctgtggggatttctgagtcgaaataaaaagccacgtatatgcacacgcgaagaatttacgagaaaagtgagaagtaacgcagcaatcggcgcagtatttgtcgacgaaaatcaatggaactctgcaaaagaggcagtggaagacgaaaggttttgggatttggtacatcgcgaacgtgaattacacaaacaagggaaatgtgctacttgtgtttacaatatgatgggcaaaagagagaagaaattaggagagttcggaaaagccaagggttcaagagcgatctggtacatgtggttaggtgcacgattcctggagttcgaagcactcggttttatgaacgaagatcattggttttccagagaaaactcactaagcggagtagaaggagaaggcctacacaaactaggatatattctgcgagatataagtaaaatccccggcggcaacatgtacgcagatgacactgcgggctgggacactaggataacagaggatgatctgcaaaatgaggcaaaaattaccgacatcatggagccagagcatgcacttctggcaaaaagtatattcaaactgacttatcaaaataaagtagtaagggtacaaagacccgccaaaaacggtactgtgatggatgtaatttctcgtagagaccaaagaggaagtggacaagtagggacttatggactgaacacctttacaaatatggaagctcaattaataagacaaatggagagcgaaggaatcttctcaccatcagaattagaaacaccgaacctggctggaagagtccttgactggttagaaaaacacggggtagagagactgaaaaggatggccataagcggcgatgattgtgtagtaaaaccaatcgacgatagatttgcaacagctcttacagctctgaacgatatgggcaaagtacgaaaagatattcctcaatgggaaccgtcaaagggatggaatgactggcaacaggtgccattttgtagccaccactttcatcagttaatcatgaaagatggacgtgaaatcgtcgtcccttgcaggaatcaagacgaacttgttggcagagctcgcgttagccaaggtgctggttggtcattaagagaaactgcctgcttaggaaagagttatgcacaaatgtggcaacttatgtatttccatagacgagatcttaggctagctgcaaacgccatttgcagcgccgttccggttgattgggtcccaacgagtagaacaacatggtctatccatgcacatcaccagtggatgacgacggaagatatgttaagtgtgtggaacagggtttggattgaagagaatccttggatggaagacaagacacatatatcttcctggggagatgttccctatttgggaaaaagggaagatcaatggtgcggctcacttataggtctaacagcacgtgccacttgggcaacaaatatccaagtagcaataaaccaggtacgtcgtctaatcggcaatgaaaattatttagactacatgacgtctatgaaaagattcaaaaatgaatcagaccccgaaggtgccctatggtga

SEQ ID NO: 21919 - RNA, 9879 nt, synthetic construct
  misc_feature 1..9879: note = derived and/or modified CDS sequence (opt6) from DENV-1__EU482816__SS-prME
  source 1..9879: mol_type = other RNA
tccgttacgatgcttctcatgttaatgccaacagctcttgcattccacttgactaccagaggtggagaaccgcatatgatagtttcaaaacaagaaagaggaaaaagtctcctgttcaaaacaagtgctggtgtaaatatgtgtacactcatcgcaatggatttaggagaattttgtgaagatactatgacctacaaatgcccacgcattactgaagcagaaccggacgacgtggattgctggtgtaacgcaactgatacatgggttacatacggaacgtgcagtcaaacaggagagcatagaagggacaaaagaagtgtagcattagctcctcatgttggtttaggtttggaaaccagaaccgagacttggatgtcatctgaaggagcatggaaacagatccagagggttgaaacatgggcactcagacatcctggtttcacggtgatcgctctgtttctagcgcatgcaatagggacgagcataacgcagaaaggaattatatttatccttctaatgctagtgaccccatcgatggcaatgcgatgtgtagggattggaagtagagatttcgttgaaggcttatcgggagcaacgtgggttgacgtagtacttgaacatggatcatgcgttactacaatggctaaagacaaaccaacactagatatagagttactaaaaactgaggttacaaatccagctgttctgaggaaactctgtatagaggcaaagatatcaaacactacaacagacagtcggtgccccacacaaggagaagctaccctagttgaagaacaggatgcgaacttcgtatgtagaagaacgtttgttgatcggggttggggaaacggatgtggtttattcggcaagggttcactgataacatgtgctaaatttaaatgtgtaacaaaactcgaagggaaaactgtccagtatgaaaatctaaaatactcggttatagtaacagtacacactggagaccaacatcaagtaggaaatgaatctaccgaacacggcaccacagcaacaataactcctcaagctccaagcacagagatacagttaactgattacggcgccctaacgttagattgctcaccaaggacgggtctagatttcaacgaaatggtacttcttacaatgaaagaaaagagttggctagtacacaaacaatggtttcttgatcttccattaccatggaccagtggagcaagtacgtcacaagagacatggaaccgaaaagatttacttgtcacttttaagacagcacatgccaagaaacaagaagtggtcgtcctggggagtcaagaaggagcaatgcacaccgctctcacaggcgctacggaaatccagacatccgggacaactacaatattcgctggacatctaaaatgcagactaaaaatggataagctcaccctaaagggcatgagttatgtaatgtgcacggggtcttttaaactggaaaaagaagtagcagaaacccaacacggcactgtgctagtgcaaattaaatatgaaggcacagatgctccttgtaaaataccgtttagcactcaggatgaaaaaggcgttactcagaatggacgcctaataacagcaaaccccatagtaacagataaagagaaacctgttaatattgaagcggaacctcctttcggagaatcgtatattgtcattggcgcaggcgagaaggcattaaagttgtcttggtttaagaagggatctagcattgggaaaatgttcgaagccacagcaaggggagcaagacgtatggctatcttaggcgacacggcatgggacttcgggtctattggaggggtcttcacaagtgtaggaaaacttgtacaccagatattcggcacagcgtacggagtcctattttccggagtatcttggacaatgaagataggcataggcgtcctacttacctggctagggctaaattctcgcagcacgtctctttcaatgacctgcatagctgtaggtcttgtaactttgtatctcggcgtgatggtccaggcggattcaggttgtgtaataaactggaagggaagagaattaaaatgtggatcgggcatttttgtgacaaacgaagtacatacatggactgagcagtataaattccaagcagacagtcctaaacgactaagtgcagctataggcaaggcttgggaggagggggtatgcggcattcgatctgcaactagactagaaaatataatgtggaaacaaataagcaatgaactgaaccacatacttctagagaacgatatgaaatttacggtggttgtaggagatgtggcaggcattttagcacaaggcaagaaaatgatacgacctcaaccgatggagtataaatatagttggaaaagttggggaaaagctaaaataattggagctgatgtccaaaatactacttttataatcgatggtcctaacactccagaatgtccagacgaccaacgagcttggaacatttgggaggtcgaagattacggatttggaatattcacaactaacatttggttaaagttaagggattcatacactcaagtatgtgatcatagactgatgagcgctgctattaaagattcgaaagcagtgcatgccgatatgggatactggatagaatcggagaaaaatgaaacatggaaattagcacgagcatcctttattgaagttaaaacatgcatatggcccaaatctcataccttgtggtcgaatggagttctcgaatcagaaatgattattcccaagatttatgggggcccgatatctcaacataactaccgaccaggttatttcacacaaacagccggtccttggcacctgggaaagctagaactagattttgatttatgcgaagggacaactgtagtcgttgatgagcattgtgggaatagaggaccatcgcttaggacgaccaccgttacaggaaaaataatacacgaatggtgctgcagatcatgtacattacccccattacgatttaaaggtgaagatggctgttggtacggtatggaaataagacccgtaaaagaaaaagaagaaaatcttgttaagagtatggtttctgcaggatcaggtgaagtggattcatttagtttaggtctattatgcatatcaattatgatagaagaagtaatgagaagtagatggtccaggaaaatgctaatgacaggaacactcgcggtcttctttttattaattatgggacagttaacctggaatgatctcatacgtctctgcattatggtaggagctaatgcatcagatagaatgggtatgggtaccacatacttagctctaatggctacttttaagatgagaccgatgttcgcagtaggactcttattcagacggctcacatcaagggaggtgctgttattaacaataggactcagtctagtagctagcgtagaattacctaattcgcttgaggagttgggcgatggtttggctatgggcataatgattctgaaattattaacagactttcaaagtcaccaattgtgggcgactttactctcgctcacatttattaaaacaactttctcattacactacgcatggaagaccatggcaatggtgctgagtattgtgtctttgtttcctctctgcctatctacaacgtcccagaaaactacctggctaccagtcctacttggcagtcttgggtgcaaaccactcacaatgttcttgatagctgagaacaagatttggggccgaaagagttggcctttgaatgaagggattatggcagttggcatagttagtattctgttaagcagcctacttaaaaacgacgtgccgttagcaggaccacttattgcaggaggcatgcttatagcttgttatgtgatatcaggaagttcagctgatttatccctagaaaaggcagcggaagtctcttgggaagaggaagcagaacattctggagctagccacaatatattggtagaagttcaagatgatgggacaatgaaaattaaagatgaagaaagagacgatacattaacaatacttttaaaggcaacgttactggctgtgtcaggtgtatacccgttatcgatacctgctactctttttgtttggtacttctggcaaaagaagaaacaacgtagcggagttctttgggatacgccatcaccacctgaagtggaacgtgcggtactagacgacggaatatacaggataatgcaacgaggcttactaggacgaagtcaagtcggtgtaggcgtattccaagagaatgtcttccatacgatgtggcacgtaacgaggggtgcagtacttatgtaccaagggaaaaggttggaaccatcttgggcttccgtcaaaaaggacttgatttcttatggaggagggtggagactgcaaggttcgtggaacacgggtgaagaagttcaagtgatagccgtagagccgggcaagaaccctaaaaatgtacaaacagcccctggtactttcaagacgagcgagggcgaagtcggggcaattgctttagattttaaacccggaacatcaggctctccaatagtaaaccgtgaagggaagattgtcggcttatacggaaacggtgtagttaccacgtctggaacttacgtctcggcgatagcacaagcaaaagcctcacaagagggcccattgcccgaaatagaagacgaagtatttcgtaaacgaaaccttactataatggacttacacccgggtagtggaaaaacgcgcagatatctacctgcaattgtgcgcgaagccataaaacgaaaattacgtacattgattctggcacctaccagagttgtcgcttccgaaatggctgaagcattaaaaggaatgcctattagatatcaaacaacggcagtgaaaagtgaacacactgggaaagaaatagtagatttaatgtgccatgccacattcacgatgagattactatcaccagtaagggtaccaaattataacatgataattatggacgaagcgcattttacagacccaagctctatagccgcccgcggatatatatcgactagagtaggtatgggagaagcagctgctatttttatgacagccacaccaccaggctctgttgaggctttcccacaatcgaatgccgttatacaagatgaagaacgagacattcctgaaaggtcatggaactcgggatacgagtggattactgatttccccggtaaaacggtatggtttgtaccgtctataaaatccggaaatgacattgctaattgtttaaggaaaaatggtaaaagagttatacagctatcaagaaaaacgtttgatacagaatatcaaaagaccaaaaataatgactgggactatgtggttacaacagacatatcagaaatgggagccaatttccgggctgatcgggtaatagatcccagaagatgcctgaagccagtgatacttaaagatggaccagaaagagttattctcgctggaccaatgcccgtcacagtagcatcggctgctcaaagaagaggtcgtatcggaagaaatcataataaagagggagatcaatacatttacatgggccaacccttaaacaatgatgaagatcatgctcattggacagaagcaaaaatgctgctggataacataaatacaccggaaggaatcataccggctctgtttgaacctgaaagggaaaaatctgcagccatcgacggagaatatcgacttagaggtgaagcacggaaaacgtttgttgaactaatgcgacgaggggatttgcctgtatggctatcgtacaaagtagctagcgaaggctttcaatatagtgataggcgttggtgctttgatggtgaaaggaacaatcaagttttagaagagaatatggatgtggagatttggaccaaggaaggagagaggaagaaattacgaccgcggtggttagacgccagaacctattcggaccctttagcactacgcgaatttaaagaatttgcagcaggacgaagaagcgtcagtggagacttgatactagaaataggaaaacttccgcaacatctcacacaaagagcccagaacgcactcgacaacctagtaatgctacataattcagaacaaggtggcagagcttatagacatgcaatggaagaattaccagacacaattgaaacattaatgctattagcgctcatagctgttttaacgggtggagttacactctttttcttgtcaggacggggcttagggaaaacaagtattggtctattatgtgtaatggccagttcagttctactctggatggcctcagttgagccacactggatagcggcaagtataatattagagttcttcttgatggttctattgatcccagaaccggatagacagcgcacaccccaggacaatcaattagcttatgttgttataggtctattatttatgatattgacagttgcagcgaacgaaatgggattattagaaaccacaaagaaagaccttggtattggtcacgtagcagtagaaaatcatcatcacgccgcaatgctcgatgtggatctgcaccctgcttcggcatggactctatacgctgtagcgacgactataattacgcctatgatgcgccatactattgagaatactactgctaacataagtttaactgcaattgcaaatcaggcggccatcctaatgggactagataaagggtggcccatcagcaaaatggatatcggagtgccactactggccctaggatgctattctcaagtcaaccctttaactttaacagcagctgtcctgatgttagtagcgcattatgctataataggcccaggtttgcaagcaaaagcaacgcgagaagcgcagaaaaggaccgcagctggtataatgaagaatcctacggtagatggtatcgtcgctattgaccttgacccggtggtctatgatgccaaattcgaaaaacaactaggacaaataatgttactcatactgtgtacatcacaaatcctattaatgaggaccacgtgggccctatgcgagtcgataacattagcgaccgggccactaactacactgtgggaaggaagtccaggaaaattttggaatacgacgatagccgtatctatggcgaacatctttaggggaagttatttggccggtgcagggcttgcgttctcactaatgaagtcattagggggcggtcgtaggggcacaggcgcacaaggagaaactcttggtgaaaagtggaagagacagttaaatcagttatctaaatcagaatttaatacctataaaagatcaggtattatggaagtagatcgaagcgaagcaaaagaagggcttaagcgcggagagacaactaaacacgcagttagtagaggtactgccaagttaaggtggtttgtcgagagaaacctagtaaagcccgaaggcaaggtaatagacctgggttgtggacgcggaggttggtcatattactgcgcgggactaaagaaagtaactgaagtgaaaggctacacaaagggaggtcccggtcatgaagaacccattcccatggccacatatggctggaatttagtgaaacttcattcaggaaaagacgtattctttactccgcccgaaaaatgtgatacattgctttgcgatattggtgagagtagccctaatccaacaattgaagagggacggacactgagagtattaaagatggtcgaaccctggcttcgtggaaatcagttctgcataaaaattcttaacccctacatgccctcagtcgtggagacacttgaacaaatgcaaagaaaacatggcggtatgctggttagaaacccactttcgagaaattcgactcacgagatgtattgggtatcgtgtggtacaggaaatatagtatcagcggttaatatgacaagccgaatgttattaaatcggtttacaatggcgcatagaaaacctacgtatgaacgcgacgtagatctaggagcgggtactagacacgtcgcagtagaaccagaggtcgcaaacctcgacattattggacaaagaattgaaaacataaaacacgagcataagtcaacgtggcattatgatgaggataatccttacaaaacgtgggcatatcacgggtcctatgaagtgaagccaagtggaagcgctagttctatggtgaatggtgtagtgaaactccttaccaagccatgggatgtcataccaatggtaacgcaaattgcaatgacagatacgacgccattcggccaacaaagagtttttaaagaaaaagtagacacccgaacccctaaagcaaaacgcggaactgcacaaatcatggaggtcacagcaaaatggttatggggatttctttcaagaaacaagaaaccgagaatatgcacccgtgaggagttcacaagaaaggtcaggtcaaacgcagccattggggctgtgtttgtggacgaaaatcagtggaactcggccaaagaagcagttgaggatgagagattctgggacttagtccaccgagagagagagttacataaacaaggcaaatgtgcaacctgtgtctataacatgatgggcaaacgggagaagaaactaggtgagttcggaaaagccaaaggttcaagagctatatggtacatgtggctaggtgcaagattcctagagttcgaggcacttggattcatgaacgaggaccattggtttagcagagaaaattctctttcgggcgtagagggagaaggtctacacaaactgggatacatactacgagatatatcgaaaattccaggaggaaatatgtatgcagatgatacggccggatgggatacaagaataaccgaagacgaccttcaaaacgaagcaaaaataacggatataatggaaccagaacacgctctacttgccaaaagtatctttaaattaacttatcaaaacaaggttgtgcgagtacaaagacctgccaaaaacggtacggttatggacgtgattagcagaagggaccaacgtgggagcgggcaagtaggtacatatggccttaatacattcactaacatggaggcacaactgatacgccaaatggaatccgaaggaatttttagcccctctgaattagaaacgcctaatttagcaggaagagtactagattggctagaaaaacatggagtggaacggctcaaacggatggcaataagtggagacgactgtgtagtaaaacctatcgatgatagattcgcaactgcattaacggcgttaaatgatatgggaaaagtccgaaaggatattccgcaatgggagccttcaaagggttggaatgactggcaacaagttcctttctgtagccatcatttccaccaattaattatgaaagacggtagagagatagtggtcccgtgtcgtaatcaggatgaattggttggacgtgctagagtcagtcaaggagctggatggagcctacgtgaaacagcctgtcttggaaagagttacgcacaaatgtggcaactcatgtatttccacaggagagatctccgattagcagcgaatgctatttgcagcgcggtcccagtagattgggttccaacatcgaggactacctggtcaatacatgcccatcatcaatggatgactactgaagatatgctatcagtatggaatcgggtttggatagaagaaaacccctggatggaggataaaactcatattagtagctggggtgatgttccctatctcgggaaacgagaggatcagtggtgtggttccctcataggtttaacagcacgggccacatgggcaacgaatattcaagttgcaataaatcaagtcagaagactaataggtaacgaaaattatttagactatatgacgtccatgaaacgctttaaaaatgaatcagaccccgaaggagcgttatggtag

SEQ ID NO: 21920 - RNA, 9879 nt, synthetic construct
  misc_feature 1..9879: note = derived and/or modified CDS sequence (opt6) from DENV-1__EU482821__SS-prME
  source 1..9879: mol_type = other RNA
tcagtgactatgttactgatgctgatgccgacggctctggcgtttcatttgacgacgagaggtggggaaccgcacatgatcgtgtcgaaacaagaacgtggaaaatcactgctttttaaaacatccgctggagtcaatatgtgtacccttattgctatggatctcggtgaattgtgtgaagataccatgacttacaaatgtccacggataaccgaaacagaaccagacgacgttgattgctggtgtaacgcaaccgatacctgggtcacgtatggtacttgtagtcaaacgggagaacatagaagagataaacgctccgttgccttggctccacatgtaggcctaggtttagaaacccgaaccgaaacctggatgtcgtcagaaggtgcttggaaacagatacaaagagtagaaacgtgggccttaagacacccgggtttcactgtgatagcactattcttagcgcacgctattggaacgagcattactcaaaaaggaattatattcatccttcttatgctagtaacaccttcaatggcaatgcgatgcgtaggaataggtaaccgggattttgtagaaggtctatcaggggcaacatgggttgatgtagtcttagaacacgggtcctgtgtaactactatggctaaagacaaaccaacactagatatagaactactcaaaactgaagtcacgaatccagcagtattaagaaaactatgtatcgaagcaaaaatatccaacacaacgactgattcaagatgtcctacgcaaggtgaagctactcttgtagaagaacaagacgcgaactttgtatgtcgtcgaacattcgtagatagaggttggggcaatggatgcggattattcggaaaaggaagcctaataacatgtgcaaagtttaaatgcgttacaaaacttgaaggcaaaatagtacaatatgaaaatttgaaatactcagtgatagtaacagtgcacaccggagatcaacatcaagttggcaacgaaagcacagaacatggaacaaccgcaaccatcactcctcaagcccctacaacggaaatacaactaaccgactacggggcattaaccctcgattgtagcccccgaacagggttagactttaatgaaatggtcttactcaccatgaaagaaaagtcgtggctagtacataaacaatggtttctagatctacctctaccctggacatcgggggcttccacaagtcaggaaacatggaatagacaagaccttttagtaacgttcaaaacagctcatgccaaaaagcaggaagtggttgtattaggctcacaagaaggagccatgcacacggcgctaacaggagcaactgagattcaaacaagtgggacgacgacaatttttgcgggtcaccttaagtgtagattaaagatggataagttaacgcttaaaggtatgagttatgtgatgtgtacagggtctttcaaattagaaaaagaagtcgctgaaacacagcacggaacagtattagtacaaatcaagtacgagggcacagacgcgccatgtaaaattccttttagcacccaggatgagaaaggggtaacacaaaacgggagacttataaccgcaaaccccattgtaaccgacaaagaaaagccagtcaatatagaggcagaaccgccttttggtgagagttacatagtaataggagcaggagagaaagcactcaaactaagttggtttaagaaaggtagctccataggaaagatgttcgaagcaaccgccaggggcgctcgcagaatggctatcttaggcgatacagcatgggacttcggttctattggaggggtatttacatctgtaggtaaactggttcaccaaatatttggcacggcatacggtgttttattttcaggtgtctcctggacaatgaaaattggaataggagtgctactgacttggttgggactaaattcacgctcaaccagtctcagcatgacgtgcatcgctgtgggattagtcacattatatctcggagtaatggtgcaagccgattccggatgtgtgatcaactggaaaggtcgagagctaaagtgtggcagtggaatatttgtgacaaatgaggtacatacctggactgagcaatataagtttcaagccgatagccccaaacgcttatccgcagctatagggaaagcatgggaagaaggcgtatgtggaattagatcagctacaagactcgaaaatattatgtggaaacaaatatcaaatgaactcaaccacatactacttgaaaacgatatgaaattcacagttgtggttggagacgtggctggtatattggcacagggtaagaaaatgatacgaccacagccaatggagtacaaatatagttggaagagttggggaaaagcgaagattattggggctgatgtccaaaataccacgtttatcattgacggaccaaatactcccgaatgcccagatgatcaacgagcttggaacatttgggaagtagaagactatgggttcggaatttttacaacaaacatttggttaaagttaagggattcgtacacacaagtatgtgatcacaggctaatgagcgcggcgataaaagattcgaaagccgtccatgcagacatgggatattggatagaatcagagaaaaacgaaacttggaaacttgcgagagcgtcttttattgaagtaaaaacttgtatatggccaaaatcacacacactatggagtaatggtgtcctagagtcagaaatgatcataccaaaaatttatggaggaccaatatcacaacacaactacaggccaggatatttcactcaaaccgcaggaccatggcatctaggaaaacttgaattggactttgatctttgcgagggaactacagtcgtcgtagatgagcattgtggtaatagagggccaagcctaagaacgacaacggtcaccgggaaaattatccatgaatggtgctgtagaagttgtactctaccacctttacgtttcagaggggaagatggctgctggtatgggatggagatcagacccgtaaaagaaaaggaagaaaacctggttaaatcgatggtaagcgctggttccggagaggtagactcattctccttagggcttctatgtataagtataatgattgaagaagtaatgcggagcagatggtcaagaaaaatgttaatgactgggacgcttgcggtattctttttattgataatgggtcaattaacttggaacgacttaatcagactgtgcatcatggttggcgcaaacgcgtcagatcgaatggggatgggaacaacgtatttagcgctaatggcaacatttaaaatgcgtccaatgtttgcggtcgggttactattcaggagattaacaagcagagaagtgctattgttaacaattgggctcagcttagtagcatcagtggaactacccaatagcttggaagaactaggggatggactggctatgggaatcatgatattaaaattactcacagattttcaatcgcatcagctatgggctacactattaagcctaaccttcatcaaaacaacattcagtctacattatgcttggaaaacaatggcgatggtattaagtattgtctccctgttccctttgtgtctgagtacaacgagtcagaaaactacctggctccctgttctcttaggcagcctcggctgcaaacccctgactatgtttcttatagcagagaataaaatatggggaagacgtagctggccattaaatgagggaataatggctgttggaatagtaagtatactactatcatcactactgaagaacgatgtaccacttgctggtcccttaatagcgggaggcatgttaatagcctgctacgttataagcggaagttctgccgaccttagtttggaaaaagcagcagaagtttcttgggaagaagaagctgaacactctggtgcgtcccacaatatcttagtagaagttcaagatgatgggacaatgaaaatcaaagacgaagaacgagatgataccctaactatcctacttaaggcaactttactagccgtcagtggtgtgtatccactaagcattccggcaaccctatttgtatggtatttctggcagaagaagaaacaaagaagtggagtcttgtgggacacaccgtcaccacccgaggttggaagggctgtattggacgatggaatttatagaatcatgcaacgagggttgctgggaaggtcgcaggtcggtgtaggtgtatttcaagaaaatgtctttcacacaatgtggcacgttacgcggggagcagtattaatgtatcaggggaaacggctagaaccatcctgggcatctgtaaagaaagatctgatatcatatggtggaggttggcgattacagggatcttggaatactggagaggaagtacaagtaatagccgtagaaccggggaaaaaccccaaaaatgtacaaacagctcccggaacttttaaaacgcctgagggtgaagttggcgcaatagccttagacttcaaaccgggaaccagcggtagtcccattgtaaatcgtgaagggaaaatagtgggattatacggtaatggagtagtcactacaagcggcacgtacgtttcagcaatagctcaggctaaagccagccaagagggtccattaccagaaatagaagacgaggtattcagaaaacggaaccttacaattatggatctacatccgggcagcggcaaaactcgccgatacttacctgcaatagtgcgagaagccataaaaagaaaactaagaacgctgatcttagctccgacaagggttgtagcatcggaaatggctgaagcattaaaaggaatgccaatccgttatcagacaactgcagtgaaatcagaacatacaggaaaggaaatagtggacctaatgtgccacgcaacttttacaatgaggttgcttagcccagtgagagtaccaaattacaacatgataattatggatgaagctcattttacagacccttcctcaattgcagcacgaggatacataagtacacgcgtgggcatgggagaggcagcggcaatatttatgaccgcgacaccccctggaagcgttgaagcatttccgcagagtaatgccgtcattcaagacgaagagagagatattccggaacgttcttggaactccggatatgaatggattactgacttccctggcaagactgtttggttcgtaccaagtattaaatcgggaaacgacattgcaaactgtctcagaaagaacgggaaaagggtcatacaattgtcacggaagacattcgacactgaatatcagaagactaaaaacaacgactgggattatgttgtaaccactgatatcagtgaaatgggtgctaatttcagggcggatagagtaattgacccaagaagatgcctcaagccagtgattcttaaggatggtccagagagagtgatacttgctggaccaatgcctgtcacagtcgcatccgcggctcagagacgaggcagaattggcagaaatcacaataaggaaggagaccaatacatctacatgggacagccacttaataatgacgaagaccatgctcattggactgaggcaaagatgctgttggataatatcaatacaccagagggcattataccagcgctatttgagccagagagagagaaaagtgcagcgattgatggagaatatcggttacgcggggaagctcgcaagacttttgtagaactcatgagacgcggtgacttgccggtctggttaagttataaggtagcttcggaaggcttccaatatagtgacagaagatggtgttttgacggtgaaagaaacaaccaagtactagaggagaatatggacgtagaaatttggacgaaggaaggagaaaggaagaaactaaggccacgttggttggatgctcggacatatagtgacccgttagctctacgcgaatttaaagagtttgccgcaggaagaagatcagtttcaggagacttgatactggagataggaaaactaccacaacatcttacccagcgcgctcaaaatgcattagacaacctagttatgttacacaatagtgaacaaggcggcagagcctatcgtcatgcaatggaggaattgccagacacgatagagacattaatgctacttgctctaatagctgtcttaacgggaggagttacactattctttctaagtggacgaggcttaggaaaaacatcaataggactactatgtgtaatggctagctccgtactgttatggatggcatccgttgagccgcattggatagccgcatcgataatattagaatttttcctaatggttctcttgatacccgaaccagatagacaacgcaccccacaagataatcaattagcttatgtagtcattggacttttattcatgatattgacagtcgcagcaaatgagatgggacttttagaaacgactaagaaagatttaggaataggtcatgtagcagtcgaaaatcatcatcatgccgcgatgttagacgtagatttacatcctgctagtgcttggacattatatgccgtagcaacaaccatcataactccaatgatgaggcatactatagaaaatactactgcgaatataagtctgacagcaatagcaaatcaagccgccatcctcatgggtttagataaggggtggccaatatcgaaaatggatattggtgtaccacttttggctttgggttgctacagtcaagtcaacccactaacactgaccgcagcagtgctaatgttagtagcacattacgcaataatcggtcccggactacaggcaaaagcaactcgtgaggcacaaaagagaacagccgctggaattatgaaaaatcctactgtggacggaattgttgcgatagatttagacccagttgtgtacgacgcaaagttcgaaaaacaactgggacaaataatgctattgattttgtgcacctcacaaatattacttatgcgaactacatgggcattatgtgaatccataacgctagctacaggacctttaacaacattatgggaaggatccccaggtaagttttggaacacaacgattgcagtaagtatggctaatatctttcgaggtagctacttggcaggagcagggttagcattttcgctcatgaaaagtctaggaggaggacgtagaggtacaggtgcgcaaggagaaacactaggagaaaagtggaaacggcaactaaatcaactaagtaaaagcgagtttaatacatacaaaagatcaggaataatggaagtcgatcgttcggaagcgaaagaagggttaaaaagaggagaaactacgaaacacgcagtctcgaggggtacggctaaacttaggtggttcgtcgaacgtaacttagttaaacctgaagggaaagtaatagatctgggctgcggtcgcgggggatggagctattattgcgcaggattaaagaaagttacggaagtaaaaggatatacgaaaggtggtcctggtcatgaagaaccgatacccatggctacttatggatggaacttagttaaattacatagcggcaaagacgtattctttataccacctgaaaaatgcgataccctactatgtgatattggcgaatcgtcacctaatccgaccatcgaagagggaagaactcttcgcgtattaaagatggtcgagccttggttgcgaggaaatcaattctgtatcaaaatattgaacccctacatgcctagcgtagttgaaactctagaacaaatgcaaaggaagcacggagggatgcttgtaagaaatcctttaagtagaaactctacacacgaaatgtattgggtatcttgtgggacgggaaacatcgtatcagctgtcaatatgacatcaagaatgttgctgaatcgattcacaatggctcaccgaaagccgacctatgagagagatgttgacctgggcgctgggacacgacatgtagccgttgaaccggaagttgctaatctagacataatagggcaaagaattgaaaatattaaacatgaacataaatcgacgtggcattacgacgaagacaacccgtacaaaacttgggcatatcacggaagctatgaagtaaagcctagcggtagtgcatcaagcatggtcaacggagttgtcaaacttctaactaaaccctgggacgtaatcccaatggttactcagattgccatgactgacacgacacctttcgggcaacaacgtgtctttaaagaaaaagtagatacccgcaccccaaaagccaagagaggcaccgcccaaataatggaagtaaccgcaaaatggctctggggtttcctatctagaaacaagaagccaagaatatgcacacgagaagagttcactaggaaagtacgaagtaacgcagcaataggcgctgtattcgtggacgagaaccagtggaactccgcaaaggaagcagtggaagatgaacgtttttgggatttagttcatcgcgaaagggaattacacaagcaaggtaagtgcgccacgtgcgtatataatatgatgggaaagcgtgagaagaaattgggcgagttcggaaaagccaaaggcagtcgagcgatttggtatatgtggttaggggcacgattcctcgagttcgaagcgctagggttcatgaacgaagaccactggttctcccgagaaaattctctttcgggcgtagaaggagagggccttcataaacttggttatatattaagagacataagcaacataccaggaggaaacatgtacgcggatgatacagccggatgggacacgcgaatcacggaagatgatctacaaaatgaagctaggattaccgacataatggaaccggaacatgcattacttgctaagagcatctttaaactaacgtaccaaaataaagtggtacgcgtccaaagaccagcgaaaaatggtactgtgatggatgtaatatcccgtagagatcaaagaggaagtggacaagtcggaacttacggattaaacactttcacaaatatggaagcacagcttattagacaaatggagtcagaaggtattttctcaccatccgaactagaaacccctaatctggcagaaagagttctagactggttggaaaaatatggagtagaaaggttaaaaagaatggcaatttccggcgatgactgtgtggtgaaacctattgacgatagatttgcaacagcattaactgctctaaatgacatgggaaaagtacgaaaggacatcccacaatgggagccaagcaaaggatggaatgattggcaacaagttccattttgttctcaccattttcatcaattgataatgaaagatggacgtgaaatagtggtcccatgtagaaatcaagatgagttagtgggcagagcaagagtgtctcaaggtgcgggatggagcttgagggaaaccgcatgtttgggcaagagctacgcacaaatgtggcaacttatgtattttcatcggcgagatcttagattagcagcaaatgcaatatgctccgctgtacccgtcgattggattcctacgagtagaacaacgtggtctatacacgcacaccaccaatggatgaccacagaggacatgttaagtgtctggaatagagtttggatcgaagaaaatccatggatggaagataaaacacacattagcagttggggagatgttccatacttaggaaagcgagaagaccagtggtgtggttcccttataggactaacggctagagcgacctgggcgacgaatattcaagttgcaattaaccaggtacgacgcctcattgggaacgaaaactacttagattatatgacctctatgaaacggttcaagaatgaaagcgatcccgaaggtgctctatggtaa

SEQ ID NO: 21921 - RNA, 9879 nt, synthetic construct
  misc_feature 1..9879: note = derived and/or modified CDS sequence (opt6) from DENV-1__EU482822__SS-prME
  source 1..9879: mol_type = other RNA
tctgtaactatgctgttaatgttaatgccaacggctcttgcgttccacttaactactagaggaggtgaaccacatatgatagttaccaaacaagaacgaggtaaatctcttctcttcaaaacaagtgcaggagtaaatatgtgcactttaatagcgatggatttaggtgaattatgtgaagacacaatgacctacaaatgccctagaataacagaagcagaacccgatgatgtcgactgttggtgtaatgcaaccgacacctgggtcacatatggaacttgttcgcaaacaggggaacacaggcgggacaaaagatctgtggctctagcgccacatgtaggacttggattagagactagaacggaaacttggatgagttctgaaggggcatggaaacaaattcaacgggtcgaaacatgggcacttagacaccccggattcactgtgatagcactatttttagcacatgcgatagggacatcaattacgcaaaaaggtatcatatttattttattaatgttagtaaccccttcgatggcgatgcgatgtgtggggataggctcgagggacttcgtcgaaggcttatcaggggcgacctgggttgatgttgtacttgaacatggatcatgcgtaacaacgatggctaaagacaaacctacgctagatatcgaactacttaaaacagaagtaacaaaccccgcaattttacgaaaactttgcatagaagcaaaaatttcgaatacaacgacagatagtagatgtcccacccagggtgaagcaacacttatggaagaacaagatgcaaactttgtttgcagaagaacgttcgtcgatagagggtggggaaacggctgtgggttgtttggtaaaggaagtctgattacctgtgctaaattcaagtgtgttactaagctagaaggaaagatagtccaatacgaaaacctaaaatatagcgtgatagtaacagtgcatacaggggatcaacatcaagtcggaaacgaatcaactgaacatggaactacagcaacgataacccctcaagcgcctacaagcgaaatacaattaacagattatggagcgttaacactagactgctcaccccggacaggactagacttcaatgaaatggttttactaacgatgaaagaaaaatcctggctcgtgcataaacaatggtttctagatttacccttaccatggacttctggtgccagtacaagtcaggaaacttggaaccggcaagatctattagttacgtttaagacggctcacgccaagaaacaagaagtagtcgtactcggttcacaggagggggctatgcacacggctcttacaggagcaacggaaatacaaacaagtggaacaacaacaatattcgccggacatttaaagtgtaggctaaaaatggacaaattaacactcaaagggatgagttacgtgatgtgcacggggagctttaaactagaaaaggaagtggcggaaacacagcatggaacggtgttagtccaaattaagtacgaaggtacggatgcaccttgtaaaatcccgttttccactcaagatgaaaaaggggttacacaaaatggacgattaatcacagctaaccccatcgtcaccgataaagaaaaacccgtaaacattgaagccgaaccaccttttggtgaaagctatattgtaataggagccggtgaaaaagccttaaagctaagttggtttaagaaaggatctagcatcggcaaaatgtttgaggcaacagcacgtggtgctcgaagaatggcgatactaggtgataccgcttgggatttcggatccattggaggggtattcacgagtattgggaaacttgtacatcagatatttggaacagcatatggagtgttattttctggcgtttcttggactatgaaaataggaataggcgtattactaacctggttagggctcaattctcgctccacaagcctatcgatgacttgtatagcagttggcctagtaacactttatttaggagtaatggttcaagctgatagcggatgtgtaataaattggaaaggccgagaattgaaatgtggaagcggtatcttcgtgacgaatgaggtccatacctggacagaacagtataaatttcaagccgactcccctaaacgtttaagcgcagccatcggcaaagcatgggaagagggggtatgtggtataagatcggcgacaagacttgaaaacataatgtggaaacagatttcaaatgaacttaatcatatattattagagaacgatatgaagttcactgttgtcgttggtgatgtagtgggaatattggcgcaaggtaaaaagatgataagaccacagcccatggagcataaatacagttggaagtcgtggggaaaagcaaaaataattggcgcagatgttcagaacacgacatttataatagatggacctaacacgcctgaatgtccagacgaccaaagggcttggaacatttgggaagtcgaagattacggatttggcatatttactactaacatctggttaaaaatgagggactcatacacacaggtttgtgatcaccggctgatgagtgcggccataaaagactcaaaggctgtccatgcagatatgggttattggattgaaagcgagaaaaatgaaacttggaaattagctagagcgtcttttatagaggttaaaacctgtatatggcccaaatcccacaccttatggagtaatggtgtactggaaagtgagatgattataccgaaaatttatgggggacctataagtcaacataattacagaccaggttactttacgcaaactgccggtccttggcacttaggaaagctagaactagatttcgacctgtgcgaaggaacaactgtcgtagtcgacgaacattgtggaaaccgaggtccaagtttgagaactacaactgtcaccggcaagataatacacgaatggtgctgcagatcgtgcacgttaccccctttaagatttaagggcgaggacggatgctggtacgggatggagatcagacccgttaaagaaaaagaggaaaacctagtaaaaagtatggtttccgccggtagcggagaggtagactctttcagtctaggacttttatgtatctcaataatgattgaggaagttatgagatcaaggtggagtcgaaaaatgttaatgacagggacgttagcggtatttttgctactgataatgggtcaactaacgtggaacgatttaataagattgtgtataatggtaggagctaatgcgtcagatagaatggggatgggtactacttatttagcattaatggcgacgtttaagatgagaccgatgttcgcagtcggtttattgttcaggaggctcacatcccgtgaagtccttctgcttaccataggcctatcgttagtcgcatcggtagaactacctaacagcttggaagagttgggtgatggtttggcaatgggcattatgatactaaaactattaactgattttcaaagccatcaattgtgggctactctattatcactaacatttattaaaactacactgagcttacactatgcgtggaagacaatggcaatggttctatcaatagtatcattaattccactgtgtttaagcacgacatcgcagaagactacttggttaccagttctgcttggatctttaggctgtaaaccacttaccatgtttctaattgcggaaaacaagatttggggaagaaaaagttggccactaaatgaaggaataatggcggtaggtgtggtatcaatacttctaagcagcttactaaagaatgatgttccgctggctggacccttaatagccggtggaatgttaatcgcgtgctacgttattagtggatcttcagcggacttatcattggaaaaagcagcagaggtctcttgggaagaagaagcagagcatagtggcgccagccatagtattcttgtggaagtacaagacgacggaacaatgaaaataaaagatgaagagagagacgatacgctcactatattgttgaaagcgacgttgttagcagtttcaggagtgtatcctctatccattcctgctacactgtttgtgtggtacttctggcagaagaagaaacaaaggtccggggtattatgggatactcctagtccacctgaagtagagagagcagtgcttgacgatggaatttatcgaataatgcaacgaggtctattaggccgctctcaggtcggagtgggggtatttcaggaaaatgtttttcacaccatgtggcatgtgacacggggcgctgtgctcatgtatcagggtaaaagacttgaaccaagttgggcatcagtaaagaaagacttaatcagttatggaggtggttggcggctacaggggtcatggaatacgggcgaagaagtacaagtcatagctgtagagcctgggaaaaaccctaaaaatgtccaaactgctccagggacattcaaaacgcctgaaggtgaggttggcgcgatagctttagattttaaaccaggaacaagcgggagtcctatcgtaaatagggaagggaaaatcgtcggcttatatggaaacggagtagttacaacttcaggaacatacgtatctgcaatagcccaggccaaggcttcccaagaaggcccgctgcccgaaatagaagatgaagttttccgaaagagaaacttaacgattatggatctacacccaggttcaggaaagacccgacgttacttacctgcaatagttagagaagcaattaagcgtaaacttaggactttaatccttgctccaacaagagttgtcgcaagtgaaatggcagaagcgcttaaaggtatgccgatacggtatcaaactacggcagtaaaaagtgaacatactggaaaagagatcgtagacctcatgtgccatgcaacatttacaatgcgtcttttatcgccagtcagggtaccgaattataatatgataattatggatgaggcacactttaccgatccatcgtcgatcgcagcacggggatacataagcacgagagtaggaatgggggaggctgctgcaatattcatgacagcaacaccaccgggtagcgttgaagcattcccccaaagtaacgcagttatacaagacgaagaacgagatattccagaacgctcttggaacagtggatatgaatggattactgactttcccggcaaaactgtatggtttgttcctagtataaagagcggaaatgatatagctaattgtttaaggaaaaatggaaaaagagtgatccagctaagccggaaaacctttgataccgaataccagaaaacgaaaaataacgattgggattatgttgttacaactgacataagtgaaatgggggctaattttcgagccgaccgagtaatagacccgcgacgttgcttaaagcccgtcatattaaaggatggaccagaaagagtaatattagcaggtccgatgccagtaactgtcgccagtgcagcgcaaagaagaggacgcattggaagaaatcacaataaggaaggagatcaatacatttatatgggacagcctttaaataacgacgaagatcatgctcactggaccgaggcaaagatgctcttggacaatataaatacaccagaaggaataattccagcattattcgaacctgaaagagagaaaagcgctgctatcgatggcgaatatcgattaagaggagaagcacgtaaaacattcgttgaacttatgcgacgtggagacctgcccgtgtggctctcatacaaagtggcatctgagggctttcaatattctgacagaagatggtgcttcgacggagaacgcaacaaccaagtgctcgaagagaatatggatgttgaaatttggactaaggagggtgaacggaaaaagttaaggcccagatggttagatgctcgaacgtactcagatccactggcactccgagaatttaaggagtttgcggcaggaaggagatcagttagtggagatttgattctagaaataggaaaattgcctcaacatttaactcagagggcacaaaatgcattagataatctcgtaatgctccataacagtgaacaaggaggtagagcctatagacatgctatggaagaattgcccgacacaatcgaaactctaatgctactcgctttaatagctgtcttgactggtggagtaacgctattcttcctaagcggaaggggattgggaaagacttctatcggtctactctgtgtaatggcaagttccgtccttttgtggatggcatcagtcgaaccccattggatagcagcaagtattatcttggagttctttttaatggtattgctaatacccgaacctgatcgacagaggacccctcaagataatcagcttgcatacgtagtaattggactgctgttcatgatattaacagtagcagcaaacgaaatgggacttttagaaacaacgaagaaagacctcggtatcggtcacgtagcggtcgagaaccatcatcatgcaacaatgctagatgtagatttacatccagcgagtgcttggacattatatgctgttgccacgactattatcacacccatgatgcggcatacgatagagaatacaaccgcaaacataagcctcacggcaatagcaaaccaggcagcgatcttaatgggcttagataaaggatggccgatatcaaaaatggatataggggtcccactactagcgctaggttgctactcgcaggtcaacccgttaacattgactgccgctgttttaatgttagtcgcacattatgcgatcatagggcctggtctacaagccaaagcaaccagagaggcacagaagcgaacagcagcaggaataatgaagaatccgactgtggacgggatagtagcgatagacttggatcctgtggtgtacgatgctaaattcgaaaaacaactaggacaaattatgttattaatattatgtacctctcagatattattaatgcgaactacatgggctctatgcgaaagtataacattagcaacggggccacttacaacgctttgggaaggtagcccaggaaaattttggaacacaacgattgcggtatcaatggcgaacatatttagaggatcctaccttgccggagctgggttggcattttccttgatgaaatctctagggggaggacgcagaggtactggcgctcaaggagaaacactcggtgaaaaatggaagagacaacttaatcagttatcaaaaagcgaatttaacatctataaaaggtctggtattatggaagtagataggtctgaagccaaggaagggcttaaaagaggcgagactacccggcatgctgtctccagaggaacagcgaaactgcgctggtttgtagaaagaaacctggtcaaacccgaaggaaaagttattgacttgggatgtggtcgaggaggttggagttactattgtgcaggtttgaagaaagtgacagaagtaaaaggttatactaaaggcggcccgggccatgaggaaccaatacctatggccacgtatggatggaatctggtaaaacttcattcaggaaaggatgtattctttacaccaccggagaaatgcgacacactactatgtgacataggggagtcttcacccaatcctacaattgaggaagggagaactttgcgcgttttgaagatggttgagccatggttgaggggtaatcaattctgtataaaaatacttaatccctatatgccaagcgtggtcgaaacactagagcaaatgcaaaggaaacacggcggtatgttagttcgtaacccgctaagccgtaattcaacgcatgaaatgtattgggttagttgcggcactggtaacatagtaagcgctgtgaatatgacaagccgtatgcttctaaacagattcactatggcacatagaaaacccacttatgaaaaagacgtcgatttaggcgcagggacgagacatgtcgccgtggagccagaagttgcgaacctagatataatagggcaacgaattgaaaatatcaaacatgagcataaatccacttggcattatgacgaagacaacccgtacaaaacatgggcctatcacggatcatatgaggtaaagccgtctggttccgcatcttcaatggtgaatggtgtcgttaaactactaacaaaaccctgggacgtgatacccatggtgactcaaatagctatgacggatactacaccctttgggcaacaaagagtcttcaaagagaaggtcgatactcgtactcctaaggcgaagcgagggacggtccaaataatggaagtaactgcccggtggctatggggatttttgagtagaaacaagaaaccaaggatatgtacgagagaagaatttacaagaaaagtgcgcagtaatgcagcaataggggccgttttcgtggatgaaaaccaatggaactcggcaaaggaagcagttgaagatgagcgattttgggaccttgtgaaaaaggaaagggaattacacaagcaaggtaagtgcgctacctgcgtttacaatatgatgggaaagagggagaaaaagttaggagagttcggaaaggcaaaaggcagcagggcgatatggtatatgtggttaggtgcaagatttctggaatttgaggcccttgggtttatgaatgaagatcactggttctcacgggaaaattctctatctggagtagagggtgagggactccataaactcggttacattctaagagacatatcaaagattcctggtggaaacatgtatgcggacgacaccgcaggttgggacactcgaataacagaagacgacctgcagaacgaggctaaaataacagatataatggagccggaacatgccctattagctaccagcattttcaagctaacgtatcaaaacaaagtagtaagagtacagcgtcccgctaaaaacggtactgttatggatgttattagccgcagagatcaacgaggctcgggtcaagttggtacttatggattaaatacttttactaatatggaggcacaacttataagacagatggaaagcgaaggtatctttttaccatcagaacttgaaactccgaatctcgcagaaagagttttagactggctagaaaaatatggagtcgaacgattaaaaagaatggctatatcaggggatgactgtgtagtaaagccaatcgacgatcgtttcgcaaccgcgcttacagcactgaacgatatgggaaaagtgagaaaggatatccctcaatgggagccgtcaaaaggatggaatgactggcagcaagtccccttttgctcacaccatttccatcaactgatcatgaaagatggccgtgaaattgtagtaccatgtagaaaccaagatgagcttgttgggagagcacgagtttcgcagggagctggttggtccttacgagaaactgcatgtttaggtaaaagttatgctcaaatgtggcagcttatgtattttcatcgaagggacctcagactggcggctaatgccatatgctcggcggtccctgtagattgggtaccaacaagtcggacaacatggagcattcacgcacatcatcaatggatgacaactgaagatatgttatcagtgtggaatagagtttggatagaagaaaacccatggatggaggacaaaacgcatgtgtcaagttggggagatgtgccatatctaggtaaaagagaagatcaatggtgtggctcgttgataggactaactgccagagcgacatgggcaagtaatatacaagtggcaataaatcaggtgcgtagacttattggcaacgagaattatcttgattatatgacctcaatgaaaaggtttaagaatgaaggagatccagaaggtgctttgtggtaa

SEQ ID NO: 21922 - RNA, 9879 nt, synthetic construct
  misc_feature 1..9879: note = derived and/or modified CDS sequence (opt6) from DENV-1__EU482476__SS-prME
  source 1..9879: mol_type = other RNA
tctgtaactatgttacttatgctcatgcctacagcactcgcatttcatttaacgacgcgtggaggagaacctcacatgatagttacaaaacaagaacggggaaagagcttgctttttaaaacaagcgcaggggtaaatatgtgtacactcattgcaatggaccttggtgagctttgtgaggatactatgacttacaaatgtcccagaatcactgaagctgaaccagacgatgtggactgttggtgcaatgcaacagatacatgggttacgtacggaacttgttcacaaacaggagagcaccggagagataagaggagtgtggctttggcaccccacgtaggactaggattagagaccaggacagaaacttggatgagctccgaaggagcttggaaacaaatacagagggtagagacatgggcacttcgtcacccagggttcaccgttattgctctcttccttgcccacgccataggtacaagtataacacaaaaaggaataatatttattctcctaatgctagtgacaccttcgatggcaatgagatgtgtaggaattggatcacgagacttcgtagaaggtctaagtggagctacgtgggtagacgtagtacttgagcacggatcgtgcgttaccacaatggccaaagacaaacccacactcgacatagaacttttaaaaacagaagtaaccaatccagctgtattaagaaaactttgtatagaagctaaaatttcaaacacaaccactgattcacggtgtcccactcagggcgaagcaacactcatggaagaacaagatgctaactttgtttgtcgaagaacattcgtggacagaggatgggggaatggttgcggacttttcgggaaaggatctttaataacatgtgctaaatttaaatgcgtcacgaaactagaaggaaaaatagttcaatatgagaacttaaaatacagtgtaatagtaacagtacatacaggtgaccaacatcaggttggtaatgaatctacagaacacggaacgaccgcaactataaccccacaagcgcccacgtcggagatccaactgactgattatggtgccttaacccttgattgctctccgagaaccggtttggattttaatgagatggtactcctaactatgaaagaaaaatcatggctggttcataagcaatggtttctcgaccttcctctgccgtggacatccggagcctccacaagtcaagaaacctggaaccggcaagatcttctagtaacgttcaagactgcacacgccaagaaacaagaggttgtggtcctgggatcacaagagggcgcaatgcatactgcgctaacaggagctaccgagatacaaacaagtggtacgaccacaatctttgcagggcatcttaagtgcaggctaaagatggataagctaactttaaagggaatgtcgtacgtaatgtgtactggcagttttaaattagaaaaagaagtagcagaaacgcaacatggaacagtgttagtccaaattaaatatgaaggcacagatgccccgtgcaaaatccctttttcgacacaggatgaaaagggtgttacacaaaatgggaggttaattaccgccaacccgatagtaactgataaagaaaagccagtaaatatagaagcggagccaccgtttggagagagttatatagtcataggggcaggcgaaaaggctttaaaattgtcttggttcaagaagggttcatcaataggaaaaatgtttgaagcgactgcaagaggtgctcgtagaatggcgatactcggagatacggcttgggacttcggatcaatagggggagtatttacgagtgttggaaaacttgttcaccaaatatttggaacagcgtacggcgttttattctctggagtatcgtggacaatgaaaatcggaatcggcgtattgctaacttggctaggattaaacagcagatcaactagcttaagtatgacttgtatagcagtcgggttggttacactatacctaggggtaatggttcaggccgattcaggttgtgtaattaactggaaaggaagggagttaaaatgtggatccggaattttcgtaacaaatgaggtacatacttggactgaacagtacaaatttcaagctgattctccgaaacgtttgtcagcggcgatcggaaaagcatgggaagagggcgtctgtggcataagaagcgccaccaggttagaaaatatcatgtggaaacagatatctaatgaattaaaccacattctgctggaaaatggcatgaaatttacagtggtagtaggcgacgtggtaggaatccttgcgcaagggaagaaaatgataagaccacaaccaatggaacacaaatactcctggaaaagctggggtaaagctaaaattataggggcggatgtacaaaacacaacattcataatagatggccccaatacacccgaatgcccagacgatcaacgggcatggaatatctgggaggtcgaagattacgggtttggcatattcacgacaaatatttggttaaaactgcgggactcttatacacaagtttgcgatcatagattaatgagtgcagcaataaaagattcaaaggcagtgcacgcagatatgggttattggatcgagtctgagaaaaacgaaacatggaagctagccagagccagtttcatagaagtgaagacctgtatatggccaaagagccataccctgtggagtaacggcgtgttagaatctgagatgatcatacctaaaatttatggtggccccatttcacaacacaactacagaccaggctatttcacacaaacggcaggcccgtggcacctaggaaaacttgaactagattttgacctgtgtgaaggtactacagttgttgtcgatgaacactgtggaaatagagggccgtctttacgcactacaactgtaacaggaaaaattattcacgaatggtgctgccgaagttgtacactaccacccttaagattcaaaggggaagatgggtgttggtatggtatggagataagacctgtcaaagaaaaagaagaaaatctagtgaaatcgatggtaagtgctggaagtggagaggttgacagctttagtctagggcttttatgtaccagtattatgatagaggaagtaatgcgatcaagatggtccagaaagatgttaatgacagggactttagcagtattcctgttgttgattatgggtcaactaacgtggaatgatctgataagactatgtatcatggttggggcgaatgcaagtgacagaatgggcatgggtacaacctatctagctctcatggccacatttaaaatgaggcctatgttcgcagttggtttattatttcgtcgactaacatcaagggaggtcctcctattaacaattggattgtcgctagttgcatccgttgaacttcctaattcactggaagaactaggtgatggcctagcaatggggataatgatcctcaaacttttaacagactttcaatcgcatcaactttgggccaccctactttccttgacgttcattaaaaccaccttatcattgcattatgcatggaaaactatggctatggtactatcaatcgtaagtttatttccactctgcctttcaactacgtctcagaaaacaacttggctacccgtactattaggaagtttaggctgtaaaccattaacgatgttcctcatcgcagagaataaaatttggggcaggaaatcctggccgttaaatgaaggtataatggcagttggtgttgtaagcatattactctcatcacttctcaaaaacgatgtcccgctagccggaccacttatagccggaggtatgctgattgcttgttacgtgattagtggaagctccgctgatctatcactagaaaaggccgctgaggtatcttgggaagaggaggcagagcattcaggagcttcacacaacatattagtagaggtgcaagacgacggtactatgaagataaaagatgaggaaagagacgacacactaactattctcctaaaagcaactttacttgctgtcagtggtgtatatccattatctatacctgcaacactgtttgtatggtacttttggcagaaaaagaaacaacgatctggtgtattgtgggacacgccatctcctcctgaagtcgagagagctgtattagatgacggaatctatcggataatgcagcggggattattagggcgttctcaagtgggagtcggggtgtttcaagaaaatgtattccatacgatgtggcacgtcacacgtggagcagtattaatgtaccaaggaaaaagactggaaccttcgtgggcatccgtgaagaaagacctcatctcatatggaggtggatggcgcttacaaggatcttggaatactggtgaagaagtacaggtcatcgctgtagagccaggcaaaaacccaaagaatgtccagacggcacccggaacattcaaaacgcctgaaggcgaggtgggcgctatagctttagattttaaacctggaacatcaggtagtcccattgtaaatagggagggcaaaatagtcggtttatatggtaacggcgttgttacaacaagtggtacatacgtgtcagcgatcgctcaagcgaaagcatcacaagaagggccgctacccgagattgaagatgaagttttccgaaaaaggaaccttaccattatggacctgcaccctggaagcggaaaaaccaggcgatacttgcccgctattgtacgtgaagcaataaaaagaaagctaagaactcttatattagcccctacaagagttgtggcaagcgaaatggcggaggcccttaaaggaatgcccatacgatatcaaacaacagcagtaaagtctgagcatacaggtaaggagatagttgacctgatgtgccatgctacttttaccatgcgacttttaagcccagttagggttccaaattataatatgataataatggatgaagctcattttacagacccatcgtcgatagccgccagagggtatatcagcactagggttgggatgggtgaagcagctgctatctttatgactgccacaccaccgggttctgttgaagcatttcctcaaagcaacgctgtgatacaagacgaagaacgtgacattccagagcgatcctggaatagtggttatgaatggataaccgattttcctggaaaaacggtatggtttgtaccctccatcaaatcaggcaatgatattgcaaactgtcttaggaaaaatggaaaaagagtaatacagcttagtagaaaaaccttcgacactgaataccagaaaactaaaaataatgactgggactatgtagtaactaccgacatctcagaaatgggcgcgaattttagagcagatcgtgttattgatccacggcgttgtttaaagcccgtaatattgaaagatggtcctgagagagtcatactagcaggaccaatgccagttactgtggcatccgctgctcaaagacgcggacgcataggtagaaatcataacaaagagggggatcaatacatatatatgggtcagccacttaataatgacgaagaccatgcacactggacggaggcaaaaatgttacttgataacatcaatacacctgaaggcattatccccgctctatttgaacccgagcgggaaaagtcagcagcaatcgatggggaatatagacttagaggagaggctaggaagacatttgtagagttaatgcggcgtggagatttacccgtatggttgagctataaggttgcaagtgagggattccagtacagtgatagaagatggtgttttgatggtgaaaggaataatcaagtactcgaagaaaatatggatgtggaaatttggactaaggaaggagagaggaaaaagttaagacccagatggctggatgccagaacttatagcgatccattggcactgcgtgaatttaaagaatttgcagcaggccggcgatctgtaagcggggacttaatactggaaattggtaagctacctcaacacctaacacaaagggcacagaatgcactggataatttagtcatgctacataattccgagcagggcggcagagcatatagacacgcaatggaagagttaccagatacaatagaaactttgatgttattagccttaattgcagttctaaccggaggtgtaaccctattctttctatcaggacgaggattagggaaaacctcaattggtttactatgtgttatggcatcaagcgtgttgctctggatggcctcagttgaaccccactggatagccgcctcgataattttagaatttttcctcatggttctgttgatcccagagcctgataggcaacgcacaccacaagacaatcaactggcgtatgttgtaataggtttattatttatgatactaactgtcgccgcaaatgagatggggttactcgaaacaacaaagaaggatttgggcatcggacatgtggcagtggagaatcaccaccatgcaacgatgttggacgtggacctacacccagcatcagcctggacgctctatgcggtggcaacgactataatcactccaatgatgcgccatacgatagagaatacaacggcaaatattagtttaacggctatagcaaaccaagcagcaatattaatgggtttagacaaaggttggcccatatctaaaatggatataggcgtcccactattagctcttggatgttactcacaagtgaaccctcttacgttaacagccgccgtactgatgttagtagcacattacgcgataataggtccaggattacaagccaaagcaaccagggaagctcagaaaagaacagcagctggaataatgaaaaatccaacagtagatggaatagtagctatagatctagatccagttgtatatgatgcaaagtttgaaaaacaactgggccaaatcatgctcttaattttatgcacatcccaaatactcctaatgcgaactacatgggccttatgtgaatctataaccctcgccacgggaccacttacaacattatgggaaggaagcccaggaaagttttggaacacaacaatcgcagttagcatggcaaacatatttagaggttcatatttagccggtgcgggtttagcgttttcacttatgaaatccttaggtggaggaagacgaggaacgggtgctcaaggagaaacattgggtgaaaaatggaaacgacaactgaatcagctttcaaaatccgagtttaatatatataaacggagtgggataatggaggttgaccgctcagaagcaaaagagggcctaaaaagaggtgaaactactaggcacgcagttagtaggggcacggctaaacttaggtggtttgtggaacgcaatttagtgaaaccagaaggtaaagtcatagatctaggctgtgggcgaggtgggtggtcatactattgtgctggtttgaaaaaggttactgaagtgaaaggttatacgaaaggtggaccaggtcatgaagaacctatcccgatggctacctatggatggaacttggtaaagctacatagtgggaaagacgtattctttactccaccagaaaaatgtgatacattgctatgtgacatcggggaatcatcgccaaaccccacgatagaggaaggcagaacgttaagagtgctcaagatggtggaaccatggttacgcggaaatcagttttgcattaagatcctaaatccttatatgccaagcgtggttgaaacacttgagcaaatgcagcgcaagcatggtggtatgttagtaagaaatccgctgtcccgcaattctacacatgaaatgtattgggtaagctgcggtacgggcaacatagtaagcgcggtgaacatgacaagtcgaatgctcctgaatcgttttacaatggcgcatcgtaaacccacttatgaaagagatgttgatctgggagccggaacaagacacgtagcagtggagcctgaagtagcgaacttagacatcataggacaacgtattgaaaatataaaacacgaacacaaaagcacatggcattacgatgaagacaacccgtacaaaacgtgggcctaccatggatcttacgaggttaaaccaagtggatcagcatcaagtatggtcaacggtgttgtcaaactactaacaaaaccatgggatgtaattccaatggtcactcagattgccatgacggacacgaccccatttggacaacaaagagtcttcaaggagaaagttgatacacgaactccgaaagctaaacgtggtaccgcacaaatcatggaagtcactgccagatggttgtggggatttcttagtagaaataagaaaccccgtatatgtacacgagaggagtttactcgcaaagttagaagcaatgcggcaattggcgctgtatttgtagacgaaaatcaatggaatagcgcaaaagaagccgtggaagatgagagattctgggatcttgtacagaaagaaagagagctccacaaacaaggtaaatgcgcaacatgcgtatataatatgatgggaaaacgcgagaagaaattaggcgaatttggcaaagcaaaaggcagtagggcaatttggtatatgtggctcggtgcgcggtttctcgagttcgaggctttagggtttatgaatgaagatcactggttcagcagagaaaatagtttaagtggagtagaaggggaaggactccataagctcggatacatattgagagatatttcaaaaattcctggaggaaacatgtacgcagatgataccgctggatgggatactcgaataacggaagatgatttacaaaatgaggctaaaattacagatataatggaacctgaacatgcattgctagcaaccagtatatttaaactaacttaccagaataaagtagttcgagtccagcgaccggctaaaaacggcacggtaatggatgtcatttcgcgtcgtgaccagagagggagtggtcaagtaggtacctacggcctcaacacattcaccaatatggaagcacagttgataagacaaatggaaagtgaaggtattttcctcccgtcagaacttgaaactccaaacttagcagaacgagtcctagactggttggaaaaatatggcgttgaacgcctaaaacggatggctattagtggagacgattgtgtagtcaaacctattgatgatcgttttgccactgcgttagcagccctaaatgatatgggaaaggtcagaaaagacataccacagtgggaacctagtaaaggttggaacgactggcaacaagtcccattttgctcccaccatttccaccagttgattatgaaagatggacgagaaatagtagtgccctgcaggaaccaagacgagctagtaggtagagcccgagtaagtcaaggagctggctggtctctacgtgaaaccgcatgcttaggtaagagttatgcacaaatgtggcaacttatgtattttcaccgtagagaccttagactagcagcaaatgcaatatgctcggcggttcctgtagattgggtacccacttccagaacaacctggtctattcacgcacaccatcaatggatgacaacggaggatatgttgagtgtctggaatagggtatggatagaagagaacccctggatggaagataaaacgcatgtaagctcctggggtgatgtgccctacttgggtaaaagagaagaccaatggtgtggatcattaataggacttacagcacgagctacgtgggcatccaacatacaagttgccataaatcaagtacgtcggttaataggtaatgaaaattatttggattatatgacatccatgaaacggttcaaaaatgagggagatcctgaaggagctctgtggtga

SEQ ID NO: 21923 - RNA, 9879 nt, synthetic construct
  misc_feature 1..9879: note = derived and/or modified CDS sequence (opt6) from DENV-1__EU482477__SS-prME
  source 1..9879: mol_type = other RNA
tcggtaactatgttgttaatgctgatgccaacagcattggcatttcacctaacaacaaggggaggagaaccgcacatgattgtatctaaacaagaaagaggaaaatcattacttttcaaaacaagcgccggtgttaatatgtgtacactaattgcgatggatttaggagaactatgcgaagacacaatgacttacaaatgccctaggatcacggaggctgagccagacgacgtcgattgctggtgcaatgcgacagatacctgggttacatacggaacctgtagtcaaacgggtgaacatcgacgagacaaacggagtgtagccctcgcgcctcacgttggtttgggtttggagacaagaactgagacatggatgagtagcgaaggagcatggaaacagatacaaagagttgaaacgtgggcactaagacatccagggtttactgtaattgctctgtttttagcacatgcaattggaacaagcataacccaaaaaggaatcatatttatattattaatgctagtaacaccttctatggcgatgagatgtgtaggaataggaagtagggactttgtagaagggctcagtggagcaacttgggtagacgtcgtcttagaacacggatcatgtgtgacaacgatggcaaaagataaacctaccctagatatagaactactgaaaacagaagtaacgaacccggctgtactccgcaaactttgtattgaagctaaaatctccaataccacgacagattctagatgtcctacacaaggtgaggcaactctagttgaggaacaagacgccaattttgtatgtcgacggacgtttgtggatagaggttgggggaacggatgcgggctatttggaaaaggtagtttaatcacttgtgccaaattcaaatgtgtgacaaaattagagggaaaaatagttcaatatgagaacctcaaatatagtgtcatagtcaccgttcataccggagaccaacaccaagtgggaaacgaatcgaccgaacacggaacgacagccactattacaccgcaagccccaagtacagaaatacaattaacggactatggtgcactaacgcttgactgttcaccgcgaactggattggattttaatgaaatggtacttctaacaatgaaagagaaaagctggctcgtacataaacagtggtttttagacctgcctttgccatggaccagtggtgcaagtactagccaagaaacatggaatcggcaagacttacttgtaacatttaaaaccgcgcacgctaagaaacaagaagtagtcgtattaggaagtcaggaaggagccatgcatacagccttaactggggcaacagaaatacaaacttcaggaactactaccatctttgctggacacttgaaatgtagacttaaaatggacaagctcaccctaaaaggtatgtcttatgtaatgtgtactggcagctttaaactagaaaaagaagtagcagagacgcaacatggaactgttttagtgcaaatcaagtatgagggaacagatgccccttgtaaaatacccttttcaacgcaggatgaaaaaggtgtaacccagaatggcagattgatcaccgcaaacccgatagtcactgataaagaaaaaccagtaaacattgaagctgaaccaccttttggagaaagctatatagttataggggcaggggaaaaagccttgaaattaagttggtttaagaaaggtagtagtataggaaagatgtttgaagcaaccgcaagaggtgcccgtagaatggcaattctcggagatacagcatgggatttcggcagcataggcggggttttcacgtctgtaggaaaattggtgcatcaaatatttggcactgcatatggagtattgtttagcggagtaagctggacaatgaaaattggaatcggagtattacttacgtggctaggcttgaactcccgttctaccagcttatctatgacttgtatagcagttggacttgtaacattatatttaggggtcatggttcaagcagattcaggttgcgtaattaattggaaaggcagggagcttaaatgtgggagtggaattttcgtgacgaatgaagtacatacttggacagagcaatataaatttcaagccgattctccaaaaagactgtcagctgccataggcaaagcgtgggaggagggagtttgtggaattagatcagccactaggcttgagaatataatgtggaaacaaataagcaatgaactcaaccatatcttactcgaaaatgatatgaaattcactgtggttgtaggcgatgtagcgggcattcttgcacaaggcaaaaagatgatcagacctcaacccatggaatacaaatatagttggaaatcatggggtaaagctaaaataataggagcagacgtgcagaatacgacttttataatagacggaccgaatacacctgagtgtccagatgaccaaagagcatggaacatatgggaagtagaagattatggattcgggatatttactacaaacatatggttaaaattacgcgactcatatacacaggtttgtgatcatcggttaatgtcagcagcaatcaaagacagtaaagcagttcatgcagatatgggttactggatcgaatcagagaaaaatgaaacttggaagttagcaagagcgagttttatcgaagttaaaacttgtatatggccaaaatcacacactctatggtctaatggcgttctcgaatctgaaatgattattcccaagatatacggtggaccgatatcacaacataattatagacctggatattttactcaaacagctggcccttggcacctaggtaaactggaacttgattttaacctttgcgaaggtactacagtagttgtagatgaacactgcggaaatcgaggtccaagccttagaacaactaccgttacaggaaaaattatccacgagtggtgttgtcgttcttgtacacttccgcccctgagatttaaaggggaggatgggtgctggtatggaatggaaatacgtccagtgaaagaaaaggaagaaaatttggtaaaatcgatggtaagtgcaggttccggggaagtagattctttctcgttaggtttattatgtatttctattatgatcgaagaggttatgcgatctagatggagccgaaaaatgctcatgacaggaacattagctgtctttttcttactcataatgggacagctcacatggaatgacctaatccggttatgtataatggtcggggctaacgcttccgaccgtatggggatgggaacaacttatttggcattaatggcaacttttaaaatgcgacctatgctggccgttggtcttttgttcaggagactaacttctcgagaagtactgttgttaacaatagggctgagcttagttgctagtgttgaattacctaattcactagaagaattaggggacgggctagctatgggtatcatgatcttaaaactcctgactgacttccagagtcatcaactatgggcaacacttctatcattaactttcataaaaacgacatactcgctccattacgcttggaaaaccatggctatggtacttagtattgtttctttatttcctttatgcttatcaactacttctcagaaaacgacatggttaccagtcctgctaggatcattaggttgtaagcccttaactatgtttttaattgcagaaaacaaaatatggggtcgtaagagttggcctttgaacgaggggataatggcagtgggaattgtttctatattactatcgagtctattgaaaaatgacgtaccgttggcaggaccattaatagcaggcgggatgttaatcgcttgttacgtcatatcaggaagttcagcagatttatcattggaaaaagctgccgaagtctcttgggaagaagaagcggaacatagtggagcatcacataatatacttgtagaagtgcaagatgatggtaccatgaaaattaaagacgaggaacgtgatgacaccttaacaattttattaaaagcaacactgttggctgtttcaggagtatatccactttctatacctgccaccctattcgtatggtacttttggcagaagaagaaacaacgatcaggtgtactatgggatactccaagcccgcctgaagtagaacgggcggtattagacgacggtatatataggataatgcaacgcggtcttctaggaagatctcaagtcggcgtaggagtatttcaagagaatgtattccacacgatgtggcacgtaacgagaggagctgtactgatgtatcaaggaaaacgtctagaaccttcgtgggcaagcgttaagaaagacttaatctcgtacggagggggatggcgcttacaaggttcctggaatacgggtgaagaagtccaagtcattgccgttgaaccgggcaaaaaccccaaaaacgtacaaactgcacccggaacgttcaaaacaagtgaaggggaggttggtgcaatcgcactagacttcaaacccggaaccagtggttctccgatagttaaccgtgaaggtaagatagtcggattatatggtaatggtgtagtgacgacgtctggaacttatgtaagcgcaatcgcgcaagctaaggcttcacaggaaggaccacttccagaaattgaaaacgaagtattcagaaagagaaatttaacaattatggatctacatcccggctcgggcaaaacacgaagatatcttccagcaatagtcagggaagcaatcaaacgaaaactcagaaccctcatactagcgccgactcgtgtagtcgcatcagagatggcagaagcactaaaaggaatgccaattcgttaccagaccaccgctgttaagagtgaacacaccggaaaggaaatagtagacctcatgtgccatgcgacttttactatgagattgctttcaccagttagagtccctaactataatatgataataatggatgaggcacacttcactgacccatcaagtatagctgcacgtggatatatttctacgcgtgtgggcatgggagaagcagctgctatcttcatgacagctacacctccagggtcagttgaagcatttccacaatcaaacgcggtcattcaggatgaggaacgagacataccagagcgaagctggaatagcggttatgaatggataacggactttcctggaaagacggtctggttcgtaccatcaataaaatcgggaaacgatatcgctaattgccttcgaaagaatggtaagcgagtaatacaattaagccgaaaaacctttgacactgaataccagaaaacaaagaataatgattgggattatgtagtaaccacagatatatcggaaatgggggctaatttcagagctgatcgtgttatagatccgagaaggtgcctaaaaccggttatattaaaagacggacctgagagagtaattctagctggaccaatgcctgtaacagtcgcttctgcagctcagagaagagggagaattggtagaaatcacaacaaggagggagaccaatacatatacatgggtcaaccacttaacaatgatgaggatcacgcacactggacggaggcaaaaatgctactagataacataaatactcctgaaggcatcataccagcattatttgaacctgaacgcgagaaaagtgcagctattgatggagaatatcgccttagaggggaagcaagaaaaaccttcgtagaactgatgagaagaggagatttaccagtctggttatcgtataaagtagcaagcgaaggctttcaatattccgaccgacgttggtgtttcgacggggaacgtaacaatcaagtactcgaagaaaatatggacgttgaaatatggactaaagaaggcgaacggaaaaagctacgaccccgctggcttgatgcaaggacgtactcggatccactagcactccgtgaatttaaagagttcgctgccggaagacgatctgtttcgggagaccttatattagagatcggaaaattgcctcaacatctcacacaaagagcacaaaatgcactggataacctagtaatgttacataatagcgaacaaggcggccgagcataccgccacgctatggaggaattacctgatacgatagaaacattaatgttgctagccttaatcgccgttctcacaggtggtgtgacactgttcttcctaagcggacgcggtctcgggaagacatcaataggattgctatgtgttatggcaagcagcgtactactgtggatggctagcgtagagcctcactggattgcagcatctatcatattagagttctttcttatggtattacttatccccgaaccagatagacaaagaacgccacaagataatcaactggcgtacgttgtaataggtctattatttatgattttgaccgttgccgcaaatgagatgggactcttagaaacgacgaagaaagatcttggtattggacacgtggctgtcgaaaaccatcaccatgcagcaatgttagacgttgatctgcatcccgcaagcgcatggacactatacgcagtcgcgaccaccataataacccccatgatgcgacacactatagaaaacaccacagcaaatatctcattaacagcgatcgctaatcaggctgcaatcctcatggggttagataaaggatggcctataagcaagatggacattggggtacccttattagcgctaggatgctacagtcaagtcaatcctctcaccttgacggctgcagttctaatgttagtcgcacactatgctataataggaccaggattacaggctaaagcaactagagaagcccagaagagaacagcggcaggaataatgaaaaatccaactgttgatggaattgttgcgatcgacttagatccagtagtttatgatgcaaaattcgaaaaacagttagggcagattatgttattaattttatgcacaagtcaaattttacttatgcgcaccacttgggctttatgtgaaagtattaccctagcgacaggtcctttgacaactttgtgggagggttccccgggaaaattctggaatacaacaatcgcggtatcaatggcaaatatttttaggggctcctacctcgctggagctgggttggcttttagcttgatgaaatctctaggaggcggaagacgtggaacaggagcacaaggcgaaacgttaggagaaaaatggaaaaggcaattaaaccaattatcaaagtcagaatttaatacatacaaaaggtcgggtataatggaagtcgatcggtcggaggcaaaagagggactaaaacgaggtgaaactactaaacacgcggtatctagaggaacagcaaaactaagatggtttgtagagagaaatcttgtcaaaccagaaggaaaagtgattgacttaggatgcggccgtggagggtggtcttactactgtgcgggactaaagaaagtaacagaagttaaaggctatactaaaggaggcccagggcacgaagaacctataccgatggcgacatatggctggaatttagtcaaattacactcagggaaggacgtcttctttattccccctgaaaaatgtgacaccctattgtgcgacattggggaatctagcccaaatcccacgatcgaggaaggtaggacactaagagtcttgaaaatggtagagccctggttgagaggtaaccaattttgtataaaaatacttaacccctatatgccatcagtggtagaaacacttgagcaaatgcagagaaaacacggcggcatgctggtacgaaatccattaagtaggaactccacacatgaaatgtactgggttagttgcggcactggtaacattgtaagtgcggtaaatatgacatccagaatgcttttaaacagatttacaatggcccatagaaagccaacctatgaaagagatgtagacttaggagcgggtacaaggcacgtagctgttgaacccgaagtagcaaatttagatataataggacagaggattgagaacattaaacatgaacacaagagtacctggcattacgatgaagataacccctacaagacttgggcgtatcatggaagttatgaagttaaaccatcaggaagtgcctcctctatggtaaatggcgtagtaaagttgcttacaaagccctgggatgtcataccaatggtcacgcaaatagcaatgacagatacgacaccattcggtcaacaaagggtcttcaaagaaaaagtggacacgaggacacctaaagccaaacgcggtacagcacaaattatggaggtgacagctaaatggctttgggggtttctttcccgcaacaagaaaccacgcatctgtactcgggaagagttcacacgtaaggtacgaagtaacgctgccataggagctgtattcgtagacgaaaaccagtggaactccgctaaagaagcagtggaagatgagcgcttctgggaccttgtacaccgagagagagaattacataaacagggaaagtgcgcaacctgcgtttacaacatgatggggaaacgggagaagaaacttggcgaatttgggaaagctaaaggctctagggcaatctggtatatgtggcttggagcccgctttctggagttcgaagcgttaggatttatgaacgaagatcactggttcagccgggaaaatagtttaagcggagtagaaggtgaaggtctacataaattgggatatatattacgcgatatatctaaaattccaggagggaacatgtacgctgatgacacagcggggtgggacacacgtataactgaagacgatttgcaaaacgaggcaaaaataacagacattatggagccggagcacgctctccttgccaaatctatttttaaattaacatatcaaaataaggttgtcagagtacaaaggcccgctaaaaatggcactgtgatggatgtgatctcgaggagagaccaaagaggatcggggcaagtgggaacatacggcttaaatacgttcactaacatggaggcacagcttattcgacagatggaaagtgaaggcatatttagtccatctgaattagaaacgcctaatctcgcgggacgagtactcgactggctggaaaaacacggagttgagcgattaaaaaggatggctataagcggtgacgattgtgttgtaaaacctattgatgacagatttgcgaccgctctaacagcattaaatgatatggggaaagtgcgtaaagatataccacaatgggaaccatcaaagggatggaatgattggcagcaagtcccgttttgctcacaccatttccaccaattgataatgaaagacggccgagagatcgtagtgccatgtcgcaaccaagacgagctcgtcggcagagcacgagtaagccaaggtgctggctggtcactacgagaaacagcttgtttaggtaaatcatacgcgcaaatgtggcaacttatgtattttcaccgacgcgatctgagattagccgctaacgccatttgctcggcggtgccagtcgactgggtaccaacttcccgaactacttggtcgattcatgcacaccaccaatggatgacgactgaagatatgttatcggtgtggaatcgcgtctggattgaagaaaatccctggatggaggataaaacccatattagcagctggggtgatgttccgtatctaggaaaacgagaggatcagtggtgtggatcactaataggactaaccgctagagctacatgggcgaccaacatccaagtagcaattaatcaggtcagacgcttgataggaaacgaaaactatctcgattacatgacttccatgaagcgattcaaaaatgaaagcgacccggagggagctttgtggtaa

SEQ ID NO: 21924 - RNA, 9879 nt, synthetic construct
  misc_feature 1..9879: note = derived and/or modified CDS sequence (opt6) from DENV-1__EU482478__SS-prME
  source 1..9879: mol_type = other RNA
agcgtaaccatgcttttaatgcttatgcctaccgcgctagctttccatctaacaacaagaggaggagaaccccacatgattgtaagcaaacaagaacgaggtaaatccttactattcaaaacttcagcaggagtaaacatgtgtaccctaattgcaatggatttgggggaactatgcgaagacacaatgacttataaatgccctagaattactgaaaccgaaccagatgatgtagactgttggtgcaatgcaaccgacacatgggtaacatacggaacatgtagccaaaccggtgaacacagacgagataaaagatcagtcgccctcgctccccacgtgggtcttgggctcgaaacgagaactgaaacatggatgagctccgaaggtgcttggaaacaaatacaaagggtagaaacatgggcactacgacatccaggttttaccgtaatagcactattcctggcacacgcaataggaacgtctatcacacaaaaaggaattatatttatcttattgatgttggttacaccttcaatggcgatgaggtgcgttggaattggatctagggatttcgttgaagggctatctggagctacttgggttgacgtagttctagaacacggatcatgcgttacgactatggctaaagataaaccaaccctcgatattgaacttttaaaaacggaagtaactaacccggccgtcctaagaaaactatgtatagaagcaaaaatatctaacacaactacagattcaagatgtccaactcaaggagaagcaaccttagttgaagaacaagatgcgaactttgtgtgccgacggacattcgtagaccgaggatggggaaatgggtgcgggttgtttggaaaaggatctttaataacatgtgccaaattcaaatgtgtaactaaactagaaggaaaaatagtgcaatacgaaaatcttaaatactcggtgatagtcactgtacacacaggcgaccagcatcaggtgggaaatgagagtactgagcacggaacaacagctacgatcacccctcaagcaccaacaacagagatacaattaaccgactacggggcacttacgctcgattgttcccctagaactgggcttgactttaacgaaatggtgctcttgacaatgaaagagaaaagctggttagtacataaacaatggtttttagatctaccactgccatggacgtcaggcgcttcgacatcgcaggaaacatggaaccgccaggacttacttgtaactttcaagacagcccacgcgaaaaagcaggaagtcgttgtgcttggatcacaagaaggagcaatgcatactgctttaacaggtgctacagagatacaaacctcgggtacaacgacaatttttgctggacatcttaaatgtcgtttgaaaatggataaactaacacttaaaggtatgagttacgttatgtgtactgggtcctttaaattagagaaggaagtagcggaaacacagcacggtacagtacttgtccagataaaatatgaaggtacagacgcaccctgtaaaataccttttctaacccaagacgagaaaggggtaacacagaatggtagactgataaccgcaaacccgatagtgaccgataaggagaaacctgtgaacatcgaagcagaacctcccttcggcgaatcctatataatcatcggtgcaggagaaaaagcactcaaattgagttggttcaaaaagggttcaagtataggtaaaatgtttgaagcgactgctcgcggtgcacgcagaatggccattctgggcgatacagcatgggacttcggatccattgggggtgtcttcacgagtgtaggaaagttagttcatcagattttcggtacagcatatggcgtcttattttcaggtgtgtcatggacaatgaagatagggatcggggtattgcttacttggttgggtctaaattctagatcaacttcattatctatgacatgtatagctgtaggcttagttactttatacttgggtgtcatggtacaggctgatagtggatgtgtcatcaactggaaaggacgtgaattaaagtgtggaagtggcatattcgttaccaacgaagtacatacgtggaccgaacaatacaaattccaggcagactcgccaaaacgtctgtcagccgccataggaaaagcatgggaagagggggtctgtggtatccgtagcgcaacaagactagaaaatataatgtggaaacaaataagtaacgaattaaatcacatattgctagaaaatgatatgaagtttacggtagtagtaggagatgtagccggaattttggcacaaggcaagaaaatgattagacctcagccgatggagtacaaatattcttggaaatcttggggcaaagcaaagataataggcgccgatgtccaaaatactacgtttattatagatgggcctaacacaccagagtgccccgacgatcagagagcttggaatatctgggaggtagaggattatggttttggaatttttacaacaaatatttggcttaaacttcgggattcgcatacacaagtatgtgaccatagactcatgtcggctgctatcaaagactccaaagctgtacacgcggacatgggctactggattgaatcggagaaaaatgaaacgtggaaattagcccgcgcctcatttattgaagtaaaaacctgtatatggcccaaatcacacactttatggagcaatggagtattggaatcagagatgatcatacccaaaatatacggaggcccgatttctcaacacaactatcggccagggtattttacccaaacggcgggcccatggcatttaggaaaacttgagctagattttgacttatgcgaaggaacaactgtagtagtcgacgaacattgtggcaacagaggccccagtcttcgcacgaccactgttaccgggaaaatcattcatgaatggtgctgtagatcatgtacactaccacccttaaggtttagaggtgaagatggttgttggtatggaatggaaattagaccagtaaaggaaaaagaagaaaatttagtcaagtctatggtttccgcaggatcaggagaagtcgactcattctccctcggtctactgtgtatatctataatgatagaggaggtgatgagatcacgttggtcgagaaaaatgcttatgaccggaacattagcggtgttctttttgcttatcatgggacaactgacctggaacgatctaatcaggttgtgcataatggtcggtgccaatgcctccgatcgaatgggcatggggacaacatatttagcactcatggcgacctttaaaatgcgcccaatgtttgcagtcggactactatttcgtcgcctgacatcaagggaagtgttacttttaacaattggcctatcgttagttgcatccgtcgagctcccaaatagtctggaagaattaggtgacgggctcgctatgggcataatgatcctaaaattactaacagattttcagtcgcatcaactgtgggcaactttacttagtttaacatttattaaaactacattttctttgcactatgcctggaaaactatggcaatggtactatcgatagtcagcttatttcccctatgtctatctacaacttcacagaaaacaacatggttaccggttttactaggaagtttaggatgcaaaccattaacaatgttcctgatagcagagaacaaaatatggggaagaagatcctggcccttgaatgagggaattatggcggttggaatagtgagcatactcttatcgtcactcttgaaaaatgatgtccctctagctggtccactaatagccggtggaatgttaatagcctgttatgtgatttctggatcaagcgccgacctttcattggaaaaagctgcagaagtttcgtgggaggaagaagcagagcatagtggagcttcgcataatatattagtagaagtccaggatgatgggacgatgaaaatcaaagatgaagaacgcgatgacactttaactatcctgttgaaggcaacacttttggctgtatctggcgtatatcctttatccataccagcgactttatttgtatggtatttttggcagaaaaagaaacaaaggtctggggtactctgggatactccgtccccgccagaggtagaaagagcagtattagatgacggaatttataggatcatgcagcgcggactccttggaagaagtcaagttggggtaggagtattccaagaaaatgtcttccatactatgtggcacgttacacgaggtgcagttctcatgtaccaaggcaaacgtcttgaaccctcttgggcatccgtgaagaaagatctcatatcctatggagggggatggcgcctacaaggatcatggaacacaggagaagaagttcaggtgatagcggttgaacccgggaaaaatcctaaaaatgttcagacagcccctggaacgtttaaaacaccagagggagaggttggcgcaatcgcgctagactttaagccggggacgagtggctctccgattgtaaacagagaaggcaagattgtagggttatatggcaacggagtggtcactacctccggaacttacgttagtgctattgcccaggctaaagcatctcaagaaggccctttacctgagattgaagacgaggtcttccgaaaaagaaatctaacaattatggatctacacccaggatcgggaaaaacaagaagatatctaccagcaatcgtacgagaagcgatcaaaagaaaactacggacactaatacttgctcctactcgtgtcgtagcgagtgaaatggccgaggcattaaaaggcatgcctataaggtaccaaactaccgcagtcaaatcggaacacacagggaaagaaatagtggacttgatgtgccatgccacatttacaatgagacttttgagcccagtaagagttccaaattataatatgataataatggatgaagctcatttcacggatccaagctcaatagccgcgagaggatacataagtaccagagtaggcatgggcgaagccgccgctatatttatgacagcaacaccccctggcagcgttgaagcattcccacagagtaacgccgttatacaagacgaagaaagggatatccctgaaagatcatggaactcggggtacgagtggattacagattttccgggaaagacggtatggttcgtaccgagtattaaaagtggcaacgacatcgccaattgtttaaggaaaaatggcaaacgggtaattcaattatctaggaaaacgtttgatacagagtaccagaaaacaaagaacaatgattgggactacgtagtaacaacagacatatcagaaatgggagctaactttagagcggatagggttatagatccacggagatgcctaaaaccagttatcctcaaagatggtccagagagggtgatcctcgcaggaccaatgcccgtaacagtcgcatcggcagcacagagaaggggtcgtatcgggcgcaaccataataaggaaggagatcaatacatatacatgggacaacctctgaacaacgatgaagaccacgctcattggaccgaagcaaaaatgttgctagacaatataaatactccagaaggaataatacccgcattattcgagcctgaacgtgaaaaatcagcggcaatagatggagaatatagacttcgaggagaagcacggaaaacttttgtggaactcatgaggagaggggatttacctgtctggttatcttacaaagttgcatcagagggcttccagtatagtgacagacgctggtgttttgacggagaaaggaataatcaagtcttagaagaaaatatggacgtcgagatctggactaaggaaggtgaaaggaaaaagctccgcccacgatggctagatgctcgcacatattcagatcctttagcattaagagagtttaaagaatttgctgcagggagaagatccgtatcaggtgatttgatccttgaaataggaaaattacctcaacatttaacgcaaagagcccaaaatgctttggataatctagtcatgctccacaacagcgaacagggagggcgcgcttatagacatgccatggaggaactaccagataccatcgaaactttaatgttattagcattaatcgctgtactgacaggtggagtaacactgtttttccttagtggccgtggattgggtaaaacatcaataggacttttatgtgtaatggcttcctctgtactactatggatggcatcagtagaaccacactggatagcagcgtcaatcatactggagttctttctaatggtattactgataccagagccagaccgacaacgtacgccacaagataatcaattagcgtatgtcgtcataggattactatttatgattctgacagtagcagcgaatgaaatgggactgcttgaaacaaccaagaaggacctaggcataggacatgtagcagtagaaaatcatcatcacgccgccatgcttgatgttgacctccatccggcttcggcgtggaccttatacgcagtagcaacaactataataacaccaatgatgcgtcacacaatagaaaatacaacagcaaatatttctctaaccgcgattgcgaaccaggcagcgatcctaatgggacttgacaaaggttggcccatttcaaaaatggacatcggcgtaccactactggcgctaggttgttatagtcaggtaaacccgctcaccttgaccgcggcagtattaatgctagtagcacattatgccatcattggtcctggactacaggccaaagcaacgcgagaagctcaaaagcgaacggcagccggtataatgaaaaatcctacagtagatggaattgttgcaatagatctagaccctgtcgtttatgacgcaaaattcgaaaaacaactcggacagataatgttattgatactttgtacgtcacaaatactactcatgagaaccacgtgggcattgtgcgagtcaataacactagctacaggacccctaactactttatgggaagggagccctggtaaattctggaatacgacaatagcagtgagtatggcaaatattttcaggggcagttatctcgctggagcaggtctagcattcagtcttatgaagagtttaggaggtggacgacgtggcaccggagcccaaggtgaaactcttggagaaaagtggaaacgacaactaaaccaattaagcaaaagcgagttcaatacgtataagagaagtgggataatggaggtcgacaggtctgaagccaaagaaggactcaaaagaggcgaaactacaaagcatgcagtatcacgaggaaccgcaaaattgagatggttcgtagaaaggaatctcgtaaaaccagaaggaaaagtaatagacttagggtgtggaagaggtggatggagctattactgtgcagggcttaaaaaggtcacggaagttaaggggtatactaaaggcgggcccgggcatgaagaaccaatcccaatggctacctatggttggaatttagtgaaattacacagtggtaaagacgtgttctttattccgcccgaaaaatgcgacacactattgtgtgatatcggcgaaagtagtccaaatccaactatagaagaaggaaggactttacgagtactcaaaatggtggagccctggctcagaggtaatcagttttgtataaaaatattgaatccttatatgcccagtgtagtggaaacactagaacagatgcaaagaaagcacggcggaatgcttgtaaggaatcctctctcccgaaatagtacacacgagatgtactgggtaagctgtggaaccggaaatatagtctccgctgtaaatatgacgtccagaatgctactaaacaggttcacgatggcccaccgcaaacctacatatgaaagagacgtagatttaggagctggtacaagacacgtagccgtagaaccagaaattgctaacttagacataattggtcaacgcattgaaaatataaaacatgaacacaaaagtacttggcactatgacgaagacaatccatacaaaacatgggcttatcatggatcttacgaagtgaaaccttccggcagcgcaagttctatggtgaacggggttgtaaagttactgacaaaaccgtgggatgtaataccaatggtaactcaaatagcaatgaccgatactaccccttttggccaacagcgtgtttttaaagaaaaagtagatacaaggacacccaaagcgaaaaggggaacagctcaaatcatggaagttacagccaagtggctatggggcttcctcagtcggaataagaaacctcgtatatgtacacgagaagaatttacacgcaaggtgagaagtaatgccgcaattggagctgtcttcgttgatgaaaaccaatggaactcagcaaaggaagcagttgaagatgaaaggttttgggacctcgtgcatcgcgaacgggagttacataaacaaggaaaatgtgctacatgcgtatacaatatgatgggcaaacgtgagaagaaattaggagagttcggaaaagctaaaggtagccgagcaatatggtacatgtggttaggagctcggtttctggaatttgaagcactaggatttatgaatgaagaccactggttctctcgggagaacagcctaagcggcgtcgagggtgaaggactacacaaattaggatatatcttgagagacatttccaaaatccctggcggtaatatgtacgcggatgatacagctggatgggacacgagaattactgaagacgatttacaaaacgaagcaaggataacagatataatggagccggaacatgctctcctagcaaaatctatatttaagctaacctatcagaacaaagttgtacgagtacaaagaccagccaagaatggaactgtaatggatgtaatatccagaagggatcaaagaggtagcggacaagtggggacatatggacttaatacttttacaaacatggaagcacaattaatacgacagatggagagcgaagggatattttccccaagcgagctcgaaactccgaatctagctgagagggtgctggactggttagagaaatatggagttgagagactaaaaagaatggcaataagcggagacgactgtgttgtcaagccgatagacgaccgttttgcaaccgctctaactgcattaaacgacatggggaaagttcgtaaagatataccacagtgggagccatcaaagggatggaacgattggcaacaagttccattctgttcccatcattttcaccagcttataatgaaggatggaagagagatagtggtaccgtgtagaaaccaagatgagctagtagggagggctcgtgtcagtcaaggggcaggctggagcttaagagaaacagcgtgtttaggtaaatcttatgcccaaatgtggcaactaatgtattttcacagacgagacctccgcttagcagcaaacgccatctgttcagctgtccctgtagattggataccgacttccaggactacctggagcatacatgcccaccatcaatggatgacaaccgaagacatgcttagtgtatggaacagagtttggatagaagaaaatccttggatggaggacaaaacgcacatcagtagttggggtgacgttccttatctcggtaagcgagaagatcaatggtgcggcagcctgataggattaacggcaagagcgacatgggcaaccaacatacaagtagccattaaccaagtgcgaagactaataggtaacgaaaactacctcgactatatgacgtcaatgaagagatttaaaaacgaaggagatccagaaggcgccctgtggtag

SEQ ID NO: 21925 - RNA, 9879 nt, synthetic construct
  misc_feature 1..9879: note = derived and/or modified CDS sequence (opt6) from DENV-1__EU482479__SS-prME
  source 1..9879: mol_type = other RNA
tctgttacgatgctgctaatgcttatgcccactgcattagcattccatctaactacaagaggaggggaaccccacatgatagtgagtaaacaagaacgaggaaaatccttactctttaaaacatctgctggtgttaatatgtgtacattaatagcgatggatctaggagaactatgcgaagatactatgacctacaaatgtcccagaattacagagacagaaccggatgatgtggattgctggtgtaatgcgacagatacctgggtcacttatggtacatgctcacaaactggggaacaccgacgagataaacgctctgtagcgctagcaccacatgttggcttaggcttagagacacgtacagaaacatggatgtcatcggagggggcatggaaacaaatacaacgtgtagaaacatgggcattacgacaccccggatttacagtaatcgctctctttctggctcacgcgatcggaacaagtattactcaaaaaggaattatttttattttactcatgttggtaactccatcaatggccatgcgatgtgtgggtataggaagcagggacttcgtcgaaggactttcaggagcaacatgggtagatgttgttttagaacatggaagttgcgtaaccactatggcgaaagataaacccacactcgacattgaacttctaaaaactgaggtaacaaatcctgcagttctgcgcaaattgtgtatcgaagcgaaaatctcaaatacaacaacggatagccgctgccccactcaaggagaagcaaccttggtcgaagaacaagatgcgaatttcgtgtgtcggagaacattcgtcgaccgtggctggggtaatggatgcggccttttcggaaaaggcagcttaatcacgtgcgcgaaatttaaatgcgtcacgaaattggaggggaaaatcgtgcagtatgagaatcttaaatatagcgttatagtaacagtacatactggtgatcaacatcaagtcggcaacgaatcaacagaacatggcactacggctaccataacgccccaagccccaacaaccgagatccaattaacagattacggcgcccttacactagattgtagtccccgaactggtttggattttaatgaaatggtactattaacaatgaaagagaaaagttggctagtacataaacaatggtttctcgacttgccactaccttggacatcaggcgcatcaacatctcaggaaacgtggaacagacaagatctactcgtaaccttcaaaactgcacacgccaagaaacaagaggtagtcgtactaggatcacaagaaggggcaatgcataccgcgttgaccggagccactgaaattcaaacaagcggtacaacgacaatatttgcaggacacttaaaatgtagactcaaaatggacaaacttactctaaagggaatgagctatgttatttgtactggctcatttaagctcgaaaaagaagtggctgagactcaacatggcaccgttcttgttcaaattaagtatgaggggacagacgcgccgtgtaaaataccatttagcacacaagacgaaaaaggcgtaacccaaaatggtagactcatcacagccaatccaatagtaacagacaaagagaaacccgtaaatatcgaggccgagcccccgttcggagagagctatataattatcggggcgggagagaaagcactaaagttatcctggtttaagaaaggcagcagtattgggaaaatgtttgaggcaaccgcaaggggagcgcgccgcatggcaatattaggcgacaccgcatgggacttcggctccattggaggtgtgtttacttcagtgggtaaattagtacaccaaatattcggtactgcgtatggggtcttattcagcggcgtctcatggaccatgaaaataggtatcggcgtgctactgacttggcttggccttaatagccgttcaacaagtctaagcatgacgtgcatagcagttggtttagttacactctatctaggagttatggtgcaagctgatagtggttgcgttattaattggaaaggaagagagcttaaatgcggctctggcatcttcgtgacaaatgaagtccatacctggacagaacaatacaaatttcaagcagactcacccaaacgattgtcggcagccatcggaaaagcatgggaagagggagtttgtggcataagatcagcaacaaggctcgaaaacattatgtggaaacaaatttcaaatgaactaaatcatatattactggaaaacgatatgaagtttactgttgtagttggagatgtagcggggatactagcacaaggtaagaaaatgattaggccgcagccaatggagtataaatattcctggaagagttggggaaaggctaaaataattggcgcagatgtgcaaaacacgacgtttatcatagacggccctaatacgcctgaatgccccgacgatcaaagagcatggaatatatgggaagttgaagattatgggtttggaatcttcacgacaaatatatggctaaaacttcgagattcccatacccaagtatgtgatcataggcttatgagcgctgcaataaaggacagcaaagcggttcatgcagatatgggttattggatagagtccgagaaaaatgagacatggaaattggcaagggcttcatttattgaggttaagacatgtatctggcctaaatctcatacgttatggagtaacggtgtattagaatctgaaatgatcattcccaaaatttacggaggtccaatctcacaacacaactatagacccggatacttcactcaaactgcaggtccatggcatctaggtaaactagaactcgacttcgacctttgtgaaggcactactgtagtagtggatgaacactgtggcaatcggggtccgagtctacgtacgaccacagtgaccggaaaaataattcacgagtggtgctgtcgctcatgcaccctaccaccgctgaggtttagaggagaagatggttgctggtacggcatggagataagaccagtaaaagaaaaagaagaaaatctagtgaaatcaatggtgtccgctggaagtggtgaagtagatagtttctcattggggctactttgtatttctataatgatagaagaagtgatgcgatccaggtggagcaggaaaatgctgatgacgggaactctagcagtattctttttattaattatgggccaactcacatggaatgatttaattagattgtgtattatggtaggcgcgaatgcttctgatagaatgggaatgggaaccacttatctagcgctgatggcaacctttaaaatgagacccatgtttgcagtaggtttgttgtttcgaagattaacttcccgtgaagtgctcttattaacaatcggattatcgttagtggctagtgtcgaacttcctaacagtcttgaagagttaggagacggcttggctatgggtatcatgattctaaagctactcactgattttcagtctcatcaattatgggcgactctattatctttaactttcataaagaccaccttttctttgcattatgcatggaaaacgatggcaatggtactaagcattgtctcattgttcccattatgtctttcgaccacgtctcagaaaactacatggctccccgtattacttggctcactcggttgtaagccgctgaccatgtttctgatagccgagaataagatttggggacggagatcttggccgttaaacgaaggcataatggctgtgggtatagtcagtattcttttaagttctttactcaagaatgacgttcccttagccgggccactgattgcaggagggatgctaatagcgtgttacgttatctctggttctagcgctgatctttctctagaaaaagcagcagaagtttcatgggaagaggaagctgaacactccggtgcttcacacaatatcttagtagaagtacaagatgacggaactatgaaaatcaaggacgaggaacgtgatgacacactcacaattctactaaaggccacgctcctcgcggtttcaggtgtatacccactttccataccagctacactcttcgtatggtacttctggcaaaagaagaaacaaaggtcaggcgtgttgtgggatactccaagccctccggaggttgagcgggccgtattagatgatggaatataccgaataatgcaacgtggactacttggtagaagtcaagttggtgtaggtgtattccaagaaaatgtctttcatacaatgtggcatgtaacacgaggagctgtcctcatgtatcaaggtaaaaggttagaacccagctgggccagtgttaagaaggacctaatttcatacggcggaggctggcgtttgcaaggtagctggaacactggagaggaagtccaggttatcgcggttgagccaggcaaaaatcctaaaaatgttcaaacggcacctggcacttttaaaacacctgaaggtgaagtcggggcgatagcattggactttaaaccgggtacgtctgggtctcctattgtgaatagagagggtaaaatagtaggattatatgggaacggcgtcgtgactacaagtgggacctatgtgtcagcaatagcacaggcaaaagccagccaagaaggccccttgcccgaaatagaggatgaagtttttagaaaaagaaatttgaccatcatggacttacatcctggatccggaaaaacaagaagatatctaccagcaattgtgagggaagcaattaagagaaagctacgtactttgattttagccccaacaagggttgtcgcatcagaaatggcagaagccttaaaaggtatgccaataagataccaaaccactgcagtcaagtcagaacatacaggaaaggaaattgtagatttaatgtgccatgccacgtttacgatgagactactctcaccagtcagagtaccaaattataatatgataatcatggacgaagctcattttacagatccctcctctatagcagctagaggctacatttcaacaagagtaggaatgggagaagcagcggcaattttcatgactgcaactccccctggatcggtggaagccttcccacaaagtaatgcagtcattcaagatgaagaacgcgatattcctgaacggagctggaacagcggctatgaatggataaccgactttcctgggaagacagtttggtttgtgccatctatcaaaagtggcaacgatatagcaaactgtctgaggaaaaatggtaaaagagttattcagctctcacggaaaacattcgacacagaatatcagaaaaccaaaaacaatgattgggactacgttgttacaaccgatataagtgagatgggggctaacttcagggctgacagggtgatagacccacgtcgctgtttgaaaccagtcatattaaaagacggtccagaacgagtaatacttgcaggtccaatgccggttaccgtagctagtgcagcacagagaagaggaaggataggaagaaatcacaataaagaaggtgaccagtatatctatatgggccaacctttaaataatgatgaagatcatgcccattggacggaagctaagatgctcttagacaatattaatacccctgaaggaataatacctgcactatttgagccagaaagagaaaaatctgcagctatagatggagagtaccgattgcgtggggaagcaagaaagaccttcgttgaattaatgagacgaggagatttaccagtgtggctttcatacaaagtagcaagtgaaggctttcaatacagcgatagacgctggtgttttgatggtgaaagaaataaccaagtcctagaggaaaacatggacgtagagatatggactaaagagggcgaacgtaaaaagctcaggcccagatggctagacgccagaacatatagtgatccgctggccttacgcgaatttaaggaatttgcagccggacgcagatccgtatcaggagatttaattctagagataggaaaacttccacagcatctaacacagcgggcccaaaacgctttagataatttggtaatgttacataactcagaacagggtggtcgagcatatagacatgctatggaagaactacctgacactatagaaacactaatgttattagccctaatcgctgtattaactggaggagttacactattctttttaagcggaagaggactcggtaagacgtcaatcggattactctgcgttgtggcctcaagcgtacttctatggatggcatccgtcgagccgcattggatagcagcgtcgattatccttgaatttttcctaatggtgcttctcatcccagaacctgatagacaaagaacgccacaagacaaccaacttgcgtatgtcgttatcggccttctatttatgattctgactgtagctgcaaatgaaatgggactattagaaacaaccaagaaagatctcggtatcggacatgtagcggttgaaaatcaccatcacgcggctatgttggatgtagatctacatccggcttcagcctggacactttacgcagtggctacaactataatcacacctatgatgagacatactatcgaaaacacaacagctaatataagccttacagcaattgccaatcaagccgcaattttaatgggtctggacaaagggtggccaatatccaaaatggatatcggagttccattactcgctcttggctgttattcgcaggttaacccattaactcttacagcagctgttctaatgcttgtagctcattatgccataataggcccgggactacaagcaaaagccacccgagaagcacaaaagagaacggcggctggaattatgaaaaatccaactgtagacggtattgtagctatcgacttggatcctgttgtatatgacgctaagtttgaaaaacaactaggacaaataatgctgttgatactttgcacatcgcaaatactcttaatgagaacaacgtgggcactatgtgaatccatcacactcgcaacagggccgttgactacattatgggaaggctcgcccgggaaattttggaataccacaatagcggttagtatggcaaatatttttagaggctcttatctagctggagcaggacttgccttttcactaatgaagtcactgggcggtggaagaagaggaactggagcacaaggtgaaactttaggggaaaaatggaagagacaactgaatcaactctctaaaagtgagttcaacacatataaaagatcgggtattatggaggtcgacagaagtgaagcaaaagagggtttgaaacgaggggaaacaaccaaacacgctgtaagtagaggaactgccaagttaagatggtttgtagaaagaaatctcgtaaagccagaaggtaaggtaattgatttaggttgcggccgaggtgggtggtcatactactgcgcaggactcaagaaagtaacagaagtgaagggttatacaaaaggaggaccgggccatgaagaacccattccaatggccacatacggttggaacctggtaaaattacactctggcaaagacgtgttctttatcccacccgagaaatgtgacacgctattatgcgacatcggtgaatcgtcgccaaacccaactattgaagagggtagaactttaagagtgttaaaaatggtagagccgtggctgcgaggaaatcaattttgtataaaaattcttaacccgtatatgccgtcggtcgtggaaacattagagcaaatgcaaagaaagcacggtgggatgcttgtaagaaacccgctttcccgaaactccacgcatgaaatgtactgggtctcatgtggaacagggaatatagtgtctgcggttaacatgacatcccggatgctactgaaccgcttcacaatggcacaccgtaagcccacatacgaaaaagatgtagatttaggtgccggaacgagacacgttgcagtcgaaccggaagtcgccaatctagatattataggccaaagaatagaaaacattaagcatgaacacaaatcgacttggcattatgacgaggacaatccttataaaacttgggcataccatggatcatacgaagtaaaaccaagtggttccgcttcctccatggttaatggtgtggtaaaactactgactaaaccctgggacgtaattccaatggttacgcaaatagcaatgacagacacaacccctttcggacagcagagagtattcaaagaaaaagtagatacaagaacacccaaggcaaagagaggaactgctcaaataatggaagttaccgcaaaatggttatggggcttcttgtcccgcaataagaaaccgcgcatttgtactcgggaagagtttacacgtaaggtcagatcaaacgcagctataggggcagtttttgtggatgaaaatcaatggaactcagcaaaagaggctgtggaagacgaaagattctgggacctagtacatagagaaagagaacttcataaacaaggcaagtgtgcgacatgtgtatataatatgatgggtaaacgagagaagaaacttggagaatttggaaaagcaaaaggttcaagagccatatggtatatgtggttaggtgccaggttccttgaatttgaagcattgggatttatgaatgaagatcattggttttcccgcgaaaacagcttaagcggagtagaaggagaaggactacacaaactgggatatatacttcgtgacatatctaaaatccccggagggaacatgtatgctgatgataccgccggatgggatactagaataactgaagatgatctccagaacgaagcacgaattactgacataatggagccagaacatgcgttactagccaagagtatatttaaattgacttatcagaataaagtggtacgcgtccagcgtccggctaagaacggtaccgtaatggatgtgataagcagaagagaccagagaggaagcggacaagtgggaacgtatggcttaaatacatttacaaatatggaagcccaactgatccgacaaatggaatccgaggggatattctcgccctccgaactagaaacacccaatctcgccgaaagagtactagattggctaaagaaatacggagtagagaggcttaagagaatggcgattagtggtgatgactgcgtcgttaaaccgatagatgatcgatttgccacagcactaacagcgttgaacgatatgggaaaggtgcgtaaagacatacctcaatgggaaccatccaaaggttggaatgattggcaacaggtccccttctgctctcatcatttccatcaattaattatgaaggatggaagagagattgtagtaccatgtcgtaatcaagacgaattagttggtcgagcaagagtttcacaaggagcaggttggagtctgagagaaacggcatgccttggaaaatcatacgcacagatgtggcaattgatgtactttcatagacgcgatctaaggttagcagctaacgctatttgttccgcggtacccgttgactggatacctacaagcagaaccacttggagtattcatgcccaccatcaatggatgactacagaggatatgctatcagtgtggaacagggtctggattgaagaaaatccatggatggaggataaaacacatattagttcgtggggtgatgtgccatatctcggaaaacgagaagaccaatggtgtggctctttaataggtctcacagcaagggcaacttgggccacgaatattcaagtagcaatcaatcaagtacgtcggctaataggaaacgaaaactacctagactacatgacgtccatgaaaagattcaaaaacgaaggcgacccagaaggtgcgctgtggtaa

SEQ ID NO: 21926 - RNA, 9879 nt, synthetic construct
  misc_feature 1..9879: note = derived and/or modified CDS sequence (opt6) from DENV-1__EU482480__SS-prME
  source 1..9879: mol_type = other RNA
tcagtaacgatgcttctcatgttaatgccaactgcattggcgtttcacctaacgacgagagggggagaaccacacatgatagttagtaaacaagagcgcggaaaatcattattattcaaaacatccgctggagtaaatatgtgcacgttaatcgccatggatttgggagagttttgtgaagatacgatgacttataaatgccctagaatcacggaggccgagccagacgacgttgactgctggtgcaatgccactgacacttgggtgacttacggtacttgtacccaaattggagaacaccgaagagataaacgttcggttgccttggcacctcatgttgggttggggcttgaaactagaacagaaacatggatgagttctgagggagcttggaaacaaatacaaagagtggaaacttgggccttgcgacatcccggctttacagtcatcgcccttttccttgcacacgcaatcggtacatcaataacacaaaaaggaataatatttattcttctaatgttagctacccctagcatggctatgcgatgcgtgggtatagggtcccgtgattttgttgagggactatccggagcgacgtgggtagatgtagtactcgaacacggctcttgtgtgacaacaatggcaaaagataaaccgacgctcgatatcgagctattaaaaactgaagtcacaaatccagcagtgttgagaaaactatgtatagaggccaaaatctccaatacaacgactgattcgaggtgcccaacgcaaggggaagcaacattagtagaggaacaggatgcaaattttgtatgcagacgcacctttgtagatcgaggctggggaaatgggtgtgggctatttggaaaaggtagtctgataacctgcgccaaattcaaatgtgttacaaagttagaaggaaaaattgtccagtatgaaaatttaaaatactcagtaattgttacggtacacacgggggatcaacatcaagtaggaaatgaatcaaccgagcatggcacgatagccaccattacaccccaagctcctagcactgaaattcagctcactgactatggtgctttaaccctagattgttcaccaagaacgggactagactttaatgaaatggtactactaactatgaaggagaaatcatggctggttcataaacaatggttcctagacttaccattaccttggaccagcggtgcaagtacatcacaggaaacgtggaacagacaagatcttcttgtaacttttaaaacagcacatgccaagaaacaagaagtggtcgtattaggctctcaagagggggcgatgcacaccgcgctaaccggagccacagaaattcaaacatcgggaacaacaacgatctttgccgggcacctcaaatgtaggttaaaaatggacaaactaacattaaaaggcatgagttacgttatgtgtacaggatcatttaaattagaaaaagaggtagctgaaacgcaacacggaactgtattggttcaaatcaaatatgagggtactgacgcaccttgtaaaattcccttttcaactcaagacgaaaaaggagtcactcaaaatggacgtcttataactgctaatcctatcgtcaccgataaagaaaagccggttaacatcgaagccgaacctcctttcggtgaaagttatattgttattggagctggggagaaggcactcaaattatcatggttcaaaaagggatcatcaattggcaagatgttcgaagctactgcacggggagcacgaagaatggcaatattaggcgatacggcatgggactttggaagtataggtggagtattcactagcgtgggtaaacttgtgcaccagatattcggcaccgcttacggagttttgtttagtggtgtgtcatggacaatgaaaatcggtattggagtgttattaacatggctagggttaaattcaagatcaacaagtctttcgatgacctgtatagctgtagggttagtgacgctataccttggagtaatggtgcaagcggattcaggatgcgtgattaattggaaaggacgagaactaaaatgcggtagcggaatttttgtgacaaacgaagtccacacatggactgagcaatacaaattccaagcagactcacccaaacgattgtctgctgcaatcggaaaagcctgggaggaaggcgtatgtggtattcgctcagcaacgcgattagaaaatatcatgtggaagcaaatatctaacgaattgaatcatatccttttagaaaatgatatgaaactcacagtggttgttggggacgtagcaggtattcttgcccaaggtaagaaaatgataagaccacagccaatggaatataaatatagctggaaaatctggggaaaagcaaaaataattggcgctgacgtccaaaatactaccttcataatcgacggacctaatacaccagaatgtccggacgatcaaagagcatggaacatttgggaagttgaagattatggcttcggtatatttacgacaaatatatggctaaaactgcgtgattcatatacccaggtatgtgatcaccggctcatgtcagctgctataaaggacagcaaggcagtacatgcggacatgggatactggatagaaagcgagaaaaatgaaacctggaaattagcgagagcaagtttcatagaagtcaaaacctgtatatggcccaaatcacatacactttggtccaatggagtactggaatcagaaatgattataccaaaaatctacggagggcctatatctcaacataactatcgtcccggatattttactcaaactgcgggaccttggcatttgggaaaattagaattggattttgatttatgtgaaggtacaacagtggttgtagacgaacactgcggcaacaggggaccatctttaagaacaacaactgtcactgggaagatcattcacgaatggtgttgtcgttcatgtaccctaccacctttaaggtttaaaggagaagatgggtgctggtatggtatggaaattagacctgtgaaagaaaaggaagaaaatcttgtaaagtcaatggtatcggccggttcaggagaagttgatagcttctcactaggacttttatgtattagtattatgatagaagaagttatgaggagtaggtggtctcgaaaaatgctaatgactggtacgcttgccgtattctttctcttaatcatggggcaattaacttggaacgatttgattaggctatgcattatggtaggagcaaacgcaagtgatcggatgggaatggggacaacttatttagctctaatggcaacctttaaaatgaggcctatgttcgcagttggcctcttgtttagacgattgacctccagggaagtgcttcttctcacgatcggattaagcctagtagcttcagtagaactaccaaatagtctagaagaactgggggacggcctagctatgggaattatgattcttaagttactaacggatttccaatctcatcagctctgggcaacactactttcactcacctttattagaacgaccttcagtctacattacgcatggaagacaatggcgatggtcttaagcatagtttccctatttccattatgcctatctactacaagccagaaaacaacttggttaccagttttactgggctctttggggtgtaaaccattaaccatgtttctgatagcagaaaacaaaatctggggccgtaagtcttggcccttaaatgaaggtattatggccgtaggtatagtgagtattctcctatcttctttactgaaaaatgacgtaccactagcaggaccattaattgcagggggtatgctgattgcctgctacgttatatcaggctcatctgcagatctttccttagaaaaagccgccgaagtatcttgggaggaagaagccgaacattctggggcgagtcacaatatcttagtagaggtacaagatgacggaacaatgaaaattaaagatgaagaaagagatgacaccctaacaatactgctaaaagcaacactacttgccgtaagtggtgtgtatcccttatctataccagctacacttttcgtctggtacttttggcagaaaaagaaacaacggtccggagtactgtgggacactccctcgccccctgaagtagaacgtgcggtgctagatgatgggatttatagaataatgcaaaggggattactgggtagaagccaggttggtgtaggagtgtttcaggaaaatgtatttcatactatgtggcacgtaaccagaggggctgtacttatgtaccaaggtaaaagattggaacctagttgggcatccgtcaagaaagatcttatttcgtacggtggcggatggagactacaaggtagctggaacacgggagaagaagtccaagtcatagcagtagagcccggcaaaaacccgaaaaatgtacaaacggctccaggaacatttaaaacgtcggaaggagaagtaggagctattgcactagattttaaaccgggtacatctggctccccaatagtgaatcgcgaaggaaagatagtgggtctatatgggaatggagtagtaacgacaagcggtacctatgtatcggctatagcccaagcaaaggcttcacaagagggaccactacctgaaatagaggacgaagtttttcggaagcgtaatttgaccataatggaccttcatccagggtcagggaaaacacgtaggtacttaccagctatagtacgagaagcaattaaaaggcgccttaggaccctaatactagcccccacacgggtagttgcctcagaaatggcagaagcgttaaaagggatgcctatccggtatcagacaacagcagtgaagtcagaacacaccggcaaagagatcgtggatcttatgtgtcacgccacatttactatgaggcttcttagtcccgtccgagtaccaaattataatatgataattatggacgaagcacactttacagacccaagttcaatcgcagcacgtggatacatctcaacccgagtcgggatgggagaagcagcggcaatctttatgaccgcaaccccgcccggttcggtagaagccttcccacaatcaaatgcggtgattcaagatgaagaacgggacatcccagaaagatcatggaactcagggtacgaatggataacagattttccgggaaaaacagtttggtttgtacctagcatcaaaagtggtaatgacattgcaaactgtttacgtaaaaatggtaaacgagtgatccagctctccaggaagacttttgatactgagtatcagaaaactaaaaacaacgactgggactacgtagtaactacagacattagcgagatgggagcaaactttagagcggatagagtaatcgatccgcgaaggtgcttgaaaccagtcatactaaaagatgggccagagagggtaatactagccggtccaatgcccgtcactgtagcaagtgctgcacagcggagaggaaggataggacgaaaccataataaggaaggagatcaatacatatatatgggacaaccactcaataatgatgaggatcatgcccattggactgaagccaaaatgctgttagacaatatcaatacgccggaaggaattattcccgcactctttgaaccggaaagagagaaatctgccgctattgatggtgaatatagattacgtggagaagctaggaaaacctttgtggaactgatgaggcgcggcgatttacccgtatggttgagttataaggtggcttcggagggattccaatactctgatagacgctggtgtttcgatggagaaaggaacaatcaagtactagaggaaaacatggatgtagaaatatggacaaaggaaggagaaagaaagaagttacgccctagatggttagacgcaagaacgtatagtgacccactcgcgcttcgagaatttaaagaatttgctgcgggaagaaggtcagtgtccggtgatctgatattggaaataggtaaattaccccagcacttaacacaacgagctcaaaatgccctagacaacctagtaatgctccataattcagaacaaggtggtagagcctaccgacatgcgatggaggaactcccagatacaatagaaaccctaatgctcttagcacttatagctgtgttgacaggaggtgtaacactattctttcttagtggaagaggactaggtaaaacatcaatcggacttttatgcgtgatggcatcctcagtactactgtggatggcatcagtagaaccccattggattgctgcatcgataatactagagttctttctaatggttcttctcatcccggaaccagaccgacaaaggacaccccaagataatcaattagcctatgttgtaataggcctactcttcatgatactgacagtggcagcaaatgaaatgggcctactggaaactaccaagaaagatctaggaataggacatgttgcagttgagaaccaccatcatgcagccatgcttgacgtggacttgcatcctgcttcagcttggaccctctacgcggtagctacaacgatcattactccgatgatgcggcacactatcgagaacacaactgcgaatatcagtttaacagcgatagcaaaccaggctgcaatactgatgggtttagataaaggttggccgattagtaaaatggacattggcgtaccactactagcgttgggttgttattcccaggtcaatccccttacattgacagctgcggtgttgatgctggttgcccactatgccataattggaccaggattgcaggctaaggcaaccagagaggcgcagaaaagaacagcggctggaataatgaagaacccaactgttgacggaatagtagcaatagatttagatccagttgtatatgatgcaaagtttgaaaaacagctcggtcagatcatgctgttaatattgtgtacaagtcaaattttactcatgcgaaccacatgggcactatgcgaatcaatcactttagcaaccggaccgctaactactttgtgggagggttctccgggtaaattttggaacacaactatagcagtatcgatggcaaatatttttagagggtcctatttggctggagctggactagccttctcattaatgaaatcattgggtggaggacgtagaggaacaggagctcaaggagagactttaggtgaaaagtggaaacgacagctaaatcaactatcaaagtcagaatttaatacatacaaaagaagcggaatcatggaagtcgacaggtctgaagccaaagagggcttgaagagaggtgaaacgactaagcatgcagttagtaggggcaccgcaaaacttcgatggtttgtagagcgaaacctggttaagccagaaggtaaggtaattgatttaggatgcggacgaggcggctggtcatactactgcgcaggcctcaagaaagtgacagaagtgaaaggatatacgaaaggtggtccaggacatgaagaaccgattccaatggctacttatggttggaacttggtgaaattacacagtgggaaagatgtatttttcatacctccagagaagtgcgacacactactatgcgatataggagaaagctcccctaacccaaccatagaagaaggcagaactttaagagttttaaaaatggtagaaccgtggttaagaggtaatcaattctgtattaagatattaaacccgtacatgccaagtgtagtagaaacactagagcaaatgcaaagaaagcacggaggaatgctggtaaggaatccattatcacgaaatagcactcacgaaatgtattgggtgagttgcggaacggggaatatcgttagtgcggtgaatatgacgagtagaatgttactcaatcggttcacaatggcacatcgcaaacctacatatgaaagggatgtagatctaggagccggcactcgacatgtggcagttgaaccagaagttgctaacttagatattattggacaaagaattgaaaatataaaacatgagcataagtcaacatggcattatgatgaagacaacccatataagacttgggcatatcatggaagttatgaagtaaaacccagtggatcagcatcatcaatggtcaatggtgtagtcaaactattgacaaagccatgggacgtaatccctatggttacacaaatcgctatgaccgatacaacacctttcggtcaacagagggtattcaaagaaaaggtcgatacgcgaacaccaaaggccaaaagagggacggcacaaataatggaagtcacggcgaaatggttatggggcttcttatcacgtaacaagaagccacggatatgtacacgagaagaatttaccagaaaggtcagatcaaatgcagcgataggtgcagtttttgtagatgaaaatcaatggaacagtgcaaaagaggcagtggaagacgagcgtttttgggatcttgtccacagagagcgtgaattacataaacaaggtaaatgtgcaacatgtgtctataatatgatgggcaaaagagagaagaaactaggggagtttggaaaagcaaaaggcagtcgagctatatggtacatgtggctaggcgcaagatttctcgaatttgaagcactaggctttatgaatgaagaccattggttttctagagaaaattccctatcaggagtagagggggaaggccttcataaattaggctacatattgcgagacatttctaagatccccgggggaaatatgtatgctgatgacacagctggttgggataccagaataactgaggatgatcttcaaaatgaagctaaaattaccgacatcatggagccagaacatgctttactagctaaaagtatatttaaattaacatatcaaaacaaagttgtcagagttcaacgcccagcgaagaatggtaccgtgatggatgtgataagtagacgagaccagcgcggatcaggacaagtaggaacgtacggactaaataccttcacgaatatggaagctcaattgatacggcaaatggagtcggaaggaatatttagcccttcggaattagaaactccaaacttggccggccgagtgcttgactggttagaaaaacatggtgtcgagcgattaaagagaatggcgatatcaggcgatgattgcgtagttaaaccaatagacgatagatttgctacagcattgacagcactaaacgatatgggtaaagtacgtaaggatataccccaatgggaaccttcaaaaggatggaacgactggcagcaagttcccttttgctctcatcactttcatcaattaataatgaaagacggtcgagagattgtcgtgccgtgcagaaatcaagacgaattggtcggcagagctagagtatcccaaggtgcaggatggagccttagagaaacggcatgtcttggtaaatcttacgctcaaatgtggcagctgatgtattttcatagaagggatttaagactggcagcgaatgcgatctgttcggccgtgccagtggactgggtgcccacatcgcgcactacatggtcaatacatgcacatcatcaatggatgaccactgaggatatgttaagcgtctggaatcgagtatggattgaagaaaatccctggatggaggacaaaactcatgttagcagttggggtgacgtcccgtacttaggtaaaagggaagatcaatggtgcggctcattaattggcttgacagcaagggcgacatgggctacaaatatacaggttgctataaatcaagtgagacgacttttaggaaatgagaattacctagattacatgacaagtatgaagagatttaaaaatgaaagcgatccagaaggtgctttatggtga

SEQ ID NO: 21927 - RNA, 9879 nt, synthetic construct
  misc_feature 1..9879: note = derived and/or modified CDS sequence (opt6) from DENV-1__EU482481__SS-prME
  source 1..9879: mol_type = other RNA
agcgtcaccatgctattaatgctaatgcctacggccttagcgttccaccttaccacgagagggggagaacctcacatgatagtaaccaaacaagaacggggcaaaagtttactattcaaaacttcagccggggtaaacatgtgtacactcatagcaatggatttaggagaattatgtgaagatactatgacatataaatgcccgcgaattacagaagctgaaccagacgatgtagactgttggtgcaatgccactgatacatgggtaacatacggaacctgttcccaaactggtgaacaccgtagagacaaacggtcagtggcattggcgccacatgtaggtttaggtttagaaacaagaacagaaacctggatgagcagtgaaggggcctggaagcaaatacaaagagtagaaacatgggctcttagacatcccgggttcaccgtgattgctttattcttagcgcatgcgatcggaacctcaatcacgcaaaaaggtattatcttcattctattgatgctagtgacacctagtatggcgatgagatgcgtcggaatcggttcaagagatttcgtagagggccttagcggtgccacttgggtagacgtagtactagaacatggttcatgcgtaactacgatggcgaaagacaaacctacactcgacatcgaattgcttaaaacagaagtaaccaaccctgctgttttaagaaaactatgcattgaagccaaaatctcaaacactacaacagactcacgatgccctacacaaggagaagcaactttgatggaagaacaagacgcaaactttgtttgcagacgaacctttgtagatagaggatggggtaatgggtgtggcctcttcggcaaaggttccttgataacatgcgcaaaatttaagtgtgtaacgaaattagagggcaaaatagttcaatatgaaaacctaaaatactcggtcattgttacagtacatactggtgatcaacatcaagttggcaatgagtctacggaacatgggacgaccgccaccataacaccacaagcacctacatcagaaattcaactgactgactatggggctttaacactggattgctcccctagaactggattagatttcaacgaaatggtcctacttactatgaaagaaaaatcctggctagtccataaacaatggtttcttgatttaccactaccatggacaagcggagcatccactagccaggaaacatggaatcgacaggacctattagtaacattcaaaactgcccatgcgaagaaacaggaagtagtcgttttaggttcacaagagggagccatgcatactgcgcttacaggagctacagaaatacaaacatcaggtacaactactatattcgctggtcacttaaaatgcaggttaaagatggacaaactaacattaaaaggaatgagctatgtcatgtgtaccggtagcttcaagctagagaaagaggtagcagaaacccaacacgggacagtgttggtccaaattaaatacgaaggtacagatgcaccatgtaagatccctttcagcacccaagatgaaaaaggcgttacacagaacggaagactaattacagcaaatcctattgttacagataaggagaaaccagttaatattgaggcagaacctcccttcggagaaagctacatagtcataggagcaggagaaaaggctcttaaattgagttggtttaaaaagggaagttctattggaaagatgttcgaagctacagcgcgaggggccagaaggatggccattttaggggacactgcatgggatttcggaagcgtgggaggtgtatttacaagtgtaggaaaacttgtacaccaaatcttcggaactgcatatggtgtactattttctggcgtttcttggactatgaagataggaataggagtattactaacatggctgggtctcaattctcgatccacttccctttctatgacttgcatagctgtagggctcgtaacactatatttaggtgtaatggtacaagcggattcaggttgtgtaataaattggaaaggacgagaattgaagtgcggctctggaatatttgtcacaaacgaagttcatacatggacagaacaatataaatttcaggcggatagccccaagcggctatctgcagcaattggaaaagcatgggaggaaggagtgtgtggaattaggtcggcaacacgactagaaaatattatgtggaaacaaatctcaaatgaattaaatcatatattattagaaaatgatatgaaattcacagttgttgtaggtgatgtggtaggcatactagctcagggcaagaaaatgattagaccacaaccaatggaacacaaatattcctggaagtcatggggtaaggcaaagattattggcgccgacgtccaaaatacaaccttcataatagacggtcctaatacacctgagtgcccagatgatcaacgagcatggaatatatgggaagtcgaagattacggatttggaatatttaccaccaacatatggcttaagctcagagactcctatacgcaagtctgtgatcatcgtctaatgtcagcagcgataaaagactcaaaagcagtacatgctgatatgggatattggattgaatcagagaaaaatgaaacttggaaactagcccgtgcatcttttatagaagtaaaaacttgtatatggccgaagtcacacacactctggagcaacggtgtactagaatctgagatgattatccccaaaatatatggtggacctatcagtcaacacaatcatagacctggctactttacacagaccgcaggaccctggcacctaggcaaactagagttggacttcgatttgtgcgaaggcacgacagtggtcgttgatgagcactgcggtaaccgagggccatcgttgagaacgaccacagttacagggaaaataatccacgaatggtgttgcagaagctgcacactcccgccgttaagattcaaaggagaagatggctgttggtatgggatggaaatccgccctgtcaaagagaaagaggaaaacttggtaaagtcaatggtatctgctggatcgggtgaagtcgacagcttttctttgggattgctctgcatctcaattatgatcgaagaagttatgaggtcaagatggagcagaaaaatgcttatgacaggaaccctagcagtattcttattactcatcatggggcagttaacctggaatgatctcatcagactatgcattatggtcggagccaacgcttccgaccgaatggggatgggtacgacatacctggcattgatggcaacttttaaaatgcgacctatgtttgcagtagggctgttatttcgacgtctgacttcgagagaagttcttctattaacaatcgggctatctttagtagcgtcagtcgaactccctaacagcctagaagaactaggagatggtttagctatgggtataatgatactcaaattgttgaccgattttcagtcccaccagctgtgggccactttactttcattgacattcataaagaccacactatccttacactatgcatggaaaacaatggctatggttttgagtatcgtatctttatttcccttatgcttatcaaccacatcacagaaaacaacatggttaccagtattactaggaagtttgggttgtaaaccactaacaatgttcctaataactgaaaataaaatttgggggaggaaatcgtggccacttaatgaaggtataatggcagtaggtgtggtgagcatcctcctctcatcactcttgaagaacgacgtccctctcgcagggccattaatcgccggaggtatgttaatagcctgctatgtcatttcaggaagcagcgcagatttatcccttgaaaaagccgccgaagtatcttgggaagaggaagctgagcattctggagcaagccataacattctggtcgaagtacaagacgacggaacgatgaaaataaaagatgaggaacgcgacgataccttaactatccttctaaaagcaactcttctagcagtcagtggggtatatcctctcagtatacccgctacgctattcgtatggtatttttggcagaaaaagaaacaaagaagtggagtgctttgggacactccaagtccacccgaagttgaacgagcagtgctggatgacggaatttatcgcatcatgcagcggggacttcttggcagatcccaagtgggcgttggcgttttccaggaaaacgtttttcatacaatgtggcatgtaacacgcggcgccgtactgatgtatcaaggtaaacgattagaacctagttgggcctcagtgaaaaaggacttaatctcttacggaggaggatggaggcttcaaggaagctggaatacaggagaagaagtccaagtcatagcggtagaaccagggaagaatcccaaaaatgtccagacagcgccggggacatttaaaacaccggagggggaggtaggtgcaatcgcactagacttcaaaccaggaacaagtggatctccaatagtgaatcgagagggaaaaatcgtcggtttatatgggaatggcgtggtaactacaagcggaacatatgttagcgctatcgcgcaagcgaaagcaagtcaagagggcccactcccagaaatagaagatgaagtgtttagaaaacgaaacctaacaataatggatttgcatccgggatctggcaagacacgaagatatttgccggccatagtacgagaagccataaaacgaaaattacggaccttgattttagcacctaccagagttgtagcttctgaaatggcagaagccttaaaaggtatgccaatccgatatcaaacaactgctgtaaagtcggaacatactggaaaagaaatagtagatctcatgtgtcacgccacctttaccatgcgactacttagtcctgttagagtacccaattataatatgatcattatggatgaagcacatttcacagatccatcatccattgccgcaagaggatacatctctacaagagttggcatgggagaagcagcagccattttcatgactgctacaccaccaggatcagtggaggccttcccgcaaagcaatgcagtaattcaagatgaagaacgcgatattcctgagagaagttggaactctggatatgaatggataacagattttcccggtaaaactgtatggttcgttccaagcatcaagagcggaaacgatatcgcaaattgtttgcggaagaacggtaagcgggtaatccaattatcacggaagacatttgatacggaatatcagaaaaccaaaaacaatgactgggactatgtcgttacaactgacataagtgaaatgggtgcaaactttagagcagatcgagtaattgatccgagaagatgtttaaaaccagtaattttaaaagacggtccagaaagagtgatattagcggggcctatgccagtgactgtggctagtgccgctcaacgacgcggacggatcgggcgtaaccacaataaggagggagatcaatacatatacatgggtcaacctttaaacaatgacgaagatcatgcacactggacagaagccaaaatgttattagataatataaatacacccgaaggtataattcctgcactcttcgagccagaacgcgaaaagagtgcagcaattgacggtgaatacagacttagaggagaagctcgaaaaacatttgtagaattgatgagaagaggggatctaccagtgtggttgtcatacaaagtagcatctgagggatttcaatattccgacagacgatggtgtttcgatggagagaggaacaatcaagtacttgaagagaacatggatgtcgaaatctggactaaagaaggtgagcgcaagaaattacgtccaagatggctagatgctcgcacatacagtgatccattggccctcagagaatttaaagagttcgcagcaggcagacgctccgtcagcggtgacttaatatcggaaattggcaaactgccacaacatctaactcaaagagcacaaaatgcattagacaacctagtaatgttgcataactcggaacaaggcggtcgagcttatagacatgcgatggaagaactaccagatacgattgaaactttaatgctacttgcactaattgccgtacttacagggggtgtaacattattctttctatcaggtcgtggtcttgggaaaacatcgatcggtctcctttgtgtgatggcatcaagtgtactcctttggatggcgtccgtagaaccacattggatcgccgcttccataatcctggagttcttcttaatggtactactaatacctgagcctgaccgacaacgcactccacaggataatcagttagcgtatgtagtaataggattactctttatgatattaaccgtagcagctaacgagatgggtttgctagagacaacaaagaaagacttaggaatcggacatgtggctgttgaaaatcaccatcatgcaactatgttggacgtagacttacatccggcatcagcctggacactttatgcagtagcgactacgataatcaccccaatgatgaggcatactatagagaataccacagctaatatatcattgacagcaattgccaatcaagccgcaattttaatgggactcgacaaaggatggccaatctcaaaaatggacatcggtgttccgttattagcgctaggatgttattctcaagtaaatccactaacgcttaccgctgcagtacttatgttagtagcccattacgcaataataggcccagggctacaggcaaaggccacaagagaggcacagaagcggacagcagcgggcattatgaaaaatcccactgtggacggtataattgcaattgacttagacccagtagtttatgatgccaaattcgaaaaacaactaggtcagatcatgttattgatcctatgtaccagtcaaatcttgttgatgcgaactacttgggctctctgcgaatcaataactcttgccacgggtccactaacaactctgtgggaaggatcgccgggaaaattctggaataccactatcgcagtgagcatggcaaacatatttagaggatcgtacttggctggagcgggattagcattcagtttaatgaaatctttaggaggaggaagaagaggcacaggagcgcagggtgaaacacttggagaaaagtggaaaagacaactcaaccaattaagcaagagtgagttcaacatttataaaagaagtggcattatggaagtcgacagatctgaagctaaagaaggtctgaaacgtggggaaactacaaggcatgccgtctcgcggggaacggcaaaattgaggtggttcgtggaaagaaacctcgtcaagcctgaaggtaaagtgatcgacttaggttgcggacggggtggctggtcatattactgtgctggtctaaagaaagtaacagaagtaaaaggatatacaaaaggagggccgggacatgaggaaccgattcctatggccacatatggttggaacttagtaaagttgcacagcggaaaggacgtattctttacaccaccggagaaatgcgacacgttactctgtgatatcggcgaaagctcacctaaccccacgattgaagaaggacgaaccctgcgtgtacttaaaatggtagagccatggttgcgtggaaatcaattctgtataaaaatactaaacccctatatgcctagcgtggtagaaaccttagaacaaatgcagagaaagcacggaggtatgttagtgagaaatccgctgtcacgtaactctacccatgaaatgtattgggtatcttgtggaactggaaacattgttagtgcagtaaatatgacttccagaatgttgctaaatagatttacaatggctcatagaaagccaacatatgaacgcgatgtagacctaggagcaggaaccaggcatgtggctgtagaaccggaagtagcaaacttggatattattgggcaaaggatcgagaatataaagcatgaacacaaatctacctggcattatgatgaggacaatccttataaaacctgggcataccatggttcatatgaggttaaaccttcaggatctgcgtcatcaatggttaatggtgtcgttaagctgctaacaaagccatgggacgtcatccccatggttacacagatagcaatgacagatacgacaccattcggccaacaaagggtgtttaaagaaaaagttgacacaagaactccaaaagcaaaaagaggaacagcacaaatcatggaagttactgctcggtggttatggggatttctctccagaaataaaaagccacgaatatgtacgagagaagaatttactcggaaagtccgatctaatgcagcaatcggagcggtcttcgttgacgagaaccaatggaactcggcgaaagaagctgtggaggatgaaagattctgggatctagtccaaaaggaaagggaactccacaagcaggggaaatgcgcaacatgcgtatacaatatgatgggaaaaagggagaagaaactaggagagttcgggaaagctaaaggaagccgtgcgatatggtacatgtggttaggtgcgagatttctcgaatttgaagcactgggcttcatgaacgaggaccactggttttctcgagaaaattcactttcaggtgtagagggagagggcctccataagctgggatatatattaagagacatatcaaagatacctggaggaaatatgtatgcagatgataccgctggttgggatacaaggataactgaagatgacctacaaaacgaagcaaaaattacagacattatggagccagaacacgcacttctggcaacatcaatcttcaagttaacatatcaaaacaaagtagttcgcgttcaacgcccagctaaaaatggtacggtaatggatgtcataagtaggagggaccaaaggggatccggacaggtaggcacctatggattaaatacatttactaacatggaagcacagttaatccgtcaaatggagtcagagggaatcttccttcccagtgaattagagacccctaacctagcagaaagagttctagattggttagaaaaatacggggtcgagcgacttaaaaggatggcgatatcaggagatgattgcgtagtaaaaccaatagacgatagattcgccaccgcactcactgccctaaatgatatgggtaaggttaggaaggatataccgcaatgggagccttctaaaggttggaatgattggcaacaggtaccattctgctcacaccacttccaccaactgataatgaaagatggccgagaaatcgtcgttccatgtcgtaatcaggacgaattagttggtagagcaagagtcagccagggggctggatggagtcttagggagactgcgtgcctaggtaaaagttatgcgcaaatgtggcagcttatgtatttccataggagagatctacgactggctgcaaatgccatatgttccgccgtaccagtagactgggtaccgacaagccgtaccacatggagtatacatgctcaccatcagtggatgactactgaagatatgctctctgtatggaaccgagtttggatcgaggaaaacccctggatggaagataaaacacatgttagcagctggggagatgtaccatatctcggcaaaagggaggatcaatggtgtggctctctcatagggctaacagcacgtgccacttgggcatccaatatccaagtagccataaaccaagtacgtcggctaattggaaatgaaaattatctggactacatgacttcaatgaagagatttaagaacgagggagatccagaaggggcgctgtggtaa

SEQ ID NO: 21928 - RNA, 9879 nt, synthetic construct
  misc_feature 1..9879: note = derived and/or modified CDS sequence (opt6) from DENV-1__EU482482__SS-prME
  source 1..9879: mol_type = other RNA
agcgtaactatgttattaatgcttatgccgacggcgttagcgtttcatctaactacacgtggcggcgaaccgcacatgatagtatcaaaacaggaaagagggaaatcactattattcaaaacgagtgccggtgtaaatatgtgcacactaattgctatggaccttggagaactatgtgaagatactatgacatataaatgtccacgcatcacggagactgaaccggatgacgttgactgctggtgcaatgctacagacacttgggttacatacggtacctgttcacaaacaggtgaacatagacgggataaaaggtcagtggcactagctccacacgttggacttggtcttgaaacgcggacggaaacgtggatgtcctctgagggcgcatggaaacaaattcaacgagtagaaacgtgggcactaaggcatcctggttttacagtaattgcactgtttttagcacatgctatcgggactagcatcactcagaaaggtataatcttcatcctactgatgctagtgactccgtccatggcaatgagatgtgtcggcataggaagtagagatttcgtcgaaggtttatccggcgctacttgggttgacgttgttctagaacacggctcttgcgttacaacgatggcgaaagacaaacccacactagatatagaactcttgaaaacggaagtcactaatccagccgttctaagaaaactctgcattgaggcaaaaatcagtaatacaaccacggattctcgatgtccaacacagggagaggctaccctagttgaagaacaagacgcgaattttgtgtgcaggagaacattcgttgaccgcggatgggggaatggatgcggactgttcggcaaaggatcactgattacatgtgcaaaatttaaatgcgtaaccaaactagagggtaaaatcgtccaatatgagaatcttaaatatagtgtaattgtcaccgttcatacaggagatcagcaccaagttggaaatgagagcacagaacacggtacaaccgccaccattaccccacaagctccaactacagaaatacaattaactgattatggagctttaacactcgattgcagccccaggacgggtctagattttaacgagatggtattattgactatgaaagaaaaatcatggctcgtacacaaacagtggtttctggatctaccgctaccatggacatccggagcatcaacttcacaggaaacatggaatagacaagacctcctagtaacattcaaaactgctcatgcaaagaaacaagaagttgtggtacttggctcacaggaaggtgcgatgcatacagctttaacaggcgcaacggagattcaaacatccgggacaacaactatattcgctgggcatctcaagtgtcggttgaaaatggacaaactcacccttaagggaatgtcatacgtcatgtgtacaggtagtttcaagttagagaaagaactagcagaaacccagcatggtaccgtgctagttcaaataaaatatgagggaacggatgcaccgtgtaaaattcctttcagtacccaagatgaaaagggagttacccaaaacggcagactcataacagcgaatcccattgttactgataaggaaaaacctgtaaacatagaagcagaacccccttttggtgaatcatatatagtcataggggccggtgaaaaagcattgaaattatcctggtttaaaaagggtagttcgatagggaaaatgtttgaggctacagctagaggtgctcgacgtatggcaatattaggagataccgcatgggatttcggaagtataggaggagtgttcacaagtgtcgggaaattggtacatcaaattttcggaacggcatacggcgtattgttctcaggagtctcatggaccatgaaaataggaattggagtactactaacctggcttggtttaaattcgagatcaacgagtctatccatgacatgtattgcagtaggacttgtaactctttacttaggcgtgatggtacaagcagattcgggttgtgtaatcaattggaagggacgagaactaaaatgtggatctggcatcttcgttaccaatgaggtccatacctggactgagcaatacaaatttcaagccgatagtcctaagcggctctcagcagcaattggaaaagcctgggaagaaggtgtatgtggtattcgatcagcgacccgcttagaaaatatcatgtggaagcaaatctcaaatgaacttaatcatatccttttggaaaatgatatgaaattcacagtagtcgtgggcgacgtggcaggaatattggcgcaagggaagaaaatgattcgcccacaacccatggaatacaaatactcatggaagtcatggggaaaagccaaaataatcggcgccgacgttcagaatacaaccttcataatagatggcccaaatactcctgaatgcccagatgatcaacgtgcgtggaatatttgggaagtcgaagactatggttttggtatatttacaacgaacatatggttaaaattaagggattcatatacgcaagtctgcgatcatagactaatgagtgccgcaattaaagatagcaaagcggttcatgccgacatggggtactggatagaatctgagaaaaatgaaacatggaagttggcacgtgcaagttttattgaagtaaaaacatgtatttggcccaaatcgcataccttatggagtaacggagttcttgaaagcgaaatgataatacctaaaatttatggagggcctatatcacaacacaactataggcccgggtactttacacagacggccggtccatggcacttggggaagttagaactggattttgacctatgcgaagggacaacggttgtggtggatgaacattgcggaaacaggggaccctccctgagaaccacaacagttactggaaaaataattcatgagtggtgttgtcgatcttgtactctccctccactaagatttaggggcgaggacggctgttggtacggtatggagatcagacctgtgaaagaaaaagaagaaaacctcgtcaagtctatggtctctgcaggaagtggcgaagtggactcattctcgttagggctattatgtatttctataatgatagaagaagtaatgagatctcgctggtcaagaaaaatgttaatgaccggaactctagcggtattctttttgttgataatgggacaactcacctggaatgacctcataagattgtgcataatggtgggggctaatgcgtccgacagaatgggtatgggaacaacttacctagcacttatggctacctttaaaatgagacccatgtttgcagtcggactactatttaggcgactgacaagcagagaagttctattattaacaataggactatcccttgttgcgtcggtagaattacccaacagtctagaagagttgggggatggcctagccatggggataatgatcctaaagctattaacagacttccaaagtcatcaattatgggctaccttgttatcattaacctttataaagacgacttttagtctacattacgcttggaaaactatggctatggtcttgagtatcgtttccttattcccactatgcctatcaaccacctcacagaaaacgacgtggttacctgtgctattaggctcacttggctgtaaacctttaacgatgtttttaattgcagaaaacaaaatatggggaagacgatcatggccactgaatgaaggaataatggcagttgggattgtatcgatccttctgtcctcattattaaagaacgatgttcctttggctgggccactaatagccgggggcatgctcattgcttgttacgtaatttctggatcatctgctgatttgtcattagaaaaagcagcggaagttagttgggaagaagaagcagagcacagcggtgcttcacataacatattagttgaggttcaagacgatgggactatgaaaattaaggacgaagaacgagacgataccctaaccatactcctaaaggcaacattattagccgtctctggggtttatcccctatcgataccagctactctatttgtatggtacttctggcagaagaagaaacagaggtctggagtgttatgggatactccgagtccacccgaggtagagagagctgtcctagatgatggtatatatagaattatgcaaagggggttactaggaagatcccaagtgggcgtaggagtttttcaggaaaacgtatttcatacaatgtggcatgtaacacgtggcgctgtgttaatgtatcaagggaagcgattggaaccttcctgggcaagtgtgaagaaagatctaatttcctatggtggtggatggaggctccaaggttcctggaacactggcgaagaagtacaggttatcgctgttgaaccgggtaaaaaccccaaaaatgtgcaaacagcacccggaacattcaaaactcctgagggggaggttggggccatcgcgcttgattttaaaccgggaacgtctggatctccgattgtaaacagagaaggaaaaatcgtagggctatatgggaacggtgtcgtaactacttcgggtacgtacgtgagcgctattgcgcaagcaaaagcatcacaagagggtcctttaccagagatagaggatgaggtattccgtaaacgaaacttaaccataatggatctacatccaggcagcggtaaaacgaggagatatctgccagcaatcgtacgtgaagcaataaagcgaaaacttagaacactgatattggcccccacacgcgtggtagcatcagagatggcagaggccctcaaaggaatgcctattagatatcaaaccaccgcggttaaatctgagcacaccgggaaagagatagtagatttaatgtgccatgccacctttacgatgaggctgttatcacctgtgagagtacctaactacaacatgataataatggatgaagcacatttcacagatccttcatcaattgcagcacggggttatattagtacaagggtaggtatgggggaagctgccgcaatatttatgacagccactcccccagggtcagtagaagccttcccacaatctaacgcagtgatacaagatgaagaacgggatattccagaacgcagctggaacagcggttatgaatggattacagattttcctggaaaaacagtatggtttgtgccatccattaaatctggtaatgatatagcgaattgtttaaggaagaacggcaaaagagtcattcagttatcacgaaaaacgtttgatactgagtatcagaagactaagaataatgattgggattacgtcgttacgactgatatttcagaaatgggtgcaaattttagagcggatcgtgtaatagatccacgaagatgtctaaaacctgtaatcttaaaagacgggccagaaagggttattctggcaggacccatgccagtaactgtagcgagtgcagcgcaaagaaggggaagaatcggccgtaatcacaataaagaaggagatcaatacatatacatgggtcaaccattaaataacgatgaagatcatgcacactggacagaagcaaagatgctactcgataacatcaacacacctgaaggtataatcccagcattattcgaaccagaaagagagaaatctgccgcaatagatggagagtaccgtctgaggggcgaagcacgaaaaactttcgttgaactaatgcgtagaggcgatctacctgtgtggttatcatataaagttgcgagtgagggatttcagtacagcgacaggcgttggtgtttcgatggagagcgcaacaatcaggtgctagaagaaaacatggatgtagaaatatggacaaaagaaggagaacgaaagaaattacgaccacgctggctagacgcacgtacctattcagatccactagctttacgtgaatttaaagagttcgccgcaggtagaagaagtgtatcaggcgatttaattttagaaattggtaaactacctcaacacttaactcagagagcccaaaatgccctagataacctagtaatgttacataatagtgaacaagggggtcgagcttacagacacgcaatggaagaattaccagatactatagaaacattaatgctactcgcactgattgctgtactaacagggggcgtgacattattctttctatccggtagggggttaggaaaaacttcaataggactactatgcgtcatggcatcatcggtcctactgtggatggccagtgtagaaccgcattggatagctgcttcaatcatattagagttctttttaatggttctcttaataccagaacctgatagacaaagaacaccacaagataatcaattagcctatgttgtcattggtctattatttatgattttgaccgtagcagccaatgaaatgggactgcttgaaacgactaagaaagacttagggattggtcacgttgccgtagaaaatcatcaccacgctgcaatgttggacgtcgaccttcacccagcatcagcttggacgctttatgccgttgcaaccaccattattacaccaatgatgaggcatactatagagaatacaactgcaaatatttcactcacagcgatagcaaatcaggccgcaatattaatgggtttggataaagggtggccaataagcaaaatggatataggtgtacctttattggctttaggttgctattcacaggtaaacccactcacactcaccgcagccgtattaatgttggtcgcgcactatgctataataggaccaggtctgcaagcaaaagccacacgggaagcccaaaagaggaccgctgcgggaataatgaaaaatccgaccgttgacggaattgtagcgattgacctagacccagtggtttacgatgcaaaattcgaaaaacaacttgggcaaattatgctcttaattttgtgcacaagccagatcctattaatgcgaacaacctgggcactatgtgaatcaataaccttagctactggaccacttaccacgctttgggagggatcaccaggtaaattttggaacaccacaatagcagtgagcatggcaaacatttttcggggatcatatttagcaggcgcaggactcgcattttcattaatgaaatcattgggcggcggacgtagagggacaggtgcacagggagaaaccctaggcgaaaaatggaagcgacagttgaatcaactcagcaagagcgagttcaacacttataagagatcaggaataatggaagttgatcgaagtgaagctaaagagggtctgaaacgaggagaaaccacaaaacacgcggtatcgagaggaacagcaaaactgaggtggttcgtcgaaagaaacctggtcaaaccggaaggtaaagtaattgacctcggttgtggacgcggcggatggtcctactactgcgcaggtctgaagaaagtaacagaagttaagggatatacgaaaggaggccctggacacgaggaacctataccaatggcgacatatggttggaatttagtgaaacttcattctgggaaagatgtgttcttcataccaccagagaagtgcgacacattgctatgcgacatcggagagtcctctccaaacccaacgatcgaagagggacgtactttgagagttttaaaaatggtagagccatggttaaggggcaaccaattttgtataaagatattgaacccgtatatgccttcggtagtggaaacgcttgagcaaatgcaacggaaacatggaggtatgttagttcgcaatccattaagtcgtaacagtacacacgaaatgtattgggtctcatgtggaacgggtaacattgtaagtgctgtaaatatgacaagcagaatgttacttaatagatttactatggcacaccgaaaacctacttatgagagggacgtagacctaggcgcggggacaaggcatgtagcggtagaacctgaagtggcgaatcttgatattatcggacagcgaatagagaacattaaacatgaacacaagtcgacctggcattacgacgaagataacccatacaaaacgtgggcatatcatggttcgtacgaagtaaaacctagtggaagtgcaagtagtatggtcaatggagtagttaagctacttacaaaaccgtgggatgtaataccaatggttacacaaatagcaatgactgatacgacaccattcggccagcaacgagtatttaaagagaaagtagacactcgcacacctaaagctaaacgcggaacagcacagattatggaagtcaccgctaaatggttatgggggtttctcagtagaaataagaaacctagaatttgcaccagagaggagttcacaagaaaggtgagaagtaatgcggccattggggcagtgtttgtggatgaaaaccaatggaactcagcaaaagaggcagtcgaagatgaaagattctgggatctagtacacagagaaagagaattacataaacaaggtaaatgtgccacgtgcgtttacaatatgatgggaaaaagagaaaagaagttgggagagtttggaaaagccaaaggtagtagggccatatggtatatgtggctcggtgcaaggttcttagagttcgaggcactcggatttatgaatgaggaccactggtttagccgagagaactcattatctggtgtcgaaggtgaaggcctacacaaactaggatatatactaagggatatatcgaaaatccctggcggaaatatgtacgctgatgatacagcggggtgggacactagaatcacggaagatgaccttcaaaacgaagcaaggattacggatattatggagccagaacatgctctattggcaaagagtatcttcaaactaacatatcaaaacaaggtcgtgagagtacaaagacccgccaaaaatggcactgtaatggacgtaattagtcgacgagatcaaagaggcagcggacaagtaggaacctacgggttaaatacgtttacgaatatggaagcacaattaataagacagatggagtctgaaggtatcttttcaccatctgaactagaaacacctaatctcgcaaaacgagtactagattggttagaaaagtatggtgtagagcgacttaagagaatggccatttccggtgatgattgcgttgttaaaccaatcgacgacagattcgcgaccgcactaaccgcattaaacgatatggggaaagttaggaaggatatacctcagtgggagccatcaaaaggatggaatgactggcaacaagtacccttctgtagtcatcactttcatcagttaataatgaaagatggcagagaaatcgtagtaccctgcagaaatcaggatgaattagtaggccgagctagagtaagccagggtgcaggttggtcactaagagaaactgcgtgtctaggtaaatcgtatgcacaaatgtggcaacttatgtattttcaccgtcgtgacctaagattagctgcgaatgcaatctgttctgcagtccctgttgattggataccaacatctagaaccacatggagtatacatgcgcaccatcagtggatgactacagaagatatgttatctgtttggaatagggtatggatagaggaaaatccgtggatggaggacaagacccacatatccagctggggtgatgtcccgtacctaggaaaaagggaagaccagtggtgtggttcgcttattggactgacagcacgggctacctgggctactaatatccaagttgctattaatcaagtacgtcgcttaataggtaatgaaaattatttggactatatgaccagcatgaagagatttaaaaatgaatcagacccagaaggagcattatggtaa

SEQ ID NO: 21929 - RNA, 9879 nt, synthetic construct
  misc_feature 1..9879: note = derived and/or modified CDS sequence (opt6) from DENV-1__EU482485__SS-prME
  source 1..9879: mol_type = other RNA
tcagttactatgttactcatgttaatgcccacagcattagcatttcatctgacgaccaggggaggagaaccgcacatgattgttagtaaacaagaaaggggtaaaagccttctttttaaaacctcagccggagtaaatatgtgtacactaatagctatggatttaggagaactatgtgaagataccatgacttacaaatgcccacgcataacagaaactgaacccgatgacgtggactgctggtgtaacgccactgatacctgggttacatatggtacatgctcacaaacaggcgaacatcgacgagataaacgatcggtagcactagccccacacgtaggactaggactagaaacccgaactgaaacctggatgtcatcggaaggcgcttggaaacaaatccaacgagtagaaacctgggcactacgccatcccggctttacagtaattgctttattcctagcccatgcaattggaacaagtataactcaaaaaggcattattttcatcctattaatgctagtaacgccaagtatggccatgaggtgtgtcgggataggtagccgagattttgttgaaggcttatccggtgcaacctgggtggatgtagttctggaacacggctcatgtgtcaccacgatggcgaaagacaaacctaccctggacatagaactacttaaaactgaagtgacaaatcctgcagtccttcgtaaactttgcatagaagcaaaaatatctaatactacaactgattccagatgtccgacccaaggggaagccacattagtagaggaacaagacgcgaacttcgtctgtagaagaacattcgtcgacagaggctgggggaatggttgcggcctatttggtaaaggaagcctgattacgtgtgcaaaattcaaatgtgtaacaaaattagaaggaaaaatcgttcaatatgaaaacctaaaatattcagtaatagtaaccgtacacacaggcgatcaacatcaagttgggaacgagagtaccgaacacggaacaaccgctacgataacgcctcaggctccaacaactgaaattcaactaactgattatggagccttaacactagactgctctccgcgaactgggttggatttcaacgagatggtcctattaacaatgaaagagaaaagttggttggtacacaaacaatggtttttggatttacctttgccgtggacgagcggagcttccacatcgcaagaaacgtggaaccgtcaagatctattggtaacctttaaaacagctcacgccaagaaacaagaagtagttgtattgggatcacaagaaggagcgatgcatacagcattaacgggcgcgacagaaattcaaacttcgggtacaacgacgatttttgcaggacatttaaaatgccgcctaaaaatggacaaactcaccttaaaaggaatgtcctatgtgatgtgtaccggatcatttaaattagaaaaagaagtagctgagacccaacatggaacagtcctagtacaaataaaatacgaaggtacggatgctccgtgcaaaatacctttcagtacacaagatgaaaaaggagtcacgcaaaacggtcgcctaatcacggcaaacccaatcgttactgataaagaaaaacctgtgaacatagaagcagaaccaccatttggtgagagttacatagttataggagccggcgaaaaagcgttgaaattaagctggtttaagaaaggatcttcaatcggtaaaatgttcgaagctacagcaaggggagcacgaaggatggctatcttaggcgacactgcttgggatttcggatctatcggaggggttttcacctcggtagggaaattagtacatcaaatatttggtaccgcttacggagttctattctctggtgtatcttggacaatgaaaataggtataggggttcttctaacttggttaggtttgaactcaagaagtacatcgctgtcaatgacgtgcatagccgttgggctagtgacgctatatttaggcgtaatggttcaagcggactcaggctgcgtgattaactggaaaggaagagaattaaaatgcggttccggaatttttgtaaccaatgaagtccatacttggacggaacaatataagttccaggctgacagtccaaaacgactgtcagcagctatcggtaaggcttgggaagaaggagtgtgcggtatcagatctgcgacaagacttgaaaatataatgtggaagcaaatctccaatgagcttaaccatatactacttgaaaacgacatgaaatttacagtcgttgttggagatgttgcaggcatactcgcacaaggcaagaaaatgatcagaccccaacccatggaatataaatattcgtggaaatcatggggtaaagcaaaaatcataggcgcagacgtgcagaacaccacatttattatagacggtccaaatactccggaatgtccagacgaccaacgagcttggaatatctgggaagtcgaagactacggttttggaatttttacaacgaatatatggctaaagttacgggattcttacacgcaggtttgtgaccatcgattaatgagtgcagctatcaaagattcaaaggccgtgcacgcagatatgggatactggattgaatctgagaagaacgaaacatggaaacttgcaagagcgagttttatagaagtcaagacatgtatatggcctaagtcgcacactttatggagtaatggagtattagagtcggaaatgatcatccccaaaatctacggaggacccatctctcaacataattacagaccgggctattttacgcagacagcaggtccgtggcatctaggcaaattagagctcgacttcgatctttgtgagggtacaacggtggtcgttgatgaacattgtggaaataggggaccatcgctgagaacaacgacagttactggaaaaattattcatgaatggtgctgccggtcatgtactctaccgccattaagatttcgaggagaagatggatgctggtatggaatggagataagaccagttaaagaaaaagaagagaatttagtgaaaagcatggtttctgcaggtagcggagaggttgactcattttcactgggccttctatgtatttctatcatgattgaagaagttatgagaagcagatggagccgaaaaatgctaatgaccggtacattggcggtgttctttttgctaattatgggacagctaacgtggaatgatctcatacgcttgtgcataatggtaggcgcaaatgcaagtgatcgtatgggaatgggcacgacatatcttgccttaatggcaaccttcaaaatgcgacctatgttcgcggtaggactcctctttcgaagactaacatcaagggaggtcctactcctaactattggactatcccttgtcgcttccgtggaattgccgaacagcctagaggaactaggtgatggtttagcaatgggtatcatgatattgaaactattaacagactttcaaagccatcagctgtgggcaactttactcagtttaactttcatcaaaacaacatttagtcttcactacgcctggaaaacaatggccatggtattatctatcgtctcactttttcctctatgtctgtcaacaacttcacagaaaaccacatggttgccggtactcctaggatcgttaggttgtaagccgttaaccatgtttttaattgcagaaaataaaatctggggacgacgcagttggcctctgaacgagggcataatggccgtaggaattgtgagtatattattgtctagtttgctcaagaatgatgttccattagcaggaccactaatagcaggaggaatgttaattgcgtgttacgtcatatcgggaagttcagcagacttgtcactcgagaaagcggcagaggtaagttgggaagaagaagcagagcacagtggggcaagtcataatattctagtagaggtacaagatgacggaacaatgaaaattaaggatgaagaaagagatgatactttaactattttactaaaggccactttgctagcggtaagcggagtttacccccttagtattcccgctacgctctttgtatggtatttttggcagaagaagaaacaacgaagcggggtgctctgggatacaccttccccacctgaagtaggtcgagcagtactcgatgacggcatctatcgaataatgcagcgaggcctattaggtcgttctcaggttggcgtcggggtattccaggaaaacgtatttcatacaatgtggcatgttacccgcggagcagttctaatgtaccagggcaaacgtttagaacctagttgggcaagcgtaaagaaagatttgatttcatacggaggtggatggcgcttgcaaggttcatggaatacaggtgaagaagtacaagttatcgcggttgaacctggcaaaaaccccaaaaacgtgcaaacagcaccaggaacattcaagacacccgaaggagaggtaggcgcaattgccttagacttcaaacccggaacaagtgggagtcccatcgtaaatagggaaggaaagatagttggtttatacggaaatggcgtagttactacgtcaggaacttatgtttcagcaatagcacaagcaaaggcaagccaagaaggacctcttccagaaattgaggatgaagtattcagaaaaagaaatctcaccataatggatctgcatcccggatcagggaaaacgcgcagatacttaccggccattgtaagggaagccattaaaaggaaattacgtactctaattctagcacctacaagagtagtcgcatcagaaatggctgaggctttgaaaggcatgccaatacgctatcagacaaccgctgttaagtctgaacatactgggaaagaaatagtcgacctcatgtgtcacgccaccttcactatgaggttactatctccagtaagggtaccaaactataatatgataatcatggatgaagctcattttacggatcccagttccattgccgcaagaggctatataagcactagggtaggtatgggcgaagccgctgcaatttttatgacggctacacctcccgggtctgtcgaggcttttccccagtcaaacgcagtaatacaggatgaagaacgagatatccctgaacgatcgtggaactctggctatgaatggataactgatttcccgggcaagacagtttggtttgtgccaagcataaaaagtggaaatgatatagcaaattgtttaaggaaaaatggaaaaagagttatacaattgtcccggaaaacgtttgacactgaatatcagaaaaccaaaaataacgattgggactacgtcgttacaactgacatctccgaaatgggagcaaactttcgagcagatagagtaatagaccctagacgttgcttaaaaccggtcatcttaaaagatggacctgaacgggttattctagcaggacctatgccagttacagtagcatcggctgcgcaaagacgtggaaggattggcaggaatcataataaagaaggtgatcaatatatatatatgggccaaccattaaacaatgatgaggatcacgcccattggacagaagcaaaaatgctattagacaatatcaatacgcctgagggaataattcctgctctatttgagccagagcgcgaaaaatctgcggctatcgatggcgaatacagattacgtggggaagcgcgtaaaactttcgtggagctaatgcgaagaggagatttaccagtttggctgtcatacaaagtagcctccgaaggttttcaatatagcgacagaaggtggtgttttgatggtgaaagaaataaccaagtactggaggagaatatggatgtggaaatatggaccaaagagggagaaagaaagaaattacgtccacgctggctagatgcaaggacatatagtgatcctttagcgctcagagagttcaaagaatttgcagcaggccgccgtagtgtaagcggtgatttaatactcgaaattggcaaattaccccaacacttaactcaacgagcacaaaatgctttagataacctagtgatgttacataatagtgaacagggcggcagagcgtaccgacatgctatggaagaacttcccgacacaatagaaaccttaatgctacttgcgcttatagctgtgctaactggcggagtcacactattctttttaagtggacgtggattgggaaaaacctcaatagggttgttgtgcgtcatggcctctagtgtccttctatggatggcgtctgtagaaccacattggatcgcagcaagtataattttagaatttttcctgatggtactactcataccggaaccagatagacaacgcacaccacaagataatcagctagcctatgtagtaattggactactattcatgattttaacagttgcggccaatgaaatgggcctgctcgaaaccacgaagaaagacctcggcataggacacgtcgcagtcgagaatcatcatcatgcagcaatgcttgacgtagacctgcaccctgcaagtgcttggacactctatgcagtagccacaactataatcacaccaatgatgagacatacaatagagaatactactgcaaatatctcgctaacggcgatcgcaaatcaggcagccatattaatgggattagataagggctggccgataagcaaaatggacataggggtccctttattagcgctaggatgttactcgcaagtcaatcctttgacattgacagcagccgtattaatgctagtagcacactacgcaatcataggaccaggattgcaagcaaaagcgactcgagaggcgcaaaaacgcacagctgcaggaattatgaagaatccaacggtcgatggaatagtagcaattgacttggacccagtagtttacgacgctaaattcgagaaacaattaggacaaataatgctgcttattctatgtacatctcaaatactcttgatgcgcacaacttgggctctgtgtgaaagcataaccttagcgacaggacctttgacaactttatgggaaggatcacccggaaaattttggaatacaactattgcagtaagcatggcgaatatcttcaggggtagttacctagctggagccggacttgcatttagtttgatgaaatccctaggcggtgggagaagagggacaggtgcgcaaggtgagacattaggtgaaaagtggaaacgacaacttaatcaactaagcaaatcagagttcaatacatacaagcgttcaggtattatggaagtcgataggagtgaagcaaaagaggggcttaaacggggagagactaccaaacacgctgtgtctagaggaacagccaaattacgatggtttgtagagagaaatttggttaaacccgaaggtaaagttattgacctaggatgcggaaggggtggttggagctactattgcgctggattaaagaaagttacagaagtgaaaggatacactaaaggagggcctggacacgaagaaccaatcccaatggcaacatatggatggaaccttgtaaaactgcacagtgggaaagacgtattcttcattccaccggaaaagtgtgataccctactttgtgacatcggggaatcatcgcccaacccaacaattgaagaagggcgtacgcttagagtattgaaaatggttgaaccgtggttaaggggtaaccaattttgtattaagatactaaatccttacatgcctagcgttgtggaaaccctagaacaaatgcagagaaaacatggtgggatgttagtaagaaatccgttgagccgaaattctacacatgagatgtactgggtgagttgtggaactggaaatatagtaagtgcagtaaacatgacatcaagaatgcttcttaacaggtttacgatggctcatcgaaagccaacgtatgaaagggacgttgacttaggtgctgggacacggcatgtcgcagttgagccagaagtagctaatcttgacattataggtcagcgtatcgaaaatataaaacacgaacacaagagtacatggcattatgatgaggataacccttacaagacttgggcataccacgggtcttatgaagtgaaaccatcaggatccgcaagttcaatggtcaatggagtggtaaaattattaacgaagccatgggacgttataccaatggtaacacaaatagccatgactgatacgacacctttcggacaacagcgtgtcttcaaagagaaagtagatacgagaactcctaaagcaaaacgaggaacagcccaaataatggaagtaacggcgaaatggttatggggtttcttaagcaggaataagaaacctagaatatgcactcgtgaagagttcacgcgtaaggtacgaagtaatgcagccataggagcagttttcgtcgacgagaatcaatggaatagtgccaaagaggcagtagaagacgaaagattttgggacttagtacatcgagaaagagaactccacaagcaagggaaatgtgcaacttgcgtatacaatatgatgggaaagagggagaagaagttaggtgagtttggaaaggcgaaaggctctcgagcgatatggtatatgtggctaggtgcacgcttccttgagttcgaggcattggggttcatgaacgaagatcattggttttcacgtgagaacagtctttcaggagtcgagggagaagggctacataaattgggatacatccttagagacataagcaatataccagggggaaacatgtatgcagatgatacagcgggctgggatacgcgaattacagaagacgaccttcagaatgaagcacgaataacggacattatggaacccgaacatgcactcctagctaaaagcatctttaaacttacttaccaaaacaaggtagttagggtacaacgtcccactaaaaatggaaccgtaatggatgtcataagcagacgtgatcaaagaggctccggccaagttgggacatacggactcaatacttttacgaatatggaggcacaactgatcagacagatggaatcagaaggaattttctccccaagtgaactagaaacacctaaccttgcagaaagggttttagactggcttgagaaatatggagtagagagattgaaacgcatggccatatccggcgacgactgtgtggtcaagcccgttgatgatcgttttgctacagctctcacagctttgaatgacatgggtaaagtaaggaaagacataccgcagtgggagccctctaaagggtggaatgattggcagcaagtaccgttttgttcacaccactttcaccagctcattatgaaagacggaagagaaattgtcgtaccatgtagaaatcaagatgaattagtgggccgcgcgagggtaagccaaggtgccgggtggagtctacgtgagactgcgtgtttaggaaaatcttacgctcaaatgtggcaactaatgtactttcatcgccgagatttgaggctggctgcgaacgcaatatgttcggcagtacccgtagattggatccccaccagcagaactacgtggagcatacacgcccaccatcaatggatgacaacagaagatatgctcagcgtatggaatcgagtatggattgaagaaaatccatggatggaggataagacacacataagcagttggggagacgtaccttatctaggcaaaagagaagatcagtggtgtgggtcactcataggtttaacggcacgcgcaacctgggcaacgaacatccaggttgccataaaccaagttagaaggttaataggcaatgaaaactatcttgactatatgaccagtatgaaaagatttaagaacgaaagtgatccagaaggtgccctatggtaa

SEQ ID NO: 21930 - RNA, 9879 nt, synthetic construct
  misc_feature 1..9879: note = derived and/or modified CDS sequence (opt6) from DENV-1__EU482486__SS-prME
  source 1..9879: mol_type = other RNA
tctgtaactatgcttcttatgctgatgccaactgctttagctttccatttaactacgagaggaggagaaccccatatgatcgtttcaaaacaagaaagaggaaaatcgctactctttaaaacttcagcaggagttaatatgtgcacactcatagcaatggacttaggagaattatgtgaagataccatgacatataaatgtccgagaataacagaagtagaaccagacgacgtagactgctggtgtaacaccaccgatacttgggtaacctatggaacttgttctcaaacaggtgaacatcgaagagataaacgaagtgttgcactagcgccacatgtgggattaggtctagagacgcgtgctgaaacttggatgtcatctgagggagcatggaaacagattcaaaaagttgagacttgggcactaaggcaccctggatttacagtaatagcattattcttagcacacgcaatcggtactagcattactcaaaaaggtataatcttcatactcttgatgttggttacaccctcaatggccatgcgatgtgttggcataggaagtagggatttcgtggaaggcctaagtggagctacatgggtcgatgtcgtattggaacacggttcttgcgtaacgactatggccaaagataaacctacactggatatcgaactgcttaaaaccgaagtaacaaatcctgcagttctaagaaaattgtgtatagaagcaaaaatctcgaacacaacaaccgatagtaggtgcccaacccaaggggaggcaacactggttgaggaacaagatgcgaattttgtttgtagacggacttttgtagatagagggtgggggaacggctgtggtttatttggaaaaggttctttaattacatgcgcgaaatttaaatgcgttacaaaactggaaggcaaaatagtgcaatatgagaatctcaaatactctgtcattgttacggtccataccggggatcaacatcaagtaggaaatgagagcacagaacacgggaccactgcaacaatcacaccgcaggccccaacatctgaaatacaattgactgattatggcgcacttacactggactgttctccgcgaacagggctagattttaacgaaatggtacttctcacaatgaaagagaaatcttggctggtacacaaacaatggtttttagacttgcctcttccatggactagcggggcatctacatcacaggaaacgtggaatagacaagacctgctcgtaacatttaagactgctcatgcgaagaaacaagaggttgttgtattagggtcacaagagggtgccatgcacactgctttaacaggtgctacagagattcaaacatccggaactacaaccattttcgcaggtcaccttaaatgtagattgaaaatggataaactaacactcaagggtatgtcatatgttatgtgcactggactttttaaattggagaaagaggtggcagagacccagcatggtaccgttctagtacaaatcaaatatgagggtactgatgccccctgtaaaatcccattttcaactcaagacgaaaagggcgtaacccaaaatggaagattaataaccgcaaacccaatagtaacagataaggaaaaacctgtaaatatagaagccgaaccaccttttggtgaatcctacatcgtaataggggctggagaaaaagctctaaaactgagttggttcaagaagggtagtagcattggaaagatgttcgaagctaccgctagaggagcgaggagaatggctatactaggagataccgcttgggatttcggctccataggaggcgttttcacgtcagtgggtaaattagttcatcagatattcggtaccgcatatggtgtcctatttagtggagtatcatggacaatgaagataggtataggtgtgctgttaacatggctcggcctaaattcaagaagtacatcattatcaatgacatgtatagcagtaggcttagtgactctttacttgggagtcatggtacaagcagattccggatgtgtcataaactggaaaggacgagaactaaagtgcgggtccggaatttttgtgaccaacgaggtacacacttggacagagcaatataaatttcaagctgactcaccgaagcgattgagcgctgccattgggaaggcttgggaagaaggagtttgcggcatccggtcagccacgagattagaaaatataatgtggagacagatatccaatgagcttaaccatatactccttgaaaatgacatgaaatttaccgttgtggttggtgatgtagtggggatactggcgcaggggaagaaaatgatcagaccacagcctatggaacataagtattcatggaaaagttggggaaaggcaaaaataataggtgctgatgttcaaaataccacttttataatagatggtccaaacactccggaatgtccagacgatcaaagggcatggaatatatgggaggttgaagactatggattcggtatctttacgacaaatatatggctaaaattgcgggactcttatactcaagtatgtgaccacagactgatgagcgcggctataaaagactcgaaagcggtccatgccgacatgggttattggatagaaagtgagaaaaatgaaacctggaagttggccagagcttcattcatcgaggttaaaacatgcatttggccaaaaagtcatacactttggtcaaacggcgtactcgaatcagagatgatcatacctaaaatctacggaggaccaatctcacaacacaactatagacctggatatttcacacagacagcaggtccttggcacctaggaaaacttgaactagatttcgatctctgcgagggcacaactgtagtagtcgatgagcattgcggaaataggggtccgtctttacgaaccacgactgtaactggtaagatcatacatgagtggtgttgcaggagttgcactctacccccactaagatttaaaggtgaggatggctgctggtatggtatggaaattagacctgttaaagaaaaggaagaaaatctagtgaagagtatggtatctgcagggtccggagaggtagacagcttttcactaggactgttatgtatttcaatcatgattgaagaagtaatgcgatccagatggagtcggaaaatgctcatgaccggcactttagctgtatttttcctattaattatggggcaattaacatggaacgacttgatcagatcctgcattatggtaggagcaaatgccagtgatagaatgggcatgggtactacttatttagctttgatggcaacctttaagatgagaccaatgttcgcggtaggactactcttccgtagactaacatcgcgcgaagtattgttgttgactattggactcagcctggtggcatcagtagaactcccgaacagtctggaagaactcggtgatgggctcgctatgggaataatgattctaaaactattaaccgattttcaatcctatcaactgtgggcaaccttattatcattaactttcataaaaacaacattctcccttcattatgcctggaaaacaatggctatggtcctaagcatagttagtttattacctctgtgtctcagcaccactagccagaaaactacatggctaccggtcctgttaggatcgcttggatgcaaacctcttacaatgttcctaatagctgaaaataaaatatggggacgtaagagctggccgctgaatgaaggtataatggctgtggggattgtaagcatcttactcagttcattacttaaaaacgatgtacctctagctggtcccttgatcgctggcggcatgctaattgcatgctatgtgatctcgggcagttcggcagacctctcgttagagaaagcagcagaagtctcttgggaagaggaagcggaacacagtggagcttctcataacattcttgttgaagtgcaggatgacggaaccatgaagatcaaagacgaagaacgcgatgatactttaacaattctgctcaaagcaacactactagcagtgagcggagtttatcccctatcaatacctgcgaccttatttgtatggtatttttggcagaagaagaaacaacgatcaggtgtactttgggacacacctagtccgccagaggttgaacgtgcagtgcttgatgatggaatatatagaattatgcaaagaggccttcttggaagatctcaggtgggagtaggggttttccaagaaaacgtatttcatactatgtggcatgtaacacgcggggcagttctgatgtatcaggggaagcgactggaacccagttgggcaagcgtcaagaaagacctcatttcatatggaggaggctggcgtttacaaggtagctggaatacaggagaggaagtacaggtaatagccgtggaacctggcaaaaatccaaagaacgttcaaaccgcccctgggacattcaaaacgcccgaaggggaagtcggagctatagctctagactttaaaccaggaacatcgggatcaccgattgtaaatagagaaggaaaaattgttggtctatatggaaacggagtggtaacaacttcagggacctatgtatccgccatagctcaggcaaaggcatcgcaagaggggccactaccagaaatagaggacgaagtattccggaagcgaaatctaaccataatggatctacacccgggttcgggtaaaacacgacgatacttaccagccatagtgagggaagcaatcaagagaaaactaaggacactcatccttgcacctactagagtagtcgcaagcgaaatggctgaggctttaaaaggaatgccaatacggtatcaaacgactgcagtcaaatcagaacatacaggacgggagattgtagatctgatgtgccacgcgacctttaccatgcgccttctatcaccggtaagggtaccaaactacaacatgatcataatggatgaagcacatttcacggatccgtctagtattgctgcgcgtggatacatatccacgcgtgtcggcatgggtgaggcagcagccatttttatgacagcgactccacctggatctgtagaggcttttccccaaagtaatgcagtaatccaagacgaggaaagggacataccggagcgttcatggaatagcggttatgaatggataactgattttcctggaaaaacagtctggttcgtaccaagtatcaaatcgggtaacgatattgctaattgtcttcgtaaaaatggtaaacgcgtaattcaactaagtcggaaaacttttgatacggagtaccagaaaactaaaaacaatgactgggattatgttgttacaactgatattagtgaaatgggcgctaattttcgagcagacagagtgatagatcccagacgatgcctaaaaccagttattttaaaagatggtccagaaagagttattctagctggacccatgcctgtaacagtagcctctgcggctcaacgtagaggacgaataggaagaaatcacaataaggaaggtgaccaatatatatatatgggccaacccctgaataacgacgaagaccacgcacattggacagaagcgaagatgttacttgataatattaacacacctgaaggaattattccggccttattcgagcctgaaagagaaaagtcggcggcaatagacggcgaatatcgactgagaggtgaagctagaaaaacttttgtagaactaatgcgacgtggggatttaccggtttggttaagttataaagtagcaagtgaaggatttcagtattcagataggagatggtgttttgatggagaaagaaataaccaggtgcttgaagagaacatggatgtggagatttggacaaaagaaggagaaaggaagaaattgagaccaagatggttagatgctagaacatatagcgatcccctcgcactgagagagttcaaagaatttgctgcgggccgtagatcagtttcaggcgatttgattctcgaaattggaaagttaccacagcatctgacacaaagagctcagaacgccttagataatttagttatgctacataatagcgagcaagggggtagggcctatagacacgcaatggaagaacttccagataccatagagaccttaatgctattagccctgatcgctgtcttgacaggtggtgtcaccctattctttttaagcggtcgcggtttagggaagacaagtataggtttactatgtgtaatggcaagttctgctttactgtggatggcatcggtagaacctcactggatagcagcctctataatattggaatttttcctaatggttttattgattccggaacctgatagacagcgaactccccaagataatcaattagcctatgtagttataggattactattcatgatattgacagtagccgctaacgaaatgggattgttagaaactactaaaaaggacttgggaataggccatgtagctgtcgagaatcaccaccatgcgacaatgctagatgtagatttgcatcccgcttcagcatggacattatatgcggttgcaacaacaatcattactccgatgatgcgtcacacaatagaaaataccacagcgaatatcagcttgacagcaattgctaatcaagctgcgattttaatgggtttagataaaggatggcctattagtaagatggatatcggtgttccgctattggccctcggatgttatagtcaggtgaatcccctaacattaactgcagcagtactgatgttagtagcacactatgctatcataggacctggcttgcaagcgaaagccacaagggaggctcaaaaacgtacagctgccggtattatgaagaatcccacagtggatggtatcgtagcaattgacttagatccagttgtatatgacgcaaagttcgaaaagcaactcggtcaaataatgctcctgatcttgtgtacaagtcaaattttgctaatgcgtaccacttgggcgttatgtgaatcaattactttagccactggtcccttaaccacattgtgggagggttcaccgggcaaattttggaacactacaattgctgtcagtatggcaaatatatttagaggctcatacctagcaggcgctgggttggctttcagtctaatgaaatctttaggaggaggcagaagaggaacgggagcacaaggtgaaaccctcggtgagaaatggaagagacaacttaatcagctttcaaagagtgagtttaatacatacaaaagaagtggcataatggaggtcgacagatctgaagcaaaagagggattaagacgtggagagacaacgaagcatgcagtatcccgcggcactgccaaactacgttggtttgtagagcgtaatttagtcaaacccgaaggaaaggtaatagaccttggatgtggacgaggcggctggtcttactattgtgcagggttaaagaaggtaacggaagtaaaaggatatacaaaaggtgggcctggtcatgaagaacccatcccgatggctacttatggatggaacttggtaaaactacactcaggtaaagacgtctttttcataccaccagaaaaatgtgatacgctcctgtgtgacattggtgaatccagtccaaaccccacaattgaagaaggaagaactttacgagtacttaaaatggttgaaccatggctcagaggtaatcagttttgtatcaaaattctaaatccctacatgccatccgtagtggagacattagaacaaatgcaaagaaaacatggcggaatgttagtaagaaaccctctttccagaaattcaactcacgaaatgtattgggtaagttgtggtactggtaatatagtatcagctgtcaacatgaccagccgaatgctattaaacagatttacaatggcccacagaaaaccaacatatgagcgagatgtggatctgggcgcggggacaagacatgtagctgtagaaccagaagtagctaacttggatatcataggacaacgtattgaaaacataaagcatgagcataaaagcacatggcattatgacgaagacaatccgtacaaaacgtgggcataccacggatcatacgaagtaaaaccgagcggcagtgcgtcatcaatggtaaacggagttgttaaactgttaacgaaaccatgggacgtaatcccgatggtgactcaaattgctatgacagatacaacgccatttggacaacaaagagtctttaaggaaaaagtagatacccgaacaccaaaagccaaacgtggaacagcacagataatggaagtaactgcgaggtggctgtgggggtttctttctcgaaataagaaaccgagaatttgtaccagggaagagttcaccagaaaagttagatcaaacgccgctattggcgccgtgttcgtagacgagaatcagtggaactcggctaaagaggctgttgaagatgaaagattttgggaccttgtgcatagagaacgcgaattgcataaacaaggcaaatgtgcgacttgtgtatataatatgatgggtaaacgagagaagaaattaggggaatttggtaaagcaaaaggtagtagagctatttggtacatgtggctcggggctagatttctagagttcgaagcacttggctttatgaatgaagaccattggttctcccgagaaaattcactgagtggcgtggaaggagagggtttgcataaacttgggtacattcttcgtgatatctcaaaaataccaggaggtaatatgtatgccgacgatacagcaggatgggacacaagaatcacagaagatgatctacaaaacgaggcaaaaataactgacataatggagcctgagcacgctctgcttgcgacaagtatctttaaactaacatatcaaaataaggttgtaagagtccagagaccagcgcggaatggcactgtgatggacgtaatctcccggcgtgatcagagaggctcgggccaagttggtacatatggcctaaataccttcacaaatatggaagcgcaattaattagacaaatggaaagcgaaggaatattcagcccatcagaactagagacgcctaatcttgcagaaagggtacttgattggctagaaaagcatggagtagaaagactaaaacgaatggccatatcaggtgatgactgcgtagtcaagccaatagacgatagattcgccacggcactttcggcactcaatgacatgggaaaagtgcgaaaagacattccgcaatgggagccaagtaaaggttggaatgattggcaacaggtccccttttgtagtcaccacttccaccaactgataatgaaagatggtagagaaattgtcgtcccctgtaggaatcaagatgagcttgttggcagggctagggttagtcaaggagccggttggagtctacgagagactgcatgtcttggtaaatcgtacgctcaaatgtggcaacttatgtacttccatcgacgcgatcttcgtttagctgcgaacgccatttgcagcgcggtaccggtagattgggtcccaacatctaggactacatggtcaatccatgctcaccaccagtggatgacaacagaagacatgttaagtgtatggaaccgcgtatggatagaagaaaatccgtggatggaagacaaaacccatatatcttcatggggtgatgttccgtatttgggaaaacgagaagatcagtggtgtggatcattgatcggattaactgctagagctacgtgggcaaccaacatccaagtagctattaaccaagtgcgtagactgataggaaacgaaaattatttagattatatgacaagtatgaagcgatttaagaatgactccgaccccgaaggtgcattgtggtag

SEQ ID NO: 21931 - RNA, 9879 nt, synthetic construct
  misc_feature 1..9879: note = derived and/or modified CDS sequence (opt6) from DENV-1__EU482487__SS-prME
  source 1..9879: mol_type = other RNA
tcagtgacaatgctactgatgttaatgccgacagctttagcgttccatcttacaacaaggggaggcgaaccccacatgatcgtaagcaaacaagaacgcggtaaatccctcctttttaaaacgagcgcgggagttaatatgtgcacactgattgcaatggatctgggggaactatgtgaagacacgatgacatataaatgtccgcgaataacggaaactgagccagatgatgtagattgctggtgtaatgcaacagatacttgggtgacatatggaacttgcagtcaaactggggaacatagacgggacaaacgcagtgtggcattagcccctcatgtaggtttgggtcttgaaacgagaacagaaacttggatgagcagcgaaggagcatggaaacaaattcaaagagtcgaaacttgggcacttcggcacccaggatttacagtgatagcactcttcctagcacatgcaatagggacttcaataactcaaaaaggtataattttcatcttactcatgctagtcactccttcaatggccatgcggtgcgttggaatcggctctagagattttgttgaaggtttatccggcgcgacctgggtagatgtggtactagagcatggttcctgtgtaacaaccatggcaaaagacaagcctacactagacatagaattactaaagactgaagtaacaaatccagcagtactacgaaaactgtgcatagaagccaaaatatcaaatacaacaaccgatagccgatgtccaacccagggtgaagccacacttgtggaagaacaagacgccaacttcgtttgccgtagaacctttgttgatcggggttggggcaacggctgtgggttatttggcaaaggatccttaatcacctgtgcaaaatttaaatgtgttacaaagctggaaggtaaaatagttcagtatgaaaatttaaaatattcggtaatagtgaccgtgcataccggagaccaacaccaagtagggaacgagtctaccgaacacggcacaactgcaaccattacaccccaagctccaacaacagaaattcagttaaccgattatggagccctaactttggattgtagcccacggacagggttagatttcaatgaaatggttttactaacaatgaaagagaaaagttggctcgtgcataaacaatggtttctagatctaccactaccatggacaagtggagccagcacaagccaagagacgtggaatcggcaagatttgctcgtgacatttaaaacagcacatgcgaagaaacaggaagtcgtagtgctaggttcacaggagggagctatgcacacggccctcaccggcgctacagagattcaaacctctggaacaacaacaatatttgctggacatctaaaatgcagactgaaaatggacaaactgacactaaagggcatgtcatatgttatgtgcacgggtagcttcaaacttgaaaaagaggtagctgaaacccaacatggaacagtgcttgtccaaataaaatatgaaggaacagatgctccatgtaaaatacctttctcaacacaagatgaaaaaggagtaacacagaacgggagattgattaccgcaaatcccattgtaacggacaaagagaaaccggtaaacatagaggcagaacctccatttggtgaaagctatattataatcggcgccggcgagaaagcacttaaactttcctggttcaagaaaggaagttctataggcaaaatgttcgaggctactgctcggggtgcacgcagaatggctatactaggagatacagcttgggactttggaagtattggcggtgtatttaccagcgtaggtaagttggttcaccaaatatttggtacagcgtacggggttttgtttagtggtgtcagctggactatgaagataggaataggagtattacttacatggttaggactaaattcacgcagtacgagtctaagtatgacgtgcattgcagtaggattagttacattgtatttaggagtaatggtgcaagcagactccggctgtgtaataaactggaaaggaagggagttaaaatgcggatcaggaatattcgttactaacgaagtacatacgtggactgagcaatataagtttcaagctgattccccaaaacgcctcagcgctgctataggaaaagcatgggaagaaggagtgtgtggaataaggagcgccaccagattagaaaacataatgtggaagcaaatatcgaatgaattaaaccacatactattagaaaatgatatgaaatttaccgtcgttgtaggcgatgtcgcaggtatattggcgcaaggtaagaaaatgataagaccccaaccaatggaatacaagtattcatggaaatcatggggaaaggcaaaaataatcggtgctgatgtccagaataccacatttattatagatggtcctaacacccctgaatgcccagacgatcaaagagcgtggaatatctgggaggtagaggattacggtttcggcatctttaccacaaacatttggctgaaactaagagatagtcatacgcaagtatgtgatcatagattaatgtctgccgctatcaaagatagtaaggccgtacacgctgacatgggttattggattgaatcagccaaaaatgaaacttggaagttagctcgagcttctttcatcgaagtgaaaacctgtatatggcccaagtcacataccctatggtcgaacggtgtactagagtcagagatgattattcctaaaatatacggtggacctatttctcaacacaattacagacccggatacttcacccaaactgctgggccttggcatctaggaaagttggaattagattttgatctatgcgaaggaacaactgtagtagtcgatgaacactgcggtaaccgaggtccttcactacggacaaccaccgtaactggaaaaataattcatgagtggtgttgccgtagttgcacgctaccacctttaagattcagaggcgaggacggctgctggtatggcatggaaataagacctgtcaaagaaaaagaagagaatttagtgaaatctatggtgagtgccggaagtggagaagtagattcattttctctaggcttgctgtgcatatcaattatgatagaagaagttatgcgctctagatggagccgtaagatgttgatgacaggaacattagcggttttcttcctgttaataatgggtcaattaacttggaatgatttaattcggctatgtataatggtaggagccaatgcctcagataggatgggaatgggtacaacatatttggcactaatggctacattcaagatgagacccatgtttgcagttggattactatttcgaagattaacttcccgtgaagtactactgttgacaatcgggctttctctggtggcttcggtagaactacccaacagtctcgaagaattaggagatggtctggcaatggggattatgattcttaaattattaacagattttcagtcacatcaattatgggcaacattgttaagtctcacattcattaaaactacattttctcttcattatgcatggaaaacaatggctatggtactatctatagtttcattattcccattgtgcttgagtaccacaagtcagaaaacgacttggctccctgtactcctagggtcgctcggatgcaaacctttaacaatgtttttgatcgctgaaaacaagatctggggtcgtagaagctggccacttaacgagggaataatggctgtaggtatagtcagcatactactttcaagtttactcaaaaatgatgttcctctagccggtcctctgattgcaggaggaatgctgatagcatgttatgtaataagtggatccagtgcggacttgtcactagagaaagcagcagaagtatcctgggaagaagaagcagaacactcgggagcttcacataatatattagtcgaggtacaagatgacggcacaatgaagataaaggatgaagaaagagacgatactttaacgatactcctaaaagcgacactgctagctgtttcgggagtttaccctctgtcaatacctgcaactcttttcgtctggtacttttggcagaagaagaaacaaagaagtggagtactatgggatacaccttctccaccggaagtagaacgcgccgttctcgatgatggtatttatcgtataatgcaacgaggcttactaggaagaagccaagttggagtaggtgtatttcaagagaacgtttttcacactatgtggcatgttacaagaggtgcagtgttgatgtaccaaggtaagaggttggaaccctcatgggcttccgttaagaaagatttgatatcctatggagggggatggagattgcaaggatcatggaacacaggagaggaagtacaggtcattgcagtagaaccaggcaaaaacccgaaaaacgtacaaacggcgccgggaacattcaagactccggaaggagaagtcggagcaattgctctcgacttcaaacctggcacctctggatcacctatagtaaatagagaaggtaagatagtaggtttatatggaaatggagtagtgactacgagtggtacatacgtatcagcaatagcccaggcgaaagcaagtcaggagggaccattacctgaaattgaagatgaagtctttagaaaacgcaatctgacaataatggatctccaccctggttcaggaaaaacccgacggtatttaccagcgatcgtcagagaggcgattaagagaaagttgcgaactcttatattagcaccaacacgtgttgttgccagtgaaatggctgaagcgttaaaaggcatgcctatacgttatcaaactactgcagtaaaatcagaacacaccggcaaagaaatagttgacttaatgtgtcatgcaacatttacaatgaggctattatcgccagtacgcgtcccaaattataacatgattattatggatgaagcacacttcacagatccatcctcgattgcggcacgcggttatatatctacaagggtcggaatgggagaggctgcggccatatttatgactgcaactccacctgggtccgtagaagcgtttccccaaagtaacgctgtaatacaggatgaagagagagatatcccagaaaggtcatggaactccggttacgaatggatcactgactttcctggaaaaacagtatggtttgtaccatcaattaaatccggaaatgacattgctaattgtctcaggaaaaatggtaaacgagtaatacaactcagcaggaaaacatttgatacagaatatcagaaaactaagaacaatgactgggattatgtagttaccacggacatctcagaaatgggggccaattttagagcagatagggttattgatccccgcagatgtctcaagccagtaatcctaaaggatggacctgaaagagtgattcttgctggtccaatgccagttacagtagccagcgcagctcaaagaagaggaagaattggaagaaaccacaataaagaaggagaccagtacatatacatgggacaacccttaaataacgatgaagaccatgcgcattggaccgaagcaaaaatgctgttagataatatcaatacccccgaaggtattatcccggctttatttgaaccagaaagggaaaagtcagcagcgattgatggagaatacaggcttcgtggagaagcccgaaaaacatttgttgaactgatgcggagaggtgacctgccagtatggctgtcttacaaagtcgcctcagaaggattccaatattcagatcgtaggtggtgttttgacggtgagagaaataaccaagttctagaagaaaatatggatgtagaaatatggacgaaagaaggagaaagaaagaaacttcgcccccgatggctcgatgcacgaacatactctgatcccttagccctaagggaatttaaagaatttgcggcaggaagaagatcagtatccggggacctaatacttgaaattggcaaattaccacaacacctaacccaacgtgcacaaaatgctttagataatttggttatgcttcataattcagagcagggtggtagagcttaccggcatgcaatggaagaactaccagacacaatagaaactcttatgcttctagcactaatcgcggtcttaacaggtggagttacgttattctttttgtcgggcaggggattaggaaagacgtctataggattactgtgcgtcatggcaagttccgtcctgttgtggatggcatccgttgaaccgcactggattgctgcctcaattatacttgagttctttcttatggtactcctcattccagaacctgaccgtcaacgaactccgcaagacaaccaactagcttacgtagtaatcggattactatttatgatactaacagtagcagcaaatgaaatgggactcctagaaacaactaagaaagacctcggaatcggtcacgccgcggtagaaaaccatcaccacgcagctatgcttgatgtcgatctccaccctgcaagtgcttggacattatatgcagtagccactacgataataactccgatgatgagacatacaatagaaaacaccactgctaacatttcactaaccgcaattgcaaaccaagcagctattctcatgggattagacaaaggttggccgattagtaaaatggacatcggtgtcccgctgctcgctttagggtgctactcccaggtaaatccactaactttaacagcagcagtacttatgttagtagcacactatgccatcattggaccaggcttgcaagctaaagctacacgagaagcgcagaaaagaactgcagctgggatcatgaaaaatcctacggtcgatggcatagtagcaatagaccttgatccggtcgtctacgatgccaagtttgaaaaacaattaggacaaatcatgttattaatcttgtgtacaagtcaaattctactcatgcgaaccacatgggcactgtgtgaaagtataacgcttgcaactggtccgttgacgacactatgggaaggatcaccaggaaagttttggaacacaacaattgcagtaagtatggcaaacatttttcgagggtcgtaccttgcaggggcaggtcttgccttctctttaatgaagagtctaggaggtggtagacgaggtactggagctcagggtgaaaccctaggggaaaagtggaagaggcaattgaatcaattgagcaaaagcgaatttaacacttacaaacggtccggcataatggaagtagatcgaagtgaagctaaagaggggttaaagagaggagaaacaacaaaacatgctgtaagcaggggtacagccaagttaagatggttcgttgaaagaaacttagtaaaaccagaaggtaaggttatcgacctaggctgcggcaggggcgggtggagctattattgcgcaggactaaagaaggttaccgaggtaaaaggatataccaaaggtgggccaggacatgaggagcctattcccatggcaacctatgggtggaacctagttaaacttcattcaggcaaagatgtcttctttataccaccagagaaatgtgatactttgctttgcgacatcggtgagagctcgcccaatcctactatagaagaaggacgcacgttaagggttctgaaaatggtagagccgtggctcagaggcaaccaattttgcataaaaatcctaaatccatacatgcccagtgtggtagaaactttggaacagatgcaacgtaagcacggaggcatgttagtaagaaatccattgtctaggaatagcactcacgaaatgtattgggtcagctgcggtaccggcaatatagtaagcgcagttaatatgacgagtcgaatgcttctaaaccgcttcactatggcacaccgaaagccaacttacgaaagagatgtagatctaggtgcaggtactcgtcatgtcgctgtagaacctgaagtagccaatttagatataatagggcaacgaatcgagaatatcaagcatgaacataaaagcacctggcactatgacgaagataatccttacaaaacgtgggcttaccatggtagctacgaggtaaaaccatcaggctccgcctcgagtatggtaaacggggttgtaaagttattgacgaagccatgggacgtcataccgatggtgacacaaattgccatgacagatacaacaccattcggccaacaacgtgttttcaaggaaaaagttgatactagaactcctaaagcaaaaaggggcacagcgcaaattatggaagtcacagctaaatggctatggggcttcctatcgagaaataagaaaccaaggatatgtactcgtgaggaatttacccgcaaggttcgttctaatgctgcgatcggcgcagtattcgtagatgaaaaccagtggaactctgcaaaagaggcagtcgaagatgagagattttgggatctagtacatagagagagagaactgcataaacagggtaagtgtgcaacttgcgtctataatatgatgggaaaacgcgagaaaaagttaggcgaatttggtaaagcgaaaggaagtagagccatctggtatatgtggttaggagctagatttctagaatttgaagcgttaggattcatgaacgaagaccactggttctcacgagaaaattctctttcaggtgtcgaaggagagggactacacaaattaggctatatattacgagacatatctaaaattcctggaggaaatatgtatgctgatgataccgcggggtgggatactagaataacggaggatgatttacaaaacgaagctaggatcacggatatcatggagccagaacatgcgttactcgctaagagtatttttaaattaacttaccaaaataaagttgtaagggttcaaagacccgccaagaatggtactgtaatggatgtgataagccgtcgggatcaacgtggatcagggcaagttggaacatatggactcaatacctttactaatatggaagcccaacttataagacaaatggagtcggagggtatattttcacctagtgaacttgaaacaccaaacctcgcagaacgcgtccttgattggttgaaaaagtatggagtagagcgtttaaagagaatggctatatccggcgatgattgtgtagtaaagccgattgatgatagatttgccactgcgcttaccgcactgaatgatatggggaaagttagaaaggacattccccaatgggagccttctaagggatggaacgactggcaacaagtgccattttgctcacaccatttccatcaactaataatgaaagatggaagggagatcgtagtcccatgcagaaatcaagacgaattagttgggcgtgctagagtatcacaaggagcaggatggagccttcgcgaaaccgcatgcttaggaaaatcgtatgcccagatgtggcaattgatgtattttcaccgacgagatctccgactagctgcgaacgctatatgttccgctgtgccagtcgactggataccaacatccagaacgacatggtctatacatgcacatcaccaatggatgactaccgaggatatgctcagcgtttggaacagagtctggatcgaggaaaacccctggatggaagataaaacccatatctcatcatggggagacgttccatacctcggcaaaagggaagatcaatggtgcggaagcctgataggtctgactgctagagcaacatgggcgaccaacatccaagtagcaattaatcaggtccggagattaataggtaacgaaaactacttggattacatgacatctatgaagagatttaaaaacgagggagacccggaaggggctctatggtga

SEQ ID NO: 21932 - RNA, 9879 nt, synthetic construct
  misc_feature 1..9879: note = derived and/or modified CDS sequence (opt6) from DENV-1__EU482488__SS-prME
  source 1..9879: mol_type = other RNA
agtgttactatgttattgatgcttatgccaactgcgctagcgttccatctaactacacgaggaggggaaccacacatgatcgtatcaaaacaagaaaggggtaaatcattattgttcaaaacatcagctggagtaaatatgtgcactttgatagcaatggatttaggtgaattatgcgaagacaccatgacatataaatgcccaaggataacagaagcggaacccgacgacgtggattgctggtgtaatgcaactgacacatgggtgacatacggaacgtgctcacaaacaggagaacacagacgcgataaacgctctgtagcattagcaccacacgttggtttgggtttggaaacacgaacagaaacctggatgtcaagcgaaggagcctggaaacaaattcaacgtgttgaaacatgggctctacgccatccaggtttcacggtaatagcactatttttagcacatgcaataggaacatcgatcactcaaaaaggtattatatttatacttttaatgttagtaacacccagcatggctatgaggtgtgtaggaattggatcgcgcgattttgtagaaggcttatctggtgcaacttgggtcgacgtagtactagaacacggcagttgtgtcaccactatggcgaaagataaacccacactagatatcgaattgctgaaaactgaggttacaaatcccgcagtgttacgaaaactttgtatcgaagcaaaaataagtaataccacaacggattcgcgttgccccactcaaggggaagcaactttagtagaagaacaagacgctaattttgtttgcaggcgcacatttgtcgacagaggttggggcaacgggtgtggcctatttggaaaaggatccctcattacctgtgccaaattcaaatgtgttactaaattagaaggaaaaatagtacaatatgaaaatctcaagtactccgtcattgtcacggtgcacacaggagatcaacatcaagtaggcaatgaatctacagagcatggcacaacagcgactataactccacaagctccatcaaccgagattcaactcactgactatggtgcactgacgctagactgcagcccaaggacaggattagattttaatgagatggtacttctaactatgaaagagaaaagctggcttgtccataaacaatggtttctagacttacctttaccttggaccagtggagcatctacctcccaagaaacttggaaccgtcaagatttattagtgacatttaaaaccgctcacgcaaagaaacaggaagtcgttgtgctaggtagtcaagaaggcgccatgcatactgctttgacaggtgcaacagagatacagacaagtggaacgacaacgatttttgcaggacacctgaagtgtaggttaaagatggacaaattaacacttaaaggaatgtcatatgtaatgtgtactgggtcttttaaactagaaaaagaggttgcagaaacacaacatggaactgtcctggtgcaaatcaaatatgagggtaccgatgcaccttgcaagattcctttctccacccaagacgaaaaaggagtgacacaaaacgggagacttataacagctaatcctattgtgaccgacaaagaaaaaccagtaaatatagaagctgagccaccgtttggtgagagttacattgtcataggggcgggagaaaaagcattaaaactatcatggtttaaaaaggggtcatcaattggtaaaatgtttgaagccacggccagaggtgctaggagaatggcaatattaggggatactgcctgggactttggtagtataggaggagtcttcacaagtgtaggtaagttggttcaccaaattttcggtacggcttatggtgtattattttctggagtatcctggactatgaaaataggaatcggagtcctcttaacatggttaggattaaactctaggagcacaagcctaagcatgacatgtatcgctgtagggctcgtaaccctctacttgggagttatggtacaggcggattcaggctgtgtgataaattggaaaggtagggaactgaaatgcggaagtggtatatttgtaacgaacgaagtccacacctggacagaacaatataaatttcaagccgattcaccgaaacgtttatcggcggccatcggtaaggcttgggaggagggtgtatgtggcattcgatctgctacgagattagaaaacataatgtggaagcaaatctcaaacgaattgaatcatattttactagaaaatgatatgaaactaactgtcgtagtaggcgatgtagcaggcatactagcacaaggcaagaaaatgatcagacctcaaccaatggagtacaaatactcctggaagtcatggggaaaagccaaaataattggagcggacgttcagaacacaaccttcattatagatgggccgaataccccggaatgtccagacgatcagagagcttggaacatatgggaggttgaagactacggctttggaatatttacaactaatatctggcttaaactccgtgatagttacacccaggtatgcgatcaccgcttgatgagtgctgctatcaaagattctaaagcagtacacgcagatatggggtattggatagaatcggagaaaaacgagacctggaagctcgcaagagcatccttcatagaagtaaagacctgcatttggccaaaatcacatacgttgtggagcaacggcgttctcgaaagcgagatgataatcccgaaaatttacgggggacccataagtcagcataattaccggccaggttattttactcaaacagcgggaccctggcatttgggtaaacttgaattagactttgatttatgtgaaggaactacagtagtagtcgacgaacattgcggaaaccgaggaccaagtcttagaactacgacagtaaccggaaagataatccatgaatggtgctgtagatcttgtactttgcctccattgaggtttaaaggcgaggatggctgctggtacgggatggaaattagaccagtcaaagaaaaagaggaaaacctagtgaagtcgatggtcagcgcgggatccggggaggtggattcgttttccttaggattactatgtattagcataatgatagaggaagtcatgcgaagtcgctggagcaggaaaatgctgatgacagggactttagccgtattctttcttttaataatgggtcagttaacatggaatgatttaattcgcttatgtataatggtaggagctaatgcctcagatcgcatgggaatggggacaacctatttagccctcatggctacctttaaaatgcgacctatgttcgcggttggattgctgttcagaagactgaccagcagggaagtcctgctactaacaataggattatctttagtagcttctgtagaattaccgaacagtttagaggagttaggtgatggactagccatgggaataatgatccttaaattattgaccgactttcaatcccatcaattatgggcaacactactatcactgacattcatcaggactacattttcactccattacgcatggaagacgatggcaatggtactatccatcgtatccctctttccactatgcctgagcaccacgagccagaaaaccacatggctacccgtacttctaggctcgcttggttgcaaaccgttgaccatgttccttatcgctgaaaacaagatctgggggcgaaaaagctggccccttaatgaaggaataatggctgtcggcatcgtatcaatcctattgagctctctactgaaaaatgatgtccctttggcaggcccattaatagcaggcggaatgctaatagcatgctatgttatatcaggatcatccgctgacctgtctctagaaaaggccgcagaagtatcatgggaggaagaagccgagcattccggagcgtctcataatattttagttgaagtacaagatgacggtacaatgaagataaaagatgaggaacgtgatgatacactgacaatactacttaaagcaacgttactcgctgtgtccggcgtttatcccttatctatcccagccacactattcgtctggtatttctggcagaagaagaaacaaagaagcggagttttatgggatactccaagtccacctgaagtcgaacgcgcagtattagatgatggaatttacagaattatgcaaaggggactcttaggccgtagtcaagtcggggtaggcgttttccaggaaaatgtgttccatacaatgtggcatgtcacaagaggcgcagttcttatgtaccaaggtaaaaggctagaacccagttgggcatcagtcaagaaagatttaatctcatatggaggaggttggaggttgcagggtagttggaataccggcgaagaggtgcaagtaatcgcagtagaacccggcaaaaatcccaaaaatgtacaaacggcaccaggtacatttaagacctcagaaggcgaagtgggagcgatagctctcgacttcaagccaggaacctcgggatctccgatagtaaacagagaaggaaaaatagtcggtttgtacggaaatggcgtagtaacgacttctggaacctacgtctccgcaatcgcccaagctaaggcttcacaagaaggaccactgcccgaaattgaggacgaagtgtttcgaaagagaaacctaacgatcatggatttacatcccggtagtgggaaaacaagacggtatttgccggccattgtacgcgaagcgataaaacgaagattaagaacacttatattagcaccaactagagttgtagcatccgagatggcagaagcactaaaaggaatgccgataaggtatcaaactactgctgtaaaaagtgaacacacaggaaaggagattgtagacttaatgtgccatgcaacctttaccatgcggttgctttcgccagtcagagtgccgaactataatatgataattatggacgaagcacatttcaccgacccatctagtatagccgcacgaggctacatttcaacgcgagtaggcatgggggaggctgcagcaatattcatgacagctacccctcctggatctgtagaggcctttcctcaaagcaacgctgtaattcaagacgaagaacgagacattccagaacgctcttggaactcgggatacgaatggataactgatttcccgggcaaaacagtctggttcgttccgtcaatcaaatcgggaaacgacattgccaactgccttcgcaaaaacggtaagcgtgtaattcaattatcaagaaagactttcgacactgaatatcaaaagacgaaaaataatgattgggattatgtggtcacaaccgacatatctgagatgggagccaattttagggcagacagagtgatcgacccaaggagatgtctcaaacccgtaattcttaaagacggaccagaacgagttattctggcagggccaatgccagttacagtggcatcggcagctcaaagacgaggcagaattggtaggaatcacaacaaagaaggcgaccaatacatatatatgggacaaccattaaataacgatgaggaccatgcgcattggacggaagctaagatgctactagacaatatcaatacgccagagggtatcattcccgccctgttcgaaccagaaagagaaaagtcggcggcaatagacggcgaatatcgtcttagaggagaagctagaaaaacattcgtagaactgatgcgtagaggcgaccttccagtctggttatcttacaaagtagccagtgaaggatttcaatatagcgatagaagatggtgcttcgatggcgagaggaataatcaagtcttagaagaaaacatggatgtagaaatttggactaaagagggtgaaaggaagaaattacgacccaggtggttagacgcaagaacttacagcgacccacttgcgctaagggaatttaaagaatttgcagcaggacgtcgtagcgtcagtggcgatttaatattagaaataggaaaattaccacaacatttgactcaacgagcacaaaatgcactcgacaatcttgttatgcttcataattcagagcaaggagggagggcatataggcacgcaatggaggaactaccagatactattgagacgctcatgttactggcacttatagcagtattaacaggtggtgtaacgcttttctttttaagcggaagaggtcttggaaaaacatcaatagggctactgtgtgttatggccagcagcgttttgttatggatggcatccgtcgagccacattggatagcagcatcgataatattggaatttttccttatggtactgctaatccctgagccagatagacagcgaacacctcaggacaatcaactagcctatgtagttattggacttctatttatgatcctaactgtagccgcgaacgaaatgggattattggagaccaccaagaaagatctaggaattggacatgtagctgtagaaaaccaccatcacgcagctatgttagatgtagatctgcatcctgcatccgcgtggacattatatgcagtagcgacaacaataatcacaccaatgatgagacacacaatagaaaatacgactgcgaatatatcacttacagcgattgcaaaccaggcagcaattttgatgggactagacaaaggatggcctattagtaaaatggatataggagtgccacttctagccttaggatgttactctcaagtaaatcccttgacattaacagctgcagtactaatgctggtcgcgcattacgcaataattggccccggtctacaagctaaagcaacgcgcgaagctcagaaaaggacagctgcaggcataatgaaaaaccctactgttgatggtatagttgcaattgatctagatcccgtcgtctacgatgctaagtttgagaaacaattaggtcagattatgctattgattctatgtaccagtcaaattctcctaatgagaactacgtgggccttatgcgagtccatcacgctagctacaggaccactaaccactttatgggagggctcaccaggtaaattttggaacacaactatagcagtatccatggcaaacatattccggggtagctacctagcaggagctggcctggcttttagtctaatgaaaagcctagggggaggaagaagaggaacgggcgctcaaggggaaacactaggtgagaagtggaagagacagcttaatcaattatcaaaatccgagttcaacacctacaaacgaagtggcataatggaagttgatcggtcagaagcaaaggaaggattaaaacgaggcgagactactaaacatgcggtttcaagaggaactgctaaattaagatggtttgttgagcgcaacttagtaaagccggaaggaaaagttatagacctcggatgtggtcgaggcggttggagttactattgtgctggcttgaagaaagtcacggaagttaaaggatatactaaaggtggcccaggccacgaagaaccaattccaatggcaacctacggatggaatctcgtaaaattacactccggaaaggatgttttctttatacctcctgagaagtgtgacacacttttatgtgatataggcgaatcttcgccaaatccaaccatagaagaaggaaggaccctacgggttttaaaaatggttgaaccgtggttaaggggtaaccaattctgtataaaaatactcaacccctacatgcccagcgtagttgaaactcttgaacagatgcaacggaaacatggagggatgctcgttcgtaatccactttcgagaaattccacacacgagatgtactgggtttcatgcgggacaggaaacattgtttcggctgtaaatatgacgagtagaatgcttttgaatagatttacaatggcacaccggaaacctacctatgaaagagacgtcgatcttggagcgggaacaagacacgttgcagtggaaccagaggtcgcgaacttggatattataggacagagaatagaaaatataaaacatgagcataagtccacatggcactatgatgaagacaatccgtataaaacttgggcgtatcatggaagttacgaggtaaagccgagcgggagtgcatcgtcgatggttaacggcgtcgttaagctactaacgaagccatgggacgtgataccaatggttacccaaattgcaatgacggacaccacgccttttggccaacaacgagtttttaaagaaaaagtcgatacaaggacccccaaagcaaaacgaggtaccgcgcaaatcatggaagtaaccgctaaatggctatggggtttcttatcaagaaacaagaaaccacgaatttgtacaagggaagagttcacaaggaaggttagatcaaatgctgcaatcggagccgtatttgtggatgaaaaccaatggaatagtgcgaaagaggcggtagaagatgagagattctgggatttggttcatagagaaagagagctccataaacaaggaaaatgtgccacatgcgtctataatatgatggggaaaagagagaagaaattaggcgaatttggaaaagcgaaaggctcacgcgcaatctggtatatgtggttaggagctcggttccttgagttcgaagcattaggtttcatgaatgaggatcattggtttagccgagaaaattctttaagcggtgtagagggcgaaggactacacaaacttggatatatcctaagggacatttcaaaaattccaggaggtaatatgtatgccgatgatactgctgggtgggatacaagaatcactgaagatgatctacaaaatgaggctaaaattaccgacataatggaaccagaacatgcgctacttgctaagtcaatattcaagttaacgtatcaaaacaaagtagttcgcgtacaacgacctgccaaaaacggaacagtaatggacgtaattagtcggagagaccaaagaggatctgggcaggtcggcacgtacggtttaaacacctttactaatatggaagcacaattaatacgtcagatggaaagtgagggtattttctctccatcagaactagaaactccaaatctagccggcagagtactcgactggcttgagaaacatggtgttgaacgacttaaacgtatggcaatatcaggagatgattgtgttgtcaaaccaatcgacgatcgatttgccacagctctaaccgcattgaacgatatgggcaaagtgagaaaagacatccctcagtgggaaccatcaaaaggatggaacgactggcaacaagttcctttttgcagtcatcatttccaccagctcattatgaaagatggaagagaaattgtggtcccctgtagaaatcaagatgaactggtaggaagggcacgggtgagtcagggggctggctggagcttaagagagacagcatgccttggaaaaagttacgcccaaatgtggcaactaatgtacttccatagaagggaccttaggctagctgcaaacgctatttgcagcgccgtcccggtcgactgggttcccaccagcagaacaacttggagtatacatgcccaccaccagtggatgacaacagaagacatgctttcagtatggaatagagtgtggatcgaagaaaacccttggatggaagataaaacacatgtatccagttgggaagatgttccttacttaggaaagcgtgaggaccaatggtgtggatcgttaatcggtttaactgcgcgagcgacatgggctacaaatattcaagtggcaataaaccaagtccgaagactactaggaaatgaaaactaccttgattacatgacatctatgaaaagatttaaaaatgaaagcgatcctgaaggggcattatggtag

SEQ ID NO: 21933 - RNA, 9879 nt, synthetic construct
  misc_feature 1..9879: note = derived and/or modified CDS sequence (opt6) from DENV-1__EU482489__SS-prME
  source 1..9879: mol_type = other RNA
tctgttactatgttattaatgcttatgcctactgcgctggcttttcatttgactacgaggggaggggaacctcatatgattgtttcaaagcaagaaagaggaaaatcactactctttaaaacaagtgcaggagtaaatatgtgcactttaattgcaatggatttgggagaactgtgtgaagacactatgacatataagtgccctagaataacggaaaccgaaccagatgatgtagattgctggtgtaacgctacagacacgtgggtcacctacggaacgtgttctcaaaccggggaacatagacgagacaaaagaagtgtagcattggcaccacacgttggattaggattggaaactagaaccgaaacatggatgtccagtgagggagcctggaaacaaattcaaagagtagaaacatgggcacttaggcatccagggttcactttgatagcgctttttcttgcacacgcaatcggaaccagtattacacaaaaaggaattatcttcattctattaatgttagttacgccttcaatggcgatgcgatgcgtaggaattggaagccgcgattttgtggaaggattaagtggggcgacctgggtggatgtagttttggaacatggttcttgcgtaactacgatggctaaggacaagcccacactagacattgagttattaaaaacagaagtgacgaacccggctgtactacgcaaactgtgcatcgaagctaagatcagtaatacaacaacggacagtcgctgccccacacaaggagaagcaactctagttgaagaacaagacgctaactttgtctgcaggcgaacatttgtagaccggggatggggaaacggttgtgggctatttggtaagggatctttgataacatgtgccaagtttaaatgtgtgacgaaactcgagggtaaaatagttcaatatgaaaatttaaaatacagtgtaattgtcacagttcatacgggagatcaacaccaagttggaaacgagtctaccgaacacggtacaactgcaactataacaccacaagcacctactactgagatccaattaactgattacggagcgctcacactagattgttcacctcggactggactcgattttaacgagatggtacttcttacaatgaaagagaaaagctggcttgttcataaacaatggttccttgacttacccctaccttggacaagcggtgctagtacttcacaggaaacctggaacagacaagatttgttagttacattcaaaacagcgcacgctaagaagcaggaggtagtcgtactcgggtcacaggaaggtgcgatgcacacagctttaactggagcgactgaaatccaaacgtctggcacgactactatattcgcgggccatcttaaatgtagactcaaaatggacaaattaactttaaaaggcatgtcatatgtaatgtgcacgggttcctttaaattagaaaaagaattagcggaaactcaacatggaacggtgctagtacaaattaaatatgaaggaaccgacgcaccatgcaaaattccattttccactcaagacgaaaagggagtaactcaaaatggcagactgattacagcgaatcctattgtgactgataaagaaaaacctgtaaacattgaagcagaacctccctttggcgaatcgtacatagtcataggggcaggggaaaaggctttaaaactcagttggttcaaaaagggatcttctatagggaaaatgtttgaagccacagcacgaggggcaagacggatggcaattctaggcgatacggcctgggattttggaagtataggtggtgtattcacaagtgtgggtaagctagtacaccaaatcttcggcaccgcatacggtgtactattttcaggcgtgtcttggacaatgaaaataggcatcggcgtattgctaacttggctaggactaaattcccgttccacaagtttgtctatgacatgtatagcagtaggcctagtaacactatacctaggtgtaatggtacaggccgacagcggatgtgttataaactggaaaggccgcgagcttaaatgtggaagtggaatttttgtaaccaacgaagttcatacgtggacagaacaatacaaatttcaagctgattctcctaagaggctctctgctgctataggcaaggcttgggaagaaggggtatgcggcataagaagtgctacacgtttggaaaatataatgtggaaacaaatatctaacgagttaaatcatatattattggaaaatgatatgaaatttacagtggtagtaggagacgttgcaggcattcttgcacaaggaaagaaaatgatacgtccccagcctatggaatataaatactcatggaaatcgtggggcaaggcaaagataattggggctgatgttcaaaacacaactttcattatagatgggcccaacacaccagagtgccctgatgaccaaagagcttggaacatatgggaagttgaagattacggatttggaatatttacaacaaacatatggttaaagttgagagattcgtacacacaagtttgtgaccatagactaatgagtgccgcaattaaagacagcaaagcggtccatgcagatatgggctattggattgagtcagaaaagaacgaaacgtggaagctcgcaagggcttcatttattgaggtcaagacgtgtatttggccaaagtcgcatacactatggtccaatggcgtcttagaaagtgaaatgattatacccaaaatatacgggggtcctatatcacaacacaactatagaccaggatatttcacacagacagccggaccgtggcacctagggaaattagagttagatttcgatttatgtgaaggcacaacagtagtagtcgacgaacactgtggcaataggggtccatcattaaggacgacaacagttaccggtaagataatacacgagtggtgctgtcgaagttgcacgttgccaccgttaagatttcgtggagaagatggatgctggtacggtatggaaatcaggccagtaaaagaaaaggaagaaaatctcgttaagagtatggtctccgcaggtagcggcgaagttgattcattcagtttaggtctattatgcatatctataatgatagaagaagtaatgagatcgcgatggagccgaaaaatgctaatgacgggtacactagcagtattctttcttctaatcatgggtcagttaacctggaatgatttaatacgattatgtataatggtaggcgcgaatgcctctgaccgtatgggcatgggaactacatatttagctttaatggctacgtttaaaatgcgaccaatgtttgcagtgggtcttttatttcgtcgactaacatccagagaagttcttctcttgacaattggtctgtcattggtggcttcggtagagttacccaattcactcgaagaattaggggacggacttgcgatgggaattatgatactaaaacttctcacagattttcaatctcaccaactttgggctactttactttctctgaccttcattaaaactactttttcgcttcattatgcatggaaaacaatggcaatggtattatcaattgtatcactctttcctctatgcctttctacaacttcccagaaaacgacctggttgccggttttgttgggaagcctaggatgcaagcctctaacgatgttcttgatcgcagaaaataaaatatgggggcgtcgctcgtggccacttaatgaaggtatcatggcagtggggatcgtaagcattcttctatctagtctactgaaaaacgatgtacctctcgcagggcctctaattgcgggtggtatgttaatagcatgttacgtaataagcgggagctcagcagatctgagtcttgaaaaggccgcagaagtctcttgggaggaagaagctgaacattctggtgcatcacataacatattagtcgaagttcaagatgatggaacgatgaaaattaaagatgaagaaagggacgatacgttaactatccttttaaaagcaacactcctcgcagtttccggggtatatccattgagcatccctgctacccttttcgtgtggtatttctggcaaaagaagaaacaacgaagcggtgtactatgggatacgccatcaccacccgaagtagaaagggcggtcctcgatgacgggatttaccgaattatgcagcgaggccttctcggacgctcccaagtaggagttggagtatttcaagagaacgtatttcacactatgtggcacgtaactcgcggcgcagtgttaatgtatcaaggcaagcggctagaaccatcctgggcttcagtcaagaaagatcttataagttacggcggcggctggagactacaaggatcatggaatacaggagaggaggtacaggttattgcagtagaacctggcaaaaatccgaaaaacgtgcaaacagcacctggtacgttcaaaacgcctgaaggggaggttggagctatagcactagactttaagcctggtacgagtggtagtcctatcgttaatagagaaggaaaaattgttggtttgtatggtaacggagttgtaacgacgagtgggacttacgtaagtgcaattgctcaagctaaggcttctcaagaaggacccttaccagaaatcgaagacgaagtgtttaggaaaagaaatttaactataatggatctacacccaggcagcggcaaaacacgtcgttacttacccgccatagtccgtgaagcgataaagagaaaactgcgtacacttattttggccccgactagagttgttgcgtcggaaatggcggaagccctaaaagggatgcccataagatatcaaactacagcggtaaagtcagaacatacaggtaaggaaatagtagatttgatgtgccatgctacattcactatgaggttactgtcacctgttagagtacccaattacaacatgataattatggatgaagcgcattttactgatccctcctccatagccgcacgtggctatatctcaactcgtgtaggaatgggtgaagccgcggccatatttatgactgcaactccccctgggagcgtcgaggctttcccgcaaagcaatgcggtgatacaagatgaagaaagagatataccggaaaggagctggaactcaggatacgagtggattacagattttcccggtaagactgtctggtttgtccccagtataaaatcgggtaacgatatagcaaattgcttaagaaagaatggaaaaagagtaatccaactcagtagaaaaacattcgataccgaatatcaaaagaccaaaaacaatgactgggactatgtagtaaccactgatatatccgaaatgggtgcaaatttccgggctgatcgtgtgatagatccacgacgttgtctcaaacctgttatacttaaggacggacccgaaagggtgattttagctggaccgatgccagttacagttgctagcgctgcccaaaggagagggagaatcggacgaaaccataataaggaaggcgaccaatatatatacatggggcagcctctcaataatgatgaagatcacgcacattggacagaggcaaaaatgctcctcgataacataaatacaccagaaggaataattcctgcgttatttgaacccgaaagagagaaatcggcagctattgatggcgaatatcgactaagaggagaggctagaaaaacttttgtagagctcatgcgacggggcgatctacctgtttggttgagctacaaagtagcatcggagggtttccagtacagtgacagaagatggtgcttcgatggggagagaaacaatcaagtccttgaggaaaatatggatgtagaaatttggaccaaagaaggggagaggaagaaattacgcccaagatggttagacgcaagaacgtattctgaccctttagctctcagggaatttaaagaatttgcagccggccgcagatccgtaagtggggacctaattttagaaataggaaagctcccacagcacctaacgcagagagcacagaatgcattagataacttggtgatgctacacaattccgaacagggcggcagagcatacagacatgcgatggaagaactaccggatacaatcgaaacgctgatgttactggctttaattgctgtactgacagggggagtaacacttttcttcttaagtggcaggggtctggggaaaacctccataggtctcttgtgtgtcatggcaagtagtgtattactttggatggcctccgtagaaccacattggatagcagcaagtataattctcgaatttttcctcatggtcctgctaatacctgaaccagatagacaacgaaccccacaggacaatcaactagcgtacgtagtaataggactactgtttatgatacttactgttgcagcaaatgaaatgggcttactagaaacaactaagaaagatttaggaattggtcatgtggcagtagaaaaccaccaccatgcagccatgctagacgtagaccttcatcctgcttcggcgtggacactatacgcagtagctacaactattattacgccaatgatgaggcacacaatcgaaaacactacggccaatattagcctaacggcgatagcaaatcaggccgctatcttaatgggtctagataaaggttggcctatttctaagatggacataggtgtacctttattggcactcggatgctacagccaagtaaaccctctaaccctgacagcagcggttctgatgttggtggcacattatgcgataataggacctggattacaagcgaaggctacacgagaagcacaaaaacgaacagctgccggtattatgaaaaaccccacagttgacggaatagtagctatagacctagaccctgtagtctatgacgctaagtttgaaaaacaactaggccaaattatgctgctaattttatgtacaagtcaaatattgctcatgaggactacatgggcgctatgtgaaagtattacgttagcaactggaccgcttacgaccctttgggaaggtagccccgggaaattttggaataccacaatcgccgtgtcaatggcaaatatattcagaggctcatatctagctggagcaggtctggccttcagcctaatgaaaagcctaggtggcggacgcagagggactggggcacaaggggaaacgctaggggaaaaatggaaaagacaacttaatcagctaagtaaatctgagttcaatacatataaaagatccggaataatggaggtagaccgctccgaagcaaaagaaggattgaaacgaggagaaaccacgaaacatgctgtttctagaggaacagcaaaacttagatggttcgtcgaaagaaacttggtaaaacccgaaggtaaggtgatagatctaggttgcggacgaggaggctggagttattactgtgctgggctcaagaaagtgactgaggtaaaaggatatacaaaaggtggtcctgggcatgaagaaccaatcccaatggctacatacggatggaatcttgttaaactccacagcggaaaagacgttttcttcattccaccagaaaaatgtgacaccctcttatgtgatataggggaatcaagccctaaccctacgattgaggagggcagaacacttcgagtattgaaaatggttgagccctggttacgtggaaaccaattttgtattaagatcctaaacccatatatgccgtccgtagtcgaaaccctagaacaaatgcaacgtaaacatggaggaatgttagttaggaacccactcagtagaaattcaacacacgaaatgtattgggtttcttgcggaacgggaaacattgtttcagcggtcaacatgacaagtagaatgctgctaaaccggtttactatggctcacagaaaaccaacatatgagagagatgtagacttgggcgcgggcaccaggcatgtcgcagtggaaccggaagttgctaacttagacattataggccaacgaatagaaaacataaagcacgaacataaatcaacatggcactacgacgaagacaacccatacaaaacatgggcataccacggctcctatgaggtaaaacctagtggatctgcaagctctatggtaaacggagttgtaaagttactcacaaagccttgggatgttattcccatggttactcaaatagcgatgaccgacacgactcccttcggccaacaacgcgtatttaaagaaaaagttgacacacgaaccccgaaagcgaaacgagggacagcccaaataatggaagttactgctaaatggctatgggggtttttgagtaggaacaaaaagccaagaatatgtaccagagaagaatttacccgtaaagtgcgaagcaatgctgcgatcggagcagtatttgtagatgagaatcagtggaactcagcgaaagaagcagtagaggatgaaaggttttgggatctagtacaccgagaacgtgagctacataaacaaggtaaatgcgccacatgtgtgtacaatatgatgggtaaacgagagaagaaactcggggagttcggaaaagcaaaaggatcacgtgcaatttggtacatgtggctaggggcgagattcttggagttcgaagccttaggatttatgaatgaagatcattggttctcgagagaaaactcattaagcggggttgaaggagagggccttcacaaacttggttatatattaagagacatttcaaagatacccggtggaaatatgtatgcagatgatacagcaggttgggacactcgaattacagaagacgatctacaaaatgaagcccgtataactgatataatggagcctgaacatgcattattagctaaaagcatctttaaactaacatatcaaaataaagttgttcgggtccaacgaccagccaaaaatggaacagtaatggacgtcatttccagaagagaccaaaggggttcagggcaggtcggtacatatggcctaaataccttcacaaacatggaagcccaactaattagacaaatggagagtgagggtatattcagtccatctgagctagagactccgaacctcgcagaacgagttctagattggttggaaaaatatggagtggaacgtctaaaacgaatggcaataagtggggacgattgtgtagttaagccaattgatgataggttcgcaacagctcttacagcacttaatgacatgggcaaagtaaggaaggatattcctcaatgggaaccgagtaaaggttggaatgattggcaacaagtaccattttgctctcaccacttccatcaattaattatgaaagatggaagagaaattgtcgtaccctgcagaaatcaagatgagttggtgggacgggcaagagtttctcaaggcgcagggtggtcactgagagaaaccgcatgtttaggaaaaagttacgcccaaatgtggcaattaatgtattttcatcgcagagatctaagactagcagcgaatgccatctgttcggcagtgccagtagattggatacctacttcacgtacgacctggtcaattcatgcacatcatcaatggatgacgactgaagatatgctctctgtttggaatagggtatggatagaggagaacccatggatggaggataagacccatatttcctcatggggagatgtcccttacttaggtaagagggaggaccaatggtgcggttctctgattggattaaccgcacgtgcaacgtgggctacaaatattcaagtggcgataaatcaagtacgtcgattaataggtaacgagaattatctagattacatgaccagtatgaaacgatttaaaaatgaatcagatcccgaaggggccttgtggtag

SEQ ID NO: 21934 - RNA, 9879 nt, synthetic construct
  misc_feature 1..9879: note = derived and/or modified CDS sequence (opt6) from DENV-1__EU482490__SS-prME
  source 1..9879: mol_type = other RNA
tcagttacaatgctcctgatgctgatgcccaccgcactggcattccatttaactacacgtgggggagaaccacatatgatcgtttctaaacaagaacgcggtaaaagccttttgttcaaaaccagcgcgggagttaatatgtgcaccttaatcgctatggacttaggtgaattatgtgaagataccatgacgtataaatgtccaagaattaccgaaacagagccagatgatgtagattgttggtgtaatgcgacggatacatgggtcacatatgggacttgttctcaaacgggggaacatcgccgagacaaaaggagtgtcgccttggctccacacgttgggttagggcttgaaacacgaactgaaacttggatgagttccgaaggagcatggaaacaaatacaaagagtcgaaacctgggccttacgtcatcctggattcacggtcattgcactatttttagcacacgccataggtacttcaataacacaaaaaggcattatatttattctattaatgcttgtgactccctctatggcaatgcgttgtgtaggtattggttcccgagacttcgtagaaggactgagtggagctacctgggttgatgtggtccttgaacatggctcttgcgtcacaacaatggctaaagacaaacctactttagacatagaattactaaaaactgaagtaacaaatccagccgttctaagaaagttgtgtatagaagcaaagatatcaaataccacaacggacagtagatgcccgactcaaggtgaagcaactttggtagaagaacaagatgctaatttcgtctgtagaaggacatttgttgacaggggttggggtaatggttgtggattgtttggtaagggatctctaataacatgtgctaagttcaaatgtgtaaccaaacttgaaggcaaaatagttcaatatgaaaatttgaaatactctgtcatagttacggtacatactggagatcaacaccaagtaggaaatgagtccacggaacacggaacgactgcaacaatcacacctcaagcaccaacaaccgaaatacaattaacagattatggtgctttgacgctcgattgctcgccgcgtacaggtctggactttaatgaaatggtactattaacaatgaaagaaaagtcctggcttgtccataagcaatggttcctagatttgccccttccctggacaagtggcgcaagcacttcacaagaaacctggaaccggcaagatctcttagtaacctttaaaacggcacacgccaagaaacaagaagtagttgtactgggatcccaagaaggtgcaatgcataccgccttgacaggtgcaaccgagatacaaacaagtggcaccacgactattttcgccggccacttaaaatgtagacttaaaatggacaagttaactcttaaaggtatgtcttatgtaatgtgtactggctcctttaaacttgaaaaggaagttgcagaaactcaacatggaacagtattagtacaaattaaatacgaaggaactgatgccccttgtaaaataccattcagtactcaagacgaaaagggagttactcaaaacggaaggttaataactgccaacccaatcgtaaccgataaagagaaaccagtgaacatcgaagctgagccccctttcggggaaagctacataactattggagcaggagagaaagcattgaaactaagttggtttaagaaaggttcatccataggaaagatgtttgaagcaacagctagaggagctagaaggatggcaatattaggagacactgcttgggactttggatcgataggaggtgtattcacatccgtaggcaagttagtacatcaaatctttggtacggcctatggagttttgtttagcggtgtaagttggaccatgaagatagggataggagttcttctaacctggctaggtttaaattcaagaagtacttcgttgagtatgacttgcatcgctgtaggattagtaacattatatttaggagttatggtacaagcagacagtggttgtgtcataaattggaaaggaagagaactcaagtgtggtagcggtatatttgtgacgaacgaagtgcatacatggacagaacaatataaattccaggccgatagtccaaaaagattatctgcagcgataggaaaggcctgggaggaaggagtctgtggaattagatctgcaacgagattagaaaacattatgtggaagcaaatttcgaacgaattaaaccatatattattagaaaacgacatgaaattcacagtagtcgtaggggatgtggcaggtatattagcacagggtaagaaaatgataagaccccagcccatggaatataaatattcgtggaaaagttggggaaaagccaaaataattggtgctgatgtacaaaatacaacctttattatagatggtcccaatacgccagaatgtccagatgaccaaagagcatggaacatatgggaagttgaagattatgggtttggaatctttacaacaaacatttggctcaaattgagggactcatatacacaagtgtgtgatcatagacttatgtcagcggcgattaaagactctaaagctgtccatgctgacatgggatactggatcgagagtgagaaaaatgagacttggaaacttgcaagagcttcatttattgaggtgaaaacatgtatctggccaaaaagtcatacgctctggtcaaatggagtacttgaaagtgagatgataattcctaaaatatatggtgggccgataagtcaacacaactaccgccctggttactttacacaaacggctggaccatggcatttaggaaagctggaacttgactttgatctatgcgaaggtacaacagtagtggtagatgaacactgtggaaatagagggccgagtcttcgaacaacaacagttactggaaaaataatacatgaatggtgctgcagaagctgcaccctcccaccattgaggtttaggggagaagatggatgttggtatgggatggaaatcaggcctgtaaaagagaaggaagaaaatctagtaaaatccatggtttcagcaggaagtggtgaagtagatagtttcagcctaggactactatgcatcagtatcatgatcgaagaagtcatgagaagtaggtggtcgcgtaaaatgcttatgacgggtacgcttgcggtattcttcctactaataatgggacaattaacatggaatgacttaattaggttatgcataatggtgggggcaaatgcctcagacagaatgggaatggggactacgtacttagcgttaatggctacatttaaaatgcgacccatgtttgcagtagggctactattcagacgattaacgagtagagaagtattgcttttaaccataggactaagtttggtcgcatcagttgaattgccaaactcgttggaggaactcggagatggacttgctatgggaatcatgatattgaaacttctgacggattttcaaagtcaccaactatgggctaccttacttagcttgacattcataaaaacaaccttctctctgcattatgcttggaaaacaatggcaatggtgttaagtatagtctcactcttcccattgtgcttgtcaaccacctcacagaaaacgacatggctgccggtacttcttggcagtttaggatgtaaaccacttactatgtttttaattgcagagaataagatatggggacgccgaagttggccattaaatgagggaattatggctgtaggtattgtaagtatacttttaagctctcttttgaaaaatgatgtccctctggcaggtccccttatagctggtggaatgctaattgcatgctacgtaataagtggatcaagcgcagatctttctctcgagaaagcagcagaagtatcgtgggaagaggaagcagaacactcaggtgcatcgcataatatcttagtggaagttcaggatgacggcacaatgaaaattaaggacgaagaaagagatgacactcttacgatcttgttgaaagctacgttattagcagtaagtggggtatacccgctaagcataccagcgacattatttgtgtggtatttttggcagaagaagaaacaaaggtccggagttttgtgggatactccttcaccgccggaggtggaacgcgctgttttagacgatggcatttaccgaataatgcaaaggggtctgctcggtagatcacaagtaggtgtcggcgtatttcaggaaaatgtatttcatacaatgtggcatgttaccagaggcgcggtcttgatgtatcaaggaaaaaggctagaaccaagttgggcttcagtcaagaaagatttaatctcgtatggaggagggtggaggttgcaggggtcatggaacacaggtgaagaagtgcaagttatagccgtggagcctggcaaaaatcccaaaaacgtacagactgcgcccggcactttcaagacacccgaaggcgaagtcggagcaattgctcttgatttcaagcccgggaccagtggatcaccgatcgtaaatagagaaggaaagatagtcggcctatacggaaacggagtagttaccacatcaggaacatacgtatcagctattgcccaagccaaggcatcacaagaaggacctctaccagagatagaagatgaagtttttagaaagcgtaacctcacaataatggatttgcaccctggatcgggtaaaaccagaagatatttacccgccattgtgagagaagccatcaaaagaaaattaagaacattgatattggcgccgacgagagttgtagcatctgaaatggccgaagccctcaaaggaatgccaatcagatatcagacaacggcagtcaagtcagaacatacagggaaagaaattgttgacctaatgtgccatgctaccttcactatgcgcttactttctcccgtacgagtacctaattataacatgataattatggacgaagctcattttactgaccccagttcaatagccgcacgaggttatatatcaactcgagtagggatgggggaagcagcagcaatcttcatgacagctactccaccaggaagcgtcgaagcatttcctcaatctaatgccgttatacaagatgaagaaagagacataccagagaggagctggaactctggctacgaatggattacagacttcccaggcaaaactgtctggtttgtaccgtctattaaaagtgggaatgacatagctaattgcctgcgcaaaaacgggaagagggtaattcagctgtcaaggaaaacatttgatacagaataccagaaaacgaagaataacgattgggattatgtagtaaccacagacataagcgaaatgggagctaattttagagctgatcgggttattgatccaagaagatgcctaaaacccgtcatactcaaagatggtcccgaaagagtaatcctagccgggccaatgcccgtgacagtggcatcagcagcccaaaggagaggcagaatagggagaaaccacaacaaggagggggaccagtacatatacatgggccaacctctaaacaatgacgaagaccacgcccactggacagaagcaaaaatgttacttgataacataaacacaccagaaggcatcatccctgctttattcgaaccggaaagggagaaaagcgctgccatcgacggtgaataccgattaagaggtgaagcgcgaaaaacttttgtcgaactcatgagaagaggcgatttgccagtatggctttcctataaagtcgcatcagagggcttccaatatagtgatcgcagatggtgcttcgacggagagaggaataatcaagttctagaggaaaacatggacgttgaaatatggacaaaggaaggggaacgaaagaaacttaggccacggtggctcgatgcgaggacttacagtgatccacttgctcttagagaatttaaagagttcgccgccggtcgacgtagtgtatcgggtgacttgattctcgaaatcggaaaattaccacaacatcttacccaaagagcacaaaacgcactagacaacttagtcatgctacataattctgagcaagggggacgagcatacagacatgcaatggaagaactaccagataccatagaaactctcatgctgctagccctgatagcagtgttgacaggaggagtaacactattctttctgagtggccgtggactagggaaaacgagtatcggactcttatgcgtgatggcctctagtgttttattatggatggcgtccgtagagccacactggatcgctgcgagcataattctggaatttttcttaatggtactactaattccggaaccagacaggcaacgtacaccacaagataatcagttagcgtatgtagtaatagggcttcttttcatgatattgaccgttgcagctaatgaaatgggcctcttggaaacaacgaagaaagacctcggaattggccacgtggctgttgaaaatcatcaccacgccgccatgctagacgttgatctacatccggcatcagcttggacactgtacgccgtcgctaccacaattattactcccatgatgaggcatactatagaaaatactacagcaaacattagcttaacagcaatcgcaaatcaagcagcaatattaatgggattggataaaggatggccaatttcaaaaatggacataggagtaccactcttagcactggggtgttattcgcaagtgaatccgctgactttaacggcagcagtactaatgctcgttgcacactatgcaattataggaccaggactccaggcaaaagcaacgagggaagctcagaaaagaacagcagcaggaatcatgaaaaatcccacagtcgatgggatagtagcaatagacctagatcctgttgtatatgatgcaaaatttgaaaaacaactaggccaaataatgttattaatcctctgtactagccagatattattaatgcgcactacatgggcgttgtgcgaaagtataaccctggccacaggccctttaactactctctgggaaggatcacccggcaagttttggaatacaacgatcgctgtcagcatggctaacatatttagaggttcgtatctagccggagccggactcgctttttccttaatgaaaagtcttggaggtggtaggagagggaccggagcacagggcgaaacgcttggagaaaaatggaaaagacaacttaaccaattaagtaaaagtgaatttaatacatacaagcgttctggaatcatggaagtcgaccgtagcgaggccaaggagggactaaaaaggggcgaaacaactaaacatgctgtgagtaggggcacagcaaaacttcgatggtttgtagaacgaaatttagtgaaacctgaagggaaagtaatagatctcggctgtggcagaggaggatggtcttattattgtgcaggcctcaagaaagtcacagaggttaaagggtatactaagggcggccctggacacgaggaacctatcccaatggcgacatacggatggaatcttgtaaaacttcactcaggaaaagatgtcttctttataccccctgaaaaatgtgatacacttttatgcgacataggagagtccagcccaaatcctacaatcgaggagggccggacgctacgggtcttgaaaatggttgaaccttggctacgaggcaaccaattttgtataaaaatattgaacccatatatgccaagtgtggttgaaacgctagaacaaatgcaacgtaaacacggcggtatgctcgtacgaaacccattgtcgcgcaattcgactcatgagatgtattgggtctcgtgtggaactggaaatatagtttccgccgtaaatatgacgtctcggatgctactaaatcgatttacaatggcacatcgtaagccaacttatgaaagagacgtcgatttaggagcaggtacaagacatgtagcagtcgaaccagaagttgcaaatttagatattattggacaaagaatagaaaacataaagcacgaacataagtcaacatggcactatgacgaagacaatccatacaaaacatgggcttatcacggatcgtatgaagtgaaaccatcaggtagtgcgagctcaatggtaaacggggttgttaagctcctaacaaagccatgggatgtcattccgatggtcacccaaatagccatgacagatacgacaccgttcggacagcaaagagtttttaaagaaaaagtggacacaaggacaccgaaagcaaaaaggggcacggcacaaataatggaggtaaccgcaaaatggttatgggggtttttaagtagaaacaagaaacccagaatttgcacgagagaagagtttacaagaaaagttagatccaatgcagctataggcgcagttttcgttgacgaaaaccaatggaatagtgcaaaagaggcagtagaagacgaacgattttgggacctagtacacagagaaagagaacttcataagcaaggtaaatgtgcaacatgtgtttacaatatgatgggaaaacgcgagaagaaattgggagaatttggtaaagcaaagggatcgagggcgatatggtatatgtggttaggcgcccgatttctagaatttgaggctttagggttcatgaacgaagaccattggtttagtcgtgagaatagtctatctggggtagaaggtgaaggtctccacaaattaggttatattttacgcgacatcagtaaaatacctggagggaatatgtatgcagatgatacagcagggtgggacactaggataacagaagatgatctacaaaacgaagcacgcattacagacataatggaaccagaacacgcactactagccaaatcaattttcaaattaacataccaaaataaggttgtaagagttcaaaggccagcgaaaaacggcacagtgatggacgtcattagtcgccgtgaccaaagaggcagtggtcaagtgggaacatatggattaaataccttcacaaacatggaagctcaattgataagacaaatggaatccgaaggaatcttttctccaagtgaattggaaacaccgaatcttgcagaaagggtccttgactggcttgaaaagtacggtgtagaaagattgaaacgtatggcgatttccggagacgactgtgtagtaaaaccaatcgacgatcgcttcgcaactgccttaacggcgctaaacgatatgggaaaagtgagaaaggatataccacaatgggaaccatcaaagggctggaacgactggcagcaagtcccattttgcagtcaccatttccatcaattgatcatgaaggacggaagagagattgtagtaccttgtcgaaaccaagacgaactcgttggacgcgcaagggtcagtcaaggtgctggttggtctctgcgtgaaacggcctgcctaggcaaatcatacgcgcagatgtggcagttaatgtacttccataggagggatttaaggttagcagctaacgctatatgcagcgctgtaccagtcgattggattcccacgagcagaacaacatggagtatacacgctcatcatcaatggatgacaacggaagacatgctatcggtctggaaccgagtctggattgaggaaaatccatggatggaggacaaaacccacatatcatcatggggagatgtcccgtatctgggtaaaagggaggatcaatggtgcggaagtcttatcggactcactgcaagggcaacttgggccacaaatatccaagtagcgattaaccaggtgcgacgcctaattggcaatgaaaattacctcgattacatgaccagtatgaagagattcaaaaatgaatctgatcctgagggcgctctttggtaa

SEQ ID NO: 21935 - RNA, 9879 nt, synthetic construct
  misc_feature 1..9879: note = derived and/or modified CDS sequence (opt6) from DENV-1__EU482491__SS-prME
  source 1..9879: mol_type = other RNA
tccgttaccatgttgttgatgctcatgccaactgcactagctttccatcttacgacccgtggaggagaacctcatatgattgtgtcaaaacaagaaagaggcaaatctctattattcaaaacttcagcgggtgttaatatgtgtacgttgattgcaatggatttaggtgaattttgtgaagatactatgacatataaatgccctcgaattaccgaagcagaaccagatgacgtcgactgctggtgtaatgcgacagacacgtgggtaacatatggaacatgtacacaaattggtgaacatagacgagacaaacgaagtgtagccctagcacctcacgtgggactgggtttagaaactagaaccgaaacatggatgtcttcggaaggagcgtggaaacaaattcaacgcgtcgaaacatgggctttacggcatccaggcttcacagtaatagcattgtttttagcacatgccataggtacatccataacacagaaaggtatcattttcatactcttaatgttggctacgccatcgatggccatgagatgcgtaggaattggatcccgagacttcgtagaagggttgtcaggcgcaacctgggtagacgttgtacttgaacatggatcttgcgttactaccatggccaaagataagccgaccctggatatcgaattactaaaaacagaagtaacaaatcctgcagtactacgaaaattatgtatcgaagcaaaaatatctaatacaactacagactctcgatgtcctacgcaaggtgaagcgactttagtggaagaacaagatgcaaattttgtatgcagaagaacttttgttgatcgaggttggggaaatggttgtggattgttcggaaaaggtagtttaataacctgcgctaaatttaaatgtgtcacgaaattggaaggaaagatcgttcaatatgaaaacctgaagtacagcgtgattgttactgtacacactggagatcaacatcaagtaggaaatgagtctactgagcatggtacaattgctactataactccgcaagcgcccagcacagagatacaactcacagactatggagctttaacattagactgtagtccgagaacagggctagacttcaatgaaatggtcctcttaacaatgaaggagaaaagttggttagtacacaagcagtggtttctggacttaccattgccgtggacatctggggccagcacttcgcaagaaacctggaataggcaagatttactggttacctttaaaactgcacacgccaagaaacaagaggtagtagtattagggagccaagaaggtgccatgcacaccgcactgactggagccaccgaaatacaaacgagtggtactaccacaatatttgcaggacacttaaaatgtagattaaaaatggacaaactaactctaaggggaatgtcttatgtcatgtgcacgggaagttttaaactagaaaaagaagtcgcagagacacagcacggaacagttttagttcaaataaaatatgaaggaacagatgcaccctgtaaaattcccttttctacacaggatgaaaaaggagtgacacagaacggccgattgattacagccaaccctattgtaacagacaaggaaaaaccagttaatatcgaggcggaaccaccgtttggggaaagctatattgttattggagctggtgagaaagccctaaaactaagctggtttaagaagggctccagcataggaaagatgtttgaagctacggcaagaggtgccagacgaatggcgatattgggagataccgcttgggatttcgggagcatcggaggtgtattcacgtcagttggaaagttagtgcaccaaatatttggaaccgcatatggcgtgcttttctctggcgtatcatggactatgaaaataggtattggagtacttcttacatggttaggccttaattcaagatccacaagcctatcaatgacatgtatcgcagtaggattagttacactataccttggagtcatggtccaagccgacagtggatgcgttataaactggaagggtcgagagctaaagtgtgggtcgggcattttcgttactaatgaagttcatacatggactgaacaatataagtttcaagccgactctccgaaaagactgagcgcagctataggcaaagcctgggaggaaggagtatgtggtattagatcagcgacaagacttgaaaatattatgtggaaacaaatatcgaatgaactgaatcatattctattagaaaatgatatgaagttaacagtagttgtaggagatgtagcaggcatcctagcccaaggcaagaaaatgattcgtccccaaccaatggaatataaatatagctggaaaatatggggtaaagcgaaaatcattggtgcagatgtccagaatacaacattcattatcgatggtccgaacacgccagaatgtccagacgatcaaagagcatggaacatatgggaagtggaagactacggatttggcatatttacgactaatatatggttgaagctaagagatagttatacgcaggtatgcgaccatcgtttaatgtcagcggcgataaaagattcaaaggccgttcatgcagacatgggttattggatcgaaagcgagaagaacgagacatggaaattggcgcgtgcgtcttttattgaggtcaaaacttgtatatggccgaaaagtcacacattgtggtcaaacggagtgttagaatcggagatgatcattccaaaaatctatggtggcccaatcagtcaacacaattacagaccgggatatttcacccagacagccggaccatggcatctagggaaacttgaactagatttcgacctttgcgaaggaacgactgtagttgttgacgaacattgtggtaaccgtggaccttcactacgcacaaccacagtcactggaaaaataattcacgagtggtgttgtcgatcatgtacactaccacctctaagattcaagggagaagacggttgttggtatggaatggaaatacgaccagtaaaagaaaaagaagaaaacttagttaaatctatggttagtgccgggagtggagaagtcgattcttttagtcttggcttactttgcatatctatcatgatagaggaggtaatgagaagtcgatggagcagaaaaatgttgatgacaggaactttggcggtattctttcttttaattatgggtcagttaacatggaatgatttaatacgattatgcattatggtaggcgcaaatgcaagcgacaggatgggaatgggaaccacgtacctagccttaatggcgacttttaaaatgagaccgatgttcgcagtcggattgctatttcgaagacttacaagtagggaagttttactcttaaccattggactatcgttagtggcgtcagtcgagctacccaatagcctagaagaactgggagacggactcgctatgggaataatgatactcaaacttctaactgactttcaaagccatcaattatgggctacactcttatcactcactttcatcaggaccacatttagtttacattacgcatggaagaccatggcaatggtattgtcgatagttagtctatttccattgtgcttaagtaccacttcacagaaaaccacctggttaccagtacttttgggcagtctaggatgcaaaccattaacaatgttccttatagcagaaaataaaatttggggaagaaaatcatggcccttaaatgagggtataatggcagtcggcatagtatcaatattactgagttcattattgaaaaacgacgtacccctagcaggaccactgatagccggtggtatgctaatagcttgctatgttatctcaggatcatcggctgatttatcattagaaaaagccgcagaagtctcttgggaagaagaagctgagcactctggcgcctcgcataacattctggtcgaagttcaagatgacggaaccatgaaaataaaagacgaagaacgggatgacacccttactatattacttaaagcaacattattggcagtaagtggtgtctacccattatctattcctgcgactcttttcgtatggtatttctggcagaagaagaaacaaaggagcggtgtcctgtgggacaccccttcccctccagaggtagaaagagctgttcttgatgacgggatataccgcattatgcaaagaggactactaggacgatcgcaagttggtgttggagtattccaagaaaacgtatttcatacaatgtggcacgtaacaaggggtgccgtactgatgtatcaagggaaacgattagaaccatcatgggcttcagtaaagaaagatctaataagttacggcggaggttggagattgcaaggttcatggaacacaggtgaagaagttcaagtcatagcggtagaacccggtaaaaatcctaaaaacgtccaaactgctccaggaacattcaaaacttcagaaggtgaggtcggtgcaatagcattagattttaaaccaggaacatcaggatcgcccattgtaaaccgagaaggaaaaattgtaggtctatacggaaatggagtcgttactacgtcaggcacgtacgtttcggccatcgcacaagcgaaagcaagccaagaagggccattgccagagattgaagatgaagtgtttagaaaaagaaacttgactatcatggacctacacccgggctcaggcaaaactagacgttatttaccagctatagtacgagaagctatcaaacgtaggctaagaactctcatattagctcctactagggtggtcgcgagtgagatggccgaggcactgaaagggatgccgatcagataccagacaacagctgtgaaatcggagcacacggggaaagagatagttgacttaatgtgtcacgcgacattcacgatgagattattatcgccagtacgcgttcctaactacaacatgatcataatggacgaagcacattttacagacccgtcatcgattgccgcgagaggatatataagcacaagagtaggtatgggagaggccgccgctatattcatgactgctacaccacctggctcagttgaagcatttccccagagtaatgctgttattcaagacgaagaaagagatatcccagaaagaagttggaacagtggttatgaatggattacagattttccgggtaaaacagtatggtttgtccctagtattaagtccggtaatgacatagccaactgtcttaggaaaaacggaaaaagggtaatccagctatcacgaaaaacttttgacacggaatatcaaaagaccaaaaataatgattgggactatgtagtgaccacagatataagtgagatgggggccaatttcagagcagatcgtgtaattgatccgagaagatgtttaaagccggtcatacttaaagacggtcccgaaagagtcatacttgctgggccgatgccagttacggtagcgtcagctgcgcaaagaagggggcgaataggtagaaaccataacaaagagggagatcaatacatatatatgggtcaacctttaaataatgatgaagatcacgctcactggactgaagccaagatgttattagacaacataaatacaccagaaggaataataccagcacttttcgaacctgaacgagagaaaagcgcagctatagatggcgagtatagattgagaggtgaggcaagaaaaacttttgtcgaattaatgaggaggggagacttgcctgtgtggctgtcttacaaagtggcaagtgaaggattccaatactccgatagacgttggtgctttgatggtgagcgaaacaatcaagtactggaagaaaatatggacgttgagatctggaccaaagaaggagagaggaagaaattacgcccacgatggctagacgcaaggacatacagtgacccattagcactgagagaatttaaagagttcgcggcgggacgccggtcagtgtcgggagacttgattttagaaataggaaaattaccacaacacctcacacaacgagctcaaaatgcactagataacctggttatgctacataactctgaacaaggcggtcgagcttaccgccatgcaatggaagagttacctgacaccatagaaactcttatgttactcgctcttatcgcggtacttacaggaggagtcacactattcttcttatcagggagaggtctgggtaaaacctcgattggacttttatgtgtaatggcgtcatccgtgctattatggatggcatcagttgaaccacactggatcgcagcttcaataatccttgagttctttcttatggttttgcttattcctgagccagacagacagagaacaccacaagacaatcagctggcctatgtagtaataggtttactattcatgattttaactgttgcagcaaatgaaatggggttactggaaacaactaagaaagacctaggcatcggccatgttgccgtagaaaatcatcatcatgctgcaatgcttgacgttgatttacacccagcgtcagcgtggacactatatgcagtagcaacgacaatcataacgccaatgatgaggcatacaattgaaaatactacggcaaacatatcacttacggcaatagctaaccaagcggctattcttatgggccttgataagggttggcccatatcaaagatggatataggtgtgcctctgctggcactcggctgttattctcaggtcaatcctctgacgctgaccgcagcagtgctaatgctggtagcacattacgcaatcattgggccaggtcttcaggctaaagccacccgagaagcccaaaaacgaactgctgctggaattatgaagaaccccacagtagacggaattgtcgcgattgacttagatccagtggtatatgacgccaaatttgaaaaacagttgggacaaataatgttgctgatactttgtacttctcaaatattactaatgaggacgacttgggcactatgcgaatctataacactagccacaggacctttaacgacgttgtgggaaggttctcccggaaaattctggaacaccactattgctgtttcgatggcaaatatattccgcgggagctatttggccggtgcgggactagcgtttagtctaatgaagtctttagggggaggccgtcgcggaacaggagctcagggagaaacgttaggagaaaaatggaaaaggcagctcaatcaattaagtaagagcgaatttaacacatataaaagaagcggaattatggaagtagatcgtagtgaagcaaaagaaggactaaaaagaggtgagaccactaaacatgcagtaagtagaggaacagctaaattaagatggtttgtcgaaagaaacttggtaaagcctgaaggtaaagttatagatcttgggtgcggtaggggtggatggagctattattgcgcgggtcttaaaaaggttacagaagtaaagggttacacgaagggaggcccgggacacgaggagccgatacccatggccacttacggatggaacttggtgaaactacatagcggaaaagatgtattctttattccccctgaaaaatgtgatacactcttatgcgacataggagaatcctctcctaatccaaccatagaagaaggacgcacgttacgtgtactaaaaatggttgaaccttggctccggggcaaccagttctgcatcaaaatattaaatccctatatgccaagcgtcgttgaaactctagagcaaatgcaaagaaaacacggaggaatgcttgtgaggaatccactgagccgtaatagtacccatgaaatgtattgggtatcttgtggtactggaaatatcgtttcagcagttaacatgacttctcgaatgttactgaataggtttacaatggcacatagaaagcctacgtacgaaagagacgtagacctcggagctggtacaagacacgtagcggtagaaccagaagtagccaatctcgacataatagggcagagaatagagaatataaaacacgaacataaatctacatggcattacgatgaggataacccgtacaaaacatgggcataccatggcagttatgaagttaagccttcgggttcagcatctagtatggtgaacggtgtcgtaaagctactaactaaaccctgggacgtcattcctatggtaacgcaaattgcgatgaccgatacaacaccatttggccaacaacgagtatttaaagagaaagtcgatacacgtactcccaaggcaaaaagaggtactgcacagataatggaggtcaccgctaaatggctatggggattcctttcacgaaataagaaacccagaatatgcacaagagaagagttcacgcggaaagtacgcagcaacgcggctataggtgcggtttttgtagatgaaaatcaatggaactctgctaaggaagcagtggaagatgaaagattttgggatctagtacatagggagcgagaacttcataagcaaggtaaatgcgctacctgtgtctataatatgatggggaaacgcgagaagaaactcggtgagtttggtaaagctaaaggctcaagagccatttggtacatgtggttaggcgctagatttctagagttcgaggcactgggatttatgaatgaagaccactggttcagtcgagaaaatagccttagtggagtagagggtgaaggactacataagttaggctacatcttaagagacattagcaaaatacccggaggcaatatgtatgcagacgataccgcaggctgggatacgagaattacagaagacgatttgcaaaatgaagcaaaaataacggatatcatggagccagaacatgcattactcgcaaagtctatattcaaattgacatatcagaacaaagtagtcagagtacagcgtccagccaaaaacggaacagttatggacgtgattagtagacgggatcaaagaggaagcggccaggtaggtacatatggccttaatacttttacaaatatggaagctcaacttataaggcaaatggaatccgagggaatattttcacctagcgaactagaaactccgaatttagctggtcgggtgctcgactggctagaaaaacacggggttgaacgtcttaaaagaatggccatatcaggagatgactgtgtggtcaaaccaattgatgatagattcgctacagccttaacagcgttaaatgatatgggtaaggttagaaaagacataccacaatgggagccttcaaagggatggaatgattggcaacaagtgcctttctgttcccaccactttcatcaacttataatgaaagatggaagggaaattgtagtgccatgtagaaaccaagatgaactcgtcggaagggccagagtttcccaaggagcaggttggtcgctgagagaaacagcttgtcttgggaaatcatatgcgcaaatgtggcagctgatgtactttcaccggagagatctaaggctcgcggctaacgccatctgttcagctgtccctgtggactgggttcctacgagccgcacgacttggtctatacacgcacatcaccaatggatgactacagaagacatgctcagtgtatggaatcgagtctggatagaggagaatccctggatggaagacaagacacacgttagttcatggggcgacgtgccgtatttaggtaagcgcgaagaccaatggtgcgggtcactcataggattaacagctcgtgcaacatgggcgacaaacatccaagtagcgatcaaccaagttaggcgattactaggtaatgagaattatttagattatatgacaagtatgaagcggtttaaaaacgaatctgatcccgaaggcgctctatggtga

SEQ ID NO: 21936 - RNA, 9879 nt, synthetic construct
  misc_feature 1..9879: note = derived and/or modified CDS sequence (opt6) from DENV-1__EU482493__SS-prME
  source 1..9879: mol_type = other RNA
tctgtgacaatgcttcttatgcttatgccgacagcattggctttccacttgaccacacggggtggggaaccccatatgattgttagtaaacaggaaagaggaaagagcttactatttaaaacatccgctggtgttaatatgtgcactcttattgcgatggacttaggtgaattatgcgaagatacgatgacatataaatgcccacgcataacagaaacagaacctgatgatgtggattgctggtgtaatgcaacagatacatgggtaacgtacggtacatgctcacaaactggggaacacagaagagataagcgttcagtagctctagcccctcatgtaggattaggtttagaaactaggacagaaacttggatgagcagcgaaggggcatggaagcaaatacaaagagttgaaacctgggcactacgccacccaggttttacagtaatagctctatttcttgcgcatgcgataggaacaagtataacccagaaaggaattatattcattcttctaatgctcgtgacaccgtcaatggcgatgcgctgtgtaggaataggaagcagagactttgttgaaggtctttcaggcgccacgtgggtagatgtcgtattagaacatggaagttgcgtaaccacgatggccaaagacaagccgaccctagacatagaattgttgaaaaccgaagtgactaatccggccgtgctaaggaaactttgtattgaagctaaaatatcaaatacaactacagattcaagatgtcccacacaaggagaagcgaccctggtagaagaacaagatgcaaattttgtatgtaggcgaacattcgtggaccgtggttgggggaacggatgcgggctatttggcaaaggttcacttatcacatgtgcgaaattcaagtgtgtaacaaaattagaaggaaaaatagtccagtatgaaaacctaaaatacagtgtgatcgttaccgtgcatacaggtgaccaacatcaagtgggcaatgaatctacggaacacggtacgactgctactatcacaccgcaagcgccaacaacggaaatacagttaacagattatggtgctcttactctagactgttcacctcgtacagggttagactttaatgaaatggtgctcctcactatgaaagaaaagtcatggctggtacataaacaatggtttttagatctgccactaccgtggacgagcggtgcaagtacctctcaagaaacatggaatagacaagacttattagtcacgttcaaaacggcgcatgcaaagaaacaagaagtggtcgttctaggtagtcaagagggtgccatgcacacagcacttaccggagcaactgaaatacaaacatctggaacaaccactatcttcgctgggcatttgaagtgtcgacttaaaatggataaattaacattaaaggggatgtcttatgtgatgtgtactggtagttttaaacttgaaaaagaactggcagaaacacaacacggcacagtgttggtccaaattaaatacgaaggaactgatgcaccatgcaaaattcccttcagcacacaagatgaaaaaggcgttacacagaatggaagactaattacagctaaccccatagtaactgataaggaaaaaccagtaaacattgaagcagagccaccgtttggtgaatcatatattgtcataggcgctggggaaaaagcactaaaactttcgtggtttaagaaaggatcatcaattggcaaaatgttcgaagcgactgcaagaggagcaaggcgaatggcaattttaggtgacacggcatgggacttcggttctataggaggtgtatttacctcggttggtaaacttgtacatcaaatatttggcacggcctacggagtactattttctggggtgtcatggacgatgaaaattggaataggagtgctattaacatggttaggattgaactctaggtcaactagcctcagcatgacctgcatagccgtcggtctagtaaccctttacttaggagtgatggtacaagctgatagcggttgcgtcataaactggaagggtagggaactaaagtgtgggagtggtatatttgtcacaaacgaagtacacacatggactgaacagtataaatttcaggcagactctcctaagcgtttgtcagctgccataggaaaagcctgggaggaaggggtctgcggaatccggagcgctacgaggctagaaaacatcatgtggaagcaaattagcaatgagcttaatcacatattactagaaaacgatatgaaatttacggtggtggtcggagacgtagcaggaatactggcacagggcaagaaaatgataaggcctcaaccaatggaacacaagtacagttggaagtcgtggggtaaagcaaaaataatcggagccgatgttcaaaacacgaccttcataatagacggtccaaacacaccagaatgtccagacgatcaacgtgcctggaacatatgggaagtggaagattacggttttgggatctttactacaaatatctggttaaaacttcgtgattcatacacacaagtttgtgatcacagattaatgagtgctgctataaaagactcaaaagcagtccatgcagacatgggatattggatagagtcggagaaaaatgagacttggaaattggcacgagcatcctttattgaagtcaaaacgtgcatttggccaaaatcccacacactatggtctaatggcgtcctcgaatccgaaatgatcataccaaaaatatacggtggaccaatatctcaacataattatagacctggatatttcacccaaacagcaggcccttggcacttggggaagttagaattagactttgacctatgtgaaggcacaaccgtagtagtagacgagcattgcgggaataggggtccatctttacgtacgactacagtcactggcaaaatcatccacgaatggtgttgcagatcatgcacattaccaccattacgatttaggggagaagatggctgttggtatgggatggaaattagaccagttaaggaaaaagaagaaaacctagttaaatctatggtgagcgctggcagtggcgaggtcgatagttttagcttaggcttactttgtatctcgataatgatagaagaagtgatgaggagccgatggtcgagaaaaatgcttatgaccggaacacttgccgtctttttcttgttaattgtgggtcaactgacgtggaacgatttgatacgcctgtgcattatggttggagcaaacgcgagcgacagaatggggatgggaaccacctacttagcgctcatggcaacgtttaaaatgcgaccaatgtttgctgtaggacttctctttagaagattaacatcgagagaggtcttactattgactataggtttatcactcgtagcatccgtagaactccctaattctttagaagaactaggtgacggactggctatgggaatcatgatcttaaaattactcacagacttccaaagtcatcagttatgggctacgctattatccctcacattcataaagactacatttagcttgcattatgcatggaaaacgatggcaatggtactctcggtagtctcactttttccattgtgcctatccacaacatctcagaagacgacttggttaccagtattactaggaagtctaggatgtaaaccgctcacgatgttcttaatcgctgagaataaaatttggggtcgtcggtcttggccactgaatgaaggcatcatggcagtaggtatagtttctatcctgttgagttcattgttgaaaaacgatgtaccactcgcgggacccttaatagcaggaggaatgctgatagcatgttacgtaatcagtggttcctctgctgacctttctctagaaaaagcagccgaggtcagttgggaagaggaagcagaacactcaggcgcgtcacataacatccttgttgaggtacaggatgacggtacaatgaaaattaaagacgaagaaagagatgatactttaacgattctccttaaggcgacactactggctgtatcaggcgtataccctttaagcattccagcaacccttttcgtctggtatttttggcagaaaaagaaacaacgatcaggagttctttgggacacaccaagcccgccagaagttgagagagcagtactcgacgatggtatttacagaatcatgcaacggggattattaggacgtagtcaagtgggtgtaggagtattccaggaaaatgtattccacacgatgtggcacgtaactcgcggagccgtattgatgtaccaaggaaaacggctagaaccatcctgggcatcggtcaagaaagatttaatatcttatggaggaggatggagattacaagggtcttggaatactggtgaagaagtacaagtgattgcagttgaaccaggcaaaaatccgaaaaatgtgcaaacagctcccggaacgttcaaaacacctgaaggtgaggtaggtgcgatagctctcgattttaaaccaggaacctcgggaagcccgatagtgaacagagaaggaaagattgtcggcctctatgggaatggggtagtaaccacaagtggtacttatgtaagtgcaatagcacaggcaaaggcaagccaagaaggacctctgcccgaaatagaagacgaagtatttcgcaaacgtaatcttaccataatggatctgcaccctggttccggaaaaactagaagatacctaccagccattgttcgagaagcaattaagagaaaattacgaactttgatactcgcacccacaagagttgtagcatctgaaatggcagaagcattgaaaggtatgcctattaggtatcaaacaacagctgtaaaaagtgaacatacagggaaggagattgtagacttaatgtgtcatgctacttttacaatgagacttctaagtccggttcgtgtacctaactacaacatgataataatggacgaggctcactttactgacccaagttctatagcagcacgagggtatatttctacgagagttggcatgggagaggctgccgctatctttatgaccgctacaccaccgggatctgtggaggcttttccacaaagtaatgcagttatacaagatgaggaacgagacatacctgaacggagctggaactccggatatgagtggataactgacttcccaggaaaaacagtctggtttgtcccgtctatcaaatctggtaatgatatagccaattgcttgcgaaagaatggtaaaagagtcatacagttatccagaaaaacattcgacacagaatatcagaaaacgaaaaacaacgattgggactatgtagtaacaaccgatatttcagagatgggagcaaactttagagctgaccgggtcatcgatccccgacgctgcctaaaacccgtaatcctaaaagacggcccagaaagagttatactagctgggcctatgccagtcacagtagcatcagcagcacaacggagagggcgcataggtaggaatcacaataaagagggtgatcagtacatttatatgggacagccactaaacaatgatgaagatcatgcccactggactgaagcgaaaatgctcctagacaacatcaacacaccagagggtattataccagcattattcgaaccggaaagagaaaaatcagctgccatcgatggggaatacagattaagaggagaagcgcgtaaaacatttgtagaattaatgaggagaggcgacttaccagtatggttgtcgtataaggtagcatccgagggattccagtattctgatagaagatggtgttttgacggtgaaagaaacaaccaggtacttgaggaaaatatggatgtggagatatggacaaaggaaggagagcgtaagaaacttagacccagatggctcgacgcgaggacctactctgacccattagcgcttagagagttcaaagaatttgcagctggcaggcgttcagttagtggtgaccttatactagagatcggtaaactaccgcaacatctaacccagagagcccaaaatgctctggacaatttagttatgcttcataactcagaacaaggaggtagggcttatagacacgcaatggaagaattacctgatacaatcgaaacacttatgctactcgcccttatagcagtattaaccggaggtgtaacactcttcttcctctcagggcgaggtcttggtaagacgtcgattgggctactctgtgtgatggcgagtagtgtactgctatggatggcaagtgttgaaccacattggatcgcagcaagtattatattggagttcttcctaatggtccttttgattcccgaaccagatcgccaaaggactcctcaggacaaccaactggcgtatgtcgtgattggtttgttgtttatgatcttgactgtcgcggctaacgaaatgggattgcttgaaacgactaagaaagatttgggaattggccatgtcgccgtagaaaatcatcatcatgcagccatgctcgatgtagatctacatccagcatcagcatggaccttatatgccgttgcaacaactataattacaccaatgatgagacacactatcgaaaacacgactgccaacatcagcttaacggccatcgctaatcaggcagcgatcctaatgggactagacaaaggttggccaatttctaaaatggatataggtgtcccgttgttagcactaggatgctacagtcaagttaatccactaacattgaccgcagcagttttaatgttagtagctcattatgcgatcataggaccagggttacaggcgaaagctacaagagaagcacaaaaacgcaccgctgctggaataatgaaaaaccccacagtggatggcatcgttgcgattgacttagacccggtagtatatgacgcgaaatttgaaaaacaattgggacaaatcatgctattgattttgtgcacgtcgcaaatcctacttatgaggaccacatgggctttgtgcgaaagcattacacttgcaacgggacccctcacaacgctatgggaagggagtccaggcaaattttggaacactactatagcagtcagtatggccaatatatttcgtggttcatacctagctggtgcaggacttgcattcagcctaatgaaatcccttggagggggtcgaagaggaacaggagctcagggagagactctaggcgaaaaatggaaaagacagctgaaccaactgtcaaaatccgaatttaatacatataagaggagtggaatcatggaagtagatagatcagaagctaaggagggcctaaaaagaggtgaaactacaaaacatgcggtatcccgaggaaccgcaaaactcaggtggtttgttgagagaaatttggtaaagcctgaaggaaaggtaattgacctcggatgtggaagaggtggctggtcatactattgtgccggacttaaaaaggtaacagaagtaaaagggtatacaaaaggcggtcctggacacgaagaacccattcccatggctacgtacggatggaatctagtcaaattgcattccggaaaggatgtattcttcatacctccggaaaaatgcgatacactcttatgtgatataggggaatcaagtccaaaccctactattgaggaaggaaggacactccgggtactaaaaatggtagaaccatggctacgaggtaatcagttctgtattaaaattctaaacccttacatgccgagcgtagttgaaaccctcgagcagatgcaacgaaaacatggaggtatgctggttcggaaccccctgagtagaaactctactcacgagatgtattgggtctcatgcggtacaggaaatatcgtttcagctgtaaatatgacgagtcgcatgttactaaatcgctttacaatggctcaccgcaaacccacatacgaacgcgatgtagatctaggtgcaggaacacgtcatgtggccgtcgaacccgaagtagctaacttagatatcataggtcaaagaattgaaaatattaaacacgaacacaaaagtacctggcattacgatgaagataatccatataaaacatgggcatatcacggttcttacgaagttaaaccgagcggatctgcgtcaagtatggtaaatggagttgtaaaacttctgacgaaaccttgggatgtaattcctatggtcactcagattgcaatgacagatacaacccctttcggacagcaaagagtctttaaggagaaggttgatactagaacgccaaaagcgaaaaggggtacagctcaaattatggaagtaactgcaaaatggctctggggtttcctatcgcgaaacaagaaaccacgaatatgcactcgagaagagtttaccagaaaggtacgctcaaatgctgcaattggcgccgtcttcgttgacgagaatcaatggaactcggcaaaagaagctgtcgaggatgaacggttttgggatttagttcacagagaaagggagcttcataagcaagggaaatgcgctacatgtgtgtacaacatgatggggaaaagggaaaagaaattaggagagttcggaaaagcgaaaggatcgcgagcaatttggtatatgtggctaggtgcccgattcctagagttcgaggctttgggttttatgaacgaggatcactggtttagtagagaaaattcgctaagtggagtagaaggagagggcttacacaaactgggatacatcttaagagatatatcaaaaatacccgggggtaacatgtatgctgacgatactgcgggatgggacactcgcataacggaagatgacctacaaaacgaagcccgtatcacagacataatggaacctgaacatgcacttctggcgaagtctatttttaaattgacctaccaaaacaaggttgtacgagttcaacgaccagcgaagaatggcacggtcatggacgtgatatcaaggcgcgatcagcgtggatcaggacaagtaggtacctacggtctaaacacatttacaaacatggaagcccagttaatacgacaaatggaaagcgaaggaattttcagtccttcggaattagaaactccaaaccttgcagagagggttctggactggctagagaaatatggagtagagcgcttgaaaagaatggctataagtggagacgattgcgttgtcaaacctatagatgatagatttgcaacggccctaacagccctaaatgacatgggaaaggtcaggaaggatattccgcaatgggaaccttccaaagggtggaatgattggcaacaagtccctttttgttctcatcacttccatcaactgataatgaaagatggcagagaaatagtagtcccatgcagaaatcaagatgaattagtaggaagggcgagagtatctcaaggagcgggttggagtttacgagaaacggcatgtttggggaaaagttacgctcagatgtggcaattaatgtatttccaccgtcgcgacctacggctagcagctaatgctatatgttcggctgttcccgtagattggatacctacctctcgtacaacttggagtattcacgctcatcatcaatggatgacgacagaagatatgcttagcgtatggaatagagtctggatagaggaaaatccatggatggaagataaaacacatatttcatcatggggagacgtgccgtacctgggaaaaagagaagatcagtggtgcggctcgctaataggattaactgctagagcgacgtgggcaactaatatacaagtggctattaaccaagtccgacgattgattggaaatgaaaattatttagattacatgaccagcatgaagaggtttaagaatgaatccgatcccgaaggtgccctatggtag

SEQ ID NO: 21937 - RNA, 9879 nt, synthetic construct
  misc_feature 1..9879: note = derived and/or modified CDS sequence (opt6) from DENV-1__EU482494__SS-prME
  source 1..9879: mol_type = other RNA
tcagtcacgatgcttttaatgttaatgcctacagcattagcgtttcaccttacaacaagaggaggagaaccccatatgattgtcagcaaacaagaacgaggaaaatcacttctatttaaaaccagcgcaggagtgaacatgtgtaccctaatagcgatggacttaggagaactatgcgaagatacgattacctataaatgcccaagaataactgaaacggaaccagatgacgtagactgttggtgtaacgctacagatacctgggtcacatacggaacttgttcccaaacaggggaacaccgaagagataaacgaagcgttgcactagccccacacgtagggttaggcttagaaacgagaacagaaacgtggatgtcgtctgaaggagcctggaaacaaattcaaagagtagaaacttgggcactaagacaccctggatttactgtaatagccttatttttggcacatgcaattggcacctcgatcactcaaaaaggaataatattcattcttctaatgctagcgactcccagtatggctatgcgatgcgttggaattggtagcagagactttgtagaagggctctcaggtgccacatgggtagatgtagtcctagaacacggaagttgtgtaactacaatggcaaaagacaaaccaacattagacatagaactgctgaaaactgaagtaacgaaccctgcagtattgaggaaactatgtatagaagccaaaatcagcaacacaactacagattcaaggtgtccgacccaaggtgaagcaacattagttgaagaacaggatgcgaatttcgtttgtagacggacattcgttgacagaggttgggggaatgggtgtggcctctttggaaaagggagtctaatcacatgcgctaaatttaaatgtgtaacgaagttggaagggaaaatcgttcagtatgaaaacttaaaatatagtgtaatcgtaacagttcacacaggtgatcaacaccaagtaggaaatgaatcaacagaacacgggaccacagcaactataacaccacaagctccaactacagaaatccaacttactgattacggagcactaacattagattgttccccaaggacagggttagattttaatgagatggtccttcttaccatgaaggagaaaagttggttagtacacaaacagtggtttctcgatttgcccctgccatggacaagtggcgcaagtacttcgcaagaaacatggaaccggcaggatctattagttacattcaaaacagcacacgccaagaaacaagaagtagtagtactcggttctcaagagggcgcgatgcataccgcacttacaggagccacagagatccaaacatccggcaccacaactatcttcgcaggccacctcaaatgtagacttaaaatggataaacttacgctacggggtatgtcctatgtaatgtgtactggcagttttaaactagaaaaagaagtcgccgaaacacaacacggaaccgtacttgtacagattaaatacgaaggcacagatgcaccttgcaaaatccccttctcaacgcaagatgaaaaaggagttacacaaaatggacgattgatcactgccaatccgatagtaacagacaaagaaaaaccagtgaatatagaagccgaaccacccttcggagaaagttacatagtaattggggccggggagaaagccttaaaactttcttggttcaagaaaggaagctccattggtaagatgtttgaggcaacagctcgcggggcgagaagaatggccatcctaggagatacggcttgggactttggatcaattggcggagtgttcacgtccgtgggaaaattagttcatcaaatttttggaaccgcatacggtgtattattcagtggtgtttcgtggacaatgaaaataggaataggcgtattgttaacttggctgggccttaattctaggagcacaagcctatcgatgacttgtattgcagtagggctagtaactctctatttgggagttatggttcaagcagatagtggatgcgttataaactggaaaggaagagagctaaaatgcggatccggaatattcgtgacgaatgaagttcatacgtggacagaacaatataaattccaagcggattcgcccaaaagattatcggcggctatcggaaaggcttgggaagaaggcgtatgcgggattcgaagcgctacacggctcgagaacatcatgtggaagcagattagtaatgaattaaatcacatcttactagaaaacgacatgaaattcactgtagtcgtcggagacgtggcaggaatacttgcacagggcaagaaaatgatacgacctcaaccaatggaacataaatactcttggaaaagttggggcaaagctaaaataataggtgccgatgtacaaaatacaacatttattatcgacggtccaaacacaccagaatgcccagacgatcagagagcatggaacatatgggaagttgaagattacggattcggtatatttacaaccaacatctggcttaagttgagagattcgtatactcaggtttgtgaccatcgactcatgagcgcagcaataaaagattcaaaggcggttcacgctgatatgggatattggatagagagcgagaaaaatgaaacatggaaacttgcaagagcttcattcatcgaagtaaaaacttgtatatggcctaaaagtcatacactctggtccaacggcgtgttagagagcgagatgattatacccaaaatatacggcgggcccatatctcaacataattataggcctggatactttacgcaaaccgcaggtccatggcatctaggaaaacttgagttagatttcgacctatgtgaggggacaactgtagtagttgatgaacattgcggtaacagaggtcccagtctaagaactacaacagttacagggaaaataattcacgaatggtgctgtaggagttgtacactgcctccattgaggtttcggggcgaagatggatgttggtatggaatggagatacgtcccgtgaaagaaaaggaggaaaatcttgtaaaatccatggtaagcgcaggctcaggagaggtcgacagcttttcattgggattactctgtatttcaatcatgatagaagaagtaatgcgaagtcgttggtctcgaaaaatgcttatgacgggaacgttggcagttttcttccttttgattatgggtcagttgacgtggaatgacttaataagattgtgcataatggtaggcgcaaatgcctctgatcgtatgggtatgggtactacttatcttgcgcttatggccacatttaaaatgagaccaatgttcgccgttggacttctttttcgaaggcttacatcgagagaagtattattactgacgatcggactcagcttggtagcatctgtggaattacccaattcactagaagagttaggtgacggattagcgatggggataatgattctcaaattattaacggatttccaatcacatcagctgtgggctactcttttgagcctcacttttataaagaccaccttcagtctacattacgcttggaaaactatggcaatggtcctttctattgtgtcactattccctttatgcttgagtacaacatcccagaaaaccacatggttacctgtattattgggtagtcttggttgtaaaccactgacaatgttcctaattgcagagaataaaatttggggacggcgaagctggcctcttaatgaaggcataatggcggttggcatagtgtcaattcttctgtcgtctctactcaaaaacgacgtacctcttgcaggaccacttatagcgggtggtatgcttattgcatgttatgttataagtgggtccagtgcagatttatctctggaaaaagcagcggaagtcagttgggaagaggaagcagaacactcaggtgcttctcacaatatcctagtagaagtacaagatgacggcacaatgaaaatcaaagatgaggaaagagatgacactctaacaattcttttgaaagccacgttactagcagtgtctggtgtctatccattatccatcccggctacactattcgtatggtacttttggcagaagaagaaacaaaggtcaggtgtactatgggatactccttctcctccagaggtagaacgtgcagtcctagatgacggtatatatcgaataatgcagcgagggttgttaggacgatcccaagtaggagtgggagttttccaagaaaatgtatttcacacaatgtggcacgtcacgcgtggagcagtactcatgtatcagggtaaaagattagaacccagttgggcctcggttaagaaagatctgataagttacggaggtggctggcggttacagggatcatggaacacaggcgaggaagttcaagtaatagcggttgaaccagggaaaaaccctaaaaatgtccaaaccgcgcctggcacatttaaaactccagaaggcgaggtaggggctattgctctagatttcaaacctgggacttccgggtccccaatagtaaaccgcgagggtaagattgtcggactctatggaaatggtgtggtaactacatcaggaacttacgttagtgctatagcccaagctaaggcttcacaggaaggaccgctacctgaaatagaagatgaagttttcagaaaacggaatttgaccataatggacctccatccaggaagtggtaaaacgcgacgttatcttcccgccattgtgcgcgaggcaataaaacgaaaattaagaacgctcatactcgctccgacaagggtcgtagcgagtgagatggctgaagcgctgaaaggtatgccaataaggtatcaaacaaccgcagtcaagtcggaacataccggcaaagagatagtagatttaatgtgccacgccacttttacaatgcgactccttagcccagttcgcgtcccaaattataacatgataatcatggatgaagcgcattttacagatcccagcagtatagcggcaagaggttatatatcaactcgagtcgggatgggcgaggctgctgccatatttatgactgccacgcccccagggtcagtagaggcgttcccccagagtaatgcagtaatccaagatgaggaaagggatatcccagaaagatcatggaactccggatatgaatggataactgattttccgggaaaaacagtatggttcgtaccttccataaagagtggtaatgacatagctaattgcttaaggaaaaatgggaaacgcgtaatacagctatcaagaaagacttttgataccgaatatcagaaaacaaagaacaatgattgggactatgtcgttacaacagatataagtgaaatgggagcaaattttcgggcagaccgggttatagatccacggcggtgcctaaagccagtgatactcaaggatggcccagaacgagtcattctagctgggcctatgccagtcacggttgcttctgcagcgcaacgacgagggaggataggccggaaccacaacaaagaaggagatcagtatatttatatgggtcagccgttgaataacgacgaagatcatgcacattggaccgaggcaaaaatgctactagacaatattaatactccagaaggaattattccagcgttattcgaacctgaaagggaaaagtcagccgctatcgatggggaatatcgacttaggggcgaagcacgaaaaactttcgtcgaactaatgagacgaggcgacctaccagtctggctatcttacaaagtcgctagtgaaggttttcaatatagcgatcggcgatggtgttttgatggagaaaggaataatcaagttctagaggaaaatatggacgtagagatctggactaaagaaggcgaacgaaagaagctaagacctagatggttagatgcacgtacatatagtgatcccctagcccttcgcgaatttaaggagtttgcggcaggccgacgttctgttagtggagacctgattttagaaataggcaaattgccgcaacacctcacacaaagggctcaaaacgctttagataatttagtgatgcttcacaattccgaacagggaggaagggcttatcggcatgctatggaggaattaccagatactatagaaacactcatgttactcgcactgatagcggttctaacaggaggcgtaacactgttctttttatcaggacgagggcttggtaaaacatcgataggtctactgtgtgttatggcatctagcgtattattatggatggcttctgttgaaccccattggattgcagcatcaatcatcctcgaatttttcttgatggtattacttatacccgaaccggacaggcaaagaactccacaagataatcaattagcgtatgtcgtgatcggattattgtttatgatcctaacggtcgctgctaacgaaatgggtttactagaaactacgaagaaggatttgggtataggccatgtagcagtcgaaaatcatcatcatgcagcaatgttagatgtagatcttcacccggctagtgcatggactttatacgcagtagcgacaactatcataaccccgatgatgaggcacactatcgaaaacacgacggcgaacatatctttaacagctatagcaaatcaggctgctatcctaatgggtttggataaaggctggcccatatccaagatggatatcggtgttccgttattagcattaggatgttacagccaagtaaaccctttgacactgacagcagctgtattgatgcttgtagcacattatgccataatagggccgggtctgcaagcaaaggctacaagggaggcccagaaaaggacagcagccgggatcatgaaaaatccaacagtggatggaattgttgccattgatctggatccagtagtttacgacgcaaaatttgaaaagcaactaggccagatcatgttactaatcctctgcacttcccaaatacttttaatgcgtacaacctgggcattatgtgaatctattaccttggctacaggcccgctaacgactttatgggaaggatcaccaggcaagttctggaacaccactatagcggtctcaatggcaaatatctttagaggaagttatctggcaggggcaggactagcattcagcctaatgaaaagtcttggagggggacgaagaggtacaggagcacaaggagaaacactaggcgaaaagtggaaaagacagctgaatcaattatcaaaaagcgagttcaatacatataaacggtccgggataatggaagtagataggtcggaagccaaagaaggcttgaagcgaggcgaaacaactaaacacgcagttagcagaggcacggcgaaattgcggtggttcgtggagcgaaacctcgtgaaaccagaaggaaaggtcatagacctgggctgtggccggggcggttggtcctactactgtgctggccttaagaaagtaacagaagtcaagggttataccaaaggtggaccaggacatgaagaacctatacctatggctacatacggatggaatctggtaaagttacattcaggtaaagacgtgttctttataccgccagaaaaatgcgatacactcttatgcgacataggagaatctagcccaaaccctacgattgaagaaggaagaactctacgagtactaaaaatggtagaaccatggctcagaggcaatcaattctgcataaagattttaaatccttacatgccatcggttgtggaaaccctagaacaaatgcaaagaaaacatgggggaatgctagtccggaatcctttatcgaggaactccacgcatgagatgtattgggtatcatgtggtactggtaacatagtaagcgcagtaaatatgacaagtagaatgttactaaacagatttacaatggctcatcgtaagccaacgtatgagagagatgttgacctaggagcagggacccggcatgtcgcagttgaacccgaggtagccaatctagacataattggacaacgaatagaaaatattaagcatgaacataaatcaacctggcattacgatgaggacaacccctacaagacctgggcatatcacgggtcgtacgaagtgaagccttcaggaagcgcttccagcatggtgaatggagtagtgaagttgttaacaaaaccctgggatgtaatcccgatggtcacccaaatcgccatgacagatactacacccttcggtcaacaaagggtattcaaagagaaagtagacactagaacacccaaggctaaacgaggaacggcgcaaattatggaagtaaccgctaaatggctttggggatttctcagcagaaataaaaagccaagaatctgcacacgtgaagagttcactcggaaggtgcgctcaaacgcagcaataggtgcagtatttgtagatgagaatcaatggaactcagctaaggaagccgtagaggatgaacgattttgggatcttgtccatcgagaaagagagttacacaagcaaggaaagtgtgcaacatgtgtatacaatatgatgggcaaaagagaaaagaaattaggagagtttggtaaagcaaagggtagcagagcgatctggtatatgtggttaggagcaagattccttgaatttgaagctctgggattcatgaatgaagatcactggttttcaagagaaaatagtctaagtggcgtagaaggagaaggccttcacaaactcggctacattctgagggacatttcgaaaattccgggaggaaacatgtacgccgatgacacggcaggatgggatacaagaataactgaagacgacttgcagaacgaagcaagaataacggatataatggaaccagaacacgcgctactagcaaaatcaatttttaaactaacataccagaacaaagtagtacgcgttcaacgtccagccaaaaatggaacagtaatggatgtaatatcgcgacgggatcaaagaggaagcggacaagttggtacctacggtttaaatacctttaccaatatggaagcacaacttattagacaaatggaaagtgaaggaatattttcaccatctgaactggagactccaaatctcgccgagcgcgtcttagactggttagagaagtatggagtagaacgtctaaagaggatggcaatttcaggggatgactgcgtagttaaaccaatagatgaccgttttgcaaccgccctaacagcgttgaacgatatgggtaaagtgcgaaaagacattccacaatgggaacctagcaagggatggaatgactggcagcaagttccattttgctcacatcattttcatcagcttatcatgaaagatggcagagaaattgtagtaccttgcagaaatcaagatgagcttgtaggacgagcacgcgtatctcaaggggcaggttggagtttacgagaaaccgcgtgtctaggtaagtcatacgcacaaatgtggcaacttatgtattttcatcgtagagatctgcgattagctgcaaatgcgatttgcagcgcagtacctgtagactggatacccacaagccgcactacatggtctatccacgctcatcatcaatggatgactacagaggatatgttatcagtttggaatcgggtttggatcgaagaaaatccatggatggaggataaaactcacatatctagctggggagatgtcccgtacttaggtaaaagagaggaccaatggtgcggtagtctaataggtctaactgcccgagcaacatgggcaaccaatatacaggtggctatcaatcaagttaggaggcttattggaaatgaaaattatctagattatatgacatctatgaaaagattcaagaatgaaagcgatccagaaggagcactttggtaa

SEQ ID NO: 21938 - RNA, 9879 nt, synthetic construct
  misc_feature 1..9879: note = derived and/or modified CDS sequence (opt6) from DENV-1__EU482495__SS-prME
  source 1..9879: mol_type = other RNA
tcggtgacaatgttattaatgttaatgccgacagcacttgcattccaccttacaacaagaggtggggaaccccatatgatagtatccaaacaagaaagaggaaaatcccttctcttcaaaacgagcgccggggtgaatatgtgtactttaatcgcgatggatttaggagaactttgcgaagatacgatgacatacaaatgtccgcggattacggaagtcgaacctgatgatgttgactgttggtgtaacacaacagacacgtgggttacgtacggaacatgtagtcaaaccggcgaacaccgtagggataaaagatcagtagcactcgcaccacacgtagggttgggccttgaaacgagagctgaaacgtggatgtccagtgaaggagcgtggaaacaaatacaaaaagttgagacttgggctttacggcatccaggttttactgtaattgcattattcctagctcatgcaatcggaacatcaatcacacaaaaaggcataatattcatattacttatgttggtcacgcctagcatggcgatgcgatgtgtcggtataggttcccgagattttgtggagggactttcaggggcgacatgggttgacgttgtactagaacatggtagctgtgtcacgacgatggcaaaagacaaaccaacattagatatagaactactaaaaaccgaggtcacaaaccctgcggtgttacggaaactgtgtattgaagctaaaataagcaatactacgactgatagtagatgcccaacacaaggtgaagctactctagtagaagaacaggatgcaaacttcgtgtgtcgacgaacatttgtagaccggggatggggtaacggttgtggtctattcggaaaaggatccctcataacatgcgctaaattcaaatgcgtgacaaaactagaaggtaaaatagttcaatatgaaaacctaaaatatagcgtaatagtgacagtccatactggagaccaacatcaagtgggaaatgaaagcaccgagcatggcacaacagcaactattacaccccaagcaccaacaagtgaaatacaattaactgattacggagcactgacattggattgctctcccagaactgggctagatttcaatgaaatggtcctcctaacaatgaaagagaaatcctggttggtacataaacaatggtttctcgatttacctctaccctggacatccggtgcgtcaacgagccaagaaacttggaatagacaagatcttttagttacctttaaaactgcacatgccaagaaacaagaagttgtagtgctaggatcccaagaaggagctatgcacacagccttgacgggagctacagagatacaaaccagtggaacaacaacaatatttgcaggtcatttaaaatgtaggttaaaaatggataaattaacccttaaagggatgtcatacgttatgtgcactggacttttcaaactagaaaaagaggtagctgaaactcaacacggaacagtgctcgtacaaataaaatacgaaggtactgacgccccatgtaaaattccattctccacccaagatgaaaaaggagtaacccagaacggtcgattgataacagccaatccgatagtaacagataaagaaaaacctgtcaatatagaagctgaacccccatttggggaaagctacatagtaattggagcaggcgaaaaagcacttaaactatcatggtttaagaaagggagctcaatcggcaaaatgttcgaagcgacagctcgtggagcaagaaggatggcaatattgggtgacacagcctgggattttggaagtataggcggggtattcacaagtgttggtaaactggttcatcaaatattcggaactgcttacggagtattgttcagtggtgtaagttggacaatgaaaataggtataggagtattattgacatggttaggattaaacagtcgttcaacctcattaagtatgacgtgtatagccgtcgggttggttacgctctatttaggtgttatggtacaagctgactcgggctgcgtaatcaattggaaagggagagaattgaaatgtggaagtggtatatttgtaacaaatgaagtgcatacttggactgaacaatacaaatttcaagctgactctcctaaacgcctttctgcagcaattggcaaagcatgggaagaaggagtatgcggaatacgttcagctactcgattggagaatatcatgtggcggcaaattagcaatgaactgaaccatatattgttagagaatgatatgaaatttacagtagtagttggagacgttgtaggtatactagcacaaggcaagaaaatgataagacctcaacccatggagcataagtattcctggaaatcctggggcaaagccaaaattataggtgctgatgtacaaaacacaacctttatcattgacgggcccaacacaccggaatgtccggatgaccaacgcgcttggaatatctgggaagtagaagattatgggttcggtatattcacaactaatatatggttaaaacttagagacagctacacacaagtatgtgatcacagattgatgtcagctgcgattaaagattcaaaggcagtacatgcagatatgggctactggatcgagagtgagaaaaacgaaacctggaaactagctagagcatcttttattgaagttaaaacttgtatttggcctaaatctcatactctctggagtaatggggtgttagaatcagagatgataatacccaaaatatacggaggtcccataagtcaacacaactataggcctggctatttcactcagacagcaggcccttggcacctcggtaaattggaattagacttcgatctctgtgaagggacaacagtggtggtagacgaacactgcggaaatcgcggtccaagtctaaggacgacaacggtaaccggcaaaattatacatgaatggtgctgtaggtcttgtactctacccccattacgatttaaaggagaagacggatgttggtacggaatggaaatacggccggttaaggaaaaagaagaaaacctagtcaaaagtatggtatccgctggatctggggaagttgactccttttccttgggattactctgtatatccataatgatagaagaagtaatgcgaagtaggtggtcacgaaagatgctaatgactggtacactcgctgttttctttctattaataatggggcagttgacatggaacgatttgatcagatcatgtattatggtaggtgcaaacgcaagcgatcgtatgggcatgggcacaacgtatctcgcactgatggctacgttcaaaatgcgaccaatgttcgccgttggactgcttttccggcgactgaccagtagagaggttctattgttgaccatcggactatctttagttgcgtcagtagaactcccaaattctctggaggaactgggagacggattggcaatgggaataatgatactaaaactattaaccgatttccaatcttatcaattatgggccacccttttatcgttgacatttattaagacaacctttagtctacattatgcatggaaaacaatggccatggtacttagtatagtctcacttctgcctttatgcctaagcacgacaagtcaaaagacaacatggctaccggtactcctggggagcttaggatgtaaaccattgaccatgtttttgattgctgaaaataaaatatggggaagaaagagctggccattaaatgagggtataatggcagtaggaatagtatctatattgttgagctcactactaaagaacgacgttccattagccggccctttaatagcagggggcatgctcatagcgtgttacgtcatatctggtagcagtgcagatctatcgttagagaaagctgcggaagtcagttgggaagaagaagcggaacatagtggagcgtcgcataacatcttagttgaagttcaggatgacggaacgatgaagataaaagatgaagaaagagatgacaccttgacaattcttttaaaagcgactttactagcggtaagcggtgtgtatcctctatcaatcccagcgacgctatttgtctggtatttttggcagaagaagaaacaacgatcaggtgtgctctgggataccccaagtccaccagaagtagaacgagcagtcctagacgacggaatatataggatcatgcaacgaggtctcctgggacgaagtcaagtaggggtaggcgtgtttcaagaaaatgtatttcataccatgtggcatgtaacaaggggtgctgttctaatgtatcaaggaaaacgactagagccaagctgggcctctgttaaaaaggatcttattagttatggaggaggatggcgtttgcaagggtcgtggaacacgggcgaagaagtccaagtaattgcagtagaacctggtaagaacccgaaaaatgtccagaccgccccaggaaccttcaaaacgccagaaggggaagtgggagcaatagcgctggacttcaaacccggcactagcggtagccctatcgtcaaccgagagggtaaaattgtaggtttatatggaaatggggtggtaactacttctggaacatatgtatcagctattgcgcaggcaaaagcgtcacaagaaggaccactacctgaaatagaagatgaagtttttcggaagcgaaatttgacaattatggacctccaccctggttccggaaaaacaagacgatatttacctgctatagtaagagaggccattaaacgaaaactaagaaccctgatattagcgccaacaagggtggtagcaagtgaaatggcagaggccctcaaaggtatgcccataaggtaccaaacgactgcagtgaagtctgagcatactggaagagaaatcgtcgatctaatgtgtcatgcaacattcacgatgcgattattatcgccagtgcgtgtgccaaattataatatgatcataatggatgaagctcacttcactgatccgagctcaatcgctgcgcgtggttacatttcaacaagggttggaatgggggaagcagctgcaatttttatgaccgctactcctccgggatccgtagaagcctttcctcagtcaaatgccgtaatacaggatgaagaacgggatattccagagcggagctggaatagtgggtacgaatggattactgactttccaggcaaaactgtatggtttgtcccgtcaataaaatctggtaatgacatagcaaactgtttacgcaaaaacgggaaaagagtaatacaactatcaagaaaaacattcgacaccgagtatcagaaaactaaaaacaatgactgggactacgttgtcacaacggatataagtgaaatgggggcaaactttagagcagatagggtaatagatccaagacgatgcttaaaacccgtcattttaaaagatggtccagaaagagtgatattagccggacctatgcccgtaacagttgcatcagcagcgcaaaggcgcggaagaattggtaggaaccataacaaagaaggagaccaatatatatatatgggccaaccgctgaacaatgacgaagatcatgcccattggacagaagcaaaaatgttacttgacaatattaatacgcctgaaggcattataccagctctattcgagcctgagagggaaaagtctgcggctatcgatggcgaatatcgtctgcgaggtgaagccaggaaaacctttgtagagcttatgcgccgaggagatctaccagtatggctttcctacaaagtcgccagtgaagggtttcaatatagtgatagaagatggtgtttcgacggcgaacgcaacaatcaagtattagaagaaaatatggatgttgaaatttggacaaaagagggggaaagaaagaaattaagacctagatggctcgatgcaagaacttatagtgaccctttagccctgagagagtttaaggaatttgcagccggacgcagatcagtcagtggggacttgatcttagagataggaaaactgccacaacacttgacacaaagagcccaaaatgcattagataatttggtgatgctacacaattcagaacaaggaggtagagcatatagacatgccatggaagaactacccgatactatagaaactttgatgttactagcactgattgcggttcttaccggaggagtgaccttatttttcctttctggtcgcggattaggtaagacttctataggtttattatgtgtgatggcgtcttctgctctactatggatggcatctgtagagccacactggattgctgccagtattattctagaatttttcctgatggtattacttatcccggaaccggatagacaacgtactccacaagacaatcaacttgcctatgtggtaataggactattattcatgatactcactgtagccgcaaatgaaatgggtcttttagaaacaaccaagaaagacttaggtataggccatgtggcagtagagaatcatcaccatgctactatgttagacatagatctgcacccagcctccgcctggacgttgtatgcagtagccacgactattataacccccatgatgcgtcacaccatcgaaaacacgacagcaaacatatcactgaccgccatagccaaccaagctgccatactaatgggcttggataaaggttggccgatatctaaaatggatatcggggtaccattactggcactaggatgttacagtcaagttaatccactaacactaacagcagctgtactaatgttagttgcacattatgcaattattggcccagggcttcaagccaaagctacacgcgaagcacaaaagaggactgccgcaggcataatgaaaaatcctacagtagatggaattgttgccatagatctcgatcctgtagtctacgacgctaaattcgaaaagcagcttggtcaaatcatgttactgattctatgcacaagtcagattttacttatgcggactacttgggcattatgtgaatctatcactttagccacagggccactaactacattatgggagggttcacctgggaaattttggaacaccacaattgcagtgtccatggctaatatattcagagggtcctatctagccggagctggactagcatttagcctaatgaaatccctaggagggggacgccgtggaaccggagcacaaggggaaacactcggagaaaaatggaaaagacaactcaatcagttaagtaagagtgagttcaatacatataagcggtcgggtatcatggaagttgaccggtcagaagcaaaagaaggcctacgtcgtggagaaactacaaaacatgcggttagtcgcggcacggcaaagctccgatggttcgttgaacgcaacttggtcaaacctgagggaaaagtgattgacttaggctgtggaagagggggctggtcgtattattgtgcaggacttaagaaagtcacagaggttaaaggatatacaaaaggaggaccaggccatgaggaacctatccctatggctacatacgggtggaacctggtcaagctccattcgggaaaagacgtattctttataccacctgaaaaatgtgacaccttattatgtgatataggtgaaagcagcccaaatcctactattgaggaggggagaaccttgagagttctaaaaatggtagaaccgtggctccgggggaaccagttctgtataaagatactaaacccatatatgccatcagtagtagagacgttagaacagatgcaaagaaaacacgggggcatgctggtgagaaaccctctttctcgaaactcaacacacgaaatgtactgggtatcttgcggaacgggtaacatagtgtcggctgtgaacatgacgtcccgaatgttactaaatcgctttaccatggcgcatcgcaagcctacctatgaacgagatgtggatctaggagctggaaccaggcatgtagctgtcgaaccagaagtagcaaatctagatataatcggacaacgcatcgaaaacattaaacacgagcataagagcacttggcattacgacgaggacaacccttataaaacctgggcctaccatggatcatatgaggttaaaccatcgggatccgcgtcatctatggttaacggtgtagtcaagctgttgacaaagccctgggacgtgatccccatggtcacccagatagctatgacagacacaacaccatttggccaacagcgagtgttcaaagaaaaagtcgacacaaggacacccaaagcaaagagaggtacagcacaaataatggaagttacagccagatggttatggggcttcttatccagaaataagaaaccaagaatatgtacacgagaagaatttaccagaaaagtacgaagtaatgctgcaataggggcagtgtttgtggacgaaaatcagtggaacagcgctaaggaagctgttgaggacgagagattctgggatttagttcatagagaacgcgaattacacaaacagggtaaatgcgcgacgtgcgtatacaatatgatgggaaaaagggagaagaaactgggagagttcggtaaagcaaagggcagcagggcgatttggtatatgtggctgggcgcaaggttcctagagtttgaagcactaggatttatgaatgaggatcattggttcagtagagaaaactcattatctggggtggagggagaagggctgcataagctaggatacattctgagggatatatccaaaataccgggcgggaacatgtacgccgatgacactgctggttgggacactcgaataaccgaagatgacctacaaaacgaagcaaaaataactgatattatggaacctgaacacgctctgctagcgacttcaatatttaaactaacatatcagaataaagtagttcgagtacaaagacccgcacgaaacggaaccgtcatggacgtaatatcaaggagagatcaaagaggctcgggtcaagttggcacatacggactcaacacgtttaccaatatggaagcacaactgataagacaaatggaaagcgaaggcatctttagtccaagtgaactggagacaccaaatttagcagagagagttttagattggctagagaaacatggcgtcgaaagactaaagcgaatggcaatcagtggcgatgattgtgtagttaaacccattgatgacaggtttgcaacagcactttcagcgttgaacgacatgggcaaagtacggaaagacataccccaatgggaaccatccaaaggctggaacgattggcaacaagttcctttctgttcacatcatttccaccaactaatcatgaaagatggacgcgaaattgttgtaccctgccgaaatcaggatgagttggtaggcagagccagggtatcacagggagcaggttggtccttgagagaaacagcctgcctaggcaaatcgtatgctcagatgtggcaactcatgtactttcaccgaagagatttacgattagcagcaaacgcaatctgcagcgcagtgccagtcgactgggttcctacgagtagaactacctggtctatacatgcacatcatcaatggatgacgactgaagatatgttatctgtctggaatagagtgtggatagaagaaaatccttggatggaggacaaaactcatattagtagctggggcgatgtaccatatctcggcaagcgtgaagaccaatggtgtgggagtctaattggattaacagcacgtgccacctgggcaactaatatacaagttgctataaatcaggtgcggaggttgataggaaatgaaaattatcttgattacatgacatcaatgaaacggttcaaaaacgactcagacccagaaggagctctatggtga

SEQ ID NO: 21939 - RNA, 9879 nt, synthetic construct
  misc_feature 1..9879: note = derived and/or modified CDS sequence (opt6) from DENV-1__EU482496__SS-prME
  source 1..9879: mol_type = other RNA
agtgtaactatgttactgatgctcatgccaacggcgctagcttttcatctaacaacaagaggtggagaaccacatatgatcgtgagtaaacaagaacgaggaaaaagtttgctttttaaaacttcagcaggagtgaatatgtgtaccctcatagcaatggatcttggagaactctgcgaagatacaatgacatacaaatgtccacggattaccgaaactgaacctgacgacgtagactgttggtgcaacgcaaccgatacatgggtgacctacggaacctgttcacaaacaggagaacaccgtcgcgacaaaagatcggtagctcttgcaccccatgtcggtctcggactagaaacgagaacagaaacttggatgagctcggaaggtgcatggaaacaaatacaaagggtagaaacatgggcattaagacatcctggtttcactgtaatagctctcttcctcgcacacgctattggcacatctatcacacaaaaaggaataatattcatacttttaatgctcgttacaccaagtatggctatgagatgtgtaggcatcgggagtcgagatttcgttgaagggttgtcgggtgcgacttgggtagatgtagtgttagaacacggtagctgtgtaaccactatggctaaagacaaaccgacacttgatatagaacttctgaaaaccgaggtgactaatccagcagtattgcgcaaactttgtatcgaagctaaaatatcaaacacgactactgactctagatgcccaactcaaggtgaggcaacccttgtagaagaacaagacgcaaatttcgtctgtcgccgtactttcgtcgacagaggttggggaaacggatgcggattgtttggaaaaggttctttaataacatgcgcaaaatttaaatgtgttaccaaattagaaggcaaaatcgttcaatacgagaacctaaagtactctgtaattgtcactgtacacactggagaccaacatcaggttggcaatgaatccacagagcatggaaccaccgcaacgataactccacaagccccaacaactgaaattcagttaaccgactacggggctcttacattagattgcagccctaggaccggactggactttaatgagatggtactactcacaatgaaagagaaaagttggctcgtacataaacagtggtttttagacttacccttaccgtggacaagcggagctagtactagccaggaaacgtggaataggcaagatttgctggtcactttcaaaacagctcatgccaagaaacaggaagtagtagtgctcggtagccaagaaggagccatgcatacagctctaacaggtgcaacggagattcaaacaagtggcacaacgactatattcgcaggacatttaaagtgtagattgaaaatggataagttgactttaaaaggcatgagttacgttatgtgtacggggtcatttaagctagaaaaagaagtcgcggaaacccaacacgggacggtcctagtgcaaataaaatatgaaggaaccgacgcaccctgcaagatacctttctcaacacaggacgaaaaaggtgttacacaaaatggacgcctaattactgctaatcccattgttacagataaagaaaagcccgttaatatagaagctgaacctccatttggcgaatcctacatcatcataggcgctggagaaaaagctctcaaattatcatggtttaagaaaggttctagtatagggaaaatgttcgaagctacggcacggggcgccagaagaatggcaattctcggagacacagcttgggactttggatcaattggaggagtattcacatcagtgggtaaactcgttcatcaaattttcggtacagcatatggtgtactattttcaggtgtgtcctggacgatgaagataggcataggcgtgcttttaacatggttaggtttaaattcacgaagcacatcattatcaatgacttgcatcgcagtcggactcgtaaccttatacttaggagtaatggtccaagcagattcaggctgtgtaattaattggaagggaagggaactcaaatgcgggtcaggcatatttgtaacaaatgaagttcacacatggaccgaacaatataaattccaggctgatagccccaagcgtctatcggcagcgattgggaaggcatgggaggaaggtgtctgcgggatccgctcagccacccgactagaaaatataatgtggaaacaaatctcaaatgagctaaaccatattttgttagaaaacgacatgaaattcacagtagtcgttggtgatgtagcaggaatactggctcaaggtaagaaaatgataagaccacagccaatggagtataaatattcctggaaaagttgggggaaagccaaaataataggcgccgatgtgcaaaacacaacgtttattatcgacggccccaacacacctgagtgtccagatgaccaaagagcatggaatatatgggaagttgaagattacggttttggcatttttacgaccaatatatggttaaaattaagggattcttatacccaagtttgcgatcaccgtcttatgtccgcagctattaaagatagcaaggcagttcacgcggacatgggttattggatagaaagcgagaaaaatgaaacatggaagttggctcgtgccagcttcatagaagtaaaaacttgtatatggccaaagagtcacactctgtggtcaaatggtgtcttggaatcagagatgataatacccaaaatttacggaggacctatatcacaacacaactatcgacctggttactttacccagaccgcgggcccttggcatttagggaaactagaattagactttgatctttgtgaagggactacggtcgtagtagacgaacattgtggtaaccgtggaccgtcactaagaactactacagttacaggtaagataatacatgaatggtgttgtagaagctgtacccttcctccgctcaggtttagaggagaagatggttgttggtatggaatggaaataaggcccgtcaaggaaaaagaggaaaatctggttaagtctatggtaagtgcaggttctggagaagtagattcattctcattggggctactgtgtataagcattatgatagaggaagttatgaggtcccggtggtcaagaaaaatgctaatgacgggtacgttggcagtgttcttccttctaattatgggtcagttaacgtggaatgacttaattagactatgtataatggtaggtgcaaacgcttctgacagaatgggaatgggaacaacttatctggctttaatggcaacattcaaaatgagacctatgtttgcggtaggtctattatttaggagattgacatcaagagaggtattattactgaccataggactttctctagttgcttccgtagaactaccaaatagtctggaggaattaggagatggattggccatgggtatcatgattctaaaattacttacagacttccaatcccaccaactatgggcaaccttattatccttaacatttataaaaactacattttccctgcattatgcttggaaaacgatggcaatggtgctatcaatagtgagcttatttcccttgtgcctatcaaccacaagtcagaaaacaacctggttgcctgtattgcttggatcactaggttgcaaaccgctcacaatgtttctaatagctgagaataagatatggggaagacgaagctggccgcttaatgaaggtataatggccgtgggaatagtctcaatattattatcgtcattactgaaaaatgacgttcccttagcaggaccactgattgctggaggaatgctgatagcatgttatgtcataagcggttcaagtgcggacttaagtctagaaaaagccgcggaggtaagttgggaggaagaagcagaacacagtggtgcaagccataacatattagtagaagttcaagatgacgggaccatgaaaattaaggatgaagaaagagacgacacactgacgatcttacttaaagcgacccttctagctgttagtggtgtttacccactaagcattcccgccacactatttgtatggtatttctggcaaaagaagaaacaacgaagcggagtactttgggatacaccatcaccgccagaagtagaaagggcggttttggatgatggaatttataggataatgcaaaggggcttactaggaagaagtcaagtaggagtcggagtctttcaggagaatgtattccacacaatgtggcatgttactagaggagcagttcttatgtaccagggaaaaagactagaaccatcgtgggcaagtgtcaagaaagatttaatatcttacggaggagggtggcggttacaagggtcatggaatacaggtgaggaagtacaagtcatagcagtagagcccggcaagaacccgaaaaacgtccaaacagcccctggcacttttaagacgccggaaggagaggtgggagcgatcgcacttgacttcaaaccaggaacgtcaggctcaccaatcgttaacagagaaggcaaaatcgttggtctctatggaaatggagtagtcacgacttcaggcacatatgtgagtgcaattgcacaagcaaaggctagccaagagggccccttgccggaaatagaggacgaagtatttcggaaacgaaatctaacaataatggaccttcacccaggaagtggcaaaacacgacgttatctcccggcgattgttcgtgaggcgattaaaagaaaacttaggacgctcattttagctccaaccagagtcgtcgcctccgagatggcagaagccttaaagggcatgccaatccgatatcaaacaacagcagtgaaatctgagcatacaggtaaagagatcgtcgacctaatgtgccatgcgacatttacaatgcgactcttaagtcctgtaagggtaccaaattacaacatgattattatggatgaggctcattttactgacccaagtagcattgcggcacgaggttacattagtacgcgagtaggaatgggggaggccgcagctatctttatgacagccacacccccaggctccgtcgaggcctttccacagtcaaatgcggttatccaagatgaagaacgtgacattcccgaaagatcgtggaactcaggatatgagtggataacagatttccctggaaagacggtatggttcgtgccatctattaaatctggaaacgatatagcaaactgtcttagaaagaatggtaaacgcgttatacagttgtcacgaaaaacattcgatacagaataccagaaaaccaagaataacgattgggactacgtagtcaccacagacataagcgagatgggagcaaattttcgcgcagatagagtaattgatccccgaagatgtttgaaaccagttattctgaaggacggtccagaacgtgttattctagcgggaccgatgccagtaactgtagcgagtgcagctcaaaggagaggtagaatcggcagaaaccataataaagaaggcgatcaatatatatatatggggcaaccactaaacaacgatgaagaccatgctcactggaccgaggcaaaaatgttgttagataacattaacactccggaaggcataatcccagcgttgttcgagcctgaacgtgaaaaatcggcagctatagatggggaatacagattacgtggagaagcaagaaaaacattcgtagaacttatgcgaagaggagatcttccagtatggttatcatacaaagtagctagtgaaggttttcaatactcagaccgacgatggtgtttcgacggagagaggaacaaccaagtactagaggaaaacatggacgtggaaatatggacgaaagaaggtgaacgcaagaaacttagacctaggtggttagacgccagaacatattcagatccattagctttaagggaatttaaggagttcgcagcaggaagaagatcagttagtggagatttgatacttgaaatcggtaaactcccccaacatttgactcaaagagcacaaaatgctctggataacttagtcatgcttcacaacagcgaacaaggaggtagagcatataggcacgcaatggaagaactgcccgatacaatcgagactttaatgctactcgccttaatagccgtattaacaggaggagtgacacttttctttctatctggaaggggtcttggcaaaaccagtattggcttactatgtgtaatggcatcaagcgttttgttatggatggcatcagtagagcctcactggatagccgcaagcataatactagaatttttcctaatggtcttactaattccggagccagatcgtcaacgaacgccccaagataatcaattggcttacgttgtaattgggttattgtttatgattctaacggtagcagctaatgaaatgggactgcttgagactactaagaaagatcttggtataggacatgtcgccgtggagaaccatcatcacgcagccatgctcgatgtcgatttacatccagccagtgcatggactctatacgcagtagcaaccactataattacaccgatgatgagacatacaatagaaaatacaacggccaacatatctttaacggctattgctaaccaagcggcgattctaatgggtcttgacaaagggtggcctataagcaaaatggacatcggagtaccattgcttgcgctagggtgttattctcaggttaatccgttgacattaacggcggccgtgctaatgctcgtggcacactatgcaatcataggacccggcttgcaagcaaaagccaccagagaagcccagaaaagaacagcagccggaatcatgaaaaatcctactgtagacggcatagtagccatagacttagacccagttgtgtacgacgcgaaattcgaaaaacaacttgggcaaataatgctactaattttatgtacgagtcagatattattaatgcgcacaacttgggcactatgtgagagtataacgttggctactgggccactaaccacattatgggagggttcaccagggaaattttggaatacgacaatagcagtatcaatggctaatatatttagaggatcatatttagcaggagctggcttagctttctcattgatgaagtcactgggcggtggtaggcgtgggacaggagcgcagggtgaaacactcggcgaaaagtggaaacgacaattaaatcaactttcaaagtctgaatttaatacttacaaaaggtctgggataatggaagtcgacagaagcgaagctaaggaaggcttaaagcgaggagaaaccactaaacacgctgtctccagaggaacagcaaaacttcgatggtttgtagaaagaaacctagtaaaaccagaagggaaagtaatagatctgggttgtgggcgagggggttggtcgtattattgtgcaggacttaagaaagtgactgaagttaaaggctacactaagggcggccctggacatgaagaaccaatacctatggcaacatacggctggaacctggtaaaactccattccggaaaggacgtattcttcataccgccagaaaaatgtgacaccctgttatgcgatataggcgagagtagtccaaaccccacaattgaagaaggacgaacactaagagtattgaaaatggttgagccatggttgcgcggaaatcaattctgcatcaagatcttaaatccctacatgccaagtgtagtggagactctagaacaaatgcaaaggaagcatgggggaatgctagtcagaaatccactttcaagaaactctacacacgaaatgtactgggtctcgtgtggcacaggcaatatagttagtgcagtaaacatgacgagtcggatgctgttgaacaggtttacaatggctcatagaaagccaacatatgaaagagacgtagatcttggagccggcactcggcatgtagctgtggagcctgaagtggccaatctcgatataattggacaaagaatagagaatatcaaacatgagcacaaatcaacatggcactatgatgaggataatccctacaagacatgggcgtatcatggttcctacgaagtaaaaccgagtggctcagcctcgtccatggtgaacggagtagtaaaattactcactaaaccgtgggacgtaattccaatggtaacacaaattgcaatgactgatacaacaccttttggacaacaacgcgtatttaaggaaaaagttgacacccggacacctaaagctaagaggggtaccgcacaaattatggaagtcaccgcaaaatggttatggggttttctctctcggaataagaaaccacgcatatgtacacgggaggagtttacaaggaaggtgagatcaaacgctgcgataggagcagttttcgtggacgaaaatcagtggaactcggctaaggaagccgttgaggatgaacgattttgggatctggtccatagggaaagagagcttcacaaacaaggtaaatgtgcaacctgtgtatataatatgatggggaagcgagagaagaaactcggagaatttggcaaagcaaaaggatcacgagcaatctggtatatgtggttgggagcccgctttctagagttcgaggccttaggatttatgaatgaagatcattggttttcacgggaaaattctctaagcggagttgaaggtgagggattacataaactgggctatatacttcgagatatttcgaagatccccggaggaaacatgtacgcagacgatactgccggatgggatacgcgtatcacagaagacgacctacaaaacgaagccagaataacagatatcatggaacctgaacatgccctgttagcgaaaagcattttcaaacttacatatcaaaataaagttgttagggtccaacgccccgccaaaaatggaactgtaatggacgtaataagtagaagagatcaaagaggttccggtcaagtcgggacatatggacttaatacatttaccaacatggaggcgcagctcataagacaaatggaatccgaaggcattttcagccctagtgagctggaaacaccaaatctagcagaaagggttttggactggctaaagaaatatggcgtagagcgattaaagcgtatggcaatatctggagatgattgcgttgtaaaaccaatagacgatagatttgccaccgcactgacagcactaaacgatatgggaaaagtgagaaaagacataccacagtgggaaccttcaaaaggatggaatgattggcaacaagtacctttctgttctcatcatttccaccaattgataatgaaagatggaagggaaatagtcgttccgtgtagaaatcaagatgagctagtcgggagagcacgtgtgtcgcagggagcaggatggtcattacgtgagactgcatgtttggggaaatcgtatgcacaaatgtggcaacttatgtatttccatcgaagagatttacggttagcagctaatgccatttgctccgcagtaccagtagactggattccaacatcccgaaccacgtggtccatacatgcacatcatcaatggatgacaacagaagacatgctaagtgtatggaacagagtatggatagaagagaacccatggatggaggacaaaacccatatatcttcttggggagatgtgccatacctaggaaagagagaagatcaatggtgtggaagtctaattgggctaactgccagggcgacctgggcaacgaacattcaagttgctattaatcaggttcgaagactcataggaaacgaaaactatctagactatatgacgtctatgaaaagattcaagaatgaaagcgatcccgaaggggccctctggtag

SEQ ID NO: 21940 - RNA, 9879 nt, synthetic construct
  misc_feature 1..9879: note = derived and/or modified CDS sequence (opt6) from DENV-1__EU482497__SS-prME
  source 1..9879: mol_type = other RNA
agtgtgacaatgttactaatgttgatgcctacggctctagcgtttcatctaacaactcgtgggggtgaaccccatatgatagtatcgaaacaagaaagaggaaaatctctattatttaaaacaagtgctggcgtaaatatgtgtacactaattgctatggacctaggcgaactttgtgaagacacgatgacgtataaatgtccgaggataacagaaaccgaaccggacgatgtcgattgctggtgtaatgctacagacacctgggtaacgtatggtacatgtagtcaaactggagaacatcgaagggataaacgaagcgttgcgttagcaccgcatgtcggtctcggcctagaaacaaggaccgaaacatggatgagttcagaaggtgcatggaagcaaattcaacgggtagaaacgtgggcgctacggcaccctggtttcactgtaattgctctattcttggctcatgctattggaacttcaataactcaaaaaggcataatatttattcttttaatgttagttactccgtccatggctatgcgttgcgttgggattggatcaagagactttgtagaagggctaagtggtgctacgtgggttgatgtcgttctagaacatgggagttgtgtaacaaccatggcaaaggataaaccaacactagacatagagctattgaagacagaagtgacaaacccagcagttttacgtaaattatgcatcgaagcaaaaatttctaacaccactacagatagccgatgccccacacaaggagaagcgacgctagtggaagaacaagatgcaaattttgtctgccgtcgaacattcgttgatagaggatgggggaatggatgcggtttattcgggaaagggtcactgataacctgcgcgaagttcaagtgtgtaactaaattggaaggtaaaatagtgcaatatgaaaacttaaaatattctgttatagtcactgttcatactggtgaccagcaccaagtaggtaatgaatcaacagaacacggaaccaccgctacaataactccacaagcgccgaccacagagattcagttgacggattacggggcattgacattggattgtagtccacgaacgggactagattttaacgaaatggtccttcttacaatgaaggagaaaagttggttagtacacaaacagtggttccttgatctgccattaccatggaccagcggagcaagcacgagccaagggacgtggaatcgccaggatctcttggtgacatttaaaacggctcatgccaagaaacaggaagtcgttgtattaggcagtcaggagggagcaatgcacacagctctcaccggagccacggaaattcaaaccagtggtacaactaccatatttgcaggacatttgaaatgcagactaaaaatggataaattaaccttaaaaggcatgagttatgttatgtgtacaggatcattcaaacttgagaaagaagtcgccgaaacgcaacatggtactgttttggttcaaatcaagtatgagggaaccgatgcaccttgcaagatcccattttctacgcaagacgaaaagggcgtaacccagaacggcagattaatcaccgctaatcctatagtgacggacaaggaaaagccagtaaacatagaggcagaacccccgtttggagaaagttatatagtaatcggcgcaggcgagaaggctttaaaactgagctggtttaaaaagggatccagtataggaaaaatgttcgaggctacagcaagaggcgctcgacgaatggcaatactaggggacacagcctgggattttggcagtataggaggggtttttacttcggtaggaaagctagtgcatcaaattttcggaacagcctacggtgtcctgttctcaggagtatcatggacgatgaaaatcggaataggagtccttctaacttggctagggctaaacagtagatcaacatctctatcaatgacatgtatcgcggtgggtttggtaacgctttatctgggagtcatggtgcaggctgattcaggttgcgtaatcaactggaaaggacgagagttaaaatgcggttcaggtatttttgttacaaatgaggtacatacatggacggaacagtacaaattccaagctgactcacctaaaagattatcggctgctatcggaaaggcctgggaagaaggggtttgtggcataagaagtgccacacgcctggaaaatattatgtggaagcaaatctctaacgaattgaatcatatccttcttgaaaatgacatgaaatttacagtcgtggtaggcgatgtagcaggaattttggcacaagggaagaaaatgataagacctcaacctatggaatataagtacagctggaaatcctggggtaaagcaaaaattataggggctgatgtacaaaataccacgttcataatagacggacccaatactcctgaatgtccggacgatcaaagagcatggaatatatgggaagtagaagattatgggtttggaatcttcacgaccaacatatggctcaaactcagagactcttatacacaagtttgtgatcatcgtttaatgagcgctgcaataaaagattctaaagctgtacatgcagatatggggtattggatagaatcagagaaaaatgagacctggaagttagcccgggcgtcttttatagaagtgaaaacgtgtatatggccaaaaagtcacactctgtggagcaatggtgttcttgaaagcgaaatgattatcccgaaaatctatggtggacccatatcacaacataattacaggccggggtattttacacagacagctggaccatggcacctagggaaattagagttagactttgatctatgcgagggtactacagtagtagtggacgaacattgcggtaacagagggccttctttaagaaccactacagttactggtaaaattattcatgagtggtgctgccggtcatgtactctaccacctctgcgatttaggggcgaagatggttgttggtatggaatggaaataaggccggtaaaggaaaaagaagagaatttagttaaatctatggtttctgctggcagtggggaggtagatagtttcagtttaggcctattgtgcattagcattatgatagaagaagtaatgaggtctcgatggtctaggaaaatgttgatgactggaacgttagctgtattctttctattaatcatgggacaattgacttggaatgatctaatacgattgtgcatcatggtaggcgctaatgcatctgatagaatgggaatggggacaacctacttagcactaatggcaacgtttaagatgagaccaatgtttgccgtcggcttactattcagacgcctaacaagccgagaagtattattgctgactataggactcagcctagtagctagcgtagaactaccaaattctttagaagaactaggcgatggactagctatggggataatgattttgaagttactcaccgattttcaatcacaccaactatgggccacccttctgtctttaacatttattaaaacaacattctctctccactatgcatggaagacgatggctatggtcctgagcatagtaagtttatttccattatgtctatctactacaagtcagaaaaccacgtggctccccgtcttactaggcagcctgggatgtaagcctttaacgatgtttctaatagcagaaaataagatatggggaagaagaagttggcctttaaacgaagggattatggccgttgggatagtatcgattctactgtctagtttactcaaaaatgacgtaccactagccggacccctcatagccggcggtatgttgattgcttgttacgtaatcagtggaagcagtgctgacctaagtttagagaaagcagcggaagtcagttgggaagaagaagcagaacattcgggagcatcacataacatacttgtggaggttcaggatgacggtacaatgaagataaaagatgaggaacgcgatgatactctgaccatcttactcaaagcaacactcttagccgtctcaggggtgtatcccttgtctattccagcaactttatttgtgtggtatttttggcagaagaagaaacaaaggtccggcgtgttatgggacacacccagcccacccgaagttgaacgagctgttcttgacgatggaatctacaggatcatgcaaagaggtttgctaggtagaagccaagtaggtgtaggtgttttccaagaaaacgtgttccacacaatgtggcatgtaacgcgcggagctgtactgatgtatcaaggcaaacgtctggaacctagttgggcgtccgtaaagaaagatctcataagctacggtgggggttggcgattacagggaagctggaatacgggggaagaagtgcaggtaatagcagtggaacctggcaaaaatcccaaaaatgtacaaacggcgccgggtactttcaaaaccccagaaggcgaagtaggcgcaatagcattagattttaaacctggaacgagtggaagccccatcgttaatagagaaggaaaaatagtaggactatatggaaatggcgtagttacgacctcaggtacatatgtctccgcaattgcacaagccaaggcaagtcaagaaggcccgttacctgagattgaggacgaagtctttcgtaaaaggaacttaacaattatggacctacatccagggtcaggcaaaacaaggaggtatcttccggccatagtcagggaagcaataaagcgaaagttaaggactctaatactagcccccactagagtggtcgcatcagaaatggccgaagcgctgaaaggaatgccaatccgttaccagactacagcagtaaaaagtgaacacaccggcaaagaaatcgttgacttaatgtgtcatgcaacttttacaatgagactgttgagcccagtaagggtacctaattacaatatgattataatggacgaagctcactttactgatccgtcttccatcgctgcgcgtggttacatatctacaagagtaggaatgggcgaagccgcagcaatcttcatgacggctactccacccggctcggtagaagcatttccacaatcaaacgcggtaattcaagatgaggaacgagatattccagaaagaagctggaatagtggttacgagtggatcaccgattttccaggtaaaactgtgtggttcgtcccgtctataaaatctggaaacgatatcgctaattgtcttaggaagaatgggaagcgggtaatacagttatcgcgtaagactttcgatacagaataccagaaaaccaaaaacaacgattgggactatgtagtgactaccgatatctcagaaatgggcgccaactttagagcagatagagtgatcgatccgcggcgctgtcttaaaccagtgatattaaaggatggaccagagagggtgatactagcaggcccaatgccggtgacagtagcatctgcggcacaacggagaggccgcatcggaagaaaccataataaagaaggtgatcaatatatatatatgggacaaccattaaataatgatgaggaccatgcccattggacggaagctaaaatgctactagataatataaataccccagagggtatcataccggcgttatttgaaccagaaagagaaaaatcagctgcaatagatggtgagtatcgattaagaggcgaagcaaggaaaacgtttgttgaactaatgaggagaggagatttaccagtttggcttagttataaagtagcaagtgagggttttcaatattcagataggcgttggtgttttgacggagaaagaaacaaccaagtcttggaagaaaatatggatgtagaaatatggactaaagaaggggagcgcaaaaagctgcgacctaggtggttagacgctcgaacctatagcgatccactggcactgagagagtttaaggaatttgctgctgggaggagaagtgtttccggagatctaatattagaaatagggaaactgcctcaacacctaacacagagagcacaaaacgccttagacaacctggtcatgttacacaacagcgagcaagggggaagggcctatagacatgcaatggaagaactaccggatacgattgaaaccttaatgctcctagcactgatagcagttctaacagggggagtgacacttttctttctaagtggaagggggttgggcaaaacatcaataggtttgctctgtgtaatggcatcatccgtactattatggatggctagtgtggagccacattggatagcagcgagtattattcttgagttctttttaatggtactcttgataccagaaccagacagacagaggactcctcaagacaaccagttagcctatgttgttataggactattgtttatgatattaacagtagccgcaaatgaaatgggactattagagacaactaagaaagatttgggaatagggcatgtagcagttgaaaaccaccatcatgccgcaatgttagatgttgatttgcatccagcatctgcctggaccttgtacgcagttgcgactaccataataacgccaatgatgcgacataccattgaaaacacaaccgctaatatttcgttaactgcgattgcaaatcaagctgcgattttaatgggattggacaagggatggcccataagtaaaatggatataggggtaccactattagctcttggatgttactcacaggtcaaccctctgacattaacagccgctgtattgatgttggtagcgcattacgcaattataggaccggggttacaggcaaaggcaacaagagaagctcagaaaaggaccgctgccggaataatgaaaaaccctacagtagatggaatagtggccatcgatctagatcctgtagtgtatgatgcaaaattcgaaaaacaactaggtcaaataatgttactaatattatgtacgtcacaaatattactaatgcgtacgacttgggctttatgtgaaagcattaccttagccacagggccactaaccacattatgggaaggttctcctggaaaattctggaacacgacgatagcggtctctatggcaaatatattcagaggtagctacttagccggggccgggttggctttcagccttatgaaaagtttaggaggcggacgacgaggaaccggggcgcaaggtgaaactcttggagaaaaatggaaacgacaactaaaccaattaagtaagtcggaatttaacacttataaacgatccggaataatggaggtggaccgaagtgaagcaaaagagggtttaaagagaggagaaactaccaaacatgctgtatcccgaggcacagctaagctccgttggtttgtcgaacggaacttggtaaaaccggagggaaaagttatcgatttaggatgcggaaggggagggtggtcatattattgcgccgggctaaagaaagtaaccgaagtaaaaggttatacaaaaggtgggccaggacacgaagaaccaataccgatggctacgtatggttggaacttagtaaaactgcactcaggcaaagacgtattctttatacctcccgaaaaatgtgatactctattgtgtgatataggtgaatcaagtccgaatcctactatagaagagggtagaactcttcgtgtcttaaagatggttgagccttggttaagaggtaaccaattctgtatcaaaattctaaatccatatatgccaagtgtagtggaaacgctagaacaaatgcaaagaaaacatggcggcatgcttgtccgcaacccactaagtcgaaacagtacacacgaaatgtactgggtgtcgtgtggaactggtaatattgttagcgcagtcaacatgacttctcgtatgttgttgaataggtttacgatggcccacagaaaaccaacctatgaaagagatgtggacttaggagcaggtactaggcatgtagcagtcgaaccagaagttgcaaatttagacataataggacaaaggatagagaacattaagcatgaacataaaagcacatggcattatgacgaagataatccgtataaaacctgggcctaccatggttcttatgaggtgaaacctagtggatcggcaagtagtatggtgaatggagttgttaaactattaactaaaccttgggacgtaatcccaatggtaacacaaatcgcaatgacagatacaacaccattcggacaacaaagagtgttcaaagaaaaagttgatactcgtacaccaaaagcaaaaaggggaacagcccagataatggaagttacggcaaagtggctatgggggttcctcagcagaaataagaaaccacggatatgtacacgagaagaatttacgagaaaagtacgatctaatgcagcaataggtgcagtgtttgtggacgaaaaccaatggaactcggctaaagaggctgtagaggacgaacgtttctgggacctcgtacaccgagagagggaattacacaagcaaggtaagtgtgcaacttgcgtatacaacatgatgggaaaaagagaaaagaaattaggagaatttggaaaggctaaaggaagtagagctatctggtatatgtggttgggagctcgattccttgaatttgaagctcttggattcatgaacgaggatcactggttcagtagagagaatagcttaagcggtgtggagggggaagggttacataaattaggttatatattaagagacatatccaagatccccggaggaaatatgtatgcagacgacactgctggatgggacactagaattaccgaagatgacttacaaaatgaagctaggattacagataccatggagccagaacacgcattactagcgcgaagtatatttaagctaacctaccaaaataaagtcgtcagagttcagcgtccagccaaaaatggcaccgtaatggatgttataagtaggagagatcagagaggctctggacaagtaggcacatacggtcttaatacgtttacaaacatggaagctcaattaatcagacaaatggaatccgaaggaatatttagtcccagtgaattagagacaccaaatctcgcggaaagggtactagactggttagaaaaatacggggtagaaaggttaaagagaatggctatttctggagatgactgcgtagtaaaacctatagatgatagatttgcaacggctctaacagctctaaacgacatgggcaaggtaagaaaagatataccccaatgggagccgagcaaaggctggaatgattggcaacaagttccattctgctcacaccactttcatcaactaataatgaaggatggtagagagattgttgtaccctgtagaaaccaggacgagttagttgggagggcacgagtctcccaaggcgctggttggtcattgagagaaacagcctgtttgggtaaatcatacgcacagatgtggcagctaatgtatttccatcggcgtgacttaagactggccgcaaatgcgatatgttcggcagtccccgtcgactggataccgacatcgcgtaccacttggtcaattcatgctcaccaccaatggatgacaacagaagatatgttgagtgtatggaatagagtgtggatagaggaaaatccatggatggaagacaaaactcatatatcgagctggggtgacgtcccatatttgggtaaaagggaagatcaatggtgtggaagtcttatcggcctcacagcacgtgctacatgggccacgaatatacaggtagcaatcaaccaagtacgccgtctgataggaaatgagaactatttggattacatgaccagtatgaaaagatttaaaaatgaatctgatcctgaaggcgcgttgtggtag

SEQ ID NO: 21941 - RNA, 9879 nt, synthetic construct
  misc_feature 1..9879: note = derived and/or modified CDS sequence (opt6) from DENV-1__EU482499__SS-prME
  source 1..9879: mol_type = other RNA
tcagtgaccatgctcttgatgctaatgccaaccgctttagcatttcatttgacgaccaggggtggtgaaccacacatgattgtatctaaacaagaaaggggaaaaagcctactgtttaaaacaagcgctggagtaaatatgtgtacactcattgcaatggacctaggtgaattatgtgaggacacaatgacgtataaatgccctagaattacagaaaccgaaccagacgacgttgattgttggtgcaatgcaacggatacctgggtgacttatggtacctgttctcaaactggtgagcaccgaagggataaaagatctgtagcacttgcaccgcatgtaggactagggctagagactagaacagaaacgtggatgtcaagtgagggcgcttggaaacaaatacaaagggtagaaacttgggcattacgccaccctggttttactgtgattgcactttttctggcgcacgcaataggtacgtcaattacccaaaaaggaattatctttatattattaatgctagtgacaccatccatggcaatgcggtgtgtggggattggaagcagagattttgttgaagggttatcaggcgccacctgggtagacgtggttctagagcacggctcatgtgttacaaccatggcaaaagataaaccaacactagacatcgaattattaaaaaccgaggtaacaaacccagctgtattaagaaaattatgcattgaagcaaaaatatcaaatacaacaaccgactcaagatgtccaacccaaggtgaggcaactttggtagaggaacaagatgcaaatttcgtctgcagaagaacctttgttgatcggggatggggtaacggatgcgggctgttcgggaaagggagtcttatcacgtgcgctaaatttaaatgtgtcacaaaattggaaggtaaaatcgtacaatacgaaaatcttaaatacagtgttatcgttacagtgcatactggagatcaacatcaagtcggaaatgaaagcacagaacatggaactacggcgaccataacccctcaagctccgacgactgaaattcaattaactgactacggtgctcttacgttagattgtagcccacgaacagggttagacttcaacgaaatggtgctattgacgatgaaggaaaaatcatggttagttcacaaacaatggtttctagatcttccattgccatggacaagtggtgcatctacaagtcaagaaacatggaatcgccaggacctcttagtaacctttaaaactgcacacgccaagaaacaagaagttgtcgtcttggggagccaagagggggccatgcataccgctctaactggtgcaacagaaattcaaacttcaggaactacaactatatttgccgggcaccttaagtgccggctcaagatggataagctgacactaaaaggaatgtcatatgttatgtgtacaggatcatttaaacttgaaaaagaagtagccgaaacgcaacatggaacagtccttgttcaaattaaatacgaaggaacagatgctccttgtaaaatccctttctccactcaggatgaaaagggcgtaactcagaatggcagattgatcacagcaaacccaatcgttactgataaagagaaaccagttaatatagaggctgaaccaccatttggtgaaagttacatcataataggtgcaggagagaaagcacttaaattatcatggttcaagaaaggaagttctataggcaagatgttcgaggctacggctaggggagcaagacgaatggcaattttaggagatacagcttgggattttggaagcattggtggagtattcacctctgttggcaagttagtgcaccaaatattcggaacagcatacggcgtcctattttctggtgtgagttggacaatgaaaataggcataggagtattactaacgtggctcggattgaatagccgttccacctcactttcaatgacttgtatagctgttggattagtaacactctatttaggcgttatggtacaagcagacagtggatgcgtgataaactggaagggaagagaattgaaatgcgggtcaggaatattcgtaaccaacgaagtacatacttggactgaacagtataaattccaagctgatagcccaaagagactatctgcggctattggaaaagcgtgggaagaaggagtatgtgggatccggtcagcaacaagattagaaaatataatgtggaaacaaataagtaacgaattaaatcacatccttctggaaaacgacatgaaatttacggtagtcgttggagacgtagcaggtatattagcccaaggcaagaaaatgattcgcccacaaccaatggaatacaaatactcgtggaagagttggggcaaagctaagataatcggagcagacgtacaaaacactaccttcataatagatggaccaaatacccccgaatgtccggatgatcaaagagcctggaacatatgggaggtagaggattatggattcggcatattcactactaacatttggctaaaattgagagacagccatacgcaagtttgcgatcatcgactaatgtctgcagcaatcaaagactcgaaagcagtgcatgccgatatgggatactggatcgaatcagagaaaaacgaaacctggaagctagcaagagcttcctttatcgaagttaagacatgcatttggccgaaaagtcatactttatggagcaacggggtcctcgaatcagaaatgatcatcccaaagatctatggtggcccaatctcacaacataactaccgtccaggatattttacacaaaccgcaggtccatggcatctaggtaaattagagttagattttgatctgtgtgagggaaccactgtagttgtcgacgaacactgtgggaatcgaggaccatccttacggacgacgacagtcactggcaaaataatacacgaatggtgttgtaggtcctgcacgctcccgcccttacgtttccgaggggaagatggttgctggtacggtatggaaataagacctgtaaaagaaaaggaagaaaatcttgttaaaagcatggtctcagccgggagtggcgaagttgatagtttttccctagggctattatgtatctctataatgattgaagaagttatgaggagccgatggtcgaggaagatgctaatgacaggtacactagcagtattctttttactcataatgggacagctaacttggaatgatctaattagactatgcatcatggtaggagcaaacgcctcggatcggatggggatgggcacaacctatttagcattaatggctaccttcaaaatgagaccaatgtttgcagtaggattgttatttcgaaggctaacaagccgggaggtgttgctcctaacgatcggcttgtcgctcgttgcttccgtggagctaccaaacagcctagaagaactaggtgacggcttggcgatgggaattatgattctaaaactcctgacagactttcaatcgcaccaactttgggcaacacttctttccttgacgtttataaaaactacctttagtcttcactatgcctggaaaaccatggccatggttttaagcatcgtatctctatttccactgtgtttaagcactactagccagaaaacgacatggttaccagtactactggggagccttggatgtaaaccacttacaatgttcttaattgccgagaataagatctggggtcgaagaagttggcctctgaacgaaggaataatggccgttgggattgtttcaattttacttagttcacttctcaaaaatgatgtaccattagcaggaccattaattgcgggcggaatgttaatcgcatgctatgtaatcagtggatcatccgctgatctaagtttagaaaaggctgcagaagtaagctgggaagaggaagctgaacattctggcgcatcacacaatatattggtagaggtacaagacgatggtacaatgaaaataaaggacgaggaaagagacgacacgctgacaatattattgaaagctacattgcttgcagtaagtggagtttatccgctcagcataccagcaacactatttgtatggtacttttggcagaaaaagaaacaacgatccggtgtactatgggatacgcctagtccaccggaagtagaacgggccgtactcgacgacggcatctatagaataatgcagaggggccttttaggacggagtcaagttggtgtaggcgtgtttcaggaaaacgtatttcataccatgtggcatgtcacaagaggtgcagtcctaatgtaccaagggaaacgcctagaaccatcttgggctagtgtaaagaaagacttgatttcctacggaggaggttggaggttacaaggtagttggaatactggcgaggaagttcaagtgattgcagtggaacccggcaaaaatcccaaaaatgtacaaactgctccgggaacattcaaaacaccagaaggcgaggttggagctatagctctagattttaaaccaggtacatcgggatcaccgattgtaaaccgagagggtaagattgttggactttatgggaatggagtagttacaacaagtggaacttatgtatctgcaattgcacaagcaaaagcatcacaagagggaccactcccagagattgaggatgaggtctttaggaaaagaaacttaacaataatggacttacatccaggctctggaaagaccaggagatatttacccgcaatagtcagagaggcaattaaaaggaaacttagaactttaattctcgctcctacgagagtcgtagcaagcgagatggcagaagcactcaaaggcatgcctatcagataccaaacaacagctgtaaaatcagaacatacaggaaaggaaattgtagatttaatgtgccacgctacttttactatgcgcctactctcgcctgtacgcgtcccaaattataatatgataatcatggatgaagctcacttcacagatccatcttccatagctgcacgagggtacatctcaactcgtgtaggaatgggcgaagcggctgccatttttatgactgcaactcctcccggatctgtagaggcctttccgcaatctaatgccgtgatccaagatgaagaacgggacatacctgaaagatcatggaactcaggatacgagtggataactgatttcccaggaaagactgtatggtttgtaccatccataaaatctggcaacgatattgctaattgtttacgaaagaatggcaaacgagtaatacaactatcaagaaagacatttgatacggaataccagaaaacgaagaataacgattgggattatgtagtaacaacagatatatctgaaatgggagccaattttagggcggacagagtaatagatccaagacgatgccttaaacctgtcatattaaaagatggccctgagcgagtaatacttgcaggaccaatgccagtgacagtcgccagcgctgctcagcgacggggcagaatcggcaggaatcataacaaagagggggaccaatatatatacatgggtcagccattaaataacgacgaagatcacgcacattggacagaagcaaaaatgttactcgacaatattaatacaccggaaggtataataccagcattatttgaacctgaacgagaaaaatctgcggccattgatggagagtaccgtttgcgtggagaagcgagaaagacatttgtagagcttatgcgtcgcggggatttaccagtatggctaagttataaagttgcatcagaaggttttcaatactctgataggcgatggtgttttgacggagagagaaataaccaagtcctggaagaaaatatggatgttgagatatggaccaaggaaggcgaacgcaagaaacttcgtcctcgatggttggatgcacggacatatagtgatccactcgcactacgtgagtttaaggaatttgcagccggaagaaggtctgtctcaggcgatcttatactagaaataggcaaactaccacaacaccttactcaaagagctcaaaatgcgctggacaatctagtcatgttgcacaatagtgaacaaggagggcgagcttaccgacacgctatggaagaattaccagataccattgaaacgctcatgctgttagcattaattgcggtcttaaccgggggcgtaacgctgttctttttatccggaagaggacttgggaagacatctataggcctgttgtgcgtaatggctagcagtgtattgttgtggatggcatcggtagaaccacactggatcgctgcctcaataattctagagttctttttaatggtacttctaattcctgaaccagatcggcaaagaactccacaggacaatcaattagcctacgtggtcataggtctactatttatgatattgacagttgctgcgaacgaaatggggctactcgagacgaccaagaaagaccttggaattggacacgtggcagttgaaaaccatcatcacgccgctatgctagatgtcgacctgcaccctgcttccgcatggactttatatgcggtggctaccaccataatcacacctatgatgagacacactatcgaaaacactacagcaaatatatctcttaccgccattgctaatcaagcagcgatattaatgggtctggataaaggatggcccataagcaaaatggacataggagtacctttactcgcactaggatgctacagtcaagtgaaccccttaacgttaacagcggctgtactaatgctggtagcccactatgcaatcataggtcctggcctccaagcgaaagctacacgagaggctcaaaaacgtaccgccgccggaatcatgaaaaaccctacggtagacggaattgtggcaattgatctcgatccggtagtatatgatgctaaatttgaaaagcaacttggccaaattatgctactaatactttgtacctcccaaatcctactgatgaggactacctgggcgctatgcgaatcaattactcttgcaacaggtcctctcactacattatgggaagggtcaccgggtaaattttggaataccacaatcgccgtatcaatggctaatatatttaggggaagctatctcgcgggtgcgggattagctttttcattaatgaaatcgttaggtggaggacgccgaggaactggcgcacagggagaaacgctaggagaaaaatggaaacgacaactaaaccaactatcgaaatcggagttcaatacttacaagagatcaggtataatggaagtcgatagatcagaggccaaggaaggtctaaagcgcggcgaaactacaaaacatgccgttagccgcggcacggcaaaattgagatggtttgttgaaagaaacttagtaaaacctgaaggcaaagtcatagacctggggtgtggccgcggaggctggagctactactgcgcgggccttaaaaaggtaactgaagtcaaaggatacacgaaagggggaccaggtcacgaagaacccatacctatggcgacgtatggctggaatttggttaaacttcattcaggtaaggatgtattcttcataccaccggaaaagtgtgatacattgctatgcgacataggagaatcatcaccaaatccaacaattgaagaaggtcgcacgctacgagtgttaaagatggttgagccctggctacgtggtaaccaattttgtataaaaatattaaatccctacatgccctcagtagttgagaccttagaacaaatgcaacgaaagcatgggggcatgcttgttagaaacccgttgtctagaaattccacgcatgaaatgtattgggtctcatgcggcaccgggaatattgtaagtgcagtaaatatgaccagtaggatgttgctaaataggttcactatggctcatagaaagcctacttatgagagagatgttgatctaggagccggtaccagacacgtagctgtcgagccagaagtcgccaatttagacattattggccagagaattgagaatatcaaacatgaacataaaagcacatggcactatgatgaagacaacccgtacaaaacttgggcataccatggaagttacgaagtaaagccatcaggatctgctagtagtatggtcaatggggttgtcaaactacttactaaaccttgggatgtaattccaatggtgacgcaaattgccatgacagatacgacaccttttggacaacagcgcgtatttaaagagaaagttgatacaagaacgccgaaagcgaaaagagggactgcccagattatggaagtaaccgcgaaatggttgtggggatttctttcaagaaataagaaaccacgaatctgcacccgggaggagttcacgaggaaagtacgaagtaatgccgccataggggctgtttttgtcgatgagaaccaatggaatagcgcaaaggaagcagttgaagatgaaagattctgggacctagttcacagagaaagagaactgcataaacaaggaaaatgcgcaacatgcgtgtataatatgatgggaaaacgtgaaaagaaattgggggagtttggtaaagccaaaggaagcagagccatatggtacatgtggttaggcgcacgatttttggaatttgaagctctaggattcatgaacgaagaccactggttttcaagggaaaattctcttagcggtgtggagggggagggccttcacaagttgggatacatacttagggatatcagcaaaatcccgggtggtaacatgtatgctgacgacacagctggatgggacacacgaattacagaagatgatctacaaaatgaagctcgaataacagatatcatggaacccgaacatgcattactcgcaaaatccatatttaaactaacttatcagaacaaagttgttagggttcaacgtccagcgaagaacggtacagtaatggacgtgatatcgagacgagatcagcggggcagtggccaagtgggaacatatggccttaatacgttcacaaatatggaagcacaactgataagacaaatggaaagtgaaggcatattttccccatccgaacttgaaacaccgaaccttgctgaaagagtgctagattggttgaaaaagtatggcgtcgagcgcttaaaacgaatggcgatatctggagacgattgtgtagtaaagccaattgatgacagatttgcaactgcattaactgcacttaacgacatgggaaaagtaagaaaagatatacctcaatgggagccatcaaaagggtggaatgactggcagcaagttcctttttgtagtcatcactttcaccaactgataatgaaggatggaagagaaatcgtggttccttgccgcaatcaggacgaattagtcggaagggctagagtcagtcaaggggcaggttggtccttacgcgaaacggcatgtctgggtaagagttatgcacaaatgtggcaattgatgtatttccaccgtagagacctgcgtttagcagcaaatgcaatttgttcagcagtaccagttgactggatacccacctccaggacaacgtggtccatacatgcacatcatcaatggatgacgacggaggatatgttgtcagtatggaatagagtatggatagaagagaacccatggatggaagataaaactcacatctcatcatgggaggatgtaccctatttaggcaaacgagaagatcaatggtgtgggagtttgataggtttaactgcacgtgctacttgggcaacaaatattcaagtagctattaaccaggtccgtagactaataggtaatgaaaactatttggattacatgacaagcatgaagcgatttaaaaacgaaggagatcccgaaggagctctatggtga

SEQ ID NO: 21942 - RNA, 9879 nt, synthetic construct
  misc_feature 1..9879: note = derived and/or modified CDS sequence (opt6) from DENV-1__EU482500__SS-prME
  source 1..9879: mol_type = other RNA
tctgttacgatgttattaatgttaatgcccactgcattagcttttcatttaacaacgcgaggaggggagcctcatatgattgtcagtaaacaagagagaggaaaatccctattatttaaaacttcagcgggtgtcaatatgtgtactctgatagcaatggacttaggagaactctgtgaagatacgatgacttataaatgtccacgtattacagaaacagaaccagatgacgtcgactgttggtgtaatgcaacagatacctgggtaacgtatggaacttgtagtcaaactggcgaacaccgaagagacaaaagatccgtggctttagcacctcatgtgggactagggctggaaacacggacagagacatggatgtcatctgaaggcgcatggaaacaaatccagagagtagaaacatgggcgttacgccatccaggatttactgtcatagcattattcctggctcacgctattggaacaagtatcactcagaaaggaattattttcatactattaatgttggtgacaccaagcatggcaatgagatgtgtcggtatagggtctagagatttcgtagaaggattatcaggtgcaacgtgggtagacgtcgtattagaacacggatcatgtgttactactatggcaaaagacaaacctactctagatattgaactcttaaaaactgaagtcaccaaccccgcagtgctccggaaattatgtatcgaggctaaaataagtaacaccactacggacagtagatgccccacccagggggaagccacactcgtcgaagaacaagatgcaaactttgtgtgtagacgaacatttgtagatcgaggttggggtaatggctgtggactatttgggaaaggttcactaataacgtgcgcaaaattcaaatgtgtaaccaaactagaagggaaaatcgtacaatatgaaaaccttaaatattctgtaatcgtcacagttcacacaggggaccaacatcaagttggaaacgaatcaactgaacatggtactacagcaactatcactccgcaagcgccaaccacagaaatccagttaaccgactacggcgcgcttactctagactgctcacctcggaccggtttagattttaatgagatggtgctattaacaatgaaagaaaaatcatggttagtacacaaacaatggtttcttgacctgcctcttccctggacatcaggggcaagtacttcacaagaaacctggaataggcaagacttgctagttacttttaaaacagctcatgccaagaaacaagaagttgtagttctaggatctcaagaaggagcgatgcatactgcactaacaggggcgacggaaatccaaacgtcaggtacgacaacaatatttgctggacacctgaaatgtagacttaaaatggataaattgaccctgaaaggtatgtcatatgtcatgtgcacaggtagttttaaactagaaaaagaagtagctgagacgcaacatggaactgtactggttcagattaaatatgaagggactgacgcaccatgtaagattccattttccacacaagatgaaaaaggagtgacacaaaacggtaggcttataacggccaacccaatagtaacggacaaagaaaagcctgttaatatagaagccgaaccgccttttggagagtcttatattataataggagctggcgaaaaggcgttgaaactgagttggtttaaaaagggatcctcaatcggaaagatgtttgaggcaaccgcacgcggagccaggcgaatggcgatattaggagatactgcatgggattttggttcaattggtggagtattcacaagtgtaggaaagttggtgcatcaaatatttggaacagcgtacggtgtattattttcaggtgtaagttggacaatgaaaatcgggatcggagttttactcacatggttaggattaaatagtcgaagtaccagtttaagtatgacctgtatagcggttggattagtgacactatatctaggtgtaatggtacaggcagactcaggatgcgtaattaattggaagggcagggaattaaaatgtggaagcggaatttttgtcacaaatgaggtacatacatggacagagcaatataagtttcaagcagattctccgaaaaggctgtcggctgcgataggtaaagcgtgggaggagggggtctgtggaatacgctcggctactcgcctagagaatattatgtggaagcaaatatcaaacgaactaaatcatatcctccttgaaaacgatatgaaattcactgtggtcgtaggagatgtggcgggaatcctcgcacagggcaagaaaatgatcagaccgcaaccaatggaatataagtacagctggaaatcctggggtaaagcaaaaataattggtgcagatgtacaaaataccactttcattatcgacggacccaacactccagaatgccctgatgatcagagagcatggaatatatgggaggtagaagattatggatttggaattttcaccacaaatatctggctcaagctacgcgatagtcatacacaagtgtgtgatcacagacttatgtcagcagcgattaaagattcaaaagcagtccacgcggacatgggttactggatcgaatcagagaaaaacgaaacctggaagttagctcgtgcatcatttattgaggtaaaaacatgcatatggcctaaatcgcataccctgtggtcgaacggagtacttgaatccgagatgataattccgaagatatatggaggaccaatttcgcaacataattacagaccagggtattttacacagactgcaggcccatggcacctaggtaaattggaattagactttgacttatgtgaagggacaacagtagtggttgacgaacactgcggcaataggggtccgagcctaagaacaactaccgtgacaggtaagataatacatgaatggtgttgtcgaagttgtacactaccacctttacgatttagaggagaggacggttgttggtatggcatggaaattcgtcctgtcaaagagaaggaagaaaacttggtaaaatccatggtatcagccggctcaggggaagtagattcattttccttaggcttattatgcatatctattatgatagaggaggtaatgcgaagtagatggagtagaaaaatgctaatgacaggtacacttgctgttttcttccttttaataatgggtcaactgacctggaacgatctaatacgtctatgcattatggtaggtgcaaatgcaagcgacagaatgggaatgggtacaacgtacctagctttaatggccacttttaagatgcgccctatgtttgcagtaggtttattatttcgccgcttgacgtcaagagaagttttactgctaactattggactctctttggtagccagtgttgagttaccaaatagtttagaagagttaggtgacggcctggctatgggtataatgatattgaaattactaaccgacttccaaagccatcagttatgggctacactattatctctcacctttataaaaacaacgttctccttgcactatgcttggaaaacaatggcaatggtactttcaattgttagtttatttccactatgtttatcgacaacaagccagaaaactacatggttgccggtgctactaggaagtttgggatgtaaacccttgacaatgtttttgatcgctgaaaataaaatatggggtcggagatcctggccccttaatgagggaataatggccgtcggtatagtttctattctacttagcagcctactcaaaaatgacgtacctctagctggaccgctgatagcaggcggtatgttaatagcatgttatgtaattagtggtagttcggcggatttgtctttagaaaaagcggcagaagtttcgtgggaagaggaagctgaacattcgggggcttctcataatattctagtggaagtacaagatgatggtactatgaaaatcaaagacgaagaacgtgatgacacacttactatcttactaaaagcgacccttttagcggtatctggcgtatatccattaagcatccccgcgacgctattcgtatggtatttttggcaaaagaagaaacaacgaagtggagtactgtgggatacaccaagtccaccagaagtggaaagagctgtactggacgacggaatatatagaataatgcaaagaggattactcggacgatcacaagtaggagttggcgtatttcaagaaaatgtatttcacacgatgtggcatgttacccgaggtgcggttttaatgtaccaaggaaaaagactagagcctagctgggcttcggtcaagaaagacctgatatcatatggaggcggttggagactgcaaggtagttggaataccggagaagaagtgcaagttatcgcagtagaaccaggcaaaaatccaaagaatgtacaaacagcacctggaaccttcaagacaccagagggagaagtaggcgcaatagcactcgactttaaaccaggaacgagtggatctcctatcgtcaatcgggaaggaaaaatcgttggactttatggaaatggtgtagttactacctcaggaacatatgtttcggctatagcacaggcgaaggccagccaagaaggcccccttccagaaatagaagatgaagtgttcagaaaaagaaatttaacgataatggacttacatcctggatcgggtaaaacaagacgctacttacctgctatcgttcgagaagcaataaagcgaaaattgcggaccttgatacttgcaccgactcgtgtcgtggcttcagagatggcagaggcgctcaaaggtatgccgatcagatatcagactacagctgtaaagagtgaacacactggtaaagaaattgttgacctgatgtgtcacgctacatttactatgcgattactcagtccagtaagggttccaaactataacatgataattatggatgaggcgcacttcaccgaccccagttcaattgccgcccgtggctacataagcaccagagtaggcatgggcgaagcagcagcaatatttatgaccgcaacaccaccaggatctgtagaagcatttccccagagtaacgcagtaatacaagatgaggaacgagatatccctgaaaggagctggaatagcggttacgaatggataactgattttccaggaaaaaccgtatggttcgtgccgagtataaaatcaggaaacgacatagcaaattgtctgaggaaaaacgggaaaagagtaatacaactgtcacgaaaaacattcgatactgaatatcagaaaactaagaataacgattgggattacgtcgttacaaccgatatctctgaaatgggtgctaactttagagctgacagagtaatagatccaagaagatgccttaaaccagtaattcttaaggatggcccagaaagagtaatactggcgggacctatgcctgtcaccgtagcatctgcagcgcaaagaagaggtcgtatcggacgcaatcataataaagaaggagaccagtacatttatatgggacaaccactaaataatgacgaagaccacgcacactggactgaggctaagatgcttttagataatataaatacaccagaagggataattcctgctctcttcgaacctgaaagagaaaaatctgccgccattgatggagaatatagacttagaggagaggcaagaaagacatttgttgagttgatgcggcgaggggatctacctgtatggctaagttataaggttgcaagcgaaggatttcagtacagcgatagaagatggtgttttgacggtgaaagaaataaccaagtcttagaagaaaacatggacgttgagatatggacaaaggagggcgagaggaagaaacttagaccgaggtggctagatgcacgaacgtacagtgaccctttagcattaagagagttcaaagaatttgcagcaggacgaagaagtgtatccggcgacttaatattggaaattggaaaactgccacaacacctaacacaacgagcgcaaaacgctctagacaatctagtgatgttacataatagcgaacaaggaggcagggcgtatagacacgcaatggaggaacttcccgacacaatagaaactctaatgcttttagcattaattgctgtactaacaggtggagtgacactgtttttcctatccggaagaggacttggcaaaacaagcattggcttgttgtgtgtaatggcatcaagtgttctactatggatggcctccgtggagccacattggattgccgcttccataatattggagttctttttaatggtgttgcttatacccgaacctgacagacaacgtacaccacaagacaaccaattagcatatgtcgtaatcggcctattatttatgatacttacagtggccgctaacgagatgggtctattagaaaccacgaagaaagacttaggcataggacatgtcgcagttgagaatcatcaccatgcggcgatgctagatgttgatttacacccggcgagtgcctggactctgtacgctgtcgctaccacgataatcacgccgatgatgcgccacactattgagaatacgacagctaacatctccttgacagcaatagcaaatcaagcggcaattttaatgggattggacaaggggtggccgatttccaaaatggacattggtgtaccgcttctagcactgggatgctactcacaagtaaatccccttaccctcacggcagcagttttgatgcttgtggcacattacgcaataattggacccggtttgcaggctaaagccacgcgtgaggctcaaaagagaactgccgctggaattatgaaaaatcctacagttgacggcatcgttgccatagatttggaccctgtagtctacgacgcaaaatttgagaagcaactcggacagattatgctattaattctttgtacgagtcaaatcctcctaatgcgaacgacttgggccctatgtgaatcaattacacttgctacgggacctctaactacactttgggaaggttccccagggaaattttggaacacgacgattgcggttagtatggcaaatatattcagggggtcttacctcgcgggtgcaggattagcattttcgttaatgaaatccttaggaggaggacgaagaggcaccggagcacaaggagaaactttaggagaaaagtggaagcgacaactaaatcaattatcaaaatcggaatttaacacctataaaagatcgggaataatggaagttgatagaagtgaggcaaaagaaggattaaaacgcggtgaaacgactaagcatgcggtatcccgtgggacagcgaaacttcgttggttcgttgaaagaaacctagtcaaacctgaaggtaaggtcatagatcttggttgtggtagaggtggctggtcgtactactgtgctggcctaaagaaggtgactgaggtaaaaggttatacgaaaggaggacccgggcacgaggaaccaatacccatggcaacttatggttggaacctcgtcaaactccacagtggaaaggatgtctttttcataccaccagaaaaatgcgacacattactatgtgatattggcgaatcgtcaccaaatccgacaattgaagaggggagaacactaagggtattgaaaatggtcgagccatggctaagaggaaatcagttttgtatcaaaatattaaatccttacatgccctctgtagtagaaacactagaacagatgcaaagaaaacatggagggatgctagtgagaaaccctttatcacgaaacagtacacacgaaatgtactgggtgtcatgcggaaccgggaacatcgtgagcgccgtcaatatgacatcaagaatgttgttaaatcggttcacaatggctcatcgtaaaccgacatacgagcgtgacgttgacttgggtgcaggtacgagacatgtcgcggtagagcctgaaatagctaatcttgatattataggacaaagaatagaaaatataaaacatgagcacaagtctacatggcactatgatgaagataacccgtataaaacatgggcatatcatggtagttatgaagtcaaaccatcgggttctgcgtcatcgatggtaaacggagttgtaaaattgttaaccaaaccgtgggacgtaattcccatggtgacacaaatagctatgacagacacaactcctttcggtcaacaaagagtctttaaagaaaaggtggacactaggacacccaaagctaagaggggaacggcacagataatggaggtgacagccaagtggttatgggggttcttgtctcgtaataaaaagcctcggatatgtactagggaagaatttacgaggaaagtaagaagcaatgcggctattggtgcggtatttgttgatgaaaatcaatggaatagcgctaaagaagcagtggaagacgagcgtttttgggatcttgtccatcgtgaaagggagctgcacaagcaagggaaatgcgcaacttgtgtttacaatatgatgggtaaacgagaaaagaaattaggagagtttgggaaagccaaaggttctcgtgcaatttggtatatgtggttaggagcccgattcctcgaatttgaagcattaggatttatgaacgaagaccattggtttagtagagaaaatagcttgagtggagttgagggggaaggtttgcacaaattaggatatattctacgagacatatctaagatacctggaggaaacatgtacgcagatgacaccgccggctgggacactagaatcactgaagacgacctacaaaacgaagcacgaataactgatattatggaagccgaacacgcattactagccaaatcaatatttaagttaacttaccagaacaaagtggtgcgagtacagcgccccgctaaaaatgggacagtaatggacgtaataagtagaagagatcaaagaggctcgggccaagttggaacttatggtctaaatacctttactaacatggaggctcaattaattagacaaatggagagtgaaggtatattcagtccaagtgagctcgaaacgcccaatctcgctgaaagagttttagattggttagaaaaatacggagtagaacgactcaaaaggatggcgatctcgggggatgattgtgtcgttaaaccgatagacgaccgctttgctaccgccctaacagctttgaatgacatgggtaaagtacggaaagatataccacaatgggagccaagtaaaggttggaacgattggcaacaggtccctttctgcagtcatcacttccaccaattaataatgaaagatgggcgagaaatagtagttccttgtcggaaccaagacgaattagtcgggcgagcaagagtatctcagggggcaggatggtcgcttagggagactgcatgcttaggtaaatcctacgctcagatgtggcaattaatgtactttcacagaagggaccttagattagcagcaaatgccatttgttcagctgtcccggttgactggattccaaccagcagaactacgtggtctatacatgctcatcatcaatggatgacgacagaagacatgctaagtgtatggaatagagtgtggatagaagaaaatccttggatggaagacaaaacacatataagttcttggggtgacgtaccatatctgggaaaacgggaagaccagtggtgcggaagcctcataggactcacagctagagctacgtgggctactaatatacaggtagcaataaatcaggtccggagacttataggaaatgaaaattatctggattacatgacctcaatgaagagattcaagaatgagggtgaccccgaaggagcactgtggtaa

SEQ ID NO: 21943 - RNA, 9879 nt, synthetic construct
  misc_feature 1..9879: note = derived and/or modified CDS sequence (opt6) from DENV-1__EU482501__SS-prME
  source 1..9879: mol_type = other RNA
tcagtaacaatgctattaatgcttatgcccacagctcttgcgtttcatctaactacacgtggtggagaaccacatatgatagtttcaaaacaggaaagaggaaaaagcctgttatttaaaacaagtgctggtgtaaatatgtgcactctaatcgcgatggatctaggagaactttgcgaagacacaatgacatacaaatgccctcgcataacggaaacggaaccggacgatgtagattgttggtgcaacgctacagatacgtgggtaacgtatggtacatgttcacaaacgggtgaacatcggcgtgacaaaaggtcggtcgcattagcccctcatgttgggctaggattagaaacacgtacagaaacatggatgtctagcgaaggagcttggaaacaaatccagagagtcgaaacatgggcacttcggcatccagggtttacagtaatcgcactatttctagcacatgcaataggcacaagtattactcaaaaaggaatcatattcatcctactaatgctagtgaccccaagtatggccatgagatgtgtcggaatagggtcaagagactttgtagagggtttgtcaggtgctacctgggtagatgtagttttagaacatggtagttgtgtaacaacgatggcaaaagacaaacctacactcgacatagaattgcttaaaacagaggttacgaacccagcagtcttaaggaaattatgtatagaggccaaaatatctaatacaacaactgattcacgatgtccaacgcaaggtgaagcaaccttagtagaagaacaagatgcaaattttgtctgccggcgaacatttgttgatagaggatggggaaatggctgtggtctatttgggaaaggctccctgattacttgtgctaaattcaaatgtgttacgaaactagaagggaaaatagtacagtacgaaaaccttaaatactcggttatagtaaccgttcacacaggcgatcaacatcaagttggaaacgagtcaacagagcatggaactaccgctacaataacaccccaagcacccacaacagaaatccaattaacagattatggggcactaacactagattgctcacctcgaacaggactagatttcaacgaaatggtcctgttgacaatgaaagagaaaagttggctggttcacaaacagtggttcctagatctgccattaccatggacgagtggtgcatccacgtctcaagaaacatggaaccgacaggatctcctagttacttttaaaacagcgcacgctaagaaacaggaagtcgttgtattggggagtcaagaaggagctatgcatacagcactaacaggagcaacggaaatacaaacatccggaacaacaactatatttgcagggcatttaaaatgcaggttaaaaatggataagctaacactaaaggggatgtcctacgtgatgtgtacgggaagttttaaactcgagaaagaagtggctgaaacacaacacgggacggtattagtccaaatcaaatacgagggaactgatgcaccctgcaaaatcccgttttctacacaggacgagaaaggggtaactcaaaatgggaggctcataacagcgaatccgattgtgacggataaagaaaaaccagtaaatatagaagcggagccaccctttggagaatcttatatcgtcattggagcaggagaaaaagccttaaaactttcgtggttcaagaagggaagttctattgggaaaatgttcgaagcaaccgcaagaggggcaaggcgaatggcgatattgggagataccgcctgggatttcggatcaataggaggcgtattcaccagcgtaggaaaattggtacaccaaatattcggaacggcctatggtgtactattttcaggtgtctcgtggacgatgaaaatcggaataggtgttctattaacgtggctaggactaaatagtcgaagcacgtcgctatctatgacctgtattgctgtgggattggtaacattatatttaggagtaatggtacaagctgactcaggatgcgtgataaactggaaaggtagggaacttaaatgcggctctggcatattcgttacaaacgaagtacatacctggacagagcaatacaaattccaggcggatagtcccaaacgcttgtctgcagcaataggtaaagcatgggaagaaggagtatgtggtattagatcagcaacaaggcttgagaatataatgtggaaacaaatttcaaacgaattaaaccatatattgctcgaaaacgacatgaaattcacggttgtagtcggggatgtagctggtatactagctcaaggcaagaaaatgattcgaccacagccaatggagtataaatacagttggaaaagttggggtaaagcgaagataataggtgccgacgtgcaaaacaccacgttcatcatagatggaccaaatactccagaatgtccagatgatcagcgagcatggaacatatgggaagttgaagactacggatttggaatttttactacgaatatttggctgaaattgagagatagttatacccaagtatgtgatcataggttaatgtcggcagcaataaaagattccaaggcggtacacgcggacatgggctattggatagaatcagaaaagaacgaaacgtggaagctagctcgagcgagttttatagaagtaaaaacatgcatatggccgaaatcacatacgttgtggtcgaatggagtcctggagagtgagatgatcattccgaaaatttacggaggccccatctcacagcacaattataggccagggtattttacccagacagcaggcccatggcatcttggaaaacttgaactagactttgatctttgcgagggcacgacggtagtagttgacgaacactgtggtaatcgaggaccttcgctaagaacgacaacagtaacaggaaagataatacatgaatggtgctgcagaagttgcactcttccgccattgaggtttcgaggtgaggacggatgttggtatggaatggagatcagaccagttaaagaaaaggaggaaaacttagtgaaaagtatggttagcgcagggtcgggcgaagtagattccttctcgctgggattattgtgcatatccataatgatagaggaagtaatgcgaagtaggtggtctaggaagatgttaatgaccgggactttagcggtgttctttttacttattatgggccaactaacatggaatgatctaatccggctctgtattatggttggtgcgaatgctagcgacagaatggggatgggaaccacatatcttgctttaatggcaacttttaaaatgaggccgatgtttgcagtcggacttctttttcgtcgcctaacctctcgtgaagtgttgctgcttacgataggcctatctttagttgcaagcgtcgaattacccaattcattagaagaacttggggatggcctggcaatgggtataatgatcctaaaactgttgactgattttcaatcacatcaattatgggcaactttgcttagcctaacttttatcaagacaacattctcgttacattatgcctggaaaactatggcgatggttttatcaatagtatcactatttccattatgcttatcaacgacttctcagaaaactacttggctccctgtgcttctgggaagtcttggttgtaaaccgctaacgatgtttctaattgccgaaaacaaaatatggggaagacgaagttggccattaaatgaaggaataatggccgtaggaatcgtaagtattcttctgtccagcctgcttaagaatgatgtgccgttagcaggaccgctgattgcaggcgggatgctgattgcatgctacgtcatatccggtagctctgcagacctaagtctagaaaaagccgcagaagtctcatgggaggaggaagctgaacattctggagcttcgcataacatcttagtagaggtgcaagacgatggtacaatgaagataaaagatgaggagagagacgatacattaacaatactacttaaggcaacattattagcagtatctggagtctatcctctgtcaattcctgcaaccctatttgtatggtacttttggcagaagaagaaacagcgatccggtgtattatgggacacacccagtcccccggaagtaggcagagcagtcttagacgatggtatttaccgcataatgcaaagaggtctacttggaagaagtcaggtaggggtcggtgtctttcaagagaacgtttttcatacgatgtggcatgtcactcgaggtgctgtcctaatgtaccagggtaagagacttgaaccatcttgggcgagtgttaagaaagatctaataagctacggagggggatggagactacaaggctcatggaacaccggagaagaagtacaagttatagccgtggaacctggcaaaaaccctaaaaacgtgcagacagcaccaggaacctttaagactccagaaggtgaggttggagcaattgcactggactttaagcccggaacatctggaagtccaattgttaatagagagggcaagatagtgggtctatacggaaatggagtagttacgacaagtgggacatacgtttcagcaatcgcacaggcgaaggcttcccaagaaggacccctcccagaaatagaagatgaagtatttagaaaacgaaatctcacaatcatggacctacatccaggaagtggaaaaacccgcagatatttacctgcaatagttcgagaagcgataaaacgtaaattgagaacactcattttggcacccacgagagtagtagcatccgagatggcagaagcgctaaaggggatgccaattagatatcaaacaacagctgttaaatcggaacacaccggaaaagaaattgtggatctcatgtgccacgcgacatttacgatgcgcttactgtctcctgtaagagtcccaaactataatatgattattatggacgaggctcattttacagacccctcttccattgcggcacggggatatatctcaacaagggttggcatgggtgaagctgcagcaatctttatgactgctacaccacccggatcagtagaggcttttcctcaaagcaacgcagtgatacaagatgaagagagggacataccagaacgtagttggaactcagggtatgaatggataacagactttcccgggaaaacagtttggtttgtaccgagtataaaatcaggcaatgacatagcaaattgcttaaggaaaaatgggaaacgtgtgatccagttaagtcgaaaaacatttgatacagaatatcagaaaactaaaaataacgactgggattatgtagtaaccacagatattagcgaaatgggcgcaaactttcgggcggaccgagtgatagatccgcgtagatgtttgaaaccagttatactaaaagatggacccgaaagggtgattctagctggtcccatgccagtgaccgtagcaagcgcagctcaacgcagaggtcgaattgggaggaaccataacaaagaaggcgaccaatatatttatatgggccaacctctaaataacgacgaagaccatgctcattggaccgaagcaaaaatgctattagataacataaacacacctgagggaataattccagctcttttcgaaccagagcgagagaaatccgccgccatagatggtgaataccgtttgcgaggagaggctcgcaagacattcgtagaactcatgaggaggggagatctaccagtatggctttcgtataaagtggctagcgaaggattccaatactcagacagaaggtggtgtttcgatggagaacgtaataatcaagtacttgaagagaatatggacgtcgaaatttggacgaaggagggagaaagaaagaaacttagaccccggtggttagatgcacgaacatattctgacccattagcacttcgagaatttaaggaatttgctgccggaaggcgcagtgtttctggtgacctgatcttagaaattggtaaattacctcaacatttgactcagagggcacaaaatgctctcgataacctagttatgttacataatagtgaacagggcggcagggcgtatcgacatgcaatggaagaacttcctgacacaatcgaaacattaatgctcttagcgttgattgcagttctgactggaggcgtaactctattcttcctttctggaagaggcttgggaaaaacatcgattggtcttttatgcgttatggcatcctcagtcctattgtggatggcttctgtcgaaccgcattggatcgcagctagcatcatactagaatttttcctcatggtacttttgatcccagagccagatcgtcaaagaaccccacaagacaatcagcttgcctacgtcgtaatcggactactcttcatgatcttaacagtagcagcaaatgaaatgggcttacttgaaacaacaaagaaggacttaggaatcgggcacgtggcagtagagaaccaccatcatgccgctatgttagacgtagatctacaccctgcgtcagcttggacgttatatgccgttgcaactactattataacacctatgatgcgtcacaccatcgagaatactacagcaaacatatctctcacagcgatcgctaatcaagccgctatattaatgggactggacaaagggtggcccattagcaaaatggacattggcgtcccattgttagcgctgggctgttattcccaagtaaaccccttaactttaactgcagccgtccttatgctagtagctcactacgcaataattgggcccggtttacaagcaaaagcaacaagggaggctcagaaacgaacagcggccggaattatgaagaatcccacagttgatggaatagtggcgatagatttagaccccgtagtctatgatgctaaatttgagaaacagttaggtcaaattatgctactgatactatgtacctcgcaaattctattaatgagaacaacgtgggctctatgtgaatcaattacgctcgccacaggaccactcacgacactttgggaaggatcacccggaaaattctggaatactacgatagccgtttctatggccaacatatttcgcggttcatatttagcgggagctggattagcctttagtcttatgaaatcactcggaggaggcagaagaggaacgggagcccaaggagaaacgttaggtgaaaaatggaaacggcaattgaatcaacttagcaaatcggagtttaacacttataagcgttcaggtatcatggaagttgatagatcagaagccaaagaaggcttgaagagaggggagacaactaagcatgctgtatccaggggtacggctaaacttcgatggttcgttgaaaggaatctagttaagccggagggaaaagtaatcgatctaggatgcggaaggggagggtggagttattactgtgccggcctaaagaaagttaccgaggtcaaagggtatacaaaaggtggacccgggcacgaggagccaatcccaatggcaacatatggttggaacctcgttaaattacactcgggcaaggacgttttctttattccgccggaaaaatgtgataccctattatgtgatattggcgaaagttcacctaatccgacaattgaagaaggaagaacactaagagtactcaaaatggtagagccatggcttaggggaaatcagttttgcatcaaaattttaaacccttatatgccttcagtggtagagacattggagcaaatgcaacggaagcatggtggtatgttagtccgaaatcctttgtcacgaaattcgacacatgaaatgtattgggtttcgtgtggtactggaaatatcgtaagtgcggttaacatgacaagcaggatgcttctaaatagatttacaatggcacacagaaaaccgacatacgagcgagatgtcgaccttggcgcgggaactagacacgtggcggtagaaccagaggtagccaatctagacataataggccagcggatcgaaaatatcaaacacgaacacaagagtacatggcactatgatgaagacaacccatacaaaacctgggcctaccatgggtcttatgaggtaaaacctagcggatctgcaagttcaatggtgaatggagtggtaaaattgttaactaaaccctgggatgtaataccaatggtaacacaaattgcgatgacagatacaactccattcgggcaacaacgcgtgttcaaagaaaaagtagatacacgcacaccaaaagctaaaaggggaacagcacagataatggaagtaacagcaaaatggctctggggattcctatcacgaaacaagaaaccacgaatatgtaccagagaggaatttacacgtaaggtaagatccaacgcagcaataggagccgtatttgttgacgaaaatcaatggaatagtgcaaaggaagcagttgaagatgaacggttttgggatctagtccatcgcgaaagagaactacacaaacagggcaaatgcgcaacgtgtgtctacaatatgatgggtaaaagggaaaagaaactaggagaatttgggaaggctaaaggaagtagagcaatttggtatatgtggctgggagccaggtttcttgaatttgaggctttgggtttcatgaacgaagaccattggttcagtagagaaaactccctatctggagttgaaggagaaggactccataaacttgggtacatactacgcgatatctcaaagattcctggcggtaacatgtacgcagatgatactgcaggttgggacacccgaataacggaagatgacctacaaaacgaagcaagaataacggatataatggaaccggaacacgcattactggctaagagcatctttaaattaacttatcagaacaaagtagtgcgcgttcaacgacctgccaaaaatggtacggtgatggatgtaataagtagacgcgatcagagaggttctggtcaggtaggaacatacggattaaacacgtttactaatatggaagcgcaacttataagacagatggagtcagaaggcatatttagtccgagcgagctagagaccccaaatttagcagagcgagttctagactggcttgagaagtacggtgtagagcgtttaaagcgtatggccattagcggagatgattgtgtggtaaaaccgattgatgatcgatttgcaaccgcattaacagctttaaatgatatggggaaagttaggaaggacatccctcaatgggagccatcaaagggatggaacgactggcaacaagtacctttttgtagccatcacttccatcaattgataatgaaagatggtcgtgaaattgttgtaccatgtagaaatcaagatgagctagtaggcagagctagggttagccaaggagcgggatggtctctaagggaaacagcatgcttgggaaaatcatacgcacagatgtggcaactgatgtattttcataggagagacctccgattagccgccaacgccatttgttctgcagtaccagtcgactggattccaacgtctcgtacaacttggtcaattcacgcccaccaccaatggatgacaaccgaagacatgctatcagtctggaaccgcgtttggattgaagaaaatccttggatggaagacaagacacatatatcatcatggggagacgtaccctatttagggaagcgagaagaccaatggtgtggttcgctaatcggattgactgctcgagctacatgggcaacaaacattcaagtagcaataaaccaagtacgaagattaataggcaatgaaaattacctggattacatgacatcaatgaaaagattcaaaaatgagagcgatccagaaggagccctatggtaa

SEQ ID NO: 21944 - RNA, 9879 nt, synthetic construct
  misc_feature 1..9879: note = derived and/or modified CDS sequence (opt6) from DENV-1__EU482504__SS-prME
  source 1..9879: mol_type = other RNA
agtgtaaccatgttattaatgttgatgcccacagctttggcttttcacttaacaacccgtgggggagaaccacacatgattgtgtccaaacaagaacggggcaaaagtttactgtttaaaacttcagccggtgttaacatgtgcactttaatagcaatggacttaggcgaactttgcgaagatactatgacttataaatgccccagaatcactgaaacagaaccagacgatgttgactgctggtgcaatgctacggatacttgggttacatatggtacgtgttcgcaaacaggcgagcacaggagagataaaagatcagtcgcattagcaccacacgtcggattgggacttgaaacacgcacagaaacatggatgtcatcggaaggcgcctggaagcaaatacaaagagttgagacatgggctctacgacacccaggctttacggtaatcgcactttttcttgcacatgctatcggtacctctattacccaaaaaggcataatctttatccttctaatgttagtcacacctagcatggcaatgcgttgcgttggaatcggttctagggattttgtagaaggactatctggagcaacatgggtcgatgttgtattagaacatggctcttgtgtaacaacaatggctaaagataaaccgacgttagacattgaacttctaaaaacggaagtaacaaacccagctgtattaagaaaactttgtatagaggcgaaaatatcgaacacaacaaccgattcacgctgcccgacacaaggagaagcaacgttggtggaagaacaagatgcgaactttgtatgtcgacgtacctttgtagaccgaggatggggtaatggatgtggcttatttggaaaaggctcactaattacctgtgcaaagttcaaatgtgtaacaaaactggaaggcaaaatcgtacaatatgaaaatctaaaatattctgtcatagtaacagtacatactggagatcaacaccaagtgggcaatgagagcactgaacatgggacaacagctacaattacaccacaagcaccgacaacagaaatccaattaacagattatggcgctctaaccctagattgttctccccgaactggtttagactttaacgaaatggtacttttgacaatgaaagagaaatcctggctagtacataaacaatggttcttggaccttccattgccatggacaagcggcgcttcaacatcacaggaaacttggaaccggcaggacctattagtaacttttaaaaccgcacatgccaagaaacaagaagtagtagttcttggatcacaagaaggggctatgcacacagccctaacaggtgcaaccgagatacagacatccggcacaaccacaatctttgccggtcatctcaaatgcagactgaaaatggacaagctaacacttaaaggaatgtcgtacgttatgtgtacaggcagttttaaattggaaaaagaagtcgcagaaacacaacatggtacagtattagtacaaataaaatacgaaggaacagatgccccatgtaaaataccgttttctactcaggacgagaaaggtgtaacacaaaacggacgtttaattactgcaaacccaatagtaaccgataaagaaaaacctgtaaacatagaggctgaaccaccattcggcgaatcgtatatagtgattggtgccggagaaaaggctttaaaactttcgtggttcaaaaagggatctagtattggaaaaatgttcgaggcgactgcccgtggagcacggaggatggcgatactaggtgacactgcatgggactttggttcaataggaggagtgtttacgtcggtcggaaagctagtgcaccaaatttttggaaccgcctatggagttctattttctggagtctcttggacgatgaaaataggcattggagtacttctcacatggttaggattgaatagcagatccacatccttatctatgacatgtatagcggtaggtcttgtcacattgtatctcggtgtcatggtacaggcggatagcgggtgtgtgataaattggaaaggacgagaattaaagtgtgggagtgggatctttgtgacgaatgaagtacatacatggacagaacaatataaattccaagctgattcgccaaaaaggttgtccgctgctataggaaaagcctgggaagagggcgtatgtggaataagatcagccacacgtctagaaaatattatgtggaagcaaatctcaaatgaattaaatcacattttacttgaaaatgacatgaaatttacagtcgtagtaggggatgtcgctggaattttagcccaaggcaagaaaatgatccgacctcaaccgatggaatataaatactcgtggaagtcatggggaaaagcaaaaataataggagcagatgttcaaaacaccacttttataatagatggacctaacaccccagaatgcccagatgaccaaagggcgtggaatatttgggaagtagaagattatggctttgggatctttaccacaaacatatggctaaaacttcgtgattcttatactcaagtatgtgatcaccgtctcatgtcagcagcaattaaagacagtaaggcagtacatgcagacatggggtattggattgaatccgagaaaaatgaaacgtggaaactcgctagagcttccttcattgaggtgaaaacttgtatctggccgaaatcacatactctatggtctaatggggtgttagaaagtgagatgataatacctaaaatatatggaggtccaatatcgcaacataattaccgaccgggatacttcacacagacggcaggtccgtggcacttgggaaaactagaattagattttgatttatgtgaagggacgaccgtagtagttgacgagcattgcggtaatcgtggacctagcctcagaacaacaacggtaacaggaaaaatcattcatgaatggtgctgtcggagctgcacattaccaccattaaggttcagaggggaagacgggtgctggtatgggatggaaattaggcccgttaaagaaaaagaagaaaacttggtaaaaagtatggtatctgccggcagtggagaggtggatagtttttcgttaggccttctctgtatcagcattatgatagaagaggtgatgcgttccagatggtccagaaagatgcttatgactggtactttggctgtcttctttcttttaataatgggacagttaacttggaatgatcttataaggctttgtataatggtaggagcgaatgcaagtgatagaatgggcatggggactacatatttagcgttaatggctacatttaaaatgcgacctatgttcgcagttggactcttgttccgtcgtctaacaagtcgcgaggtcttgttgctaaccatcggcctgtcgctcgtggcttcagttgaattacccaatagtctggaggagctcggggatggactggctatgggcataatgattttaaaattactaaccgattttcagagccatcagctgtgggtaaccttgctatcattgacgttcattaagacaaccttctcactacactatgcgtggaagacaatggctatggtattgtccatagtatcgttgttcccactttgcctgtcaactacaagccaaaagacgacgtggcttccggtattactaggctcactaggatgcaagcctttaacaatgttccttatagcagaaaataaaatttggggacgtcgttcctggccgttaaatgaagggattatggctgttggcattgtttcgatcttgctatcaagcctcctcaaaaatgatgtcccacttgcgggtcccttaattgctggtggaatgctaattgcatgctatgtaataagtggatcttcagcagacctttccttagaaaaagcggcagaagtatcttgggaagaagaagcagaacacagcggagcatctcataacatcttggtggaagttcaggatgatggcaccatgaaaattaaggacgaagaacgagatgacaccttaacgatacttttaaaggcgacattgttagccgtttcaggtgtttacccgttatccataccggccacactctttgtctggtatttttggcagaaaaagaaacaacgatctggagtactttgggacactcctagcccacctgaggtggaaagggcagtactagatgatggaatatatcgaattatgcaaagaggcttattagggaggagtcaggtcggagtaggtgtgttccaggaaaatgtttttcatacaatgtggcacgtcacccgaggggctgtacttatgtaccaaggaaaaagacttgaaccatcctgggcaagcgttaagaaagatctcatatcgtatggtgggggttggcgactacagggctcatggaacacaggggaagaagtacaagtgattgccgtagaacccggtaaaaaccctaaaaatgtccaaaccgcacctggtacttttaaaaccccagaaggtgaagtgggagcaatcgctttggactttaagccgggaacatcgggatcgccaatcgtcaatcgtgaaggaaaaattgtaggcttatatggaaatggcgttgtcacgacatcaggtacatacgtatcggcaatagcgcaagccaaggcttcccaggaaggaccgcttccagaaatagaagatgaagtctttcgcaagcgcaacttaactataatggacctccatcccggaagcggtaaaacccgacggtatctcccggccattgttagagaagcaataaaaagaaaacttaggaccttaatactagctcctacgagagtagtagcttcagaaatggccgaggcgctaaagggcatgcccatcaggtatcaaacaacagcggtaaaatcagaacacacgggtaaggagatagtagaccttatgtgtcacgcaacttttactatgcgtttgttatccccggtccgagttcctaactacaacatgattataatggatgaagcgcatttcacagatccctctagtatagcagcacggggctacatctcaacgagggtaggtatgggtgaagctgctgctatttttatgacagcgactccacccggttctgtagaggcttttccccagtcaaatgctgtcatacaggatgaagaacgagatataccagaaagatcatggaactctggatatgagtggataaccgactttcctggtaaaacggtatggtttgtcccatcaattaagagcggtaacgatatagcaaattgtctgcggaaaaatggaaagagggttatccaattgtcaagaaaaacttttgatactgaatatcagaaaactaaaaacaacgattgggattatgtagtaacaacagatatatctgaaatgggggcgaactttagggccgatcgagttatagaccccagacgttgtctaaaaccggtaatcttaaaagacggacctgaacgagtaattttggctggtccaatgccagttactgtagcttcagcagcacaacgaagaggtagaataggaagaaatcacaataaagaaggagaccaatatatctatatgggacaaccactcaataatgacgaagatcatgcgcattggacagaagcaaaaatgctcttagataatatcaacactccagagggaataataccagcattatttgagccagagagagaaaagtctgctgcaatagatggggagtacagattgcgaggtgaagcacgtaagacattcgtggaactaatgaggagaggcgacttaccagtgtggttatcatacaaagtagcatcggaagggtttcaatatagcgacagaagatggtgctttgacggggaaagaaacaatcaggtgttagaagaaaacatggacgttgagatatggacaaaagaaggcgaaaggaagaaattacggccgagatggctagatgctaggacttactctgacccacttgcgttaagagaatttaaggagttcgcggccggaagaagaagtgttagcggggacctgatttccgagataggtaaactccctcaacacttaacgcaaagagcccaaaacgcactagataacctagtaatgctacataactcagaacaaggtggacgagcatatcgccacgcaatggaagaacttccggatactattgaaacactcatgcttttagcactgatagcagtactgaccggaggagtcacattattctttctatcaggtcgtggactgggaaaaacaagtatcgggttactctgcgtcatggcaagtagtgttttactatggatggcgagcgttgaaccacactggatagctgctagtataatattagagttctttctcatggttttactcattcccgaacctgatcgtcaacggacaccgcaagataaccaactggcttacgtagtaatcggcttattgttcatgatcttaacagtcgcagcgaacgaaatgggactattagagacaacgaagaaagacttaggcattggacatgtggcagtagaaaatcaccatcacgctgcaatgttagacgtagatttacatccagcgtcggcatggaccttatatgctgttgccacaactataataacacctatgatgagacatactatcgaaaacaccacagcaaatatatcgctgactgctattgcaaatcaggctgctatattaatgggcctagacaaaggttggcccatcagcaaaatggatattggagttcctctattagcactagggtgttattcacaagtgaaccctctaacactaacggcggcagtgcttatgttagtagcccattacgcaataataggccctggactacaagctaaagcaactcgtgaagcccagaaaagaacagccgcaggaatcatgaaaaatccaactgttgacggcatagttgccatcgatctagatcctgtcgtatatgatgctaaattcgaaaagcaactaggccaaataatgctattaatattgtgtacgtcccaaatacttttaatgaggacgacttgggcgctgtgtgaaagcattaccctggcgacaggacctctaacgactttatgggagggctcaccgggaaaattctggaatacaacgattgcagtcagtatggccaacatctttcgtggcagctacctcgcaggagctgggctagcattctccttgatgaagtcattaggtgggggaagaagaggtacaggcgctcaaggagaaacattaggagagaaatggaagcggcaattgaaccagcttagtaaaagcgagtttaacacatacaagcgctcaggaattatggaagtagaccgtagtgaagcaaaggagggattaaagagaggtgaaaccacgaaacatgcagtaagccgaggtacggcaaaactaagatggtttgtcgaaaggaacttagtcaagccagaaggaaaggtaatagatttaggttgtggtagaggaggatggtcatactactgtgcggggctaaagaaagtcacagaagtaaaaggatacacaaaaggaggtccaggacatgaagaaccgattccaatggctacttatggctggaacttagtaaaactccattcaggtaaagacgttttctttataccaccggaaaaatgtgatactttattgtgtgatattggtgaatcatcacccaatcctactattgaagaaggtcggacacttagggtgctcaaaatggtagagccgtggcttaggggaaaccaattctgcattaagatacttaatccctatatgccaagcgtagtagaaactctagaacaaatgcagagaaagcatggcggcatgttagtgagaaatcccctctcacgaaatagtacgcatgagatgtattgggttagttgcgggacgggaaacattgtatctgccgtaaatatgacatcaagaatgctgctcaaccgcttcacaatggcacatcgtaaaccaacctatgaaagagatgtagacctgggtgccggaacccgacacgtagccgtcgaaccagaagttgcgaacttagatataataggacagaggatcgaaaacattaaacacgagcacaaatccacgtggcattatgatgaagataatccatacaagacgtgggcatatcacggaagctatgaagtcaaacctagtggtagcgcatctagtatggtcaatggcgttgtcaaacttcttacgaagccttgggatgtaatccccatggtgactcaaatagccatgaccgatacaaccccttttggacaacagcgggtttttaaagagaaggtagatacaagaacgccaaaggctaaaaggggaacagcccagatcatggaagtaacggcaaaatggttatggggtttcttgtctcgtaacaagaaaccgagaatatgtacgagagaggaatttacacgcaaggttagatcaaatgctgcgatcggagcagtattcgttgatgaaaatcagtggaacagcgcaaaagaagctgttgaagacgaaaggttttgggatttggttcaccgagagagagagctacacaaacaggggaaatgcgcgacttgcgtatataacatgatgggaaaacgcgagaagaaactaggtgaatttggaaaagctaaaggttcaagggctatctggtatatgtggttgggagccagatttttggaatttgaggctttaggttttatgaatgaagatcattggtttagtcgtgaaaatagtttgtcgggtgtggaaggtgaaggactacacaagttaggatatattctaagggatatttctaagattcccggcggaaacatgtatgctgatgacacggcaggatgggatacacgcatcactgaggacgatttacagaatgaagcaagaataacagacataatggaacctgaacatgccttacttgcaaaatcgattttcaaactgacgtatcagaataaagtggtgcgagtacaacgtcctgcaaagaatgggacagtgatggatgtcatctctagaagagaccaacgaggttcgggtcaagtaggaacatatggtctaaatacatttactaatatggaagctcaactgataagacaaatggaaagcgaaggaatattttcaccatctgaattagaaacacctaaccttgcagagagagttctagactggctggagaaatatggtatagaaagactgaaacgcatggcaataagtggtgacgattgcgtagtgaagccaatagatgacaggtttgccacggctctgacggctcttaatgatatgggtaaagtacgtaaagatataccgcaatgggaaccctcgaaagggtggaatgactggcaacaggttccattttgttctcaccattttcaccaattgatcatgaaagatggtagagaaattgttgtaccatgtcgtaatcaagatgaacttgtgggccgtgcaagagtttcacagggtgcgggatggagtttacgggaaacagcgtgtctggggaaaagttatgcacaaatgtggcaactaatgtattttcatagaagagaccttcgacttgcagcaaatgcaatatgtagtgcagtgccagtagactggatacctacaagcagaacaacatggtcaatacatgcacaccatcaatggatgacaaccgaagacatgttgtccgtatggaacagagtttggattgaggaaaacccatggatggaagacaaaacacacatatctagttggggcgacgtaccatatttaggcaaacgtgaagatcaatggtgtgggagtctgataggtcttacagccagagcaacttgggcgacaaacattcaagtagcaataaatcaagtccgtcgtctaataggaaacgaaaattacttagactatatgacaagtatgaaacgattcaagaacgagtcagatcccgaaggagcactttggtaa

SEQ ID NO: 21945 - RNA, 9879 nt, synthetic construct
  misc_feature 1..9879: note = derived and/or modified CDS sequence (opt6) from DENV-1__EU482505__SS-prME
  source 1..9879: mol_type = other RNA
tccgtgactatgttactaatgctaatgccaacagcattagcattccatcttacaacccgaggtggagaacctcatatgatagtgtccaaacaagaacgagggaaaagtctgctattcaaaacgtccgcaggagttaacatgtgcacactcattgctatggatttaggggaattttgcgaagacactatgacatacaaatgtccaagaataacagaagcagaacccgacgatgtcgactgctggtgtaatgcaaccgatacttgggtaacgtatggcacctgtagccaaacaggcgaacataggcgagacaaacgatcagttgctctggcgccgcatgtcggacttggattagaaactagaactgaaacctggatgtcaagtgaaggagcatggaaacaaatacaaagggtagaaacatgggccttaagacacccagggttcacagtgatagcattatttcttgcacacgcaatagggacatcgattactcagaaagggattatcttcatacttctaatgctagttaccccatctatggcaatgcgatgtgtcgggataggatcccgagactttgtagaagggctgtcaggagcaacatgggtcgacgttgttttagaacacggatcgtgtgtaacaaccatggcaaaagataaacctactctagatattgaattacttaaaacagaagtgacaaacccggctgtcctacgtaaactttgcattgaagctaaaatatccaacaccacaacggactcacgatgtccgacccaaggtgaggccacacttgttgaggaacaagatgctaacttcgtatgtcgcaggacgtttgtagacagaggttggggaaacggttgtggattattcggtaaaggatccttgattacatgtgcaaaattcaaatgtgttacaaaattagaagggaaaacagtacaatatgaaaatttaaagtactccgtaattgtgacagtacatacaggtgaccagcaccaagttggaaacgaatcaactgaacatgggacaacagcaacgataacacctcaggcaccctcgacagaaatacaactaacagactatggcgcactaaccctagattgctcccctaggacggggttagactttaacgaaatggttttattaactatgaaagaaaaagcatggctcgtacataagcaatggtttttagacttaccgcttccttggacaagcggcgcttccacatcacaggagacttggaatagaaaagaccttttagtgacgtttaaaacggcacatgcgaagaaacaagaagttgtagtcttgggtagtcaagaaggagccatgcatactgcgttaactggagcgacggaaattcaaacatcaggaacaacgacaatttttgcgggtcaccttaagtgcagattgaaaatggataagctaactctcaaaggaatgtcctacgtaatgtgtacggggagctttaaactcgaaaaggaagtcgcagaaactcaacatggaacagtattggtgcaaataaaatacgaagggacggacgcgccatgcaaaatacctttctcgacacaagatgaaaaaggagtgacccaaaacggaagattaataacagccaatcctatagtcaccgataaagaaaaaccagtcaatatcgaagcagaaccaccatttggggagtcatatattgtgataggtgctggagagaaggctttgaaactctcatggtttaaaaaggggtcaagtattggtaagatgttcgaagctacagccaggggtgcaagaagaatggctatcttaggagatactgcatgggattttggatcaattggaggagtgtttacatcggtaggcaagctagtacatcaaattttcggtactgcttatggtgtactattttctggagtaagctggacaatgaaaataggtataggcgttctactaacgtggttaggactaaacagtagatctacatcgctgagcatgacatgtatagcagtcgggcttgtaacactgtatttgggcgttatggtccaggcagattccggttgtgttataaattggaaagggagagagctcaaatgcggatcgggtattttcgtgacaaatgaagtgcacacatggactgaacaatataaattccaagctgatagcccaaaaagattatcggcagcaatcggtaaagcatgggaagaaggagtttgtggaattagatcggcaactagactagaaaacataatgtggaaacaaatatctaacgagttaaaccatatactgttagaaaatgatatgaagttcacggttgtcgttggtgatgtagcgggtatattggcgcaagggaagaaaatgataaggcctcagccaatggaacataaatattcatggaaatcatggggaaaagccaagattattggagccgatgtacagaacgctacttttataatagatggacctaacactccggaatgcccagatgatcaaagagcgtggaatatctgggaggtagaggactatggttttggaattttcaccacgaatatatggctaaagctaagggactcctacacacaggtatgtgaccatagattgatgtccgcagccataaaagattcgaaagctgttcacgccgacatgggttactggatcgaatcagagaaaaacgagacatggaaattagcgagagcctcatttattgaggtgaaaacctgcatatggcccaaatcacataccttatggtctaacggagtcctcgagtcagagatgataataccaaagatctacggcggtccaatcagccaacataattatagaccaggatattttactcaaaccgctgggccgtggcaccttggaaagttagaacttgacttcgatctgtgtgagggcacaacagtagtcgtagacgagcactgtgggaatcgaggaccgtccctaagaacgaccacagtaacaggaaagattatacacgaatggtgttgtagatcttgtacgctacctcctttaaggtttaaaggagaggatggatgctggtacggtatggagatcagacccgtaaaggaaaaagaggaaaatctagtcaaaagcatggtttcagcaggatcgggagaagtagacagtttctcacttggattattatgcataagtataatgattgaagaagtaatgaggtctagatggagtagaaaaatgttgatgacggggacactagcagtgtttttcttattgataatgggacagctgacgtggaatgatttgattagattatgtataatggtcggtgccaatgccagtgaccgtatgggcatgggtactacatacctcgcactaatggccacttttaagatgcgtcctatgtttgcggttggattactttttaggaggctaacaagccgtgaagtcctattgctaacaatcggattaagtttagttgcgagtgtggaattgccaaactctctagaggaattaggtgatggccttgccatgggaattatgatacttaagttacttactgatttccaatcacatcaattatgggctacactactttcgttgactttcataaaaaccacattttctttacattatgcatggaaaaccatggcgatggtattgtccatcgtttcacttttcccattatgtctcagcacgacaagtcagaaaactacatggttacctgtgcttttaggatcattgggatgcaaaccacttaccatgttcttaatcgccgaaaacaaaatatgggggaggaaaagctggccactgaacgagggaataatggccgttggcattgtatctatattattgagttcacttctcaaaaatgatgtacctttagctggaccgctcattgccggtggaatgcttattgcatgttatgtcatatctggatccagtgccgaccttagccttgaaaaagcagcagaggtaagctgggaagaagaagcagaacatagtggtgctagtcacaacatcttggttgaagtccaagatgatggcacgatgaaaataaaggacgaagaacgagatgatacattaacaatactgctcaaagcaacattactagccgtatctggcgtatatccactctcaatacctgctactttatttgtatggtacttctggcagaaaaagaagcaaaggagtggtgttttgtgggatactccgagtccaccagaagttgagcgagcagtgttagatgacggaatttacagaattatgcaacgaggattactgggcagatcacaagtcggagtaggggttttccaagaaaatgtttttcacacaatgtggcatgttactcgaggggctgtgttgatgtaccaaggaaagaggttagaaccatcctgggcgtctgtgaagaaagatctcattagttatggcggtggctggagactgcaaggctcctggaatacaggagaagaagtacaggtaatcgcagtcgaaccaggaaagaatccgaagaatgtccagaccgcaccaggaacgttcaagacctcagaaggtgaggttggagcgattgccttggattttaagcctggaacttcagggtcgcccattgtaaatcgcgaaggtaaaatcgtaggattgtatgggaacggggtagtgacaaccagcggtacttacgtttcagctattgcacaagcaaaagcatcgcaagaaggaccattgcccgaaatagaggatgaagtatttcgaaaaaggaatcttactattatggacctccatccaggatcaggtaagacgagaagatatttaccagctatagttagagaagcaataaagaggaaactgagaacattaatattagcgccaacaagagtagtcgccagtgaaatggctgaagccttaaaaggaatgccgatcaggtaccaaacaaccgctgtaaaatcagagcacactggtaaagaaatagtagacttgatgtgccatgctacatttacgatgcgactattatccccggtaagagtaccaaactataatatgattattatggatgaagctcattttacagaccccagcagcatcgcagctagaggatatatttcaactagagtgggcatgggcgaagcagctgccatttttatgaccgcaacgccgccaggttctgtagaagcattccctcagagtaacgctgtaatacaagatgaagaacgagacatcccggagcgttcgtggaatagtgggtacgaatggataactgattttcccggcaaaacagtttggtttgtgcccagcattaaatcaggtaacgacatcgctaattgtttaaggaaaaacggaaagcgtgtcatacaactgagccgtaaaacatttgatacagagtatcagaaaacgaaaaacaacgattgggattatgtggttacaactgacatatctgagatgggagcaaactttagagcagatcgagttatagatccaagacggtgtttaaaaccagtgatccttaaagatggaccagaaagggttatcctagcaggccccatgccagtcacggtagcttccgctgcacagagacgaggtcgcataggcagaaatcacaacaaagagggagatcaatatatatacatgggacaaccattaaataacgacgaagatcacgcacattggaccgaagcaaaaatgttactggataatataaatacacctgaaggaataatacctgccttatttgaacctgaacgagagaaaagcgctgcgatagatggagaatatagactaaggggcgaagctcgtaaaacctttgtcgaactaatgagaagaggagacttaccagtttggttaagctacaaggtggcttccgaaggttttcagtattcagatcgtcggtggtgttttgacggagagagaaacaatcaagtattagaagagaatatggacgttgaaatatggacaaaggaaggagaaagaaagaaactacgacctagatggctggatgcgagaacgtatagtgaccccctggctttgagagaatttaaagagtttgctgcgggaaggaggtccgtctcaggagacttaatattagaaataggtaaacttcctcaacaccttacgcaaagggcacaaaatgcgttagataacctagttatgcttcacaattcggaacaaggcggtagggcctatcggcatgcgatggaggaactaccggatacaatcgagacactaatgctacttgcacttatagcagtattaacaggcggtgttacgttattctttttatccggtaggggattaggtaaaacaagcattggactactctgtgtaatggcatctagcgtattgctctggatggcaagtgtagagccacattggatcgctgcatcaattattctagaatttttcctcatggtgttgctaataccagaaccagacagacaacgcacgccacaagataatcaattggcatatgtcgtcatcgggctgttgtttatgatattgacggtagcggctaatgaaatgggtttgttagaaactactaagaaagacctaggaatagggcacgttgcggttgagaatcaccaccatgcagcaatgttagacgtggacttacatcctgcgtcagcgtggacattatatgctgtagctactacaatcattacccctatgatgagacatactatcgagaacacaaccgcaaacatatcgttaacggcgatagcaaatcaagcagctatattgatggggttagacaaaggatggcctatctctaaaatggatataggcgttcccctacttgctttaggatgctacagccaagttaatccgcttactctcacagcagcagttctaatgttggtagctcactacgccataattggaccgggcctccaagcgaaagctacacgagaagcgcaaaaacgaactgcagctggaattatgaaaaaccctactgttgatggaatagttgcgatagacttggatccagtggtgtatgatacaaaatttgaaaaacaactgggtcagataatgctattaattttgtgcacaagtcaaatattattaatgaggacaacttgggccttatgtgaaagcattacgcttgccacgggacccttaactacgctatgggaagggagccccggcaaattttggaataccacaatagcagtctccatggctaatatatttcggggaagttatttggctggagcaggactagcattctcactcatgaaatcattgggcggaggcagacgaggtacgggtgcgcagggtgaaacgctaggtgaaaagtggaagcgtcaactgaatcaactttcaaagagcgagttcaatacctataaacgatcgggtataatggaagttgacaggtcagaagctaaagaaggcttaaagagaggtgaaactaccaagcacgcagtgtctcgaggcacagcaaaattaaggtggttcgttgaacgaaatttggtaaaaccggaaggcaaagtcatagatctgggttgtggccgaggagggtggagctattattgtgccgggttaaagaaagttaccgaagtaaaaggatatacaaaaggaggtccaggacacgaagaaccgatccccatggcgacttatggatggaacctggttaaacttcactctggtaaagacgtattctttataccacccgaaaaatgcgatactctgttatgtgacattggagaaagtagtccaaatccaaccatcgaggaaggacggacactccgagtcttaaaaatggtagaaccatggctacgtggaaatcaattctgcattaagatattaaacccatatatgccgagtgttgtggaaaccctagaacaaatgcagaggaaacatggtggaatgttagtacgcaatcctttgagtaggaatagtactcacgaaatgtattgggtgagctgtgggactggtaatatagtaagtgcggttaacatgacatcccgaatgcttctaaacagatttacaatggcgcataggaaacctacgtacgaacgagatgtagatttaggcgccgggacaagacacgttgcagttgagccggaagtagcaaatctagacattatcggccaaagaattgagaacattaagcacgagcacaaaagtacgtggcactacgatgaagacaacccctacaaaacatgggcataccacggcagctatgaggttaaaccatccggaagcgcctcctctatggtgaacggagttgtaaaacttttaacaaaaccttgggatgtcattcctatggtgacgcaaatagctatgactgatacaactccattcggacaacagagagtttttaaagaaaaagtagacacgcgcacgccgaaggcgaaacgagggacagctcagataatggaagttaccgcaaaatggctgtggggtttcctaagtagaaataaaaagccgcgaatttgtacgagagaggaatttacaagaaaagtccgttctaacgcggcaattggagcagtcttcgttgatgaaaaccaatggaacagtgcaaaagaagctgtagaagacgaacgattttgggacctggtacaccgagaacgcgaactccataaacagggcaagtgcgctacgtgcgtatataacatgatgggaaaacgcgagaagaaactaggcgagttcggtaaagcaaaaggtagcagagcaatttggtatatgtggctgggtgccagatttctagaatttgaggcattgggtttcatgaatgaagaccactggttcaacagagaaaattctctaagcggtgtagagggtgaaggactacataaattaggctacatattaagagatataagcaaaattcctggcggtaatatgtacgcagacgatacggcgggttgggatacccgcataactgaagacgatctccaaaacgaagcgaaaattacagacattatggaacccgagcacgcgttattagccaaatcaatcttcaaattaacgtatcaaaacaaagtcgtaagagttcaacgacctgcgaaaaacggtacagtaatggacgtcataagtcgtcgagaccaaagaggatcagggcaagttggtacttatggtctgaatactttcactaatatggaggcccaactcattagacagatggagagtgaagggatattttctcccagtgaacttgaaactcctaatcttgctggcagggttttagactggctggaaaaacatggcgtagaacgcctcaaacgtatggcaatatcaggggacgactgcgtagtaaagccgatagacgatagatttgctacagcgttgacagctctgaacgatatgggcaaagttcgtaaagacatccctcaatgggaaccatcgaagggatggaatgattggcaacaagttcctttttgctcacatcattttcatcagttaataatgaaggacggacgtgaaatagtggtcccatgccgtaatcaggatgaattagttggcagagcaagggtttcacaaggtgcgggttggtctttgagggaaactgcgtgcttaggcaaatcatatgcacaaatgtggcaattaatgtatttccatagaagagatctgagattagcagcaaatgcgatatgtagtgccgtgcccgtggattgggtgcccacttcccgaacaacttggtccatacacgcacatcaccaatggatgacgacggaagacatgctgtcagtatggaaccgcgtgtggattgaagagaacccttggatggaagataaaacacatatttcatcatggggagatgtaccatacttgggaaaaagagaagatcaatggtgtggaagtctaataggactgaccgccagagcgacttgggcaactaacatccaggtggcgattaatcaagtaagaagactgataggtaatgaaaactacctggattatatgacatcaatgaaaaggtttaaaaatgagattgatccggaaggagcgctgtggtga

SEQ ID NO: 21946 - RNA, 9879 nt, synthetic construct
  misc_feature 1..9879: note = derived and/or modified CDS sequence (opt6) from DENV-1__EU482506__SS-prME
  source 1..9879: mol_type = other RNA
agtgtaacaatgttattgatgctcatgcctacagcgttagcattccacttaactactcgaggaggtgaacctcacatgattgtgagcaaacaagaaaggggaaaatcgttactattcaaaacatcagcgggggttaatatgtgtacacttatagcaatggacctaggtgagctctgcgaagacacaatgacatataaatgtccacgtataaccgaaacagaaccagatgacgtagactgctggtgtaatgcgaccgatacatgggtaacatacggaacttgtagccaaacgggagaacataggcgtgataaacgctccgtagccttagcgcctcatgtaggattaggattagagactcgtacagaaacatggatgagcagtgagggagcgtggaaacaaatacaaagggtagaaacatgggcactgaggcacccgggatttacggttatagccttattccttgcacatgccatcggaacttcaataactcagaaagggattattttcattctactaatgttagtgactccaagtatggcaatgagatgtgttggaatcgggtcacgcgatttcgttgaaggtctttccggagctacttgggtggacgttgtattagaacatggaagttgcgtaactacgatggctaaagataaaccaactttagatatagaactgctcaaaactgaagtgacaaatccagcagtattaaggaaactatgtattgaggctaaaataagtaatactacgaccgattcaagatgcccaacacaaggggaagctacccttgtagaagaacaagatgctaattttgtatgcagacgaacatttgtggatagaggatggggtaatggatgcggattgttcggaaaaggttcactcattacgtgcgccaaattcaaatgtgtaaccaaattagagggaaaaatagttcaatatgaaaatttaaaatacagcgtaatagtaactgttcatacgggcgatcaacatcaagtcggaaatgagtcaactgaacatggcacaacagcgacgatcactccacaagctcctacaactgaaatacaactaaccgattatggggcgctaacattggactgctcgccaaggacaggactagattttaatgaaatggttttgcttaccatgaaagagaaaagttggttggtccacaaacagtggttcctggacctgcctctcccttggacatcgggagcttcaacttctcaagaaacttggaaccgacaggatcttctcgtaaccttcaagacagcgcatgcaaagaaacaagaagttgtcgtactgggtagccaggaaggagctatgcatacagcgttaacaggagcaacagagatacagacgtcaggaacgacaactatcttcgcaggtcacttaaagtgccgactcaaaatggacaagttgactctaaaaggaatgagttacgtcatgtgtacaggaagtttcaaactggaaaaagaagtagcggaaactcagcatggaactgtcttagtccagattaagtacgaaggaacagacgccccttgtaaaattccatttcttactcaagatgaaaaaggcgtaacacaaaacggtagattaataacagcaaaccccatagtaactgataaagaaaaacctgttaatatcgaggcagaaccaccatttggtgagtcatatataataattggtgcaggggaaaaagcattgaaactcagctggttcaaaaagggtagttcaataggcaaaatgttcgaagcaactgcaagaggtgcaaggagaatggctatactaggagacactgcttgggatttcggttcaataggaggtgtattcacatcggttggaaaacttgtacaccagatattcggaacagcctacggagtcttattttcaggagtcagttggacaatgaaaattggtataggtatcttactaacctggctaggtcttaacagtcgttcgacctcgctatcgatgacatgtatagctgtcggactggtcacactttacttgggcgtgatggttcaagctgatagcgggtgcgtaattaactggaagggcagagaattaaaatgcggatcaggaatttttgttacaaacgaagtacacacatggacagagcaatacaaattccaggcagacagtccaaagcgattgagcgcagcaataggtaaggcgtgggaagaaggagtatgtgggataaggtcggcgactaggctcgagaatataatgtggaaacaaatctcgaatgagttaaatcacatattattagaaaacgatatgaagttcacagttgtggttggtgacgtagcaggcatcttagcacagggcaagaaaatgatacggcctcaacccatggaatacaaatactcgtggaaatcatggggaaaagccaagattataggtgcggatgtgcagaacacaacatttatcatagatgggcccaatacaccagaatgcccagatgaccaacgggcatggaatatctgggaagtcgaagactatggatttggcatatttaccacaaacatatggctaaaattaagagatagctacacccaggtttgtgaccacaggctgatgtccgcagccataaaagactcaaaagcagttcatgcagatatgggttattggatagaatcagagaaaaatgaaacatggaaattagcacgagcctcctttatagaggtaaaaacatgcatatggccgaaaagccacacgctttggagtaacggagtgctagaaagcgaaatgataatacctaagatctatggaggtcccatcagccaacataactaccgacctggttacttcacccaaacggccggtccgtggcatctaggaaaactagaactagactttgatctatgtgaaggtaccacggttgtcgttgatgaacattgtggcaaccgtgggccttctctaaggacgacgacagtaacagggaaaataattcatgagtggtgttgccgcagttgtactctcccgcccttaaggtttaggggcgaagatggatgctggtatggaatggaaataaggcccgttaaggaaaaagaagaaaacctggtaaagagtatggtctccgcgggcagtggcgaagtagatagtttcagtctggggttgctatgcatatcaatcataatagaggaagtaatgcgcagtcgatggagtagaaaaatgttaatgaccggaactttagcagtgtttttcctgttaataatgggacaattgacatggaatgacttaataaggttatgtatcatggtcggagccaacgcttccgatcggatgggaatgggcaccacatatctcgcgttaatggccacattcaagatgagaccaatgttcgcagtaggtctcttatttaggagattaacaagtagagaagtactattactaacaatcggattatctctggtagcatcagtcgaactacccaacagtctagaagaactaggggatgggttagctatgggaataatgatccttaagctattgacggacttccagagccatcagctttgggcgacacttttatctcttacatttattaaaacaacttttagccttcactatgcgtggaaaactatggctatggttctgagtatcgtcagtctcttcccgctatgcttatcgacaacttcacaaaagacaacatggctccccgtgctccttggaagccttggatgtaaacctctaactatgtttttgatagcagaaaataaaatatggggcagaaggtcttggccactcaacgagggaatcatggctgtcggtatagtgagcatattgttatccagcctattaaagaacgacgttccattagcgggacccctaattgctggtggcatgttgattgcttgttatgttataagtggatcaagcgctgatttatcactagaaaaagcagcagaagtttcatgggaagaagaagccgaacattcaggagcctctcacaatatcttggtggaagtccaagacgacggcactatgaaaattaaggatgaggaaagagacgatacattaacgattttgctgaaagctacactccttgcggtgagcggtgtttacccgctatctatacccgctacattattcgtctggtatttctggcagaagaagaaacaaagatccggtgttctctgggatactccttcacctcctgaagttgagcgagcagttctagacgatgggatttacagaataatgcagcgaggattattgggaagatcccaagttggggtaggagtgtttcaagaaaacgtatttcataccatgtggcacgtcacaagaggggcggtattaatgtatcagggaaaaaggttagaaccaagttgggcgtcagtcaagaaagatctaatatcatatgggggcgggtggagattgcaaggtagttggaacaccggagaagaggtacaagttatcgcggtggagccaggcaaaaatccgaagaatgtacaaacagcaccaggcacattcaaaacacctgaaggagaagttggagcaatcgcattggatttcaaaccggggacgtcagggagcccaattgtaaatagagaagggaaaattgttggattgtatggaaatggcgtcgtcacaacatcaggcacatacgtcagtgccatagcacaggccaaagcgtctcaagaaggaccactaccagaaattgaggacgaagttttccgaaaaaggaaccttacaattatggacctacatccaggaagcggtaaaacacgtcgttatctcccagccattgttcgagaagcgataaaaagaaaactgcgaaccttgatattagcacctacgcgggttgtcgctagtgaaatggcggaagcgttaaaaggtatgccgattcgataccaaactacagcagtaaaaagtgagcacactgggaaagaaattgtggacctgatgtgccatgcaacgttcacaatgagactgctatccccagtaagagttccgaattacaatatgatcattatggacgaggcacatttcacggacccgtctagtatagcagccagaggttacatatccacaagagtaggaatgggtgaggcagcagcaatctttatgacagccaccccacccggcagtgtagaagcctttccacagtccaatgccgtcatacaggatgaagaacgggatatccctgagaggtcttggaactctggatatgagtggatcactgactttcctggaaaaacagtatggtttgtaccatctataaaaagcggaaatgatatagctaactgcctccgcaaaaatggaaaaagagtgatccaactgagtagaaagacttttgatacagaatatcagaaaaccaaaaataatgattgggattatgtagtaacaacggacataagtgaaatgggtgcgaatttcagggctgacagagtaattgaccctagaaggtgcttaaaacccgtaattctgaaggatggacctgaacgtgtcattttggcaggcccaatgccagttacagtagcctcagctgcacaacgcaggggcagaataggacgcaaccacaacaaggaaggagaccaatatatatatatgggtcaacccttaaacaatgacgaggatcacgctcattggacagaagcaaaaatgttgctagacaacattaacaccccagaggggatcatccccgcattattcgaaccagagagagaaaaatcggcggcaatagacggtgaatacagactacgaggggaggcgcgaaaaacatttgtagagttaatgcgacgtggggacttgccggtttggttgagttacaaagttgcgagcgaaggttttcaatattctgatcgtcgctggtgcttcgatggtgaaaggaacaatcaagtattagaagaaaatatggatgttgaaatctggaccaaagaaggagagaggaagaaattacgcccgaggtggctagatgcaagaacatactcagatcctctagctttacgggaatttaaagaatttgcggcaggccggagatccgtaagcggtgaccttattttagaaataggcaaacttccgcaacacctaacccaaagagcccaaaatgcgctagataatttagtaatgctgcataattctgaacaaggtggtagggcataccggcacgctatggaagagttaccagatactatagaaaccctaatgttgttagcactaatagcagtgctcacgggtggtgtaacactatttttccttagtggaaggggtttagggaaaacctctataggtttattatgcgtaatggcgagcagcgtcctactctggatggcttcagtagaaccacattggatcgcagcaagtattatattagagttctttttaatggtactcttgatcccggaacctgatagacaacgtacaccccaagataaccagctagcgtatgtagttataggactactgtttatgatactgacggtcgcagccaatgaaatgggattacttgaaactaccaagaaagacttgggcatagggcatgtcgcagtcgaaaaccatcatcacgccgcaatgctagacgttgatctacatccagcaagtgcgtggacgttatatgccgttgcgacgacaataattacaccaatgatgagacatactatagaaaatacgactgcgaatatttctctaacagctatagccaatcaagcagcaattctaatgggattagacaaaggatggcctatatctaagatggacattggcgtaccacttttggcattaggatgttactcacaggtcaacccactaaccttaactgctgcagttctaatgctagttgcacactatgccattataggaccaggcctccaagccaaagctacaagagaagcacaaaagagaaccgcagctggcataatgaaaaatccgaccgttgacggtatagtggctatcgatttagaccctgttgtttatgacgctaaatttgagaagcaacttggacaaattatgcttcttatcttatgtacatcgcaaattttgctcatgaggactacctgggctttatgtgaaagcataacacttgcaacagggcctttgactacactgtgggaaggaagtccagggaaattctggaatactacaatagctgttagtatggcaaatatttttaggggctcttatcttgctggggctggtctagcctttagcttgatgaaaagccttggtggtggccggcgaggcacaggggcacaaggggagacattaggagaaaaatggaaaaggcagttgaatcaattaagtaaaagcgagttcaacacttataaacgttccggtatcatggaagtagacagaagtgaagcgaaagaaggtttgaaaagaggagagacaactaaacatgcggtctccaggggaacagccaagctgcgatggttcgtagaacgtaaccttgttaaaccggaaggcaaagtcatagatcttggatgcggacgaggaggatggagctattattgcgcgggtctgaagaaagttacagaagttaaaggttatacgaaaggaggcccaggccatgaggaacccattccaatggctacgtatggatggaacttagtaaaactccatagcggaaaagatgtatttttcataccgccagaaaagtgtgacacactgttgtgtgacataggcgagtcatcgccaaaccctaccatagaagaaggtagaacattacgtgtattaaagatggtagagccgtggttacgaggaaaccaattttgtataaaaattttaaatccatacatgccatctgtagttgagactctggaacaaatgcagcggaagcacggaggaatgcttgtacgcaatccactttctcgaaatagtactcatgagatgtattgggtatcgtgcgggactggtaatatagtttcagcggttaatatgacctcaagaatgcttttaaacaggttcacgatggcacaccgaaaacctacctatgagagggatgtagacctcggggcaggcactagacacgtcgctgttgaacccgaagtagccaatctagacattattgggcaaaggatagaaaacattaaacatgaacacaagtcaacatggcattacgatgaagacaacccatacaaaacgtgggcgtatcacggcagttacgaagtcaaaccatcaggttcagcctcctccatggttaacggagttgttaagctactcacaaagccgtgggacgtaattcctatggtaacgcaaatagcgatgacagatacaactccattcggccagcaacgagtatttaaagagaaagtagataccaggacacctaaggctaagaggggcacggcgcagataatggaagttactgcgaaatggctttggggatttctatctcgtaataagaaacctcggatttgtacaagggaagaatttacgaggaaagtgcgatccaatgccgcaataggggcagtgtttgtggacgagaaccagtggaactctgccaaagaagccgttgaagatgaacgcttttgggatctagtacatagggaaagggaactacataaacaaggtaaatgcgcgacatgtgtatataacatgatgggaaagagagagaagaaacttggagaatttggcaaagccaaggggagtcgagcaatatggtacatgtggttaggagcaagattcctagaatttgaagcacttggttttatgaatgaagaccactggttttctagagaaaactccttgagtggtgttgaaggtgaaggattacacaaactgggctacatattaagggatatttcaaagataccgggtggcaatatgtatgcagatgataccgccggatgggatacacgaataacagaagatgacctacaaaatgaggctcgaataactgacataatggaaccagaacatgctcttttagctaaatctatattcaaactcacttaccaaaataaagtagtaagggtgcaaagacctgcaaagaatggaacagtgatggatgtcatatcgaggagagaccagagaggtagcggtcaagtcggaacatacggacttaatactttcacaaacatggaagcacaattaataagacaaatggagagtgaggggatattttcaccctcggagcttgagacacctaatcttgcggaaagggtactagactggctagaaaagtatggagttgaaagattaaaaaggatggctataagcggagatgactgtgttgtcaaaccaattgacgaccgttttgcgacagcactaacagccttgaacgatatgggtaaagtccggaaagatataccacaatgggaaccaagcaaaggctggaacgattggcagcaagtgccattttgttcacatcactttcaccaactcataatgaaagatggtcgggagatagtagttccttgtagaaaccaagacgaacttgtcggcagagctagggtaagtcaaggtgctggatggagcctaagagaaacagcgtgtttaggcaaatcatatgcacaaatgtggcagctaatgtattttcaccgaagagatctgagattggcggcaaacgccatatgtagtgctgtacccgtggattggatcccgacctcaagaactacttggtcaattcacgcacatcatcagtggatgacaacagaagatatgctaagtgtgtggaatagggtatggatagaggaaaatccatggatggaagacaaaacgcacatatcaagttggggagatgtaccctacttaggtaagcgagaagaccaatggtgcggatctttgataggtttgactgcacgagcaacgtgggctacaaatatacaggtagccatcaatcaagtcagacgactgattgggaatgaaaattacctagattacatgacgagcatgaagcggtttaaaaatgaaggcgatccagaaggagcactgtggtag

SEQ ID NO: 21947 - RNA, 9879 nt, synthetic construct
  misc_feature 1..9879: note = derived and/or modified CDS sequence (opt6) from DENV-1__EU482509__SS-prME
  source 1..9879: mol_type = other RNA
tctgttactatgctcctgatgcttatgccgacagcattagcttttcatttaacgacacgcggaggagaaccacacatgattgtcagtaaacaagaacgaggcaaatcattattattcaaaaccagtgctggagtgaacatgtgtacacttatagcaatggatttgggcgaactgtgcgaagatacaatgacatataaatgtccgagaattaccgaaacagaaccagatgacgtcgattgttggtgcaacgcaacggatacgtgggtgacttatggtacatgtagccaaacaggcgaacaccgtagagacaaaaggtccgtggcgctggctccacatgtggggctaggacttgaaacgcgcacggaaacatggatgtcatcagaaggcgcttggaaacaaatacaaagagtggaaacttgggcgctaagacatccaggattcactgtgatagcgttatttttggcgcatgctataggcacatctataactcaaaaaggaatcatttttatactgttgatgctagtaaccccatccatggcaatgaggtgcgttggaatcggatcacgagatttcgtagaaggcctatccggggctacgtgggtagatgtcgtactcgagcacgggtcatgcgttaccacgatggcaaaagataaaccgacactagacattgagctactcaaaacagaagttacgaatccagcagttttacgtaaactatgtatcgaagctaaaatttccaatacaaccacagattctcgatgtcccacacaaggagaagcaacattagttgaagaacaagacgcgaacttcgtctgtagaagaacatttgttgacaggggttggggtaatgggtgcggcttatttggcaaagggagtctcataacgtgtgcaaaattcaaatgcgttacgaaattggaagggaaaatagtccaatatgaaaatcttaaatattctgttatagttacggtacatacaggggatcaacaccaggtgggtaacgaaagtacggaacatggaactactgcaacaataacaccccaagctcctaccacagaaatccagttaactgactacggcgctttgacgttagattgttcgccacgaactggattagacttcaatgaaatggtactactgacgatgaaagagaaaagctggttagtacacaaacaatggttcttagatttaccgcttccatggacctctggggcaagcacatcccaagaaacctggaatcgacaagatttactggttacgtttaaaacagcacacgccaagaaacaagaagtggtggtacttggctcgcaagaaggagcgatgcacacagccttaaccggagcaactgaaatccagacatctggaacaacaacaatttttgcaggacacctaaaatgtcgacttaaaatggataaactcactttgaaggggatgtcctacgtaatgtgtacgggtagtttcaaactcgagaaagaagtagcagagacccaacacgggaccgtcctagtacaaataaagtatgaaggaacagatgccccatgcaagatacctttccttacacaggacgaaaaaggagttacacagaatggaaggttaattaccgcaaatccaatcgttacggacaaggaaaaaccggttaacatagaagccgagccaccgttcggagaatcatacatcatcatcggagctggcgaaaaagcgctaaagctgtcctggtttaagaaaggcagttcgataggaaaaatgttcgaggcgacagctcgtggagctagacgtatggcgatactgggagatactgcatgggattttggcagtattggcggagtatttacatccgcgggcaaattagtgcatcaaattttcggcacggcctacggagtactttttagcggagtttcatggactatgaaaataggaataggtgtattactaacctggttaggattaaattcgcgttcaacttctttatctatgacctgtatcgcagttggcctagtaactttgtacttaggggtgatggttcaagcagattctggttgcgtaatcaactggaaaggccgagaattaaaatgtggttcaggtatatttgttacaaatgaagtgcatacgtggacggagcaatataaatttcaagctgattcaccgaaaagactgagtgcagcaattggcaaagcgtgggaagaaggtgtatgtggaatcaggtccgcaaccagacttgaaaatattatgtggaaacagatttctaacgagttaaatcatattcttttagaaaatgacatgaagtttaccgtggtagtgggcgatgtagcgggaattttagcgcagggcaagaaaatgataagacctcaaccaatggaatataaatactcctggaaatcctggggaaaggcaaagataatcggtgcggacgtccaaaatactacctttataatagatggcccaaacaccccagaatgcccagacgaccaaagggcctggaacatatgggaggtagaggactatgggttcggtattttcactacaaacatatggttaaaattaagggatagctatacacaagtatgcgatcatcgtctaatgagcgcggcaataaaagattctaaggcagtacatgcagatatgggttactggatagaatctgagaaaaatgaaacttggaaattagcaagggctagtttcatagaggtcaaaacatgcatatggcccaaatcacacacactatggagcaacggtgtgctagaatcagaaatgattgtaccaaaaatctatggaggacctattagccaacataactatcggcccggctactttacccaaacagcaggtccgtggcatctaggcaaactagaattagattttgacctatgcgaaggtacaacggtggtagtagatgaacattgcggaaacaggggtccttctctgagaacgacaacagttacgggtaaaataattcacgagtggtgttgtcgcagttgtacgttaccaccgctccgcttcaggggagaagatggatgttggtacggcatggaaatcaggcctgtcaaggaaaaagaagaaaacctggtaaaatcgatggtcagcgctggtagtggcgaagtagactccttttctttaggtttactgtgtatatcaataataatagaagaagtaatgagatcccgatggagcagaaagatgcttatgacgggaactttagcagtatttttcttattgataatggggcaacttacttggaacgacttaatacgtttgtgtatcatggtaggagccaatgctagtgatcggatgggtatgggtacaacatatctggcattaatggccacatttaaaatgaggccaatgtttgccgtaggactactctttcggaggttaacatccagagaagtactactattaactattggcctcagtttagttgcgagtgtcgaattacctaatagcctagaagaattgggggacggtcttgcaatgggcataatgatcttaaaactacttaccgattttcaatctcatcaactctgggcgacactactgtcgcttacatttatcaaaactacatttagcttgcattatgcatggaaaacaatggccatggtgctatctatagtaagccttttcccactttgtctaagcacaacaagccagaaaaccacgtggctccctgttttgttaggttcacttggctgtaaacccttaacaatgttcctcatagccgaaaacaaaatttggggaaggcgatcctggcccttaaatgaggggattatggcagtggggattgttagcatcttgttaagtagtttgctaaagaatgacgtacctttagcaggaccactgatcgctggaggtatgctgatcgcttgttatgtcattagtggatcctcagcagatctatccctcgaaaaggcagccgaagttagctgggaagaagaagctgagcattcaggcgcaagtcataacatcttagtggaagtccaggacgatggcacaatgaaaataaaagacgaagaaagagatgacacactaacaatcttgttaaaggccacgctacttgctgtaagtggagtgtaccctttaagtatcccagcgacattgttcgtctggtacttctggcaaaagaagaaacaaagatcaggtgttttatgggatacccccagtccaccagaagtagaacgcgcagtgttggacgatggtatataccgaattatgcagcggggattactagggcgatcacaagttggtgttggagtttttcaggaaaatgtgttccatacaatgtggcatgtcactcgtggagcagtactaatgtaccaaggaaagagactagaaccgtcatgggcaagtgtcaaaaaggacttaatttcttacggtggaggatggagattacaaggatcctggaacacaggtgaggaagtgcaagttattgcagttgaaccaggtaaaaaccctaagaatgttcaaacggctccgggaacattcaagacgccagaaggcgaagttggtgccattgctctagattttaaaccaggtaccagtggaagtcctatagtaaatagagaaggtaaaatagtaggactatatggaaatggagttgttacgacatcaggcacatacgtttcagcaatagcccaagccaaggcgtcccaggagggtccattaccggagatagaggatgaagtcttccgaaaaagaaacctaacaatcatggatttgcaccccggttctggaaaaacgagaaggtacttgcctgccattgtccgcgaagctattaaaaggaagttaagaacactgatactcgcaccaactcgagtcgtagcttcagagatggctgaggcattgaaaggaatgccaatcagataccaaaccacggccgtaaagtccgaacatacaggcaaagaaattgtagacttgatgtgccatgcaacattcacaatgcggttactttcacccgttagagttcctaattataatatgataattatggatgaagcacacttcaccgaccctagttctatagcagctcgaggatatatctcaacgcgagtaggaatgggtgaagcagcagccatatttatgacggctactccacccggaagtgtagaggcttttccacagtcgaacgcggtgatccaagacgaagaacgtgatattcccgaacgatcttggaactcaggatatgaatggatcactgacttcccaggtaagactgtatggttcgttccatccattaaatctggcaatgatatagcaaactgcctacgtaaaaacgggaagcgagttatacaactatcccgtaaaactttcgatactgaataccagaaaacaaagaataatgattgggattatgtagttacgacagatatcagtgaaatgggagctaatttcagggcggacagagtaatagacccaagacgatgtcttaaacctgtcatattgaaggatggtccagaaagagtaattctcgctgggcctatgccggtcacagtagcatctgccgcacaaagaaggggtaggatcggccgaaaccacaacaaagaaggagatcaatacatatacatgggccaaccgcttaataacgatgaagaccacgctcactggactgaggctaaaatgctactcgacaatataaatacaccagaaggcatcatacctgctctattcgagcccgaacgcgaaaaatcagctgcgatcgatggggaatacagattaagaggggaagcacgaaagacctttgttgaattaatgagaagaggcgacctaccagtgtggctaagctataaggtggcctctgaaggctttcaatattcagatagaagatggtgctttgacggagaaagaaataaccaggtcttagaagaaaatatggatgtggaaatatggactaaagaaggtgaaaggaagaaattacgcccaagatggcttgatgcgaggacctattcggacccgctagccttacgtgagtttaaagaatttgccgcaggaagacggtctgtaagtggtgatctgatcctcgaaatcggcaaattacctcaacacctaacgcaaagagctcaaaatgcactggataatttagtgatgttacataattcagaacaaggaggtcgtgcttaccgacatgctatggaagaattacctgatacaatagagacattaatgctcctagccttgatagccgttcttaccggaggcgtaacattattctttctctcagggagaggccttgggaaaacgtcaatagggttattatgcgtgatggcatcatccgtactactatggatggcctcagtcgaaccacactggatagcggcatcaataatcttagagttctttctaatggtgcttctcataccggaaccagatagacagagaaccccgcaagataatcaattagcctacgtcgtaattggactactatttatgattctaacggtagcagcaaacgagatgggcttgttagagacaaccaagaaagacttaggcataggccatgtagctgtagagaatcaccatcacgcagccatgctagatgttgatttacacccagctagcgcgtggactttatacgcggttgccacaacaattataacgcccatgatgcggcatacaatagaaaacactaccgctaacatatctttgaccgctatagcaaatcaagctgctattctaatgggattagataaaggttggccaatttcaaaaatggatataggagtaccacttttggctttgggatgttattcacaagttaatcctcttaccctgacagcagccgtactcatgctagtcgcacattatgctataataggccccggtttacaagcaaaagcaacacgtgaagcgcagaaaaggactgccgcaggtattatgaaaaatccaacagtagacggcatagttgcgatagacctcgatcctgttgtatatgacgcgaaatttgaaaaacaactcggacaaatcatgctgttgattctttgcacttctcagatcttactaatgcgtacaacctgggccttatgtgaatcgatcaccttagcaaccggtccacttacgacattgtgggaaggctcaccaggtaagttttggaatactactattgccgtttctatggcaaatatttttcgaggctcttatctcgccggtgctggactcgctttttcattaatgaaaagcctaggaggcggaagaagaggaacaggcgcacaaggcgaaacattaggcgaaaagtggaaacgacaattaaaccagctatcaaaatcggaatttaacacatacaaaaggagcggcattatggaagttgatagaagtgaggcgaaagaaggactaaaaaggggagaaactacaaaacacgcagtatccagagggactgcaaaactacgatggtttgttgagcgaaacctagtcaaaccggaggggaaagtaattgatttaggttgcggcagaggaggctggtcatattattgcgctggtctgaagaaagtaacagaggttaaaggatatactaaaggtggaccaggacatgaagaacccataccaatggcaacctatggatggaatcttgttaagttacattccggtaaagatgttttctttattcctcccgaaaaatgcgataccctattatgcgacataggagaatcaagtccgaatccgacgatagaagaaggtagaaccctgagggtccttaagatggtggaaccttggctccgaggcaaccaattttgtataaaaatactaaatccttacatgcctagcgtagtggaaactttagaacaaatgcaaaggaaacatggaggtatgttggtcaggaatccactttcccgaaacagcacccatgaaatgtattgggtatcgtgcggaacggggaatattgtctcagcagttaatatgaccagtaggatgttactaaacagatttactatggctcaccggaaacctacatatgaacgggacgtggatctaggtgctgggaccagacatgtagcagtggaacccgaagtagccaacctggatataattggacagcgaatagaaaacataaaacatgaacacaaatctacctggcattacgatgaagataatccctataaaacatgggcatatcacggaagctacgaggtaaagccatctgggagtgcaagcagcatggtaaatggcgttgtaaagctcttaacaaaaccgtgggatgtaataccgatggtcactcagatagcaatgacagatacaacaccctttggccaacagcgggtatttaaagaaaaagtagatacacgcaccccaaaagcaaagagggggaccgctcaaataatggaagtcacagccaaatggttatggggattcttatcaaggaataagaaaccacggatatgtacgagagaagagttcactcgtaaagtgaggagtaacgctgcaataggagctgtttttgtagatgagaaccaatggaacagcgctaaggaagcggttgaagatgagaggttctgggacttggtacatagggaaagagagttacataagcaaggaaaatgtgccacatgtgtttataacatgatggggaaaagagaaaagaaattaggcgaatttggaaaagcaaaaggcagtagagccatctggtacatgtggctaggagccaggttcttagagttcgaagcgctggggtttatgaacgaggatcactggttttcgagggaaaatagcttgagtggcgtcgaaggagaaggactccacaagttaggttatatactcagagacatatcgaagataccgggaggtaacatgtacgcggacgatacagctggctgggacacccgcataactgaagatgacttgcaaaatgaagcgagaatcaccgacataatggagccagaacatgctctcttggcaaaaagcatctttaaattaacttaccaaaacaaagtagtgagggtgcaaagaccagccaaaaacggtactgtaatggacgttatcagtagaagagatcaacgaggcagtgggcaggtaggaacatacggactaaatacttttacgaatatggaagcacagctaattaggcagatggaatctgagggtatttttagtccatccgaactagaaaccccaaacctcgcagaaagagtacttgattggctagaaaagtacggagttgaaaggctaaagcgtatggccataagtggtgacgactgtgtcgttaagccaatagatgatagatttgcaacagctctaacagcattaaatgatatgggcaaggtaagaaaagatatcccgcagtgggaacccagcaaaggttggaatgactggcaacaagttcccttttgttctcaccacttccaccagctgataatgaaagacggacgggaaatagtagtcccttgtcggaatcaagatgagttggtggggagagcacgagtaagccaaggggccggatggagcctccgagaaacagcttgtctaggaaaaagctatgcacagatgtggcagttgatgtattttcataggagagatttaagactcgcggcaaatgccatatgctcagctgttcccgtagattggattcccacttcccgcactacatggagtatacatgcacaccatcaatggatgacgactgaggatatgctttcagtatggaacagagtctggatagaagagaatccttggatggaagataaaacccacatcagctcctggggtgacgtaccttacttgggaaagagagaagatcaatggtgcggatcattaattggattaactgcacgcgcaacttgggcaactaatatacaggtagctataaaccaagttagacgattaattggcaacgaaaattacctagattatatgacttcgatgaaaagattcaaaaacgaaggggaaccagaaggtgcgctatggtga

SEQ ID NO: 21948 - RNA, 9879 nt, synthetic construct
  misc_feature 1..9879: note = derived and/or modified CDS sequence (opt6) from DENV-1__EU482510__SS-prME
  source 1..9879: mol_type = other RNA
tcagtaacaatgctacttatgcttatgccaactgcactagcatttcacctaactactcgagggggtgaaccccatatgatagtgagtaaacaggaacgtgggaaatcgctactatttaaaacatccgccggtgtaaatatgtgcacattgatagctatggatctaggtgaactatgtgaagatacgatgacttataaatgtccacgtataacagaagtagaacctgacgatgtagactgttggtgtaatacaacagatacctgggtcacttatggtacatgctcacaaacaggtgaacatagaagggacaaacgctctgtggccctagcacctcatgtaggtttaggactagaaacacgtgcagaaacatggatgtcgtcagaaggagcctggaaacaaattcaaaaagtagaaacatgggcgttaagacacccagggtttactgtgattgccctatttcttgcgcatgctattggtacaagtatcacacagaaaggaataatatttattcttttaatgttagtaaccccatcgatggcaatgagatgcgtaggaataggatcacgtgattttgtagaaggtttgtctggggccacctgggtcgacgtagtactagagcatggaagttgcgttacaaccatggcgaaagataaacctactcttgacatagaactattacgtacggaagtaacaaatccagcagtcttacgtaaattatgtattgaggccaaaatatcaaacaccactaccgactccagatgtccaactcaaggagaagcaactcttgtagaagaacaagatgccaacttcgtctgtagacgcacgttcgttgatagaggatggggaaacggatgtggactctttggcaaaggatcgctaataacatgtgcaaaattcaaatgtgtcaccaaacttgaaggcaaaatagtacagtatgaaaacttgaaatattcagttatcgtcactgtccacacaggagatcaacatcaggtaggtaacgagagcacagagcacggcactacggcaactataactcctcaagcaccgacgagcgaaatacagctcacagattacggtgctttaactttggattgttcgcctagaacaggcctggactttaacgaaatggtattattaacaatgaaagagaaaagttggttagttcacaaacaatggtttctggatttacctttaccatggacgtcaggagccagtacatcgcaggaaacatggaatcggcaagacttactggtcacattcaaaacggcacatgcaaagaaacaggaagtggtcgttctaggatcgcaagagggagcaatgcatacagcactaacgggagcgacggaaattcaaacttctggtacgaccaccatcttcgcaggacacctgaaatgtagattaaaaatggacaaattaaccttaaaaggtatgtcttatgtcatgtgtaccggcagctttaaactagaaaaagaagttgccgaaacccaacatggaaccgtacttgtgcagataaaatatgaaggaacagatgcaccttgcaaaatacccttctctacacaagatggaaaaggggtaacacaaaatggacggttaatcactgccaacccaatcgtaacagataaagaaaaaccggttaacatcgaagctgaaccaccatttggtgaatcatacatagtaataggggcaggagaaaaagccttgaaattgtcatggtttaagaaaggatcctccattggcaaaatgttcgaagctacggctagaggagcacgacgaatggcaatattaggtgacacggcgtgggattttggaagtataggaggtgtatttacctcagtaggaaagctagtacatcaaatatttgggacagcttacggagttctattcagtggtgtatcatggacaatgaaaataggtataggagtcctattaacttggcttggcttaaattctagaagcacgtctttatcgatgacctgcattgcggttggtttagttaccctttacttgggcgtcatggtacaagcagactcggggtgtgtaataaactggaaaggacgtgaactaaaatgtggttcgggaatatttgtgacgaatgaagtgcatacatggaccgaacaatacaaatttcaagcagattctccaaaaagactctcagcagcaataggaaaggcttgggaagagggggtatgtggcatcagatcagccacaagattagagaacattatgtggcgacagatatctaatgaattaaatcacatcctattagaaaatgatatgaaattcaccgtagtggtaggagatgtcgtaggcatcttagcgcaaggcaagaaaatgataagaccgcaaccaatggaacataaatattcttggaaatcatggggcaaggctaaaattataggagcagacgtgcagaacacaacctttataatagatggaccaaatacgcctgagtgtccagatgatcagcgggcctggaatatatgggaagtagaggactacggatttggtatctttacaacgaacatatggctaaagctacgcgattcatacacccaagtttgtgaccatcgattaatgagcgccgcaattaaagatagtaaagctgtacatgccgatatgggttattggattgagagtgagaaaaatgaaacatggaaactcgcgcgtgcaagttttattgaagtaaaaacttgtatttggcctaaatctcatacgctctggtccaacggggttctcgaaagtgaaatgataatacctaaaatatatggaggaccaattagccagcataattataggccaggatatttcacccaaacagctggtccctggcacttaggcaaattagaattagattttgacctctgtgaaggaaccacagtggttgtagatgagcattgtggcaatcggggacctagccttcgtactactacggtaaccggtaagatcatacacgaatggtgttgtagaagttgtactttacctccattacggttcaaaggcgaagatggatgctggtacggtatggagatacgcccagttaaggaaaaagaagaaaacttggtaaaaagtatggtgagtgctggatcaggcgaggtagattcattttccctcggcttgctttgtattagcatcatgatagaggaagtcatgagaagcagatggtcacgcaagatgctgatgacaggcaccctggctgtatttttcttattaattatgggacaactcacgtggaatgatctgatccgttcatgtattatggttggagcaaatgcatcagatcgaatgggtatgggtactacttacctagcgttaatggcgacttttaaaatgaggcctatgtttgcagtaggattactttttaggagattaacttctcgcgaagttttgcttctgacaatcggtttatctctggttgcatcagtagaactaccaaattctcttgaagagttgggagatggattagcaatgggtataatgatattgaaactactcacagattttcaaagctatcaattatgggcgactttgctaagcctgacatttatcaaaactacattttctctacattacgcatggaaaactatggcaatggttctaagcatcgtgtctcttctacctctttgcttatcaaccacatcacagaaaactacttggttaccagtcttattgggtagcttaggatgcaagccgttaacaatgtttctgatagcagaaaacaaaatttggggtagaaaatcttggcctcttaatgaaggtattatggcagtcggtatagtttcaatactactctccagtcttcttaagaatgacgtaccactcgcagggcctcttatagcgggagggatgcttattgcgtgttacgtcatatccggatcaagcgcggatttatcattagaaaaagcagcggaggtatcgtgggaagaagaggctgagcattcaggagcctcgcataatattttagttgaggtccaagacgacgggacaatgaaaattaaggatgaggaaagagatgatacccttactatcctattgaaagctaccttacttgctgtctccggagtatatcctttatctatacctgcaacattatttgtatggtatttttggcagaagaagaaacaaagatctggcgttttatgggatacaccctcgccccctgaggtggaaagagcagttctagatgatggaatctacagaataatgcaaaggggattactgggaaggtcacaagtaggtgtcggagtgtttcaagagaacgtttttcacacaatgtggcacgtaactcgaggagcggttctaatgtaccaaggcaaaaggcttgaacctagctgggcatcagtcaagaaagacttgataagttatgggggcggttggagattacaaggatcttggaatacgggagaagaagtacaggttatagctgtagaaccaggtaaaaatcccaaaaatgtacagacggctcctggcacattcaaaacaccggaaggggaagtaggggccatagccctagacttcaaacccggcacatcaggatccccaattgtaaatagagaaggcaaaatagtcggattatatggaaatggcgtcgtaacgacatccggtacatacgtctctgccattgcacaggctaaagccagccaagagggcccgcttccagaaatcgaggacgaggtcttccgcaaacggaatctaacgatcatggatttgcatcctggaagcggcaaaacacgaaggtatctacccgcgatcgttcgagaagctataaagaggaaactaagaacactaattctcgctcccactagggtcgtagctagtgagatggccgaggctttaaaaggcatgccaataaggtatcaaacaacagcggtaaaaagtgaacataccggacgagaaattgtagatctaatgtgtcacgctacgtttacaatgcgcttattatcacccgtgagagtgccaaactacaacatgatcataatggacgaagcgcattttaccgacccatctagtattgctgctcggggatatatatcaactagagtagggatgggagaggcggcggctatatttatgacagctacgccaccaggatctgtcgaagcatttccacagtccaatgcagtaattcaggacgaggagcgagatattcccgaaaggtcttggaactcagggtacgaatggataacagacttcccagggaaaactgtttggtttgtcccaagtatcaagtctggaaatgatatagcaaattgtttacggaagaacggtaaacgtgtaatacagctaagccgaaagacgtttgatacggaataccaaaagacaaagaacaacgactgggattatgttgtaacaacagacatctcagaaatgggggctaatttccgcgccgatagggtgattgacccacgaagatgcctcaagccggtgatactgaaagatggacccgagagagtcatactagcgggacctatgccagtcacagtagcaagtgcagcacagcgcagagggcgtatcggacgtaaccacaataaggagggagaccaatatatatatatgggacaaccgttaaataacgatgaagaccatgcacactggacggaagccaagatgttactggacaatataaatacaccagaaggaataatcccagcgttgttcgaacctgagagagagaagagtgcggcaatcgatggagaatatcgacttagaggtgaagctcgaaaaacttttgtggaattaatgaggcgaggcgacttaccagtctggttatcgtacaaggttgctagtgaaggatttcaatatagtgatcgaagatggtgctttgatggagaacgaaacaatcaggtgcttgaagaaaatatggacgtagagatctggacaaaagaaggcgaacgaaagaaactaagaccgcgatggctagatgcaagaacatattcagatccattagcactgagggaatttaaagaatttgcagcgggacgaagaagcgtaagcggtgatctaattttagaaataggaaaactgccccaacacttaactcaaagagctcaaaatgccttagataatttagttatgttgcacaattcagaacaaggcggccgtgcgtaccgtcacgcgatggaggaactgcccgacactatagaaacactaatgttgcttgccctaatagcggttttgactggtggagtcacgttattctttctctccggacgaggattagggaaaacatctataggtctactttgcgtcatggctagttcggcgttattatggatagcatcggtcgaacctcattggatagccgcttcaattatattagagttctttttaatggtgcttttaatacctgaaccagataggcaacgcactcctcaagacaatcaattagcttacgttgtcataggtttattgtttatgattcttaccgttgccgctaatgagatgggactgcttgagaccactaagaaagatcttggaattggccatgttgccgtggagaaccatcatcacgccaccatgttagatgtagatctccatccagcaagtgcgtggaccttatatgctgttgctacgacaataataacccccatgatgcgacatacaatagagaatactacagcgaatataagtctaacagcaatagcaaaccaagccgctatactaatgggactagacaaaggctggccaataagcaaaatggatattggagtacccttactcgctctcggttgctattcacaggttaatcccttaacactaactgccgcagtactgatgttagtagcacattatgcaatcataggccctggtttgcaagcaaaagcaacacgagaggcccagaagaggactgcggccgggattatgaaaaatcccacagtagatggaatagttgcaatagacctcgaccctgtagtctatgatgcgaaattcgaaaaacaacttggacaaatcatgttactcatcctttgtacttcacaaatcttactgatgcgaaccacatgggcactctgtgaatccataacattagccacaggacctctcactacgctttgggaaggtagtccagggaaattctggaataccacgatcgcagtttcgatggcaaatatatttcgagggtcatatctggcaggagctggtctcgccttttcactcatgaagagtttaggaggcggaagacgaggaacaggagcacaaggagagacacttggcgaaaaatggaaacgacaattaaaccagttaagcaaatcagaatttaacacttataaaagatcaggaataatggaggtcgataggagcgaagcgaaggaaggcttgcgcaggggtgagacgacaaagcatgcggtatctcgaggtactgcaaagttacgctggtttgttgagcgtaatctagttaaacccgaagggaaagtaattgacctcggttgcggtagaggcggatggtcatattattgtgccggcctcaagaaagtaacagaagtcaaagggtatactaaaggaggtccaggtcacgaagaaccaatacctatggcaacgtacggatggaaccttgtaaagctacacagcggaaaagacgtgttctttattccaccagaaaaatgtgacaccctactttgcgacatcggtgaaagttccccgaatccgacaatcgaggaaggtagaacattaagggtcttaaaaatggttgaaccatggctcagaggaaaccagttctgtattaaaatacttaacccatatatgcctagtgtagtcgagacactagagcaaatgcaacggaaatatggaggaatgctggtacgcaatccactaagtagaaacagtacacatgagatgtactgggtttcctgcgggacaggaaatatagttagtgcagtcaatatgacgtcaagaatgctactaaaccgtttcacaatggcccatcggaaaccgacatatgaaagagatgtagatttgggcgccgggactaggcatgttgccgttgagcctgaagtagcaaatttagatataattgggcaaagaatagaaaacataaaacatgaacacaagtccacatggcattacgatgaggataacccatataaaacatgggcatatcacggttcatacgaagttaaaccctcaggatcagcatcaagtatggtgaacggagttgtcaaattattgacaaaaccatgggatgtaatcccaatggtcactcaaatagctatgactgacactacgcccttcggacagcaaagggtctttaaagaaaaagttgatacccgaaccccaaaggcaaaaagaggaacggcccaaatcatggaagtcacagcgagatggctttggggattcctgtctcgaaacaaaaagccaagaatctgtacgcgtgaagagtttacgagaaaagtacgatcgaacgcagcaataggtgctgtcttcgttgatgaaaaccaatggaactcagcaaaagaggccgtagaagatgagcgtttctgggacctagtccaccgagagagagagctccataaacaaggaaaatgcgccacctgtgtctacaatatgatgggaaagcgcgagaagaaattaggggagtttggaaaagcaaaaggtagccgagcaatctggtacatgtggttaggagcacgatttctcgaatttgaggcactaggttttatgaatgaggaccattggttttcacgcgaaaacagtttatcaggagttgaaggagagggactacacaaacttgggtatattttaagggatattagtaagatacctggaggtaatatgtacgccgatgatacagcaggatgggatacacgaataacagaagatgatttacagaatgaagccaaaataactgacataatggaaccagaacacgcgctattagccacaagtatatttaagttgacttatcagaataaagtagtccgagttcaaaggcctgccaaaaacggaacggtgatggacgtaatctcgagacgagatcagcgtggatcaggacaagtaggaacgtacgggctgaacacatttacgaacatggaagcgcaacttattagacaaatggaatcagagggaatattcagccctagcgagctagaaactccaaacctagcagaaagagttctggattggttggaaaagtatggtgttgaaaggctcaaaaggatggcaatcagcggtgatgattgtgtggttaagccaatagacgataggttcgcaacggctttaacggctctaaatgacatgggaaaagtgaggaaagatattccccagtgggagccaagtaaaggatggaacgactggcaacaagtccctttctgcagtcaccactttcatcaattgattatgaaagacgggagagaaatagtcgttccctgtcgaaaccaagacgaacttgtcggtagggcacgagtttcacagggagctggctggtcgttacgagaaactgcgtgtttggggaaatcttatgcacaaatgtggcaattaatgtattttcaccggagggatttaagactcgcggcaaacgcaatatgttcggcggtacctgtagactgggtacccacttcgcgtacaacatggagcattcatgcgcaccatcaatggatgacaacagaagacatgctgagtgtgtggaacagagtatggattgaagaaaatccctggatggaagacaaaacacatattagttcatggggagatgtaccttatttaggtaaacgagaggaccaatggtgcggttccttaattgggcttacggcacgtgcaacttgggctacaaatatacaggtagctataaaccaagtaagaagattgataggaaacgaaaactatttagattacatgacgtcaatgaaacgtttcaagaatgaatctgacccggaaggcgcattatggtaa

SEQ ID NO: 21949 - RNA, 9879 nt, synthetic construct
  misc_feature 1..9879: note = derived and/or modified CDS sequence (opt6) from DENV-1__EU482511__SS-prME
  source 1..9879: mol_type = other RNA
tccgtcactatgcttctaatgctcatgcctacagcgttagcattccatttgacgacaagaggaggtgaaccccatatgatagtatcaaaacaagaacgcggaaaatccttgttattcaaaacaagcgctggtgttaatatgtgtacactaatcgcgatggatctaggggaactgtgtgaagataccatgacatataaatgcccgagaattactgaaacagaaccagacgatgtagactgctggtgtaatgctacagacacctgggttacgtacggaacatgttcacaaactggagaacatcgaagagataaacgatccgttgctctagcaccccacgttggtttgggtctcgaaacaaggaccgaaacctggatgagcagtgagggagcatggaaacaaattcaaagagttgaaacatgggccttgcgtcaccctggatttacagtaatagctttatttttagcacatgccattggtacatcaatcactcaaaaaggcatcatatttatcttgctaatgctggtgacaccaagtatggcaatgcgatgtgtaggcataggatcacgtgactttgtagaaggattatcaggagcaacgtgggtagacgttgtactagaacacggtagctgcgtaaccaccatggcgaaagacaaaccaacacttgatatcgaattattaaaaactgaagttactaatccagcagttctgcgaaaactatgtattgaagctaaaatttcaaacacgaccacagattcacgctgcccaacacaaggagaagcaacattggtcgaagaacaagatgctaactttgtttgtaggagaacgtttgttgatagaggctggggtaatggctgcggtttattcggtaagggatctttgataacatgtgcgaaattcaaatgtgtcactaaattggaaggaaaaatagtacagtatgaaaacttaaagtactcagttatcgtaacagtgcacacaggagaccaacaccaagtaggtaatgagtccacagaacatggtaccaccgctactattacaccacaggcgccgacaaccgaaattcaattaacagattatggcgccctaacacttgattgtagtccgcgaacaggattagacttcaatgagatggtcttgcttacgatgaaagaaaaatcatggctagtgcataagcaatggttccttgacttgcccctaccatggacatcaggagcaagtaccagccaggaaacgtggaacaggcaagatttactggtaaccttcaaaacagcacatgcgaagaaacaagaagttgtagttttaggatcccaagagggagccatgcatacagcgctcacaggggcaacagagatacagacaagtggaactacgacaatatttgctggacacctaaaatgtcggcttaaaatggacaaactaacattaaagggaatgagctacgttatgtgtacaggatcattcaaacttgaaaaggaattggctgaaacacaacatggcacggtcttagtccaaattaaatacgaagggacagacgcgccttgcaaaattccgttcagcacccaggacgagaagggagtcacccagaatggtcgactaataacagcaaacccgattgttaccgataaagaaaaaccagtaaatatagaagcagaacctccatttggtgaaagctatatagtcataggcgcaggagagaaggctcttaaattaagttggtttaagaaaggatcttcaataggaaagatgtttgaagctacagctcgcggtgcaagaagaatggcaatcctcggagatacggcttgggactttggctcaatcggtggagtttttacatcagtggggaaacttgtacaccagatttttggtacagcttacggcgtgttgttcagcggcgtatcttggacaatgaaaataggaattggcgtactgctaacctggttagggttaaattcgagaagcacgagcctttctatgacatgcattgccgtagggctagtgacactttatctcggggttatggtgcaagcagacagtggttgtgtaataaattggaaagggcgggaactaaaatgtggttcaggaatctttgtaacaaatgaagtccacacctggacagaacaatacaaatttcaagcagactctcccaagcgtctatctgcagccattggtaaagcgtgggaagaaggcgtatgtggaatacgcagtgctactaggttagaaaatataatgtggaagcaaatctcgaatgaactaaatcatatactcttagaaaatgacatgaaattcaccgtagtcgttggcgatgtcgcagggattctggctcaggggaaaaagatgattcgaccccaaccaatggaatataaatactcgtggaaatcttggggaaaggctaaaataatcggagcggacgttcaaaatacaacattcatcatagatggaccaaacactcctgagtgccctgacgaccaaagagcttggaatatttgggaagtagaagactacggcttcggtatatttacaaccaacatttggttgaaattaagagacagctatacgcaggtctgcgatcacagacttatgagcgcagcaattaaagatagtaaagcagtgcatgctgatatgggctattggatcgagagcgagaaaaacgaaacgtggaaactcgctcgtgcatcctttatagaagtcaaaacatgcatctggccaaaatctcatacactatggagtaatggagtactcgaaagcgagatgatcataccgaaaatatacggtggcccgatgagtcaacataattataggccaggttatttcacccaaaccgcgggaccatggcatctaggtaaattagaactagactttgatctatgcgaggggacaactgtggtagtagacgaacactgcggaaacagggggccgtctctccgaactactacggtaacggggaaaataatccacgagtggtgttgtagaagttgtaccctaccacccctacgtttccggggagaagatggttgttggtatggtatggaaattaggcccgtaaaagagaaagaggaaaatctagtaaaatctatggtaagcgcaggttcaggagaagttgatagcttttccttaggtttgctctgtatatctattatgatcgaagaagttatgagaagcagatggtcacgaaagatgttaatgactgggacgttagctgtatttttccttttgataatgggtcaattaacttggaacgatctaatacgattatgtataatggtaggggcaaatgcgagtgacaggatgggaatgggtaccacatatctagctctgatggcgactttcaagatgaggccgatgtttgctgtgggattgctgtttcgacgattaacttcgagagaagtcttactattaaccattggactaagtttagtagcatctgtagaattacctaactcgttagaagaactaggagatggactagcaatgggaataatgatactaaagttactcactgacttccaaagccatcaactctgggcgaccctattgagccttacctttattaaaacaacgttttctctacattacgcctggaagacaatggccatggtattatcaatagtatcactatttccactctgtttaagcacaacgtcgcagaaaactacgtggctcccagttcttttaggtagcttaggctgtaagcccttaacaatgtttctcatagcagaaaataaaatatggggtaggcgttcatggccgcttaatgaaggcataatggcagtaggaatcgtatcgatactgctttcatctctactaaagaatgacgttccattagccggtccactcatagccggtggaatgctaatagcatgctatgtgatatcaggatcgtcagccgatttgtcacttgaaaaagccgcagaagtaagttgggaagaagaggcagaacatagtggggcaagtcacaacatcctagtagaggtacaagatgatggcaccatgaaaattaaggacgaagaaagagatgacacactaacaatactactgaaagccaccttactcgcagtttccggcgtatatccgttgtcaataccagccacactatttgtgtggtatttttggcagaagaagaaacaaagatccggagtattatgggacacgcccagcccaccagaagtggaaagggctgttctggatgacggaatttaccgaataatgcaacgggggttgctagggagatcacaagtaggagtaggcgtgtttcaggaaaacgttttccatacaatgtggcacgtaacacgaggtgcagttctgatgtaccaaggaaagagattagagccatcatgggcaagtgtaaagaaggatctaatatcttacggaggcggatggcgtttgcaaggaagctggaatactggcgaggaagttcaagtaatcgccgtggaaccaggcaaaaatcctaagaatgtgcagacagcaccggggaccttcaaaacgccagaaggtgaagttggggccatagctctggatttcaaaccaggaacgtcgggatccccgatagtaaatcgggaaggtaagatcgtcggcctgtatggtaatggggtcgttacgacatctgggacgtatgtatctgccattgcacaggcgaaggcttcacaagaaggacccttacctgaaatagaagatgaagttttccgaaaaagaaatctcacaattatggatcttcatccagggtccggcaaaactaggcgttatttgccagcaattgtgcgtgaagcaataaaacgaaaacttcgtactttaattttagcgccaactcgggtggtagcttccgaaatggcagaagctctaaaagggatgccaataagatatcaaacaacagcagtcaaaagcgaacatacaggaaaagaaatagttgacctcatgtgtcatgcaacattcactatgcgcctgttatcgccagtacgtgtaccaaactacaacatgatcattatggatgaagctcatttcacagatccctcttctatagccgcacggggatatatatcaacccgagttgggatgggcgaagcagcagcaatatttatgacagccacaccgccaggatcagttgaggcttttccccagagcaacgccgtcattcaggacgaagaaagagatatacctgagagatcatggaatagtggttacgaatggataacagactttcctggaaaaactgtgtggttcgtaccgagcattaagagtggcaacgatatagcaaactgtttaaggaaaaatgggaagcgagtaatccaactatcgagaaaaactttcgacacagaatatcagaaaacgaaaaacaatgactgggattacgtagtgactactgatatcagcgagatgggtgctaattttagggcagatcgtgtgatagatccacgaagatgtttaaaacccgtaattttaaaagatgggccagaacgcgttatactggcagggccaatgccggtaactgtagcatctgctgcacaaaggagagggaggattggtagaaaccacaacaaagagggagatcaatacatctacatgggccaacctctaaacaatgacgaagatcacgcccactggacagaagcgaagatgttacttgataacataaacacacctgaaggtataatcccagccttatttgaaccggagcgcgaaaagtcagccgctatagatggcgaatacaggttaagaggagaggctcggaaaacatttgttgaattgatgagaagaggagatttgcctgtttggcttagctacaaggtagctagcgaaggctttcaatactctgaccgccgctggtgctttgatggggaacggaataaccaagtactggaagaaaatatggacgtagagatatggacaaaagaaggggaaaggaagaaactaaggccaaggtggctagatgcacgcacatattctgaccccttagcacttcgagagttcaaagaatttgcagctggaagacgctcagttagcggtgacctaatactagaaataggaaaacttcctcaacatttaactcaaagggcacagaatgcgctagataatttagtcatgttacacaacagtgaacaaggtggcagagcataccgacatgctatggaagagttgcctgatactattgaaaccttaatgttgttggcattaatagctgtgctaactggtggtgtcaccctcttctttttatcaggcagaggcttgggaaagacgtctataggactactctgtgtcatggcaagttccgtactcttatggatggcaagtgttgaaccacactggattgcggcttccatcatattagaatttttcctgatggtattattaatacccgaaccagataggcaaaggactccgcaagataaccaactggcgtacgtagtaataggactcttattcatgattctaacagtggccgccaatgaaatgggattgttagaaactaccaagaaagacctggggataggtcatgtggccgtcgaaaatcatcatcatgcagccatgttagatgtagacctccacccagcctcagcctggacactatatgcagttgcaacaaccataataacaccgatgatgaggcacactatcgaaaacacaacagctaacataagtttgactgcaatcgccaatcaagcagcaattctcatgggtttagataaaggatggcctatatcgaaaatggatattggagtaccgttactagccctcggttgctactcacaagtgaatccactaacactgacagccgctgtgctcatgctggtggcacactatgctataattgggccaggattgcaggcaaaggcaacaagggaggcacaaaagagaactgcggcaggaatcatgaaaaatccgactgtagacggcattgttgcaatagacttggatcctgtagtttatgatgcgaaatttgaaaaacaactaggacaaataatgctattaatcttatgcacttctcaaattcttttaatgagaacaacatgggcattatgtgagagtataacacttgctaccggacctcttacaacgctatgggaaggttccccaggaaaattctggaacactacaatagcggtgtcaatggctaatatatttcggggctcatatctcgctggagcaggactagcatttagtttaatgaaatctcttggaggaggcagaagaggcacaggggcacaaggtgaaactttgggtgaaaagtggaaacgacagttaaatcaactctcaaaaagtgaatttaacacttacaaacgttcgggaattatggaggtagacagaagcgaagcaaaagagggtctaaaacgtggcgaaaccacaaaacatgcggtaagtagaggcacagcaaaattaagatggttcgtagagagaaacttggtaaaaccagagggaaaagtaatagatcttggatgtggaaggggaggatggtcatactattgcgccggactgaaaaaggtaaccgaagtgaaaggatatactaaaggtggaccaggccatgaagaacctataccaatggcgacttatggatggaacttggtaaaattgcatagtggaaaggatgtgttcttcataccaccggagaaatgcgatacacttttgtgcgacattggcgaaagttcacctaacccgacgattgaggaaggtagaacattacgcgtcttgaaaatggtcgaaccatggttacgagggaaccaattctgcataaaaatcttaaatccgtacatgccgagcgtagtcgaaactctcgaacaaatgcaacggaaacatggtggaatgctagtaagaaatcccttaagtagaaacagcacacatgagatgtactgggtttcatgtggaacggggaacatcgtgagtgcagtcaatatgaccagtcgcatgctcttaaatagattcactatggctcatcggaagccgacctatgagagagatgtcgatttaggtgccggtactcgacacgtagcagtcgaacctgaggtagcaaaccttgatataataggacaaagaatagagaatattaagcatgaacacaaatcaacttggcattatgatgaggacaatccttataaaacatgggcatatcacggaagttatgaggtaaagccgtccggaagtgcaagctccatggtgaacggagtagtcaaacttctaactaaaccgtgggacgtaatacctatggtgactcagattgcaatgacagacactacacctttcggacaacagagagtcttcaaagaaaaggttgatacaaggacgccaaaagccaagaggggcactgcgcaaattatggaagtcacagccaaatggctttggggatttctcagcagaaacaagaaaccgcgcatatgcaccagggaagaatttactcgaaaagtacgatctaatgcagctataggtgccgtattcgttgatgaaaatcaatggaatagtgcaaaagaggcagtagaagatgaacggttctgggatttagtacatagggaaagagaattgcacaaacagggtaaatgtgctacatgcgtgtataacatgatggggaaaagagagaagaaactgggtgaatttggaaaagcgaaaggatcacgagcgatttggtacatgtggctaggggcgaggttcttggaatttgaagcccttgggtttatgaacgaagatcattggttcagtcgagaaaactcactgtcaggggtggagggcgaagggcttcacaaattaggatacatattacgcgatatcagtaaaatacctggaggaaatatgtatgcggacgatacagcaggatgggatacacgaattactgaagacgacctgcaaaatgaggcacgaataacggatataatggaaccagaacatgctttattagcaaagtcaatctttaagttgacctaccagaataaagtggtccgagtacaacgcccagcaaagaacggtacggtcatggacgttatatcacgcagagaccaaagaggtagtggccaagttggaacttacggactaaatacgttcacaaatatggaagctcaattgataagacaaatggaatctgaggggatattctcgccaagtgagttggaaacaccaaatttggcaaaacgagtactagactggctagaaaaatatggcgttgaaagattaaaacggatggcaatttcaggcgacgactgtgtagtcaagcccatcgacgatagatttgctacagcactaactgccctcaatgatatgggcaaagtcagaaaggacataccacaatgggagccaagtaaaggttggaacgattggcaacaggtaccgttttgcagtcatcactttcatcagctcatcatgaaggatgggagagaaatagttgtaccctgtaggaatcaggatgaacttgtgggcagagcaagagtttcacaaggagctggttggagtttacgagaaacagcttgtctgggtaagagttatgctcagatgtggcaactcatgtatttccacaggagagatctacgattggcagcaaacgctatatgttccgcagtacctgtggattggataccaactagccgaacgacttggagtatacatgctcatcaccaatggatgaccactgaagatatgttgtccgtctggaatcgggtatggattgaggaaaatccttggatggaagataaaacccatatcagtagttggggagacgttccctacctgggtaaacgtgaagaccaatggtgtgggtcattaatcggtctaacagcaagagctacatgggcaacaaatatacaagttgcaataaaccaagtccgaagacttataggcaacgaaaattatttagattacatgacatctatgaaacgatttaaaaatgagtccgatcctgagggagccttatggtga

SEQ ID NO: 21950 - RNA, 9879 nt, synthetic construct
  misc_feature 1..9879: note = derived and/or modified CDS sequence (opt6) from DENV-1__EU482513__SS-prME
  source 1..9879: mol_type = other RNA
tcagttacaatgctactaatgttaatgccaacagcgctagcctttcatctaactacacgtggtggagaaccccatatgattgtttcgaaacaagaaagaggtaaatcattgctatttaaaacatcggccggagtgaacatgtgcacattaattgcaatggacctaggtgaattatgcgaagataccatgacgtacaaatgtcctaggattacggaaacggaacctgatgatgttgattgctggtgtaatgcgactgatacgtgggtaacatatggtacatgttcgcaaactggagaacatcggagagacaaaaggtcagttgccttagcgccccatgttggattaggccttgaaactagaactgaaacatggatgagctctgaaggggcatggaaacaaatacagcgcgttgaaacatgggcattgagacacccgggcttcacagtaattgctctttttctcgcgcatgcgattggtacaagcattactcaaaaaggaattatttttatattactaatgctagtaacgccgtcaatggctatgcgatgtgtaggcattggttcaagggatttcgtcgaaggcctaagtggagctacatgggtggatgtggtcctagaacatggatcatgtgtaacgacaatggcaaaagacaaaccaacactagatatagaacttcttaaaacggaggtaacgaatccagctgtactgcgaaaactgtgcatagaagcaaaaatttcaaacacgactaccgattctcgatgtccaactcaaggagaagcaactctagtagaagaacaagatgcgaatttcgtatgtagaagaacgttcgtagatagaggttgggggaatgggtgtggtctattcggaaaaggatctttgattacgtgtgcaaaatttaaatgcgtgacaaaactagaaggaaaaattgtacaatatgaaaacctaaaatactcagttatagtaacagtgcacacaggagatcaacatcaagttggtaatgaatccacagaacacggcacaacagcaacaattacaccacaagctcccaccacggaaattcaattaaccgattatggggcattaactcttgattgctcaccacgaaccggactcgattttaatgaaatggtactgttaacaatgaaagagaaaagttggctagtccataaacaatggttcttagatctaccgttaccttggacttcgggggcgtcaacaagtcaagaaacatggaaccggcaagatctccttgtaactttcaaaacagcccatgcgaagaaacaagaagtggttgttttaggatcgcaggaaggtgcaatgcacactgctttaacaggtgccactgaaatacaaacgtcaggcactacaacaatatttgcaggtcacttaaagtgcagattaaaaatggacaaacttactttaaaaggaatgtcatatgtgatgtgtactggaagttttaaacttgaaaaagaattggctgaaactcaacatgggacagtacttgtgcaaataaagtatgaaggcacagatgcaccgtgcaagattccattctcaacacaggatgaaaagggtgttacgcaaaatggtaggttgattaccgcaaaccctattgtgacagacaaagaaaaacccgtcaacattgaagctgaacctccgttcggagagtcttatattgtaatcggcgcgggcgaaaaagcactcaaactttcgtggttcaagaagggatcaagtatcgggaaaatgttcgaagcaacagccagaggagcccgtaggatggccattttaggagacaccgcatgggattttggaagcattggtggagtattcacaagtgtaggaaagctagtacaccaaatttttggaacggcgtatggagttttattctctggagtctcctggacgatgaaaataggaatcggtgtgttacttacgtggttgggcttaaattcacgatccacaagtttatccatgacatgcattgccgtcggcctagtgacactgtacttgggagttatggtacaagcggattcaggatgtgtaatcaactggaaaggtagggaattaaagtgtggaagtggaatatttgtaaccaacgaagttcacacatggacagaacaatataagttccaagcagattcaccaaaaagactatctgccgcaatcggcaaagcgtgggaagagggagtatgcgggattcggtcagctactaggctggagaacataatgtggaaacaaataagtaatgaattaaaccacattttactggagaacgatatgaaatttacagtggtggtgggcgatgtggcaggtatactagcgcagggaaagaaaatgattcgcccacaaccaatggaatataagtactcatggaaatcatggggtaaagcaaaaataattggagctgatgtacagaatactacattcattatagatggtccaaacactccagaatgtccagacgatcagcgcgcttggaatatatgggaagtagaggattacggtttcggtattttcacaaccaacatttggctgaaactacgagattcatacacacaggtatgcgaccatcgtctaatgtctgccgcaataaaggattcaaaagcagtccatgcggacatgggatattggatagaatctgagaaaaatgaaacttggaaattagctagagcaagttttattgaagttaaaacgtgtatttggcctaaaagtcatacattatggtccaatggagttttagagagtgagatgataatcccaaagatatatgggggtccgatatcccaacataactatcgacctggatacttcactcaaacagcgggcccgtggcatttaggtaaattagaactcgattttgatctatgtgaaggtacgacagtagtagtcgacgaacattgcggtaatcgaggtccatcgttaagaacgaccaccgtaacgggcaagataatacatgaatggtgttgtcgttcgtgtacactgccacccctgaggttcagaggtgaagatggttgctggtatggaatggagattaggcctgtcaaagaaaaagaagaaaacctagtgaaatctatggttagtgcaggtagcggagaggtagattcgttctctctaggcttattgtgtattagcattatgatcgaagaagtgatgagatcgagatggtctcgaaaaatgttaatgacggggaccttagcagtattctttttactcataatgggccaactaacatggaatgatttaatacgcctatgtatcatggtaggagcaaatgccagtgacagaatggggatgggtactacatacctcgccctaatggcaactttcaaaatgagacctatgtttgctgtagggttactattcaggagacttacatcaagagaagtccttctcttaacaattggactatcattagtagcaagcgtggagctaccaaattcattagaggaacttggagatggattagcgatgggcataatgattctcaaattacttactgacttccaatcacatcaactatgggccacactactttcacttacatttataaagactactttttcactgcattacgcatggaagacgatggcaatggttcttagtattgtatcgttattcccattatgtctcagcactacgtcacagaaaacgacctggttgcctgtactactaggatccttggggtgcaaaccactgactatgtttctcatagcagaaaataaaatttggggtagacgatcgtggcccttaaacgagggaatcatggcagttggaatagtatcaattctcttgtcatctctactcaaaaatgacgtaccattagcaggccctcttattgcagggggcatgttaatcgcctgctatgtaatctcaggatctagtgccgatttatcattggaaaaagcagcagaggtaagctgggaggaagaagctgaacactcaggtgcatcacataacattctcgtagaagtgcaagatgacggaacaatgaaaatcaaagatgaagaacgtgatgacacactcaccattctacttaaagcaacgctgttagctgtatctggagtatatcccttaagtatacccgcaacgctatttgtatggtacttttggcagaagaagaaacaaagatcgggagttttatgggacacccctagcccacctgaggtcgagagagccgtcctcgacgatggcatatataggataatgcaacgcgggttgttgggccgtagccaagtcggggtaggagtattccaagaaaatgtttttcataccatgtggcatgttacaagaggagcagtactaatgtatcaaggcaagcgtttagaaccatcgtgggccagcgttaagaaagacctgatttcttacggtggtggatggagattacaaggttcatggaatacaggtgaagaagttcaggttatagcagtagaaccgggcaaaaatccaaagaacgtacaaaccgccccgggcacctttaagacaccagaaggagaagtaggtgcaattgcattagacttcaaacccggtacaagtggaagcccaatagtaaatcgcgaaggaaaaatagtggggctatatggtaatggagtagtaacgacaagcggaacctatgttagtgctattgcacaagctaaagcaagtcaagaaggaccactcccagaaattgaagatgaagtatttagaaagaggaacctaactattatggatttgcaccccgggtcgggaaagacaagaagatatctcccagcgatagtccgtgaagccattaaacgcaaattgagaaccttgatactggctccaactagagtagtagcttccgagatggcagaggctctgaaaggtatgcccataaggtaccaaactactgctgtgaaatcagagcatacaggcaaggaaatagtcgacttgatgtgtcatgctacattcacaatgagactattatcaccggttagagttcctaattataatatgattattatggacgaagcccactttactgatccaagtagtattgccgcacggggatacatctcgacaagagtaggcatgggggaagctgccgcaattttcatgacagcaacacctccaggctctgtagaagcatttccacagtctaacgcggtaatacaagatgaagaacgggatattcctgaacgaagctggaatagtggctatgagtggataaccgatttccccggaaaaacagtttggttcgtcccaagcataaaaagcgggaatgatattgctaactgcctgagaaagaatggaaaacgagtaattcaattatcaagaaaaacgtttgatacagaatatcagaaaacgaaaaataatgactgggattacgtagtgacaacagacatttcagagatgggtgcaaactttcgagcagatagagttatagacccaagaagatgtctaaaaccagttattctaaaggacggacccgaaagggtgatcctagccggacctatgccagtaacggttgcaagcgctgcacagcgtcgcggacgaattggtagaaatcataataaagaaggggatcaatatatatatatgggacaacctttaaacaacgatgaggaccacgcacattggaccgaagcgaaaatgctactcgataacataaacacccccgaaggaattattcctgcgctgttcgaacctgagagggagaaaagtgcagcaatagatggggaataccgactgaggggtgaagcaagaaaaacgtttgttgaactaatgagaagaggagatttaccagtatggctttcatataaggtggcgtcagagggtttccaatacagcgatagacgatggtgctttgatggagaaagaaacaaccaagtactagaagaaaacatggatgtagaaatctggaccaaagaaggagagagaaagaaattaaggccgagatggcttgatgcacgtacatatagcgatccgcttgctttaagggagttcaaggaatttgctgccgggagacggtcagtgagtggtgacctgatattagagattggaaagttgcctcagcatctaacacagagagcacaaaatgcactagacaacctagttatgctccacaactccgaacagggcgggagggcgtatagacacgctatggaagaattaccagatacaattgaaacattaatgttattagctcttattgcagtcttaacgggaggcgttacgctattctttctatcgggccgtggactgggtaaaacgtcgatcggattactgtgtgtgatggcttcttcagtgctactgtggatggcgagtgttgagccacattggatagcggctagcataatattagaatttttcctaatggtattactaattcctgagccagaccgccaaagaactccccaggataatcaactcgcatatgttgtgataggtttattatttatgatcttaactgtggccgcaaatgaaatgggtttactagaaaccactaagaaagacctagggatagggcacgtagcagtagaaaaccaccatcatgcagccatgttagacgtagatttacatcctgccagtgcatggaccttgtacgctgtagccacaacaattataacacccatgatgaggcatacaattgaaaacacaacggctaacatatcactaacagcaatagctaatcaagccgctatcctgatgggactagacaaaggatggccgatctccaagatggatataggagtacctttactagctttaggctgctactcacaagtgaatccgctgacattgacagcagcagttctcatgttagttgctcactacgcaattattggacctggcctacaagcaaaggcaacaagagaagctcaaaaacgaacagcggcgggtattatgaagaaccctacagtcgatggcatcgtagctattgacttagaccccgtggtttacgatgccaaatttgaaaaacaactaggacaaatcatgcttctcatactatgtacttcacaaatactactaatgcgaacgacatgggcgctgtgcgaatcaattacattagcaacgggtccattaacaacattatgggaaggttcaccgggtaaattttggaataccacaatcgcagtgtccatggctaacatattcaggggaagctatctagccggtgcaggactggctttcagtctcatgaaatctttgggaggaggtcgccgtggtacaggcgctcaaggggaaacactgggcgagaaatggaagcgacagctaaaccaattgtcaaaatccgagtttaatacatataaaagaagcggtattatggaagttgatcgaagtgaagccaaagagggtcttaagcgaggagaaacaacgaaacacgcggtatcacgcggtacggcaaaattaagatggtttgttgaaaggaatctagttaaaccggaagggaaggtcattgatttgggttgcggtagaggcggatggagttattattgtgctgggcttaaaaaggtcacagaggtaaaagggtatacaaaaggtggacccggacacgaggagccgatcccgatggccacatatggatggaatcttgtaaaattacattcaggaaaagatgtattctttatacctcccgaaaaatgcgacactttactctgtgatataggtgagtcttcaccaaaccctactattgaggaaggacgtacgcttagggtactaaagatggtcgaaccatggttacgtggtaatcagttttgtattaaaattttaaatccatacatgccatcggtcgtagagacgcttgaacaaatgcaacgtaaacacggagggatgctagttcggaacccactttcgagaaactctactcatgaaatgtactgggtatcgtgcggcaccggaaacatagtaagtgcagtgaacatgacgtcacgaatgctgctcaatagatttacgatggcacacaggaagccaacgtacgaacgggatgtagacttaggcgcaggtacaaggcatgtagctgttgaacccgaggtagcaaatttagacattattggtcagagaatagaaaatataaagcacgaacataaatcaacctggcactacgacgaggataacccttacaagacttgggcatatcatgggtcgtatgaagtaaaaccaagcggtagcgcgtctagcatggtaaacggagtagttaaactactaactaaaccttgggatgttataccgatggtgactcaaattgcgatgacagacacaacaccattcggtcaacagcgagtattcaaggaaaaagtagatacaagaactccaaaagctaaaaggggcaccgcacagataatggaggttactgcgaaatggttatggggatttctatcgagaaacaaaaagccccgaatctgtacgagagaagaatttacaaggaaagttaggtcaaacgccgcaataggtgctgtattcgtagatgagaaccaatggaactctgcgaaagaagctgttgaagacgaacgattctgggatttagtgcatagagaaagagaactgcataaacaaggaaagtgtgctacatgtgtatacaacatgatgggcaaaagagagaagaaattgggtgaatttggaaaagcaaaaggtagtagggctatctggtatatgtggctaggggccaggtttttagaatttgaagcgctagggttcatgaacgaggaccattggttttctcgtgaaaactctttatccggagtagaaggggaagggttacataaattaggatatatcctcagagatatatcaaaaatccccggtggtaacatgtatgcagacgatacggcgggatgggacacccgtattacggaggatgacctacaaaatgaagcaagaataaccgacataatggagcctgagcatgcattattagcgaagtcaatcttcaagttgacttaccaaaacaaagtagtaagagtacaacgcccagctaaaaatgggaccgtaatggacgtgatctcacggagagaccagaggggttcgggacaggtgggaacttatggtcttaatacatttacaaatatggaagcacagttaataagacaaatggaaagtgagggaatcttctcaccgtctgaactagaaaccccgaatttagcggagagagtactcgattggctagaaaaatatggtgtcgaacggttgaagagaatggcgatttcaggtgacgactgtgtcgttaaaccaatagatgatagattcgcaacggcgctaaccgccttgaacgatatgggaaaagttcgaaaggatattccacaatgggagccgtctaaggggtggaatgactggcaacaggttccattctgttcgcaccatttccaccaattaattatgaaggatgggcgcgagatcgttgttccgtgcagaaaccaagatgaattagtcggcagagcacgtgtatcacaaggagcgggctggagtctcagagaaacagcatgtttaggtaaaagctacgcgcaaatgtggcaattaatgtattttcatcgaagggatcttcgactggcggcaaacgccatctgttccgctgtgcctgtggactggattccaacaagtagaacaacgtggagtatccatgcgcatcaccaatggatgaccactgaagacatgttgagtgtttggaacagagtatggatagaggaaaatccgtggatggaggataaaacacacatatcgtcgtggggtgatgttccctatttgggcaaacgagaagatcaatggtgcgggagcctcatcggactgacagcccgggcaacgtgggctaccaatatacaagtagcaataaaccaagtaagacgcctaattggaaatgaaaactatctcgattatatgacatcaatgaaaaggtttaaaaatgagtctgatccagagggcgccctttggtaa
